United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 108

SEQ ID NO: 3833541 - RNA, 14 nt, Shigella flexneri 2a str. 2457T
gcaucuccugcaac

SEQ ID NO: 3833542 - RNA, 18 nt, Shigella flexneri 2a str. 2457T
gcaucucgcgcucuucuu

SEQ ID NO: 3833543 - RNA, 12 nt, Shigella flexneri 2a str. 2457T
gcaucugaaacu

SEQ ID NO: 3833544 - RNA, 15 nt, Shigella flexneri 2a str. 2457T
gcaucugaccagaug

SEQ ID NO: 3833545 - RNA, 14 nt, Shigella flexneri 2a str. 2457T
gcaucugauaagcc

SEQ ID NO: 3833546 - RNA, 14 nt, Shigella flexneri 2a str. 2457T
gcaucugccagcca

SEQ ID NO: 3833547 - RNA, 16 nt, Shigella flexneri 2a str. 2457T
gcaucuggaaagucug

SEQ ID NO: 3833548 - RNA, 20 nt, Shigella flexneri 2a str. 2457T
gcaucuggaaagucugaaug

SEQ ID NO: 3833549 - RNA, 20 nt, Shigella flexneri 2a str. 2457T
gcaucuggcauaaacaaagc

SEQ ID NO: 3833550 - RNA, 20 nt, Shigella flexneri 2a str. 2457T
gcaucugguaagugccacac

SEQ ID NO: 3833551 - RNA, 22 nt, Shigella flexneri 2a str. 2457T
gcaucuguuucgaucagcaauu

SEQ ID NO: 3833552 - RNA, 22 nt, Shigella flexneri 2a str. 2457T
gcaucuguuuuccgaugagcga

SEQ ID NO: 3833553 - RNA, 20 nt, Shigella flexneri 2a str. 2457T
gcaucuuauccagcaaccag

SEQ ID NO: 3833554 - RNA, 18 nt, Shigella flexneri 2a str. 2457T
gcaucuucgcccacggcu

SEQ ID NO: 3833555 - RNA, 17 nt, Shigella flexneri 2a str. 2457T
gcaucuucuccacgcca

SEQ ID NO: 3833556 - RNA, 13 nt, Shigella flexneri 2a str. 2457T
gcaucuucuucau

SEQ ID NO: 3833557 - RNA, 16 nt, Shigella flexneri 2a str. 2457T
gcaucuucuucauucc

SEQ ID NO: 3833558 - RNA, 19 nt, Shigella flexneri 2a str. 2457T
gcaucuucuucuaugccag

SEQ ID NO: 3833559 - RNA, 21 nt, Shigella flexneri 2a str. 2457T
gcaucuugauaccaaaauggc

SEQ ID NO: 3833560 - RNA, 15 nt, Shigella flexneri 2a str. 2457T
gcaugaacaaagcgc

SEQ ID NO: 3833561 - RNA, 20 nt, Shigella flexneri 2a str. 2457T
gcaugacuuuguaggccgga

SEQ ID NO: 3833562 - RNA, 14 nt, Shigella flexneri 2a str. 2457T
gcaugauaccgauu

SEQ ID NO: 3833563 - RNA, 21 nt, Shigella flexneri 2a str. 2457T
gcaugauuucgucauccggug

SEQ ID NO: 3833564 - RNA, 20 nt, Shigella flexneri 2a str. 2457T
gcauggacacugccggaaga

SEQ ID NO: 3833565 - RNA, 16 nt, Shigella flexneri 2a str. 2457T
gcauggcaauaaccgc

SEQ ID NO: 3833566 - RNA, 15 nt, Shigella flexneri 2a str. 2457T
gcauggcauuuugca

SEQ ID NO: 3833567 - RNA, 13 nt, Shigella flexneri 2a str. 2457T
gcauggcgcuggc

SEQ ID NO: 3833568 - RNA, 17 nt, Shigella flexneri 2a str. 2457T
gcauggcuggaaugcaa

SEQ ID NO: 3833569 - RNA, 12 nt, Shigella flexneri 2a str. 2457T
gcauggggagac

SEQ ID NO: 3833570 - RNA, 14 nt, Shigella flexneri 2a str. 2457T
gcaugguacccaau

SEQ ID NO: 3833571 - RNA, 20 nt, Shigella flexneri 2a str. 2457T
gcauggucuuguaggccaga

SEQ ID NO: 3833572 - RNA, 21 nt, Shigella flexneri 2a str. 2457T
gcaugguguucagauggccaa

SEQ ID NO: 3833573 - RNA, 18 nt, Shigella flexneri 2a str. 2457T
gcaugguuaacuccuucu

SEQ ID NO: 3833574 - RNA, 21 nt, Shigella flexneri 2a str. 2457T
gcaugucgguuguacaaaaaa

SEQ ID NO: 3833575 - RNA, 12 nt, Shigella flexneri 2a str. 2457T
gcauguguaacc

SEQ ID NO: 3833576 - RNA, 16 nt, Shigella flexneri 2a str. 2457T
gcauguguaaccgcuu

SEQ ID NO: 3833577 - RNA, 13 nt, Shigella flexneri 2a str. 2457T
gcauuaaacgcau

SEQ ID NO: 3833578 - RNA, 19 nt, Shigella flexneri 2a str. 2457T
gcauuaagggugaucagcc

SEQ ID NO: 3833579 - RNA, 14 nt, Shigella flexneri 2a str. 2457T
gcauuaaucugcuc

SEQ ID NO: 3833580 - RNA, 13 nt, Shigella flexneri 2a str. 2457T
gcauuacuacggu

SEQ ID NO: 3833581 - RNA, 21 nt, Shigella flexneri 2a str. 2457T
gcauuacuacgguaauacaac

SEQ ID NO: 3833582 - RNA, 22 nt, Shigella flexneri 2a str. 2457T
gcauuaggugcucaaugccuga

SEQ ID NO: 3833583 - RNA, 14 nt, Shigella flexneri 2a str. 2457T
gcauuauccagcga

SEQ ID NO: 3833584 - RNA, 23 nt, Shigella flexneri 2a str. 2457T
gcauuaugagauugagcgauuua

SEQ ID NO: 3833585 - RNA, 14 nt, Shigella flexneri 2a str. 2457T
gcauuauucaucug

SEQ ID NO: 3833586 - RNA, 20 nt, Shigella flexneri 2a str. 2457T
gcauucacccggggugauaa

SEQ ID NO: 3833587 - RNA, 21 nt, Shigella flexneri 2a str. 2457T
gcauucagacacgccgccaga

SEQ ID NO: 3833588 - RNA, 16 nt, Shigella flexneri 2a str. 2457T
gcauucagaguaucca

SEQ ID NO: 3833589 - RNA, 19 nt, Shigella flexneri 2a str. 2457T
gcauucagcagcagcaaga

SEQ ID NO: 3833590 - RNA, 22 nt, Shigella flexneri 2a str. 2457T
gcauucagugcaaaugccagau

SEQ ID NO: 3833591 - RNA, 17 nt, Shigella flexneri 2a str. 2457T
gcauucccgccagcggc

SEQ ID NO: 3833592 - RNA, 24 nt, Shigella flexneri 2a str. 2457T
gcauucgaguaacguucugucucc

SEQ ID NO: 3833593 - RNA, 12 nt, Shigella flexneri 2a str. 2457T
gcauucucauca

SEQ ID NO: 3833594 - RNA, 16 nt, Shigella flexneri 2a str. 2457T
gcauucuggagcugga

SEQ ID NO: 3833595 - RNA, 19 nt, Shigella flexneri 2a str. 2457T
gcauugaacucuucuuccg

SEQ ID NO: 3833596 - RNA, 20 nt, Shigella flexneri 2a str. 2457T
gcauugaacucuucuuccgg

SEQ ID NO: 3833597 - RNA, 14 nt, Shigella flexneri 2a str. 2457T
gcauugauaauguu

SEQ ID NO: 3833598 - RNA, 14 nt, Shigella flexneri 2a str. 2457T
gcauugcgccugca

SEQ ID NO: 3833599 - RNA, 16 nt, Shigella flexneri 2a str. 2457T
gcauugcgccugcagg

SEQ ID NO: 3833600 - RNA, 15 nt, Shigella flexneri 2a str. 2457T
gcauugcuaaugcug

SEQ ID NO: 3833601 - RNA, 19 nt, Shigella flexneri 2a str. 2457T
gcauugcucacuuccuuuu

SEQ ID NO: 3833602 - RNA, 16 nt, Shigella flexneri 2a str. 2457T
gcauuggguauucauu

SEQ ID NO: 3833603 - RNA, 18 nt, Shigella flexneri 2a str. 2457T
gcauugguugcuggaaag

SEQ ID NO: 3833604 - RNA, 18 nt, Shigella flexneri 2a str. 2457T
gcauuguguugccgggcg

SEQ ID NO: 3833605 - RNA, 22 nt, Shigella flexneri 2a str. 2457T
gcauuuaugccauguucaucaa

SEQ ID NO: 3833606 - RNA, 13 nt, Shigella flexneri 2a str. 2457T
gcauuuccauaaa

SEQ ID NO: 3833607 - RNA, 16 nt, Shigella flexneri 2a str. 2457T
gcauuucccagcaaga

SEQ ID NO: 3833608 - RNA, 18 nt, Shigella flexneri 2a str. 2457T
gaaaaaagcgcucccgca

SEQ ID NO: 3833609 - RNA, 20 nt, Shigella flexneri 2a str. 2457T
gaaaaaaugaccggccagca

SEQ ID NO: 3833610 - RNA, 12 nt, Shigella flexneri 2a str. 2457T
gaaaaacacaaa

SEQ ID NO: 3833611 - RNA, 19 nt, Shigella flexneri 2a str. 2457T
gaaaaaccgaccuucgcgu

SEQ ID NO: 3833612 - RNA, 19 nt, Shigella flexneri 2a str. 2457T
gaaaaaccguguuuaugaa

SEQ ID NO: 3833613 - RNA, 18 nt, Shigella flexneri 2a str. 2457T
gaaaaaccuccggcguuu

SEQ ID NO: 3833614 - RNA, 18 nt, Shigella flexneri 2a str. 2457T
gaaaaacgggucgccaga

SEQ ID NO: 3833615 - RNA, 22 nt, Shigella flexneri 2a str. 2457T
gaaaaacgggucgccagaaggu

SEQ ID NO: 3833616 - RNA, 20 nt, Shigella flexneri 2a str. 2457T
gaaaaacuuaauccugaguu

SEQ ID NO: 3833617 - RNA, 21 nt, Shigella flexneri 2a str. 2457T
gaaaaaguucgacuuaaaucu

SEQ ID NO: 3833618 - RNA, 23 nt, Shigella flexneri 2a str. 2457T
gaaaaauaaaagcgugaaacaaa

SEQ ID NO: 3833619 - RNA, 17 nt, Shigella flexneri 2a str. 2457T
gaaaaaucaaaaaacug

SEQ ID NO: 3833620 - RNA, 20 nt, Shigella flexneri 2a str. 2457T
gaaaaaucgacaaaaucgga

SEQ ID NO: 3833621 - RNA, 17 nt, Shigella flexneri 2a str. 2457T
gaaaaauuuauugaaag

SEQ ID NO: 3833622 - RNA, 22 nt, Shigella flexneri 2a str. 2457T
gaaaaauuuauugaaagcauag

SEQ ID NO: 3833623 - RNA, 12 nt, Shigella flexneri 2a str. 2457T
gaaaacagcgca

SEQ ID NO: 3833624 - RNA, 17 nt, Shigella flexneri 2a str. 2457T
gaaaacagcgcaccaga

SEQ ID NO: 3833625 - RNA, 18 nt, Shigella flexneri 2a str. 2457T
gaaaacagcgcaccagaa

SEQ ID NO: 3833626 - RNA, 14 nt, Shigella flexneri 2a str. 2457T
gaaaaccacuccug

SEQ ID NO: 3833627 - RNA, 11 nt, Shigella flexneri 2a str. 2457T
gaaaaccgcac

SEQ ID NO: 3833628 - RNA, 22 nt, Shigella flexneri 2a str. 2457T
gaaaaccggacugaaaguacuu

SEQ ID NO: 3833629 - RNA, 22 nt, Shigella flexneri 2a str. 2457T
gaaaaccgguacagaaucugaa

SEQ ID NO: 3833630 - RNA, 15 nt, Shigella flexneri 2a str. 2457T
gaaaacgaauacugg

SEQ ID NO: 3833631 - RNA, 14 nt, Shigella flexneri 2a str. 2457T
gaaaacgaauugca

SEQ ID NO: 3833632 - RNA, 20 nt, Shigella flexneri 2a str. 2457T
gaaaacgauguuugcugcga

SEQ ID NO: 3833633 - RNA, 19 nt, Shigella flexneri 2a str. 2457T
gaaaacgcauaccagucua

SEQ ID NO: 3833634 - RNA, 13 nt, Shigella flexneri 2a str. 2457T
gaaaacgcuggca

SEQ ID NO: 3833635 - RNA, 11 nt, Shigella flexneri 2a str. 2457T
gaaaacgcugu

SEQ ID NO: 3833636 - RNA, 20 nt, Shigella flexneri 2a str. 2457T
gaaaacguuucaaacaggcu

SEQ ID NO: 3833637 - RNA, 22 nt, Shigella flexneri 2a str. 2457T
gaaaacuuccggcagaaauaaa

SEQ ID NO: 3833638 - RNA, 17 nt, Shigella flexneri 2a str. 2457T
gaaaagauccguaaugc

SEQ ID NO: 3833639 - RNA, 13 nt, Shigella flexneri 2a str. 2457T
gaaaagccggaau

SEQ ID NO: 3833640 - RNA, 18 nt, Shigella flexneri 2a str. 2457T
gaaaagccggaauguacu

SEQ ID NO: 3833641 - RNA, 22 nt, Shigella flexneri 2a str. 2457T
gaaaagcugcaaggugaaagca

SEQ ID NO: 3833642 - RNA, 19 nt, Shigella flexneri 2a str. 2457T
gaaaaggcguucacgccgc

SEQ ID NO: 3833643 - RNA, 22 nt, Shigella flexneri 2a str. 2457T
gaaaaggcguucacgccgcauc

SEQ ID NO: 3833644 - RNA, 16 nt, Shigella flexneri 2a str. 2457T
gaaaagguagaauaag

SEQ ID NO: 3833645 - RNA, 20 nt, Shigella flexneri 2a str. 2457T
gaaaaggugauuuuugagac

SEQ ID NO: 3833646 - RNA, 21 nt, Shigella flexneri 2a str. 2457T
gaaaagguucgggagcaggcc

SEQ ID NO: 3833647 - RNA, 17 nt, Shigella flexneri 2a str. 2457T
gaaaauaaaucaaaguc

SEQ ID NO: 3833648 - RNA, 23 nt, Shigella flexneri 2a str. 2457T
gaaaauaaccauauaugauaauu

SEQ ID NO: 3833649 - RNA, 16 nt, Shigella flexneri 2a str. 2457T
gaaaauaaucaugcag

SEQ ID NO: 3833650 - RNA, 18 nt, Shigella flexneri 2a str. 2457T
gaaaauaauccgcuguaa

SEQ ID NO: 3833651 - RNA, 19 nt, Shigella flexneri 2a str. 2457T
gaaaauacagcaauggaaa

SEQ ID NO: 3833652 - RNA, 20 nt, Shigella flexneri 2a str. 2457T
gaaaauagacguucuucuuc

SEQ ID NO: 3833653 - RNA, 17 nt, Shigella flexneri 2a str. 2457T
gaaaauaugcccauguu

SEQ ID NO: 3833654 - RNA, 17 nt, Shigella flexneri 2a str. 2457T
gaaaaucacaggcgcga

SEQ ID NO: 3833655 - RNA, 16 nt, Shigella flexneri 2a str. 2457T
gaaaaucaccucauca

SEQ ID NO: 3833656 - RNA, 18 nt, Shigella flexneri 2a str. 2457T
gaaaaucauucgccgguu

SEQ ID NO: 3833657 - RNA, 14 nt, Shigella flexneri 2a str. 2457T
gaaaaucugcggga

SEQ ID NO: 3833658 - RNA, 22 nt, Shigella flexneri 2a str. 2457T
gaaaaugcccgccgugcugcca

SEQ ID NO: 3833659 - RNA, 17 nt, Shigella flexneri 2a str. 2457T
gaaaaugccgcacauca

SEQ ID NO: 3833660 - RNA, 21 nt, Shigella flexneri 2a str. 2457T
gaaaaugccgcacaucaccgc

SEQ ID NO: 3833661 - RNA, 17 nt, Shigella flexneri 2a str. 2457T
gaaaaugccucagagcu

SEQ ID NO: 3833662 - RNA, 22 nt, Shigella flexneri 2a str. 2457T
gaaaauuaacgggcaggucacu

SEQ ID NO: 3833663 - RNA, 16 nt, Shigella flexneri 2a str. 2457T
gaaaauuacgcaacca

SEQ ID NO: 3833664 - RNA, 20 nt, Shigella flexneri 2a str. 2457T
gaaaauugguagaccagagc

SEQ ID NO: 3833665 - RNA, 16 nt, Shigella flexneri 2a str. 2457T
gaaacaaauacaugau

SEQ ID NO: 3833666 - RNA, 23 nt, Shigella flexneri 2a str. 2457T
gaaacaaaucacuauuaaagaaa

SEQ ID NO: 3833667 - RNA, 20 nt, Shigella flexneri 2a str. 2457T
gaaacaacguggaacaaaua

SEQ ID NO: 3833668 - RNA, 16 nt, Shigella flexneri 2a str. 2457T
gaaacacacuuuccag

SEQ ID NO: 3833669 - RNA, 12 nt, Shigella flexneri 2a str. 2457T
gaaacaccagaa

SEQ ID NO: 3833670 - RNA, 19 nt, Shigella flexneri 2a str. 2457T
gaaacagcaccauccgccc

SEQ ID NO: 3833671 - RNA, 14 nt, Shigella flexneri 2a str. 2457T
gaaacaguguauuu

SEQ ID NO: 3833672 - RNA, 18 nt, Shigella flexneri 2a str. 2457T
gaaacaguuguaaaguac

SEQ ID NO: 3833673 - RNA, 19 nt, Shigella flexneri 2a str. 2457T
gaaaccacggugauucccg

SEQ ID NO: 3833674 - RNA, 16 nt, Shigella flexneri 2a str. 2457T
gaaaccacugcaacag

SEQ ID NO: 3833675 - RNA, 19 nt, Shigella flexneri 2a str. 2457T
gaaacccgcugccaucgca

SEQ ID NO: 3833676 - RNA, 19 nt, Shigella flexneri 2a str. 2457T
gaaacccggccacagcgcc

SEQ ID NO: 3833677 - RNA, 14 nt, Shigella flexneri 2a str. 2457T
gaaaccgaaguugu

SEQ ID NO: 3833678 - RNA, 23 nt, Shigella flexneri 2a str. 2457T
gaaaccgacuuacuuauuucugu

SEQ ID NO: 3833679 - RNA, 19 nt, Shigella flexneri 2a str. 2457T
gaaaccgcuauuuacggua

SEQ ID NO: 3833680 - RNA, 23 nt, Shigella flexneri 2a str. 2457T
gaaaccgggcaauuuaaacccua

SEQ ID NO: 3833681 - RNA, 20 nt, Shigella flexneri 2a str. 2457T
gaaaccgucuucccgcagcc

SEQ ID NO: 3833682 - RNA, 14 nt, Shigella flexneri 2a str. 2457T
gaaaccgugcccga

SEQ ID NO: 3833683 - RNA, 18 nt, Shigella flexneri 2a str. 2457T
gaaaccgugcccgauccu

SEQ ID NO: 3833684 - RNA, 19 nt, Shigella flexneri 2a str. 2457T
gaaaccgugcccgauccuu

SEQ ID NO: 3833685 - RNA, 16 nt, Shigella flexneri 2a str. 2457T
gaaaccuuuaugcagc

SEQ ID NO: 3833686 - RNA, 24 nt, Shigella flexneri 2a str. 2457T
gaaacgaaccauaaaaucacaggu

SEQ ID NO: 3833687 - RNA, 16 nt, Shigella flexneri 2a str. 2457T
gaaacgcaccucagca

SEQ ID NO: 3833688 - RNA, 19 nt, Shigella flexneri 2a str. 2457T
gaaacgcaccucagcaagu

SEQ ID NO: 3833689 - RNA, 18 nt, Shigella flexneri 2a str. 2457T
gaaacgcauaccuaccug

SEQ ID NO: 3833690 - RNA, 19 nt, Shigella flexneri 2a str. 2457T
gaaacgccaucucuuuaug

SEQ ID NO: 3833691 - RNA, 15 nt, Shigella flexneri 2a str. 2457T
gaaacgccaucugaa

SEQ ID NO: 3833692 - RNA, 19 nt, Shigella flexneri 2a str. 2457T
gaaacgcgaucgccaaaua

SEQ ID NO: 3833693 - RNA, 21 nt, Shigella flexneri 2a str. 2457T
gaaacgcucauaaauugcagc

SEQ ID NO: 3833694 - RNA, 15 nt, Shigella flexneri 2a str. 2457T
gaaacggcuuccauu

SEQ ID NO: 3833695 - RNA, 24 nt, Shigella flexneri 2a str. 2457T
gaaacgggcgcugagguuaugcaa

SEQ ID NO: 3833696 - RNA, 22 nt, Shigella flexneri 2a str. 2457T
gaaacgguaauuauugaugaag

SEQ ID NO: 3833697 - RNA, 14 nt, Shigella flexneri 2a str. 2457T
gaaacguaacguac

SEQ ID NO: 3833698 - RNA, 21 nt, Shigella flexneri 2a str. 2457T
gaaacuaucaggcaaaaaaau

SEQ ID NO: 3833699 - RNA, 23 nt, Shigella flexneri 2a str. 2457T
gaaacucacgcagggugugcucc

SEQ ID NO: 3833700 - RNA, 17 nt, Shigella flexneri 2a str. 2457T
gaaacucacgccagcag

SEQ ID NO: 3833701 - RNA, 21 nt, Shigella flexneri 2a str. 2457T
gaaacucgcguaaauccagcg

SEQ ID NO: 3833702 - RNA, 13 nt, Shigella flexneri 2a str. 2457T
gaaacugccggaa

SEQ ID NO: 3833703 - RNA, 14 nt, Shigella flexneri 2a str. 2457T
gaaacugccggaag

SEQ ID NO: 3833704 - RNA, 21 nt, Shigella flexneri 2a str. 2457T
gaaacugucaauaaacgccug

SEQ ID NO: 3833705 - RNA, 24 nt, Shigella flexneri 2a str. 2457T
gaaacugucaauaaacgccugcuu

SEQ ID NO: 3833706 - RNA, 19 nt, Shigella flexneri 2a str. 2457T
gaaacuuauucaaucucuu

SEQ ID NO: 3833707 - RNA, 12 nt, Shigella flexneri 2a str. 2457T
gaaacuuguaac

SEQ ID NO: 3833708 - RNA, 16 nt, Shigella flexneri 2a str. 2457T
gaaagaggcgcagaug

SEQ ID NO: 3833709 - RNA, 19 nt, Shigella flexneri 2a str. 2457T
gaaagauaccgccgccaug

SEQ ID NO: 3833710 - RNA, 18 nt, Shigella flexneri 2a str. 2457T
gaaagaucgccacugcug

SEQ ID NO: 3833711 - RNA, 16 nt, Shigella flexneri 2a str. 2457T
gaaagcaccugcgcag

SEQ ID NO: 3833712 - RNA, 23 nt, Shigella flexneri 2a str. 2457T
gaaagcagcauguagaugccggu

SEQ ID NO: 3833713 - RNA, 17 nt, Shigella flexneri 2a str. 2457T
gaaagcagggcggcagg

SEQ ID NO: 3833714 - RNA, 15 nt, Shigella flexneri 2a str. 2457T
gaaagccccaccagc

SEQ ID NO: 3833715 - RNA, 16 nt, Shigella flexneri 2a str. 2457T
gaaagccccaccagca

SEQ ID NO: 3833716 - RNA, 20 nt, Shigella flexneri 2a str. 2457T
gaaagccccaccagcaaaua

SEQ ID NO: 3833717 - RNA, 14 nt, Shigella flexneri 2a str. 2457T
gaaagccgacugca

SEQ ID NO: 3833718 - RNA, 15 nt, Shigella flexneri 2a str. 2457T
gaaagcgagcaguac

SEQ ID NO: 3833719 - RNA, 18 nt, Shigella flexneri 2a str. 2457T
gaaagcgagcaguacagc

SEQ ID NO: 3833720 - RNA, 16 nt, Shigella flexneri 2a str. 2457T
gaaagcgaucuuucug

SEQ ID NO: 3833721 - RNA, 15 nt, Shigella flexneri 2a str. 2457T
gaaagcgaugcugau

SEQ ID NO: 3833722 - RNA, 14 nt, Shigella flexneri 2a str. 2457T
gaaagcgccagcaa

SEQ ID NO: 3833723 - RNA, 21 nt, Shigella flexneri 2a str. 2457T
gaaagcgccaucaaugugcug

SEQ ID NO: 3833724 - RNA, 17 nt, Shigella flexneri 2a str. 2457T
gaaagcgccucaagcuc

SEQ ID NO: 3833725 - RNA, 20 nt, Shigella flexneri 2a str. 2457T
gaaagcggaucaguuccagc

SEQ ID NO: 3833726 - RNA, 19 nt, Shigella flexneri 2a str. 2457T
gaaagcgggugaaggugcc

SEQ ID NO: 3833727 - RNA, 23 nt, Shigella flexneri 2a str. 2457T
gaaagcguuuaugcgcauugcca

SEQ ID NO: 3833728 - RNA, 12 nt, Shigella flexneri 2a str. 2457T
gaaaggcgcggu

SEQ ID NO: 3833729 - RNA, 19 nt, Shigella flexneri 2a str. 2457T
gaaaguaaaaaagaaggaa

SEQ ID NO: 3833730 - RNA, 15 nt, Shigella flexneri 2a str. 2457T
gaaaguaaaccacca

SEQ ID NO: 3833731 - RNA, 13 nt, Shigella flexneri 2a str. 2457T
gaaaguaaauuua

SEQ ID NO: 3833732 - RNA, 15 nt, Shigella flexneri 2a str. 2457T
gaaaguaacaccauc

SEQ ID NO: 3833733 - RNA, 20 nt, Shigella flexneri 2a str. 2457T
gaaaguaaucuauauuucug

SEQ ID NO: 3833734 - RNA, 17 nt, Shigella flexneri 2a str. 2457T
gaaaguaauuacacccu

SEQ ID NO: 3833735 - RNA, 17 nt, Shigella flexneri 2a str. 2457T
gaaaguauuugacuguu

SEQ ID NO: 3833736 - RNA, 20 nt, Shigella flexneri 2a str. 2457T
gaaaguauuugacuguucua

SEQ ID NO: 3833737 - RNA, 15 nt, Shigella flexneri 2a str. 2457T
gaaagucauggcaaa

SEQ ID NO: 3833738 - RNA, 20 nt, Shigella flexneri 2a str. 2457T
gaaaguggaaaaauaacaaa

SEQ ID NO: 3833739 - RNA, 20 nt, Shigella flexneri 2a str. 2457T
gaaauaaaaaaaguauuuuu

SEQ ID NO: 3833740 - RNA, 21 nt, Shigella flexneri 2a str. 2457T
gaaauaacaucccuuaacacu

SEQ ID NO: 3833741 - RNA, 12 nt, Shigella flexneri 2a str. 2457T
gaaauaaucacc

SEQ ID NO: 3833742 - RNA, 21 nt, Shigella flexneri 2a str. 2457T
gaaauaaucgggaauacagaa

SEQ ID NO: 3833743 - RNA, 14 nt, Shigella flexneri 2a str. 2457T
gaaauaccagguug

SEQ ID NO: 3833744 - RNA, 18 nt, Shigella flexneri 2a str. 2457T
gaaauagagaaaguaaac

SEQ ID NO: 3833745 - RNA, 23 nt, Shigella flexneri 2a str. 2457T
gaaauaguugcauuccaguccac

SEQ ID NO: 3833746 - RNA, 12 nt, Shigella flexneri 2a str. 2457T
gaaauauauccu

SEQ ID NO: 3833747 - RNA, 21 nt, Shigella flexneri 2a str. 2457T
gaaauauggcgcugcggcgga

SEQ ID NO: 3833748 - RNA, 12 nt, Shigella flexneri 2a str. 2457T
gaaaucaaguua

SEQ ID NO: 3833749 - RNA, 12 nt, Shigella flexneri 2a str. 2457T
gaaaucaccacc

SEQ ID NO: 3833750 - RNA, 19 nt, Shigella flexneri 2a str. 2457T
gaaaucaccaccagcaccg

SEQ ID NO: 3833751 - RNA, 20 nt, Shigella flexneri 2a str. 2457T
gaaaucaccaccagcaccgc

SEQ ID NO: 3833752 - RNA, 21 nt, Shigella flexneri 2a str. 2457T
gaaaucaccaccagcaccgcg

SEQ ID NO: 3833753 - RNA, 15 nt, Shigella flexneri 2a str. 2457T
gaaaucaccaccgca

SEQ ID NO: 3833754 - RNA, 21 nt, Shigella flexneri 2a str. 2457T
gaaaucagaaggguuggugaa

SEQ ID NO: 3833755 - RNA, 22 nt, Shigella flexneri 2a str. 2457T
gaaaucagagauuugcuccagc

SEQ ID NO: 3833756 - RNA, 18 nt, Shigella flexneri 2a str. 2457T
gaaaucagcuuuggugaa

SEQ ID NO: 3833757 - RNA, 16 nt, Shigella flexneri 2a str. 2457T
gaaaucauccagcacg

SEQ ID NO: 3833758 - RNA, 17 nt, Shigella flexneri 2a str. 2457T
gaaauccucaaccggug

SEQ ID NO: 3833759 - RNA, 21 nt, Shigella flexneri 2a str. 2457T
gaaauccugccgcaguuucug

SEQ ID NO: 3833760 - RNA, 14 nt, Shigella flexneri 2a str. 2457T
gaaaucgaucauca

SEQ ID NO: 3833761 - RNA, 21 nt, Shigella flexneri 2a str. 2457T
gaaaucguuugcauccagcuc

SEQ ID NO: 3833762 - RNA, 21 nt, Shigella flexneri 2a str. 2457T
gaaaucuacgguggaacauuu

SEQ ID NO: 3833763 - RNA, 17 nt, Shigella flexneri 2a str. 2457T
gaaaugaaaaaauagaa

SEQ ID NO: 3833764 - RNA, 17 nt, Shigella flexneri 2a str. 2457T
gaaaugaaaaucaccau

SEQ ID NO: 3833765 - RNA, 19 nt, Shigella flexneri 2a str. 2457T
gaaaugcagcguuuccagc

SEQ ID NO: 3833766 - RNA, 15 nt, Shigella flexneri 2a str. 2457T
gaaaugccaguaacu

SEQ ID NO: 3833767 - RNA, 19 nt, Shigella flexneri 2a str. 2457T
gaaauggcccaaaaggcag

SEQ ID NO: 3833768 - RNA, 15 nt, Shigella flexneri 2a str. 2457T
gaaaugguaaagaag

SEQ ID NO: 3833769 - RNA, 21 nt, Shigella flexneri 2a str. 2457T
gaaauggugugcaugguguuc

SEQ ID NO: 3833770 - RNA, 22 nt, Shigella flexneri 2a str. 2457T
gaaauuaaacugucgucgcuuu

SEQ ID NO: 3833771 - RNA, 16 nt, Shigella flexneri 2a str. 2457T
gaaauuaacgucacca

SEQ ID NO: 3833772 - RNA, 19 nt, Shigella flexneri 2a str. 2457T
gaaauuaacgucaccaucc

SEQ ID NO: 3833773 - RNA, 22 nt, Shigella flexneri 2a str. 2457T
gaaauuaccgcaccaccagcag

SEQ ID NO: 3833774 - RNA, 20 nt, Shigella flexneri 2a str. 2457T
gaaauuacgauguguggcau

SEQ ID NO: 3833775 - RNA, 12 nt, Shigella flexneri 2a str. 2457T
gaaauuauuucu

SEQ ID NO: 3833776 - RNA, 14 nt, Shigella flexneri 2a str. 2457T
gaaauucagcgucg

SEQ ID NO: 3833777 - RNA, 15 nt, Shigella flexneri 2a str. 2457T
gaaauuccagcggca

SEQ ID NO: 3833778 - RNA, 21 nt, Shigella flexneri 2a str. 2457T
gaaauucgcuucaucgcacga

SEQ ID NO: 3833779 - RNA, 18 nt, Shigella flexneri 2a str. 2457T
gaaauugaaaaaccagac

SEQ ID NO: 3833780 - RNA, 12 nt, Shigella flexneri 2a str. 2457T
gaaauugcacug

SEQ ID NO: 3833781 - RNA, 23 nt, Shigella flexneri 2a str. 2457T
gaaauugccacgccaauguguuu

SEQ ID NO: 3833782 - RNA, 21 nt, Shigella flexneri 2a str. 2457T
gaaauuguaaacgaguuaagc

SEQ ID NO: 3833783 - RNA, 20 nt, Shigella flexneri 2a str. 2457T
gaaauuuugcugauauuuau

SEQ ID NO: 3833784 - RNA, 13 nt, Shigella flexneri 2a str. 2457T
gaacaaaaaagag

SEQ ID NO: 3833785 - RNA, 16 nt, Shigella flexneri 2a str. 2457T
gaacaaauaaauagau

SEQ ID NO: 3833786 - RNA, 17 nt, Shigella flexneri 2a str. 2457T
gaacaacagaucaacau

SEQ ID NO: 3833787 - RNA, 12 nt, Shigella flexneri 2a str. 2457T
gaacaaccagaa

SEQ ID NO: 3833788 - RNA, 21 nt, Shigella flexneri 2a str. 2457T
gaacaacgcgcgucugauauu

SEQ ID NO: 3833789 - RNA, 18 nt, Shigella flexneri 2a str. 2457T
gaacaacguaucuugcgu

SEQ ID NO: 3833790 - RNA, 16 nt, Shigella flexneri 2a str. 2457T
gaacaagugccacgca

SEQ ID NO: 3833791 - RNA, 16 nt, Shigella flexneri 2a str. 2457T
gaacaaucacccccac

SEQ ID NO: 3833792 - RNA, 15 nt, Shigella flexneri 2a str. 2457T
gaacaauuaacccgc

SEQ ID NO: 3833793 - RNA, 13 nt, Shigella flexneri 2a str. 2457T
gaacacagugguu

SEQ ID NO: 3833794 - RNA, 20 nt, Shigella flexneri 2a str. 2457T
gaacacagugguuuuaacga

SEQ ID NO: 3833795 - RNA, 15 nt, Shigella flexneri 2a str. 2457T
gaacaccaccugcca

SEQ ID NO: 3833796 - RNA, 13 nt, Shigella flexneri 2a str. 2457T
gaacaccauaaug

SEQ ID NO: 3833797 - RNA, 22 nt, Shigella flexneri 2a str. 2457T
gaacacccgacgugcagcaucg

SEQ ID NO: 3833798 - RNA, 13 nt, Shigella flexneri 2a str. 2457T
gaacacgaucuca

SEQ ID NO: 3833799 - RNA, 15 nt, Shigella flexneri 2a str. 2457T
gaacacgaucucacg

SEQ ID NO: 3833800 - RNA, 20 nt, Shigella flexneri 2a str. 2457T
gaacacgcucccagcagaga

SEQ ID NO: 3833801 - RNA, 15 nt, Shigella flexneri 2a str. 2457T
gaacacgguaaugac

SEQ ID NO: 3833802 - RNA, 23 nt, Shigella flexneri 2a str. 2457T
gaacacgguaguuaaacuuucau

SEQ ID NO: 3833803 - RNA, 15 nt, Shigella flexneri 2a str. 2457T
gaacacucuuccagu

SEQ ID NO: 3833804 - RNA, 24 nt, Shigella flexneri 2a str. 2457T
gaacacucuuccagucgccugcuu

SEQ ID NO: 3833805 - RNA, 22 nt, Shigella flexneri 2a str. 2457T
gaacacuucuucugucgggcau

SEQ ID NO: 3833806 - RNA, 14 nt, Shigella flexneri 2a str. 2457T
gaacagaacuggcg

SEQ ID NO: 3833807 - RNA, 18 nt, Shigella flexneri 2a str. 2457T
gaacagaauguuugccau

SEQ ID NO: 3833808 - RNA, 14 nt, Shigella flexneri 2a str. 2457T
gaacagaccaguaa

SEQ ID NO: 3833809 - RNA, 15 nt, Shigella flexneri 2a str. 2457T
gaacagcacaucagc

SEQ ID NO: 3833810 - RNA, 18 nt, Shigella flexneri 2a str. 2457T
gaacagcacaucagccag

SEQ ID NO: 3833811 - RNA, 21 nt, Shigella flexneri 2a str. 2457T
gaacagccacuggugagcggu

SEQ ID NO: 3833812 - RNA, 20 nt, Shigella flexneri 2a str. 2457T
gaacagccugugccugagcc

SEQ ID NO: 3833813 - RNA, 17 nt, Shigella flexneri 2a str. 2457T
gaacagcgccagacaaa

SEQ ID NO: 3833814 - RNA, 20 nt, Shigella flexneri 2a str. 2457T
gaacagcgccagacaaacca

SEQ ID NO: 3833815 - RNA, 17 nt, Shigella flexneri 2a str. 2457T
gaacaggugcuuacguu

SEQ ID NO: 3833816 - RNA, 14 nt, Shigella flexneri 2a str. 2457T
gaacaguaaagcgc

SEQ ID NO: 3833817 - RNA, 15 nt, Shigella flexneri 2a str. 2457T
gaacaguaaagcgca

SEQ ID NO: 3833818 - RNA, 15 nt, Shigella flexneri 2a str. 2457T
gaacauacacaagcc

SEQ ID NO: 3833819 - RNA, 17 nt, Shigella flexneri 2a str. 2457T
gaacaucaauccaaaca

SEQ ID NO: 3833820 - RNA, 15 nt, Shigella flexneri 2a str. 2457T
gaacaucacugcaaa

SEQ ID NO: 3833821 - RNA, 14 nt, Shigella flexneri 2a str. 2457T
gaacaucauucccg

SEQ ID NO: 3833822 - RNA, 20 nt, Shigella flexneri 2a str. 2457T
gaacaucccgguaauaaugc

SEQ ID NO: 3833823 - RNA, 16 nt, Shigella flexneri 2a str. 2457T
gaacauccuuuccuua

SEQ ID NO: 3833824 - RNA, 14 nt, Shigella flexneri 2a str. 2457T
gaacaucgcaggga

SEQ ID NO: 3833825 - RNA, 12 nt, Shigella flexneri 2a str. 2457T
gaacaucgccau

SEQ ID NO: 3833826 - RNA, 18 nt, Shigella flexneri 2a str. 2457T
gaacaucgccugccgcag

SEQ ID NO: 3833827 - RNA, 16 nt, Shigella flexneri 2a str. 2457T
gaacaucucuucccau

SEQ ID NO: 3833828 - RNA, 12 nt, Shigella flexneri 2a str. 2457T
gaacaucugccc

SEQ ID NO: 3833829 - RNA, 15 nt, Shigella flexneri 2a str. 2457T
gaacauuacuuuccg

SEQ ID NO: 3833830 - RNA, 16 nt, Shigella flexneri 2a str. 2457T
gaacauuacuuuccgu

SEQ ID NO: 3833831 - RNA, 13 nt, Shigella flexneri 2a str. 2457T
gaacauuggauua

SEQ ID NO: 3833832 - RNA, 18 nt, Shigella flexneri 2a str. 2457T
gaacauuuucuucugcca

SEQ ID NO: 3833833 - RNA, 18 nt, Shigella flexneri 2a str. 2457T
gaaccaaacagcgccaga

SEQ ID NO: 3833834 - RNA, 17 nt, Shigella flexneri 2a str. 2457T
gaaccaaagaaaucagu

SEQ ID NO: 3833835 - RNA, 21 nt, Shigella flexneri 2a str. 2457T
gaaccacggaaaggcaguuca

SEQ ID NO: 3833836 - RNA, 21 nt, Shigella flexneri 2a str. 2457T
gaaccacggaauaaccagcga

SEQ ID NO: 3833837 - RNA, 22 nt, Shigella flexneri 2a str. 2457T
gaaccacggaauaaccagcgaa

SEQ ID NO: 3833838 - RNA, 12 nt, Shigella flexneri 2a str. 2457T
gaaccagcugcc

SEQ ID NO: 3833839 - RNA, 21 nt, Shigella flexneri 2a str. 2457T
gaaccagggaaaaaagccccg

SEQ ID NO: 3833840 - RNA, 16 nt, Shigella flexneri 2a str. 2457T
gaaccagugaauacug

SEQ ID NO: 3833841 - RNA, 14 nt, Shigella flexneri 2a str. 2457T
gaaccagugcucca

SEQ ID NO: 3833842 - RNA, 18 nt, Shigella flexneri 2a str. 2457T
gaaccagugcuccaccuu

SEQ ID NO: 3833843 - RNA, 16 nt, Shigella flexneri 2a str. 2457T
gaaccauaaaaucaca

SEQ ID NO: 3833844 - RNA, 13 nt, Shigella flexneri 2a str. 2457T
gaaccaucaccuc

SEQ ID NO: 3833845 - RNA, 21 nt, Shigella flexneri 2a str. 2457T
gaaccaucgagaaucagcgag

SEQ ID NO: 3833846 - RNA, 13 nt, Shigella flexneri 2a str. 2457T
gaaccaugcaauu

SEQ ID NO: 3833847 - RNA, 23 nt, Shigella flexneri 2a str. 2457T
gaaccaugcaauuaccgccacca

SEQ ID NO: 3833848 - RNA, 17 nt, Shigella flexneri 2a str. 2457T
gaacccguuggcacagg

SEQ ID NO: 3833849 - RNA, 17 nt, Shigella flexneri 2a str. 2457T
gaacccuaccagcugcc

SEQ ID NO: 3833850 - RNA, 21 nt, Shigella flexneri 2a str. 2457T
gaacccuuacgucccgacccc

SEQ ID NO: 3833851 - RNA, 15 nt, Shigella flexneri 2a str. 2457T
gaaccgccccacccc

SEQ ID NO: 3833852 - RNA, 15 nt, Shigella flexneri 2a str. 2457T
gaaccgccuggcgcu

SEQ ID NO: 3833853 - RNA, 23 nt, Shigella flexneri 2a str. 2457T
gaaccgcuguugucugaaugaua

SEQ ID NO: 3833854 - RNA, 15 nt, Shigella flexneri 2a str. 2457T
gaaccggaccagcaa

SEQ ID NO: 3833855 - RNA, 16 nt, Shigella flexneri 2a str. 2457T
gaaccggcuggccgua

SEQ ID NO: 3833856 - RNA, 15 nt, Shigella flexneri 2a str. 2457T
gaaccguaaaagccu

SEQ ID NO: 3833857 - RNA, 23 nt, Shigella flexneri 2a str. 2457T
gaaccucacagaggucuuuucuc

SEQ ID NO: 3833858 - RNA, 18 nt, Shigella flexneri 2a str. 2457T
gaaccugaacgccggguu

SEQ ID NO: 3833859 - RNA, 23 nt, Shigella flexneri 2a str. 2457T
gaaccugaacucgccgcacaggc

SEQ ID NO: 3833860 - RNA, 19 nt, Shigella flexneri 2a str. 2457T
gaaccugugacagcagcgg

SEQ ID NO: 3833861 - RNA, 16 nt, Shigella flexneri 2a str. 2457T
gaaccuguucaacaau

SEQ ID NO: 3833862 - RNA, 15 nt, Shigella flexneri 2a str. 2457T
gaaccuguuuucacc

SEQ ID NO: 3833863 - RNA, 18 nt, Shigella flexneri 2a str. 2457T
gaaccuuuaucacuguga

SEQ ID NO: 3833864 - RNA, 20 nt, Shigella flexneri 2a str. 2457T
gaacgacgugguaaaagccg

SEQ ID NO: 3833865 - RNA, 13 nt, Shigella flexneri 2a str. 2457T
gaacgagaaaagc

SEQ ID NO: 3833866 - RNA, 17 nt, Shigella flexneri 2a str. 2457T
gaacgaucccagcgugg

SEQ ID NO: 3833867 - RNA, 19 nt, Shigella flexneri 2a str. 2457T
gaacgauuuuagcaaacug

SEQ ID NO: 3833868 - RNA, 20 nt, Shigella flexneri 2a str. 2457T
gaacgcaccgaccaucggca

SEQ ID NO: 3833869 - RNA, 20 nt, Shigella flexneri 2a str. 2457T
gaacgcacuauacaaccaga

SEQ ID NO: 3833870 - RNA, 20 nt, Shigella flexneri 2a str. 2457T
gaacgcauugccacgccgua

SEQ ID NO: 3833871 - RNA, 13 nt, Shigella flexneri 2a str. 2457T
gaacgccaguuca

SEQ ID NO: 3833872 - RNA, 16 nt, Shigella flexneri 2a str. 2457T
gaacgccauaaaaguc

SEQ ID NO: 3833873 - RNA, 14 nt, Shigella flexneri 2a str. 2457T
gaacgcccacggcg

SEQ ID NO: 3833874 - RNA, 22 nt, Shigella flexneri 2a str. 2457T
gaacgcccacggcguggcauca

SEQ ID NO: 3833875 - RNA, 21 nt, Shigella flexneri 2a str. 2457T
gaacgccgaauaacgcgcagc

SEQ ID NO: 3833876 - RNA, 14 nt, Shigella flexneri 2a str. 2457T
gaacgccugugucc

SEQ ID NO: 3833877 - RNA, 20 nt, Shigella flexneri 2a str. 2457T
gaacgccuguguccuguuga

SEQ ID NO: 3833878 - RNA, 16 nt, Shigella flexneri 2a str. 2457T
gaacgccuuaucuggc

SEQ ID NO: 3833879 - RNA, 16 nt, Shigella flexneri 2a str. 2457T
gaacgcguucacugcc

SEQ ID NO: 3833880 - RNA, 18 nt, Shigella flexneri 2a str. 2457T
gaacgcguucacugccgu

SEQ ID NO: 3833881 - RNA, 15 nt, Shigella flexneri 2a str. 2457T
gaacggcggcggcgc

SEQ ID NO: 3833882 - RNA, 18 nt, Shigella flexneri 2a str. 2457T
gaacggcuguugaugucc

SEQ ID NO: 3833883 - RNA, 20 nt, Shigella flexneri 2a str. 2457T
gaacgggagaaacccggcca

SEQ ID NO: 3833884 - RNA, 12 nt, Shigella flexneri 2a str. 2457T
gaacgggccauc

SEQ ID NO: 3833885 - RNA, 16 nt, Shigella flexneri 2a str. 2457T
gaacgggugauuaaag

SEQ ID NO: 3833886 - RNA, 20 nt, Shigella flexneri 2a str. 2457T
gaacgguaacaggaagcagc

SEQ ID NO: 3833887 - RNA, 23 nt, Shigella flexneri 2a str. 2457T
gaacggugaaaacccuauuuuug

SEQ ID NO: 3833888 - RNA, 16 nt, Shigella flexneri 2a str. 2457T
gaacgugcaaaaucaa

SEQ ID NO: 3833889 - RNA, 17 nt, Shigella flexneri 2a str. 2457T
gaacgugcaaaaucaaa

SEQ ID NO: 3833890 - RNA, 17 nt, Shigella flexneri 2a str. 2457T
gaacgugcucugcgccg

SEQ ID NO: 3833891 - RNA, 22 nt, Shigella flexneri 2a str. 2457T
gaacgugcucugcgccgccuuc

SEQ ID NO: 3833892 - RNA, 16 nt, Shigella flexneri 2a str. 2457T
gaacguguaggccuga

SEQ ID NO: 3833893 - RNA, 19 nt, Shigella flexneri 2a str. 2457T
gaacuaccgugcuguacag

SEQ ID NO: 3833894 - RNA, 15 nt, Shigella flexneri 2a str. 2457T
gaacuacguuccaug

SEQ ID NO: 3833895 - RNA, 18 nt, Shigella flexneri 2a str. 2457T
gaacucaacgccuucuuc

SEQ ID NO: 3833896 - RNA, 14 nt, Shigella flexneri 2a str. 2457T
gaacucacagggcu

SEQ ID NO: 3833897 - RNA, 15 nt, Shigella flexneri 2a str. 2457T
gaacucaggcugcca

SEQ ID NO: 3833898 - RNA, 15 nt, Shigella flexneri 2a str. 2457T
gaacuccugaaagcg

SEQ ID NO: 3833899 - RNA, 14 nt, Shigella flexneri 2a str. 2457T
gaacucgagaacac

SEQ ID NO: 3833900 - RNA, 17 nt, Shigella flexneri 2a str. 2457T
gaacucgagaacacggu

SEQ ID NO: 3833901 - RNA, 17 nt, Shigella flexneri 2a str. 2457T
gaacucgcugcgcggca

SEQ ID NO: 3833902 - RNA, 20 nt, Shigella flexneri 2a str. 2457T
gaacucgcugcgcggcagcu

SEQ ID NO: 3833903 - RNA, 22 nt, Shigella flexneri 2a str. 2457T
gaacucggugaccgaucgcccg

SEQ ID NO: 3833904 - RNA, 23 nt, Shigella flexneri 2a str. 2457T
gaacucguucagcgcauuccagu

SEQ ID NO: 3833905 - RNA, 22 nt, Shigella flexneri 2a str. 2457T
gaacucuuucaaaccguagucc

SEQ ID NO: 3833906 - RNA, 13 nt, Shigella flexneri 2a str. 2457T
gaacugaaaggcg

SEQ ID NO: 3833907 - RNA, 18 nt, Shigella flexneri 2a str. 2457T
gaacugaacaaaaaagag

SEQ ID NO: 3833908 - RNA, 14 nt, Shigella flexneri 2a str. 2457T
gaacugacagccaa

SEQ ID NO: 3833909 - RNA, 17 nt, Shigella flexneri 2a str. 2457T
gaacugacugaaugcca

SEQ ID NO: 3833910 - RNA, 15 nt, Shigella flexneri 2a str. 2457T
gaacugcaacucacc

SEQ ID NO: 3833911 - RNA, 16 nt, Shigella flexneri 2a str. 2457T
gaacugcauugucgga

SEQ ID NO: 3833912 - RNA, 19 nt, Shigella flexneri 2a str. 2457T
gaacuggcaacaauggcau

SEQ ID NO: 3833913 - RNA, 14 nt, Shigella flexneri 2a str. 2457T
gaacuggcaggaaa

SEQ ID NO: 3833914 - RNA, 16 nt, Shigella flexneri 2a str. 2457T
gaacuggcguguuuca

SEQ ID NO: 3833915 - RNA, 19 nt, Shigella flexneri 2a str. 2457T
gaacuggcguguuucauua

SEQ ID NO: 3833916 - RNA, 15 nt, Shigella flexneri 2a str. 2457T
gaacuggcugccagc

SEQ ID NO: 3833917 - RNA, 18 nt, Shigella flexneri 2a str. 2457T
gaacugggccugcauauc

SEQ ID NO: 3833918 - RNA, 12 nt, Shigella flexneri 2a str. 2457T
gaacuggucugc

SEQ ID NO: 3833919 - RNA, 23 nt, Shigella flexneri 2a str. 2457T
gaacuguggcgcgaagcccucaa

SEQ ID NO: 3833920 - RNA, 20 nt, Shigella flexneri 2a str. 2457T
gaacuucauaugcgccagac

SEQ ID NO: 3833921 - RNA, 12 nt, Shigella flexneri 2a str. 2457T
gaacuucgccac

SEQ ID NO: 3833922 - RNA, 22 nt, Shigella flexneri 2a str. 2457T
gaacuucgccauuuucugccgc

SEQ ID NO: 3833923 - RNA, 21 nt, Shigella flexneri 2a str. 2457T
gaacuugacgaucugcuacag

SEQ ID NO: 3833924 - RNA, 23 nt, Shigella flexneri 2a str. 2457T
gaacuugacgaucugcuacaggc

SEQ ID NO: 3833925 - RNA, 14 nt, Shigella flexneri 2a str. 2457T
gaagaaaaauauaa

SEQ ID NO: 3833926 - RNA, 18 nt, Shigella flexneri 2a str. 2457T
gaagaacugcuggaagcu

SEQ ID NO: 3833927 - RNA, 24 nt, Shigella flexneri 2a str. 2457T
gaagaaggcuucguaaguggcguu

SEQ ID NO: 3833928 - RNA, 18 nt, Shigella flexneri 2a str. 2457T
gaagaaguaagcugagug

SEQ ID NO: 3833929 - RNA, 14 nt, Shigella flexneri 2a str. 2457T
gaagaauggaaaaa

SEQ ID NO: 3833930 - RNA, 13 nt, Shigella flexneri 2a str. 2457T
gaagacaaccaaa

SEQ ID NO: 3833931 - RNA, 21 nt, Shigella flexneri 2a str. 2457T
gaagacaucgcagggaucauc

SEQ ID NO: 3833932 - RNA, 17 nt, Shigella flexneri 2a str. 2457T
gaagacuguagcaggau

SEQ ID NO: 3833933 - RNA, 13 nt, Shigella flexneri 2a str. 2457T
gaagagauggauc

SEQ ID NO: 3833934 - RNA, 14 nt, Shigella flexneri 2a str. 2457T
gaagagcacacauu

SEQ ID NO: 3833935 - RNA, 19 nt, Shigella flexneri 2a str. 2457T
gaagaggaacccagugaua

SEQ ID NO: 3833936 - RNA, 19 nt, Shigella flexneri 2a str. 2457T
gaagaggaucugcucuucu

SEQ ID NO: 3833937 - RNA, 15 nt, Shigella flexneri 2a str. 2457T
gaagauuugcagauc

SEQ ID NO: 3833938 - RNA, 14 nt, Shigella flexneri 2a str. 2457T
gaagauuuugcugu

SEQ ID NO: 3833939 - RNA, 15 nt, Shigella flexneri 2a str. 2457T
gaagcaaaccaggcc

SEQ ID NO: 3833940 - RNA, 23 nt, Shigella flexneri 2a str. 2457T
gaagcaacaguaauaaugcccau

SEQ ID NO: 3833941 - RNA, 22 nt, Shigella flexneri 2a str. 2457T
gaagcaauguauuuguccacgc

SEQ ID NO: 3833942 - RNA, 23 nt, Shigella flexneri 2a str. 2457T
gaagcacguucaucccacucuga

SEQ ID NO: 3833943 - RNA, 15 nt, Shigella flexneri 2a str. 2457T
gaagcacucguaaga

SEQ ID NO: 3833944 - RNA, 16 nt, Shigella flexneri 2a str. 2457T
gaagcagcuugcuguu

SEQ ID NO: 3833945 - RNA, 14 nt, Shigella flexneri 2a str. 2457T
gaagcagucaacac

SEQ ID NO: 3833946 - RNA, 19 nt, Shigella flexneri 2a str. 2457T
gaagcaguuucaccagcag

SEQ ID NO: 3833947 - RNA, 21 nt, Shigella flexneri 2a str. 2457T
gaagccaaaucauccagaccg

SEQ ID NO: 3833948 - RNA, 18 nt, Shigella flexneri 2a str. 2457T
gaagccaccacgccaaga

SEQ ID NO: 3833949 - RNA, 14 nt, Shigella flexneri 2a str. 2457T
gaagccagucagcu

SEQ ID NO: 3833950 - RNA, 18 nt, Shigella flexneri 2a str. 2457T
gaagccauuaaacaccag

SEQ ID NO: 3833951 - RNA, 20 nt, Shigella flexneri 2a str. 2457T
gaagcccaucaguacaccac

SEQ ID NO: 3833952 - RNA, 14 nt, Shigella flexneri 2a str. 2457T
gaagccgccagacc

SEQ ID NO: 3833953 - RNA, 21 nt, Shigella flexneri 2a str. 2457T
gaagccuuccgcaaacaggcg

SEQ ID NO: 3833954 - RNA, 16 nt, Shigella flexneri 2a str. 2457T
gaagcgcaacgcauca

SEQ ID NO: 3833955 - RNA, 14 nt, Shigella flexneri 2a str. 2457T
gaagcgcauggcgu

SEQ ID NO: 3833956 - RNA, 23 nt, Shigella flexneri 2a str. 2457T
gaagcgcauggcguccgucaucg

SEQ ID NO: 3833957 - RNA, 17 nt, Shigella flexneri 2a str. 2457T
gaagcggcacugcucuu

SEQ ID NO: 3833958 - RNA, 12 nt, Shigella flexneri 2a str. 2457T
gaagcggccguc

SEQ ID NO: 3833959 - RNA, 20 nt, Shigella flexneri 2a str. 2457T
gaagcggccgucagaucgcc

SEQ ID NO: 3833960 - RNA, 23 nt, Shigella flexneri 2a str. 2457T
gaagcgggggagucgcugguuaa

SEQ ID NO: 3833961 - RNA, 19 nt, Shigella flexneri 2a str. 2457T
gaagcguaauauccaggcc

SEQ ID NO: 3833962 - RNA, 23 nt, Shigella flexneri 2a str. 2457T
gaagcucguuguuuaugccggau

SEQ ID NO: 3833963 - RNA, 12 nt, Shigella flexneri 2a str. 2457T
gaagcucuuucg

SEQ ID NO: 3833964 - RNA, 12 nt, Shigella flexneri 2a str. 2457T
gaagcugaaagu

SEQ ID NO: 3833965 - RNA, 15 nt, Shigella flexneri 2a str. 2457T
gaagcuggucagcau

SEQ ID NO: 3833966 - RNA, 16 nt, Shigella flexneri 2a str. 2457T
gaagcuggucagcauc

SEQ ID NO: 3833967 - RNA, 20 nt, Shigella flexneri 2a str. 2457T
gaagcuuucuugcagcucuu

SEQ ID NO: 3833968 - RNA, 21 nt, Shigella flexneri 2a str. 2457T
gaagcuuucuugcagcucuug

SEQ ID NO: 3833969 - RNA, 14 nt, Shigella flexneri 2a str. 2457T
gaaggaaaauacag

SEQ ID NO: 3833970 - RNA, 17 nt, Shigella flexneri 2a str. 2457T
gaaggaauauucaggcu

SEQ ID NO: 3833971 - RNA, 23 nt, Shigella flexneri 2a str. 2457T
gaaggacucgaggagcuggagga

SEQ ID NO: 3833972 - RNA, 14 nt, Shigella flexneri 2a str. 2457T
gaaggaugagaagc

SEQ ID NO: 3833973 - RNA, 13 nt, Shigella flexneri 2a str. 2457T
gaaggauuacuca

SEQ ID NO: 3833974 - RNA, 14 nt, Shigella flexneri 2a str. 2457T
gaaggccagcaggu

SEQ ID NO: 3833975 - RNA, 20 nt, Shigella flexneri 2a str. 2457T
gaaggcgauuaaacgccauc

SEQ ID NO: 3833976 - RNA, 20 nt, Shigella flexneri 2a str. 2457T
gaaggcgcacugauucauga

SEQ ID NO: 3833977 - RNA, 16 nt, Shigella flexneri 2a str. 2457T
gaaggcgcauugcugg

SEQ ID NO: 3833978 - RNA, 11 nt, Shigella flexneri 2a str. 2457T
gaaggcggcga

SEQ ID NO: 3833979 - RNA, 22 nt, Shigella flexneri 2a str. 2457T
gaaggcuagguugaccuggaag

SEQ ID NO: 3833980 - RNA, 16 nt, Shigella flexneri 2a str. 2457T
gaagggauugugcagg

SEQ ID NO: 3833981 - RNA, 22 nt, Shigella flexneri 2a str. 2457T
gaagggcuggccaauuggcugg

SEQ ID NO: 3833982 - RNA, 23 nt, Shigella flexneri 2a str. 2457T
gaagggcuggcuguucugccucu

SEQ ID NO: 3833983 - RNA, 21 nt, Shigella flexneri 2a str. 2457T
gaaggguauugccgaugaacg

SEQ ID NO: 3833984 - RNA, 14 nt, Shigella flexneri 2a str. 2457T
gaaggguuggugaa

SEQ ID NO: 3833985 - RNA, 21 nt, Shigella flexneri 2a str. 2457T
gaagguaaggauaaaaaaggg

SEQ ID NO: 3833986 - RNA, 14 nt, Shigella flexneri 2a str. 2457T
gaaggucagguuug

SEQ ID NO: 3833987 - RNA, 19 nt, Shigella flexneri 2a str. 2457T
gaaggugaaauugucggcg

SEQ ID NO: 3833988 - RNA, 14 nt, Shigella flexneri 2a str. 2457T
gaaguaauaaucaa

SEQ ID NO: 3833989 - RNA, 17 nt, Shigella flexneri 2a str. 2457T
gaaguaauaaucaacgc

SEQ ID NO: 3833990 - RNA, 17 nt, Shigella flexneri 2a str. 2457T
gaaguaccaauggcaau

SEQ ID NO: 3833991 - RNA, 15 nt, Shigella flexneri 2a str. 2457T
gaaguacuccugcuc

SEQ ID NO: 3833992 - RNA, 20 nt, Shigella flexneri 2a str. 2457T
gaaguacuccugcucgccga

SEQ ID NO: 3833993 - RNA, 19 nt, Shigella flexneri 2a str. 2457T
gaaguagccaguaccaccc

SEQ ID NO: 3833994 - RNA, 14 nt, Shigella flexneri 2a str. 2457T
gaaguaguugcugu

SEQ ID NO: 3833995 - RNA, 18 nt, Shigella flexneri 2a str. 2457T
gaaguauuggugaguccu

SEQ ID NO: 3833996 - RNA, 20 nt, Shigella flexneri 2a str. 2457T
gaaguauuggugaguccuga

SEQ ID NO: 3833997 - RNA, 22 nt, Shigella flexneri 2a str. 2457T
gaaguccacgcgguagcgggca

SEQ ID NO: 3833998 - RNA, 17 nt, Shigella flexneri 2a str. 2457T
gaagucgaacuucucuu

SEQ ID NO: 3833999 - RNA, 18 nt, Shigella flexneri 2a str. 2457T
gaagucguucagaucuuu

SEQ ID NO: 3834000 - RNA, 17 nt, Shigella flexneri 2a str. 2457T
gaaguuauccugguacu

SEQ ID NO: 3834001 - RNA, 15 nt, Shigella flexneri 2a str. 2457T
gaaguuccagggcag

SEQ ID NO: 3834002 - RNA, 16 nt, Shigella flexneri 2a str. 2457T
gaaguugcucaagcug

SEQ ID NO: 3834003 - RNA, 16 nt, Shigella flexneri 2a str. 2457T
gaaguuguagcuggcu

SEQ ID NO: 3834004 - RNA, 19 nt, Shigella flexneri 2a str. 2457T
gaaguuuugucgcugauuu

SEQ ID NO: 3834005 - RNA, 12 nt, Shigella flexneri 2a str. 2457T
gaauaaaacaga

SEQ ID NO: 3834006 - RNA, 15 nt, Shigella flexneri 2a str. 2457T
gaauaaaacagaaac

SEQ ID NO: 3834007 - RNA, 13 nt, Shigella flexneri 2a str. 2457T
gaauaaaacaggc

SEQ ID NO: 3834008 - RNA, 23 nt, Shigella flexneri 2a str. 2457T
gaauaaaguuuuaguugccguuc

SEQ ID NO: 3834009 - RNA, 14 nt, Shigella flexneri 2a str. 2457T
gaauaaauugagcu

SEQ ID NO: 3834010 - RNA, 17 nt, Shigella flexneri 2a str. 2457T
gaauaacaccagccaga

SEQ ID NO: 3834011 - RNA, 13 nt, Shigella flexneri 2a str. 2457T
gaauaaccagcga

SEQ ID NO: 3834012 - RNA, 21 nt, Shigella flexneri 2a str. 2457T
gaauaagacuggcaaaugaca

SEQ ID NO: 3834013 - RNA, 19 nt, Shigella flexneri 2a str. 2457T
gaauaaucaccuuuaaccu

SEQ ID NO: 3834014 - RNA, 13 nt, Shigella flexneri 2a str. 2457T
gaauaaucagcaa

SEQ ID NO: 3834015 - RNA, 17 nt, Shigella flexneri 2a str. 2457T
gaauaaucguaaucagc

SEQ ID NO: 3834016 - RNA, 12 nt, Shigella flexneri 2a str. 2457T
gaauacagaaca

SEQ ID NO: 3834017 - RNA, 20 nt, Shigella flexneri 2a str. 2457T
gaauaccccauggagaaaau

SEQ ID NO: 3834018 - RNA, 13 nt, Shigella flexneri 2a str. 2457T
gaauaccgacauc

SEQ ID NO: 3834019 - RNA, 13 nt, Shigella flexneri 2a str. 2457T
gaauaccuucuuc

SEQ ID NO: 3834020 - RNA, 15 nt, Shigella flexneri 2a str. 2457T
gaauaccuucuuccu

SEQ ID NO: 3834021 - RNA, 21 nt, Shigella flexneri 2a str. 2457T
gaauagaaccuaagaaccaga

SEQ ID NO: 3834022 - RNA, 20 nt, Shigella flexneri 2a str. 2457T
gaauagccuuuagcgagcga

SEQ ID NO: 3834023 - RNA, 15 nt, Shigella flexneri 2a str. 2457T
gaauagcggaaaucu

SEQ ID NO: 3834024 - RNA, 14 nt, Shigella flexneri 2a str. 2457T
gaauaguuucagcc

SEQ ID NO: 3834025 - RNA, 19 nt, Shigella flexneri 2a str. 2457T
gaauaguuugauuaacgca

SEQ ID NO: 3834026 - RNA, 19 nt, Shigella flexneri 2a str. 2457T
gaauauaacgcagcgucag

SEQ ID NO: 3834027 - RNA, 14 nt, Shigella flexneri 2a str. 2457T
gaauauaagucagg

SEQ ID NO: 3834028 - RNA, 20 nt, Shigella flexneri 2a str. 2457T
gaauauauaauuaaaaauag

SEQ ID NO: 3834029 - RNA, 22 nt, Shigella flexneri 2a str. 2457T
gaauauaucagccugaaugcuu

SEQ ID NO: 3834030 - RNA, 20 nt, Shigella flexneri 2a str. 2457T
gaauaucaagaucaucaaac

SEQ ID NO: 3834031 - RNA, 21 nt, Shigella flexneri 2a str. 2457T
gaauaucaagaucaucaaacu

SEQ ID NO: 3834032 - RNA, 17 nt, Shigella flexneri 2a str. 2457T
gaauaugaacaugaaaa

SEQ ID NO: 3834033 - RNA, 23 nt, Shigella flexneri 2a str. 2457T
gaauaugagucguaaacaacugg

SEQ ID NO: 3834034 - RNA, 17 nt, Shigella flexneri 2a str. 2457T
gaauaugcgccacacca

SEQ ID NO: 3834035 - RNA, 17 nt, Shigella flexneri 2a str. 2457T
gaauauggcggcggcuu

SEQ ID NO: 3834036 - RNA, 20 nt, Shigella flexneri 2a str. 2457T
gaauaugguuagagaacaac

SEQ ID NO: 3834037 - RNA, 18 nt, Shigella flexneri 2a str. 2457T
gaauaugucgcgccaggc

SEQ ID NO: 3834038 - RNA, 16 nt, Shigella flexneri 2a str. 2457T
gaauauguuuuugcag

SEQ ID NO: 3834039 - RNA, 16 nt, Shigella flexneri 2a str. 2457T
gaauauucaccgguuc

SEQ ID NO: 3834040 - RNA, 20 nt, Shigella flexneri 2a str. 2457T
gaauauugccgaagaccaga

SEQ ID NO: 3834041 - RNA, 15 nt, Shigella flexneri 2a str. 2457T
gaauauuucaccggu

SEQ ID NO: 3834042 - RNA, 16 nt, Shigella flexneri 2a str. 2457T
gaaucaaccaugguuu

SEQ ID NO: 3834043 - RNA, 19 nt, Shigella flexneri 2a str. 2457T
gaaucaacuccagaauacc

SEQ ID NO: 3834044 - RNA, 16 nt, Shigella flexneri 2a str. 2457T
gaaucaaucgccccuu

SEQ ID NO: 3834045 - RNA, 16 nt, Shigella flexneri 2a str. 2457T
gaaucaccgccacgcc

SEQ ID NO: 3834046 - RNA, 22 nt, Shigella flexneri 2a str. 2457T
gaaucaccgccacgcccuccug

SEQ ID NO: 3834047 - RNA, 14 nt, Shigella flexneri 2a str. 2457T
gaaucagcaguuca

SEQ ID NO: 3834048 - RNA, 14 nt, Shigella flexneri 2a str. 2457T
gaaucagcccagcc

SEQ ID NO: 3834049 - RNA, 23 nt, Shigella flexneri 2a str. 2457T
gaaucaggcaggucuuucaccug

SEQ ID NO: 3834050 - RNA, 21 nt, Shigella flexneri 2a str. 2457T
gaaucaguaaugauucgggcu

SEQ ID NO: 3834051 - RNA, 22 nt, Shigella flexneri 2a str. 2457T
gaaucaguuguucagaaugccc

SEQ ID NO: 3834052 - RNA, 16 nt, Shigella flexneri 2a str. 2457T
gaaucauaacugccgu

SEQ ID NO: 3834053 - RNA, 17 nt, Shigella flexneri 2a str. 2457T
gaauccgcaccaacucc

SEQ ID NO: 3834054 - RNA, 18 nt, Shigella flexneri 2a str. 2457T
gaauccgcaccaacucca

SEQ ID NO: 3834055 - RNA, 15 nt, Shigella flexneri 2a str. 2457T
gaauccgcgacuggc

SEQ ID NO: 3834056 - RNA, 18 nt, Shigella flexneri 2a str. 2457T
gaauccuucccccaccac

SEQ ID NO: 3834057 - RNA, 16 nt, Shigella flexneri 2a str. 2457T
gaaucgcaaagccgau

SEQ ID NO: 3834058 - RNA, 23 nt, Shigella flexneri 2a str. 2457T
gaaucgcaaagccgauaccuucc

SEQ ID NO: 3834059 - RNA, 16 nt, Shigella flexneri 2a str. 2457T
gaaucgccacaacuuc

SEQ ID NO: 3834060 - RNA, 13 nt, Shigella flexneri 2a str. 2457T
gaaucgccagcau

SEQ ID NO: 3834061 - RNA, 18 nt, Shigella flexneri 2a str. 2457T
gaaucgccagcaucggca

SEQ ID NO: 3834062 - RNA, 14 nt, Shigella flexneri 2a str. 2457T
gaaucuccagaucu

SEQ ID NO: 3834063 - RNA, 21 nt, Shigella flexneri 2a str. 2457T
gaaucucugcgcuauccagcg

SEQ ID NO: 3834064 - RNA, 13 nt, Shigella flexneri 2a str. 2457T
gaaucucuucuuc

SEQ ID NO: 3834065 - RNA, 14 nt, Shigella flexneri 2a str. 2457T
gaaucucuuuuguu

SEQ ID NO: 3834066 - RNA, 12 nt, Shigella flexneri 2a str. 2457T
gaaucugauuag

SEQ ID NO: 3834067 - RNA, 13 nt, Shigella flexneri 2a str. 2457T
gaaucugcaauca

SEQ ID NO: 3834068 - RNA, 22 nt, Shigella flexneri 2a str. 2457T
gaaucuguuuuuugguguuacu

SEQ ID NO: 3834069 - RNA, 15 nt, Shigella flexneri 2a str. 2457T
gaaucuuuucaucgc

SEQ ID NO: 3834070 - RNA, 16 nt, Shigella flexneri 2a str. 2457T
gaaugacgacguacca

SEQ ID NO: 3834071 - RNA, 19 nt, Shigella flexneri 2a str. 2457T
gaaugacgacguaccagcg

SEQ ID NO: 3834072 - RNA, 14 nt, Shigella flexneri 2a str. 2457T
gaaugagcaucuac

SEQ ID NO: 3834073 - RNA, 18 nt, Shigella flexneri 2a str. 2457T
gaaugaggaucagccgcu

SEQ ID NO: 3834074 - RNA, 15 nt, Shigella flexneri 2a str. 2457T
gaaugaggcagcaag

SEQ ID NO: 3834075 - RNA, 19 nt, Shigella flexneri 2a str. 2457T
gaaugaucaaacgaagcgg

SEQ ID NO: 3834076 - RNA, 22 nt, Shigella flexneri 2a str. 2457T
gaaugaucagcgguuuugccag

SEQ ID NO: 3834077 - RNA, 14 nt, Shigella flexneri 2a str. 2457T
gaaugcaggcgcgc

SEQ ID NO: 3834078 - RNA, 19 nt, Shigella flexneri 2a str. 2457T
gaaugcagucacgccagua

SEQ ID NO: 3834079 - RNA, 18 nt, Shigella flexneri 2a str. 2457T
gaaugccacgcaaacuuc

SEQ ID NO: 3834080 - RNA, 21 nt, Shigella flexneri 2a str. 2457T
gaaugccccauugcaacgugg

SEQ ID NO: 3834081 - RNA, 19 nt, Shigella flexneri 2a str. 2457T
gaaugccgcagcacccuga

SEQ ID NO: 3834082 - RNA, 14 nt, Shigella flexneri 2a str. 2457T
gaaugccugugcga

SEQ ID NO: 3834083 - RNA, 16 nt, Shigella flexneri 2a str. 2457T
gaaugccuuauccgau

SEQ ID NO: 3834084 - RNA, 17 nt, Shigella flexneri 2a str. 2457T
gaaugcgauggcaaaag

SEQ ID NO: 3834085 - RNA, 19 nt, Shigella flexneri 2a str. 2457T
gaaugcgcccgacgccguu

SEQ ID NO: 3834086 - RNA, 17 nt, Shigella flexneri 2a str. 2457T
gaaugcgcuuuauugua

SEQ ID NO: 3834087 - RNA, 14 nt, Shigella flexneri 2a str. 2457T
gaaugcggcaggca

SEQ ID NO: 3834088 - RNA, 19 nt, Shigella flexneri 2a str. 2457T
gaaugcgguuaaaccgaaa

SEQ ID NO: 3834089 - RNA, 15 nt, Shigella flexneri 2a str. 2457T
gaauggaaacagcac

SEQ ID NO: 3834090 - RNA, 17 nt, Shigella flexneri 2a str. 2457T
gaauggaaacagcacca

SEQ ID NO: 3834091 - RNA, 21 nt, Shigella flexneri 2a str. 2457T
gaauggacaccagcucaguga

SEQ ID NO: 3834092 - RNA, 18 nt, Shigella flexneri 2a str. 2457T
gaauggcaucuacgcucu

SEQ ID NO: 3834093 - RNA, 20 nt, Shigella flexneri 2a str. 2457T
gaauggcaucuacgcucucu

SEQ ID NO: 3834094 - RNA, 22 nt, Shigella flexneri 2a str. 2457T
gaaugguauaacgcaagugauc

SEQ ID NO: 3834095 - RNA, 13 nt, Shigella flexneri 2a str. 2457T
gaauggucgggcu

SEQ ID NO: 3834096 - RNA, 15 nt, Shigella flexneri 2a str. 2457T
gaaugugaugaaaaa

SEQ ID NO: 3834097 - RNA, 15 nt, Shigella flexneri 2a str. 2457T
gaauguggcaaugag

SEQ ID NO: 3834098 - RNA, 14 nt, Shigella flexneri 2a str. 2457T
gaauguuccauacc

SEQ ID NO: 3834099 - RNA, 20 nt, Shigella flexneri 2a str. 2457T
gaauguuccaucaccagauu

SEQ ID NO: 3834100 - RNA, 19 nt, Shigella flexneri 2a str. 2457T
gaauguuuuccugcuucac

SEQ ID NO: 3834101 - RNA, 13 nt, Shigella flexneri 2a str. 2457T
gaauuaaugguga

SEQ ID NO: 3834102 - RNA, 16 nt, Shigella flexneri 2a str. 2457T
gaauuacacagccaca

SEQ ID NO: 3834103 - RNA, 14 nt, Shigella flexneri 2a str. 2457T
gaauuacuggcaga

SEQ ID NO: 3834104 - RNA, 16 nt, Shigella flexneri 2a str. 2457T
gaauuaugcagccuuc

SEQ ID NO: 3834105 - RNA, 21 nt, Shigella flexneri 2a str. 2457T
gaauuaugcagccuucauuca

SEQ ID NO: 3834106 - RNA, 17 nt, Shigella flexneri 2a str. 2457T
gaauuauucacuggaga

SEQ ID NO: 3834107 - RNA, 17 nt, Shigella flexneri 2a str. 2457T
gaauucaaauccuucag

SEQ ID NO: 3834108 - RNA, 15 nt, Shigella flexneri 2a str. 2457T
gaauucacgccgcau

SEQ ID NO: 3834109 - RNA, 18 nt, Shigella flexneri 2a str. 2457T
gaauuccgacagagaaag

SEQ ID NO: 3834110 - RNA, 22 nt, Shigella flexneri 2a str. 2457T
gaauuccggcagagaaagcaaa

SEQ ID NO: 3834111 - RNA, 20 nt, Shigella flexneri 2a str. 2457T
gaauugcugcgcccgcagcg

SEQ ID NO: 3834112 - RNA, 14 nt, Shigella flexneri 2a str. 2457T
gaauugugaugguu

SEQ ID NO: 3834113 - RNA, 19 nt, Shigella flexneri 2a str. 2457T
gaauuguuuuauaaagaac

SEQ ID NO: 3834114 - RNA, 16 nt, Shigella flexneri 2a str. 2457T
gaauuucagcgccuga

SEQ ID NO: 3834115 - RNA, 20 nt, Shigella flexneri 2a str. 2457T
gaauuucaucaucacgaaau

SEQ ID NO: 3834116 - RNA, 14 nt, Shigella flexneri 2a str. 2457T
gaauuugaggaagc

SEQ ID NO: 3834117 - RNA, 13 nt, Shigella flexneri 2a str. 2457T
gaauuugcaugac

SEQ ID NO: 3834118 - RNA, 14 nt, Shigella flexneri 2a str. 2457T
gaauuugcgccguu

SEQ ID NO: 3834119 - RNA, 16 nt, Shigella flexneri 2a str. 2457T
gaauuugcuccagaaa

SEQ ID NO: 3834120 - RNA, 16 nt, Shigella flexneri 2a str. 2457T
gaauuuguaggccgga

SEQ ID NO: 3834121 - RNA, 21 nt, Shigella flexneri 2a str. 2457T
gaauuugucgauuuccaucuc

SEQ ID NO: 3834122 - RNA, 12 nt, Shigella flexneri 2a str. 2457T
gaauuuuccuuc

SEQ ID NO: 3834123 - RNA, 14 nt, Shigella flexneri 2a str. 2457T
gaauuuuuccguug

SEQ ID NO: 3834124 - RNA, 15 nt, Shigella flexneri 2a str. 2457T
gacaaaaauaccacc

SEQ ID NO: 3834125 - RNA, 17 nt, Shigella flexneri 2a str. 2457T
gacaaaaucggaaacaa

SEQ ID NO: 3834126 - RNA, 13 nt, Shigella flexneri 2a str. 2457T
gacaaaauguucg

SEQ ID NO: 3834127 - RNA, 14 nt, Shigella flexneri 2a str. 2457T
gacaaacacaaaac

SEQ ID NO: 3834128 - RNA, 21 nt, Shigella flexneri 2a str. 2457T
gacaaacacaauauucauagu

SEQ ID NO: 3834129 - RNA, 20 nt, Shigella flexneri 2a str. 2457T
gacaaacaccgaaccagaga

SEQ ID NO: 3834130 - RNA, 23 nt, Shigella flexneri 2a str. 2457T
gacaaacacgguuaguucaaugc

SEQ ID NO: 3834131 - RNA, 19 nt, Shigella flexneri 2a str. 2457T
gacaaacaggaaguuucag

SEQ ID NO: 3834132 - RNA, 17 nt, Shigella flexneri 2a str. 2457T
gacaaacauugcugcca

SEQ ID NO: 3834133 - RNA, 20 nt, Shigella flexneri 2a str. 2457T
gacaaacuugauagaacaaa

SEQ ID NO: 3834134 - RNA, 12 nt, Shigella flexneri 2a str. 2457T
gacaaagcauga

SEQ ID NO: 3834135 - RNA, 10 nt, Shigella flexneri 2a str. 2457T
gacaaaucau

SEQ ID NO: 3834136 - RNA, 23 nt, Shigella flexneri 2a str. 2457T
gacaaauccuucacuuuugccag

SEQ ID NO: 3834137 - RNA, 17 nt, Shigella flexneri 2a str. 2457T
gacaaauuccgaacaaa

SEQ ID NO: 3834138 - RNA, 18 nt, Shigella flexneri 2a str. 2457T
gacaacaaaacgggggcu

SEQ ID NO: 3834139 - RNA, 19 nt, Shigella flexneri 2a str. 2457T
gacaacaaaacgggggcua

SEQ ID NO: 3834140 - RNA, 23 nt, Shigella flexneri 2a str. 2457T
gacaacaaacgcaaacaccagcg

SEQ ID NO: 3834141 - RNA, 20 nt, Shigella flexneri 2a str. 2457T
gacaacaacaucacaccugc

SEQ ID NO: 3834142 - RNA, 11 nt, Shigella flexneri 2a str. 2457T
gacaacaucau

SEQ ID NO: 3834143 - RNA, 19 nt, Shigella flexneri 2a str. 2457T
gacaacaugagaacaguuc

SEQ ID NO: 3834144 - RNA, 19 nt, Shigella flexneri 2a str. 2457T
gacaaccagcuucaacgau

SEQ ID NO: 3834145 - RNA, 22 nt, Shigella flexneri 2a str. 2457T
gacaacgcaacgccgccggaag

SEQ ID NO: 3834146 - RNA, 20 nt, Shigella flexneri 2a str. 2457T
gacaacgccuuguucgcccu

SEQ ID NO: 3834147 - RNA, 19 nt, Shigella flexneri 2a str. 2457T
gacaacgcuuuuugguuca

SEQ ID NO: 3834148 - RNA, 12 nt, Shigella flexneri 2a str. 2457T
gacaacuucccu

SEQ ID NO: 3834149 - RNA, 18 nt, Shigella flexneri 2a str. 2457T
gacaacuucugauguugu

SEQ ID NO: 3834150 - RNA, 17 nt, Shigella flexneri 2a str. 2457T
gacaagauacugccgau

SEQ ID NO: 3834151 - RNA, 21 nt, Shigella flexneri 2a str. 2457T
gacaagcuuacguuacccagc

SEQ ID NO: 3834152 - RNA, 22 nt, Shigella flexneri 2a str. 2457T
gacaaggcaggcaucaaugaaa

SEQ ID NO: 3834153 - RNA, 23 nt, Shigella flexneri 2a str. 2457T
gacaaggcguugauuggcgcagg

SEQ ID NO: 3834154 - RNA, 21 nt, Shigella flexneri 2a str. 2457T
gacaauaauacccagcaccgc

SEQ ID NO: 3834155 - RNA, 23 nt, Shigella flexneri 2a str. 2457T
gacaauaauacccagcaccgcag

SEQ ID NO: 3834156 - RNA, 12 nt, Shigella flexneri 2a str. 2457T
gacaauaauauc

SEQ ID NO: 3834157 - RNA, 20 nt, Shigella flexneri 2a str. 2457T
gacaauagcuaacgaaaaug

SEQ ID NO: 3834158 - RNA, 19 nt, Shigella flexneri 2a str. 2457T
gacaauaugcucuccacca

SEQ ID NO: 3834159 - RNA, 15 nt, Shigella flexneri 2a str. 2457T
gacaaucacaucacu

SEQ ID NO: 3834160 - RNA, 17 nt, Shigella flexneri 2a str. 2457T
gacaaucaccaggucac

SEQ ID NO: 3834161 - RNA, 23 nt, Shigella flexneri 2a str. 2457T
gacaaucaccaggucaccagaca

SEQ ID NO: 3834162 - RNA, 13 nt, Shigella flexneri 2a str. 2457T
gacaaucagguaa

SEQ ID NO: 3834163 - RNA, 20 nt, Shigella flexneri 2a str. 2457T
gacaaucgccagugauugcu

SEQ ID NO: 3834164 - RNA, 15 nt, Shigella flexneri 2a str. 2457T
gacaaugcaguucca

SEQ ID NO: 3834165 - RNA, 18 nt, Shigella flexneri 2a str. 2457T
gacacaacaauucccagu

SEQ ID NO: 3834166 - RNA, 15 nt, Shigella flexneri 2a str. 2457T
gacacaaucaaaucc

SEQ ID NO: 3834167 - RNA, 16 nt, Shigella flexneri 2a str. 2457T
gacacaauccaugcca

SEQ ID NO: 3834168 - RNA, 23 nt, Shigella flexneri 2a str. 2457T
gacacagauaccaaaaucggcaa

SEQ ID NO: 3834169 - RNA, 14 nt, Shigella flexneri 2a str. 2457T
gacacaggcagcaa

SEQ ID NO: 3834170 - RNA, 16 nt, Shigella flexneri 2a str. 2457T
gacacaggcagcaauc

SEQ ID NO: 3834171 - RNA, 19 nt, Shigella flexneri 2a str. 2457T
gacacaguucuucaaaaau

SEQ ID NO: 3834172 - RNA, 15 nt, Shigella flexneri 2a str. 2457T
gacacaucuaaugcu

SEQ ID NO: 3834173 - RNA, 17 nt, Shigella flexneri 2a str. 2457T
gacaccaaggaacugug

SEQ ID NO: 3834174 - RNA, 16 nt, Shigella flexneri 2a str. 2457T
gacaccagcacaucau

SEQ ID NO: 3834175 - RNA, 14 nt, Shigella flexneri 2a str. 2457T
gacaccauaacaga

SEQ ID NO: 3834176 - RNA, 17 nt, Shigella flexneri 2a str. 2457T
gacaccccuucauucag

SEQ ID NO: 3834177 - RNA, 18 nt, Shigella flexneri 2a str. 2457T
gacaccgauauucgccgc

SEQ ID NO: 3834178 - RNA, 19 nt, Shigella flexneri 2a str. 2457T
gacaccguuaaauaacugg

SEQ ID NO: 3834179 - RNA, 21 nt, Shigella flexneri 2a str. 2457T
gacacgcuaccuugagguggu

SEQ ID NO: 3834180 - RNA, 19 nt, Shigella flexneri 2a str. 2457T
gacacuauucgccagcacg

SEQ ID NO: 3834181 - RNA, 13 nt, Shigella flexneri 2a str. 2457T
gacacuauuuccc

SEQ ID NO: 3834182 - RNA, 22 nt, Shigella flexneri 2a str. 2457T
gacacugacgcgucuuaucugg

SEQ ID NO: 3834183 - RNA, 16 nt, Shigella flexneri 2a str. 2457T
gacacugcugauaauc

SEQ ID NO: 3834184 - RNA, 13 nt, Shigella flexneri 2a str. 2457T
gacacuuuaucua

SEQ ID NO: 3834185 - RNA, 23 nt, Shigella flexneri 2a str. 2457T
gacacuuuaucuaucaggacgaa

SEQ ID NO: 3834186 - RNA, 20 nt, Shigella flexneri 2a str. 2457T
gacacuuucagcgcagcgcg

SEQ ID NO: 3834187 - RNA, 14 nt, Shigella flexneri 2a str. 2457T
gacacuuugcgcca

SEQ ID NO: 3834188 - RNA, 16 nt, Shigella flexneri 2a str. 2457T
gacagaaucaggccau

SEQ ID NO: 3834189 - RNA, 12 nt, Shigella flexneri 2a str. 2457T
gacagacuggcu

SEQ ID NO: 3834190 - RNA, 20 nt, Shigella flexneri 2a str. 2457T
gacagagauucgguaaccau

SEQ ID NO: 3834191 - RNA, 20 nt, Shigella flexneri 2a str. 2457T
gacagagguggucgcagcgg

SEQ ID NO: 3834192 - RNA, 14 nt, Shigella flexneri 2a str. 2457T
gacagauucaugcu

SEQ ID NO: 3834193 - RNA, 12 nt, Shigella flexneri 2a str. 2457T
gacagcaugggg

SEQ ID NO: 3834194 - RNA, 17 nt, Shigella flexneri 2a str. 2457T
gacagccgaaaagguag

SEQ ID NO: 3834195 - RNA, 13 nt, Shigella flexneri 2a str. 2457T
gacagccuaccag

SEQ ID NO: 3834196 - RNA, 15 nt, Shigella flexneri 2a str. 2457T
gacagcgauuccagu

SEQ ID NO: 3834197 - RNA, 22 nt, Shigella flexneri 2a str. 2457T
gacagcgucacaucaggccauc

SEQ ID NO: 3834198 - RNA, 20 nt, Shigella flexneri 2a str. 2457T
gacagcucguuaaucagaau

SEQ ID NO: 3834199 - RNA, 17 nt, Shigella flexneri 2a str. 2457T
gacaggcgaaacccgcu

SEQ ID NO: 3834200 - RNA, 19 nt, Shigella flexneri 2a str. 2457T
gacaggcggcccagugagu

SEQ ID NO: 3834201 - RNA, 18 nt, Shigella flexneri 2a str. 2457T
gacagggaucucuuccag

SEQ ID NO: 3834202 - RNA, 19 nt, Shigella flexneri 2a str. 2457T
gacagggaucucuuccagu

SEQ ID NO: 3834203 - RNA, 15 nt, Shigella flexneri 2a str. 2457T
gacaggucaaaguaa

SEQ ID NO: 3834204 - RNA, 22 nt, Shigella flexneri 2a str. 2457T
gacaggugccggauuucauauc

SEQ ID NO: 3834205 - RNA, 13 nt, Shigella flexneri 2a str. 2457T
gacaguaaaguuu

SEQ ID NO: 3834206 - RNA, 18 nt, Shigella flexneri 2a str. 2457T
gacaguaccagcaguaca

SEQ ID NO: 3834207 - RNA, 16 nt, Shigella flexneri 2a str. 2457T
gacaguacccagauuc

SEQ ID NO: 3834208 - RNA, 19 nt, Shigella flexneri 2a str. 2457T
gacaguagccuuuaucugu

SEQ ID NO: 3834209 - RNA, 15 nt, Shigella flexneri 2a str. 2457T
gacaguauaacgaaa

SEQ ID NO: 3834210 - RNA, 20 nt, Shigella flexneri 2a str. 2457T
gacaguauaacgaaacgggu

SEQ ID NO: 3834211 - RNA, 22 nt, Shigella flexneri 2a str. 2457T
gacaguccccucgccccuccgg

SEQ ID NO: 3834212 - RNA, 15 nt, Shigella flexneri 2a str. 2457T
gacagucuggaagcc

SEQ ID NO: 3834213 - RNA, 18 nt, Shigella flexneri 2a str. 2457T
gacagucuggaagccagu

SEQ ID NO: 3834214 - RNA, 19 nt, Shigella flexneri 2a str. 2457T
gacagugacuuccguccca

SEQ ID NO: 3834215 - RNA, 17 nt, Shigella flexneri 2a str. 2457T
gacaguuaucaaauuca

SEQ ID NO: 3834216 - RNA, 16 nt, Shigella flexneri 2a str. 2457T
gacaguucaaucuccg

SEQ ID NO: 3834217 - RNA, 21 nt, Shigella flexneri 2a str. 2457T
gacauaaaauaaccaaauaaa

SEQ ID NO: 3834218 - RNA, 16 nt, Shigella flexneri 2a str. 2457T
gacauaaacaccagca

SEQ ID NO: 3834219 - RNA, 19 nt, Shigella flexneri 2a str. 2457T
gacauaaacaccagcaaua

SEQ ID NO: 3834220 - RNA, 22 nt, Shigella flexneri 2a str. 2457T
gacauaaccacucaccgccguu

SEQ ID NO: 3834221 - RNA, 21 nt, Shigella flexneri 2a str. 2457T
gacauaagcgcaugaucguuc

SEQ ID NO: 3834222 - RNA, 22 nt, Shigella flexneri 2a str. 2457T
gacauacucagcgccugcugca

SEQ ID NO: 3834223 - RNA, 16 nt, Shigella flexneri 2a str. 2457T
gacauauaaccggcaa

SEQ ID NO: 3834224 - RNA, 13 nt, Shigella flexneri 2a str. 2457T
gacauaugcuuaa

SEQ ID NO: 3834225 - RNA, 17 nt, Shigella flexneri 2a str. 2457T
gacaucaacgaugccuu

SEQ ID NO: 3834226 - RNA, 16 nt, Shigella flexneri 2a str. 2457T
gacaucaagaaaugca

SEQ ID NO: 3834227 - RNA, 18 nt, Shigella flexneri 2a str. 2457T
gacaucaauaaacaauga

SEQ ID NO: 3834228 - RNA, 14 nt, Shigella flexneri 2a str. 2457T
gacaucaccaguac

SEQ ID NO: 3834229 - RNA, 20 nt, Shigella flexneri 2a str. 2457T
gacaucacgguugagggcaa

SEQ ID NO: 3834230 - RNA, 14 nt, Shigella flexneri 2a str. 2457T
gacauccaugcacu

SEQ ID NO: 3834231 - RNA, 17 nt, Shigella flexneri 2a str. 2457T
gacaucccgccagccgc

SEQ ID NO: 3834232 - RNA, 18 nt, Shigella flexneri 2a str. 2457T
gacaucccggcagagaaa

SEQ ID NO: 3834233 - RNA, 17 nt, Shigella flexneri 2a str. 2457T
gacauccgugcagaacu

SEQ ID NO: 3834234 - RNA, 17 nt, Shigella flexneri 2a str. 2457T
gacaucugcaauuugug

SEQ ID NO: 3834235 - RNA, 22 nt, Shigella flexneri 2a str. 2457T
gacaucuuucugcgcaucuucc

SEQ ID NO: 3834236 - RNA, 23 nt, Shigella flexneri 2a str. 2457T
gacaucuuucugcgcaucuuccc

SEQ ID NO: 3834237 - RNA, 22 nt, Shigella flexneri 2a str. 2457T
gacaugaucuuuuuauugaaga

SEQ ID NO: 3834238 - RNA, 22 nt, Shigella flexneri 2a str. 2457T
gacaugcaucacgcgcaucugu

SEQ ID NO: 3834239 - RNA, 22 nt, Shigella flexneri 2a str. 2457T
gacauuaaguguccgccaauuu

SEQ ID NO: 3834240 - RNA, 15 nt, Shigella flexneri 2a str. 2457T
gacauucugacuggu

SEQ ID NO: 3834241 - RNA, 22 nt, Shigella flexneri 2a str. 2457T
gacauugaguuuacgcagcaga

SEQ ID NO: 3834242 - RNA, 21 nt, Shigella flexneri 2a str. 2457T
gacauugugugaaaucagcac

SEQ ID NO: 3834243 - RNA, 24 nt, Shigella flexneri 2a str. 2457T
gacauugugugaaaucagcacaua

SEQ ID NO: 3834244 - RNA, 18 nt, Shigella flexneri 2a str. 2457T
gacauuguuuccauaugu

SEQ ID NO: 3834245 - RNA, 16 nt, Shigella flexneri 2a str. 2457T
gacauuucugcugccu

SEQ ID NO: 3834246 - RNA, 13 nt, Shigella flexneri 2a str. 2457T
gacauuuucucua

SEQ ID NO: 3834247 - RNA, 21 nt, Shigella flexneri 2a str. 2457T
gaccaaaacgugcagcugccu

SEQ ID NO: 3834248 - RNA, 16 nt, Shigella flexneri 2a str. 2457T
gaccaaagaaugacac

SEQ ID NO: 3834249 - RNA, 22 nt, Shigella flexneri 2a str. 2457T
gaccaaagccuuucacuucggu

SEQ ID NO: 3834250 - RNA, 18 nt, Shigella flexneri 2a str. 2457T
gaccaauaaacgccaggu

SEQ ID NO: 3834251 - RNA, 20 nt, Shigella flexneri 2a str. 2457T
gaccaauaacgcuuuucuca

SEQ ID NO: 3834252 - RNA, 21 nt, Shigella flexneri 2a str. 2457T
gaccaauaauccccaauacga

SEQ ID NO: 3834253 - RNA, 15 nt, Shigella flexneri 2a str. 2457T
gaccaauccgccagc

SEQ ID NO: 3834254 - RNA, 17 nt, Shigella flexneri 2a str. 2457T
gaccaauccgccagcca

SEQ ID NO: 3834255 - RNA, 14 nt, Shigella flexneri 2a str. 2457T
gaccaccagcacgc

SEQ ID NO: 3834256 - RNA, 17 nt, Shigella flexneri 2a str. 2457T
gaccacccaccgcagcc

SEQ ID NO: 3834257 - RNA, 21 nt, Shigella flexneri 2a str. 2457T
gaccacccaccgcagcccaga

SEQ ID NO: 3834258 - RNA, 18 nt, Shigella flexneri 2a str. 2457T
gaccacccguaaucccgg

SEQ ID NO: 3834259 - RNA, 17 nt, Shigella flexneri 2a str. 2457T
gaccaccgaaugcgccu

SEQ ID NO: 3834260 - RNA, 13 nt, Shigella flexneri 2a str. 2457T
gaccaccgcgcua

SEQ ID NO: 3834261 - RNA, 20 nt, Shigella flexneri 2a str. 2457T
gaccacggccacagccagcc

SEQ ID NO: 3834262 - RNA, 16 nt, Shigella flexneri 2a str. 2457T
gaccacugcgccgcuc

SEQ ID NO: 3834263 - RNA, 15 nt, Shigella flexneri 2a str. 2457T
gaccacuucaugccc

SEQ ID NO: 3834264 - RNA, 16 nt, Shigella flexneri 2a str. 2457T
gaccagaaacgccacc

SEQ ID NO: 3834265 - RNA, 17 nt, Shigella flexneri 2a str. 2457T
gaccagaaacgccacca

SEQ ID NO: 3834266 - RNA, 19 nt, Shigella flexneri 2a str. 2457T
gaccagaauaagucuggca

SEQ ID NO: 3834267 - RNA, 22 nt, Shigella flexneri 2a str. 2457T
gaccagaccggcaaucgcgcca

SEQ ID NO: 3834268 - RNA, 22 nt, Shigella flexneri 2a str. 2457T
gaccagaugcgacguaaaaacu

SEQ ID NO: 3834269 - RNA, 15 nt, Shigella flexneri 2a str. 2457T
gaccagcaacaaaua

SEQ ID NO: 3834270 - RNA, 16 nt, Shigella flexneri 2a str. 2457T
gaccagcaacaaauaa

SEQ ID NO: 3834271 - RNA, 16 nt, Shigella flexneri 2a str. 2457T
gaccagcagcauuuca

SEQ ID NO: 3834272 - RNA, 16 nt, Shigella flexneri 2a str. 2457T
gaccagcaucccggca

SEQ ID NO: 3834273 - RNA, 22 nt, Shigella flexneri 2a str. 2457T
gaccagcgauaaaaauccgcca

SEQ ID NO: 3834274 - RNA, 17 nt, Shigella flexneri 2a str. 2457T
gaccagcgucgcaucag

SEQ ID NO: 3834275 - RNA, 19 nt, Shigella flexneri 2a str. 2457T
gaccagcgucgcaucaggc

SEQ ID NO: 3834276 - RNA, 16 nt, Shigella flexneri 2a str. 2457T
gaccagcuccagcaga

SEQ ID NO: 3834277 - RNA, 18 nt, Shigella flexneri 2a str. 2457T
gaccagcuccagcagacc

SEQ ID NO: 3834278 - RNA, 20 nt, Shigella flexneri 2a str. 2457T
gaccaggauuugauggucuc

SEQ ID NO: 3834279 - RNA, 16 nt, Shigella flexneri 2a str. 2457T
gaccaggcaaaccagu

SEQ ID NO: 3834280 - RNA, 19 nt, Shigella flexneri 2a str. 2457T
gaccaggccaucagcagcg

SEQ ID NO: 3834281 - RNA, 20 nt, Shigella flexneri 2a str. 2457T
gaccaggccaucagcagcgg

SEQ ID NO: 3834282 - RNA, 15 nt, Shigella flexneri 2a str. 2457T
gaccaguaccaccgc

SEQ ID NO: 3834283 - RNA, 12 nt, Shigella flexneri 2a str. 2457T
gaccauaaaagg

SEQ ID NO: 3834284 - RNA, 17 nt, Shigella flexneri 2a str. 2457T
gaccauaaauaugguga

SEQ ID NO: 3834285 - RNA, 18 nt, Shigella flexneri 2a str. 2457T
gaccauacagcagcaacg

SEQ ID NO: 3834286 - RNA, 21 nt, Shigella flexneri 2a str. 2457T
gaccaucaacuaaauauccac

SEQ ID NO: 3834287 - RNA, 14 nt, Shigella flexneri 2a str. 2457T
gaccaucagcagcg

SEQ ID NO: 3834288 - RNA, 15 nt, Shigella flexneri 2a str. 2457T
gaccaucagcugcca

SEQ ID NO: 3834289 - RNA, 19 nt, Shigella flexneri 2a str. 2457T
gaccaucuccuuacugccc

SEQ ID NO: 3834290 - RNA, 18 nt, Shigella flexneri 2a str. 2457T
gaccaucuuccaguugca

SEQ ID NO: 3834291 - RNA, 21 nt, Shigella flexneri 2a str. 2457T
gaccaucuuccaguugcacgc

SEQ ID NO: 3834292 - RNA, 19 nt, Shigella flexneri 2a str. 2457T
gaccauugcaucaucgaca

SEQ ID NO: 3834293 - RNA, 20 nt, Shigella flexneri 2a str. 2457T
gacccagcaccaguaccauu

SEQ ID NO: 3834294 - RNA, 18 nt, Shigella flexneri 2a str. 2457T
gacccagccagacgccag

SEQ ID NO: 3834295 - RNA, 16 nt, Shigella flexneri 2a str. 2457T
gacccauaaucagacg

SEQ ID NO: 3834296 - RNA, 14 nt, Shigella flexneri 2a str. 2457T
gacccaucugccag

SEQ ID NO: 3834297 - RNA, 20 nt, Shigella flexneri 2a str. 2457T
gacccgacagaugcucgcca

SEQ ID NO: 3834298 - RNA, 16 nt, Shigella flexneri 2a str. 2457T
gacccgagccacguca

SEQ ID NO: 3834299 - RNA, 16 nt, Shigella flexneri 2a str. 2457T
gacccgcaccguccuc

SEQ ID NO: 3834300 - RNA, 14 nt, Shigella flexneri 2a str. 2457T
gacccgcagccagc

SEQ ID NO: 3834301 - RNA, 15 nt, Shigella flexneri 2a str. 2457T
gacccggcggcgcgc

SEQ ID NO: 3834302 - RNA, 17 nt, Shigella flexneri 2a str. 2457T
gacccugcucuuucagc

SEQ ID NO: 3834303 - RNA, 19 nt, Shigella flexneri 2a str. 2457T
gacccugcucuuucagcac

SEQ ID NO: 3834304 - RNA, 20 nt, Shigella flexneri 2a str. 2457T
gacccugcucuuucagcacc

SEQ ID NO: 3834305 - RNA, 21 nt, Shigella flexneri 2a str. 2457T
gacccugcucuuucagcaccg

SEQ ID NO: 3834306 - RNA, 23 nt, Shigella flexneri 2a str. 2457T
gacccugcucuuucagcaccgcg

SEQ ID NO: 3834307 - RNA, 19 nt, Shigella flexneri 2a str. 2457T
gaccgauacacaucgucgc

SEQ ID NO: 3834308 - RNA, 18 nt, Shigella flexneri 2a str. 2457T
gaccgauggguucagaau

SEQ ID NO: 3834309 - RNA, 17 nt, Shigella flexneri 2a str. 2457T
gaccgauugauucccaa

SEQ ID NO: 3834310 - RNA, 19 nt, Shigella flexneri 2a str. 2457T
gaccgcacaccccggcggc

SEQ ID NO: 3834311 - RNA, 14 nt, Shigella flexneri 2a str. 2457T
gaccgccaccggcc

SEQ ID NO: 3834312 - RNA, 13 nt, Shigella flexneri 2a str. 2457T
gaccgccagcgcc

SEQ ID NO: 3834313 - RNA, 14 nt, Shigella flexneri 2a str. 2457T
gaccgccagcgcca

SEQ ID NO: 3834314 - RNA, 23 nt, Shigella flexneri 2a str. 2457T
gaccgcuucaaaguucugugucu

SEQ ID NO: 3834315 - RNA, 14 nt, Shigella flexneri 2a str. 2457T
gaccggacugacuc

SEQ ID NO: 3834316 - RNA, 17 nt, Shigella flexneri 2a str. 2457T
gaccggcaaccagcacc

SEQ ID NO: 3834317 - RNA, 16 nt, Shigella flexneri 2a str. 2457T
gaccguccaggcgguc

SEQ ID NO: 3834318 - RNA, 13 nt, Shigella flexneri 2a str. 2457T
gaccgucuuucau

SEQ ID NO: 3834319 - RNA, 19 nt, Shigella flexneri 2a str. 2457T
gaccgugaucguggccaug

SEQ ID NO: 3834320 - RNA, 13 nt, Shigella flexneri 2a str. 2457T
gaccgugccggac

SEQ ID NO: 3834321 - RNA, 17 nt, Shigella flexneri 2a str. 2457T
gaccguucgccagguca

SEQ ID NO: 3834322 - RNA, 24 nt, Shigella flexneri 2a str. 2457T
gaccguugauuuuauuggcauggu

SEQ ID NO: 3834323 - RNA, 14 nt, Shigella flexneri 2a str. 2457T
gaccuagcaaacua

SEQ ID NO: 3834324 - RNA, 22 nt, Shigella flexneri 2a str. 2457T
gaccucacuuucuggcagcugc

SEQ ID NO: 3834325 - RNA, 16 nt, Shigella flexneri 2a str. 2457T
gaccugaaaccgccuu

SEQ ID NO: 3834326 - RNA, 19 nt, Shigella flexneri 2a str. 2457T
gaccugaauuugcuccaga

SEQ ID NO: 3834327 - RNA, 19 nt, Shigella flexneri 2a str. 2457T
gaccugcccaaucaugaac

SEQ ID NO: 3834328 - RNA, 14 nt, Shigella flexneri 2a str. 2457T
gaccugcgucacca

SEQ ID NO: 3834329 - RNA, 20 nt, Shigella flexneri 2a str. 2457T
gaccugcgucaccacaucca

SEQ ID NO: 3834330 - RNA, 21 nt, Shigella flexneri 2a str. 2457T
gaccugcgucaccacauccag

SEQ ID NO: 3834331 - RNA, 16 nt, Shigella flexneri 2a str. 2457T
gaccuggaaggacucg

SEQ ID NO: 3834332 - RNA, 16 nt, Shigella flexneri 2a str. 2457T
gaccuggcgcuucacu

SEQ ID NO: 3834333 - RNA, 15 nt, Shigella flexneri 2a str. 2457T
gaccugggaaaucca

SEQ ID NO: 3834334 - RNA, 14 nt, Shigella flexneri 2a str. 2457T
gaccugguugcugg

SEQ ID NO: 3834335 - RNA, 20 nt, Shigella flexneri 2a str. 2457T
gaccugucggggccagcgca

SEQ ID NO: 3834336 - RNA, 18 nt, Shigella flexneri 2a str. 2457T
gaccuguugcccaugcuu

SEQ ID NO: 3834337 - RNA, 22 nt, Shigella flexneri 2a str. 2457T
gaccuuacgacugcgccugcag

SEQ ID NO: 3834338 - RNA, 15 nt, Shigella flexneri 2a str. 2457T
gaccuucugccagac

SEQ ID NO: 3834339 - RNA, 17 nt, Shigella flexneri 2a str. 2457T
gaccuucuucagcaaua

SEQ ID NO: 3834340 - RNA, 14 nt, Shigella flexneri 2a str. 2457T
gacgaaaccgggca

SEQ ID NO: 3834341 - RNA, 17 nt, Shigella flexneri 2a str. 2457T
gacgaaagucugggccg

SEQ ID NO: 3834342 - RNA, 18 nt, Shigella flexneri 2a str. 2457T
gacgaacguuuaauaaaa

SEQ ID NO: 3834343 - RNA, 14 nt, Shigella flexneri 2a str. 2457T
gacgaacuggcgca

SEQ ID NO: 3834344 - RNA, 15 nt, Shigella flexneri 2a str. 2457T
gacgaacuucacggu

SEQ ID NO: 3834345 - RNA, 20 nt, Shigella flexneri 2a str. 2457T
gacgaagcgccuucgauaau

SEQ ID NO: 3834346 - RNA, 18 nt, Shigella flexneri 2a str. 2457T
gacgaauaccuucuuccu

SEQ ID NO: 3834347 - RNA, 19 nt, Shigella flexneri 2a str. 2457T
gacgacaaucaaccagcac

SEQ ID NO: 3834348 - RNA, 12 nt, Shigella flexneri 2a str. 2457T
gacgacaggcaa

SEQ ID NO: 3834349 - RNA, 15 nt, Shigella flexneri 2a str. 2457T
gacgacaggcaagca

SEQ ID NO: 3834350 - RNA, 15 nt, Shigella flexneri 2a str. 2457T
gacgaccugauuuug

SEQ ID NO: 3834351 - RNA, 15 nt, Shigella flexneri 2a str. 2457T
gacgacgacgcgcgc

SEQ ID NO: 3834352 - RNA, 11 nt, Shigella flexneri 2a str. 2457T
gacgacgcuga

SEQ ID NO: 3834353 - RNA, 15 nt, Shigella flexneri 2a str. 2457T
gacgacgguuuccac

SEQ ID NO: 3834354 - RNA, 22 nt, Shigella flexneri 2a str. 2457T
gacgacuggccgaaaaaggauc

SEQ ID NO: 3834355 - RNA, 15 nt, Shigella flexneri 2a str. 2457T
gacgacuuuuuccau

SEQ ID NO: 3834356 - RNA, 13 nt, Shigella flexneri 2a str. 2457T
gacgagcgcuggu

SEQ ID NO: 3834357 - RNA, 14 nt, Shigella flexneri 2a str. 2457T
gacgauacaacgcu

SEQ ID NO: 3834358 - RNA, 17 nt, Shigella flexneri 2a str. 2457T
gacgauagaaccuucca

SEQ ID NO: 3834359 - RNA, 16 nt, Shigella flexneri 2a str. 2457T
gacgaucgcagaugaa

SEQ ID NO: 3834360 - RNA, 17 nt, Shigella flexneri 2a str. 2457T
gacgaucuucggcguca

SEQ ID NO: 3834361 - RNA, 19 nt, Shigella flexneri 2a str. 2457T
gacgaugaccgcaucaaug

SEQ ID NO: 3834362 - RNA, 16 nt, Shigella flexneri 2a str. 2457T
gacgauuacucgccuu

SEQ ID NO: 3834363 - RNA, 22 nt, Shigella flexneri 2a str. 2457T
gacgauuguagaaaaucucaau

SEQ ID NO: 3834364 - RNA, 14 nt, Shigella flexneri 2a str. 2457T
gacgauugugcugg

SEQ ID NO: 3834365 - RNA, 18 nt, Shigella flexneri 2a str. 2457T
gacgauugugcuggugau

SEQ ID NO: 3834366 - RNA, 17 nt, Shigella flexneri 2a str. 2457T
gacgcaaaguagcggcc

SEQ ID NO: 3834367 - RNA, 18 nt, Shigella flexneri 2a str. 2457T
gacgcaaccgcaaaugau

SEQ ID NO: 3834368 - RNA, 17 nt, Shigella flexneri 2a str. 2457T
gacgcaacuuccccucu

SEQ ID NO: 3834369 - RNA, 18 nt, Shigella flexneri 2a str. 2457T
gacgcacacguuucaggu

SEQ ID NO: 3834370 - RNA, 17 nt, Shigella flexneri 2a str. 2457T
gacgcacuuucgcuuua

SEQ ID NO: 3834371 - RNA, 18 nt, Shigella flexneri 2a str. 2457T
gacgcagaauggcgaacg

SEQ ID NO: 3834372 - RNA, 12 nt, Shigella flexneri 2a str. 2457T
gacgcagcaugc

SEQ ID NO: 3834373 - RNA, 13 nt, Shigella flexneri 2a str. 2457T
gacgcagucaugc

SEQ ID NO: 3834374 - RNA, 19 nt, Shigella flexneri 2a str. 2457T
gacgcagucaugcgagaag

SEQ ID NO: 3834375 - RNA, 12 nt, Shigella flexneri 2a str. 2457T
gacgcaguccag

SEQ ID NO: 3834376 - RNA, 19 nt, Shigella flexneri 2a str. 2457T
gacgcauccgaucgcgcau

SEQ ID NO: 3834377 - RNA, 20 nt, Shigella flexneri 2a str. 2457T
gacgcauccgaucgcgcauc

SEQ ID NO: 3834378 - RNA, 16 nt, Shigella flexneri 2a str. 2457T
gacgccacaaucugau

SEQ ID NO: 3834379 - RNA, 12 nt, Shigella flexneri 2a str. 2457T
gacgccagcgcu

SEQ ID NO: 3834380 - RNA, 17 nt, Shigella flexneri 2a str. 2457T
gacgccauucacuggca

SEQ ID NO: 3834381 - RNA, 20 nt, Shigella flexneri 2a str. 2457T
gacgccauuuuuuauacacu

SEQ ID NO: 3834382 - RNA, 14 nt, Shigella flexneri 2a str. 2457T
gacgcccccaaacu

SEQ ID NO: 3834383 - RNA, 19 nt, Shigella flexneri 2a str. 2457T
gacgcccugcgcuggugaa

SEQ ID NO: 3834384 - RNA, 19 nt, Shigella flexneri 2a str. 2457T
gacgccgccggugucgcac

SEQ ID NO: 3834385 - RNA, 19 nt, Shigella flexneri 2a str. 2457T
gacgccgcgguucuuccaa

SEQ ID NO: 3834386 - RNA, 15 nt, Shigella flexneri 2a str. 2457T
gacgccuucagcgau

SEQ ID NO: 3834387 - RNA, 21 nt, Shigella flexneri 2a str. 2457T
gacgcgacaagcgucgcauca

SEQ ID NO: 3834388 - RNA, 22 nt, Shigella flexneri 2a str. 2457T
gacgcgaccaucaagggucggu

SEQ ID NO: 3834389 - RNA, 14 nt, Shigella flexneri 2a str. 2457T
gacgcgcagcgucg

SEQ ID NO: 3834390 - RNA, 18 nt, Shigella flexneri 2a str. 2457T
gacgcgcagcuucacuuc

SEQ ID NO: 3834391 - RNA, 15 nt, Shigella flexneri 2a str. 2457T
gacgcgccagcaccg

SEQ ID NO: 3834392 - RNA, 18 nt, Shigella flexneri 2a str. 2457T
gacgcgccagcgucgcau

SEQ ID NO: 3834393 - RNA, 21 nt, Shigella flexneri 2a str. 2457T
gacgcgucaagcgucgcauca

SEQ ID NO: 3834394 - RNA, 12 nt, Shigella flexneri 2a str. 2457T
gacgcgucagug

SEQ ID NO: 3834395 - RNA, 18 nt, Shigella flexneri 2a str. 2457T
gacgcgugcgccaaguuu

SEQ ID NO: 3834396 - RNA, 19 nt, Shigella flexneri 2a str. 2457T
gacgcguggagagucauca

SEQ ID NO: 3834397 - RNA, 18 nt, Shigella flexneri 2a str. 2457T
gacgcguuagugucuuau

SEQ ID NO: 3834398 - RNA, 20 nt, Shigella flexneri 2a str. 2457T
gacgcuccaguguggccaga

SEQ ID NO: 3834399 - RNA, 19 nt, Shigella flexneri 2a str. 2457T
gacgcucgccauuuuucag

SEQ ID NO: 3834400 - RNA, 22 nt, Shigella flexneri 2a str. 2457T
gacgcugaugucagcacuucca

SEQ ID NO: 3834401 - RNA, 23 nt, Shigella flexneri 2a str. 2457T
gacgcugaugucagcacuuccag

SEQ ID NO: 3834402 - RNA, 15 nt, Shigella flexneri 2a str. 2457T
gacgcugcucaaagc

SEQ ID NO: 3834403 - RNA, 16 nt, Shigella flexneri 2a str. 2457T
gacgcuggcagaaagu

SEQ ID NO: 3834404 - RNA, 15 nt, Shigella flexneri 2a str. 2457T
gacgcuggcuuugcc

SEQ ID NO: 3834405 - RNA, 19 nt, Shigella flexneri 2a str. 2457T
gacggaaaucgggagagau

SEQ ID NO: 3834406 - RNA, 20 nt, Shigella flexneri 2a str. 2457T
gacggacguccggugauauc

SEQ ID NO: 3834407 - RNA, 17 nt, Shigella flexneri 2a str. 2457T
gacggauaaggcguuca

SEQ ID NO: 3834408 - RNA, 16 nt, Shigella flexneri 2a str. 2457T
gacggcagcgaagggu

SEQ ID NO: 3834409 - RNA, 14 nt, Shigella flexneri 2a str. 2457T
gacggcaucgccau

SEQ ID NO: 3834410 - RNA, 20 nt, Shigella flexneri 2a str. 2457T
gacggccagucauugagcuu

SEQ ID NO: 3834411 - RNA, 21 nt, Shigella flexneri 2a str. 2457T
gacggccucugcggaggccgu

SEQ ID NO: 3834412 - RNA, 23 nt, Shigella flexneri 2a str. 2457T
gacggcgcucuugcggcauuucg

SEQ ID NO: 3834413 - RNA, 15 nt, Shigella flexneri 2a str. 2457T
gacggcguauugcau

SEQ ID NO: 3834414 - RNA, 13 nt, Shigella flexneri 2a str. 2457T
gacggcguucuuu

SEQ ID NO: 3834415 - RNA, 16 nt, Shigella flexneri 2a str. 2457T
gacggcuacgcucauu

SEQ ID NO: 3834416 - RNA, 22 nt, Shigella flexneri 2a str. 2457T
gacgggaaacucugcuggcgga

SEQ ID NO: 3834417 - RNA, 17 nt, Shigella flexneri 2a str. 2457T
gacgggauagcucaaug

SEQ ID NO: 3834418 - RNA, 17 nt, Shigella flexneri 2a str. 2457T
gacgggcccauaacgcc

SEQ ID NO: 3834419 - RNA, 12 nt, Shigella flexneri 2a str. 2457T
gacgggcggcuu

SEQ ID NO: 3834420 - RNA, 20 nt, Shigella flexneri 2a str. 2457T
gacgguaaaaagaaaguuug

SEQ ID NO: 3834421 - RNA, 15 nt, Shigella flexneri 2a str. 2457T
gacgguaaccccucu

SEQ ID NO: 3834422 - RNA, 21 nt, Shigella flexneri 2a str. 2457T
gacgguuuaucucaucuucca

SEQ ID NO: 3834423 - RNA, 17 nt, Shigella flexneri 2a str. 2457T
gacgguuuuacgcuccc

SEQ ID NO: 3834424 - RNA, 16 nt, Shigella flexneri 2a str. 2457T
gacguaaagaagaugu

SEQ ID NO: 3834425 - RNA, 20 nt, Shigella flexneri 2a str. 2457T
gacguaaugauguaaaaaua

SEQ ID NO: 3834426 - RNA, 18 nt, Shigella flexneri 2a str. 2457T
gacguagugaaaucgcca

SEQ ID NO: 3834427 - RNA, 18 nt, Shigella flexneri 2a str. 2457T
gacguauaaccggaugac

SEQ ID NO: 3834428 - RNA, 14 nt, Shigella flexneri 2a str. 2457T
gacgucucggcaug

SEQ ID NO: 3834429 - RNA, 19 nt, Shigella flexneri 2a str. 2457T
gacgucugccgguacuuca

SEQ ID NO: 3834430 - RNA, 20 nt, Shigella flexneri 2a str. 2457T
gacgugcaccgucacuucuu

SEQ ID NO: 3834431 - RNA, 17 nt, Shigella flexneri 2a str. 2457T
gacgugucuuaucaggc

SEQ ID NO: 3834432 - RNA, 17 nt, Shigella flexneri 2a str. 2457T
gacguuaauaaaauuua

SEQ ID NO: 3834433 - RNA, 12 nt, Shigella flexneri 2a str. 2457T
gacguucagcca

SEQ ID NO: 3834434 - RNA, 17 nt, Shigella flexneri 2a str. 2457T
gacguucaugccggucg

SEQ ID NO: 3834435 - RNA, 14 nt, Shigella flexneri 2a str. 2457T
gacguucugccaaa

SEQ ID NO: 3834436 - RNA, 14 nt, Shigella flexneri 2a str. 2457T
gacguucuuccugu

SEQ ID NO: 3834437 - RNA, 22 nt, Shigella flexneri 2a str. 2457T
gacguucuucgcugacaguacc

SEQ ID NO: 3834438 - RNA, 22 nt, Shigella flexneri 2a str. 2457T
gacguugauucacuuucugaag

SEQ ID NO: 3834439 - RNA, 22 nt, Shigella flexneri 2a str. 2457T
gacguuguuuucaugccgccgc

SEQ ID NO: 3834440 - RNA, 22 nt, Shigella flexneri 2a str. 2457T
gacguuuuagccauaaacgggc

SEQ ID NO: 3834441 - RNA, 21 nt, Shigella flexneri 2a str. 2457T
gacuaaaguuucuuuaggauu

SEQ ID NO: 3834442 - RNA, 21 nt, Shigella flexneri 2a str. 2457T
gacuaaauuucacugcuuaau

SEQ ID NO: 3834443 - RNA, 14 nt, Shigella flexneri 2a str. 2457T
gacuaacuucugau

SEQ ID NO: 3834444 - RNA, 15 nt, Shigella flexneri 2a str. 2457T
gacuaauuucucgcc

SEQ ID NO: 3834445 - RNA, 17 nt, Shigella flexneri 2a str. 2457T
gacuagcgccauaauaa

SEQ ID NO: 3834446 - RNA, 16 nt, Shigella flexneri 2a str. 2457T
gacuagugauaaccac

SEQ ID NO: 3834447 - RNA, 13 nt, Shigella flexneri 2a str. 2457T
gacuaucaucgcc

SEQ ID NO: 3834448 - RNA, 15 nt, Shigella flexneri 2a str. 2457T
gacuauccgccgcuu

SEQ ID NO: 3834449 - RNA, 20 nt, Shigella flexneri 2a str. 2457T
gacuaucgcgacgaauaggu

SEQ ID NO: 3834450 - RNA, 14 nt, Shigella flexneri 2a str. 2457T
gacuauuacucaac

SEQ ID NO: 3834451 - RNA, 20 nt, Shigella flexneri 2a str. 2457T
gacuauuaugaauuuacucu

SEQ ID NO: 3834452 - RNA, 15 nt, Shigella flexneri 2a str. 2457T
gacuauucagcucuu

SEQ ID NO: 3834453 - RNA, 13 nt, Shigella flexneri 2a str. 2457T
gacuauuugacac

SEQ ID NO: 3834454 - RNA, 19 nt, Shigella flexneri 2a str. 2457T
gacucaaaccccgcagcaa

SEQ ID NO: 3834455 - RNA, 18 nt, Shigella flexneri 2a str. 2457T
gacucaauggcauccgcc

SEQ ID NO: 3834456 - RNA, 19 nt, Shigella flexneri 2a str. 2457T
gacucagcggcugccagca

SEQ ID NO: 3834457 - RNA, 15 nt, Shigella flexneri 2a str. 2457T
gacuccaguuuguuc

SEQ ID NO: 3834458 - RNA, 23 nt, Shigella flexneri 2a str. 2457T
gacuccggaaaaacagaggcccg

SEQ ID NO: 3834459 - RNA, 21 nt, Shigella flexneri 2a str. 2457T
gacuccggaaaaacggaggcc

SEQ ID NO: 3834460 - RNA, 20 nt, Shigella flexneri 2a str. 2457T
gacuccugacuugccagaua

SEQ ID NO: 3834461 - RNA, 21 nt, Shigella flexneri 2a str. 2457T
gacuccuguaucgucacuggu

SEQ ID NO: 3834462 - RNA, 16 nt, Shigella flexneri 2a str. 2457T
gacucgccgcugugga

SEQ ID NO: 3834463 - RNA, 21 nt, Shigella flexneri 2a str. 2457T
gacucggagucgacuucagau

SEQ ID NO: 3834464 - RNA, 16 nt, Shigella flexneri 2a str. 2457T
gacucgguugcacaga

SEQ ID NO: 3834465 - RNA, 14 nt, Shigella flexneri 2a str. 2457T
gacucugaaacucg

SEQ ID NO: 3834466 - RNA, 18 nt, Shigella flexneri 2a str. 2457T
gacucuguagcgggaaag

SEQ ID NO: 3834467 - RNA, 18 nt, Shigella flexneri 2a str. 2457T
gacugaaaguacuucaca

SEQ ID NO: 3834468 - RNA, 20 nt, Shigella flexneri 2a str. 2457T
gacugaaaguacuucacaau

SEQ ID NO: 3834469 - RNA, 12 nt, Shigella flexneri 2a str. 2457T
gacugaauacgc

SEQ ID NO: 3834470 - RNA, 19 nt, Shigella flexneri 2a str. 2457T
gacugaauacgcuggcgcg

SEQ ID NO: 3834471 - RNA, 11 nt, Shigella flexneri 2a str. 2457T
gacugacuccg

SEQ ID NO: 3834472 - RNA, 14 nt, Shigella flexneri 2a str. 2457T
gacugauaucccgc

SEQ ID NO: 3834473 - RNA, 19 nt, Shigella flexneri 2a str. 2457T
gacugauaucugcccgcac

SEQ ID NO: 3834474 - RNA, 17 nt, Shigella flexneri 2a str. 2457T
gacugaugacaaacgca

SEQ ID NO: 3834475 - RNA, 20 nt, Shigella flexneri 2a str. 2457T
gacugaugugauccaucagg

SEQ ID NO: 3834476 - RNA, 21 nt, Shigella flexneri 2a str. 2457T
gacugaugugauccaucaggu

SEQ ID NO: 3834477 - RNA, 13 nt, Shigella flexneri 2a str. 2457T
gacugcaaaccau

SEQ ID NO: 3834478 - RNA, 17 nt, Shigella flexneri 2a str. 2457T
gacugcagcggucacau

SEQ ID NO: 3834479 - RNA, 15 nt, Shigella flexneri 2a str. 2457T
gacugccccaguucc

SEQ ID NO: 3834480 - RNA, 14 nt, Shigella flexneri 2a str. 2457T
gacugcccgcgagc

SEQ ID NO: 3834481 - RNA, 18 nt, Shigella flexneri 2a str. 2457T
gacugcccgcgagcgugg

SEQ ID NO: 3834482 - RNA, 18 nt, Shigella flexneri 2a str. 2457T
gacugccgcucaccugac

SEQ ID NO: 3834483 - RNA, 18 nt, Shigella flexneri 2a str. 2457T
gacugccggaugcaucgc

SEQ ID NO: 3834484 - RNA, 12 nt, Shigella flexneri 2a str. 2457T
gacugcgcccug

SEQ ID NO: 3834485 - RNA, 15 nt, Shigella flexneri 2a str. 2457T
gacugcgccgugucg

SEQ ID NO: 3834486 - RNA, 20 nt, Shigella flexneri 2a str. 2457T
gacugcggcgugggcgcugu

SEQ ID NO: 3834487 - RNA, 22 nt, Shigella flexneri 2a str. 2457T
gacugcggcgugggcgcuguug

SEQ ID NO: 3834488 - RNA, 21 nt, Shigella flexneri 2a str. 2457T
gacuggaaacucacgccagca

SEQ ID NO: 3834489 - RNA, 14 nt, Shigella flexneri 2a str. 2457T
gacuggaaaucaaa

SEQ ID NO: 3834490 - RNA, 18 nt, Shigella flexneri 2a str. 2457T
gacuggaaaucaaaaaca

SEQ ID NO: 3834491 - RNA, 18 nt, Shigella flexneri 2a str. 2457T
gacuggaauaagccaaau

SEQ ID NO: 3834492 - RNA, 22 nt, Shigella flexneri 2a str. 2457T
gacuggaauaagccaaauccag

SEQ ID NO: 3834493 - RNA, 16 nt, Shigella flexneri 2a str. 2457T
gacuggagccgcauca

SEQ ID NO: 3834494 - RNA, 19 nt, Shigella flexneri 2a str. 2457T
gacuggcaugcuguccagc

SEQ ID NO: 3834495 - RNA, 15 nt, Shigella flexneri 2a str. 2457T
gacuggcggugauug

SEQ ID NO: 3834496 - RNA, 19 nt, Shigella flexneri 2a str. 2457T
gacuguacagauccgccau

SEQ ID NO: 3834497 - RNA, 14 nt, Shigella flexneri 2a str. 2457T
gacuguaggccgga

SEQ ID NO: 3834498 - RNA, 12 nt, Shigella flexneri 2a str. 2457T
gacugucagaug

SEQ ID NO: 3834499 - RNA, 18 nt, Shigella flexneri 2a str. 2457T
gacugucagaugcggcuu

SEQ ID NO: 3834500 - RNA, 18 nt, Shigella flexneri 2a str. 2457T
gacugucgcagccagcgc

SEQ ID NO: 3834501 - RNA, 20 nt, Shigella flexneri 2a str. 2457T
gacuguuucacccgccuguu

SEQ ID NO: 3834502 - RNA, 20 nt, Shigella flexneri 2a str. 2457T
gacuuaccagcccuaauaaa

SEQ ID NO: 3834503 - RNA, 15 nt, Shigella flexneri 2a str. 2457T
gacuuauaagucuca

SEQ ID NO: 3834504 - RNA, 19 nt, Shigella flexneri 2a str. 2457T
gacuuauaagucucagaaa

SEQ ID NO: 3834505 - RNA, 14 nt, Shigella flexneri 2a str. 2457T
gacuucagauaaau

SEQ ID NO: 3834506 - RNA, 17 nt, Shigella flexneri 2a str. 2457T
gacuucaugcgcagcau

SEQ ID NO: 3834507 - RNA, 13 nt, Shigella flexneri 2a str. 2457T
gacuuccacuucc

SEQ ID NO: 3834508 - RNA, 16 nt, Shigella flexneri 2a str. 2457T
gacuuccacuuccugc

SEQ ID NO: 3834509 - RNA, 14 nt, Shigella flexneri 2a str. 2457T
gacuucccucccgu

SEQ ID NO: 3834510 - RNA, 12 nt, Shigella flexneri 2a str. 2457T
gacuuccgggau

SEQ ID NO: 3834511 - RNA, 12 nt, Shigella flexneri 2a str. 2457T
gacuucugcuuu

SEQ ID NO: 3834512 - RNA, 14 nt, Shigella flexneri 2a str. 2457T
gacuucuucauuca

SEQ ID NO: 3834513 - RNA, 23 nt, Shigella flexneri 2a str. 2457T
gacuugcucaggaguaaacuuuc

SEQ ID NO: 3834514 - RNA, 19 nt, Shigella flexneri 2a str. 2457T
gacuuuaucgcgcaaaaaa

SEQ ID NO: 3834515 - RNA, 20 nt, Shigella flexneri 2a str. 2457T
gacuuucguuugaaaacugg

SEQ ID NO: 3834516 - RNA, 20 nt, Shigella flexneri 2a str. 2457T
gacuuucuccgcauccggca

SEQ ID NO: 3834517 - RNA, 24 nt, Shigella flexneri 2a str. 2457T
gacuuucuggcacgaccuggcagc

SEQ ID NO: 3834518 - RNA, 18 nt, Shigella flexneri 2a str. 2457T
gacuuugccuggcggcag

SEQ ID NO: 3834519 - RNA, 22 nt, Shigella flexneri 2a str. 2457T
gacuuuucauaagcgucagaaa

SEQ ID NO: 3834520 - RNA, 17 nt, Shigella flexneri 2a str. 2457T
gacuuuugcccggcaug

SEQ ID NO: 3834521 - RNA, 23 nt, Shigella flexneri 2a str. 2457T
gacuuuuuccaguccacguucaa

SEQ ID NO: 3834522 - RNA, 14 nt, Shigella flexneri 2a str. 2457T
gagaaaaagcgaag

SEQ ID NO: 3834523 - RNA, 11 nt, Shigella flexneri 2a str. 2457T
gagaaaaauag

SEQ ID NO: 3834524 - RNA, 21 nt, Shigella flexneri 2a str. 2457T
gagaaaaccgaugcagugcgg

SEQ ID NO: 3834525 - RNA, 18 nt, Shigella flexneri 2a str. 2457T
gagaaaccacaucaaucc

SEQ ID NO: 3834526 - RNA, 16 nt, Shigella flexneri 2a str. 2457T
gagaaagcaaaaauaa

SEQ ID NO: 3834527 - RNA, 23 nt, Shigella flexneri 2a str. 2457T
gagaaaguaaaccaccaguccuu

SEQ ID NO: 3834528 - RNA, 18 nt, Shigella flexneri 2a str. 2457T
gagaaagucguaggccug

SEQ ID NO: 3834529 - RNA, 16 nt, Shigella flexneri 2a str. 2457T
gagaacaccaccugcc

SEQ ID NO: 3834530 - RNA, 22 nt, Shigella flexneri 2a str. 2457T
gagaacaccaccugccagagcu

SEQ ID NO: 3834531 - RNA, 11 nt, Shigella flexneri 2a str. 2457T
gagaacagaua

SEQ ID NO: 3834532 - RNA, 18 nt, Shigella flexneri 2a str. 2457T
gagaacaucaauccaaac

SEQ ID NO: 3834533 - RNA, 18 nt, Shigella flexneri 2a str. 2457T
gagaaccacaaugaagaa

SEQ ID NO: 3834534 - RNA, 20 nt, Shigella flexneri 2a str. 2457T
gagaacgaccaucagcugcc

SEQ ID NO: 3834535 - RNA, 15 nt, Shigella flexneri 2a str. 2457T
gagaagaccgccgcu

SEQ ID NO: 3834536 - RNA, 17 nt, Shigella flexneri 2a str. 2457T
gagaagccaccgcgcca

SEQ ID NO: 3834537 - RNA, 18 nt, Shigella flexneri 2a str. 2457T
gagaagguugccauaucu

SEQ ID NO: 3834538 - RNA, 13 nt, Shigella flexneri 2a str. 2457T
gagaaucacgucg

SEQ ID NO: 3834539 - RNA, 14 nt, Shigella flexneri 2a str. 2457T
gagaaucagcgaga

SEQ ID NO: 3834540 - RNA, 16 nt, Shigella flexneri 2a str. 2457T
gagaauuccggcagag

SEQ ID NO: 3834541 - RNA, 18 nt, Shigella flexneri 2a str. 2457T
gagacaacaacaucagcg

SEQ ID NO: 3834542 - RNA, 14 nt, Shigella flexneri 2a str. 2457T
gagacaaucgccac

SEQ ID NO: 3834543 - RNA, 21 nt, Shigella flexneri 2a str. 2457T
gagacauuccuuuacuuagaa

SEQ ID NO: 3834544 - RNA, 12 nt, Shigella flexneri 2a str. 2457T
gagacgcgcuug

SEQ ID NO: 3834545 - RNA, 21 nt, Shigella flexneri 2a str. 2457T
gagacgguuaaaaacagccag

SEQ ID NO: 3834546 - RNA, 22 nt, Shigella flexneri 2a str. 2457T
gagacgguuauauuuacaaauc

SEQ ID NO: 3834547 - RNA, 14 nt, Shigella flexneri 2a str. 2457T
gagacucaaacccc

SEQ ID NO: 3834548 - RNA, 13 nt, Shigella flexneri 2a str. 2457T
gagagaagaaacg

SEQ ID NO: 3834549 - RNA, 19 nt, Shigella flexneri 2a str. 2457T
gagagccggacugacauua

SEQ ID NO: 3834550 - RNA, 15 nt, Shigella flexneri 2a str. 2457T
gagagcgccagaagu

SEQ ID NO: 3834551 - RNA, 19 nt, Shigella flexneri 2a str. 2457T
gagaggguuagggugaggg

SEQ ID NO: 3834552 - RNA, 17 nt, Shigella flexneri 2a str. 2457T
gagagguaaaaccugac

SEQ ID NO: 3834553 - RNA, 22 nt, Shigella flexneri 2a str. 2457T
gagagguaaaaccugacaacaa

SEQ ID NO: 3834554 - RNA, 19 nt, Shigella flexneri 2a str. 2457T
gagagugacgucauagcag

SEQ ID NO: 3834555 - RNA, 21 nt, Shigella flexneri 2a str. 2457T
gagagugauuaacuguucuga

SEQ ID NO: 3834556 - RNA, 17 nt, Shigella flexneri 2a str. 2457T
gagauaaccacguucau

SEQ ID NO: 3834557 - RNA, 22 nt, Shigella flexneri 2a str. 2457T
gagauaaccacguucauuucau

SEQ ID NO: 3834558 - RNA, 17 nt, Shigella flexneri 2a str. 2457T
gagauacaucaccgcca

SEQ ID NO: 3834559 - RNA, 14 nt, Shigella flexneri 2a str. 2457T
gagauacucaagca

SEQ ID NO: 3834560 - RNA, 14 nt, Shigella flexneri 2a str. 2457T
gagauaucgccagg

SEQ ID NO: 3834561 - RNA, 15 nt, Shigella flexneri 2a str. 2457T
gagauauuccccaga

SEQ ID NO: 3834562 - RNA, 15 nt, Shigella flexneri 2a str. 2457T
gagaucacgccacaa

SEQ ID NO: 3834563 - RNA, 21 nt, Shigella flexneri 2a str. 2457T
gagaucauuauuaaacagaca

SEQ ID NO: 3834564 - RNA, 16 nt, Shigella flexneri 2a str. 2457T
gagaucgagcgccguu

SEQ ID NO: 3834565 - RNA, 21 nt, Shigella flexneri 2a str. 2457T
gagaucuuuaucaaucaccgc

SEQ ID NO: 3834566 - RNA, 23 nt, Shigella flexneri 2a str. 2457T
gagaucuuuaucaaucaccgcuu

SEQ ID NO: 3834567 - RNA, 18 nt, Shigella flexneri 2a str. 2457T
gagaugcggaaauaucgg

SEQ ID NO: 3834568 - RNA, 16 nt, Shigella flexneri 2a str. 2457T
gagauguccccugcgg

SEQ ID NO: 3834569 - RNA, 13 nt, Shigella flexneri 2a str. 2457T
gagauguugcaaa

SEQ ID NO: 3834570 - RNA, 21 nt, Shigella flexneri 2a str. 2457T
gagauuacuuuauuuauauca

SEQ ID NO: 3834571 - RNA, 16 nt, Shigella flexneri 2a str. 2457T
gagauuugcuccagcg

SEQ ID NO: 3834572 - RNA, 22 nt, Shigella flexneri 2a str. 2457T
gagauuuuacccaugacuuuga

SEQ ID NO: 3834573 - RNA, 19 nt, Shigella flexneri 2a str. 2457T
gagcaaacaguucugcagc

SEQ ID NO: 3834574 - RNA, 16 nt, Shigella flexneri 2a str. 2457T
gagcaaaccacaggcc

SEQ ID NO: 3834575 - RNA, 16 nt, Shigella flexneri 2a str. 2457T
gagcaaccugcacguu

SEQ ID NO: 3834576 - RNA, 23 nt, Shigella flexneri 2a str. 2457T
gagcaauaaaaacuccgccgcau

SEQ ID NO: 3834577 - RNA, 21 nt, Shigella flexneri 2a str. 2457T
gagcaauagacaguucuuccu

SEQ ID NO: 3834578 - RNA, 10 nt, Shigella flexneri 2a str. 2457T
gagcaaugau

SEQ ID NO: 3834579 - RNA, 19 nt, Shigella flexneri 2a str. 2457T
gagcaauguaaggugcauc

SEQ ID NO: 3834580 - RNA, 14 nt, Shigella flexneri 2a str. 2457T
gagcacaugcagug

SEQ ID NO: 3834581 - RNA, 21 nt, Shigella flexneri 2a str. 2457T
gagcaccgcgugcgcggcagc

SEQ ID NO: 3834582 - RNA, 16 nt, Shigella flexneri 2a str. 2457T
gagcaccuuuuuucug

SEQ ID NO: 3834583 - RNA, 22 nt, Shigella flexneri 2a str. 2457T
gagcacgacuuucucuucaucu

SEQ ID NO: 3834584 - RNA, 17 nt, Shigella flexneri 2a str. 2457T
gagcacggcaucccaac

SEQ ID NO: 3834585 - RNA, 20 nt, Shigella flexneri 2a str. 2457T
gagcacugcgcccgccagca

SEQ ID NO: 3834586 - RNA, 21 nt, Shigella flexneri 2a str. 2457T
gagcagagaaacgccagcagc

SEQ ID NO: 3834587 - RNA, 17 nt, Shigella flexneri 2a str. 2457T
gagcagauacugaugaa

SEQ ID NO: 3834588 - RNA, 13 nt, Shigella flexneri 2a str. 2457T
gagcagcacaaug

SEQ ID NO: 3834589 - RNA, 16 nt, Shigella flexneri 2a str. 2457T
gagcagcacgcaguga

SEQ ID NO: 3834590 - RNA, 17 nt, Shigella flexneri 2a str. 2457T
gagcagcauuaccugcc

SEQ ID NO: 3834591 - RNA, 18 nt, Shigella flexneri 2a str. 2457T
gagcagccaccacuugca

SEQ ID NO: 3834592 - RNA, 13 nt, Shigella flexneri 2a str. 2457T
gagcaggccgggu

SEQ ID NO: 3834593 - RNA, 15 nt, Shigella flexneri 2a str. 2457T
gagcaguagcgucgc

SEQ ID NO: 3834594 - RNA, 15 nt, Shigella flexneri 2a str. 2457T
gagcauaggcauuaa

SEQ ID NO: 3834595 - RNA, 23 nt, Shigella flexneri 2a str. 2457T
gagcauaucgacgaaccauuucg

SEQ ID NO: 3834596 - RNA, 18 nt, Shigella flexneri 2a str. 2457T
gagcaucaguuaacggca

SEQ ID NO: 3834597 - RNA, 18 nt, Shigella flexneri 2a str. 2457T
gagcaucgcccaggcgac

SEQ ID NO: 3834598 - RNA, 17 nt, Shigella flexneri 2a str. 2457T
gagcaucgguaucuucc

SEQ ID NO: 3834599 - RNA, 15 nt, Shigella flexneri 2a str. 2457T
gagcaucugcaaaau

SEQ ID NO: 3834600 - RNA, 16 nt, Shigella flexneri 2a str. 2457T
gagcaugaugccugau

SEQ ID NO: 3834601 - RNA, 21 nt, Shigella flexneri 2a str. 2457T
gagcauggcuggaaugcaacu

SEQ ID NO: 3834602 - RNA, 22 nt, Shigella flexneri 2a str. 2457T
gagcaugguaacgccccacaaa

SEQ ID NO: 3834603 - RNA, 22 nt, Shigella flexneri 2a str. 2457T
gagcauuacuuucggugacuuc

SEQ ID NO: 3834604 - RNA, 16 nt, Shigella flexneri 2a str. 2457T
gagccagccccacagc

SEQ ID NO: 3834605 - RNA, 15 nt, Shigella flexneri 2a str. 2457T
gagccagcuucccaa

SEQ ID NO: 3834606 - RNA, 22 nt, Shigella flexneri 2a str. 2457T
gagccaguuggcguaccauuaa

SEQ ID NO: 3834607 - RNA, 14 nt, Shigella flexneri 2a str. 2457T
gagcccagaugccg

SEQ ID NO: 3834608 - RNA, 22 nt, Shigella flexneri 2a str. 2457T
gagccgaaauauggcgcugcgg

SEQ ID NO: 3834609 - RNA, 23 nt, Shigella flexneri 2a str. 2457T
gagccgaaauauggcgcugcggc

SEQ ID NO: 3834610 - RNA, 15 nt, Shigella flexneri 2a str. 2457T
gagccgauauccgga

SEQ ID NO: 3834611 - RNA, 12 nt, Shigella flexneri 2a str. 2457T
gagccgcaguaa

SEQ ID NO: 3834612 - RNA, 17 nt, Shigella flexneri 2a str. 2457T
gagccggaugccucucc

SEQ ID NO: 3834613 - RNA, 18 nt, Shigella flexneri 2a str. 2457T
gagccggauggcauacca

SEQ ID NO: 3834614 - RNA, 19 nt, Shigella flexneri 2a str. 2457T
gagccugaauaaacgccau

SEQ ID NO: 3834615 - RNA, 19 nt, Shigella flexneri 2a str. 2457T
gagcgaauaaaaaaagaaa

SEQ ID NO: 3834616 - RNA, 15 nt, Shigella flexneri 2a str. 2457T
gagcgagggagaaaa

SEQ ID NO: 3834617 - RNA, 16 nt, Shigella flexneri 2a str. 2457T
gagcgcaaauugcugg

SEQ ID NO: 3834618 - RNA, 16 nt, Shigella flexneri 2a str. 2457T
gagcgccagcauggca

SEQ ID NO: 3834619 - RNA, 16 nt, Shigella flexneri 2a str. 2457T
gagcgccagccauuca

SEQ ID NO: 3834620 - RNA, 22 nt, Shigella flexneri 2a str. 2457T
gagcgccauuucuucuccggca

SEQ ID NO: 3834621 - RNA, 17 nt, Shigella flexneri 2a str. 2457T
gagcgccccagaccuga

SEQ ID NO: 3834622 - RNA, 19 nt, Shigella flexneri 2a str. 2457T
gagcgccguugcgcccauc

SEQ ID NO: 3834623 - RNA, 22 nt, Shigella flexneri 2a str. 2457T
gagcgcuggugacaucgccaga

SEQ ID NO: 3834624 - RNA, 22 nt, Shigella flexneri 2a str. 2457T
gagcgcuuuuuuccugccgcua

SEQ ID NO: 3834625 - RNA, 22 nt, Shigella flexneri 2a str. 2457T
gagcggggaacaccucuggcga

SEQ ID NO: 3834626 - RNA, 23 nt, Shigella flexneri 2a str. 2457T
gagcgguaaagaacugagcgccg

SEQ ID NO: 3834627 - RNA, 19 nt, Shigella flexneri 2a str. 2457T
gagcguauccagcauaccu

SEQ ID NO: 3834628 - RNA, 18 nt, Shigella flexneri 2a str. 2457T
gagcgucauauagccgcc

SEQ ID NO: 3834629 - RNA, 23 nt, Shigella flexneri 2a str. 2457T
gagcgucauauagccgccuuguu

SEQ ID NO: 3834630 - RNA, 19 nt, Shigella flexneri 2a str. 2457T
gagcguuacccgcagccau

SEQ ID NO: 3834631 - RNA, 16 nt, Shigella flexneri 2a str. 2457T
gagcuacaaagauuug

SEQ ID NO: 3834632 - RNA, 20 nt, Shigella flexneri 2a str. 2457T
gagcuauaccaugccguucu

SEQ ID NO: 3834633 - RNA, 22 nt, Shigella flexneri 2a str. 2457T
gagcugauacgggaggucauca

SEQ ID NO: 3834634 - RNA, 14 nt, Shigella flexneri 2a str. 2457T
gagcugauuuccgg

SEQ ID NO: 3834635 - RNA, 23 nt, Shigella flexneri 2a str. 2457T
gagcugucgacuaaccugagagu

SEQ ID NO: 3834636 - RNA, 18 nt, Shigella flexneri 2a str. 2457T
gagcuucacccgcagcac

SEQ ID NO: 3834637 - RNA, 14 nt, Shigella flexneri 2a str. 2457T
gagcuucggcggcg

SEQ ID NO: 3834638 - RNA, 15 nt, Shigella flexneri 2a str. 2457T
gagcuugauccuaca

SEQ ID NO: 3834639 - RNA, 16 nt, Shigella flexneri 2a str. 2457T
gaggaacccagugaua

SEQ ID NO: 3834640 - RNA, 15 nt, Shigella flexneri 2a str. 2457T
gaggacagcuaucgc

SEQ ID NO: 3834641 - RNA, 23 nt, Shigella flexneri 2a str. 2457T
gaggagagugcaaugaaaaaccg

SEQ ID NO: 3834642 - RNA, 22 nt, Shigella flexneri 2a str. 2457T
gaggagcugcacgaugacugaa

SEQ ID NO: 3834643 - RNA, 18 nt, Shigella flexneri 2a str. 2457T
gaggauaugcaucaugaa

SEQ ID NO: 3834644 - RNA, 14 nt, Shigella flexneri 2a str. 2457T
gaggaugcggguca

SEQ ID NO: 3834645 - RNA, 16 nt, Shigella flexneri 2a str. 2457T
gaggcaaccagcacgc

SEQ ID NO: 3834646 - RNA, 16 nt, Shigella flexneri 2a str. 2457T
gaggcaauaguucugu

SEQ ID NO: 3834647 - RNA, 15 nt, Shigella flexneri 2a str. 2457T
gaggcagcaaggaaa

SEQ ID NO: 3834648 - RNA, 17 nt, Shigella flexneri 2a str. 2457T
gaggcagcaaggaaaac

SEQ ID NO: 3834649 - RNA, 17 nt, Shigella flexneri 2a str. 2457T
gaggcauuggcaaauuu

SEQ ID NO: 3834650 - RNA, 13 nt, Shigella flexneri 2a str. 2457T
gaggccaaaacca

SEQ ID NO: 3834651 - RNA, 21 nt, Shigella flexneri 2a str. 2457T
gaggccaaaaccacagugacc

SEQ ID NO: 3834652 - RNA, 20 nt, Shigella flexneri 2a str. 2457T
gaggccgcggcucaggcgca

SEQ ID NO: 3834653 - RNA, 20 nt, Shigella flexneri 2a str. 2457T
gaggccuucgccugaugaua

SEQ ID NO: 3834654 - RNA, 22 nt, Shigella flexneri 2a str. 2457T
gaggcgcuggcgcauguuggcg

SEQ ID NO: 3834655 - RNA, 18 nt, Shigella flexneri 2a str. 2457T
gaggcuagcggcuuuuua

SEQ ID NO: 3834656 - RNA, 17 nt, Shigella flexneri 2a str. 2457T
gaggcuuauccggcaug

SEQ ID NO: 3834657 - RNA, 23 nt, Shigella flexneri 2a str. 2457T
gaggcuuuaauaccugccuggua

SEQ ID NO: 3834658 - RNA, 14 nt, Shigella flexneri 2a str. 2457T
gagggaauccagca

SEQ ID NO: 3834659 - RNA, 18 nt, Shigella flexneri 2a str. 2457T
gagggaauccagcaauaa

SEQ ID NO: 3834660 - RNA, 17 nt, Shigella flexneri 2a str. 2457T
gagggcaaacaggcgcu

SEQ ID NO: 3834661 - RNA, 19 nt, Shigella flexneri 2a str. 2457T
gaggggcugacgcaacugg

SEQ ID NO: 3834662 - RNA, 19 nt, Shigella flexneri 2a str. 2457T
gagguacaaccgcaaaggu

SEQ ID NO: 3834663 - RNA, 18 nt, Shigella flexneri 2a str. 2457T
gagguacgcuccagcagg

SEQ ID NO: 3834664 - RNA, 20 nt, Shigella flexneri 2a str. 2457T
gagguuggcucaucaagcac

SEQ ID NO: 3834665 - RNA, 17 nt, Shigella flexneri 2a str. 2457T
gaguaaaaaaacaucau

SEQ ID NO: 3834666 - RNA, 13 nt, Shigella flexneri 2a str. 2457T
gaguaaaaagcag

SEQ ID NO: 3834667 - RNA, 15 nt, Shigella flexneri 2a str. 2457T
gaguaaaaauauuuc

SEQ ID NO: 3834668 - RNA, 19 nt, Shigella flexneri 2a str. 2457T
gaguaaaauaacagcggca

SEQ ID NO: 3834669 - RNA, 15 nt, Shigella flexneri 2a str. 2457T
gaguaaacggcagag

SEQ ID NO: 3834670 - RNA, 23 nt, Shigella flexneri 2a str. 2457T
gaguaaagcccgccaucgcccau

SEQ ID NO: 3834671 - RNA, 12 nt, Shigella flexneri 2a str. 2457T
gaguaaucacau

SEQ ID NO: 3834672 - RNA, 12 nt, Shigella flexneri 2a str. 2457T
gaguaucugcug

SEQ ID NO: 3834673 - RNA, 17 nt, Shigella flexneri 2a str. 2457T
gaguaugcgcgucagag

SEQ ID NO: 3834674 - RNA, 19 nt, Shigella flexneri 2a str. 2457T
gaguauguuaccugugaau

SEQ ID NO: 3834675 - RNA, 17 nt, Shigella flexneri 2a str. 2457T
gaguauucuugcugaua

SEQ ID NO: 3834676 - RNA, 19 nt, Shigella flexneri 2a str. 2457T
gagucaauuucugcaaaau

SEQ ID NO: 3834677 - RNA, 19 nt, Shigella flexneri 2a str. 2457T
gagucacucgacagcaccg

SEQ ID NO: 3834678 - RNA, 22 nt, Shigella flexneri 2a str. 2457T
gagucauucuccagaucuuccg

SEQ ID NO: 3834679 - RNA, 16 nt, Shigella flexneri 2a str. 2457T
gaguccuuccagguca

SEQ ID NO: 3834680 - RNA, 14 nt, Shigella flexneri 2a str. 2457T
gagucggaccauca

SEQ ID NO: 3834681 - RNA, 22 nt, Shigella flexneri 2a str. 2457T
gagucgucgauaucgaugacgc

SEQ ID NO: 3834682 - RNA, 12 nt, Shigella flexneri 2a str. 2457T
gagucuugcugg

SEQ ID NO: 3834683 - RNA, 13 nt, Shigella flexneri 2a str. 2457T
gagugaaaaugcc

SEQ ID NO: 3834684 - RNA, 11 nt, Shigella flexneri 2a str. 2457T
gagugaacacg

SEQ ID NO: 3834685 - RNA, 19 nt, Shigella flexneri 2a str. 2457T
gagugacaguucaaucucc

SEQ ID NO: 3834686 - RNA, 19 nt, Shigella flexneri 2a str. 2457T
gagugaccgccaauaaccg

SEQ ID NO: 3834687 - RNA, 22 nt, Shigella flexneri 2a str. 2457T
gagugacgucauagcaguaccu

SEQ ID NO: 3834688 - RNA, 23 nt, Shigella flexneri 2a str. 2457T
gagugauacguaaaccacugaca

SEQ ID NO: 3834689 - RNA, 19 nt, Shigella flexneri 2a str. 2457T
gagugccgaagaacauaaa

SEQ ID NO: 3834690 - RNA, 20 nt, Shigella flexneri 2a str. 2457T
gagugccuugcugaccgcca

SEQ ID NO: 3834691 - RNA, 21 nt, Shigella flexneri 2a str. 2457T
gagugcguucaccgaagacgu

SEQ ID NO: 3834692 - RNA, 22 nt, Shigella flexneri 2a str. 2457T
gagugcucaaccguaggccgga

SEQ ID NO: 3834693 - RNA, 20 nt, Shigella flexneri 2a str. 2457T
gaguggugaaaaaaaggcga

SEQ ID NO: 3834694 - RNA, 18 nt, Shigella flexneri 2a str. 2457T
gagugguuagagcacaga

SEQ ID NO: 3834695 - RNA, 20 nt, Shigella flexneri 2a str. 2457T
gaguguuauaaaacgcgccc

SEQ ID NO: 3834696 - RNA, 13 nt, Shigella flexneri 2a str. 2457T
gaguguuccucug

SEQ ID NO: 3834697 - RNA, 19 nt, Shigella flexneri 2a str. 2457T
gaguuaaauuaauaaucac

SEQ ID NO: 3834698 - RNA, 15 nt, Shigella flexneri 2a str. 2457T
gaguuaagcaaaaaa

SEQ ID NO: 3834699 - RNA, 18 nt, Shigella flexneri 2a str. 2457T
gaguucaauuggccugau

SEQ ID NO: 3834700 - RNA, 16 nt, Shigella flexneri 2a str. 2457T
gaguucaggcgcugca

SEQ ID NO: 3834701 - RNA, 23 nt, Shigella flexneri 2a str. 2457T
gaguuccaacgcagcacguaauu

SEQ ID NO: 3834702 - RNA, 23 nt, Shigella flexneri 2a str. 2457T
gaguuccuggaugacccggaacu

SEQ ID NO: 3834703 - RNA, 21 nt, Shigella flexneri 2a str. 2457T
gaguucgucaacacgguugga

SEQ ID NO: 3834704 - RNA, 21 nt, Shigella flexneri 2a str. 2457T
gaguugagcaguccccacauc

SEQ ID NO: 3834705 - RNA, 12 nt, Shigella flexneri 2a str. 2457T
gaguugcagauu

SEQ ID NO: 3834706 - RNA, 19 nt, Shigella flexneri 2a str. 2457T
gaguugcuccacugcucac

SEQ ID NO: 3834707 - RNA, 16 nt, Shigella flexneri 2a str. 2457T
gaguuggggccagcau

SEQ ID NO: 3834708 - RNA, 12 nt, Shigella flexneri 2a str. 2457T
gaguuguaugcg

SEQ ID NO: 3834709 - RNA, 15 nt, Shigella flexneri 2a str. 2457T
gaguuuggugccacg

SEQ ID NO: 3834710 - RNA, 15 nt, Shigella flexneri 2a str. 2457T
gaguuuuaaacgcag

SEQ ID NO: 3834711 - RNA, 12 nt, Shigella flexneri 2a str. 2457T
gauaaaaaaccc

SEQ ID NO: 3834712 - RNA, 19 nt, Shigella flexneri 2a str. 2457T
gauaaaaaagggugcugca

SEQ ID NO: 3834713 - RNA, 14 nt, Shigella flexneri 2a str. 2457T
gauaaaaaguuuuu

SEQ ID NO: 3834714 - RNA, 21 nt, Shigella flexneri 2a str. 2457T
gauaaaaauaccgagcagcca

SEQ ID NO: 3834715 - RNA, 21 nt, Shigella flexneri 2a str. 2457T
gauaaaacucucaucuuugaa

SEQ ID NO: 3834716 - RNA, 16 nt, Shigella flexneri 2a str. 2457T
gauaaaacuucccgug

SEQ ID NO: 3834717 - RNA, 15 nt, Shigella flexneri 2a str. 2457T
gauaaacaguuucgc

SEQ ID NO: 3834718 - RNA, 20 nt, Shigella flexneri 2a str. 2457T
gauaaacaucgggacaugau

SEQ ID NO: 3834719 - RNA, 17 nt, Shigella flexneri 2a str. 2457T
gauaaaccuccagcauc

SEQ ID NO: 3834720 - RNA, 19 nt, Shigella flexneri 2a str. 2457T
gauaaaccuccagcaucag

SEQ ID NO: 3834721 - RNA, 17 nt, Shigella flexneri 2a str. 2457T
gauaaacggcaggagau

SEQ ID NO: 3834722 - RNA, 21 nt, Shigella flexneri 2a str. 2457T
gauaaacguauaguggaauug

SEQ ID NO: 3834723 - RNA, 17 nt, Shigella flexneri 2a str. 2457T
gauaaacucaaucaggc

SEQ ID NO: 3834724 - RNA, 14 nt, Shigella flexneri 2a str. 2457T
gauaaacuccugca

SEQ ID NO: 3834725 - RNA, 19 nt, Shigella flexneri 2a str. 2457T
gauaaagcccccgcaacau

SEQ ID NO: 3834726 - RNA, 16 nt, Shigella flexneri 2a str. 2457T
gauaaaggucaucaca

SEQ ID NO: 3834727 - RNA, 12 nt, Shigella flexneri 2a str. 2457T
gauaaauauuau

SEQ ID NO: 3834728 - RNA, 15 nt, Shigella flexneri 2a str. 2457T
gauaaauccaucggg

SEQ ID NO: 3834729 - RNA, 22 nt, Shigella flexneri 2a str. 2457T
gauaaaucccgccgcuucacca

SEQ ID NO: 3834730 - RNA, 15 nt, Shigella flexneri 2a str. 2457T
gauaaaucuccauuu

SEQ ID NO: 3834731 - RNA, 17 nt, Shigella flexneri 2a str. 2457T
gauaaauuacugccgcu

SEQ ID NO: 3834732 - RNA, 19 nt, Shigella flexneri 2a str. 2457T
gauaaccacguucauuuca

SEQ ID NO: 3834733 - RNA, 19 nt, Shigella flexneri 2a str. 2457T
gauaaccaucuucuucacu

SEQ ID NO: 3834734 - RNA, 15 nt, Shigella flexneri 2a str. 2457T
gauaaccgcaccuuc

SEQ ID NO: 3834735 - RNA, 17 nt, Shigella flexneri 2a str. 2457T
gauaaccuuccagcuuc

SEQ ID NO: 3834736 - RNA, 21 nt, Shigella flexneri 2a str. 2457T
gauaaccuucuucauuaugaa

SEQ ID NO: 3834737 - RNA, 16 nt, Shigella flexneri 2a str. 2457T
gauaacgcggcagcag

SEQ ID NO: 3834738 - RNA, 22 nt, Shigella flexneri 2a str. 2457T
gauaacguacugggcggcaaaa

SEQ ID NO: 3834739 - RNA, 16 nt, Shigella flexneri 2a str. 2457T
gauaacguuauauccc

SEQ ID NO: 3834740 - RNA, 22 nt, Shigella flexneri 2a str. 2457T
gauaacuauggucggucaggag

SEQ ID NO: 3834741 - RNA, 21 nt, Shigella flexneri 2a str. 2457T
gauaacucaaaaauaaucauc

SEQ ID NO: 3834742 - RNA, 19 nt, Shigella flexneri 2a str. 2457T
gauaagacgcgccagcguc

SEQ ID NO: 3834743 - RNA, 14 nt, Shigella flexneri 2a str. 2457T
gauaagacgcguca

SEQ ID NO: 3834744 - RNA, 17 nt, Shigella flexneri 2a str. 2457T
gauaagaugcgccagca

SEQ ID NO: 3834745 - RNA, 15 nt, Shigella flexneri 2a str. 2457T
gauaagccccaguuc

SEQ ID NO: 3834746 - RNA, 13 nt, Shigella flexneri 2a str. 2457T
gauaagcgaacau

SEQ ID NO: 3834747 - RNA, 20 nt, Shigella flexneri 2a str. 2457T
gauaagcguagcgcaucagg

SEQ ID NO: 3834748 - RNA, 17 nt, Shigella flexneri 2a str. 2457T
gauaaggaauucacgcc

SEQ ID NO: 3834749 - RNA, 23 nt, Shigella flexneri 2a str. 2457T
gauaagguaucgcgaaaaaaaga

SEQ ID NO: 3834750 - RNA, 19 nt, Shigella flexneri 2a str. 2457T
gauaaggugccaauccuuc

SEQ ID NO: 3834751 - RNA, 22 nt, Shigella flexneri 2a str. 2457T
gauaagugagcgauucaaauuc

SEQ ID NO: 3834752 - RNA, 21 nt, Shigella flexneri 2a str. 2457T
gauaauauugaugcacaccau

SEQ ID NO: 3834753 - RNA, 23 nt, Shigella flexneri 2a str. 2457T
gauaauauugaugcacaccaucg

SEQ ID NO: 3834754 - RNA, 22 nt, Shigella flexneri 2a str. 2457T
gauaauauuuuugcguccuggc

SEQ ID NO: 3834755 - RNA, 16 nt, Shigella flexneri 2a str. 2457T
gauaaucaacaaacca

SEQ ID NO: 3834756 - RNA, 16 nt, Shigella flexneri 2a str. 2457T
gauaaucaacgcgccg

SEQ ID NO: 3834757 - RNA, 23 nt, Shigella flexneri 2a str. 2457T
gauaaucaaugacacguuuauua

SEQ ID NO: 3834758 - RNA, 23 nt, Shigella flexneri 2a str. 2457T
gauaaucaucccacaugaauucg

SEQ ID NO: 3834759 - RNA, 12 nt, Shigella flexneri 2a str. 2457T
gauaauccacgc

SEQ ID NO: 3834760 - RNA, 13 nt, Shigella flexneri 2a str. 2457T
gauaauccaggac

SEQ ID NO: 3834761 - RNA, 18 nt, Shigella flexneri 2a str. 2457T
gauaauccaggacauauc

SEQ ID NO: 3834762 - RNA, 18 nt, Shigella flexneri 2a str. 2457T
gauaauccaucacuucau

SEQ ID NO: 3834763 - RNA, 11 nt, Shigella flexneri 2a str. 2457T
gauaaucucaa

SEQ ID NO: 3834764 - RNA, 14 nt, Shigella flexneri 2a str. 2457T
gauaaugcccagca

SEQ ID NO: 3834765 - RNA, 22 nt, Shigella flexneri 2a str. 2457T
gauaaugccguuuggcaaauac

SEQ ID NO: 3834766 - RNA, 12 nt, Shigella flexneri 2a str. 2457T
gauaauggcugu

SEQ ID NO: 3834767 - RNA, 13 nt, Shigella flexneri 2a str. 2457T
gauaauggcuguu

SEQ ID NO: 3834768 - RNA, 20 nt, Shigella flexneri 2a str. 2457T
gauaauggcuguugaaugcc

SEQ ID NO: 3834769 - RNA, 17 nt, Shigella flexneri 2a str. 2457T
gauaauuaaucuuucua

SEQ ID NO: 3834770 - RNA, 21 nt, Shigella flexneri 2a str. 2457T
gauaauuaugccgaucaucau

SEQ ID NO: 3834771 - RNA, 18 nt, Shigella flexneri 2a str. 2457T
gauaauucagcagggcga

SEQ ID NO: 3834772 - RNA, 15 nt, Shigella flexneri 2a str. 2457T
gauaauuuucagcgu

SEQ ID NO: 3834773 - RNA, 15 nt, Shigella flexneri 2a str. 2457T
gauacagaagcaccg

SEQ ID NO: 3834774 - RNA, 15 nt, Shigella flexneri 2a str. 2457T
gauacagccaaauca

SEQ ID NO: 3834775 - RNA, 17 nt, Shigella flexneri 2a str. 2457T
gauacagcucaugggcu

SEQ ID NO: 3834776 - RNA, 15 nt, Shigella flexneri 2a str. 2457T
gauacaguuuuugcg

SEQ ID NO: 3834777 - RNA, 16 nt, Shigella flexneri 2a str. 2457T
gauaccaccagugcca

SEQ ID NO: 3834778 - RNA, 17 nt, Shigella flexneri 2a str. 2457T
gauaccacccgcaguga

SEQ ID NO: 3834779 - RNA, 16 nt, Shigella flexneri 2a str. 2457T
gauaccgaacauacca

SEQ ID NO: 3834780 - RNA, 22 nt, Shigella flexneri 2a str. 2457T
gauaccgcacgcucaaagacgc

SEQ ID NO: 3834781 - RNA, 13 nt, Shigella flexneri 2a str. 2457T
gauaccuaacauu

SEQ ID NO: 3834782 - RNA, 19 nt, Shigella flexneri 2a str. 2457T
gauacgaccguuccauuca

SEQ ID NO: 3834783 - RNA, 19 nt, Shigella flexneri 2a str. 2457T
gauacgauguuguagcauc

SEQ ID NO: 3834784 - RNA, 12 nt, Shigella flexneri 2a str. 2457T
gauacgcaguac

SEQ ID NO: 3834785 - RNA, 15 nt, Shigella flexneri 2a str. 2457T
gauacgcccuggaua

SEQ ID NO: 3834786 - RNA, 19 nt, Shigella flexneri 2a str. 2457T
gauacgcugcacaauugcc

SEQ ID NO: 3834787 - RNA, 17 nt, Shigella flexneri 2a str. 2457T
gauacgcuugccggaca

SEQ ID NO: 3834788 - RNA, 20 nt, Shigella flexneri 2a str. 2457T
gauacggaauaucgcuggcc

SEQ ID NO: 3834789 - RNA, 18 nt, Shigella flexneri 2a str. 2457T
gauacggcgcaucuguuu

SEQ ID NO: 3834790 - RNA, 18 nt, Shigella flexneri 2a str. 2457T
gauacguaauucaucguc

SEQ ID NO: 3834791 - RNA, 14 nt, Shigella flexneri 2a str. 2457T
gauacguugccgua

SEQ ID NO: 3834792 - RNA, 15 nt, Shigella flexneri 2a str. 2457T
gauacguugccguau

SEQ ID NO: 3834793 - RNA, 18 nt, Shigella flexneri 2a str. 2457T
gauacuacguucaaucac

SEQ ID NO: 3834794 - RNA, 19 nt, Shigella flexneri 2a str. 2457T
gauacucaagcagccaggu

SEQ ID NO: 3834795 - RNA, 13 nt, Shigella flexneri 2a str. 2457T
gauacucugccau

SEQ ID NO: 3834796 - RNA, 20 nt, Shigella flexneri 2a str. 2457T
gauacugcauucccaucgca

SEQ ID NO: 3834797 - RNA, 21 nt, Shigella flexneri 2a str. 2457T
gauagccagguuuaccagcag

SEQ ID NO: 3834798 - RNA, 19 nt, Shigella flexneri 2a str. 2457T
gauagccgaccgcaaggaa

SEQ ID NO: 3834799 - RNA, 23 nt, Shigella flexneri 2a str. 2457T
gauagccgcccccgacuccagca

SEQ ID NO: 3834800 - RNA, 16 nt, Shigella flexneri 2a str. 2457T
gauagcggcugacggu

SEQ ID NO: 3834801 - RNA, 19 nt, Shigella flexneri 2a str. 2457T
gauagcguagcgccucagg

SEQ ID NO: 3834802 - RNA, 12 nt, Shigella flexneri 2a str. 2457T
gauagcugguga

SEQ ID NO: 3834803 - RNA, 14 nt, Shigella flexneri 2a str. 2457T
gauaggaauuaaaa

SEQ ID NO: 3834804 - RNA, 17 nt, Shigella flexneri 2a str. 2457T
gauaggaauuaaaaccc

SEQ ID NO: 3834805 - RNA, 16 nt, Shigella flexneri 2a str. 2457T
gauagucaugaugacg

SEQ ID NO: 3834806 - RNA, 18 nt, Shigella flexneri 2a str. 2457T
gauaguguugguaaauaa

SEQ ID NO: 3834807 - RNA, 17 nt, Shigella flexneri 2a str. 2457T
gauaguguuuuauguuc

SEQ ID NO: 3834808 - RNA, 15 nt, Shigella flexneri 2a str. 2457T
gauaguuaaaauuca

SEQ ID NO: 3834809 - RNA, 17 nt, Shigella flexneri 2a str. 2457T
gauaguuaaaauucaag

SEQ ID NO: 3834810 - RNA, 16 nt, Shigella flexneri 2a str. 2457T
gauaguucaacagauu

SEQ ID NO: 3834811 - RNA, 14 nt, Shigella flexneri 2a str. 2457T
gauaguuggcagcg

SEQ ID NO: 3834812 - RNA, 13 nt, Shigella flexneri 2a str. 2457T
gauauaaauucca

SEQ ID NO: 3834813 - RNA, 22 nt, Shigella flexneri 2a str. 2457T
gauauaauaaaccugccuuaca

SEQ ID NO: 3834814 - RNA, 13 nt, Shigella flexneri 2a str. 2457T
gauauacagcccg

SEQ ID NO: 3834815 - RNA, 13 nt, Shigella flexneri 2a str. 2457T
gauauacccgcca

SEQ ID NO: 3834816 - RNA, 13 nt, Shigella flexneri 2a str. 2457T
gauaucaccacca

SEQ ID NO: 3834817 - RNA, 14 nt, Shigella flexneri 2a str. 2457T
gauauccaccgcgu

SEQ ID NO: 3834818 - RNA, 19 nt, Shigella flexneri 2a str. 2457T
gauauccacugucaaaucc

SEQ ID NO: 3834819 - RNA, 14 nt, Shigella flexneri 2a str. 2457T
gauauccagcgccg

SEQ ID NO: 3834820 - RNA, 23 nt, Shigella flexneri 2a str. 2457T
gauaucccagcugccgccaggcu

SEQ ID NO: 3834821 - RNA, 18 nt, Shigella flexneri 2a str. 2457T
gauaucccgccagcacca

SEQ ID NO: 3834822 - RNA, 23 nt, Shigella flexneri 2a str. 2457T
gauaucccgccagcaccagcaac

SEQ ID NO: 3834823 - RNA, 21 nt, Shigella flexneri 2a str. 2457T
gauaucgaccacuuuaaccag

SEQ ID NO: 3834824 - RNA, 18 nt, Shigella flexneri 2a str. 2457T
gauaucgccaggccagcc

SEQ ID NO: 3834825 - RNA, 13 nt, Shigella flexneri 2a str. 2457T
gauaucgcuggca

SEQ ID NO: 3834826 - RNA, 20 nt, Shigella flexneri 2a str. 2457T
gauaucgcuggcagaaagcc

SEQ ID NO: 3834827 - RNA, 14 nt, Shigella flexneri 2a str. 2457T
gauaucguggcacg

SEQ ID NO: 3834828 - RNA, 23 nt, Shigella flexneri 2a str. 2457T
gauaucuacaaaaccacacuucu

SEQ ID NO: 3834829 - RNA, 16 nt, Shigella flexneri 2a str. 2457T
gauaucucaccagauu

SEQ ID NO: 3834830 - RNA, 23 nt, Shigella flexneri 2a str. 2457T
gauaucuucccgccguugccgca

SEQ ID NO: 3834831 - RNA, 13 nt, Shigella flexneri 2a str. 2457T
gauaucuuuccgg

SEQ ID NO: 3834832 - RNA, 18 nt, Shigella flexneri 2a str. 2457T
gauaugcaguaaggaaau

SEQ ID NO: 3834833 - RNA, 18 nt, Shigella flexneri 2a str. 2457T
gauaugcaucaugaaaac

SEQ ID NO: 3834834 - RNA, 15 nt, Shigella flexneri 2a str. 2457T
gauaugccggcauca

SEQ ID NO: 3834835 - RNA, 14 nt, Shigella flexneri 2a str. 2457T
gauauguaacauac

SEQ ID NO: 3834836 - RNA, 14 nt, Shigella flexneri 2a str. 2457T
gauauuaucuucau

SEQ ID NO: 3834837 - RNA, 23 nt, Shigella flexneri 2a str. 2457T
gauauuaucuucaucgauacugc

SEQ ID NO: 3834838 - RNA, 22 nt, Shigella flexneri 2a str. 2457T
gauauucaggcguugaaaaauc

SEQ ID NO: 3834839 - RNA, 16 nt, Shigella flexneri 2a str. 2457T
gauauucaucuccagc

SEQ ID NO: 3834840 - RNA, 13 nt, Shigella flexneri 2a str. 2457T
gauauuccccaga

SEQ ID NO: 3834841 - RNA, 14 nt, Shigella flexneri 2a str. 2457T
gauauuccugaaug

SEQ ID NO: 3834842 - RNA, 16 nt, Shigella flexneri 2a str. 2457T
gauauuccugaauggu

SEQ ID NO: 3834843 - RNA, 15 nt, Shigella flexneri 2a str. 2457T
gauauucuccagcuu

SEQ ID NO: 3834844 - RNA, 18 nt, Shigella flexneri 2a str. 2457T
gauauugcggaacaucgc

SEQ ID NO: 3834845 - RNA, 16 nt, Shigella flexneri 2a str. 2457T
gauauuggcaucgcca

SEQ ID NO: 3834846 - RNA, 16 nt, Shigella flexneri 2a str. 2457T
gauauuuauuuccuuc

SEQ ID NO: 3834847 - RNA, 16 nt, Shigella flexneri 2a str. 2457T
gauauuucaccagcgc

SEQ ID NO: 3834848 - RNA, 23 nt, Shigella flexneri 2a str. 2457T
gauauuucaccagcgcacgcagg

SEQ ID NO: 3834849 - RNA, 21 nt, Shigella flexneri 2a str. 2457T
gauauuuucccaacgugacca

SEQ ID NO: 3834850 - RNA, 21 nt, Shigella flexneri 2a str. 2457T
gauauuuuucccugaaggcug

SEQ ID NO: 3834851 - RNA, 14 nt, Shigella flexneri 2a str. 2457T
gaucaaauuauuac

SEQ ID NO: 3834852 - RNA, 16 nt, Shigella flexneri 2a str. 2457T
gaucaacacauccagu

SEQ ID NO: 3834853 - RNA, 15 nt, Shigella flexneri 2a str. 2457T
gaucaacagcaucau

SEQ ID NO: 3834854 - RNA, 18 nt, Shigella flexneri 2a str. 2457T
gaucaacagcaucaucgc

SEQ ID NO: 3834855 - RNA, 21 nt, Shigella flexneri 2a str. 2457T
gaucaaccaccgucgucccuu

SEQ ID NO: 3834856 - RNA, 23 nt, Shigella flexneri 2a str. 2457T
gaucaaccgcuacauacuuaaau

SEQ ID NO: 3834857 - RNA, 18 nt, Shigella flexneri 2a str. 2457T
gaucaagcacaugcugac

SEQ ID NO: 3834858 - RNA, 21 nt, Shigella flexneri 2a str. 2457T
gaucaagcacaugcugacauu

SEQ ID NO: 3834859 - RNA, 19 nt, Shigella flexneri 2a str. 2457T
gaucaaggcauauaccaca

SEQ ID NO: 3834860 - RNA, 14 nt, Shigella flexneri 2a str. 2457T
gaucaaucugcucu

SEQ ID NO: 3834861 - RNA, 12 nt, Shigella flexneri 2a str. 2457T
gaucaccgcguc

SEQ ID NO: 3834862 - RNA, 16 nt, Shigella flexneri 2a str. 2457T
gaucacgcgaccaucg

SEQ ID NO: 3834863 - RNA, 19 nt, Shigella flexneri 2a str. 2457T
gaucacgcggucaaugguc

SEQ ID NO: 3834864 - RNA, 21 nt, Shigella flexneri 2a str. 2457T
gaucacguacacaacgcggca

SEQ ID NO: 3834865 - RNA, 13 nt, Shigella flexneri 2a str. 2457T
gaucacugcaacu

SEQ ID NO: 3834866 - RNA, 13 nt, Shigella flexneri 2a str. 2457T
gaucagacacaau

SEQ ID NO: 3834867 - RNA, 11 nt, Shigella flexneri 2a str. 2457T
gaucagcaauu

SEQ ID NO: 3834868 - RNA, 19 nt, Shigella flexneri 2a str. 2457T
gaucagcauccauaucgcc

SEQ ID NO: 3834869 - RNA, 20 nt, Shigella flexneri 2a str. 2457T
gaucagcauccauaucgcca

SEQ ID NO: 3834870 - RNA, 18 nt, Shigella flexneri 2a str. 2457T
gaucagcgguuuugccag

SEQ ID NO: 3834871 - RNA, 15 nt, Shigella flexneri 2a str. 2457T
gaucaggguuagccg

SEQ ID NO: 3834872 - RNA, 16 nt, Shigella flexneri 2a str. 2457T
gaucaguuccagcagc

SEQ ID NO: 3834873 - RNA, 17 nt, Shigella flexneri 2a str. 2457T
gaucauacugaacuuau

SEQ ID NO: 3834874 - RNA, 22 nt, Shigella flexneri 2a str. 2457T
gaucauagagcacggcauccca

SEQ ID NO: 3834875 - RNA, 20 nt, Shigella flexneri 2a str. 2457T
gaucaucaaggcuuccuucg

SEQ ID NO: 3834876 - RNA, 15 nt, Shigella flexneri 2a str. 2457T
gaucaucauccagca

SEQ ID NO: 3834877 - RNA, 19 nt, Shigella flexneri 2a str. 2457T
gaucaucauuacguucuua

SEQ ID NO: 3834878 - RNA, 12 nt, Shigella flexneri 2a str. 2457T
gaucauccggcu

SEQ ID NO: 3834879 - RNA, 20 nt, Shigella flexneri 2a str. 2457T
gaucaucgacaguaccagca

SEQ ID NO: 3834880 - RNA, 11 nt, Shigella flexneri 2a str. 2457T
gaucaucgccc

SEQ ID NO: 3834881 - RNA, 19 nt, Shigella flexneri 2a str. 2457T
gaucaugccgcaauugucu

SEQ ID NO: 3834882 - RNA, 16 nt, Shigella flexneri 2a str. 2457T
gaucauucaccagccc

SEQ ID NO: 3834883 - RNA, 19 nt, Shigella flexneri 2a str. 2457T
cuguaauuucacaccauca

SEQ ID NO: 3834884 - RNA, 14 nt, Shigella flexneri 2a str. 2457T
cuguacauugagcu

SEQ ID NO: 3834885 - RNA, 15 nt, Shigella flexneri 2a str. 2457T
cuguaccacaaccug

SEQ ID NO: 3834886 - RNA, 21 nt, Shigella flexneri 2a str. 2457T
cuguaccaccagaaucgccag

SEQ ID NO: 3834887 - RNA, 14 nt, Shigella flexneri 2a str. 2457T
cuguaccagcccgc

SEQ ID NO: 3834888 - RNA, 16 nt, Shigella flexneri 2a str. 2457T
cuguaccagcccgccu

SEQ ID NO: 3834889 - RNA, 12 nt, Shigella flexneri 2a str. 2457T
cuguaccugguu

SEQ ID NO: 3834890 - RNA, 19 nt, Shigella flexneri 2a str. 2457T
cuguaccuucagcggcagc

SEQ ID NO: 3834891 - RNA, 17 nt, Shigella flexneri 2a str. 2457T
cuguacgacaaaagaau

SEQ ID NO: 3834892 - RNA, 15 nt, Shigella flexneri 2a str. 2457T
cuguacggcagugaa

SEQ ID NO: 3834893 - RNA, 13 nt, Shigella flexneri 2a str. 2457T
cuguacuuccugu

SEQ ID NO: 3834894 - RNA, 23 nt, Shigella flexneri 2a str. 2457T
cuguagauaaaacacucuuuuug

SEQ ID NO: 3834895 - RNA, 14 nt, Shigella flexneri 2a str. 2457T
cuguagccagcucg

SEQ ID NO: 3834896 - RNA, 17 nt, Shigella flexneri 2a str. 2457T
cuguagugaucaaacac

SEQ ID NO: 3834897 - RNA, 17 nt, Shigella flexneri 2a str. 2457T
cuguauaaacuauccug

SEQ ID NO: 3834898 - RNA, 14 nt, Shigella flexneri 2a str. 2457T
cuguauacgggcuu

SEQ ID NO: 3834899 - RNA, 14 nt, Shigella flexneri 2a str. 2457T
cuguaucaggcuga

SEQ ID NO: 3834900 - RNA, 13 nt, Shigella flexneri 2a str. 2457T
cuguaucccagcc

SEQ ID NO: 3834901 - RNA, 14 nt, Shigella flexneri 2a str. 2457T
cuguaucccagccc

SEQ ID NO: 3834902 - RNA, 19 nt, Shigella flexneri 2a str. 2457T
cuguaucccagcccagcgg

SEQ ID NO: 3834903 - RNA, 23 nt, Shigella flexneri 2a str. 2457T
cuguaucccaguucgauuuccca

SEQ ID NO: 3834904 - RNA, 15 nt, Shigella flexneri 2a str. 2457T
cuguauguuccccuc

SEQ ID NO: 3834905 - RNA, 14 nt, Shigella flexneri 2a str. 2457T
cuguauuacagagg

SEQ ID NO: 3834906 - RNA, 14 nt, Shigella flexneri 2a str. 2457T
cuguauuugucuca

SEQ ID NO: 3834907 - RNA, 20 nt, Shigella flexneri 2a str. 2457T
cugucaauaaacgccugcuu

SEQ ID NO: 3834908 - RNA, 22 nt, Shigella flexneri 2a str. 2457T
cugucaauaaacgccugcuuau

SEQ ID NO: 3834909 - RNA, 17 nt, Shigella flexneri 2a str. 2457T
cugucacaccuuauuua

SEQ ID NO: 3834910 - RNA, 13 nt, Shigella flexneri 2a str. 2457T
cugucaccaauca

SEQ ID NO: 3834911 - RNA, 20 nt, Shigella flexneri 2a str. 2457T
cugucagaacgguucuugaa

SEQ ID NO: 3834912 - RNA, 20 nt, Shigella flexneri 2a str. 2457T
cugucaguggacgauaagca

SEQ ID NO: 3834913 - RNA, 15 nt, Shigella flexneri 2a str. 2457T
cugucaguuggcugu

SEQ ID NO: 3834914 - RNA, 13 nt, Shigella flexneri 2a str. 2457T
cugucauaacaca

SEQ ID NO: 3834915 - RNA, 21 nt, Shigella flexneri 2a str. 2457T
cugucauacgcguaaaacagc

SEQ ID NO: 3834916 - RNA, 16 nt, Shigella flexneri 2a str. 2457T
cugucauuacgggcaa

SEQ ID NO: 3834917 - RNA, 22 nt, Shigella flexneri 2a str. 2457T
cuguccaaauccuucagcaacu

SEQ ID NO: 3834918 - RNA, 20 nt, Shigella flexneri 2a str. 2457T
cuguccauaccggacuccag

SEQ ID NO: 3834919 - RNA, 23 nt, Shigella flexneri 2a str. 2457T
cuguccgcgucuuaucaggccua

SEQ ID NO: 3834920 - RNA, 13 nt, Shigella flexneri 2a str. 2457T
cuguccggcacca

SEQ ID NO: 3834921 - RNA, 16 nt, Shigella flexneri 2a str. 2457T
cuguccggcgcacugg

SEQ ID NO: 3834922 - RNA, 21 nt, Shigella flexneri 2a str. 2457T
cuguccugagugggcgucagc

SEQ ID NO: 3834923 - RNA, 15 nt, Shigella flexneri 2a str. 2457T
cugucgacuaaccug

SEQ ID NO: 3834924 - RNA, 13 nt, Shigella flexneri 2a str. 2457T
cugucgaggccaa

SEQ ID NO: 3834925 - RNA, 14 nt, Shigella flexneri 2a str. 2457T
cugucgaucuccgg

SEQ ID NO: 3834926 - RNA, 14 nt, Shigella flexneri 2a str. 2457T
cugucgcaaauccg

SEQ ID NO: 3834927 - RNA, 15 nt, Shigella flexneri 2a str. 2457T
cugucgcaaauccgc

SEQ ID NO: 3834928 - RNA, 14 nt, Shigella flexneri 2a str. 2457T
cugucgcagccagc

SEQ ID NO: 3834929 - RNA, 18 nt, Shigella flexneri 2a str. 2457T
cugucgcagcgugcucuc

SEQ ID NO: 3834930 - RNA, 19 nt, Shigella flexneri 2a str. 2457T
cugucgccgcgacgccccc

SEQ ID NO: 3834931 - RNA, 17 nt, Shigella flexneri 2a str. 2457T
cugucggacgcugucac

SEQ ID NO: 3834932 - RNA, 20 nt, Shigella flexneri 2a str. 2457T
cugucggcacugaccaccac

SEQ ID NO: 3834933 - RNA, 17 nt, Shigella flexneri 2a str. 2457T
cugucggguaagcgcca

SEQ ID NO: 3834934 - RNA, 17 nt, Shigella flexneri 2a str. 2457T
cugucgggugcuuuuuu

SEQ ID NO: 3834935 - RNA, 14 nt, Shigella flexneri 2a str. 2457T
cugucguccggcag

SEQ ID NO: 3834936 - RNA, 18 nt, Shigella flexneri 2a str. 2457T
cugucguccggcagcaga

SEQ ID NO: 3834937 - RNA, 12 nt, Shigella flexneri 2a str. 2457T
cugucuaccagc

SEQ ID NO: 3834938 - RNA, 21 nt, Shigella flexneri 2a str. 2457T
cugucucauuguguacauccu

SEQ ID NO: 3834939 - RNA, 17 nt, Shigella flexneri 2a str. 2457T
cugucugaugauaauca

SEQ ID NO: 3834940 - RNA, 12 nt, Shigella flexneri 2a str. 2457T
cugucugcuucu

SEQ ID NO: 3834941 - RNA, 16 nt, Shigella flexneri 2a str. 2457T
cugucugcuucugccu

SEQ ID NO: 3834942 - RNA, 21 nt, Shigella flexneri 2a str. 2457T
cugucuuaacgcaccaugcac

SEQ ID NO: 3834943 - RNA, 12 nt, Shigella flexneri 2a str. 2457T
cugucuucccug

SEQ ID NO: 3834944 - RNA, 22 nt, Shigella flexneri 2a str. 2457T
cugucuucccugcugaaucccc

SEQ ID NO: 3834945 - RNA, 18 nt, Shigella flexneri 2a str. 2457T
cugugaacucaggcugcc

SEQ ID NO: 3834946 - RNA, 13 nt, Shigella flexneri 2a str. 2457T
cugugacagauuu

SEQ ID NO: 3834947 - RNA, 14 nt, Shigella flexneri 2a str. 2457T
cugugacagauuuu

SEQ ID NO: 3834948 - RNA, 19 nt, Shigella flexneri 2a str. 2457T
cugugacagcagcggcaga

SEQ ID NO: 3834949 - RNA, 16 nt, Shigella flexneri 2a str. 2457T
cugugacgacuuuuuc

SEQ ID NO: 3834950 - RNA, 17 nt, Shigella flexneri 2a str. 2457T
cugugacgacuuuuucc

SEQ ID NO: 3834951 - RNA, 16 nt, Shigella flexneri 2a str. 2457T
cugugcaaccuuuucc

SEQ ID NO: 3834952 - RNA, 17 nt, Shigella flexneri 2a str. 2457T
cugugcaauauuacuuc

SEQ ID NO: 3834953 - RNA, 16 nt, Shigella flexneri 2a str. 2457T
cugugcaaucgccgcu

SEQ ID NO: 3834954 - RNA, 15 nt, Shigella flexneri 2a str. 2457T
cugugcacccgcuuc

SEQ ID NO: 3834955 - RNA, 18 nt, Shigella flexneri 2a str. 2457T
cugugcagccaaaaauga

SEQ ID NO: 3834956 - RNA, 14 nt, Shigella flexneri 2a str. 2457T
cugugcagcgacgu

SEQ ID NO: 3834957 - RNA, 21 nt, Shigella flexneri 2a str. 2457T
cugugcagcgacgucugccgg

SEQ ID NO: 3834958 - RNA, 15 nt, Shigella flexneri 2a str. 2457T
cugugccgcugacau

SEQ ID NO: 3834959 - RNA, 14 nt, Shigella flexneri 2a str. 2457T
cugugccggaaggg

SEQ ID NO: 3834960 - RNA, 22 nt, Shigella flexneri 2a str. 2457T
cugugccguaaaucccagugcc

SEQ ID NO: 3834961 - RNA, 19 nt, Shigella flexneri 2a str. 2457T
cugugccugagccggaguu

SEQ ID NO: 3834962 - RNA, 20 nt, Shigella flexneri 2a str. 2457T
cugugcgcgccaggagacgc

SEQ ID NO: 3834963 - RNA, 11 nt, Shigella flexneri 2a str. 2457T
cugugcugccg

SEQ ID NO: 3834964 - RNA, 20 nt, Shigella flexneri 2a str. 2457T
cugugcugguacuggugcaa

SEQ ID NO: 3834965 - RNA, 21 nt, Shigella flexneri 2a str. 2457T
cugugcuuuacaccaugccac

SEQ ID NO: 3834966 - RNA, 15 nt, Shigella flexneri 2a str. 2457T
cuguggauucagcac

SEQ ID NO: 3834967 - RNA, 14 nt, Shigella flexneri 2a str. 2457T
cuguggcagggcag

SEQ ID NO: 3834968 - RNA, 13 nt, Shigella flexneri 2a str. 2457T
cuguggcgcgaag

SEQ ID NO: 3834969 - RNA, 14 nt, Shigella flexneri 2a str. 2457T
cugugguagcggcu

SEQ ID NO: 3834970 - RNA, 16 nt, Shigella flexneri 2a str. 2457T
cuguggugucuuucuc

SEQ ID NO: 3834971 - RNA, 21 nt, Shigella flexneri 2a str. 2457T
cuguguaaugaauggaguugu

SEQ ID NO: 3834972 - RNA, 16 nt, Shigella flexneri 2a str. 2457T
cuguguaaugcggcug

SEQ ID NO: 3834973 - RNA, 20 nt, Shigella flexneri 2a str. 2457T
cugugucaggccggcauaua

SEQ ID NO: 3834974 - RNA, 18 nt, Shigella flexneri 2a str. 2457T
cuguguuguacaguacug

SEQ ID NO: 3834975 - RNA, 13 nt, Shigella flexneri 2a str. 2457T
cuguuaaccggag

SEQ ID NO: 3834976 - RNA, 21 nt, Shigella flexneri 2a str. 2457T
cuguuaagaagggcuggccaa

SEQ ID NO: 3834977 - RNA, 16 nt, Shigella flexneri 2a str. 2457T
cuguuaaucgcauuga

SEQ ID NO: 3834978 - RNA, 12 nt, Shigella flexneri 2a str. 2457T
cuguuacaaacc

SEQ ID NO: 3834979 - RNA, 16 nt, Shigella flexneri 2a str. 2457T
cuguuaccccugcggc

SEQ ID NO: 3834980 - RNA, 20 nt, Shigella flexneri 2a str. 2457T
cuguuacgccagaacagcua

SEQ ID NO: 3834981 - RNA, 20 nt, Shigella flexneri 2a str. 2457T
cuguuacggugcgcagccgc

SEQ ID NO: 3834982 - RNA, 14 nt, Shigella flexneri 2a str. 2457T
cuguuacugucggc

SEQ ID NO: 3834983 - RNA, 17 nt, Shigella flexneri 2a str. 2457T
cuguucacugugcuggu

SEQ ID NO: 3834984 - RNA, 16 nt, Shigella flexneri 2a str. 2457T
cuguucacuuuugcug

SEQ ID NO: 3834985 - RNA, 15 nt, Shigella flexneri 2a str. 2457T
cuguucauccucuuc

SEQ ID NO: 3834986 - RNA, 22 nt, Shigella flexneri 2a str. 2457T
cuguucauccucuucugccugc

SEQ ID NO: 3834987 - RNA, 16 nt, Shigella flexneri 2a str. 2457T
cuguucaucgacagaa

SEQ ID NO: 3834988 - RNA, 15 nt, Shigella flexneri 2a str. 2457T
cuguucauuaaagcc

SEQ ID NO: 3834989 - RNA, 21 nt, Shigella flexneri 2a str. 2457T
cuguuccagacgcugcauuga

SEQ ID NO: 3834990 - RNA, 15 nt, Shigella flexneri 2a str. 2457T
cuguuccccucaccc

SEQ ID NO: 3834991 - RNA, 16 nt, Shigella flexneri 2a str. 2457T
cuguuccggcggcagg

SEQ ID NO: 3834992 - RNA, 15 nt, Shigella flexneri 2a str. 2457T
cuguuccuaucuuca

SEQ ID NO: 3834993 - RNA, 18 nt, Shigella flexneri 2a str. 2457T
cuguucgccgccgcuuuc

SEQ ID NO: 3834994 - RNA, 20 nt, Shigella flexneri 2a str. 2457T
cuguucugccguccagccgg

SEQ ID NO: 3834995 - RNA, 18 nt, Shigella flexneri 2a str. 2457T
cuguucugccucugaaac

SEQ ID NO: 3834996 - RNA, 14 nt, Shigella flexneri 2a str. 2457T
cuguucugcgcuug

SEQ ID NO: 3834997 - RNA, 21 nt, Shigella flexneri 2a str. 2457T
cuguucuuuuaacgcaugcac

SEQ ID NO: 3834998 - RNA, 16 nt, Shigella flexneri 2a str. 2457T
cuguugaaaagccgga

SEQ ID NO: 3834999 - RNA, 15 nt, Shigella flexneri 2a str. 2457T
cuguugaaauuauug

SEQ ID NO: 3835000 - RNA, 21 nt, Shigella flexneri 2a str. 2457T
cuguugacguccagcccuucu

SEQ ID NO: 3835001 - RNA, 21 nt, Shigella flexneri 2a str. 2457T
cuguugcaagacgaugacauu

SEQ ID NO: 3835002 - RNA, 20 nt, Shigella flexneri 2a str. 2457T
cuguugcccaugcuucugca

SEQ ID NO: 3835003 - RNA, 21 nt, Shigella flexneri 2a str. 2457T
cuguugcugaaauuccaucac

SEQ ID NO: 3835004 - RNA, 15 nt, Shigella flexneri 2a str. 2457T
cuguugcugaagaaa

SEQ ID NO: 3835005 - RNA, 22 nt, Shigella flexneri 2a str. 2457T
cuguuggaaucacucaucaugc

SEQ ID NO: 3835006 - RNA, 19 nt, Shigella flexneri 2a str. 2457T
cuguugucugaaugauaac

SEQ ID NO: 3835007 - RNA, 19 nt, Shigella flexneri 2a str. 2457T
cuguugucuuuccagacuc

SEQ ID NO: 3835008 - RNA, 19 nt, Shigella flexneri 2a str. 2457T
cuguugugccagaccaaac

SEQ ID NO: 3835009 - RNA, 16 nt, Shigella flexneri 2a str. 2457T
cuguuguucaacacuc

SEQ ID NO: 3835010 - RNA, 15 nt, Shigella flexneri 2a str. 2457T
cuguuuauccaucac

SEQ ID NO: 3835011 - RNA, 18 nt, Shigella flexneri 2a str. 2457T
cuguuucaggaacaccgc

SEQ ID NO: 3835012 - RNA, 20 nt, Shigella flexneri 2a str. 2457T
cuguuucgccaguuuuuucg

SEQ ID NO: 3835013 - RNA, 18 nt, Shigella flexneri 2a str. 2457T
cuguuucgcuucuucagc

SEQ ID NO: 3835014 - RNA, 22 nt, Shigella flexneri 2a str. 2457T
cuguuugccucguucuucccuc

SEQ ID NO: 3835015 - RNA, 16 nt, Shigella flexneri 2a str. 2457T
cuguuugucgaucauc

SEQ ID NO: 3835016 - RNA, 19 nt, Shigella flexneri 2a str. 2457T
cuguuuuaccugcgccggu

SEQ ID NO: 3835017 - RNA, 16 nt, Shigella flexneri 2a str. 2457T
cuguuuucagcaccag

SEQ ID NO: 3835018 - RNA, 19 nt, Shigella flexneri 2a str. 2457T
cuguuuuucguuuggggca

SEQ ID NO: 3835019 - RNA, 15 nt, Shigella flexneri 2a str. 2457T
cuguuuuuuauacuu

SEQ ID NO: 3835020 - RNA, 16 nt, Shigella flexneri 2a str. 2457T
cuuaaaaaccagagaa

SEQ ID NO: 3835021 - RNA, 17 nt, Shigella flexneri 2a str. 2457T
cuuaaaaucccgccagc

SEQ ID NO: 3835022 - RNA, 17 nt, Shigella flexneri 2a str. 2457T
cuuaaacaguacgagag

SEQ ID NO: 3835023 - RNA, 19 nt, Shigella flexneri 2a str. 2457T
cuuaaaggggugaaaaaaa

SEQ ID NO: 3835024 - RNA, 20 nt, Shigella flexneri 2a str. 2457T
cuuaaagucuuuguauuuau

SEQ ID NO: 3835025 - RNA, 23 nt, Shigella flexneri 2a str. 2457T
cuuaaauaagguuaauuaccuua

SEQ ID NO: 3835026 - RNA, 19 nt, Shigella flexneri 2a str. 2457T
cuuaacauccaucgccagc

SEQ ID NO: 3835027 - RNA, 13 nt, Shigella flexneri 2a str. 2457T
cuuaacgccuggc

SEQ ID NO: 3835028 - RNA, 20 nt, Shigella flexneri 2a str. 2457T
cuuaacggcgaaaaauauuu

SEQ ID NO: 3835029 - RNA, 23 nt, Shigella flexneri 2a str. 2457T
cuuaacgguguuuaguuucguuc

SEQ ID NO: 3835030 - RNA, 21 nt, Shigella flexneri 2a str. 2457T
cuuaacuugcuuaaaaaauca

SEQ ID NO: 3835031 - RNA, 22 nt, Shigella flexneri 2a str. 2457T
cuuaacuugcuuaaaaaaucac

SEQ ID NO: 3835032 - RNA, 14 nt, Shigella flexneri 2a str. 2457T
cuuaagccagcgcc

SEQ ID NO: 3835033 - RNA, 16 nt, Shigella flexneri 2a str. 2457T
cuuaaggcuguuccca

SEQ ID NO: 3835034 - RNA, 17 nt, Shigella flexneri 2a str. 2457T
cuuaagguucacuuaau

SEQ ID NO: 3835035 - RNA, 22 nt, Shigella flexneri 2a str. 2457T
cuuaaguuagucgcuuucauuc

SEQ ID NO: 3835036 - RNA, 17 nt, Shigella flexneri 2a str. 2457T
cuuaauauuaacuuaau

SEQ ID NO: 3835037 - RNA, 18 nt, Shigella flexneri 2a str. 2457T
cuuaaucaauugcaggaa

SEQ ID NO: 3835038 - RNA, 17 nt, Shigella flexneri 2a str. 2457T
cuuaaucagaauuuuuc

SEQ ID NO: 3835039 - RNA, 16 nt, Shigella flexneri 2a str. 2457T
cuuaaucaucaaugcc

SEQ ID NO: 3835040 - RNA, 23 nt, Shigella flexneri 2a str. 2457T
cuuaaucaucgcguacucaccgc

SEQ ID NO: 3835041 - RNA, 14 nt, Shigella flexneri 2a str. 2457T
cuuaaucgcuucuu

SEQ ID NO: 3835042 - RNA, 12 nt, Shigella flexneri 2a str. 2457T
cuuaaucugcca

SEQ ID NO: 3835043 - RNA, 14 nt, Shigella flexneri 2a str. 2457T
cuuaaucugccaga

SEQ ID NO: 3835044 - RNA, 20 nt, Shigella flexneri 2a str. 2457T
cuuaaucuuagguaaugacu

SEQ ID NO: 3835045 - RNA, 22 nt, Shigella flexneri 2a str. 2457T
cuuaaugaaucaucguucauau

SEQ ID NO: 3835046 - RNA, 19 nt, Shigella flexneri 2a str. 2457T
cuuaaugcccaucucuucu

SEQ ID NO: 3835047 - RNA, 16 nt, Shigella flexneri 2a str. 2457T
cuuaauggaaaacugu

SEQ ID NO: 3835048 - RNA, 18 nt, Shigella flexneri 2a str. 2457T
cuuaauggacgaacuggc

SEQ ID NO: 3835049 - RNA, 17 nt, Shigella flexneri 2a str. 2457T
cuuaauguaaugcuuug

SEQ ID NO: 3835050 - RNA, 14 nt, Shigella flexneri 2a str. 2457T
cuuacacacccggc

SEQ ID NO: 3835051 - RNA, 21 nt, Shigella flexneri 2a str. 2457T
cuuaccacagacaaaauccug

SEQ ID NO: 3835052 - RNA, 13 nt, Shigella flexneri 2a str. 2457T
cuuaccacugccg

SEQ ID NO: 3835053 - RNA, 22 nt, Shigella flexneri 2a str. 2457T
cuuacccggaccgucuuuuuuc

SEQ ID NO: 3835054 - RNA, 17 nt, Shigella flexneri 2a str. 2457T
cuuaccgcgucuuauca

SEQ ID NO: 3835055 - RNA, 20 nt, Shigella flexneri 2a str. 2457T
cuuaccggucccuucaaucu

SEQ ID NO: 3835056 - RNA, 14 nt, Shigella flexneri 2a str. 2457T
cuuaccuucacgaa

SEQ ID NO: 3835057 - RNA, 17 nt, Shigella flexneri 2a str. 2457T
cuuaccuuuacguccac

SEQ ID NO: 3835058 - RNA, 15 nt, Shigella flexneri 2a str. 2457T
cuuacgcaacugcca

SEQ ID NO: 3835059 - RNA, 17 nt, Shigella flexneri 2a str. 2457T
cuuacgcaacugccagu

SEQ ID NO: 3835060 - RNA, 17 nt, Shigella flexneri 2a str. 2457T
cuuacgccgacuaauuu

SEQ ID NO: 3835061 - RNA, 18 nt, Shigella flexneri 2a str. 2457T
cuuacgcguucauacuuu

SEQ ID NO: 3835062 - RNA, 13 nt, Shigella flexneri 2a str. 2457T
cuuacggauaauu

SEQ ID NO: 3835063 - RNA, 20 nt, Shigella flexneri 2a str. 2457T
cuuacguuacccagcacgga

SEQ ID NO: 3835064 - RNA, 15 nt, Shigella flexneri 2a str. 2457T
cuuacugauaguguu

SEQ ID NO: 3835065 - RNA, 18 nt, Shigella flexneri 2a str. 2457T
cuuacuuuuaaugcuuua

SEQ ID NO: 3835066 - RNA, 16 nt, Shigella flexneri 2a str. 2457T
cuuagacagcgccgcu

SEQ ID NO: 3835067 - RNA, 16 nt, Shigella flexneri 2a str. 2457T
cuuagcaacaggccag

SEQ ID NO: 3835068 - RNA, 22 nt, Shigella flexneri 2a str. 2457T
cuuagcugaucgacaaaauccc

SEQ ID NO: 3835069 - RNA, 15 nt, Shigella flexneri 2a str. 2457T
cuuaguagaagagga

SEQ ID NO: 3835070 - RNA, 17 nt, Shigella flexneri 2a str. 2457T
cuuaguagaagaggaac

SEQ ID NO: 3835071 - RNA, 17 nt, Shigella flexneri 2a str. 2457T
cuuauaaagaaaaucug

SEQ ID NO: 3835072 - RNA, 21 nt, Shigella flexneri 2a str. 2457T
cuuauaaagaaaaucugaauu

SEQ ID NO: 3835073 - RNA, 20 nt, Shigella flexneri 2a str. 2457T
cuuauacggcuggauuucgc

SEQ ID NO: 3835074 - RNA, 17 nt, Shigella flexneri 2a str. 2457T
cuuauagcgcaucgcag

SEQ ID NO: 3835075 - RNA, 15 nt, Shigella flexneri 2a str. 2457T
cuuauauugagccaa

SEQ ID NO: 3835076 - RNA, 22 nt, Shigella flexneri 2a str. 2457T
cuuaucaggccaauugaacucu

SEQ ID NO: 3835077 - RNA, 12 nt, Shigella flexneri 2a str. 2457T
cuuaucaggccu

SEQ ID NO: 3835078 - RNA, 17 nt, Shigella flexneri 2a str. 2457T
cuuaucaggccuacaaa

SEQ ID NO: 3835079 - RNA, 18 nt, Shigella flexneri 2a str. 2457T
cuuaucaggccuacaaaa

SEQ ID NO: 3835080 - RNA, 22 nt, Shigella flexneri 2a str. 2457T
cuuaucaggccuacaguuuuac

SEQ ID NO: 3835081 - RNA, 17 nt, Shigella flexneri 2a str. 2457T
cuuaucaugccuacaua

SEQ ID NO: 3835082 - RNA, 22 nt, Shigella flexneri 2a str. 2457T
cuuauccgacauuucugcugcc

SEQ ID NO: 3835083 - RNA, 12 nt, Shigella flexneri 2a str. 2457T
cuuauccggcau

SEQ ID NO: 3835084 - RNA, 23 nt, Shigella flexneri 2a str. 2457T
cuuauccggcccacaucaacucu

SEQ ID NO: 3835085 - RNA, 18 nt, Shigella flexneri 2a str. 2457T
cuuaucgauaaacggcac

SEQ ID NO: 3835086 - RNA, 20 nt, Shigella flexneri 2a str. 2457T
cuuaucgccagcgccacgca

SEQ ID NO: 3835087 - RNA, 17 nt, Shigella flexneri 2a str. 2457T
cuuaucgcccugcucca

SEQ ID NO: 3835088 - RNA, 20 nt, Shigella flexneri 2a str. 2457T
cuuaucgcccugcuccagca

SEQ ID NO: 3835089 - RNA, 11 nt, Shigella flexneri 2a str. 2457T
cuuaucuggcc

SEQ ID NO: 3835090 - RNA, 19 nt, Shigella flexneri 2a str. 2457T
cuuaucuuuuucgguauau

SEQ ID NO: 3835091 - RNA, 11 nt, Shigella flexneri 2a str. 2457T
cuuaugcaaua

SEQ ID NO: 3835092 - RNA, 23 nt, Shigella flexneri 2a str. 2457T
cuuaugcaauagcgccugcugcu

SEQ ID NO: 3835093 - RNA, 15 nt, Shigella flexneri 2a str. 2457T
cuuaugcagcugcuc

SEQ ID NO: 3835094 - RNA, 12 nt, Shigella flexneri 2a str. 2457T
cuuauuaaaauu

SEQ ID NO: 3835095 - RNA, 21 nt, Shigella flexneri 2a str. 2457T
cuuauucgggauugccagaug

SEQ ID NO: 3835096 - RNA, 19 nt, Shigella flexneri 2a str. 2457T
cuuauucuucaacaauuga

SEQ ID NO: 3835097 - RNA, 15 nt, Shigella flexneri 2a str. 2457T
cuuauuucugugacu

SEQ ID NO: 3835098 - RNA, 14 nt, Shigella flexneri 2a str. 2457T
cuucaaaaaaguca

SEQ ID NO: 3835099 - RNA, 20 nt, Shigella flexneri 2a str. 2457T
cuucaaaaauaaguugccac

SEQ ID NO: 3835100 - RNA, 17 nt, Shigella flexneri 2a str. 2457T
cuucaaaaauaaucuga

SEQ ID NO: 3835101 - RNA, 13 nt, Shigella flexneri 2a str. 2457T
cuucaaacgcuga

SEQ ID NO: 3835102 - RNA, 17 nt, Shigella flexneri 2a str. 2457T
cuucaaacguuuugcaa

SEQ ID NO: 3835103 - RNA, 19 nt, Shigella flexneri 2a str. 2457T
cuucaaacguuuugcaauu

SEQ ID NO: 3835104 - RNA, 21 nt, Shigella flexneri 2a str. 2457T
cuucaaaucgacgcgugaaaa

SEQ ID NO: 3835105 - RNA, 13 nt, Shigella flexneri 2a str. 2457T
cuucaacaauuga

SEQ ID NO: 3835106 - RNA, 12 nt, Shigella flexneri 2a str. 2457T
cuucaacacccc

SEQ ID NO: 3835107 - RNA, 21 nt, Shigella flexneri 2a str. 2457T
cuucaacacggcgcauugcca

SEQ ID NO: 3835108 - RNA, 18 nt, Shigella flexneri 2a str. 2457T
cuucaacgauuucucagc

SEQ ID NO: 3835109 - RNA, 14 nt, Shigella flexneri 2a str. 2457T
cuucaacgcaagaa

SEQ ID NO: 3835110 - RNA, 15 nt, Shigella flexneri 2a str. 2457T
cuucaagaauuaaaa

SEQ ID NO: 3835111 - RNA, 17 nt, Shigella flexneri 2a str. 2457T
cuucaagaauuaaaaua

SEQ ID NO: 3835112 - RNA, 18 nt, Shigella flexneri 2a str. 2457T
cuucaagaauuaaaauau

SEQ ID NO: 3835113 - RNA, 18 nt, Shigella flexneri 2a str. 2457T
cuucaagccaggcuuuaa

SEQ ID NO: 3835114 - RNA, 16 nt, Shigella flexneri 2a str. 2457T
cuucaaggucaacauu

SEQ ID NO: 3835115 - RNA, 19 nt, Shigella flexneri 2a str. 2457T
cuucaaguguggccgccag

SEQ ID NO: 3835116 - RNA, 14 nt, Shigella flexneri 2a str. 2457T
cuucaauauaugca

SEQ ID NO: 3835117 - RNA, 22 nt, Shigella flexneri 2a str. 2457T
cuucaauauuaaugcugaccga

SEQ ID NO: 3835118 - RNA, 13 nt, Shigella flexneri 2a str. 2457T
cuucaaucaauaa

SEQ ID NO: 3835119 - RNA, 20 nt, Shigella flexneri 2a str. 2457T
cuucaaucaauaacagcgca

SEQ ID NO: 3835120 - RNA, 13 nt, Shigella flexneri 2a str. 2457T
cuucaaucgccac

SEQ ID NO: 3835121 - RNA, 16 nt, Shigella flexneri 2a str. 2457T
cuucaaucgccaccac

SEQ ID NO: 3835122 - RNA, 12 nt, Shigella flexneri 2a str. 2457T
cuucaaugcugc

SEQ ID NO: 3835123 - RNA, 18 nt, Shigella flexneri 2a str. 2457T
cuucaauggucagccaca

SEQ ID NO: 3835124 - RNA, 22 nt, Shigella flexneri 2a str. 2457T
cuucaauuuuuucuggcgaacc

SEQ ID NO: 3835125 - RNA, 22 nt, Shigella flexneri 2a str. 2457T
cuucacacacuuuuauuaacuc

SEQ ID NO: 3835126 - RNA, 19 nt, Shigella flexneri 2a str. 2457T
cuucacacugaugacaggc

SEQ ID NO: 3835127 - RNA, 21 nt, Shigella flexneri 2a str. 2457T
cuucacacugaugacaggcua

SEQ ID NO: 3835128 - RNA, 18 nt, Shigella flexneri 2a str. 2457T
cuucacagaaggccagga

SEQ ID NO: 3835129 - RNA, 14 nt, Shigella flexneri 2a str. 2457T
cuucacaucaccau

SEQ ID NO: 3835130 - RNA, 12 nt, Shigella flexneri 2a str. 2457T
cuucaccagcag

SEQ ID NO: 3835131 - RNA, 13 nt, Shigella flexneri 2a str. 2457T
cuucaccagcagc

SEQ ID NO: 3835132 - RNA, 13 nt, Shigella flexneri 2a str. 2457T
cuucaccagccug

SEQ ID NO: 3835133 - RNA, 16 nt, Shigella flexneri 2a str. 2457T
cuucacccaucgccag

SEQ ID NO: 3835134 - RNA, 15 nt, Shigella flexneri 2a str. 2457T
cuucacccgcagcac

SEQ ID NO: 3835135 - RNA, 22 nt, Shigella flexneri 2a str. 2457T
cuucacccucacgcauucucuu

SEQ ID NO: 3835136 - RNA, 15 nt, Shigella flexneri 2a str. 2457T
cuucaccgcaucguc

SEQ ID NO: 3835137 - RNA, 15 nt, Shigella flexneri 2a str. 2457T
cuucaccuuccagua

SEQ ID NO: 3835138 - RNA, 18 nt, Shigella flexneri 2a str. 2457T
cuucaccuuucagaacgg

SEQ ID NO: 3835139 - RNA, 15 nt, Shigella flexneri 2a str. 2457T
cuucacgcccagauc

SEQ ID NO: 3835140 - RNA, 14 nt, Shigella flexneri 2a str. 2457T
cuucacgcgcucca

SEQ ID NO: 3835141 - RNA, 18 nt, Shigella flexneri 2a str. 2457T
cuucacgcgcuccaggag

SEQ ID NO: 3835142 - RNA, 18 nt, Shigella flexneri 2a str. 2457T
cuucacgcggguugccac

SEQ ID NO: 3835143 - RNA, 19 nt, Shigella flexneri 2a str. 2457T
cuucacgcuaauaccggau

SEQ ID NO: 3835144 - RNA, 20 nt, Shigella flexneri 2a str. 2457T
cuucacgcuaauaccggaug

SEQ ID NO: 3835145 - RNA, 17 nt, Shigella flexneri 2a str. 2457T
cuucacgcuuugcaggc

SEQ ID NO: 3835146 - RNA, 23 nt, Shigella flexneri 2a str. 2457T
cuucacggcugcuaauauuuucg

SEQ ID NO: 3835147 - RNA, 13 nt, Shigella flexneri 2a str. 2457T
cuucacguuuuuc

SEQ ID NO: 3835148 - RNA, 20 nt, Shigella flexneri 2a str. 2457T
cuucacucuauagucuuuuc

SEQ ID NO: 3835149 - RNA, 16 nt, Shigella flexneri 2a str. 2457T
cuucacucugcugcca

SEQ ID NO: 3835150 - RNA, 14 nt, Shigella flexneri 2a str. 2457T
cuucacuggcgaca

SEQ ID NO: 3835151 - RNA, 21 nt, Shigella flexneri 2a str. 2457T
cuucacuuccccgagcucaau

SEQ ID NO: 3835152 - RNA, 16 nt, Shigella flexneri 2a str. 2457T
cuucacuucuucuuca

SEQ ID NO: 3835153 - RNA, 15 nt, Shigella flexneri 2a str. 2457T
cuucacuuuugccag

SEQ ID NO: 3835154 - RNA, 16 nt, Shigella flexneri 2a str. 2457T
cuucacuuuugccaga

SEQ ID NO: 3835155 - RNA, 23 nt, Shigella flexneri 2a str. 2457T
cuucagacggucagcgagauaac

SEQ ID NO: 3835156 - RNA, 14 nt, Shigella flexneri 2a str. 2457T
cuucagcaagcgau

SEQ ID NO: 3835157 - RNA, 22 nt, Shigella flexneri 2a str. 2457T
cuucagcagcagccgcgcuuuc

SEQ ID NO: 3835158 - RNA, 14 nt, Shigella flexneri 2a str. 2457T
cuucagcagcccau

SEQ ID NO: 3835159 - RNA, 24 nt, Shigella flexneri 2a str. 2457T
cuucagccaccagguucaacagcg

SEQ ID NO: 3835160 - RNA, 16 nt, Shigella flexneri 2a str. 2457T
cuucagccccuccaca

SEQ ID NO: 3835161 - RNA, 12 nt, Shigella flexneri 2a str. 2457T
cuucagcggcag

SEQ ID NO: 3835162 - RNA, 14 nt, Shigella flexneri 2a str. 2457T
cuucagcucccgcu

SEQ ID NO: 3835163 - RNA, 21 nt, Shigella flexneri 2a str. 2457T
cuucaggaauaagacaauuga

SEQ ID NO: 3835164 - RNA, 22 nt, Shigella flexneri 2a str. 2457T
cuucaggacccuuaaaggguca

SEQ ID NO: 3835165 - RNA, 23 nt, Shigella flexneri 2a str. 2457T
cuucaggaucaaccgcuacauac

SEQ ID NO: 3835166 - RNA, 14 nt, Shigella flexneri 2a str. 2457T
cuucaggcccugcu

SEQ ID NO: 3835167 - RNA, 20 nt, Shigella flexneri 2a str. 2457T
cuucaggcccugcuguuuuu

SEQ ID NO: 3835168 - RNA, 16 nt, Shigella flexneri 2a str. 2457T
cuucagucaggcgauu

SEQ ID NO: 3835169 - RNA, 17 nt, Shigella flexneri 2a str. 2457T
cuucaguuccgcugcaa

SEQ ID NO: 3835170 - RNA, 14 nt, Shigella flexneri 2a str. 2457T
cuucaguugccugg

SEQ ID NO: 3835171 - RNA, 20 nt, Shigella flexneri 2a str. 2457T
cuucaguuuuucccgcuucg

SEQ ID NO: 3835172 - RNA, 15 nt, Shigella flexneri 2a str. 2457T
cuucauacaccacua

SEQ ID NO: 3835173 - RNA, 14 nt, Shigella flexneri 2a str. 2457T
cuucauacuaccug

SEQ ID NO: 3835174 - RNA, 15 nt, Shigella flexneri 2a str. 2457T
cuucauagguaaaca

SEQ ID NO: 3835175 - RNA, 24 nt, Shigella flexneri 2a str. 2457T
cuucauauuccugacccagcacca

SEQ ID NO: 3835176 - RNA, 15 nt, Shigella flexneri 2a str. 2457T
cuucaucacgaugca

SEQ ID NO: 3835177 - RNA, 21 nt, Shigella flexneri 2a str. 2457T
cuucaucacgcagcgucagca

SEQ ID NO: 3835178 - RNA, 14 nt, Shigella flexneri 2a str. 2457T
cuucaucaucgcag

SEQ ID NO: 3835179 - RNA, 16 nt, Shigella flexneri 2a str. 2457T
cuucauccagcaucau

SEQ ID NO: 3835180 - RNA, 18 nt, Shigella flexneri 2a str. 2457T
cuucauccggauacagcc

SEQ ID NO: 3835181 - RNA, 21 nt, Shigella flexneri 2a str. 2457T
cuucauccuucacacugccuc

SEQ ID NO: 3835182 - RNA, 13 nt, Shigella flexneri 2a str. 2457T
cuucaucgucaua

SEQ ID NO: 3835183 - RNA, 17 nt, Shigella flexneri 2a str. 2457T
cuucaucgugcucgcuu

SEQ ID NO: 3835184 - RNA, 18 nt, Shigella flexneri 2a str. 2457T
cuucaucgugcucgcuuu

SEQ ID NO: 3835185 - RNA, 13 nt, Shigella flexneri 2a str. 2457T
cuucaugaccuuc

SEQ ID NO: 3835186 - RNA, 19 nt, Shigella flexneri 2a str. 2457T
cuucaugcagcauggucag

SEQ ID NO: 3835187 - RNA, 20 nt, Shigella flexneri 2a str. 2457T
cuucaugcagcauggucagg

SEQ ID NO: 3835188 - RNA, 22 nt, Shigella flexneri 2a str. 2457T
cuucauggggaugcugaaaaga

SEQ ID NO: 3835189 - RNA, 16 nt, Shigella flexneri 2a str. 2457T
cuucauuaaccacgau

SEQ ID NO: 3835190 - RNA, 13 nt, Shigella flexneri 2a str. 2457T
cuucauuaccuuc

SEQ ID NO: 3835191 - RNA, 13 nt, Shigella flexneri 2a str. 2457T
cuucauuauccuu

SEQ ID NO: 3835192 - RNA, 19 nt, Shigella flexneri 2a str. 2457T
cuucauucagacaggcgaa

SEQ ID NO: 3835193 - RNA, 12 nt, Shigella flexneri 2a str. 2457T
cuucauugcucu

SEQ ID NO: 3835194 - RNA, 15 nt, Shigella flexneri 2a str. 2457T
cuucauugcucucuu

SEQ ID NO: 3835195 - RNA, 21 nt, Shigella flexneri 2a str. 2457T
cuucauugcucucuucuccuu

SEQ ID NO: 3835196 - RNA, 16 nt, Shigella flexneri 2a str. 2457T
cuucauuugccagcuu

SEQ ID NO: 3835197 - RNA, 18 nt, Shigella flexneri 2a str. 2457T
cuuccacaccacuuccga

SEQ ID NO: 3835198 - RNA, 15 nt, Shigella flexneri 2a str. 2457T
cuuccaccacgucca

SEQ ID NO: 3835199 - RNA, 13 nt, Shigella flexneri 2a str. 2457T
cuuccaccacuuc

SEQ ID NO: 3835200 - RNA, 16 nt, Shigella flexneri 2a str. 2457T
cuuccaccacuuccug

SEQ ID NO: 3835201 - RNA, 17 nt, Shigella flexneri 2a str. 2457T
cuuccaccacuuccugc

SEQ ID NO: 3835202 - RNA, 14 nt, Shigella flexneri 2a str. 2457T
cuuccaccagcggc

SEQ ID NO: 3835203 - RNA, 13 nt, Shigella flexneri 2a str. 2457T
cuuccacgccugc

SEQ ID NO: 3835204 - RNA, 14 nt, Shigella flexneri 2a str. 2457T
cuuccacgccugca

SEQ ID NO: 3835205 - RNA, 15 nt, Shigella flexneri 2a str. 2457T
cuuccacgccugcau

SEQ ID NO: 3835206 - RNA, 12 nt, Shigella flexneri 2a str. 2457T
cuuccacuuccu

SEQ ID NO: 3835207 - RNA, 16 nt, Shigella flexneri 2a str. 2457T
cuuccacuuccugcgg

SEQ ID NO: 3835208 - RNA, 14 nt, Shigella flexneri 2a str. 2457T
cuuccagauucagu

SEQ ID NO: 3835209 - RNA, 11 nt, Shigella flexneri 2a str. 2457T
cuuccagcaga

SEQ ID NO: 3835210 - RNA, 19 nt, Shigella flexneri 2a str. 2457T
cuuccagcagaccagcaau

SEQ ID NO: 3835211 - RNA, 19 nt, Shigella flexneri 2a str. 2457T
cuuccagcagaccuucugc

SEQ ID NO: 3835212 - RNA, 18 nt, Shigella flexneri 2a str. 2457T
cuuccagcgcaucugccg

SEQ ID NO: 3835213 - RNA, 12 nt, Shigella flexneri 2a str. 2457T
cuuccagcgcca

SEQ ID NO: 3835214 - RNA, 15 nt, Shigella flexneri 2a str. 2457T
cuuccagcggcaggc

SEQ ID NO: 3835215 - RNA, 17 nt, Shigella flexneri 2a str. 2457T
cuuccagcggcaggccg

SEQ ID NO: 3835216 - RNA, 22 nt, Shigella flexneri 2a str. 2457T
cuuccagcguucgccaaaccca

SEQ ID NO: 3835217 - RNA, 13 nt, Shigella flexneri 2a str. 2457T
cuuccagcguuuc

SEQ ID NO: 3835218 - RNA, 12 nt, Shigella flexneri 2a str. 2457T
cuuccagcucca

SEQ ID NO: 3835219 - RNA, 15 nt, Shigella flexneri 2a str. 2457T
cuuccagcuccagcc

SEQ ID NO: 3835220 - RNA, 17 nt, Shigella flexneri 2a str. 2457T
cuuccagcuccagccgc

SEQ ID NO: 3835221 - RNA, 22 nt, Shigella flexneri 2a str. 2457T
cuuccaggcucauaccuuccac

SEQ ID NO: 3835222 - RNA, 15 nt, Shigella flexneri 2a str. 2457T
cuuccaggguaaaca

SEQ ID NO: 3835223 - RNA, 20 nt, Shigella flexneri 2a str. 2457T
cuuccaguacgcgcaacccc

SEQ ID NO: 3835224 - RNA, 18 nt, Shigella flexneri 2a str. 2457T
cuuccagucgccugcuuu

SEQ ID NO: 3835225 - RNA, 12 nt, Shigella flexneri 2a str. 2457T
cuuccagugccu

SEQ ID NO: 3835226 - RNA, 14 nt, Shigella flexneri 2a str. 2457T
cuuccaguuccggc

SEQ ID NO: 3835227 - RNA, 19 nt, Shigella flexneri 2a str. 2457T
cuuccaguuugcucaaauc

SEQ ID NO: 3835228 - RNA, 13 nt, Shigella flexneri 2a str. 2457T
cuuccaucacaaa

SEQ ID NO: 3835229 - RNA, 19 nt, Shigella flexneri 2a str. 2457T
cuuccaucgcaucuucgcc

SEQ ID NO: 3835230 - RNA, 17 nt, Shigella flexneri 2a str. 2457T
cuuccauugagaaagcc

SEQ ID NO: 3835231 - RNA, 20 nt, Shigella flexneri 2a str. 2457T
cuuccauugagaaagcccug

SEQ ID NO: 3835232 - RNA, 22 nt, Shigella flexneri 2a str. 2457T
cuuccauugagaaagcccuggc

SEQ ID NO: 3835233 - RNA, 20 nt, Shigella flexneri 2a str. 2457T
cuuccauugccgcuuuccag

SEQ ID NO: 3835234 - RNA, 18 nt, Shigella flexneri 2a str. 2457T
cuuccauuucaucgccag

SEQ ID NO: 3835235 - RNA, 14 nt, Shigella flexneri 2a str. 2457T
cuucccaaagaucu

SEQ ID NO: 3835236 - RNA, 20 nt, Shigella flexneri 2a str. 2457T
cuucccaauugcacauauuu

SEQ ID NO: 3835237 - RNA, 22 nt, Shigella flexneri 2a str. 2457T
cuucccaauugcacauauuuuu

SEQ ID NO: 3835238 - RNA, 15 nt, Shigella flexneri 2a str. 2457T
cuucccacgucagac

SEQ ID NO: 3835239 - RNA, 12 nt, Shigella flexneri 2a str. 2457T
cuucccagcgca

SEQ ID NO: 3835240 - RNA, 21 nt, Shigella flexneri 2a str. 2457T
cuuccccgcuugggcagaaua

SEQ ID NO: 3835241 - RNA, 17 nt, Shigella flexneri 2a str. 2457T
cuuccccguucugccag

SEQ ID NO: 3835242 - RNA, 22 nt, Shigella flexneri 2a str. 2457T
cuuccccucauuaagccacggu

SEQ ID NO: 3835243 - RNA, 15 nt, Shigella flexneri 2a str. 2457T
cuucccgcagccacg

SEQ ID NO: 3835244 - RNA, 14 nt, Shigella flexneri 2a str. 2457T
cuucccgcauccag

SEQ ID NO: 3835245 - RNA, 16 nt, Shigella flexneri 2a str. 2457T
cuucccucuacaggaa

SEQ ID NO: 3835246 - RNA, 17 nt, Shigella flexneri 2a str. 2457T
cuuccgcaaacaggcgc

SEQ ID NO: 3835247 - RNA, 17 nt, Shigella flexneri 2a str. 2457T
cuuccgcaauacagcca

SEQ ID NO: 3835248 - RNA, 21 nt, Shigella flexneri 2a str. 2457T
cuuccgcaauacagccagcca

SEQ ID NO: 3835249 - RNA, 14 nt, Shigella flexneri 2a str. 2457T
cuuccgccagcggc

SEQ ID NO: 3835250 - RNA, 15 nt, Shigella flexneri 2a str. 2457T
cuuccgccagcggcg

SEQ ID NO: 3835251 - RNA, 14 nt, Shigella flexneri 2a str. 2457T
cuuccgcgaaggcg

SEQ ID NO: 3835252 - RNA, 18 nt, Shigella flexneri 2a str. 2457T
cuuccgcgccaaacauuu

SEQ ID NO: 3835253 - RNA, 18 nt, Shigella flexneri 2a str. 2457T
cuuccggcaacaaugcca

SEQ ID NO: 3835254 - RNA, 15 nt, Shigella flexneri 2a str. 2457T
cuuccggcguggcgu

SEQ ID NO: 3835255 - RNA, 14 nt, Shigella flexneri 2a str. 2457T
cuuccggugcaauc

SEQ ID NO: 3835256 - RNA, 21 nt, Shigella flexneri 2a str. 2457T
cuuccguuuaaagagcaaccc

SEQ ID NO: 3835257 - RNA, 23 nt, Shigella flexneri 2a str. 2457T
cuuccucguuucgcccugccuuu

SEQ ID NO: 3835258 - RNA, 12 nt, Shigella flexneri 2a str. 2457T
cuuccugaguga

SEQ ID NO: 3835259 - RNA, 21 nt, Shigella flexneri 2a str. 2457T
cuuccugagugaauauuuaac

SEQ ID NO: 3835260 - RNA, 22 nt, Shigella flexneri 2a str. 2457T
cuuccugauaaccuuccagcuu

SEQ ID NO: 3835261 - RNA, 12 nt, Shigella flexneri 2a str. 2457T
cuuccugcaacg

SEQ ID NO: 3835262 - RNA, 15 nt, Shigella flexneri 2a str. 2457T
cuuccugccagaucc

SEQ ID NO: 3835263 - RNA, 15 nt, Shigella flexneri 2a str. 2457T
cuuccuggcgcuggc

SEQ ID NO: 3835264 - RNA, 16 nt, Shigella flexneri 2a str. 2457T
cuuccuuaagccgcug

SEQ ID NO: 3835265 - RNA, 16 nt, Shigella flexneri 2a str. 2457T
cuuccuuaaucccugg

SEQ ID NO: 3835266 - RNA, 14 nt, Shigella flexneri 2a str. 2457T
cuuccuucagcucc

SEQ ID NO: 3835267 - RNA, 20 nt, Shigella flexneri 2a str. 2457T
cuucgacagcguuucgccac

SEQ ID NO: 3835268 - RNA, 17 nt, Shigella flexneri 2a str. 2457T
cuucgacguuauuuacc

SEQ ID NO: 3835269 - RNA, 16 nt, Shigella flexneri 2a str. 2457T
cuucgagauucuuaaa

SEQ ID NO: 3835270 - RNA, 16 nt, Shigella flexneri 2a str. 2457T
cuucgaguacauccac

SEQ ID NO: 3835271 - RNA, 19 nt, Shigella flexneri 2a str. 2457T
cuucgaguacauccacugc

SEQ ID NO: 3835272 - RNA, 16 nt, Shigella flexneri 2a str. 2457T
cuucgauaaaagccau

SEQ ID NO: 3835273 - RNA, 15 nt, Shigella flexneri 2a str. 2457T
cuucgauccagugau

SEQ ID NO: 3835274 - RNA, 16 nt, Shigella flexneri 2a str. 2457T
cuucgaucuugccgcu

SEQ ID NO: 3835275 - RNA, 17 nt, Shigella flexneri 2a str. 2457T
cuucgcacacacugcuu

SEQ ID NO: 3835276 - RNA, 14 nt, Shigella flexneri 2a str. 2457T
cuucgccaaaucgc

SEQ ID NO: 3835277 - RNA, 22 nt, Shigella flexneri 2a str. 2457T
cuucgcccuucgggucguugcc

SEQ ID NO: 3835278 - RNA, 12 nt, Shigella flexneri 2a str. 2457T
cuucgccugccu

SEQ ID NO: 3835279 - RNA, 21 nt, Shigella flexneri 2a str. 2457T
cuucgccuuucaguucaacgg

SEQ ID NO: 3835280 - RNA, 18 nt, Shigella flexneri 2a str. 2457T
cuucgcgaacacccgacg

SEQ ID NO: 3835281 - RNA, 20 nt, Shigella flexneri 2a str. 2457T
cuucgcgaacacccgacgug

SEQ ID NO: 3835282 - RNA, 22 nt, Shigella flexneri 2a str. 2457T
cuucgcgaucaaacgccagauc

SEQ ID NO: 3835283 - RNA, 14 nt, Shigella flexneri 2a str. 2457T
cuucgcgcaccaac

SEQ ID NO: 3835284 - RNA, 16 nt, Shigella flexneri 2a str. 2457T
cuucgcggaauuucag

SEQ ID NO: 3835285 - RNA, 21 nt, Shigella flexneri 2a str. 2457T
cuucgcucauguuaucaagau

SEQ ID NO: 3835286 - RNA, 22 nt, Shigella flexneri 2a str. 2457T
cuucgcucauguuaucaagaua

SEQ ID NO: 3835287 - RNA, 18 nt, Shigella flexneri 2a str. 2457T
cuucgcucccuagaagga

SEQ ID NO: 3835288 - RNA, 16 nt, Shigella flexneri 2a str. 2457T
cuucgcugcagcucug

SEQ ID NO: 3835289 - RNA, 17 nt, Shigella flexneri 2a str. 2457T
cuucgcugcagcucugc

SEQ ID NO: 3835290 - RNA, 13 nt, Shigella flexneri 2a str. 2457T
cuucgcugcugga

SEQ ID NO: 3835291 - RNA, 16 nt, Shigella flexneri 2a str. 2457T
cuucgcugcugguucu

SEQ ID NO: 3835292 - RNA, 16 nt, Shigella flexneri 2a str. 2457T
cuucgcuggcaacaca

SEQ ID NO: 3835293 - RNA, 21 nt, Shigella flexneri 2a str. 2457T
cuucgcuguacgccuucaugu

SEQ ID NO: 3835294 - RNA, 22 nt, Shigella flexneri 2a str. 2457T
cuucgcuuaccaugccaacgcg

SEQ ID NO: 3835295 - RNA, 19 nt, Shigella flexneri 2a str. 2457T
cuucgcuuacgccugccag

SEQ ID NO: 3835296 - RNA, 19 nt, Shigella flexneri 2a str. 2457T
cuucgcuuaucaggccuac

SEQ ID NO: 3835297 - RNA, 21 nt, Shigella flexneri 2a str. 2457T
cuucgcuucaccgacaucuuu

SEQ ID NO: 3835298 - RNA, 16 nt, Shigella flexneri 2a str. 2457T
cuucgcuuuacccugg

SEQ ID NO: 3835299 - RNA, 18 nt, Shigella flexneri 2a str. 2457T
cuucggacguuugccaug

SEQ ID NO: 3835300 - RNA, 12 nt, Shigella flexneri 2a str. 2457T
cuucgguagcag

SEQ ID NO: 3835301 - RNA, 22 nt, Shigella flexneri 2a str. 2457T
cuucgguagcagcuuucagcag

SEQ ID NO: 3835302 - RNA, 19 nt, Shigella flexneri 2a str. 2457T
cuucggucaccgucaugcc

SEQ ID NO: 3835303 - RNA, 17 nt, Shigella flexneri 2a str. 2457T
cuucggugcgacaaaca

SEQ ID NO: 3835304 - RNA, 15 nt, Shigella flexneri 2a str. 2457T
cuucguagacgcuuu

SEQ ID NO: 3835305 - RNA, 22 nt, Shigella flexneri 2a str. 2457T
cuucgucccagucgucauccca

SEQ ID NO: 3835306 - RNA, 20 nt, Shigella flexneri 2a str. 2457T
cuucgucguaguaguucauc

SEQ ID NO: 3835307 - RNA, 18 nt, Shigella flexneri 2a str. 2457T
cuucgugcggcugcaucu

SEQ ID NO: 3835308 - RNA, 19 nt, Shigella flexneri 2a str. 2457T
cuucgugcguuuguaggcc

SEQ ID NO: 3835309 - RNA, 23 nt, Shigella flexneri 2a str. 2457T
cuucguuaaacagcuuggauucu

SEQ ID NO: 3835310 - RNA, 14 nt, Shigella flexneri 2a str. 2457T
cuucguuaucccag

SEQ ID NO: 3835311 - RNA, 22 nt, Shigella flexneri 2a str. 2457T
cuucguuauccucugcaagaua

SEQ ID NO: 3835312 - RNA, 18 nt, Shigella flexneri 2a str. 2457T
cuucguucaucucaaaca

SEQ ID NO: 3835313 - RNA, 18 nt, Shigella flexneri 2a str. 2457T
cuucuaauuuuuccagca

SEQ ID NO: 3835314 - RNA, 18 nt, Shigella flexneri 2a str. 2457T
cuucuacaggcugcaucu

SEQ ID NO: 3835315 - RNA, 14 nt, Shigella flexneri 2a str. 2457T
cuucuauaccaaug

SEQ ID NO: 3835316 - RNA, 14 nt, Shigella flexneri 2a str. 2457T
cuucuauauucugg

SEQ ID NO: 3835317 - RNA, 24 nt, Shigella flexneri 2a str. 2457T
cuucuauauucuggcguuagucgu

SEQ ID NO: 3835318 - RNA, 15 nt, Shigella flexneri 2a str. 2457T
cuucucaaucccuuu

SEQ ID NO: 3835319 - RNA, 21 nt, Shigella flexneri 2a str. 2457T
cuucucaaucccuuucucuuc

SEQ ID NO: 3835320 - RNA, 13 nt, Shigella flexneri 2a str. 2457T
cuucucagccaaa

SEQ ID NO: 3835321 - RNA, 16 nt, Shigella flexneri 2a str. 2457T
cuucucauccuucccc

SEQ ID NO: 3835322 - RNA, 21 nt, Shigella flexneri 2a str. 2457T
cuucucauuucugccauucca

SEQ ID NO: 3835323 - RNA, 12 nt, Shigella flexneri 2a str. 2457T
cuucuccacgcc

SEQ ID NO: 3835324 - RNA, 22 nt, Shigella flexneri 2a str. 2457T
cuucucgauaaaaccuuccuca

SEQ ID NO: 3835325 - RNA, 14 nt, Shigella flexneri 2a str. 2457T
cuucucgauaaacc

SEQ ID NO: 3835326 - RNA, 16 nt, Shigella flexneri 2a str. 2457T
cuucucgccagccucc

SEQ ID NO: 3835327 - RNA, 20 nt, Shigella flexneri 2a str. 2457T
cuucucgugaaacucacgca

SEQ ID NO: 3835328 - RNA, 14 nt, Shigella flexneri 2a str. 2457T
cuucucuuccccgg

SEQ ID NO: 3835329 - RNA, 15 nt, Shigella flexneri 2a str. 2457T
cuucucuucuuccgc

SEQ ID NO: 3835330 - RNA, 21 nt, Shigella flexneri 2a str. 2457T
cuucugacauaaccacucacc

SEQ ID NO: 3835331 - RNA, 15 nt, Shigella flexneri 2a str. 2457T
cuucugaguucggca

SEQ ID NO: 3835332 - RNA, 15 nt, Shigella flexneri 2a str. 2457T
cuucugauguuguuu

SEQ ID NO: 3835333 - RNA, 19 nt, Shigella flexneri 2a str. 2457T
cuucugcaacgucuccggu

SEQ ID NO: 3835334 - RNA, 16 nt, Shigella flexneri 2a str. 2457T
cuucugccagcugcug

SEQ ID NO: 3835335 - RNA, 13 nt, Shigella flexneri 2a str. 2457T
cuucugccgcuuc

SEQ ID NO: 3835336 - RNA, 20 nt, Shigella flexneri 2a str. 2457T
cuucugcuuuggcugccgcc

SEQ ID NO: 3835337 - RNA, 22 nt, Shigella flexneri 2a str. 2457T
cuucugcuuuggcugccgccag

SEQ ID NO: 3835338 - RNA, 22 nt, Shigella flexneri 2a str. 2457T
cuucuggcgacauuuucucuac

SEQ ID NO: 3835339 - RNA, 22 nt, Shigella flexneri 2a str. 2457T
cuucuggcgacccguuuuucuu

SEQ ID NO: 3835340 - RNA, 17 nt, Shigella flexneri 2a str. 2457T
cuucuggcuacugaugg

SEQ ID NO: 3835341 - RNA, 15 nt, Shigella flexneri 2a str. 2457T
cuucugguaacagcg

SEQ ID NO: 3835342 - RNA, 20 nt, Shigella flexneri 2a str. 2457T
cuucugguaacagcggacgg

SEQ ID NO: 3835343 - RNA, 19 nt, Shigella flexneri 2a str. 2457T
cuucuggugauaggcguug

SEQ ID NO: 3835344 - RNA, 17 nt, Shigella flexneri 2a str. 2457T
cuucugguuauauuucc

SEQ ID NO: 3835345 - RNA, 18 nt, Shigella flexneri 2a str. 2457T
cuucugguuucaguaauc

SEQ ID NO: 3835346 - RNA, 15 nt, Shigella flexneri 2a str. 2457T
cuucuguaacuggaa

SEQ ID NO: 3835347 - RNA, 20 nt, Shigella flexneri 2a str. 2457T
cuucugucgggcaucacuau

SEQ ID NO: 3835348 - RNA, 23 nt, Shigella flexneri 2a str. 2457T
cuucuuaaugcccaucucuucuu

SEQ ID NO: 3835349 - RNA, 15 nt, Shigella flexneri 2a str. 2457T
cuucuucacuucuuc

SEQ ID NO: 3835350 - RNA, 17 nt, Shigella flexneri 2a str. 2457T
cuucuucauucauccgc

SEQ ID NO: 3835351 - RNA, 16 nt, Shigella flexneri 2a str. 2457T
cuucuuccagcggcag

SEQ ID NO: 3835352 - RNA, 16 nt, Shigella flexneri 2a str. 2457T
cuucuucuggcugcca

SEQ ID NO: 3835353 - RNA, 21 nt, Shigella flexneri 2a str. 2457T
cuucuucugucgggcaucacu

SEQ ID NO: 3835354 - RNA, 13 nt, Shigella flexneri 2a str. 2457T
cuucuucuuucag

SEQ ID NO: 3835355 - RNA, 18 nt, Shigella flexneri 2a str. 2457T
cuucuugcagcuuaauca

SEQ ID NO: 3835356 - RNA, 12 nt, Shigella flexneri 2a str. 2457T
cuucuuuauuga

SEQ ID NO: 3835357 - RNA, 22 nt, Shigella flexneri 2a str. 2457T
cuucuuuugucgugcccugcgc

SEQ ID NO: 3835358 - RNA, 20 nt, Shigella flexneri 2a str. 2457T
cuucuuuuuaccuucauuug

SEQ ID NO: 3835359 - RNA, 12 nt, Shigella flexneri 2a str. 2457T
cuugaaaccaga

SEQ ID NO: 3835360 - RNA, 15 nt, Shigella flexneri 2a str. 2457T
cuugaagugucuggu

SEQ ID NO: 3835361 - RNA, 20 nt, Shigella flexneri 2a str. 2457T
cuugacgccauuuuuuauac

SEQ ID NO: 3835362 - RNA, 21 nt, Shigella flexneri 2a str. 2457T
cuugacgugucuuaucaggcc

SEQ ID NO: 3835363 - RNA, 16 nt, Shigella flexneri 2a str. 2457T
cuugagacauuguuuc

SEQ ID NO: 3835364 - RNA, 20 nt, Shigella flexneri 2a str. 2457T
cuugagcccuggccacaaac

SEQ ID NO: 3835365 - RNA, 14 nt, Shigella flexneri 2a str. 2457T
cuugaggugguagu

SEQ ID NO: 3835366 - RNA, 23 nt, Shigella flexneri 2a str. 2457T
cuugaguuuuucaucccucucau

SEQ ID NO: 3835367 - RNA, 22 nt, Shigella flexneri 2a str. 2457T
cuugauaaagaucgaucauuuu

SEQ ID NO: 3835368 - RNA, 19 nt, Shigella flexneri 2a str. 2457T
cuugauaacgagcaauaga

SEQ ID NO: 3835369 - RNA, 12 nt, Shigella flexneri 2a str. 2457T
cuugauacugaa

SEQ ID NO: 3835370 - RNA, 18 nt, Shigella flexneri 2a str. 2457T
cuugauauaaaucccagg

SEQ ID NO: 3835371 - RNA, 17 nt, Shigella flexneri 2a str. 2457T
cuugaucuuccugauaa

SEQ ID NO: 3835372 - RNA, 23 nt, Shigella flexneri 2a str. 2457T
cuugaucuuccugauaaccuucc

SEQ ID NO: 3835373 - RNA, 14 nt, Shigella flexneri 2a str. 2457T
cuugaugcacuggg

SEQ ID NO: 3835374 - RNA, 15 nt, Shigella flexneri 2a str. 2457T
cuugaugugcuucau

SEQ ID NO: 3835375 - RNA, 16 nt, Shigella flexneri 2a str. 2457T
cuugauguuccucgcu

SEQ ID NO: 3835376 - RNA, 17 nt, Shigella flexneri 2a str. 2457T
cuugauucuguucagua

SEQ ID NO: 3835377 - RNA, 18 nt, Shigella flexneri 2a str. 2457T
cuugcaagccuguaguac

SEQ ID NO: 3835378 - RNA, 16 nt, Shigella flexneri 2a str. 2457T
cuugcaauaguuucag

SEQ ID NO: 3835379 - RNA, 16 nt, Shigella flexneri 2a str. 2457T
cuugcaaucuuuagca

SEQ ID NO: 3835380 - RNA, 21 nt, Shigella flexneri 2a str. 2457T
cuugcaccggcgacaucccag

SEQ ID NO: 3835381 - RNA, 18 nt, Shigella flexneri 2a str. 2457T
cuugcagucggcuuucuc

SEQ ID NO: 3835382 - RNA, 17 nt, Shigella flexneri 2a str. 2457T
cuugcaucguguaauuc

SEQ ID NO: 3835383 - RNA, 14 nt, Shigella flexneri 2a str. 2457T
cuugccaacgcaaa

SEQ ID NO: 3835384 - RNA, 17 nt, Shigella flexneri 2a str. 2457T
cuugccagaugccagga

SEQ ID NO: 3835385 - RNA, 16 nt, Shigella flexneri 2a str. 2457T
cuugccagcaggguuu

SEQ ID NO: 3835386 - RNA, 15 nt, Shigella flexneri 2a str. 2457T
cuugccauuccacaa

SEQ ID NO: 3835387 - RNA, 23 nt, Shigella flexneri 2a str. 2457T
cuugcccaggugugucucaaguc

SEQ ID NO: 3835388 - RNA, 23 nt, Shigella flexneri 2a str. 2457T
cuugccgcgucuuaucaggccua

SEQ ID NO: 3835389 - RNA, 19 nt, Shigella flexneri 2a str. 2457T
cuugccggacaugcugccu

SEQ ID NO: 3835390 - RNA, 17 nt, Shigella flexneri 2a str. 2457T
cuugccuuuccuccugu

SEQ ID NO: 3835391 - RNA, 14 nt, Shigella flexneri 2a str. 2457T
cuugcgacucagcc

SEQ ID NO: 3835392 - RNA, 20 nt, Shigella flexneri 2a str. 2457T
cuugcgagacggcggaaagg

SEQ ID NO: 3835393 - RNA, 19 nt, Shigella flexneri 2a str. 2457T
cuugcgccgcuuucucugc

SEQ ID NO: 3835394 - RNA, 15 nt, Shigella flexneri 2a str. 2457T
cuugcgcgcaaucag

SEQ ID NO: 3835395 - RNA, 20 nt, Shigella flexneri 2a str. 2457T
cuugcgcgcaaucagcaccg

SEQ ID NO: 3835396 - RNA, 23 nt, Shigella flexneri 2a str. 2457T
cuugcggaagcaaccggugucau

SEQ ID NO: 3835397 - RNA, 19 nt, Shigella flexneri 2a str. 2457T
cuugcguacaccaacauca

SEQ ID NO: 3835398 - RNA, 21 nt, Shigella flexneri 2a str. 2457T
cuugcguuuuucaucuuccgu

SEQ ID NO: 3835399 - RNA, 22 nt, Shigella flexneri 2a str. 2457T
cuugcuaaccaacaaugcaaaa

SEQ ID NO: 3835400 - RNA, 14 nt, Shigella flexneri 2a str. 2457T
cuugcucaaugagu

SEQ ID NO: 3835401 - RNA, 19 nt, Shigella flexneri 2a str. 2457T
cuugcuccacaagcuccgg

SEQ ID NO: 3835402 - RNA, 20 nt, Shigella flexneri 2a str. 2457T
cuugcuccacguucagagag

SEQ ID NO: 3835403 - RNA, 22 nt, Shigella flexneri 2a str. 2457T
cuugcucgcgcaccuacagcca

SEQ ID NO: 3835404 - RNA, 19 nt, Shigella flexneri 2a str. 2457T
cuugcugauaacgugcagc

SEQ ID NO: 3835405 - RNA, 18 nt, Shigella flexneri 2a str. 2457T
cuugcugauacuccucau

SEQ ID NO: 3835406 - RNA, 20 nt, Shigella flexneri 2a str. 2457T
cuugcugauacuccucauug

SEQ ID NO: 3835407 - RNA, 23 nt, Shigella flexneri 2a str. 2457T
cuugcugcauugagguaaacaga

SEQ ID NO: 3835408 - RNA, 15 nt, Shigella flexneri 2a str. 2457T
cuugcuggucacuga

SEQ ID NO: 3835409 - RNA, 18 nt, Shigella flexneri 2a str. 2457T
cuugcuggucacugacca

SEQ ID NO: 3835410 - RNA, 16 nt, Shigella flexneri 2a str. 2457T
cuugcuguuugcgauu

SEQ ID NO: 3835411 - RNA, 15 nt, Shigella flexneri 2a str. 2457T
cuugcuuaaaauccc

SEQ ID NO: 3835412 - RNA, 18 nt, Shigella flexneri 2a str. 2457T
cuuggcagagcaacauac

SEQ ID NO: 3835413 - RNA, 15 nt, Shigella flexneri 2a str. 2457T
cuuggcuauaaccug

SEQ ID NO: 3835414 - RNA, 16 nt, Shigella flexneri 2a str. 2457T
cuuggcugggauagcu

SEQ ID NO: 3835415 - RNA, 14 nt, Shigella flexneri 2a str. 2457T
cuugguuuugccau

SEQ ID NO: 3835416 - RNA, 16 nt, Shigella flexneri 2a str. 2457T
cuuguacggcuccgcc

SEQ ID NO: 3835417 - RNA, 13 nt, Shigella flexneri 2a str. 2457T
cuuguaggaauca

SEQ ID NO: 3835418 - RNA, 17 nt, Shigella flexneri 2a str. 2457T
cuuguaggaaucaggca

SEQ ID NO: 3835419 - RNA, 17 nt, Shigella flexneri 2a str. 2457T
cuuguauaucaaaccac

SEQ ID NO: 3835420 - RNA, 22 nt, Shigella flexneri 2a str. 2457T
cuugucaaacgggcuucuaauc

SEQ ID NO: 3835421 - RNA, 20 nt, Shigella flexneri 2a str. 2457T
cuugucaccguaaccaccag

SEQ ID NO: 3835422 - RNA, 16 nt, Shigella flexneri 2a str. 2457T
cuugucaugcagcucc

SEQ ID NO: 3835423 - RNA, 22 nt, Shigella flexneri 2a str. 2457T
cuugucaugcagcuccaccgau

SEQ ID NO: 3835424 - RNA, 15 nt, Shigella flexneri 2a str. 2457T
cuugucgucccaggc

SEQ ID NO: 3835425 - RNA, 16 nt, Shigella flexneri 2a str. 2457T
cuugugcaaaaagucc

SEQ ID NO: 3835426 - RNA, 17 nt, Shigella flexneri 2a str. 2457T
cuugugccaguucaggu

SEQ ID NO: 3835427 - RNA, 15 nt, Shigella flexneri 2a str. 2457T
cuuguggugaaacua

SEQ ID NO: 3835428 - RNA, 16 nt, Shigella flexneri 2a str. 2457T
cuuguuaccugaugca

SEQ ID NO: 3835429 - RNA, 13 nt, Shigella flexneri 2a str. 2457T
cuuguugaacagg

SEQ ID NO: 3835430 - RNA, 15 nt, Shigella flexneri 2a str. 2457T
cuuguuguaaugaca

SEQ ID NO: 3835431 - RNA, 14 nt, Shigella flexneri 2a str. 2457T
cuuguuuaaggaaa

SEQ ID NO: 3835432 - RNA, 13 nt, Shigella flexneri 2a str. 2457T
cuuguuuuuuucg

SEQ ID NO: 3835433 - RNA, 17 nt, Shigella flexneri 2a str. 2457T
cuuuaaaaaaagcauuu

SEQ ID NO: 3835434 - RNA, 14 nt, Shigella flexneri 2a str. 2457T
cuuuaaaaaagaau

SEQ ID NO: 3835435 - RNA, 14 nt, Shigella flexneri 2a str. 2457T
cuuuaaaaaguaaa

SEQ ID NO: 3835436 - RNA, 21 nt, Shigella flexneri 2a str. 2457T
cuuuaaacacgcgaccaaagg

SEQ ID NO: 3835437 - RNA, 17 nt, Shigella flexneri 2a str. 2457T
cuuuaaauugcguaaag

SEQ ID NO: 3835438 - RNA, 22 nt, Shigella flexneri 2a str. 2457T
cuuuaaccuuugcgguuaaaaa

SEQ ID NO: 3835439 - RNA, 21 nt, Shigella flexneri 2a str. 2457T
cuuuaacgaaagcgccucaag

SEQ ID NO: 3835440 - RNA, 22 nt, Shigella flexneri 2a str. 2457T
cuuuaacugccgcacauuuccc

SEQ ID NO: 3835441 - RNA, 16 nt, Shigella flexneri 2a str. 2457T
cuuuaauaugccacgc

SEQ ID NO: 3835442 - RNA, 21 nt, Shigella flexneri 2a str. 2457T
cuuuaauauuaacgccagccu

SEQ ID NO: 3835443 - RNA, 21 nt, Shigella flexneri 2a str. 2457T
cuuuaauccguuacggaugaa

SEQ ID NO: 3835444 - RNA, 15 nt, Shigella flexneri 2a str. 2457T
cuuuaaugacacgaa

SEQ ID NO: 3835445 - RNA, 21 nt, Shigella flexneri 2a str. 2457T
cuuuaaugccacauuagauaa

SEQ ID NO: 3835446 - RNA, 21 nt, Shigella flexneri 2a str. 2457T
cuuuaauggcaccguucuuua

SEQ ID NO: 3835447 - RNA, 15 nt, Shigella flexneri 2a str. 2457T
cuuuaauuuugugca

SEQ ID NO: 3835448 - RNA, 18 nt, Shigella flexneri 2a str. 2457T
cuuuaauuuugugcagca

SEQ ID NO: 3835449 - RNA, 19 nt, Shigella flexneri 2a str. 2457T
cuuuaauuuugugcagcau

SEQ ID NO: 3835450 - RNA, 16 nt, Shigella flexneri 2a str. 2457T
cuuuaccaccgucaaa

SEQ ID NO: 3835451 - RNA, 20 nt, Shigella flexneri 2a str. 2457T
cuuuaccaccgucaaaaaaa

SEQ ID NO: 3835452 - RNA, 23 nt, Shigella flexneri 2a str. 2457T
cuuuaccgcaucuuaacgccugg

SEQ ID NO: 3835453 - RNA, 20 nt, Shigella flexneri 2a str. 2457T
cuuuaccgcgcauacggaau

SEQ ID NO: 3835454 - RNA, 14 nt, Shigella flexneri 2a str. 2457T
cuuuaccucgaaaa

SEQ ID NO: 3835455 - RNA, 23 nt, Shigella flexneri 2a str. 2457T
cuuuaccucgaaaaccacuccug

SEQ ID NO: 3835456 - RNA, 16 nt, Shigella flexneri 2a str. 2457T
cuuuacgaagaaagca

SEQ ID NO: 3835457 - RNA, 19 nt, Shigella flexneri 2a str. 2457T
cuuuacgcaaaaucagcaa

SEQ ID NO: 3835458 - RNA, 16 nt, Shigella flexneri 2a str. 2457T
cuuuacgccaggcauc

SEQ ID NO: 3835459 - RNA, 18 nt, Shigella flexneri 2a str. 2457T
cuuuacggcgcgucagau

SEQ ID NO: 3835460 - RNA, 14 nt, Shigella flexneri 2a str. 2457T
cuuuacucaacucc

SEQ ID NO: 3835461 - RNA, 15 nt, Shigella flexneri 2a str. 2457T
cuuuacugacugucc

SEQ ID NO: 3835462 - RNA, 23 nt, Shigella flexneri 2a str. 2457T
cuuuacuguuccgauaaguucag

SEQ ID NO: 3835463 - RNA, 18 nt, Shigella flexneri 2a str. 2457T
cuuuagccgguuuuucaa

SEQ ID NO: 3835464 - RNA, 15 nt, Shigella flexneri 2a str. 2457T
cuuuaucaccaauga

SEQ ID NO: 3835465 - RNA, 15 nt, Shigella flexneri 2a str. 2457T
cuuuaucccuggugg

SEQ ID NO: 3835466 - RNA, 14 nt, Shigella flexneri 2a str. 2457T
cuuuauccugacuc

SEQ ID NO: 3835467 - RNA, 14 nt, Shigella flexneri 2a str. 2457T
cuuuauccugccca

SEQ ID NO: 3835468 - RNA, 23 nt, Shigella flexneri 2a str. 2457T
cuuuauccugcccacuccagcua

SEQ ID NO: 3835469 - RNA, 19 nt, Shigella flexneri 2a str. 2457T
cuuuaucgcgcaaaaaauc

SEQ ID NO: 3835470 - RNA, 17 nt, Shigella flexneri 2a str. 2457T
cuuuaucggcgcugcuu

SEQ ID NO: 3835471 - RNA, 23 nt, Shigella flexneri 2a str. 2457T
cuuuaucugauuugauaaugcca

SEQ ID NO: 3835472 - RNA, 21 nt, Shigella flexneri 2a str. 2457T
cuuuaucugccggacuuaagg

SEQ ID NO: 3835473 - RNA, 15 nt, Shigella flexneri 2a str. 2457T
cuuuaucugucgaaa

SEQ ID NO: 3835474 - RNA, 13 nt, Shigella flexneri 2a str. 2457T
cuuuaugcagcuc

SEQ ID NO: 3835475 - RNA, 14 nt, Shigella flexneri 2a str. 2457T
cuuuaugugcuucu

SEQ ID NO: 3835476 - RNA, 16 nt, Shigella flexneri 2a str. 2457T
cuuuaugugcuucuac

SEQ ID NO: 3835477 - RNA, 17 nt, Shigella flexneri 2a str. 2457T
cuuuaugugcuucuacc

SEQ ID NO: 3835478 - RNA, 22 nt, Shigella flexneri 2a str. 2457T
cuuuauuaucaacaugauggcu

SEQ ID NO: 3835479 - RNA, 15 nt, Shigella flexneri 2a str. 2457T
cuuuauucauucgcu

SEQ ID NO: 3835480 - RNA, 21 nt, Shigella flexneri 2a str. 2457T
cuuuauucggcauacauaauc

SEQ ID NO: 3835481 - RNA, 13 nt, Shigella flexneri 2a str. 2457T
cuuuauugcaaac

SEQ ID NO: 3835482 - RNA, 17 nt, Shigella flexneri 2a str. 2457T
cuuuauugcaaacauuu

SEQ ID NO: 3835483 - RNA, 21 nt, Shigella flexneri 2a str. 2457T
cuuuauuggcauggcgcuggc

SEQ ID NO: 3835484 - RNA, 20 nt, Shigella flexneri 2a str. 2457T
cuuuauuuauaucagugaua

SEQ ID NO: 3835485 - RNA, 13 nt, Shigella flexneri 2a str. 2457T
cuuucaacaaccu

SEQ ID NO: 3835486 - RNA, 16 nt, Shigella flexneri 2a str. 2457T
cuuucaacagucgcca

SEQ ID NO: 3835487 - RNA, 21 nt, Shigella flexneri 2a str. 2457T
cuuucaaugcuuuuugcauuu

SEQ ID NO: 3835488 - RNA, 14 nt, Shigella flexneri 2a str. 2457T
cuuucacaaaaaua

SEQ ID NO: 3835489 - RNA, 16 nt, Shigella flexneri 2a str. 2457T
cuuucacaaaaauaau

SEQ ID NO: 3835490 - RNA, 21 nt, Shigella flexneri 2a str. 2457T
cuuucacaaagacgccaucaa

SEQ ID NO: 3835491 - RNA, 23 nt, Shigella flexneri 2a str. 2457T
cuuucaccaucgcgaucaucagu

SEQ ID NO: 3835492 - RNA, 22 nt, Shigella flexneri 2a str. 2457T
cuuucacccggaucaauuaauc

SEQ ID NO: 3835493 - RNA, 16 nt, Shigella flexneri 2a str. 2457T
cuuucaccgccugauc

SEQ ID NO: 3835494 - RNA, 16 nt, Shigella flexneri 2a str. 2457T
cuuucaccucuucauu

SEQ ID NO: 3835495 - RNA, 17 nt, Shigella flexneri 2a str. 2457T
cuuucacgcccaguccg

SEQ ID NO: 3835496 - RNA, 15 nt, Shigella flexneri 2a str. 2457T
cuuucacgccgccaa

SEQ ID NO: 3835497 - RNA, 20 nt, Shigella flexneri 2a str. 2457T
cuuucacgccgggaaauuuu

SEQ ID NO: 3835498 - RNA, 22 nt, Shigella flexneri 2a str. 2457T
cuuucacgcgcugaccuucuuc

SEQ ID NO: 3835499 - RNA, 17 nt, Shigella flexneri 2a str. 2457T
cuuucacggucagcaua

SEQ ID NO: 3835500 - RNA, 18 nt, Shigella flexneri 2a str. 2457T
cuuucacuacaaucaggc

SEQ ID NO: 3835501 - RNA, 15 nt, Shigella flexneri 2a str. 2457T
cuuucacuauuucuu

SEQ ID NO: 3835502 - RNA, 21 nt, Shigella flexneri 2a str. 2457T
cuuucacuauuucuuuguaga

SEQ ID NO: 3835503 - RNA, 12 nt, Shigella flexneri 2a str. 2457T
cuuucacugccc

SEQ ID NO: 3835504 - RNA, 21 nt, Shigella flexneri 2a str. 2457T
cuuucacuucagcaacgugcu

SEQ ID NO: 3835505 - RNA, 23 nt, Shigella flexneri 2a str. 2457T
cuuucagaccgccaauagaagca

SEQ ID NO: 3835506 - RNA, 19 nt, Shigella flexneri 2a str. 2457T
cuuucagagaagcaccgcc

SEQ ID NO: 3835507 - RNA, 15 nt, Shigella flexneri 2a str. 2457T
cuuucagcaaaccac

SEQ ID NO: 3835508 - RNA, 22 nt, Shigella flexneri 2a str. 2457T
cuuucagcaccagcccgacgau

SEQ ID NO: 3835509 - RNA, 23 nt, Shigella flexneri 2a str. 2457T
cuuucagcaccagcccgacgaua

SEQ ID NO: 3835510 - RNA, 13 nt, Shigella flexneri 2a str. 2457T
cuuucagcaccgc

SEQ ID NO: 3835511 - RNA, 16 nt, Shigella flexneri 2a str. 2457T
cuuucagcgaaaaagu

SEQ ID NO: 3835512 - RNA, 18 nt, Shigella flexneri 2a str. 2457T
cuuucagcgaaaaagucc

SEQ ID NO: 3835513 - RNA, 20 nt, Shigella flexneri 2a str. 2457T
cuuucagcgaaaaagucccu

SEQ ID NO: 3835514 - RNA, 22 nt, Shigella flexneri 2a str. 2457T
cuuucaguggcuuaucuuccug

SEQ ID NO: 3835515 - RNA, 22 nt, Shigella flexneri 2a str. 2457T
cuuucauucgguuuucaaucga

SEQ ID NO: 3835516 - RNA, 18 nt, Shigella flexneri 2a str. 2457T
cuuucauuucaauaaauu

SEQ ID NO: 3835517 - RNA, 17 nt, Shigella flexneri 2a str. 2457T
cuuucauuuucggcagu

SEQ ID NO: 3835518 - RNA, 20 nt, Shigella flexneri 2a str. 2457T
cuuuccaacuguaccagcaa

SEQ ID NO: 3835519 - RNA, 20 nt, Shigella flexneri 2a str. 2457T
cuuuccagcaaccaaugcca

SEQ ID NO: 3835520 - RNA, 15 nt, Shigella flexneri 2a str. 2457T
cuuuccagccacagu

SEQ ID NO: 3835521 - RNA, 13 nt, Shigella flexneri 2a str. 2457T
cuuuccaggcauc

SEQ ID NO: 3835522 - RNA, 16 nt, Shigella flexneri 2a str. 2457T
cuuuccagguggugca

SEQ ID NO: 3835523 - RNA, 18 nt, Shigella flexneri 2a str. 2457T
cuuuccagguggugcagg

SEQ ID NO: 3835524 - RNA, 18 nt, Shigella flexneri 2a str. 2457T
cuuuccauaccggcugca

SEQ ID NO: 3835525 - RNA, 20 nt, Shigella flexneri 2a str. 2457T
cuuuccaugccaucugccag

SEQ ID NO: 3835526 - RNA, 20 nt, Shigella flexneri 2a str. 2457T
cuuucccgcgcccgugcauc

SEQ ID NO: 3835527 - RNA, 16 nt, Shigella flexneri 2a str. 2457T
cuuucccggcaaucac

SEQ ID NO: 3835528 - RNA, 17 nt, Shigella flexneri 2a str. 2457T
cuuucccggcaaucacc

SEQ ID NO: 3835529 - RNA, 14 nt, Shigella flexneri 2a str. 2457T
cuuucccuggcgcu

SEQ ID NO: 3835530 - RNA, 18 nt, Shigella flexneri 2a str. 2457T
cuuucccuucacucugcu

SEQ ID NO: 3835531 - RNA, 22 nt, Shigella flexneri 2a str. 2457T
cuuucccuucacucugcugcca

SEQ ID NO: 3835532 - RNA, 13 nt, Shigella flexneri 2a str. 2457T
cuuucccuucucg

SEQ ID NO: 3835533 - RNA, 16 nt, Shigella flexneri 2a str. 2457T
cuuuccggcagaagca

SEQ ID NO: 3835534 - RNA, 21 nt, Shigella flexneri 2a str. 2457T
cuuuccggcagaagcaaucau

SEQ ID NO: 3835535 - RNA, 22 nt, Shigella flexneri 2a str. 2457T
cuuuccggcagaagcaaucauc

SEQ ID NO: 3835536 - RNA, 17 nt, Shigella flexneri 2a str. 2457T
cuuuccggcaucacauc

SEQ ID NO: 3835537 - RNA, 16 nt, Shigella flexneri 2a str. 2457T
cuuuccgucagcggca

SEQ ID NO: 3835538 - RNA, 15 nt, Shigella flexneri 2a str. 2457T
cuuuccucacuccuu

SEQ ID NO: 3835539 - RNA, 19 nt, Shigella flexneri 2a str. 2457T
cuuuccuccugucuucccu

SEQ ID NO: 3835540 - RNA, 18 nt, Shigella flexneri 2a str. 2457T
cuuuccuggucggcaaac

SEQ ID NO: 3835541 - RNA, 20 nt, Shigella flexneri 2a str. 2457T
cuuuccuuaacuccucgccu

SEQ ID NO: 3835542 - RNA, 20 nt, Shigella flexneri 2a str. 2457T
cuuucgaaaucauucgcagu

SEQ ID NO: 3835543 - RNA, 20 nt, Shigella flexneri 2a str. 2457T
cuuucgacagcgauuccagu

SEQ ID NO: 3835544 - RNA, 23 nt, Shigella flexneri 2a str. 2457T
cuuucgacggcaucagaaacaca

SEQ ID NO: 3835545 - RNA, 21 nt, Shigella flexneri 2a str. 2457T
cuuucgagcaauuuuccuuga

SEQ ID NO: 3835546 - RNA, 23 nt, Shigella flexneri 2a str. 2457T
cuuucgauugcacaaagguuucg

SEQ ID NO: 3835547 - RNA, 22 nt, Shigella flexneri 2a str. 2457T
cuuucgauuucggcgugcgcgc

SEQ ID NO: 3835548 - RNA, 13 nt, Shigella flexneri 2a str. 2457T
cuuucgcaaauau

SEQ ID NO: 3835549 - RNA, 16 nt, Shigella flexneri 2a str. 2457T
cuuucgcgucgggauc

SEQ ID NO: 3835550 - RNA, 20 nt, Shigella flexneri 2a str. 2457T
cuuucgcuaaggucaccagu

SEQ ID NO: 3835551 - RNA, 15 nt, Shigella flexneri 2a str. 2457T
cuuucgcuguaaacg

SEQ ID NO: 3835552 - RNA, 14 nt, Shigella flexneri 2a str. 2457T
cuuucgcuucaagu

SEQ ID NO: 3835553 - RNA, 15 nt, Shigella flexneri 2a str. 2457T
cuuucgcuucaagua

SEQ ID NO: 3835554 - RNA, 17 nt, Shigella flexneri 2a str. 2457T
cuuucgcuuuaucgccu

SEQ ID NO: 3835555 - RNA, 16 nt, Shigella flexneri 2a str. 2457T
cuuucgcuuucucuuc

SEQ ID NO: 3835556 - RNA, 13 nt, Shigella flexneri 2a str. 2457T
cuuucggaucggc

SEQ ID NO: 3835557 - RNA, 20 nt, Shigella flexneri 2a str. 2457T
cuuucgucugguucgccaaa

SEQ ID NO: 3835558 - RNA, 14 nt, Shigella flexneri 2a str. 2457T
cuuucgugaagcug

SEQ ID NO: 3835559 - RNA, 21 nt, Shigella flexneri 2a str. 2457T
cuuucguggugagggcaaaca

SEQ ID NO: 3835560 - RNA, 18 nt, Shigella flexneri 2a str. 2457T
cuuucguuaaauucuucu

SEQ ID NO: 3835561 - RNA, 22 nt, Shigella flexneri 2a str. 2457T
cuuucguuaaauucuucugaau

SEQ ID NO: 3835562 - RNA, 23 nt, Shigella flexneri 2a str. 2457T
cuuucguuaaauucuucugaaug

SEQ ID NO: 3835563 - RNA, 19 nt, Shigella flexneri 2a str. 2457T
cuuucguuugaaaacuggc

SEQ ID NO: 3835564 - RNA, 21 nt, Shigella flexneri 2a str. 2457T
cuuucuauaagauacuggaua

SEQ ID NO: 3835565 - RNA, 20 nt, Shigella flexneri 2a str. 2457T
cuuucuaugguuuugaagaa

SEQ ID NO: 3835566 - RNA, 23 nt, Shigella flexneri 2a str. 2457T
cuuucucaauuaacgguaauaau

SEQ ID NO: 3835567 - RNA, 17 nt, Shigella flexneri 2a str. 2457T
cuuucucauuuuuuaaa

SEQ ID NO: 3835568 - RNA, 14 nt, Shigella flexneri 2a str. 2457T
cuuucucuucaucu

SEQ ID NO: 3835569 - RNA, 16 nt, Shigella flexneri 2a str. 2457T
cuuucucuucaucuau

SEQ ID NO: 3835570 - RNA, 14 nt, Shigella flexneri 2a str. 2457T
cuuucugaaggauu

SEQ ID NO: 3835571 - RNA, 19 nt, Shigella flexneri 2a str. 2457T
cuuucugaaggauuagccg

SEQ ID NO: 3835572 - RNA, 16 nt, Shigella flexneri 2a str. 2457T
cuuucugagcaucaca

SEQ ID NO: 3835573 - RNA, 18 nt, Shigella flexneri 2a str. 2457T
cuuucugcauccguucuu

SEQ ID NO: 3835574 - RNA, 17 nt, Shigella flexneri 2a str. 2457T
cuuucugcccgcguuuc

SEQ ID NO: 3835575 - RNA, 22 nt, Shigella flexneri 2a str. 2457T
cuuucuggaaaucgccucgcau

SEQ ID NO: 3835576 - RNA, 21 nt, Shigella flexneri 2a str. 2457T
cuuucuggcagcugcgcuuuc

SEQ ID NO: 3835577 - RNA, 21 nt, Shigella flexneri 2a str. 2457T
cuuucuuaaacuucacuuccc

SEQ ID NO: 3835578 - RNA, 14 nt, Shigella flexneri 2a str. 2457T
cuuucuuaaauuaa

SEQ ID NO: 3835579 - RNA, 21 nt, Shigella flexneri 2a str. 2457T
cuuucuuaccccugauuuugu

SEQ ID NO: 3835580 - RNA, 22 nt, Shigella flexneri 2a str. 2457T
cuuucuuaccccugauuuuguu

SEQ ID NO: 3835581 - RNA, 14 nt, Shigella flexneri 2a str. 2457T
cuuucuucagccgu

SEQ ID NO: 3835582 - RNA, 23 nt, Shigella flexneri 2a str. 2457T
cuuucuuuuuguugcgcugaaac

SEQ ID NO: 3835583 - RNA, 17 nt, Shigella flexneri 2a str. 2457T
cuuugaaaauaacaucg

SEQ ID NO: 3835584 - RNA, 18 nt, Shigella flexneri 2a str. 2457T
cuuugaauaucuccucug

SEQ ID NO: 3835585 - RNA, 21 nt, Shigella flexneri 2a str. 2457T
cuuugaauaucuccucugcuu

SEQ ID NO: 3835586 - RNA, 17 nt, Shigella flexneri 2a str. 2457T
cuuugauaccgccaaua

SEQ ID NO: 3835587 - RNA, 21 nt, Shigella flexneri 2a str. 2457T
cuuugaucucaaacgguucuu

SEQ ID NO: 3835588 - RNA, 21 nt, Shigella flexneri 2a str. 2457T
cuuugaucugcgucgcuuucc

SEQ ID NO: 3835589 - RNA, 15 nt, Shigella flexneri 2a str. 2457T
cuuugauuaaccguu

SEQ ID NO: 3835590 - RNA, 13 nt, Shigella flexneri 2a str. 2457T
cuuugcaggcugg

SEQ ID NO: 3835591 - RNA, 19 nt, Shigella flexneri 2a str. 2457T
cuuugcccgcagauccagu

SEQ ID NO: 3835592 - RNA, 15 nt, Shigella flexneri 2a str. 2457T
cuuugccgucagcca

SEQ ID NO: 3835593 - RNA, 20 nt, Shigella flexneri 2a str. 2457T
cuuugccgucagccacuucu

SEQ ID NO: 3835594 - RNA, 13 nt, Shigella flexneri 2a str. 2457T
cuuugccgucauc

SEQ ID NO: 3835595 - RNA, 21 nt, Shigella flexneri 2a str. 2457T
cuuugccgugaacaauuucag

SEQ ID NO: 3835596 - RNA, 23 nt, Shigella flexneri 2a str. 2457T
cuuugcgaacgcguucacugccg

SEQ ID NO: 3835597 - RNA, 19 nt, Shigella flexneri 2a str. 2457T
cuuugcuacagccugguga

SEQ ID NO: 3835598 - RNA, 17 nt, Shigella flexneri 2a str. 2457T
cuuugcuaccuuccucc

SEQ ID NO: 3835599 - RNA, 13 nt, Shigella flexneri 2a str. 2457T
cuuugcuggcaug

SEQ ID NO: 3835600 - RNA, 14 nt, Shigella flexneri 2a str. 2457T
cuuugcuggcuggc

SEQ ID NO: 3835601 - RNA, 12 nt, Shigella flexneri 2a str. 2457T
cuuugcuguaca

SEQ ID NO: 3835602 - RNA, 16 nt, Shigella flexneri 2a str. 2457T
cuuugcuuccugagua

SEQ ID NO: 3835603 - RNA, 20 nt, Shigella flexneri 2a str. 2457T
cuuugcuuuguaaagcgcca

SEQ ID NO: 3835604 - RNA, 18 nt, Shigella flexneri 2a str. 2457T
cuuuggcaaacuacaaau

SEQ ID NO: 3835605 - RNA, 13 nt, Shigella flexneri 2a str. 2457T
cuuuggcaucaau

SEQ ID NO: 3835606 - RNA, 13 nt, Shigella flexneri 2a str. 2457T
cuuuguagaugau

SEQ ID NO: 3835607 - RNA, 16 nt, Shigella flexneri 2a str. 2457T
cuuuguaggccggaua

SEQ ID NO: 3835608 - RNA, 16 nt, Shigella flexneri 2a str. 2457T
cuuuguauuuauuuuc

SEQ ID NO: 3835609 - RNA, 23 nt, Shigella flexneri 2a str. 2457T
cuuugucaaaaaucuaaccuacu

SEQ ID NO: 3835610 - RNA, 13 nt, Shigella flexneri 2a str. 2457T
cuuugucuucaau

SEQ ID NO: 3835611 - RNA, 19 nt, Shigella flexneri 2a str. 2457T
cuuugugucagcgccagaa

SEQ ID NO: 3835612 - RNA, 18 nt, Shigella flexneri 2a str. 2457T
cuuuguuaaacagugccc

SEQ ID NO: 3835613 - RNA, 19 nt, Shigella flexneri 2a str. 2457T
cuuuguuaaacagugccca

SEQ ID NO: 3835614 - RNA, 19 nt, Shigella flexneri 2a str. 2457T
cuuuguuacccccauccac

SEQ ID NO: 3835615 - RNA, 21 nt, Shigella flexneri 2a str. 2457T
cuuuguuacccccauccacgc

SEQ ID NO: 3835616 - RNA, 17 nt, Shigella flexneri 2a str. 2457T
cuuuguuagcgaauaaa

SEQ ID NO: 3835617 - RNA, 17 nt, Shigella flexneri 2a str. 2457T
cuuuuacagcgccagaa

SEQ ID NO: 3835618 - RNA, 20 nt, Shigella flexneri 2a str. 2457T
cuuuuacaugcgcgacaaaa

SEQ ID NO: 3835619 - RNA, 21 nt, Shigella flexneri 2a str. 2457T
cuuuuacaugcgcgacaaaaa

SEQ ID NO: 3835620 - RNA, 23 nt, Shigella flexneri 2a str. 2457T
cuuuuaccagcgccugcgcggca

SEQ ID NO: 3835621 - RNA, 19 nt, Shigella flexneri 2a str. 2457T
cuuuuaccugcuuaaucau

SEQ ID NO: 3835622 - RNA, 15 nt, Shigella flexneri 2a str. 2457T
cuuuuaccuucaggu

SEQ ID NO: 3835623 - RNA, 16 nt, Shigella flexneri 2a str. 2457T
cuuuuagaucacucac

SEQ ID NO: 3835624 - RNA, 12 nt, Shigella flexneri 2a str. 2457T
cuuuuauuguua

SEQ ID NO: 3835625 - RNA, 14 nt, Shigella flexneri 2a str. 2457T
cuuuuauuuaaccg

SEQ ID NO: 3835626 - RNA, 16 nt, Shigella flexneri 2a str. 2457T
cuuuucaaccauccua

SEQ ID NO: 3835627 - RNA, 22 nt, Shigella flexneri 2a str. 2457T
cuuuucaguuggcugacaaagu

SEQ ID NO: 3835628 - RNA, 21 nt, Shigella flexneri 2a str. 2457T
cuuuucaucagguuggaucaa

SEQ ID NO: 3835629 - RNA, 13 nt, Shigella flexneri 2a str. 2457T
cuuuucauuaucg

SEQ ID NO: 3835630 - RNA, 17 nt, Shigella flexneri 2a str. 2457T
cuuuuccagcauaaugu

SEQ ID NO: 3835631 - RNA, 23 nt, Shigella flexneri 2a str. 2457T
cuuuuccagcauaaugugcgcac

SEQ ID NO: 3835632 - RNA, 17 nt, Shigella flexneri 2a str. 2457T
cuuuucguucaggccua

SEQ ID NO: 3835633 - RNA, 16 nt, Shigella flexneri 2a str. 2457T
cuuuucugaaguacac

SEQ ID NO: 3835634 - RNA, 21 nt, Shigella flexneri 2a str. 2457T
cuuuucuggucaguuggcugg

SEQ ID NO: 3835635 - RNA, 16 nt, Shigella flexneri 2a str. 2457T
cuuuugacuuugccga

SEQ ID NO: 3835636 - RNA, 17 nt, Shigella flexneri 2a str. 2457T
cuuuugauacucugucu

SEQ ID NO: 3835637 - RNA, 19 nt, Shigella flexneri 2a str. 2457T
cuuuugcaguuaaaauagg

SEQ ID NO: 3835638 - RNA, 17 nt, Shigella flexneri 2a str. 2457T
cuuuugccagaauagcg

SEQ ID NO: 3835639 - RNA, 14 nt, Shigella flexneri 2a str. 2457T
cuuuuggcaggaac

SEQ ID NO: 3835640 - RNA, 20 nt, Shigella flexneri 2a str. 2457T
cuuuugucacuuuuggugcu

SEQ ID NO: 3835641 - RNA, 15 nt, Shigella flexneri 2a str. 2457T
cuuuuguuucccgau

SEQ ID NO: 3835642 - RNA, 19 nt, Shigella flexneri 2a str. 2457T
cuuuuguuuguucuucucg

SEQ ID NO: 3835643 - RNA, 22 nt, Shigella flexneri 2a str. 2457T
cuuuuuaaacgaauaguuucag

SEQ ID NO: 3835644 - RNA, 15 nt, Shigella flexneri 2a str. 2457T
cuuuuuaaucgccau

SEQ ID NO: 3835645 - RNA, 18 nt, Shigella flexneri 2a str. 2457T
cuuuuuaccaacauacug

SEQ ID NO: 3835646 - RNA, 17 nt, Shigella flexneri 2a str. 2457T
cuuuuuacccaugguca

SEQ ID NO: 3835647 - RNA, 21 nt, Shigella flexneri 2a str. 2457T
cuuuuuaguaucuauucauca

SEQ ID NO: 3835648 - RNA, 18 nt, Shigella flexneri 2a str. 2457T
cuuuuuaugucauuaacc

SEQ ID NO: 3835649 - RNA, 23 nt, Shigella flexneri 2a str. 2457T
cuuuuuauugaagauguugccac

SEQ ID NO: 3835650 - RNA, 21 nt, Shigella flexneri 2a str. 2457T
cuuuuucaauuccauuucccu

SEQ ID NO: 3835651 - RNA, 13 nt, Shigella flexneri 2a str. 2457T
cuuuuucaugcua

SEQ ID NO: 3835652 - RNA, 21 nt, Shigella flexneri 2a str. 2457T
cuuuuucaugcuauuccuuga

SEQ ID NO: 3835653 - RNA, 23 nt, Shigella flexneri 2a str. 2457T
cuuuuugaacggguugcgguuuc

SEQ ID NO: 3835654 - RNA, 20 nt, Shigella flexneri 2a str. 2457T
cuuuuugaacggugaugcuc

SEQ ID NO: 3835655 - RNA, 13 nt, Shigella flexneri 2a str. 2457T
cuuuuugcauaau

SEQ ID NO: 3835656 - RNA, 14 nt, Shigella flexneri 2a str. 2457T
cuuuuuuaaacauu

SEQ ID NO: 3835657 - RNA, 17 nt, Shigella flexneri 2a str. 2457T
cuuuuuuaagauccagu

SEQ ID NO: 3835658 - RNA, 18 nt, Shigella flexneri 2a str. 2457T
cuuuuuuaagauccaguu

SEQ ID NO: 3835659 - RNA, 20 nt, Shigella flexneri 2a str. 2457T
cuuuuuuagguacaaagcca

SEQ ID NO: 3835660 - RNA, 20 nt, Shigella flexneri 2a str. 2457T
cuuuuuuccagcacacccau

SEQ ID NO: 3835661 - RNA, 13 nt, Shigella flexneri 2a str. 2457T
cuuuuuuccgcuu

SEQ ID NO: 3835662 - RNA, 16 nt, Shigella flexneri 2a str. 2457T
cuuuuuuccugccgcu

SEQ ID NO: 3835663 - RNA, 20 nt, Shigella flexneri 2a str. 2457T
cuuuuuugagcagcauuacc

SEQ ID NO: 3835664 - RNA, 18 nt, Shigella flexneri 2a str. 2457T
cuuuuuugguaaugacuc

SEQ ID NO: 3835665 - RNA, 21 nt, Shigella flexneri 2a str. 2457T
cuuuuuugguuauccagcaac

SEQ ID NO: 3835666 - RNA, 12 nt, Shigella flexneri 2a str. 2457T
gaaaaaaacugc

SEQ ID NO: 3835667 - RNA, 18 nt, Shigella flexneri 2a str. 2457T
gaaaaaaaucaugcaaua

SEQ ID NO: 3835668 - RNA, 15 nt, Shigella flexneri 2a str. 2457T
cuggauaaugaaguc

SEQ ID NO: 3835669 - RNA, 18 nt, Shigella flexneri 2a str. 2457T
cuggauauugcggaacau

SEQ ID NO: 3835670 - RNA, 23 nt, Shigella flexneri 2a str. 2457T
cuggaucaaggauugcagcacug

SEQ ID NO: 3835671 - RNA, 23 nt, Shigella flexneri 2a str. 2457T
cuggaucacaauccgcucuuuca

SEQ ID NO: 3835672 - RNA, 15 nt, Shigella flexneri 2a str. 2457T
cuggaucagacgcag

SEQ ID NO: 3835673 - RNA, 22 nt, Shigella flexneri 2a str. 2457T
cuggaucagacgcagccagcgu

SEQ ID NO: 3835674 - RNA, 16 nt, Shigella flexneri 2a str. 2457T
cuggaucccagaagau

SEQ ID NO: 3835675 - RNA, 18 nt, Shigella flexneri 2a str. 2457T
cuggaugaaaaaauccca

SEQ ID NO: 3835676 - RNA, 17 nt, Shigella flexneri 2a str. 2457T
cuggaugaagagcgaca

SEQ ID NO: 3835677 - RNA, 22 nt, Shigella flexneri 2a str. 2457T
cuggaugagucggaccaucauu

SEQ ID NO: 3835678 - RNA, 13 nt, Shigella flexneri 2a str. 2457T
cuggaugccagcg

SEQ ID NO: 3835679 - RNA, 15 nt, Shigella flexneri 2a str. 2457T
cuggaugccagcgaa

SEQ ID NO: 3835680 - RNA, 16 nt, Shigella flexneri 2a str. 2457T
cuggauuacaaauaaa

SEQ ID NO: 3835681 - RNA, 13 nt, Shigella flexneri 2a str. 2457T
cuggauugccagc

SEQ ID NO: 3835682 - RNA, 13 nt, Shigella flexneri 2a str. 2457T
cuggauuucaaua

SEQ ID NO: 3835683 - RNA, 15 nt, Shigella flexneri 2a str. 2457T
cuggauuucaauaac

SEQ ID NO: 3835684 - RNA, 15 nt, Shigella flexneri 2a str. 2457T
cuggauuugugucag

SEQ ID NO: 3835685 - RNA, 22 nt, Shigella flexneri 2a str. 2457T
cuggauuuuagggacaaagaau

SEQ ID NO: 3835686 - RNA, 22 nt, Shigella flexneri 2a str. 2457T
cuggauuuucucuguuuccaga

SEQ ID NO: 3835687 - RNA, 22 nt, Shigella flexneri 2a str. 2457T
cuggauuuuugacuaaaguuuc

SEQ ID NO: 3835688 - RNA, 15 nt, Shigella flexneri 2a str. 2457T
cuggcaaaguagagc

SEQ ID NO: 3835689 - RNA, 19 nt, Shigella flexneri 2a str. 2457T
cuggcaaaguagagcgaaa

SEQ ID NO: 3835690 - RNA, 22 nt, Shigella flexneri 2a str. 2457T
cuggcaacaacgcaacuccagc

SEQ ID NO: 3835691 - RNA, 16 nt, Shigella flexneri 2a str. 2457T
cuggcaacuuauuaaa

SEQ ID NO: 3835692 - RNA, 23 nt, Shigella flexneri 2a str. 2457T
cuggcaacuuauuaaaauugcau

SEQ ID NO: 3835693 - RNA, 21 nt, Shigella flexneri 2a str. 2457T
cuggcaagaucggugccgcca

SEQ ID NO: 3835694 - RNA, 16 nt, Shigella flexneri 2a str. 2457T
cuggcaaucaguggcu

SEQ ID NO: 3835695 - RNA, 15 nt, Shigella flexneri 2a str. 2457T
cuggcaauccagcuc

SEQ ID NO: 3835696 - RNA, 13 nt, Shigella flexneri 2a str. 2457T
cuggcaaucgcca

SEQ ID NO: 3835697 - RNA, 17 nt, Shigella flexneri 2a str. 2457T
cuggcaaucgccagcgg

SEQ ID NO: 3835698 - RNA, 12 nt, Shigella flexneri 2a str. 2457T
cuggcaaugacc

SEQ ID NO: 3835699 - RNA, 13 nt, Shigella flexneri 2a str. 2457T
cuggcaaugaccc

SEQ ID NO: 3835700 - RNA, 17 nt, Shigella flexneri 2a str. 2457T
cuggcaaugacgggcuu

SEQ ID NO: 3835701 - RNA, 19 nt, Shigella flexneri 2a str. 2457T
cuggcacaacucggcggcu

SEQ ID NO: 3835702 - RNA, 14 nt, Shigella flexneri 2a str. 2457T
cuggcaccaccugg

SEQ ID NO: 3835703 - RNA, 20 nt, Shigella flexneri 2a str. 2457T
cuggcaccuguaccagcccg

SEQ ID NO: 3835704 - RNA, 16 nt, Shigella flexneri 2a str. 2457T
cuggcacgaccuggca

SEQ ID NO: 3835705 - RNA, 22 nt, Shigella flexneri 2a str. 2457T
cuggcacgcucuucaucgcuaa

SEQ ID NO: 3835706 - RNA, 14 nt, Shigella flexneri 2a str. 2457T
cuggcacugggauc

SEQ ID NO: 3835707 - RNA, 19 nt, Shigella flexneri 2a str. 2457T
cuggcagaaauugacccca

SEQ ID NO: 3835708 - RNA, 22 nt, Shigella flexneri 2a str. 2457T
cuggcagaugcgucuucugcag

SEQ ID NO: 3835709 - RNA, 17 nt, Shigella flexneri 2a str. 2457T
cuggcagcaagugcggc

SEQ ID NO: 3835710 - RNA, 17 nt, Shigella flexneri 2a str. 2457T
cuggcagccauaaucac

SEQ ID NO: 3835711 - RNA, 19 nt, Shigella flexneri 2a str. 2457T
cuggcaguggaauauaauu

SEQ ID NO: 3835712 - RNA, 20 nt, Shigella flexneri 2a str. 2457T
cuggcaguggcaaccagcgg

SEQ ID NO: 3835713 - RNA, 16 nt, Shigella flexneri 2a str. 2457T
cuggcauaaacaaagc

SEQ ID NO: 3835714 - RNA, 20 nt, Shigella flexneri 2a str. 2457T
cuggcaucagcaaacaugcc

SEQ ID NO: 3835715 - RNA, 23 nt, Shigella flexneri 2a str. 2457T
cuggcauccccgcccuuccagcu

SEQ ID NO: 3835716 - RNA, 23 nt, Shigella flexneri 2a str. 2457T
cuggcaugccgguagaagccagu

SEQ ID NO: 3835717 - RNA, 16 nt, Shigella flexneri 2a str. 2457T
cuggcaugcuguccag

SEQ ID NO: 3835718 - RNA, 17 nt, Shigella flexneri 2a str. 2457T
cuggccaaugccucuac

SEQ ID NO: 3835719 - RNA, 21 nt, Shigella flexneri 2a str. 2457T
cuggccacuucuguuacucca

SEQ ID NO: 3835720 - RNA, 16 nt, Shigella flexneri 2a str. 2457T
cuggccauuucugcca

SEQ ID NO: 3835721 - RNA, 22 nt, Shigella flexneri 2a str. 2457T
cuggcccaguugauucgcgcgu

SEQ ID NO: 3835722 - RNA, 15 nt, Shigella flexneri 2a str. 2457T
cuggcccauagacag

SEQ ID NO: 3835723 - RNA, 12 nt, Shigella flexneri 2a str. 2457T
cuggccgcuucc

SEQ ID NO: 3835724 - RNA, 13 nt, Shigella flexneri 2a str. 2457T
cuggccgcuucca

SEQ ID NO: 3835725 - RNA, 15 nt, Shigella flexneri 2a str. 2457T
cuggccgcuuccagc

SEQ ID NO: 3835726 - RNA, 22 nt, Shigella flexneri 2a str. 2457T
cuggccguuguugaacggcaaa

SEQ ID NO: 3835727 - RNA, 21 nt, Shigella flexneri 2a str. 2457T
cuggccuauuaugacuccagc

SEQ ID NO: 3835728 - RNA, 18 nt, Shigella flexneri 2a str. 2457T
cuggccucucuggccgcu

SEQ ID NO: 3835729 - RNA, 18 nt, Shigella flexneri 2a str. 2457T
cuggccuuuaauaugcca

SEQ ID NO: 3835730 - RNA, 17 nt, Shigella flexneri 2a str. 2457T
cuggcgaaccaggaaga

SEQ ID NO: 3835731 - RNA, 18 nt, Shigella flexneri 2a str. 2457T
cuggcgaacccaaccgug

SEQ ID NO: 3835732 - RNA, 20 nt, Shigella flexneri 2a str. 2457T
cuggcgacaugcaucacgcg

SEQ ID NO: 3835733 - RNA, 19 nt, Shigella flexneri 2a str. 2457T
cuggcgauauugccgcgau

SEQ ID NO: 3835734 - RNA, 13 nt, Shigella flexneri 2a str. 2457T
cuggcgaugcccc

SEQ ID NO: 3835735 - RNA, 11 nt, Shigella flexneri 2a str. 2457T
cuggcgcacaa

SEQ ID NO: 3835736 - RNA, 15 nt, Shigella flexneri 2a str. 2457T
cuggcgcagugggcg

SEQ ID NO: 3835737 - RNA, 19 nt, Shigella flexneri 2a str. 2457T
cuggcgcauuaacggcaag

SEQ ID NO: 3835738 - RNA, 16 nt, Shigella flexneri 2a str. 2457T
cuggcgcgaacagcac

SEQ ID NO: 3835739 - RNA, 22 nt, Shigella flexneri 2a str. 2457T
cuggcgcgaacagcacaucagc

SEQ ID NO: 3835740 - RNA, 21 nt, Shigella flexneri 2a str. 2457T
cuggcgcgaauagcuucuuca

SEQ ID NO: 3835741 - RNA, 15 nt, Shigella flexneri 2a str. 2457T
cuggcgcgacgcagg

SEQ ID NO: 3835742 - RNA, 18 nt, Shigella flexneri 2a str. 2457T
cuggcgcguuuaaucaca

SEQ ID NO: 3835743 - RNA, 20 nt, Shigella flexneri 2a str. 2457T
cuggcgcucaccauuuccgg

SEQ ID NO: 3835744 - RNA, 21 nt, Shigella flexneri 2a str. 2457T
cuggcggagcucccaggcucc

SEQ ID NO: 3835745 - RNA, 17 nt, Shigella flexneri 2a str. 2457T
cuggcggaugugcugga

SEQ ID NO: 3835746 - RNA, 18 nt, Shigella flexneri 2a str. 2457T
cuggcggcaaucgccaga

SEQ ID NO: 3835747 - RNA, 17 nt, Shigella flexneri 2a str. 2457T
cuggcggcaaugaaagc

SEQ ID NO: 3835748 - RNA, 12 nt, Shigella flexneri 2a str. 2457T
cuggcggcagca

SEQ ID NO: 3835749 - RNA, 13 nt, Shigella flexneri 2a str. 2457T
cuggcggcagcag

SEQ ID NO: 3835750 - RNA, 20 nt, Shigella flexneri 2a str. 2457T
cuggcgggaauaaaagccag

SEQ ID NO: 3835751 - RNA, 18 nt, Shigella flexneri 2a str. 2457T
cuggcgggcagaggcaau

SEQ ID NO: 3835752 - RNA, 17 nt, Shigella flexneri 2a str. 2457T
cuggcguacagagggca

SEQ ID NO: 3835753 - RNA, 23 nt, Shigella flexneri 2a str. 2457T
cuggcguaccaaucagacucaua

SEQ ID NO: 3835754 - RNA, 16 nt, Shigella flexneri 2a str. 2457T
cuggcguacccaucaa

SEQ ID NO: 3835755 - RNA, 18 nt, Shigella flexneri 2a str. 2457T
cuggcguacccaucaaca

SEQ ID NO: 3835756 - RNA, 17 nt, Shigella flexneri 2a str. 2457T
cuggcgucaaagcugcu

SEQ ID NO: 3835757 - RNA, 16 nt, Shigella flexneri 2a str. 2457T
cuggcgucacgccgac

SEQ ID NO: 3835758 - RNA, 21 nt, Shigella flexneri 2a str. 2457T
cuggcgucacgccgaccagac

SEQ ID NO: 3835759 - RNA, 23 nt, Shigella flexneri 2a str. 2457T
cuggcgucacgccgaccagaccg

SEQ ID NO: 3835760 - RNA, 14 nt, Shigella flexneri 2a str. 2457T
cuggcguccggaaa

SEQ ID NO: 3835761 - RNA, 17 nt, Shigella flexneri 2a str. 2457T
cuggcgugggcaucgau

SEQ ID NO: 3835762 - RNA, 22 nt, Shigella flexneri 2a str. 2457T
cuggcguguuucauuagcccgg

SEQ ID NO: 3835763 - RNA, 22 nt, Shigella flexneri 2a str. 2457T
cuggcguuucucgccacuaaag

SEQ ID NO: 3835764 - RNA, 17 nt, Shigella flexneri 2a str. 2457T
cuggcguuuuuccaaaa

SEQ ID NO: 3835765 - RNA, 23 nt, Shigella flexneri 2a str. 2457T
cuggcuaagaagccuuuaucugg

SEQ ID NO: 3835766 - RNA, 22 nt, Shigella flexneri 2a str. 2457T
cugcguuagaaaacgccugcuc

SEQ ID NO: 3835767 - RNA, 14 nt, Shigella flexneri 2a str. 2457T
cugcguucagcagu

SEQ ID NO: 3835768 - RNA, 18 nt, Shigella flexneri 2a str. 2457T
cugcguucagcaguucug

SEQ ID NO: 3835769 - RNA, 15 nt, Shigella flexneri 2a str. 2457T
cugcguuccggcaug

SEQ ID NO: 3835770 - RNA, 20 nt, Shigella flexneri 2a str. 2457T
cugcguuccggcaugauuca

SEQ ID NO: 3835771 - RNA, 13 nt, Shigella flexneri 2a str. 2457T
cugcguucugucg

SEQ ID NO: 3835772 - RNA, 15 nt, Shigella flexneri 2a str. 2457T
cugcguuucuggcuu

SEQ ID NO: 3835773 - RNA, 20 nt, Shigella flexneri 2a str. 2457T
cugcuaaauuugcacgucag

SEQ ID NO: 3835774 - RNA, 12 nt, Shigella flexneri 2a str. 2457T
cugcuaauuuau

SEQ ID NO: 3835775 - RNA, 22 nt, Shigella flexneri 2a str. 2457T
cugcuagggcgcguccggcguc

SEQ ID NO: 3835776 - RNA, 19 nt, Shigella flexneri 2a str. 2457T
cugcuaugcaagauguuaa

SEQ ID NO: 3835777 - RNA, 17 nt, Shigella flexneri 2a str. 2457T
cugcucaaagccgucga

SEQ ID NO: 3835778 - RNA, 21 nt, Shigella flexneri 2a str. 2457T
cugcucaacugccaguucccc

SEQ ID NO: 3835779 - RNA, 18 nt, Shigella flexneri 2a str. 2457T
cugcucaaucugcgcuuc

SEQ ID NO: 3835780 - RNA, 12 nt, Shigella flexneri 2a str. 2457T
cugcucaauguc

SEQ ID NO: 3835781 - RNA, 12 nt, Shigella flexneri 2a str. 2457T
cugcucagcucc

SEQ ID NO: 3835782 - RNA, 14 nt, Shigella flexneri 2a str. 2457T
cugcucagcuccuc

SEQ ID NO: 3835783 - RNA, 17 nt, Shigella flexneri 2a str. 2457T
cugcucagcuccucuuu

SEQ ID NO: 3835784 - RNA, 21 nt, Shigella flexneri 2a str. 2457T
cugcucaguugcaucgucugu

SEQ ID NO: 3835785 - RNA, 14 nt, Shigella flexneri 2a str. 2457T
cugcucaucuggcg

SEQ ID NO: 3835786 - RNA, 13 nt, Shigella flexneri 2a str. 2457T
cugcuccagugca

SEQ ID NO: 3835787 - RNA, 15 nt, Shigella flexneri 2a str. 2457T
cugcuccagugcauc

SEQ ID NO: 3835788 - RNA, 17 nt, Shigella flexneri 2a str. 2457T
cugcuccauuagcccga

SEQ ID NO: 3835789 - RNA, 23 nt, Shigella flexneri 2a str. 2457T
cugcucccgaaccuuuucucaau

SEQ ID NO: 3835790 - RNA, 14 nt, Shigella flexneri 2a str. 2457T
cugcuccugcggcu

SEQ ID NO: 3835791 - RNA, 16 nt, Shigella flexneri 2a str. 2457T
cugcucgcaucaggga

SEQ ID NO: 3835792 - RNA, 16 nt, Shigella flexneri 2a str. 2457T
cugcucgcuggaagug

SEQ ID NO: 3835793 - RNA, 18 nt, Shigella flexneri 2a str. 2457T
cugcucggucugcugggc

SEQ ID NO: 3835794 - RNA, 15 nt, Shigella flexneri 2a str. 2457T
cugcucuucaguagu

SEQ ID NO: 3835795 - RNA, 15 nt, Shigella flexneri 2a str. 2457T
cugcucuuccggcgu

SEQ ID NO: 3835796 - RNA, 18 nt, Shigella flexneri 2a str. 2457T
cugcucuuucagcaccgc

SEQ ID NO: 3835797 - RNA, 19 nt, Shigella flexneri 2a str. 2457T
cugcucuuucagcaccgcg

SEQ ID NO: 3835798 - RNA, 19 nt, Shigella flexneri 2a str. 2457T
cugcucuuuuugcauaauu

SEQ ID NO: 3835799 - RNA, 15 nt, Shigella flexneri 2a str. 2457T
cugcugaacgugauu

SEQ ID NO: 3835800 - RNA, 17 nt, Shigella flexneri 2a str. 2457T
cugcugaccaccagcac

SEQ ID NO: 3835801 - RNA, 23 nt, Shigella flexneri 2a str. 2457T
cugcugacgcagauccugauuua

SEQ ID NO: 3835802 - RNA, 18 nt, Shigella flexneri 2a str. 2457T
cugcugauuaacccgacc

SEQ ID NO: 3835803 - RNA, 16 nt, Shigella flexneri 2a str. 2457T
cugcugcacgcccuga

SEQ ID NO: 3835804 - RNA, 23 nt, Shigella flexneri 2a str. 2457T
cugcugcacgcccugauaaauca

SEQ ID NO: 3835805 - RNA, 23 nt, Shigella flexneri 2a str. 2457T
cugcugccggcacaggcaucacu

SEQ ID NO: 3835806 - RNA, 19 nt, Shigella flexneri 2a str. 2457T
cugcugcggaauugccggu

SEQ ID NO: 3835807 - RNA, 11 nt, Shigella flexneri 2a str. 2457T
cugcugcggcg

SEQ ID NO: 3835808 - RNA, 16 nt, Shigella flexneri 2a str. 2457T
cugcugcguuccggca

SEQ ID NO: 3835809 - RNA, 17 nt, Shigella flexneri 2a str. 2457T
cugcuggaagcuggcau

SEQ ID NO: 3835810 - RNA, 18 nt, Shigella flexneri 2a str. 2457T
cugcuggguaaagacauc

SEQ ID NO: 3835811 - RNA, 16 nt, Shigella flexneri 2a str. 2457T
cugcugguucugcggg

SEQ ID NO: 3835812 - RNA, 18 nt, Shigella flexneri 2a str. 2457T
cugcuguacuuuuuccuu

SEQ ID NO: 3835813 - RNA, 20 nt, Shigella flexneri 2a str. 2457T
cugcuguagcaguuccagca

SEQ ID NO: 3835814 - RNA, 20 nt, Shigella flexneri 2a str. 2457T
cugcugugccguaaauccca

SEQ ID NO: 3835815 - RNA, 17 nt, Shigella flexneri 2a str. 2457T
cugcuguuccgcaaagc

SEQ ID NO: 3835816 - RNA, 19 nt, Shigella flexneri 2a str. 2457T
cugcuguuuuuucaggccc

SEQ ID NO: 3835817 - RNA, 15 nt, Shigella flexneri 2a str. 2457T
cugcuuaaauuucuu

SEQ ID NO: 3835818 - RNA, 16 nt, Shigella flexneri 2a str. 2457T
cugcuuaacugcgcuu

SEQ ID NO: 3835819 - RNA, 18 nt, Shigella flexneri 2a str. 2457T
cugcuuaauaucccuucc

SEQ ID NO: 3835820 - RNA, 13 nt, Shigella flexneri 2a str. 2457T
cugcuuacaggcu

SEQ ID NO: 3835821 - RNA, 22 nt, Shigella flexneri 2a str. 2457T
cugcuuacaggcugguuucucu

SEQ ID NO: 3835822 - RNA, 19 nt, Shigella flexneri 2a str. 2457T
cugcuuaguaaaaauagug

SEQ ID NO: 3835823 - RNA, 22 nt, Shigella flexneri 2a str. 2457T
cugcuuaguaaaaauagugcgu

SEQ ID NO: 3835824 - RNA, 20 nt, Shigella flexneri 2a str. 2457T
cugcuuaucgcccugcucca

SEQ ID NO: 3835825 - RNA, 20 nt, Shigella flexneri 2a str. 2457T
cugcuucacgcccagaucca

SEQ ID NO: 3835826 - RNA, 22 nt, Shigella flexneri 2a str. 2457T
cugcuucagccgcacuuuuuaa

SEQ ID NO: 3835827 - RNA, 15 nt, Shigella flexneri 2a str. 2457T
cugcuucggucagca

SEQ ID NO: 3835828 - RNA, 12 nt, Shigella flexneri 2a str. 2457T
cugcuucugccg

SEQ ID NO: 3835829 - RNA, 15 nt, Shigella flexneri 2a str. 2457T
cugcuuuacgccagg

SEQ ID NO: 3835830 - RNA, 16 nt, Shigella flexneri 2a str. 2457T
cugcuuuaucagauca

SEQ ID NO: 3835831 - RNA, 17 nt, Shigella flexneri 2a str. 2457T
cugcuuuaucagaucac

SEQ ID NO: 3835832 - RNA, 20 nt, Shigella flexneri 2a str. 2457T
cugcuuucucccaguugugg

SEQ ID NO: 3835833 - RNA, 23 nt, Shigella flexneri 2a str. 2457T
cugcuuuucguucaggccuaccg

SEQ ID NO: 3835834 - RNA, 20 nt, Shigella flexneri 2a str. 2457T
cuggaaaaagugccccagcu

SEQ ID NO: 3835835 - RNA, 21 nt, Shigella flexneri 2a str. 2457T
cuggaaacucacgccagcagc

SEQ ID NO: 3835836 - RNA, 13 nt, Shigella flexneri 2a str. 2457T
cuggaaagagaaa

SEQ ID NO: 3835837 - RNA, 16 nt, Shigella flexneri 2a str. 2457T
cuggaaaucaaugguc

SEQ ID NO: 3835838 - RNA, 24 nt, Shigella flexneri 2a str. 2457T
cuggaaauguccgcgaacagcagc

SEQ ID NO: 3835839 - RNA, 13 nt, Shigella flexneri 2a str. 2457T
cuggaacaaacug

SEQ ID NO: 3835840 - RNA, 18 nt, Shigella flexneri 2a str. 2457T
cuggaacaaacugccgcg

SEQ ID NO: 3835841 - RNA, 13 nt, Shigella flexneri 2a str. 2457T
cuggaacgaugcc

SEQ ID NO: 3835842 - RNA, 20 nt, Shigella flexneri 2a str. 2457T
cuggaagagcgacaaucccu

SEQ ID NO: 3835843 - RNA, 21 nt, Shigella flexneri 2a str. 2457T
cuggaaggacucgaggagcug

SEQ ID NO: 3835844 - RNA, 17 nt, Shigella flexneri 2a str. 2457T
cuggaaggguugaaaua

SEQ ID NO: 3835845 - RNA, 22 nt, Shigella flexneri 2a str. 2457T
cuggaagguaaggauaaaaaag

SEQ ID NO: 3835846 - RNA, 16 nt, Shigella flexneri 2a str. 2457T
cuggaauggaaacagc

SEQ ID NO: 3835847 - RNA, 22 nt, Shigella flexneri 2a str. 2457T
cuggaauuccuuucccuauuuu

SEQ ID NO: 3835848 - RNA, 22 nt, Shigella flexneri 2a str. 2457T
cuggacaaagagcuuucauuuc

SEQ ID NO: 3835849 - RNA, 18 nt, Shigella flexneri 2a str. 2457T
cuggacaacuucugaugu

SEQ ID NO: 3835850 - RNA, 22 nt, Shigella flexneri 2a str. 2457T
cuggacagcucguuaaucagaa

SEQ ID NO: 3835851 - RNA, 23 nt, Shigella flexneri 2a str. 2457T
cuggacguugcguugcagcagga

SEQ ID NO: 3835852 - RNA, 19 nt, Shigella flexneri 2a str. 2457T
cuggacguuugauuuuuaa

SEQ ID NO: 3835853 - RNA, 20 nt, Shigella flexneri 2a str. 2457T
cuggacucccagaacaaccc

SEQ ID NO: 3835854 - RNA, 15 nt, Shigella flexneri 2a str. 2457T
cuggagcaaaaagcg

SEQ ID NO: 3835855 - RNA, 18 nt, Shigella flexneri 2a str. 2457T
cuggagcacugcgcccgc

SEQ ID NO: 3835856 - RNA, 15 nt, Shigella flexneri 2a str. 2457T
cuggagcagcaaaga

SEQ ID NO: 3835857 - RNA, 19 nt, Shigella flexneri 2a str. 2457T
cuggagccgcaucaccgca

SEQ ID NO: 3835858 - RNA, 16 nt, Shigella flexneri 2a str. 2457T
cuggaguggugaaaca

SEQ ID NO: 3835859 - RNA, 16 nt, Shigella flexneri 2a str. 2457T
cuggaguuccuggaug

SEQ ID NO: 3835860 - RNA, 22 nt, Shigella flexneri 2a str. 2457T
cuggauaaggcguucacgccgc

SEQ ID NO: 3835861 - RNA, 22 nt, Shigella flexneri 2a str. 2457T
cuggauaaggcguuuacgccgc

SEQ ID NO: 3835862 - RNA, 18 nt, Shigella flexneri 2a str. 2457T
cuggauaaucacaauggu

SEQ ID NO: 3835863 - RNA, 21 nt, Shigella flexneri 2a str. 2457T
cuggauaaucacaauggucaa

SEQ ID NO: 3835864 - RNA, 23 nt, Shigella flexneri 2a str. 2457T
cugaauggcgauuucacaagacu

SEQ ID NO: 3835865 - RNA, 14 nt, Shigella flexneri 2a str. 2457T
cugaauuaauuuau

SEQ ID NO: 3835866 - RNA, 16 nt, Shigella flexneri 2a str. 2457T
cugaauuucagcgccu

SEQ ID NO: 3835867 - RNA, 18 nt, Shigella flexneri 2a str. 2457T
cugaauuucaucaccagc

SEQ ID NO: 3835868 - RNA, 14 nt, Shigella flexneri 2a str. 2457T
cugaauuugcucca

SEQ ID NO: 3835869 - RNA, 16 nt, Shigella flexneri 2a str. 2457T
cugaauuugcuccaga

SEQ ID NO: 3835870 - RNA, 20 nt, Shigella flexneri 2a str. 2457T
cugacaacgcugaauggcga

SEQ ID NO: 3835871 - RNA, 16 nt, Shigella flexneri 2a str. 2457T
cugacacaggcagcaa

SEQ ID NO: 3835872 - RNA, 19 nt, Shigella flexneri 2a str. 2457T
cugacacuauucgccagca

SEQ ID NO: 3835873 - RNA, 23 nt, Shigella flexneri 2a str. 2457T
cugacaguugucagcccuuuuuc

SEQ ID NO: 3835874 - RNA, 13 nt, Shigella flexneri 2a str. 2457T
cugacauaaacac

SEQ ID NO: 3835875 - RNA, 18 nt, Shigella flexneri 2a str. 2457T
cugacauaaacaccagca

SEQ ID NO: 3835876 - RNA, 21 nt, Shigella flexneri 2a str. 2457T
cugacauaaacaccagcaaua

SEQ ID NO: 3835877 - RNA, 17 nt, Shigella flexneri 2a str. 2457T
cugacauaaccacucac

SEQ ID NO: 3835878 - RNA, 19 nt, Shigella flexneri 2a str. 2457T
cugacauauuuuuguugaa

SEQ ID NO: 3835879 - RNA, 17 nt, Shigella flexneri 2a str. 2457T
cugacauuaucagacac

SEQ ID NO: 3835880 - RNA, 19 nt, Shigella flexneri 2a str. 2457T
cugacauuuuggacaaugc

SEQ ID NO: 3835881 - RNA, 19 nt, Shigella flexneri 2a str. 2457T
cugaccaaauacacgcacg

SEQ ID NO: 3835882 - RNA, 14 nt, Shigella flexneri 2a str. 2457T
cugaccaccagcac

SEQ ID NO: 3835883 - RNA, 15 nt, Shigella flexneri 2a str. 2457T
cugaccaccagcacg

SEQ ID NO: 3835884 - RNA, 17 nt, Shigella flexneri 2a str. 2457T
cugaccaccagcacgcu

SEQ ID NO: 3835885 - RNA, 13 nt, Shigella flexneri 2a str. 2457T
cugaccacggcca

SEQ ID NO: 3835886 - RNA, 15 nt, Shigella flexneri 2a str. 2457T
cugaccacggccaca

SEQ ID NO: 3835887 - RNA, 19 nt, Shigella flexneri 2a str. 2457T
cugaccacggccacagcca

SEQ ID NO: 3835888 - RNA, 20 nt, Shigella flexneri 2a str. 2457T
cugaccacggccacagccag

SEQ ID NO: 3835889 - RNA, 16 nt, Shigella flexneri 2a str. 2457T
cugaccagacuggagc

SEQ ID NO: 3835890 - RNA, 20 nt, Shigella flexneri 2a str. 2457T
cugaccagugaauuucacuu

SEQ ID NO: 3835891 - RNA, 18 nt, Shigella flexneri 2a str. 2457T
cugacccaguagacgagc

SEQ ID NO: 3835892 - RNA, 15 nt, Shigella flexneri 2a str. 2457T
cugacccuugaugug

SEQ ID NO: 3835893 - RNA, 13 nt, Shigella flexneri 2a str. 2457T
cugaccgaccaga

SEQ ID NO: 3835894 - RNA, 15 nt, Shigella flexneri 2a str. 2457T
cugaccgcacacccc

SEQ ID NO: 3835895 - RNA, 23 nt, Shigella flexneri 2a str. 2457T
cugaccgcccgcuaugagcagau

SEQ ID NO: 3835896 - RNA, 16 nt, Shigella flexneri 2a str. 2457T
cugaccguaggccgga

SEQ ID NO: 3835897 - RNA, 20 nt, Shigella flexneri 2a str. 2457T
cugaccgucaccccauugaa

SEQ ID NO: 3835898 - RNA, 13 nt, Shigella flexneri 2a str. 2457T
cugaccgucgccu

SEQ ID NO: 3835899 - RNA, 15 nt, Shigella flexneri 2a str. 2457T
cugaccguuaauuuc

SEQ ID NO: 3835900 - RNA, 22 nt, Shigella flexneri 2a str. 2457T
cugaccugaauuaaugccucuc

SEQ ID NO: 3835901 - RNA, 17 nt, Shigella flexneri 2a str. 2457T
cugaccugcccaaucau

SEQ ID NO: 3835902 - RNA, 20 nt, Shigella flexneri 2a str. 2457T
cugacgaaucaaauaaaaau

SEQ ID NO: 3835903 - RNA, 16 nt, Shigella flexneri 2a str. 2457T
cugacgaggcgucagc

SEQ ID NO: 3835904 - RNA, 21 nt, Shigella flexneri 2a str. 2457T
cugacgaggcgucagcguucc

SEQ ID NO: 3835905 - RNA, 22 nt, Shigella flexneri 2a str. 2457T
cugacgaggcgucagcguucca

SEQ ID NO: 3835906 - RNA, 13 nt, Shigella flexneri 2a str. 2457T
cugacgcaucuuc

SEQ ID NO: 3835907 - RNA, 20 nt, Shigella flexneri 2a str. 2457T
cugacgccaccauucaccaa

SEQ ID NO: 3835908 - RNA, 21 nt, Shigella flexneri 2a str. 2457T
cugacgccaccauucaccaag

SEQ ID NO: 3835909 - RNA, 19 nt, Shigella flexneri 2a str. 2457T
cugacgcccguuuucaccu

SEQ ID NO: 3835910 - RNA, 21 nt, Shigella flexneri 2a str. 2457T
cugacgcgucuuaucuggccu

SEQ ID NO: 3835911 - RNA, 19 nt, Shigella flexneri 2a str. 2457T
cugacgcuuaucuucugua

SEQ ID NO: 3835912 - RNA, 17 nt, Shigella flexneri 2a str. 2457T
cugacggacgcgcggcg

SEQ ID NO: 3835913 - RNA, 13 nt, Shigella flexneri 2a str. 2457T
cugacggcagcga

SEQ ID NO: 3835914 - RNA, 19 nt, Shigella flexneri 2a str. 2457T
cugacggcgauaaaucuca

SEQ ID NO: 3835915 - RNA, 16 nt, Shigella flexneri 2a str. 2457T
cugacggcguucuuua

SEQ ID NO: 3835916 - RNA, 19 nt, Shigella flexneri 2a str. 2457T
cugacggugauaaucaucc

SEQ ID NO: 3835917 - RNA, 21 nt, Shigella flexneri 2a str. 2457T
cugacggugauaaucauccca

SEQ ID NO: 3835918 - RNA, 21 nt, Shigella flexneri 2a str. 2457T
cugacggugauacagcaaaau

SEQ ID NO: 3835919 - RNA, 13 nt, Shigella flexneri 2a str. 2457T
cugacguagcagc

SEQ ID NO: 3835920 - RNA, 15 nt, Shigella flexneri 2a str. 2457T
cugacgucuggccuc

SEQ ID NO: 3835921 - RNA, 20 nt, Shigella flexneri 2a str. 2457T
cugacgugauuuagcaccga

SEQ ID NO: 3835922 - RNA, 23 nt, Shigella flexneri 2a str. 2457T
cugacgugcgcaaacuucuucag

SEQ ID NO: 3835923 - RNA, 20 nt, Shigella flexneri 2a str. 2457T
cugacguugcuguuuuucgu

SEQ ID NO: 3835924 - RNA, 24 nt, Shigella flexneri 2a str. 2457T
cugacuagaugugcaguuccugca

SEQ ID NO: 3835925 - RNA, 13 nt, Shigella flexneri 2a str. 2457T
cugacuauuuccg

SEQ ID NO: 3835926 - RNA, 14 nt, Shigella flexneri 2a str. 2457T
cugacugaaugcca

SEQ ID NO: 3835927 - RNA, 15 nt, Shigella flexneri 2a str. 2457T
cugacugaaugccac

SEQ ID NO: 3835928 - RNA, 16 nt, Shigella flexneri 2a str. 2457T
cugacugacgugauga

SEQ ID NO: 3835929 - RNA, 16 nt, Shigella flexneri 2a str. 2457T
cugacugacuucaaca

SEQ ID NO: 3835930 - RNA, 14 nt, Shigella flexneri 2a str. 2457T
cugacugagcuggu

SEQ ID NO: 3835931 - RNA, 19 nt, Shigella flexneri 2a str. 2457T
cugacugauaacgcggcag

SEQ ID NO: 3835932 - RNA, 20 nt, Shigella flexneri 2a str. 2457T
cugacugauaacgcggcagc

SEQ ID NO: 3835933 - RNA, 18 nt, Shigella flexneri 2a str. 2457T
cugacugccggaugcauc

SEQ ID NO: 3835934 - RNA, 17 nt, Shigella flexneri 2a str. 2457T
cugacuggcucuuuuuc

SEQ ID NO: 3835935 - RNA, 16 nt, Shigella flexneri 2a str. 2457T
cugacuguaggccgga

SEQ ID NO: 3835936 - RNA, 17 nt, Shigella flexneri 2a str. 2457T
cugacugucgcagccag

SEQ ID NO: 3835937 - RNA, 15 nt, Shigella flexneri 2a str. 2457T
cugacuguuccagca

SEQ ID NO: 3835938 - RNA, 16 nt, Shigella flexneri 2a str. 2457T
cugacuguuccagcac

SEQ ID NO: 3835939 - RNA, 14 nt, Shigella flexneri 2a str. 2457T
cugacuuccacuuc

SEQ ID NO: 3835940 - RNA, 16 nt, Shigella flexneri 2a str. 2457T
cugacuuccacuuccu

SEQ ID NO: 3835941 - RNA, 20 nt, Shigella flexneri 2a str. 2457T
cugacuuucguuugaaaacu

SEQ ID NO: 3835942 - RNA, 20 nt, Shigella flexneri 2a str. 2457T
cugacuuugccccagcggga

SEQ ID NO: 3835943 - RNA, 14 nt, Shigella flexneri 2a str. 2457T
cugagaaacucagu

SEQ ID NO: 3835944 - RNA, 21 nt, Shigella flexneri 2a str. 2457T
cugagaacaagauugccugau

SEQ ID NO: 3835945 - RNA, 22 nt, Shigella flexneri 2a str. 2457T
cugagaacaagauugccugaug

SEQ ID NO: 3835946 - RNA, 18 nt, Shigella flexneri 2a str. 2457T
cugagaauuccgacagag

SEQ ID NO: 3835947 - RNA, 18 nt, Shigella flexneri 2a str. 2457T
cugagacagacagccuca

SEQ ID NO: 3835948 - RNA, 15 nt, Shigella flexneri 2a str. 2457T
cugagauacucaagc

SEQ ID NO: 3835949 - RNA, 21 nt, Shigella flexneri 2a str. 2457T
cugagauacucaagcagccag

SEQ ID NO: 3835950 - RNA, 14 nt, Shigella flexneri 2a str. 2457T
cugagauggcuuca

SEQ ID NO: 3835951 - RNA, 21 nt, Shigella flexneri 2a str. 2457T
cugagcaaacaguucugcagc

SEQ ID NO: 3835952 - RNA, 16 nt, Shigella flexneri 2a str. 2457T
cugagcacuggggcuu

SEQ ID NO: 3835953 - RNA, 16 nt, Shigella flexneri 2a str. 2457T
cugagcagccaccacu

SEQ ID NO: 3835954 - RNA, 18 nt, Shigella flexneri 2a str. 2457T
cugagcaucggucgcguu

SEQ ID NO: 3835955 - RNA, 18 nt, Shigella flexneri 2a str. 2457T
cugagccaaacgcccagc

SEQ ID NO: 3835956 - RNA, 14 nt, Shigella flexneri 2a str. 2457T
cugagccagugccg

SEQ ID NO: 3835957 - RNA, 21 nt, Shigella flexneri 2a str. 2457T
cugagccaguuuuucuuuuuc

SEQ ID NO: 3835958 - RNA, 16 nt, Shigella flexneri 2a str. 2457T
cugagccugccauugg

SEQ ID NO: 3835959 - RNA, 20 nt, Shigella flexneri 2a str. 2457T
cugagcgauaaaaucagaaa

SEQ ID NO: 3835960 - RNA, 19 nt, Shigella flexneri 2a str. 2457T
cugagcggccuuuuccuuu

SEQ ID NO: 3835961 - RNA, 22 nt, Shigella flexneri 2a str. 2457T
cugagcgugccccugaauaauc

SEQ ID NO: 3835962 - RNA, 12 nt, Shigella flexneri 2a str. 2457T
cugagcuggcag

SEQ ID NO: 3835963 - RNA, 13 nt, Shigella flexneri 2a str. 2457T
cugagcuucuuca

SEQ ID NO: 3835964 - RNA, 17 nt, Shigella flexneri 2a str. 2457T
cugaggcugaugacaaa

SEQ ID NO: 3835965 - RNA, 22 nt, Shigella flexneri 2a str. 2457T
cugaguaauaacuuccugagug

SEQ ID NO: 3835966 - RNA, 17 nt, Shigella flexneri 2a str. 2457T
cugaguaauccuucccc

SEQ ID NO: 3835967 - RNA, 18 nt, Shigella flexneri 2a str. 2457T
cugagucaauuucugcaa

SEQ ID NO: 3835968 - RNA, 14 nt, Shigella flexneri 2a str. 2457T
cugagucagaaacu

SEQ ID NO: 3835969 - RNA, 20 nt, Shigella flexneri 2a str. 2457T
cugagucgggugcagcgaca

SEQ ID NO: 3835970 - RNA, 19 nt, Shigella flexneri 2a str. 2457T
cugagugggcgucagcagu

SEQ ID NO: 3835971 - RNA, 14 nt, Shigella flexneri 2a str. 2457T
cugaguuaagcaaa

SEQ ID NO: 3835972 - RNA, 23 nt, Shigella flexneri 2a str. 2457T
cugaguugcagcaacucuuuuuc

SEQ ID NO: 3835973 - RNA, 19 nt, Shigella flexneri 2a str. 2457T
cugaguugccaucaucacc

SEQ ID NO: 3835974 - RNA, 20 nt, Shigella flexneri 2a str. 2457T
cugaguugccaucaucacca

SEQ ID NO: 3835975 - RNA, 12 nt, Shigella flexneri 2a str. 2457T
cugauaaaaaac

SEQ ID NO: 3835976 - RNA, 21 nt, Shigella flexneri 2a str. 2457T
cugauaaaaaccauucaggcu

SEQ ID NO: 3835977 - RNA, 14 nt, Shigella flexneri 2a str. 2457T
cugauaaacaagcg

SEQ ID NO: 3835978 - RNA, 17 nt, Shigella flexneri 2a str. 2457T
cugauaaaccuucaucg

SEQ ID NO: 3835979 - RNA, 13 nt, Shigella flexneri 2a str. 2457T
cugauaaaucccg

SEQ ID NO: 3835980 - RNA, 15 nt, Shigella flexneri 2a str. 2457T
cugauaaccuuccag

SEQ ID NO: 3835981 - RNA, 17 nt, Shigella flexneri 2a str. 2457T
cugauaacgcggcagca

SEQ ID NO: 3835982 - RNA, 15 nt, Shigella flexneri 2a str. 2457T
cugauaacgugcagc

SEQ ID NO: 3835983 - RNA, 19 nt, Shigella flexneri 2a str. 2457T
cugauaagcccagcgacca

SEQ ID NO: 3835984 - RNA, 19 nt, Shigella flexneri 2a str. 2457T
cugauaauccagacuauuu

SEQ ID NO: 3835985 - RNA, 20 nt, Shigella flexneri 2a str. 2457T
cugauaaucggggauaagaa

SEQ ID NO: 3835986 - RNA, 16 nt, Shigella flexneri 2a str. 2457T
cugauaauuuuuucac

SEQ ID NO: 3835987 - RNA, 18 nt, Shigella flexneri 2a str. 2457T
cugauacagccaaaucau

SEQ ID NO: 3835988 - RNA, 14 nt, Shigella flexneri 2a str. 2457T
cugauacauagcac

SEQ ID NO: 3835989 - RNA, 14 nt, Shigella flexneri 2a str. 2457T
cugauacugcuccg

SEQ ID NO: 3835990 - RNA, 21 nt, Shigella flexneri 2a str. 2457T
cugauagcguagcgccucagg

SEQ ID NO: 3835991 - RNA, 22 nt, Shigella flexneri 2a str. 2457T
cugauagugauccaucagguag

SEQ ID NO: 3835992 - RNA, 16 nt, Shigella flexneri 2a str. 2457T
cugauagugcugccau

SEQ ID NO: 3835993 - RNA, 15 nt, Shigella flexneri 2a str. 2457T
cugauauacccuuca

SEQ ID NO: 3835994 - RNA, 17 nt, Shigella flexneri 2a str. 2457T
cugauaugccagacuuc

SEQ ID NO: 3835995 - RNA, 18 nt, Shigella flexneri 2a str. 2457T
cugauauuaagcagacgg

SEQ ID NO: 3835996 - RNA, 16 nt, Shigella flexneri 2a str. 2457T
cugauauucgacacca

SEQ ID NO: 3835997 - RNA, 15 nt, Shigella flexneri 2a str. 2457T
cugauauugcccgug

SEQ ID NO: 3835998 - RNA, 16 nt, Shigella flexneri 2a str. 2457T
cugaucaauauagaua

SEQ ID NO: 3835999 - RNA, 15 nt, Shigella flexneri 2a str. 2457T
cugauccagcucuuc

SEQ ID NO: 3836000 - RNA, 17 nt, Shigella flexneri 2a str. 2457T
cugauccccgcaagucc

SEQ ID NO: 3836001 - RNA, 22 nt, Shigella flexneri 2a str. 2457T
cugaucccgauggucagcuuca

SEQ ID NO: 3836002 - RNA, 14 nt, Shigella flexneri 2a str. 2457T
cugauccugacaag

SEQ ID NO: 3836003 - RNA, 18 nt, Shigella flexneri 2a str. 2457T
cugaucgacaaaaucccg

SEQ ID NO: 3836004 - RNA, 17 nt, Shigella flexneri 2a str. 2457T
cugaucgccauauuucu

SEQ ID NO: 3836005 - RNA, 16 nt, Shigella flexneri 2a str. 2457T
cugaucguccugcggu

SEQ ID NO: 3836006 - RNA, 17 nt, Shigella flexneri 2a str. 2457T
cugaugaagacagaccu

SEQ ID NO: 3836007 - RNA, 14 nt, Shigella flexneri 2a str. 2457T
cugaugaagcaagc

SEQ ID NO: 3836008 - RNA, 22 nt, Shigella flexneri 2a str. 2457T
cugaugaagcaagcgucgccag

SEQ ID NO: 3836009 - RNA, 21 nt, Shigella flexneri 2a str. 2457T
cugaugacaaacacaaaacug

SEQ ID NO: 3836010 - RNA, 13 nt, Shigella flexneri 2a str. 2457T
cugaugacaaagu

SEQ ID NO: 3836011 - RNA, 22 nt, Shigella flexneri 2a str. 2457T
cugaugacgcgcuagugcauug

SEQ ID NO: 3836012 - RNA, 21 nt, Shigella flexneri 2a str. 2457T
cugaugacuaaagucuaaaaa

SEQ ID NO: 3836013 - RNA, 17 nt, Shigella flexneri 2a str. 2457T
cugaugagaugcuggag

SEQ ID NO: 3836014 - RNA, 20 nt, Shigella flexneri 2a str. 2457T
cugaugauaaguuaacccca

SEQ ID NO: 3836015 - RNA, 18 nt, Shigella flexneri 2a str. 2457T
cugaugcacgauaacguc

SEQ ID NO: 3836016 - RNA, 16 nt, Shigella flexneri 2a str. 2457T
cugaugcaggcgaucg

SEQ ID NO: 3836017 - RNA, 17 nt, Shigella flexneri 2a str. 2457T
cugaugcaucagucacg

SEQ ID NO: 3836018 - RNA, 13 nt, Shigella flexneri 2a str. 2457T
cugaugcgacacu

SEQ ID NO: 3836019 - RNA, 15 nt, Shigella flexneri 2a str. 2457T
cugaugcgacacugu

SEQ ID NO: 3836020 - RNA, 16 nt, Shigella flexneri 2a str. 2457T
cugaugcgcugcgcuu

SEQ ID NO: 3836021 - RNA, 21 nt, Shigella flexneri 2a str. 2457T
cugaugcgcuucgcuuaucag

SEQ ID NO: 3836022 - RNA, 19 nt, Shigella flexneri 2a str. 2457T
cugauggaauuucaucauc

SEQ ID NO: 3836023 - RNA, 19 nt, Shigella flexneri 2a str. 2457T
cugauggcccaucgucaca

SEQ ID NO: 3836024 - RNA, 23 nt, Shigella flexneri 2a str. 2457T
cugauggcuguuuucagcaccag

SEQ ID NO: 3836025 - RNA, 18 nt, Shigella flexneri 2a str. 2457T
cugaugucagcacuucca

SEQ ID NO: 3836026 - RNA, 19 nt, Shigella flexneri 2a str. 2457T
cugaugugacgcugucuua

SEQ ID NO: 3836027 - RNA, 14 nt, Shigella flexneri 2a str. 2457T
cugauguucgccag

SEQ ID NO: 3836028 - RNA, 15 nt, Shigella flexneri 2a str. 2457T
cugauguucgccaga

SEQ ID NO: 3836029 - RNA, 23 nt, Shigella flexneri 2a str. 2457T
cugauguuguuucucuuucuuca

SEQ ID NO: 3836030 - RNA, 20 nt, Shigella flexneri 2a str. 2457T
cugauuaccuuccugccaga

SEQ ID NO: 3836031 - RNA, 14 nt, Shigella flexneri 2a str. 2457T
cugauuacuuccuu

SEQ ID NO: 3836032 - RNA, 17 nt, Shigella flexneri 2a str. 2457T
cugauuaugucaucauc

SEQ ID NO: 3836033 - RNA, 20 nt, Shigella flexneri 2a str. 2457T
cugauucaaaaccgguucug

SEQ ID NO: 3836034 - RNA, 13 nt, Shigella flexneri 2a str. 2457T
cugauucagauaa

SEQ ID NO: 3836035 - RNA, 14 nt, Shigella flexneri 2a str. 2457T
cugauucagauaau

SEQ ID NO: 3836036 - RNA, 19 nt, Shigella flexneri 2a str. 2457T
cugauucaugaacuguaca

SEQ ID NO: 3836037 - RNA, 18 nt, Shigella flexneri 2a str. 2457T
cugauucgcgccacguuc

SEQ ID NO: 3836038 - RNA, 13 nt, Shigella flexneri 2a str. 2457T
cugauucgucaau

SEQ ID NO: 3836039 - RNA, 17 nt, Shigella flexneri 2a str. 2457T
cugauucugauccugca

SEQ ID NO: 3836040 - RNA, 18 nt, Shigella flexneri 2a str. 2457T
cugauucugauccugcac

SEQ ID NO: 3836041 - RNA, 18 nt, Shigella flexneri 2a str. 2457T
cugauugaccgccagcgc

SEQ ID NO: 3836042 - RNA, 16 nt, Shigella flexneri 2a str. 2457T
cugauugcggagaagg

SEQ ID NO: 3836043 - RNA, 22 nt, Shigella flexneri 2a str. 2457T
cugauuuaaccaacaauaaaau

SEQ ID NO: 3836044 - RNA, 19 nt, Shigella flexneri 2a str. 2457T
cugauuuauagauuuacua

SEQ ID NO: 3836045 - RNA, 13 nt, Shigella flexneri 2a str. 2457T
cugauuucaccau

SEQ ID NO: 3836046 - RNA, 21 nt, Shigella flexneri 2a str. 2457T
cugauuugauaaugccagccu

SEQ ID NO: 3836047 - RNA, 13 nt, Shigella flexneri 2a str. 2457T
cugauuuuauugc

SEQ ID NO: 3836048 - RNA, 18 nt, Shigella flexneri 2a str. 2457T
cugauuuucaucuucuuc

SEQ ID NO: 3836049 - RNA, 17 nt, Shigella flexneri 2a str. 2457T
cugauuuugcaacaacu

SEQ ID NO: 3836050 - RNA, 16 nt, Shigella flexneri 2a str. 2457T
cugcaaaauaccaaua

SEQ ID NO: 3836051 - RNA, 17 nt, Shigella flexneri 2a str. 2457T
cugcaaaauaccaauaa

SEQ ID NO: 3836052 - RNA, 22 nt, Shigella flexneri 2a str. 2457T
cugcaaaauaccaauaaucaau

SEQ ID NO: 3836053 - RNA, 20 nt, Shigella flexneri 2a str. 2457T
cugcaaagcugaugguugaa

SEQ ID NO: 3836054 - RNA, 21 nt, Shigella flexneri 2a str. 2457T
cugcaaagucugggcuuuugu

SEQ ID NO: 3836055 - RNA, 13 nt, Shigella flexneri 2a str. 2457T
cugcaaauaaaua

SEQ ID NO: 3836056 - RNA, 14 nt, Shigella flexneri 2a str. 2457T
cugcaaauauuaau

SEQ ID NO: 3836057 - RNA, 14 nt, Shigella flexneri 2a str. 2457T
cugcaaaucaccac

SEQ ID NO: 3836058 - RNA, 22 nt, Shigella flexneri 2a str. 2457T
cugcaaaucugcgccuacggca

SEQ ID NO: 3836059 - RNA, 14 nt, Shigella flexneri 2a str. 2457T
cugcaaauuauuug

SEQ ID NO: 3836060 - RNA, 15 nt, Shigella flexneri 2a str. 2457T
cugcaaauucaauaa

SEQ ID NO: 3836061 - RNA, 13 nt, Shigella flexneri 2a str. 2457T
cugcaacgagugc

SEQ ID NO: 3836062 - RNA, 22 nt, Shigella flexneri 2a str. 2457T
cugcaacgccuuugucgggcag

SEQ ID NO: 3836063 - RNA, 13 nt, Shigella flexneri 2a str. 2457T
cugcaacugcgcg

SEQ ID NO: 3836064 - RNA, 14 nt, Shigella flexneri 2a str. 2457T
cugcaacuucucuu

SEQ ID NO: 3836065 - RNA, 16 nt, Shigella flexneri 2a str. 2457T
cugcaacuucucuuuc

SEQ ID NO: 3836066 - RNA, 22 nt, Shigella flexneri 2a str. 2457T
cugcaaggccauccgcugcggu

SEQ ID NO: 3836067 - RNA, 14 nt, Shigella flexneri 2a str. 2457T
cugcaaggcucuau

SEQ ID NO: 3836068 - RNA, 18 nt, Shigella flexneri 2a str. 2457T
cugcaaggugaaagcaau

SEQ ID NO: 3836069 - RNA, 21 nt, Shigella flexneri 2a str. 2457T
cugcaauaaaauaucuuccac

SEQ ID NO: 3836070 - RNA, 12 nt, Shigella flexneri 2a str. 2457T
cugcaaugacca

SEQ ID NO: 3836071 - RNA, 20 nt, Shigella flexneri 2a str. 2457T
cugcaaugccguuugcugca

SEQ ID NO: 3836072 - RNA, 16 nt, Shigella flexneri 2a str. 2457T
cugcaauugcggcagg

SEQ ID NO: 3836073 - RNA, 17 nt, Shigella flexneri 2a str. 2457T
cugcaauugcggcaggu

SEQ ID NO: 3836074 - RNA, 23 nt, Shigella flexneri 2a str. 2457T
cugcaauugcggcaggucaucgu

SEQ ID NO: 3836075 - RNA, 20 nt, Shigella flexneri 2a str. 2457T
cugcacaaguuguuuacagu

SEQ ID NO: 3836076 - RNA, 16 nt, Shigella flexneri 2a str. 2457T
cugcacaccaaccgcu

SEQ ID NO: 3836077 - RNA, 18 nt, Shigella flexneri 2a str. 2457T
cugcacaccgcggaacgc

SEQ ID NO: 3836078 - RNA, 14 nt, Shigella flexneri 2a str. 2457T
cugcaccaggcggg

SEQ ID NO: 3836079 - RNA, 17 nt, Shigella flexneri 2a str. 2457T
cugcaccauugcugccg

SEQ ID NO: 3836080 - RNA, 19 nt, Shigella flexneri 2a str. 2457T
cugcacccuuuuuuuaaau

SEQ ID NO: 3836081 - RNA, 22 nt, Shigella flexneri 2a str. 2457T
cugcacggagauauccagcgcc

SEQ ID NO: 3836082 - RNA, 23 nt, Shigella flexneri 2a str. 2457T
cugcacggagauauccagcgccg

SEQ ID NO: 3836083 - RNA, 24 nt, Shigella flexneri 2a str. 2457T
cugcacggcuucccacgucagacc

SEQ ID NO: 3836084 - RNA, 19 nt, Shigella flexneri 2a str. 2457T
cugcacgguuuuuccagcu

SEQ ID NO: 3836085 - RNA, 20 nt, Shigella flexneri 2a str. 2457T
cugcacgucauacugcucag

SEQ ID NO: 3836086 - RNA, 17 nt, Shigella flexneri 2a str. 2457T
cugcacugcaggccgga

SEQ ID NO: 3836087 - RNA, 15 nt, Shigella flexneri 2a str. 2457T
cugcacuggcuucca

SEQ ID NO: 3836088 - RNA, 21 nt, Shigella flexneri 2a str. 2457T
cugcacuuaacaggaucuggu

SEQ ID NO: 3836089 - RNA, 21 nt, Shigella flexneri 2a str. 2457T
cugcacuuugugucagcgcca

SEQ ID NO: 3836090 - RNA, 19 nt, Shigella flexneri 2a str. 2457T
cugcagcagccugcgcuuc

SEQ ID NO: 3836091 - RNA, 20 nt, Shigella flexneri 2a str. 2457T
cugcagcagccugcgcuucu

SEQ ID NO: 3836092 - RNA, 23 nt, Shigella flexneri 2a str. 2457T
cugcagcagccugcgcuucuuuu

SEQ ID NO: 3836093 - RNA, 18 nt, Shigella flexneri 2a str. 2457T
cugcagccagggucaaca

SEQ ID NO: 3836094 - RNA, 23 nt, Shigella flexneri 2a str. 2457T
cugcagcucaucuaaugcagggg

SEQ ID NO: 3836095 - RNA, 18 nt, Shigella flexneri 2a str. 2457T
cugcaggaacggcaauac

SEQ ID NO: 3836096 - RNA, 16 nt, Shigella flexneri 2a str. 2457T
cugcaggaccauacug

SEQ ID NO: 3836097 - RNA, 14 nt, Shigella flexneri 2a str. 2457T
cugcagggcuuuca

SEQ ID NO: 3836098 - RNA, 20 nt, Shigella flexneri 2a str. 2457T
cugcagguauugcuucucag

SEQ ID NO: 3836099 - RNA, 14 nt, Shigella flexneri 2a str. 2457T
cugcagugaaauua

SEQ ID NO: 3836100 - RNA, 18 nt, Shigella flexneri 2a str. 2457T
cugcagugaaauuaaacu

SEQ ID NO: 3836101 - RNA, 21 nt, Shigella flexneri 2a str. 2457T
cugcagugcacgaaccagaga

SEQ ID NO: 3836102 - RNA, 20 nt, Shigella flexneri 2a str. 2457T
cugcauaaacgccgucauca

SEQ ID NO: 3836103 - RNA, 16 nt, Shigella flexneri 2a str. 2457T
cugcauacgacgugcc

SEQ ID NO: 3836104 - RNA, 21 nt, Shigella flexneri 2a str. 2457T
cugcauacggugaaaguccuc

SEQ ID NO: 3836105 - RNA, 13 nt, Shigella flexneri 2a str. 2457T
cugcaucaaccaa

SEQ ID NO: 3836106 - RNA, 19 nt, Shigella flexneri 2a str. 2457T
cugcaucaaccaacaccug

SEQ ID NO: 3836107 - RNA, 12 nt, Shigella flexneri 2a str. 2457T
cugcaucaccau

SEQ ID NO: 3836108 - RNA, 15 nt, Shigella flexneri 2a str. 2457T
cugcaucaccaucuu

SEQ ID NO: 3836109 - RNA, 19 nt, Shigella flexneri 2a str. 2457T
cugcaucagcgccuuacca

SEQ ID NO: 3836110 - RNA, 16 nt, Shigella flexneri 2a str. 2457T
cugcauccgccaucca

SEQ ID NO: 3836111 - RNA, 13 nt, Shigella flexneri 2a str. 2457T
cugcauccguucu

SEQ ID NO: 3836112 - RNA, 23 nt, Shigella flexneri 2a str. 2457T
cugcaucgcgcugaacaucgucu

SEQ ID NO: 3836113 - RNA, 12 nt, Shigella flexneri 2a str. 2457T
cugcaucuuccg

SEQ ID NO: 3836114 - RNA, 18 nt, Shigella flexneri 2a str. 2457T
cugcauguaaccuaauuu

SEQ ID NO: 3836115 - RNA, 14 nt, Shigella flexneri 2a str. 2457T
cugcauguuggcga

SEQ ID NO: 3836116 - RNA, 15 nt, Shigella flexneri 2a str. 2457T
cugcauuauccagcg

SEQ ID NO: 3836117 - RNA, 17 nt, Shigella flexneri 2a str. 2457T
cugcauuaugagauuga

SEQ ID NO: 3836118 - RNA, 22 nt, Shigella flexneri 2a str. 2457T
cugcauuccgguguaaccauca

SEQ ID NO: 3836119 - RNA, 13 nt, Shigella flexneri 2a str. 2457T
cugcauugacaag

SEQ ID NO: 3836120 - RNA, 13 nt, Shigella flexneri 2a str. 2457T
cugcauugucgga

SEQ ID NO: 3836121 - RNA, 13 nt, Shigella flexneri 2a str. 2457T
cugcauuuucucg

SEQ ID NO: 3836122 - RNA, 18 nt, Shigella flexneri 2a str. 2457T
cugccaaacgcucccugc

SEQ ID NO: 3836123 - RNA, 14 nt, Shigella flexneri 2a str. 2457T
cugccaauacaaaa

SEQ ID NO: 3836124 - RNA, 13 nt, Shigella flexneri 2a str. 2457T
cugccacgccacg

SEQ ID NO: 3836125 - RNA, 22 nt, Shigella flexneri 2a str. 2457T
cugccacgguaugacccagcgc

SEQ ID NO: 3836126 - RNA, 15 nt, Shigella flexneri 2a str. 2457T
cugccacuacccgca

SEQ ID NO: 3836127 - RNA, 19 nt, Shigella flexneri 2a str. 2457T
cugccagacccauaaucag

SEQ ID NO: 3836128 - RNA, 15 nt, Shigella flexneri 2a str. 2457T
cugccagaccugcga

SEQ ID NO: 3836129 - RNA, 13 nt, Shigella flexneri 2a str. 2457T
cugccagaucauc

SEQ ID NO: 3836130 - RNA, 16 nt, Shigella flexneri 2a str. 2457T
cugccagauucuccaa

SEQ ID NO: 3836131 - RNA, 13 nt, Shigella flexneri 2a str. 2457T
cugccagcgccga

SEQ ID NO: 3836132 - RNA, 20 nt, Shigella flexneri 2a str. 2457T
cugccagcguaaauccugac

SEQ ID NO: 3836133 - RNA, 17 nt, Shigella flexneri 2a str. 2457T
cugccagcgugagggaa

SEQ ID NO: 3836134 - RNA, 15 nt, Shigella flexneri 2a str. 2457T
cugccagcguggcga

SEQ ID NO: 3836135 - RNA, 23 nt, Shigella flexneri 2a str. 2457T
cugccaggucgugccagaaaguc

SEQ ID NO: 3836136 - RNA, 18 nt, Shigella flexneri 2a str. 2457T
cugccagucaaucaucca

SEQ ID NO: 3836137 - RNA, 21 nt, Shigella flexneri 2a str. 2457T
cugccaguucccccugccaga

SEQ ID NO: 3836138 - RNA, 22 nt, Shigella flexneri 2a str. 2457T
cugccaucauggcauccuguuu

SEQ ID NO: 3836139 - RNA, 14 nt, Shigella flexneri 2a str. 2457T
cugccauccugauu

SEQ ID NO: 3836140 - RNA, 21 nt, Shigella flexneri 2a str. 2457T
cugccauuggcaggcucuggu

SEQ ID NO: 3836141 - RNA, 15 nt, Shigella flexneri 2a str. 2457T
cugcccaagcgggga

SEQ ID NO: 3836142 - RNA, 19 nt, Shigella flexneri 2a str. 2457T
cugcccacgcgguauccau

SEQ ID NO: 3836143 - RNA, 17 nt, Shigella flexneri 2a str. 2457T
cugcccacgggcaggcu

SEQ ID NO: 3836144 - RNA, 13 nt, Shigella flexneri 2a str. 2457T
cugcccacuccag

SEQ ID NO: 3836145 - RNA, 15 nt, Shigella flexneri 2a str. 2457T
cugcccacuccagcu

SEQ ID NO: 3836146 - RNA, 20 nt, Shigella flexneri 2a str. 2457T
cugcccaucauaccugagug

SEQ ID NO: 3836147 - RNA, 15 nt, Shigella flexneri 2a str. 2457T
cugccccagugggcu

SEQ ID NO: 3836148 - RNA, 18 nt, Shigella flexneri 2a str. 2457T
cugcccgugggcaggccu

SEQ ID NO: 3836149 - RNA, 16 nt, Shigella flexneri 2a str. 2457T
cugcccguuaaccaua

SEQ ID NO: 3836150 - RNA, 18 nt, Shigella flexneri 2a str. 2457T
cugcccguugccaggacc

SEQ ID NO: 3836151 - RNA, 19 nt, Shigella flexneri 2a str. 2457T
cugcccguugccaggaccg

SEQ ID NO: 3836152 - RNA, 13 nt, Shigella flexneri 2a str. 2457T
cugcccugcuggu

SEQ ID NO: 3836153 - RNA, 18 nt, Shigella flexneri 2a str. 2457T
cugcccuugccaacgcaa

SEQ ID NO: 3836154 - RNA, 20 nt, Shigella flexneri 2a str. 2457T
cugcccuugccaacgcaaac

SEQ ID NO: 3836155 - RNA, 14 nt, Shigella flexneri 2a str. 2457T
cugccgacaaaugc

SEQ ID NO: 3836156 - RNA, 15 nt, Shigella flexneri 2a str. 2457T
cugccgaccaucugu

SEQ ID NO: 3836157 - RNA, 15 nt, Shigella flexneri 2a str. 2457T
cugccgauggcacaa

SEQ ID NO: 3836158 - RNA, 14 nt, Shigella flexneri 2a str. 2457T
cugccgcaauggcc

SEQ ID NO: 3836159 - RNA, 15 nt, Shigella flexneri 2a str. 2457T
cugccgcacggacaa

SEQ ID NO: 3836160 - RNA, 15 nt, Shigella flexneri 2a str. 2457T
cugccgccaguucuu

SEQ ID NO: 3836161 - RNA, 20 nt, Shigella flexneri 2a str. 2457T
cugccgccaguucuuccagu

SEQ ID NO: 3836162 - RNA, 21 nt, Shigella flexneri 2a str. 2457T
cugccgcgcacgucagccucg

SEQ ID NO: 3836163 - RNA, 16 nt, Shigella flexneri 2a str. 2457T
cugccgcugcgcguga

SEQ ID NO: 3836164 - RNA, 15 nt, Shigella flexneri 2a str. 2457T
cugccggaacgugca

SEQ ID NO: 3836165 - RNA, 19 nt, Shigella flexneri 2a str. 2457T
cugccggagggauguggcc

SEQ ID NO: 3836166 - RNA, 22 nt, Shigella flexneri 2a str. 2457T
cugccggaugacagacuccgcu

SEQ ID NO: 3836167 - RNA, 23 nt, Shigella flexneri 2a str. 2457T
cugccggaugcaucgcauccgac

SEQ ID NO: 3836168 - RNA, 21 nt, Shigella flexneri 2a str. 2457T
cugccggcacaggcaucacuu

SEQ ID NO: 3836169 - RNA, 23 nt, Shigella flexneri 2a str. 2457T
cugccggggagauauuccccaga

SEQ ID NO: 3836170 - RNA, 19 nt, Shigella flexneri 2a str. 2457T
cugccgggguaaagcgcgg

SEQ ID NO: 3836171 - RNA, 23 nt, Shigella flexneri 2a str. 2457T
cugccguaauagauccuuuuucc

SEQ ID NO: 3836172 - RNA, 21 nt, Shigella flexneri 2a str. 2457T
cugccguacaggcagcuuaga

SEQ ID NO: 3836173 - RNA, 23 nt, Shigella flexneri 2a str. 2457T
cugccguacaggcagcuuagaaa

SEQ ID NO: 3836174 - RNA, 15 nt, Shigella flexneri 2a str. 2457T
cugccgucaauuuua

SEQ ID NO: 3836175 - RNA, 21 nt, Shigella flexneri 2a str. 2457T
cugccguccccaucaggaaac

SEQ ID NO: 3836176 - RNA, 18 nt, Shigella flexneri 2a str. 2457T
cugccguugcuugaugca

SEQ ID NO: 3836177 - RNA, 19 nt, Shigella flexneri 2a str. 2457T
cugccucgggauccaugca

SEQ ID NO: 3836178 - RNA, 21 nt, Shigella flexneri 2a str. 2457T
cugccucgggauccaugcacg

SEQ ID NO: 3836179 - RNA, 17 nt, Shigella flexneri 2a str. 2457T
cugccucucuucgcugc

SEQ ID NO: 3836180 - RNA, 18 nt, Shigella flexneri 2a str. 2457T
cugccucucuucgcugcu

SEQ ID NO: 3836181 - RNA, 21 nt, Shigella flexneri 2a str. 2457T
cugccucucuucgcugcuggu

SEQ ID NO: 3836182 - RNA, 18 nt, Shigella flexneri 2a str. 2457T
cugccugauccugggcua

SEQ ID NO: 3836183 - RNA, 10 nt, Shigella flexneri 2a str. 2457T
cugccugaug

SEQ ID NO: 3836184 - RNA, 13 nt, Shigella flexneri 2a str. 2457T
cugccugaugcgc

SEQ ID NO: 3836185 - RNA, 15 nt, Shigella flexneri 2a str. 2457T
cugccuuauccagca

SEQ ID NO: 3836186 - RNA, 16 nt, Shigella flexneri 2a str. 2457T
cugcgaaaguaccauu

SEQ ID NO: 3836187 - RNA, 13 nt, Shigella flexneri 2a str. 2457T
cugcgaaucgcuu

SEQ ID NO: 3836188 - RNA, 19 nt, Shigella flexneri 2a str. 2457T
cugcgaaucgcuucauuua

SEQ ID NO: 3836189 - RNA, 20 nt, Shigella flexneri 2a str. 2457T
cugcgacagggaucucuucc

SEQ ID NO: 3836190 - RNA, 21 nt, Shigella flexneri 2a str. 2457T
cugcgacagggaucucuucca

SEQ ID NO: 3836191 - RNA, 22 nt, Shigella flexneri 2a str. 2457T
cugcgacagggaucucuuccag

SEQ ID NO: 3836192 - RNA, 23 nt, Shigella flexneri 2a str. 2457T
cugcgacgcaaacgacgagcgcu

SEQ ID NO: 3836193 - RNA, 18 nt, Shigella flexneri 2a str. 2457T
cugcgacgucucggcaug

SEQ ID NO: 3836194 - RNA, 13 nt, Shigella flexneri 2a str. 2457T
cugcgacucucag

SEQ ID NO: 3836195 - RNA, 23 nt, Shigella flexneri 2a str. 2457T
cugcgagguuauccgccagcgcc

SEQ ID NO: 3836196 - RNA, 13 nt, Shigella flexneri 2a str. 2457T
cugcgaguccugu

SEQ ID NO: 3836197 - RNA, 15 nt, Shigella flexneri 2a str. 2457T
cugcgauaacggucg

SEQ ID NO: 3836198 - RNA, 20 nt, Shigella flexneri 2a str. 2457T
cugcgauaguggaacaaaga

SEQ ID NO: 3836199 - RNA, 14 nt, Shigella flexneri 2a str. 2457T
cugcgaugucugau

SEQ ID NO: 3836200 - RNA, 21 nt, Shigella flexneri 2a str. 2457T
cugcgauugugacacgcgcgc

SEQ ID NO: 3836201 - RNA, 17 nt, Shigella flexneri 2a str. 2457T
cugcgauuuaacgccug

SEQ ID NO: 3836202 - RNA, 17 nt, Shigella flexneri 2a str. 2457T
cugcgcagauuagccgg

SEQ ID NO: 3836203 - RNA, 14 nt, Shigella flexneri 2a str. 2457T
cugcgcaucaugcc

SEQ ID NO: 3836204 - RNA, 17 nt, Shigella flexneri 2a str. 2457T
cugcgcaucaugccacc

SEQ ID NO: 3836205 - RNA, 19 nt, Shigella flexneri 2a str. 2457T
cugcgcaucaugccaccca

SEQ ID NO: 3836206 - RNA, 21 nt, Shigella flexneri 2a str. 2457T
cugcgcaucaugccacccagg

SEQ ID NO: 3836207 - RNA, 14 nt, Shigella flexneri 2a str. 2457T
cugcgcaucuuccc

SEQ ID NO: 3836208 - RNA, 15 nt, Shigella flexneri 2a str. 2457T
cugcgcauuucccag

SEQ ID NO: 3836209 - RNA, 20 nt, Shigella flexneri 2a str. 2457T
cugcgcauuucccagcaaga

SEQ ID NO: 3836210 - RNA, 13 nt, Shigella flexneri 2a str. 2457T
cugcgccaauacc

SEQ ID NO: 3836211 - RNA, 13 nt, Shigella flexneri 2a str. 2457T
cugcgccaccaca

SEQ ID NO: 3836212 - RNA, 16 nt, Shigella flexneri 2a str. 2457T
cugcgccaccacaaca

SEQ ID NO: 3836213 - RNA, 12 nt, Shigella flexneri 2a str. 2457T
cugcgccagcca

SEQ ID NO: 3836214 - RNA, 15 nt, Shigella flexneri 2a str. 2457T
cugcgccagccagcc

SEQ ID NO: 3836215 - RNA, 12 nt, Shigella flexneri 2a str. 2457T
cugcgccagcgc

SEQ ID NO: 3836216 - RNA, 16 nt, Shigella flexneri 2a str. 2457T
cugcgccagcgcgcgu

SEQ ID NO: 3836217 - RNA, 18 nt, Shigella flexneri 2a str. 2457T
cugcgccagcggcaguaa

SEQ ID NO: 3836218 - RNA, 13 nt, Shigella flexneri 2a str. 2457T
cugcgcccgcagc

SEQ ID NO: 3836219 - RNA, 14 nt, Shigella flexneri 2a str. 2457T
cugcgcccgcccgc

SEQ ID NO: 3836220 - RNA, 22 nt, Shigella flexneri 2a str. 2457T
cugcgccuuuuuucgccgcagc

SEQ ID NO: 3836221 - RNA, 16 nt, Shigella flexneri 2a str. 2457T
cugcgcgacucccuga

SEQ ID NO: 3836222 - RNA, 17 nt, Shigella flexneri 2a str. 2457T
cugcgcgacuucauuca

SEQ ID NO: 3836223 - RNA, 22 nt, Shigella flexneri 2a str. 2457T
cugcgcgucuuaucaggccugu

SEQ ID NO: 3836224 - RNA, 16 nt, Shigella flexneri 2a str. 2457T
cugcgcuaaacaggau

SEQ ID NO: 3836225 - RNA, 19 nt, Shigella flexneri 2a str. 2457T
cugcgcuaaacaggaucug

SEQ ID NO: 3836226 - RNA, 14 nt, Shigella flexneri 2a str. 2457T
cugcgcuaccagga

SEQ ID NO: 3836227 - RNA, 14 nt, Shigella flexneri 2a str. 2457T
cugcgcuauccagc

SEQ ID NO: 3836228 - RNA, 15 nt, Shigella flexneri 2a str. 2457T
cugcgcucuucuggc

SEQ ID NO: 3836229 - RNA, 21 nt, Shigella flexneri 2a str. 2457T
cugcgcuggaacaacgcgcgu

SEQ ID NO: 3836230 - RNA, 15 nt, Shigella flexneri 2a str. 2457T
cugcgcuuccagcuc

SEQ ID NO: 3836231 - RNA, 16 nt, Shigella flexneri 2a str. 2457T
cugcgcuuccagcucc

SEQ ID NO: 3836232 - RNA, 16 nt, Shigella flexneri 2a str. 2457T
cugcgcuuccugcaac

SEQ ID NO: 3836233 - RNA, 18 nt, Shigella flexneri 2a str. 2457T
cugcggaaucaccggcaa

SEQ ID NO: 3836234 - RNA, 17 nt, Shigella flexneri 2a str. 2457T
cugcggacaaaacguga

SEQ ID NO: 3836235 - RNA, 13 nt, Shigella flexneri 2a str. 2457T
cugcggacgcacc

SEQ ID NO: 3836236 - RNA, 23 nt, Shigella flexneri 2a str. 2457T
cugcggcaagaauuacuucuuga

SEQ ID NO: 3836237 - RNA, 14 nt, Shigella flexneri 2a str. 2457T
cugcggccagcagc

SEQ ID NO: 3836238 - RNA, 19 nt, Shigella flexneri 2a str. 2457T
cugcggcggcaucgccuuc

SEQ ID NO: 3836239 - RNA, 19 nt, Shigella flexneri 2a str. 2457T
cugcgggaacauaugcaca

SEQ ID NO: 3836240 - RNA, 13 nt, Shigella flexneri 2a str. 2457T
cugcgggagcgcu

SEQ ID NO: 3836241 - RNA, 14 nt, Shigella flexneri 2a str. 2457T
cugcggguuagucu

SEQ ID NO: 3836242 - RNA, 17 nt, Shigella flexneri 2a str. 2457T
cugcggguuagucugca

SEQ ID NO: 3836243 - RNA, 14 nt, Shigella flexneri 2a str. 2457T
cugcgguaauccgg

SEQ ID NO: 3836244 - RNA, 16 nt, Shigella flexneri 2a str. 2457T
cugcgguucagcuuuu

SEQ ID NO: 3836245 - RNA, 20 nt, Shigella flexneri 2a str. 2457T
cugcgguuucaacgacccag

SEQ ID NO: 3836246 - RNA, 18 nt, Shigella flexneri 2a str. 2457T
cugcguaucgcccugcca

SEQ ID NO: 3836247 - RNA, 11 nt, Shigella flexneri 2a str. 2457T
cugcguauuuc

SEQ ID NO: 3836248 - RNA, 23 nt, Shigella flexneri 2a str. 2457T
cugcgucauuccggaguuuauga

SEQ ID NO: 3836249 - RNA, 19 nt, Shigella flexneri 2a str. 2457T
cugcgucgacauagccauc

SEQ ID NO: 3836250 - RNA, 19 nt, Shigella flexneri 2a str. 2457T
cugcgucgcuuuccagucg

SEQ ID NO: 3836251 - RNA, 17 nt, Shigella flexneri 2a str. 2457T
cugcgugacuaaaaccc

SEQ ID NO: 3836252 - RNA, 15 nt, Shigella flexneri 2a str. 2457T
cugcguggaauuugu

SEQ ID NO: 3836253 - RNA, 16 nt, Shigella flexneri 2a str. 2457T
cugcguggaauuuguc

SEQ ID NO: 3836254 - RNA, 20 nt, Shigella flexneri 2a str. 2457T
cugcgugucggacggaauuu

SEQ ID NO: 3836255 - RNA, 20 nt, Shigella flexneri 2a str. 2457T
cugcgugucguaagccaccg

SEQ ID NO: 3836256 - RNA, 23 nt, Shigella flexneri 2a str. 2457T
cggucagcagcaccaccgcccgu

SEQ ID NO: 3836257 - RNA, 23 nt, Shigella flexneri 2a str. 2457T
cggucagccauugcuaccgcuuc

SEQ ID NO: 3836258 - RNA, 15 nt, Shigella flexneri 2a str. 2457T
cggucaucaguucag

SEQ ID NO: 3836259 - RNA, 22 nt, Shigella flexneri 2a str. 2457T
cggucauuuucuucagcaguuc

SEQ ID NO: 3836260 - RNA, 18 nt, Shigella flexneri 2a str. 2457T
cggucauuuugaccacac

SEQ ID NO: 3836261 - RNA, 18 nt, Shigella flexneri 2a str. 2457T
cgguccgguugcagagua

SEQ ID NO: 3836262 - RNA, 11 nt, Shigella flexneri 2a str. 2457T
cgguccuggcg

SEQ ID NO: 3836263 - RNA, 18 nt, Shigella flexneri 2a str. 2457T
cgguccuggcgaucgggc

SEQ ID NO: 3836264 - RNA, 19 nt, Shigella flexneri 2a str. 2457T
cggucgccgucaggcaagc

SEQ ID NO: 3836265 - RNA, 18 nt, Shigella flexneri 2a str. 2457T
cggucggagguucgaauc

SEQ ID NO: 3836266 - RNA, 22 nt, Shigella flexneri 2a str. 2457T
cggucggccuucguaccaacga

SEQ ID NO: 3836267 - RNA, 18 nt, Shigella flexneri 2a str. 2457T
cggucguaaucgcccgcu

SEQ ID NO: 3836268 - RNA, 23 nt, Shigella flexneri 2a str. 2457T
cggucguaaucgcccgcuuccag

SEQ ID NO: 3836269 - RNA, 14 nt, Shigella flexneri 2a str. 2457T
cggucugcucaaac

SEQ ID NO: 3836270 - RNA, 22 nt, Shigella flexneri 2a str. 2457T
cggugaaaguaacugacaguag

SEQ ID NO: 3836271 - RNA, 18 nt, Shigella flexneri 2a str. 2457T
cggugaaggcaaacuguc

SEQ ID NO: 3836272 - RNA, 14 nt, Shigella flexneri 2a str. 2457T
cggugaccagcagc

SEQ ID NO: 3836273 - RNA, 17 nt, Shigella flexneri 2a str. 2457T
cggugaccgaucgcccg

SEQ ID NO: 3836274 - RNA, 20 nt, Shigella flexneri 2a str. 2457T
cggugaccgaucgcccgcca

SEQ ID NO: 3836275 - RNA, 22 nt, Shigella flexneri 2a str. 2457T
cggugacgcacaguacgcgccc

SEQ ID NO: 3836276 - RNA, 21 nt, Shigella flexneri 2a str. 2457T
cggugauaaacccaacggcaa

SEQ ID NO: 3836277 - RNA, 17 nt, Shigella flexneri 2a str. 2457T
cggugauaacuguaugu

SEQ ID NO: 3836278 - RNA, 19 nt, Shigella flexneri 2a str. 2457T
cggugauguuuaucgucug

SEQ ID NO: 3836279 - RNA, 15 nt, Shigella flexneri 2a str. 2457T
cggugauuuccgccg

SEQ ID NO: 3836280 - RNA, 21 nt, Shigella flexneri 2a str. 2457T
cggugauuuccgccgccagca

SEQ ID NO: 3836281 - RNA, 16 nt, Shigella flexneri 2a str. 2457T
cggugcaaaugccaga

SEQ ID NO: 3836282 - RNA, 17 nt, Shigella flexneri 2a str. 2457T
cggugcaaaugccagau

SEQ ID NO: 3836283 - RNA, 22 nt, Shigella flexneri 2a str. 2457T
cggugcaacccgccagguuuca

SEQ ID NO: 3836284 - RNA, 14 nt, Shigella flexneri 2a str. 2457T
cggugcaccgcauc

SEQ ID NO: 3836285 - RNA, 16 nt, Shigella flexneri 2a str. 2457T
cggugcaucuucacac

SEQ ID NO: 3836286 - RNA, 17 nt, Shigella flexneri 2a str. 2457T
cggugccaucauacagc

SEQ ID NO: 3836287 - RNA, 18 nt, Shigella flexneri 2a str. 2457T
cggugccaucgauaauca

SEQ ID NO: 3836288 - RNA, 19 nt, Shigella flexneri 2a str. 2457T
cggugccauugaccagcug

SEQ ID NO: 3836289 - RNA, 23 nt, Shigella flexneri 2a str. 2457T
cggugcggcucucuuucuccagc

SEQ ID NO: 3836290 - RNA, 18 nt, Shigella flexneri 2a str. 2457T
cggugcgguaaucgcccg

SEQ ID NO: 3836291 - RNA, 19 nt, Shigella flexneri 2a str. 2457T
cggugcuccagugcgcuuu

SEQ ID NO: 3836292 - RNA, 21 nt, Shigella flexneri 2a str. 2457T
cggugcuggucuguuccccuc

SEQ ID NO: 3836293 - RNA, 18 nt, Shigella flexneri 2a str. 2457T
cgguggaacauuuaccgc

SEQ ID NO: 3836294 - RNA, 22 nt, Shigella flexneri 2a str. 2457T
cgguggaccacggcgugccguc

SEQ ID NO: 3836295 - RNA, 23 nt, Shigella flexneri 2a str. 2457T
cgguggcaguagcgccucuucca

SEQ ID NO: 3836296 - RNA, 17 nt, Shigella flexneri 2a str. 2457T
cgguggccgucgagcag

SEQ ID NO: 3836297 - RNA, 17 nt, Shigella flexneri 2a str. 2457T
cgguggccuugccguug

SEQ ID NO: 3836298 - RNA, 18 nt, Shigella flexneri 2a str. 2457T
cgguggcguuuccagcag

SEQ ID NO: 3836299 - RNA, 19 nt, Shigella flexneri 2a str. 2457T
cgguggcguuuccagcagu

SEQ ID NO: 3836300 - RNA, 13 nt, Shigella flexneri 2a str. 2457T
cggugggcugaca

SEQ ID NO: 3836301 - RNA, 15 nt, Shigella flexneri 2a str. 2457T
cggugguauuaccgc

SEQ ID NO: 3836302 - RNA, 15 nt, Shigella flexneri 2a str. 2457T
cgguggucauaauau

SEQ ID NO: 3836303 - RNA, 19 nt, Shigella flexneri 2a str. 2457T
cggugguguaaccuucacc

SEQ ID NO: 3836304 - RNA, 15 nt, Shigella flexneri 2a str. 2457T
cggugguguuaucac

SEQ ID NO: 3836305 - RNA, 23 nt, Shigella flexneri 2a str. 2457T
cgguguaaccaucaaaacgcugg

SEQ ID NO: 3836306 - RNA, 20 nt, Shigella flexneri 2a str. 2457T
cgguguccacuuccgcguca

SEQ ID NO: 3836307 - RNA, 12 nt, Shigella flexneri 2a str. 2457T
cggugucgccag

SEQ ID NO: 3836308 - RNA, 13 nt, Shigella flexneri 2a str. 2457T
cgguguggcaugg

SEQ ID NO: 3836309 - RNA, 15 nt, Shigella flexneri 2a str. 2457T
cgguguucacucauc

SEQ ID NO: 3836310 - RNA, 22 nt, Shigella flexneri 2a str. 2457T
cgguguuguuggucaggaaacu

SEQ ID NO: 3836311 - RNA, 17 nt, Shigella flexneri 2a str. 2457T
cgguuaacaguuuguuu

SEQ ID NO: 3836312 - RNA, 15 nt, Shigella flexneri 2a str. 2457T
cgguuacgccgcauc

SEQ ID NO: 3836313 - RNA, 23 nt, Shigella flexneri 2a str. 2457T
cgguuagaacaauuaacccgcga

SEQ ID NO: 3836314 - RNA, 19 nt, Shigella flexneri 2a str. 2457T
cgguuagaauaccugccug

SEQ ID NO: 3836315 - RNA, 20 nt, Shigella flexneri 2a str. 2457T
cgguuagaauaccugccugu

SEQ ID NO: 3836316 - RNA, 17 nt, Shigella flexneri 2a str. 2457T
cgguuagcucaacgcau

SEQ ID NO: 3836317 - RNA, 23 nt, Shigella flexneri 2a str. 2457T
cgguuauacacgcccgucaugcc

SEQ ID NO: 3836318 - RNA, 17 nt, Shigella flexneri 2a str. 2457T
cgguuaucacucuugac

SEQ ID NO: 3836319 - RNA, 20 nt, Shigella flexneri 2a str. 2457T
cgguucaaauagcaaugucu

SEQ ID NO: 3836320 - RNA, 17 nt, Shigella flexneri 2a str. 2457T
cgguucaauaucuuccu

SEQ ID NO: 3836321 - RNA, 15 nt, Shigella flexneri 2a str. 2457T
cgguucagcgucggc

SEQ ID NO: 3836322 - RNA, 17 nt, Shigella flexneri 2a str. 2457T
cgguucagcgucggcgu

SEQ ID NO: 3836323 - RNA, 18 nt, Shigella flexneri 2a str. 2457T
cgguucauggucgccaag

SEQ ID NO: 3836324 - RNA, 14 nt, Shigella flexneri 2a str. 2457T
cgguuccagcuuca

SEQ ID NO: 3836325 - RNA, 14 nt, Shigella flexneri 2a str. 2457T
cgguucccucgccc

SEQ ID NO: 3836326 - RNA, 13 nt, Shigella flexneri 2a str. 2457T
cgguucgccauca

SEQ ID NO: 3836327 - RNA, 16 nt, Shigella flexneri 2a str. 2457T
cgguucgccugcacca

SEQ ID NO: 3836328 - RNA, 15 nt, Shigella flexneri 2a str. 2457T
cgguucggccauauc

SEQ ID NO: 3836329 - RNA, 15 nt, Shigella flexneri 2a str. 2457T
cgguucgucauacuc

SEQ ID NO: 3836330 - RNA, 18 nt, Shigella flexneri 2a str. 2457T
cgguucguugauaauaaa

SEQ ID NO: 3836331 - RNA, 14 nt, Shigella flexneri 2a str. 2457T
cgguugacugcuga

SEQ ID NO: 3836332 - RNA, 15 nt, Shigella flexneri 2a str. 2457T
cgguugacugcugag

SEQ ID NO: 3836333 - RNA, 22 nt, Shigella flexneri 2a str. 2457T
cgguugaugccguuccacccag

SEQ ID NO: 3836334 - RNA, 14 nt, Shigella flexneri 2a str. 2457T
cgguugauggcagu

SEQ ID NO: 3836335 - RNA, 15 nt, Shigella flexneri 2a str. 2457T
cgguugccagcgcca

SEQ ID NO: 3836336 - RNA, 19 nt, Shigella flexneri 2a str. 2457T
cgguugcggaacccagcgc

SEQ ID NO: 3836337 - RNA, 20 nt, Shigella flexneri 2a str. 2457T
cgguugcggaacccagcgcg

SEQ ID NO: 3836338 - RNA, 16 nt, Shigella flexneri 2a str. 2457T
cgguugcggcuuacca

SEQ ID NO: 3836339 - RNA, 22 nt, Shigella flexneri 2a str. 2457T
cgguuguucaaccaccggcacc

SEQ ID NO: 3836340 - RNA, 23 nt, Shigella flexneri 2a str. 2457T
cgguuuauccauccccagagcac

SEQ ID NO: 3836341 - RNA, 17 nt, Shigella flexneri 2a str. 2457T
cgguuuauccccaagga

SEQ ID NO: 3836342 - RNA, 15 nt, Shigella flexneri 2a str. 2457T
cgguuuaucucaucu

SEQ ID NO: 3836343 - RNA, 15 nt, Shigella flexneri 2a str. 2457T
cgguuucaauccagg

SEQ ID NO: 3836344 - RNA, 18 nt, Shigella flexneri 2a str. 2457T
cgguuucaauuucccgcu

SEQ ID NO: 3836345 - RNA, 19 nt, Shigella flexneri 2a str. 2457T
cgguuucacuauuaccgau

SEQ ID NO: 3836346 - RNA, 17 nt, Shigella flexneri 2a str. 2457T
cgguuucagcagcggca

SEQ ID NO: 3836347 - RNA, 14 nt, Shigella flexneri 2a str. 2457T
cgguuucucuucug

SEQ ID NO: 3836348 - RNA, 16 nt, Shigella flexneri 2a str. 2457T
cgguuucucuucugcu

SEQ ID NO: 3836349 - RNA, 14 nt, Shigella flexneri 2a str. 2457T
cgguuuucaucauc

SEQ ID NO: 3836350 - RNA, 13 nt, Shigella flexneri 2a str. 2457T
cgguuuugccagc

SEQ ID NO: 3836351 - RNA, 11 nt, Shigella flexneri 2a str. 2457T
cguaaaaaaug

SEQ ID NO: 3836352 - RNA, 21 nt, Shigella flexneri 2a str. 2457T
cguaaaaccguguugaggcca

SEQ ID NO: 3836353 - RNA, 17 nt, Shigella flexneri 2a str. 2457T
cguaaaccacugacaca

SEQ ID NO: 3836354 - RNA, 13 nt, Shigella flexneri 2a str. 2457T
cguaaacgccuua

SEQ ID NO: 3836355 - RNA, 22 nt, Shigella flexneri 2a str. 2457T
cguaaacgccuuauccggccua

SEQ ID NO: 3836356 - RNA, 13 nt, Shigella flexneri 2a str. 2457T
cguaaacgugcgg

SEQ ID NO: 3836357 - RNA, 19 nt, Shigella flexneri 2a str. 2457T
cguaaaggcggcagaacag

SEQ ID NO: 3836358 - RNA, 20 nt, Shigella flexneri 2a str. 2457T
cguaaagucgaugcgcuggc

SEQ ID NO: 3836359 - RNA, 18 nt, Shigella flexneri 2a str. 2457T
cguaaauaccuuccggcg

SEQ ID NO: 3836360 - RNA, 13 nt, Shigella flexneri 2a str. 2457T
cguaaaucaaacc

SEQ ID NO: 3836361 - RNA, 16 nt, Shigella flexneri 2a str. 2457T
cguaaaucccgccauu

SEQ ID NO: 3836362 - RNA, 11 nt, Shigella flexneri 2a str. 2457T
cguaaaugccu

SEQ ID NO: 3836363 - RNA, 18 nt, Shigella flexneri 2a str. 2457T
cguaaauucaauauauug

SEQ ID NO: 3836364 - RNA, 14 nt, Shigella flexneri 2a str. 2457T
cguaacauauuccc

SEQ ID NO: 3836365 - RNA, 15 nt, Shigella flexneri 2a str. 2457T
cguaaccauaaccaa

SEQ ID NO: 3836366 - RNA, 14 nt, Shigella flexneri 2a str. 2457T
cguaaccgagcaga

SEQ ID NO: 3836367 - RNA, 14 nt, Shigella flexneri 2a str. 2457T
cguaacgaccacca

SEQ ID NO: 3836368 - RNA, 20 nt, Shigella flexneri 2a str. 2457T
cguaacgaccaccaccgcag

SEQ ID NO: 3836369 - RNA, 15 nt, Shigella flexneri 2a str. 2457T
cguaacgacugacuu

SEQ ID NO: 3836370 - RNA, 12 nt, Shigella flexneri 2a str. 2457T
cguaacgacugc

SEQ ID NO: 3836371 - RNA, 16 nt, Shigella flexneri 2a str. 2457T
cguaacgacugcggau

SEQ ID NO: 3836372 - RNA, 22 nt, Shigella flexneri 2a str. 2457T
cguaacgcucaaguacggcaau

SEQ ID NO: 3836373 - RNA, 18 nt, Shigella flexneri 2a str. 2457T
cguaagaaaguggcaggc

SEQ ID NO: 3836374 - RNA, 17 nt, Shigella flexneri 2a str. 2457T
cguaagcaacgccaaau

SEQ ID NO: 3836375 - RNA, 13 nt, Shigella flexneri 2a str. 2457T
cguaaguaagaua

SEQ ID NO: 3836376 - RNA, 21 nt, Shigella flexneri 2a str. 2457T
cguaauaagguucauugagcg

SEQ ID NO: 3836377 - RNA, 21 nt, Shigella flexneri 2a str. 2457T
cguaauaguuucugacauuuu

SEQ ID NO: 3836378 - RNA, 22 nt, Shigella flexneri 2a str. 2457T
cguaaucaacauauuccccugg

SEQ ID NO: 3836379 - RNA, 18 nt, Shigella flexneri 2a str. 2457T
cguaaucccggauaucac

SEQ ID NO: 3836380 - RNA, 23 nt, Shigella flexneri 2a str. 2457T
cguaaugaauguuuuccugcuuc

SEQ ID NO: 3836381 - RNA, 18 nt, Shigella flexneri 2a str. 2457T
cguaaugauguaaaaaua

SEQ ID NO: 3836382 - RNA, 19 nt, Shigella flexneri 2a str. 2457T
cguaaugauguaaaaauac

SEQ ID NO: 3836383 - RNA, 20 nt, Shigella flexneri 2a str. 2457T
cguaaugauguaaaaauacu

SEQ ID NO: 3836384 - RNA, 23 nt, Shigella flexneri 2a str. 2457T
cguaauggaugcccgcgggcgaa

SEQ ID NO: 3836385 - RNA, 23 nt, Shigella flexneri 2a str. 2457T
cguaauuaguggcuaaccgucug

SEQ ID NO: 3836386 - RNA, 19 nt, Shigella flexneri 2a str. 2457T
cguacaaaauuagaaaggg

SEQ ID NO: 3836387 - RNA, 16 nt, Shigella flexneri 2a str. 2457T
cguacaaccaaaucug

SEQ ID NO: 3836388 - RNA, 12 nt, Shigella flexneri 2a str. 2457T
cguacaccaaca

SEQ ID NO: 3836389 - RNA, 15 nt, Shigella flexneri 2a str. 2457T
cguacaccaacauca

SEQ ID NO: 3836390 - RNA, 22 nt, Shigella flexneri 2a str. 2457T
cguacagggugagggcaauaau

SEQ ID NO: 3836391 - RNA, 21 nt, Shigella flexneri 2a str. 2457T
cguacaucccgcgaacgagaa

SEQ ID NO: 3836392 - RNA, 15 nt, Shigella flexneri 2a str. 2457T
cguacaugcagggca

SEQ ID NO: 3836393 - RNA, 21 nt, Shigella flexneri 2a str. 2457T
cguacauugccgacauggcaa

SEQ ID NO: 3836394 - RNA, 23 nt, Shigella flexneri 2a str. 2457T
cguaccaaucagacucauauaaa

SEQ ID NO: 3836395 - RNA, 17 nt, Shigella flexneri 2a str. 2457T
cguaccagccuugccag

SEQ ID NO: 3836396 - RNA, 20 nt, Shigella flexneri 2a str. 2457T
cguaccaucauuggagaguu

SEQ ID NO: 3836397 - RNA, 16 nt, Shigella flexneri 2a str. 2457T
cguaccaucgccagcc

SEQ ID NO: 3836398 - RNA, 18 nt, Shigella flexneri 2a str. 2457T
cguaccaugcgcaucauc

SEQ ID NO: 3836399 - RNA, 17 nt, Shigella flexneri 2a str. 2457T
cguaccauuaucaccaa

SEQ ID NO: 3836400 - RNA, 13 nt, Shigella flexneri 2a str. 2457T
cguacccggcgac

SEQ ID NO: 3836401 - RNA, 13 nt, Shigella flexneri 2a str. 2457T
cguaccgcagcaa

SEQ ID NO: 3836402 - RNA, 22 nt, Shigella flexneri 2a str. 2457T
cguaccggcaacgacugcgagc

SEQ ID NO: 3836403 - RNA, 16 nt, Shigella flexneri 2a str. 2457T
cguaccggccuugcca

SEQ ID NO: 3836404 - RNA, 17 nt, Shigella flexneri 2a str. 2457T
cguaccggccuugccag

SEQ ID NO: 3836405 - RNA, 17 nt, Shigella flexneri 2a str. 2457T
cguaccucacguuccag

SEQ ID NO: 3836406 - RNA, 13 nt, Shigella flexneri 2a str. 2457T
cguaccuucaggc

SEQ ID NO: 3836407 - RNA, 18 nt, Shigella flexneri 2a str. 2457T
cguaccuuugccuuccag

SEQ ID NO: 3836408 - RNA, 18 nt, Shigella flexneri 2a str. 2457T
cguacgcuuuugaggauu

SEQ ID NO: 3836409 - RNA, 21 nt, Shigella flexneri 2a str. 2457T
cguacgggucgggcuguguuu

SEQ ID NO: 3836410 - RNA, 15 nt, Shigella flexneri 2a str. 2457T
cguacucaauuuuca

SEQ ID NO: 3836411 - RNA, 21 nt, Shigella flexneri 2a str. 2457T
cguacucaccagacaucccag

SEQ ID NO: 3836412 - RNA, 19 nt, Shigella flexneri 2a str. 2457T
cguacugcauaaugccggu

SEQ ID NO: 3836413 - RNA, 12 nt, Shigella flexneri 2a str. 2457T
cguacugcugaa

SEQ ID NO: 3836414 - RNA, 22 nt, Shigella flexneri 2a str. 2457T
cguacuggcaaucgccagcggc

SEQ ID NO: 3836415 - RNA, 19 nt, Shigella flexneri 2a str. 2457T
cguagaucauagagcacgg

SEQ ID NO: 3836416 - RNA, 24 nt, Shigella flexneri 2a str. 2457T
cguagcaccgacgucgauauaauu

SEQ ID NO: 3836417 - RNA, 17 nt, Shigella flexneri 2a str. 2457T
cguagcaguucaccgcc

SEQ ID NO: 3836418 - RNA, 14 nt, Shigella flexneri 2a str. 2457T
cguagccaccaucu

SEQ ID NO: 3836419 - RNA, 21 nt, Shigella flexneri 2a str. 2457T
cguagccaugaugaacaaccc

SEQ ID NO: 3836420 - RNA, 19 nt, Shigella flexneri 2a str. 2457T
cguagccccagucuuccug

SEQ ID NO: 3836421 - RNA, 19 nt, Shigella flexneri 2a str. 2457T
cguagcccgguacaagagu

SEQ ID NO: 3836422 - RNA, 15 nt, Shigella flexneri 2a str. 2457T
cguagcguuaacgcg

SEQ ID NO: 3836423 - RNA, 15 nt, Shigella flexneri 2a str. 2457T
cguaggacacagaau

SEQ ID NO: 3836424 - RNA, 19 nt, Shigella flexneri 2a str. 2457T
cguaggcaauuggcgcauc

SEQ ID NO: 3836425 - RNA, 14 nt, Shigella flexneri 2a str. 2457T
cguaggccaaccgu

SEQ ID NO: 3836426 - RNA, 15 nt, Shigella flexneri 2a str. 2457T
cguaggcccagccgu

SEQ ID NO: 3836427 - RNA, 20 nt, Shigella flexneri 2a str. 2457T
cguaggccggauaaggcgua

SEQ ID NO: 3836428 - RNA, 20 nt, Shigella flexneri 2a str. 2457T
cguaggccggauaaggcguu

SEQ ID NO: 3836429 - RNA, 13 nt, Shigella flexneri 2a str. 2457T
cguaggccugaua

SEQ ID NO: 3836430 - RNA, 14 nt, Shigella flexneri 2a str. 2457T
cguaggccugauaa

SEQ ID NO: 3836431 - RNA, 19 nt, Shigella flexneri 2a str. 2457T
cguaggccugauaagacgc

SEQ ID NO: 3836432 - RNA, 19 nt, Shigella flexneri 2a str. 2457T
cguaggccugauaagcgua

SEQ ID NO: 3836433 - RNA, 19 nt, Shigella flexneri 2a str. 2457T
cguaggucggauaagacgc

SEQ ID NO: 3836434 - RNA, 14 nt, Shigella flexneri 2a str. 2457T
cguaguaguucauc

SEQ ID NO: 3836435 - RNA, 16 nt, Shigella flexneri 2a str. 2457T
cguaguucuuucucug

SEQ ID NO: 3836436 - RNA, 17 nt, Shigella flexneri 2a str. 2457T
cguaguucuuucucugc

SEQ ID NO: 3836437 - RNA, 13 nt, Shigella flexneri 2a str. 2457T
cguauaacacgcc

SEQ ID NO: 3836438 - RNA, 21 nt, Shigella flexneri 2a str. 2457T
cguauagaucacuuugcggau

SEQ ID NO: 3836439 - RNA, 21 nt, Shigella flexneri 2a str. 2457T
cguauaguguccacaggaaaa

SEQ ID NO: 3836440 - RNA, 17 nt, Shigella flexneri 2a str. 2457T
cguaucaccccgcccga

SEQ ID NO: 3836441 - RNA, 20 nt, Shigella flexneri 2a str. 2457T
cguauccagcauaccuucca

SEQ ID NO: 3836442 - RNA, 13 nt, Shigella flexneri 2a str. 2457T
cguauccggcauu

SEQ ID NO: 3836443 - RNA, 11 nt, Shigella flexneri 2a str. 2457T
cguauccggcu

SEQ ID NO: 3836444 - RNA, 19 nt, Shigella flexneri 2a str. 2457T
cguaucgaccagaauaagu

SEQ ID NO: 3836445 - RNA, 20 nt, Shigella flexneri 2a str. 2457T
cguaucuucaugcuccagca

SEQ ID NO: 3836446 - RNA, 14 nt, Shigella flexneri 2a str. 2457T
cguaucuuccaggg

SEQ ID NO: 3836447 - RNA, 18 nt, Shigella flexneri 2a str. 2457T
cguaugaugugcgcuaac

SEQ ID NO: 3836448 - RNA, 14 nt, Shigella flexneri 2a str. 2457T
cguaugcauaauuu

SEQ ID NO: 3836449 - RNA, 15 nt, Shigella flexneri 2a str. 2457T
cguaugcccagcgca

SEQ ID NO: 3836450 - RNA, 18 nt, Shigella flexneri 2a str. 2457T
cguauguucccaccagcc

SEQ ID NO: 3836451 - RNA, 21 nt, Shigella flexneri 2a str. 2457T
cguauucugacugucagaugc

SEQ ID NO: 3836452 - RNA, 16 nt, Shigella flexneri 2a str. 2457T
cguauuuccugccaga

SEQ ID NO: 3836453 - RNA, 23 nt, Shigella flexneri 2a str. 2457T
cguauuuuuugcucauaaaauca

SEQ ID NO: 3836454 - RNA, 16 nt, Shigella flexneri 2a str. 2457T
cgucaaaaaaacggcg

SEQ ID NO: 3836455 - RNA, 18 nt, Shigella flexneri 2a str. 2457T
cgucaaacgcacgucuga

SEQ ID NO: 3836456 - RNA, 18 nt, Shigella flexneri 2a str. 2457T
cgucaaauaauuccugcg

SEQ ID NO: 3836457 - RNA, 21 nt, Shigella flexneri 2a str. 2457T
cgucaacaccgggugcagaca

SEQ ID NO: 3836458 - RNA, 20 nt, Shigella flexneri 2a str. 2457T
cgucaacagcguuucuucga

SEQ ID NO: 3836459 - RNA, 18 nt, Shigella flexneri 2a str. 2457T
cgucaacggugccauuga

SEQ ID NO: 3836460 - RNA, 22 nt, Shigella flexneri 2a str. 2457T
cgucaagcgguaaccauccaua

SEQ ID NO: 3836461 - RNA, 18 nt, Shigella flexneri 2a str. 2457T
cgucaaggguugccggau

SEQ ID NO: 3836462 - RNA, 20 nt, Shigella flexneri 2a str. 2457T
cgucaaucugcccgaccaga

SEQ ID NO: 3836463 - RNA, 15 nt, Shigella flexneri 2a str. 2457T
cgucacaggcacacc

SEQ ID NO: 3836464 - RNA, 22 nt, Shigella flexneri 2a str. 2457T
cgucacgaagcauugcgccugc

SEQ ID NO: 3836465 - RNA, 17 nt, Shigella flexneri 2a str. 2457T
cgucacgcucauccugg

SEQ ID NO: 3836466 - RNA, 17 nt, Shigella flexneri 2a str. 2457T
cgucacguucugcgccg

SEQ ID NO: 3836467 - RNA, 20 nt, Shigella flexneri 2a str. 2457T
cgucacuggugugucaucug

SEQ ID NO: 3836468 - RNA, 23 nt, Shigella flexneri 2a str. 2457T
cgucagaccggcaaccagcaccg

SEQ ID NO: 3836469 - RNA, 14 nt, Shigella flexneri 2a str. 2457T
cgucagauccgcca

SEQ ID NO: 3836470 - RNA, 16 nt, Shigella flexneri 2a str. 2457T
cgucagauccgccagu

SEQ ID NO: 3836471 - RNA, 20 nt, Shigella flexneri 2a str. 2457T
cgucagccacuucuuccagc

SEQ ID NO: 3836472 - RNA, 14 nt, Shigella flexneri 2a str. 2457T
cgucagccgcccgc

SEQ ID NO: 3836473 - RNA, 21 nt, Shigella flexneri 2a str. 2457T
cgucagcggcaauucuuucuc

SEQ ID NO: 3836474 - RNA, 23 nt, Shigella flexneri 2a str. 2457T
cgucagcguuccacgugcggccg

SEQ ID NO: 3836475 - RNA, 22 nt, Shigella flexneri 2a str. 2457T
cgucagcucgcugccaucaacu

SEQ ID NO: 3836476 - RNA, 14 nt, Shigella flexneri 2a str. 2457T
cgucaggccgccac

SEQ ID NO: 3836477 - RNA, 19 nt, Shigella flexneri 2a str. 2457T
cgucaguacauagccaucu

SEQ ID NO: 3836478 - RNA, 18 nt, Shigella flexneri 2a str. 2457T
cgucaguagcgcaaucac

SEQ ID NO: 3836479 - RNA, 16 nt, Shigella flexneri 2a str. 2457T
cgucagucccaacuga

SEQ ID NO: 3836480 - RNA, 18 nt, Shigella flexneri 2a str. 2457T
cgucagugucuuaucugg

SEQ ID NO: 3836481 - RNA, 22 nt, Shigella flexneri 2a str. 2457T
cgucaguuuuucacccgcaauc

SEQ ID NO: 3836482 - RNA, 14 nt, Shigella flexneri 2a str. 2457T
cgucaucaaacggc

SEQ ID NO: 3836483 - RNA, 15 nt, Shigella flexneri 2a str. 2457T
cgucaucagcaauuu

SEQ ID NO: 3836484 - RNA, 18 nt, Shigella flexneri 2a str. 2457T
cgucaucauagacuuccc

SEQ ID NO: 3836485 - RNA, 16 nt, Shigella flexneri 2a str. 2457T
cgucauccagcacuug

SEQ ID NO: 3836486 - RNA, 14 nt, Shigella flexneri 2a str. 2457T
cgucaucccagucu

SEQ ID NO: 3836487 - RNA, 15 nt, Shigella flexneri 2a str. 2457T
cgucaucccagucuu

SEQ ID NO: 3836488 - RNA, 19 nt, Shigella flexneri 2a str. 2457T
cgucauccuaaacgcuggc

SEQ ID NO: 3836489 - RNA, 22 nt, Shigella flexneri 2a str. 2457T
cgucauccuaaacgcuggcagg

SEQ ID NO: 3836490 - RNA, 22 nt, Shigella flexneri 2a str. 2457T
cgucaucucgcucaaaaaucca

SEQ ID NO: 3836491 - RNA, 13 nt, Shigella flexneri 2a str. 2457T
cgucauggcuguc

SEQ ID NO: 3836492 - RNA, 20 nt, Shigella flexneri 2a str. 2457T
cgucauggcuguccuuuacc

SEQ ID NO: 3836493 - RNA, 21 nt, Shigella flexneri 2a str. 2457T
cgucaugguauagagauagca

SEQ ID NO: 3836494 - RNA, 16 nt, Shigella flexneri 2a str. 2457T
cgucauuaaccagcca

SEQ ID NO: 3836495 - RNA, 14 nt, Shigella flexneri 2a str. 2457T
cgucauuaccgcga

SEQ ID NO: 3836496 - RNA, 20 nt, Shigella flexneri 2a str. 2457T
cgucauuagcgauaaauguc

SEQ ID NO: 3836497 - RNA, 15 nt, Shigella flexneri 2a str. 2457T
cgucauugacgcugg

SEQ ID NO: 3836498 - RNA, 20 nt, Shigella flexneri 2a str. 2457T
cgucauuucgaagaaaccga

SEQ ID NO: 3836499 - RNA, 22 nt, Shigella flexneri 2a str. 2457T
cguccacggugcgacacugcgu

SEQ ID NO: 3836500 - RNA, 20 nt, Shigella flexneri 2a str. 2457T
cguccagaugcgagaugucc

SEQ ID NO: 3836501 - RNA, 14 nt, Shigella flexneri 2a str. 2457T
cguccagcagcaau

SEQ ID NO: 3836502 - RNA, 18 nt, Shigella flexneri 2a str. 2457T
cguccaguuucacuuuca

SEQ ID NO: 3836503 - RNA, 23 nt, Shigella flexneri 2a str. 2457T
cguccauccacaggguguauuca

SEQ ID NO: 3836504 - RNA, 22 nt, Shigella flexneri 2a str. 2457T
cguccaugcugucggcugccag

SEQ ID NO: 3836505 - RNA, 17 nt, Shigella flexneri 2a str. 2457T
cgucccacgaccgcagc

SEQ ID NO: 3836506 - RNA, 13 nt, Shigella flexneri 2a str. 2457T
cgucccagccuug

SEQ ID NO: 3836507 - RNA, 15 nt, Shigella flexneri 2a str. 2457T
cgucccaggcaaauc

SEQ ID NO: 3836508 - RNA, 18 nt, Shigella flexneri 2a str. 2457T
cgucccagucgucauccc

SEQ ID NO: 3836509 - RNA, 20 nt, Shigella flexneri 2a str. 2457T
cgucccaucggcaaucauuc

SEQ ID NO: 3836510 - RNA, 17 nt, Shigella flexneri 2a str. 2457T
cgucccaugaugcgcgg

SEQ ID NO: 3836511 - RNA, 21 nt, Shigella flexneri 2a str. 2457T
cgucccggugaagcgcccugc

SEQ ID NO: 3836512 - RNA, 23 nt, Shigella flexneri 2a str. 2457T
cguccucacuguuuucuaacuca

SEQ ID NO: 3836513 - RNA, 20 nt, Shigella flexneri 2a str. 2457T
cguccuggcaacggacgacc

SEQ ID NO: 3836514 - RNA, 22 nt, Shigella flexneri 2a str. 2457T
cguccuucaucuucauccggcu

SEQ ID NO: 3836515 - RNA, 22 nt, Shigella flexneri 2a str. 2457T
cgucgaacgcugcgcgaccauc

SEQ ID NO: 3836516 - RNA, 22 nt, Shigella flexneri 2a str. 2457T
cgucgauaaucguuggcagacg

SEQ ID NO: 3836517 - RNA, 19 nt, Shigella flexneri 2a str. 2457T
cgucgauaucgaugacgcg

SEQ ID NO: 3836518 - RNA, 14 nt, Shigella flexneri 2a str. 2457T
cgucgauugcucaa

SEQ ID NO: 3836519 - RNA, 22 nt, Shigella flexneri 2a str. 2457T
cgucgauuguuauaccagucca

SEQ ID NO: 3836520 - RNA, 13 nt, Shigella flexneri 2a str. 2457T
cgucgcacccggc

SEQ ID NO: 3836521 - RNA, 16 nt, Shigella flexneri 2a str. 2457T
cgucgcaucaggcauu

SEQ ID NO: 3836522 - RNA, 19 nt, Shigella flexneri 2a str. 2457T
cgucgcccacaccagauga

SEQ ID NO: 3836523 - RNA, 14 nt, Shigella flexneri 2a str. 2457T
cgucgcccgaugca

SEQ ID NO: 3836524 - RNA, 15 nt, Shigella flexneri 2a str. 2457T
cgucgcccgcgcgag

SEQ ID NO: 3836525 - RNA, 16 nt, Shigella flexneri 2a str. 2457T
cgucgcccgcgcgagc

SEQ ID NO: 3836526 - RNA, 14 nt, Shigella flexneri 2a str. 2457T
cgucgcuuuccagu

SEQ ID NO: 3836527 - RNA, 20 nt, Shigella flexneri 2a str. 2457T
cgucggcaucgggcagcauc

SEQ ID NO: 3836528 - RNA, 17 nt, Shigella flexneri 2a str. 2457T
cgucggcgucagcgcca

SEQ ID NO: 3836529 - RNA, 19 nt, Shigella flexneri 2a str. 2457T
cgucgggaucaucgcccag

SEQ ID NO: 3836530 - RNA, 17 nt, Shigella flexneri 2a str. 2457T
cgucgguguccacuucc

SEQ ID NO: 3836531 - RNA, 23 nt, Shigella flexneri 2a str. 2457T
cgucgguucagggcaucaucauu

SEQ ID NO: 3836532 - RNA, 15 nt, Shigella flexneri 2a str. 2457T
cgucguaguaguuca

SEQ ID NO: 3836533 - RNA, 20 nt, Shigella flexneri 2a str. 2457T
cgucguuacugucgcgcagc

SEQ ID NO: 3836534 - RNA, 15 nt, Shigella flexneri 2a str. 2457T
cgucucaaucaccac

SEQ ID NO: 3836535 - RNA, 22 nt, Shigella flexneri 2a str. 2457T
cgucucaaucaccaccagcgga

SEQ ID NO: 3836536 - RNA, 14 nt, Shigella flexneri 2a str. 2457T
cgucucccgaugcc

SEQ ID NO: 3836537 - RNA, 20 nt, Shigella flexneri 2a str. 2457T
cgucucccgaugccagcaca

SEQ ID NO: 3836538 - RNA, 15 nt, Shigella flexneri 2a str. 2457T
cgucucggcauggau

SEQ ID NO: 3836539 - RNA, 22 nt, Shigella flexneri 2a str. 2457T
cgucucuucaauucgcgauaac

SEQ ID NO: 3836540 - RNA, 15 nt, Shigella flexneri 2a str. 2457T
cgucugacggccuuc

SEQ ID NO: 3836541 - RNA, 15 nt, Shigella flexneri 2a str. 2457T
cgucugauguaauca

SEQ ID NO: 3836542 - RNA, 19 nt, Shigella flexneri 2a str. 2457T
cgucugccggaacugauga

SEQ ID NO: 3836543 - RNA, 23 nt, Shigella flexneri 2a str. 2457T
cgucuggaacggcagauccaaac

SEQ ID NO: 3836544 - RNA, 14 nt, Shigella flexneri 2a str. 2457T
cgucuggccucucu

SEQ ID NO: 3836545 - RNA, 18 nt, Shigella flexneri 2a str. 2457T
cgucugggcaaaaucauc

SEQ ID NO: 3836546 - RNA, 19 nt, Shigella flexneri 2a str. 2457T
cgucugggcaaaaucauca

SEQ ID NO: 3836547 - RNA, 23 nt, Shigella flexneri 2a str. 2457T
cgucugguaucgcgccagccagu

SEQ ID NO: 3836548 - RNA, 24 nt, Shigella flexneri 2a str. 2457T
cgucugguaucgcgccagccagua

SEQ ID NO: 3836549 - RNA, 19 nt, Shigella flexneri 2a str. 2457T
cgucuguuuuaucucccug

SEQ ID NO: 3836550 - RNA, 19 nt, Shigella flexneri 2a str. 2457T
cgucuuaucaugccuacaa

SEQ ID NO: 3836551 - RNA, 15 nt, Shigella flexneri 2a str. 2457T
cgugaaaaaucaaua

SEQ ID NO: 3836552 - RNA, 16 nt, Shigella flexneri 2a str. 2457T
cgugaaaagcugcaua

SEQ ID NO: 3836553 - RNA, 14 nt, Shigella flexneri 2a str. 2457T
cgugaaacucagcc

SEQ ID NO: 3836554 - RNA, 20 nt, Shigella flexneri 2a str. 2457T
cgugaacgccuaauccagcc

SEQ ID NO: 3836555 - RNA, 13 nt, Shigella flexneri 2a str. 2457T
cgugaacgccuua

SEQ ID NO: 3836556 - RNA, 22 nt, Shigella flexneri 2a str. 2457T
cgugaacgccuuauccggccua

SEQ ID NO: 3836557 - RNA, 23 nt, Shigella flexneri 2a str. 2457T
cgugaacggcuucgccuccuguu

SEQ ID NO: 3836558 - RNA, 22 nt, Shigella flexneri 2a str. 2457T
cgugaacuucgccauuuucugc

SEQ ID NO: 3836559 - RNA, 13 nt, Shigella flexneri 2a str. 2457T
cgugaagcuggca

SEQ ID NO: 3836560 - RNA, 20 nt, Shigella flexneri 2a str. 2457T
cgugaaugccuuauccggca

SEQ ID NO: 3836561 - RNA, 20 nt, Shigella flexneri 2a str. 2457T
cgugaauuuuaggaugcugc

SEQ ID NO: 3836562 - RNA, 20 nt, Shigella flexneri 2a str. 2457T
cgugaccaguugcuccagca

SEQ ID NO: 3836563 - RNA, 22 nt, Shigella flexneri 2a str. 2457T
cgugaccgaaauggagccgaaa

SEQ ID NO: 3836564 - RNA, 14 nt, Shigella flexneri 2a str. 2457T
cgugacuaaaaccc

SEQ ID NO: 3836565 - RNA, 19 nt, Shigella flexneri 2a str. 2457T
cgugagcggcaggacgcgc

SEQ ID NO: 3836566 - RNA, 19 nt, Shigella flexneri 2a str. 2457T
cgugagcguauuggugaau

SEQ ID NO: 3836567 - RNA, 20 nt, Shigella flexneri 2a str. 2457T
cgugaguuuuuguccccuca

SEQ ID NO: 3836568 - RNA, 23 nt, Shigella flexneri 2a str. 2457T
cgugaucgucuucaaccgcagug

SEQ ID NO: 3836569 - RNA, 17 nt, Shigella flexneri 2a str. 2457T
cgugaucguggccauga

SEQ ID NO: 3836570 - RNA, 19 nt, Shigella flexneri 2a str. 2457T
cgugauucacguucgugaa

SEQ ID NO: 3836571 - RNA, 17 nt, Shigella flexneri 2a str. 2457T
cgugcaaaaucaaacag

SEQ ID NO: 3836572 - RNA, 21 nt, Shigella flexneri 2a str. 2457T
cgugcaaauauacauaaaguc

SEQ ID NO: 3836573 - RNA, 16 nt, Shigella flexneri 2a str. 2457T
cgugcaaauucaauau

SEQ ID NO: 3836574 - RNA, 21 nt, Shigella flexneri 2a str. 2457T
cgugcagaacauccagcucgc

SEQ ID NO: 3836575 - RNA, 17 nt, Shigella flexneri 2a str. 2457T
cgugcagcgcaaucgcc

SEQ ID NO: 3836576 - RNA, 17 nt, Shigella flexneri 2a str. 2457T
cgugcagcuuucccuuc

SEQ ID NO: 3836577 - RNA, 14 nt, Shigella flexneri 2a str. 2457T
cgugcagugauuca

SEQ ID NO: 3836578 - RNA, 19 nt, Shigella flexneri 2a str. 2457T
cgugcauagcagcacacca

SEQ ID NO: 3836579 - RNA, 16 nt, Shigella flexneri 2a str. 2457T
cgugcaucauggaagc

SEQ ID NO: 3836580 - RNA, 17 nt, Shigella flexneri 2a str. 2457T
cgugccagagcaucuac

SEQ ID NO: 3836581 - RNA, 18 nt, Shigella flexneri 2a str. 2457T
cgugccaggaccauucac

SEQ ID NO: 3836582 - RNA, 23 nt, Shigella flexneri 2a str. 2457T
cgugccaggguggcucaaucgcc

SEQ ID NO: 3836583 - RNA, 11 nt, Shigella flexneri 2a str. 2457T
cgugcccugcg

SEQ ID NO: 3836584 - RNA, 14 nt, Shigella flexneri 2a str. 2457T
cgugccgcagcuuc

SEQ ID NO: 3836585 - RNA, 13 nt, Shigella flexneri 2a str. 2457T
cgugccgcauuuc

SEQ ID NO: 3836586 - RNA, 23 nt, Shigella flexneri 2a str. 2457T
cgugccggaagucucuugccggu

SEQ ID NO: 3836587 - RNA, 14 nt, Shigella flexneri 2a str. 2457T
cgugccgguaaugc

SEQ ID NO: 3836588 - RNA, 22 nt, Shigella flexneri 2a str. 2457T
cgugcgaggugauguuccgcuu

SEQ ID NO: 3836589 - RNA, 18 nt, Shigella flexneri 2a str. 2457T
cgugcgcaauaacccaga

SEQ ID NO: 3836590 - RNA, 14 nt, Shigella flexneri 2a str. 2457T
cgugcgcgccguga

SEQ ID NO: 3836591 - RNA, 14 nt, Shigella flexneri 2a str. 2457T
cgugcggcugugcg

SEQ ID NO: 3836592 - RNA, 18 nt, Shigella flexneri 2a str. 2457T
cgugcgggagaguaucca

SEQ ID NO: 3836593 - RNA, 18 nt, Shigella flexneri 2a str. 2457T
cgugcgguuucagcucac

SEQ ID NO: 3836594 - RNA, 20 nt, Shigella flexneri 2a str. 2457T
cgugcguuccacccacggcg

SEQ ID NO: 3836595 - RNA, 13 nt, Shigella flexneri 2a str. 2457T
cgugcguuuuuug

SEQ ID NO: 3836596 - RNA, 16 nt, Shigella flexneri 2a str. 2457T
cgugcucgcuuuccau

SEQ ID NO: 3836597 - RNA, 18 nt, Shigella flexneri 2a str. 2457T
cgugcucuggcaagcgac

SEQ ID NO: 3836598 - RNA, 13 nt, Shigella flexneri 2a str. 2457T
cgugcugccagcg

SEQ ID NO: 3836599 - RNA, 16 nt, Shigella flexneri 2a str. 2457T
cgugcugccagcgauu

SEQ ID NO: 3836600 - RNA, 19 nt, Shigella flexneri 2a str. 2457T
cguggaauuuguccaccaa

SEQ ID NO: 3836601 - RNA, 19 nt, Shigella flexneri 2a str. 2457T
cguggagcaacacgccagc

SEQ ID NO: 3836602 - RNA, 20 nt, Shigella flexneri 2a str. 2457T
cguggagcaacacgccagcg

SEQ ID NO: 3836603 - RNA, 20 nt, Shigella flexneri 2a str. 2457T
cguggaucaagccccagcag

SEQ ID NO: 3836604 - RNA, 18 nt, Shigella flexneri 2a str. 2457T
cguggaugcgauguuccc

SEQ ID NO: 3836605 - RNA, 23 nt, Shigella flexneri 2a str. 2457T
cguggaugcgauguucccccagc

SEQ ID NO: 3836606 - RNA, 13 nt, Shigella flexneri 2a str. 2457T
cguggaugggacu

SEQ ID NO: 3836607 - RNA, 17 nt, Shigella flexneri 2a str. 2457T
cguggauuuaaugccaa

SEQ ID NO: 3836608 - RNA, 18 nt, Shigella flexneri 2a str. 2457T
cguggauuuaaugccaau

SEQ ID NO: 3836609 - RNA, 18 nt, Shigella flexneri 2a str. 2457T
cguggcaugacgcagguc

SEQ ID NO: 3836610 - RNA, 22 nt, Shigella flexneri 2a str. 2457T
cguggcccauacguuugccuuu

SEQ ID NO: 3836611 - RNA, 19 nt, Shigella flexneri 2a str. 2457T
cguggcgagcgauaaccca

SEQ ID NO: 3836612 - RNA, 20 nt, Shigella flexneri 2a str. 2457T
cguggcgauaaucagcgcca

SEQ ID NO: 3836613 - RNA, 15 nt, Shigella flexneri 2a str. 2457T
cguggcgcagugccu

SEQ ID NO: 3836614 - RNA, 20 nt, Shigella flexneri 2a str. 2457T
cguggcggaaaucuuucauu

SEQ ID NO: 3836615 - RNA, 14 nt, Shigella flexneri 2a str. 2457T
cgugggcaggaaaa

SEQ ID NO: 3836616 - RNA, 17 nt, Shigella flexneri 2a str. 2457T
cgugggcaucgcgacag

SEQ ID NO: 3836617 - RNA, 19 nt, Shigella flexneri 2a str. 2457T
cguggucaauauuaucgau

SEQ ID NO: 3836618 - RNA, 14 nt, Shigella flexneri 2a str. 2457T
cguggucauggcau

SEQ ID NO: 3836619 - RNA, 18 nt, Shigella flexneri 2a str. 2457T
cguggugauaccagacca

SEQ ID NO: 3836620 - RNA, 15 nt, Shigella flexneri 2a str. 2457T
cgugguuuaugcaau

SEQ ID NO: 3836621 - RNA, 21 nt, Shigella flexneri 2a str. 2457T
cgugguuuucgccggaaccug

SEQ ID NO: 3836622 - RNA, 21 nt, Shigella flexneri 2a str. 2457T
cgugucggacggaauuugaaa

SEQ ID NO: 3836623 - RNA, 15 nt, Shigella flexneri 2a str. 2457T
cgugucuuuuacuga

SEQ ID NO: 3836624 - RNA, 20 nt, Shigella flexneri 2a str. 2457T
cguguggcgaugggacgcgc

SEQ ID NO: 3836625 - RNA, 15 nt, Shigella flexneri 2a str. 2457T
cguguuaauuaccua

SEQ ID NO: 3836626 - RNA, 16 nt, Shigella flexneri 2a str. 2457T
cguguucucaucgcca

SEQ ID NO: 3836627 - RNA, 15 nt, Shigella flexneri 2a str. 2457T
cguguucugaauaaa

SEQ ID NO: 3836628 - RNA, 21 nt, Shigella flexneri 2a str. 2457T
cguguugucagcucauccagc

SEQ ID NO: 3836629 - RNA, 22 nt, Shigella flexneri 2a str. 2457T
cguguuuaugaaaguuuaacua

SEQ ID NO: 3836630 - RNA, 17 nt, Shigella flexneri 2a str. 2457T
cguguuuccgggccgaa

SEQ ID NO: 3836631 - RNA, 12 nt, Shigella flexneri 2a str. 2457T
cguuaaauaacu

SEQ ID NO: 3836632 - RNA, 17 nt, Shigella flexneri 2a str. 2457T
cguuaaauccagauccu

SEQ ID NO: 3836633 - RNA, 20 nt, Shigella flexneri 2a str. 2457T
cguuaaauucuaauguuaaa

SEQ ID NO: 3836634 - RNA, 16 nt, Shigella flexneri 2a str. 2457T
cguuaacagcgcauuc

SEQ ID NO: 3836635 - RNA, 21 nt, Shigella flexneri 2a str. 2457T
cguuaagacuuuuuucauggg

SEQ ID NO: 3836636 - RNA, 21 nt, Shigella flexneri 2a str. 2457T
cguuaauauugcccgggcgag

SEQ ID NO: 3836637 - RNA, 14 nt, Shigella flexneri 2a str. 2457T
cguuacagcuggag

SEQ ID NO: 3836638 - RNA, 15 nt, Shigella flexneri 2a str. 2457T
cguuaccccuucauc

SEQ ID NO: 3836639 - RNA, 20 nt, Shigella flexneri 2a str. 2457T
cguuacccgcagccaucaac

SEQ ID NO: 3836640 - RNA, 16 nt, Shigella flexneri 2a str. 2457T
cguuaccggguguucu

SEQ ID NO: 3836641 - RNA, 13 nt, Shigella flexneri 2a str. 2457T
cguuaccuucggc

SEQ ID NO: 3836642 - RNA, 21 nt, Shigella flexneri 2a str. 2457T
cguuacgacgcaaucaaaaaa

SEQ ID NO: 3836643 - RNA, 13 nt, Shigella flexneri 2a str. 2457T
cguuacgcagcau

SEQ ID NO: 3836644 - RNA, 18 nt, Shigella flexneri 2a str. 2457T
cguuacgccccaacacaa

SEQ ID NO: 3836645 - RNA, 21 nt, Shigella flexneri 2a str. 2457T
cguuacgccccgguuucucuu

SEQ ID NO: 3836646 - RNA, 17 nt, Shigella flexneri 2a str. 2457T
cguuacguacuuccuua

SEQ ID NO: 3836647 - RNA, 17 nt, Shigella flexneri 2a str. 2457T
cguuacguucuccugaa

SEQ ID NO: 3836648 - RNA, 16 nt, Shigella flexneri 2a str. 2457T
cguuacucuccggacu

SEQ ID NO: 3836649 - RNA, 15 nt, Shigella flexneri 2a str. 2457T
cguuacugucgcgca

SEQ ID NO: 3836650 - RNA, 16 nt, Shigella flexneri 2a str. 2457T
cguuacugucgcgcag

SEQ ID NO: 3836651 - RNA, 18 nt, Shigella flexneri 2a str. 2457T
cguuagccagcgcaccag

SEQ ID NO: 3836652 - RNA, 18 nt, Shigella flexneri 2a str. 2457T
cguuagucgucgccgaua

SEQ ID NO: 3836653 - RNA, 12 nt, Shigella flexneri 2a str. 2457T
cguuagugucuu

SEQ ID NO: 3836654 - RNA, 18 nt, Shigella flexneri 2a str. 2457T
cguuagugucuuaucugg

SEQ ID NO: 3836655 - RNA, 23 nt, Shigella flexneri 2a str. 2457T
cguuagugucuuaucuggcauuu

SEQ ID NO: 3836656 - RNA, 13 nt, Shigella flexneri 2a str. 2457T
cguuaguguggcc

SEQ ID NO: 3836657 - RNA, 19 nt, Shigella flexneri 2a str. 2457T
cguuaguguggccaguucc

SEQ ID NO: 3836658 - RNA, 20 nt, Shigella flexneri 2a str. 2457T
cguuaguucgcguaacugcu

SEQ ID NO: 3836659 - RNA, 19 nt, Shigella flexneri 2a str. 2457T
cguuauacaucgcuuucca

SEQ ID NO: 3836660 - RNA, 19 nt, Shigella flexneri 2a str. 2457T
cguuauaucccauuuuuga

SEQ ID NO: 3836661 - RNA, 12 nt, Shigella flexneri 2a str. 2457T
cguuaucaccug

SEQ ID NO: 3836662 - RNA, 17 nt, Shigella flexneri 2a str. 2457T
cguuaucagcaacuggc

SEQ ID NO: 3836663 - RNA, 23 nt, Shigella flexneri 2a str. 2457T
cguuaucagggagucuugcugga

SEQ ID NO: 3836664 - RNA, 19 nt, Shigella flexneri 2a str. 2457T
cguuaucccaucccacuca

SEQ ID NO: 3836665 - RNA, 20 nt, Shigella flexneri 2a str. 2457T
cguuauccggcuaacaaaau

SEQ ID NO: 3836666 - RNA, 17 nt, Shigella flexneri 2a str. 2457T
cguuaucgcuguuaaug

SEQ ID NO: 3836667 - RNA, 22 nt, Shigella flexneri 2a str. 2457T
cguuaugcaccgacaauccggu

SEQ ID NO: 3836668 - RNA, 12 nt, Shigella flexneri 2a str. 2457T
cguuaugucucc

SEQ ID NO: 3836669 - RNA, 23 nt, Shigella flexneri 2a str. 2457T
cguucaaacgauucggcaaucac

SEQ ID NO: 3836670 - RNA, 20 nt, Shigella flexneri 2a str. 2457T
cguucaccccuuucucgccc

SEQ ID NO: 3836671 - RNA, 21 nt, Shigella flexneri 2a str. 2457T
cguucaccgaagacgugcgcc

SEQ ID NO: 3836672 - RNA, 11 nt, Shigella flexneri 2a str. 2457T
cguucacgccg

SEQ ID NO: 3836673 - RNA, 21 nt, Shigella flexneri 2a str. 2457T
cguucacgucgcauccggcau

SEQ ID NO: 3836674 - RNA, 17 nt, Shigella flexneri 2a str. 2457T
cguucaguucaaaguua

SEQ ID NO: 3836675 - RNA, 22 nt, Shigella flexneri 2a str. 2457T
cguucauaaauacagagcacgc

SEQ ID NO: 3836676 - RNA, 18 nt, Shigella flexneri 2a str. 2457T
cguucaucaguuccaguu

SEQ ID NO: 3836677 - RNA, 15 nt, Shigella flexneri 2a str. 2457T
cguucauccaacaau

SEQ ID NO: 3836678 - RNA, 11 nt, Shigella flexneri 2a str. 2457T
cguucauccca

SEQ ID NO: 3836679 - RNA, 17 nt, Shigella flexneri 2a str. 2457T
cguucaucccacucuga

SEQ ID NO: 3836680 - RNA, 24 nt, Shigella flexneri 2a str. 2457T
cguucaucgggcauugcaaccaca

SEQ ID NO: 3836681 - RNA, 22 nt, Shigella flexneri 2a str. 2457T
cguucauggcgcgacauggcga

SEQ ID NO: 3836682 - RNA, 23 nt, Shigella flexneri 2a str. 2457T
cguucauuaacgccccaaucaga

SEQ ID NO: 3836683 - RNA, 20 nt, Shigella flexneri 2a str. 2457T
cguuccaccacguuuuucaa

SEQ ID NO: 3836684 - RNA, 13 nt, Shigella flexneri 2a str. 2457T
cguuccaccgcuc

SEQ ID NO: 3836685 - RNA, 14 nt, Shigella flexneri 2a str. 2457T
cguuccagcaacuc

SEQ ID NO: 3836686 - RNA, 17 nt, Shigella flexneri 2a str. 2457T
cguuccauggcaggagu

SEQ ID NO: 3836687 - RNA, 14 nt, Shigella flexneri 2a str. 2457T
cguuccccagaugc

SEQ ID NO: 3836688 - RNA, 21 nt, Shigella flexneri 2a str. 2457T
cguuccccgaagacgugcgcc

SEQ ID NO: 3836689 - RNA, 22 nt, Shigella flexneri 2a str. 2457T
cguuccccuguugugccagacc

SEQ ID NO: 3836690 - RNA, 15 nt, Shigella flexneri 2a str. 2457T
cguuccuaacaugcc

SEQ ID NO: 3836691 - RNA, 19 nt, Shigella flexneri 2a str. 2457T
cguuccuacaacugggaca

SEQ ID NO: 3836692 - RNA, 13 nt, Shigella flexneri 2a str. 2457T
cguuccugcaacg

SEQ ID NO: 3836693 - RNA, 20 nt, Shigella flexneri 2a str. 2457T
cguuccuggaaccagugaau

SEQ ID NO: 3836694 - RNA, 11 nt, Shigella flexneri 2a str. 2457T
cguuccuggcu

SEQ ID NO: 3836695 - RNA, 14 nt, Shigella flexneri 2a str. 2457T
cguuccuggggaaa

SEQ ID NO: 3836696 - RNA, 22 nt, Shigella flexneri 2a str. 2457T
cguucgaugcggcucagccaga

SEQ ID NO: 3836697 - RNA, 17 nt, Shigella flexneri 2a str. 2457T
cguucgauggcgcgcca

SEQ ID NO: 3836698 - RNA, 15 nt, Shigella flexneri 2a str. 2457T
cguucgcccauucca

SEQ ID NO: 3836699 - RNA, 12 nt, Shigella flexneri 2a str. 2457T
cguucgccguuu

SEQ ID NO: 3836700 - RNA, 21 nt, Shigella flexneri 2a str. 2457T
cguucgcgccgcauccggcau

SEQ ID NO: 3836701 - RNA, 24 nt, Shigella flexneri 2a str. 2457T
cguucgcggggcuaccgccagacc

SEQ ID NO: 3836702 - RNA, 19 nt, Shigella flexneri 2a str. 2457T
cguucguagaaaaaacagc

SEQ ID NO: 3836703 - RNA, 16 nt, Shigella flexneri 2a str. 2457T
cguucugaucuuucuu

SEQ ID NO: 3836704 - RNA, 15 nt, Shigella flexneri 2a str. 2457T
cguucugccaaacgc

SEQ ID NO: 3836705 - RNA, 14 nt, Shigella flexneri 2a str. 2457T
cguucuucccgccu

SEQ ID NO: 3836706 - RNA, 13 nt, Shigella flexneri 2a str. 2457T
cguucuucccucc

SEQ ID NO: 3836707 - RNA, 12 nt, Shigella flexneri 2a str. 2457T
cguucuuccugu

SEQ ID NO: 3836708 - RNA, 15 nt, Shigella flexneri 2a str. 2457T
cguugaaaaaucaaa

SEQ ID NO: 3836709 - RNA, 15 nt, Shigella flexneri 2a str. 2457T
cguugaacccggcau

SEQ ID NO: 3836710 - RNA, 20 nt, Shigella flexneri 2a str. 2457T
cguugaaggguauugccgau

SEQ ID NO: 3836711 - RNA, 13 nt, Shigella flexneri 2a str. 2457T
cguugaccagcau

SEQ ID NO: 3836712 - RNA, 13 nt, Shigella flexneri 2a str. 2457T
cguugaccaguca

SEQ ID NO: 3836713 - RNA, 21 nt, Shigella flexneri 2a str. 2457T
cguugaccugaauacccgcau

SEQ ID NO: 3836714 - RNA, 20 nt, Shigella flexneri 2a str. 2457T
cguugagaauggccaaucac

SEQ ID NO: 3836715 - RNA, 22 nt, Shigella flexneri 2a str. 2457T
cguugagcaaucgacgccguuu

SEQ ID NO: 3836716 - RNA, 21 nt, Shigella flexneri 2a str. 2457T
cguugaggaacucaaaccauu

SEQ ID NO: 3836717 - RNA, 16 nt, Shigella flexneri 2a str. 2457T
cguugaucucuccggu

SEQ ID NO: 3836718 - RNA, 20 nt, Shigella flexneri 2a str. 2457T
cguugaugccgugcagcacg

SEQ ID NO: 3836719 - RNA, 20 nt, Shigella flexneri 2a str. 2457T
cguugcaauacuuccgcuuc

SEQ ID NO: 3836720 - RNA, 15 nt, Shigella flexneri 2a str. 2457T
cguugcaaucagcgg

SEQ ID NO: 3836721 - RNA, 23 nt, Shigella flexneri 2a str. 2457T
cguugcaaucagcggugccgcga

SEQ ID NO: 3836722 - RNA, 21 nt, Shigella flexneri 2a str. 2457T
cguugcauaaaugccgcaaug

SEQ ID NO: 3836723 - RNA, 18 nt, Shigella flexneri 2a str. 2457T
cguugcccggagcagcag

SEQ ID NO: 3836724 - RNA, 20 nt, Shigella flexneri 2a str. 2457T
cguugccggauauacccgcc

SEQ ID NO: 3836725 - RNA, 17 nt, Shigella flexneri 2a str. 2457T
cguugcgcgucaacugu

SEQ ID NO: 3836726 - RNA, 17 nt, Shigella flexneri 2a str. 2457T
cguugcgcuucucaggc

SEQ ID NO: 3836727 - RNA, 17 nt, Shigella flexneri 2a str. 2457T
cguugcguugcagcagg

SEQ ID NO: 3836728 - RNA, 22 nt, Shigella flexneri 2a str. 2457T
cguugcuugaugcacugggaga

SEQ ID NO: 3836729 - RNA, 16 nt, Shigella flexneri 2a str. 2457T
cguuggucucaagcaa

SEQ ID NO: 3836730 - RNA, 18 nt, Shigella flexneri 2a str. 2457T
cguuguaguguuccugcg

SEQ ID NO: 3836731 - RNA, 16 nt, Shigella flexneri 2a str. 2457T
cguugucagcaaccug

SEQ ID NO: 3836732 - RNA, 20 nt, Shigella flexneri 2a str. 2457T
cguugucagcaaccugcuua

SEQ ID NO: 3836733 - RNA, 23 nt, Shigella flexneri 2a str. 2457T
cguugugcaucaggcaaacuuca

SEQ ID NO: 3836734 - RNA, 23 nt, Shigella flexneri 2a str. 2457T
cguuguuccuuccagcuggcuac

SEQ ID NO: 3836735 - RNA, 16 nt, Shigella flexneri 2a str. 2457T
cguuuaaucacaccau

SEQ ID NO: 3836736 - RNA, 19 nt, Shigella flexneri 2a str. 2457T
cguuuaaucacaccauuga

SEQ ID NO: 3836737 - RNA, 12 nt, Shigella flexneri 2a str. 2457T
cguuuauuuccc

SEQ ID NO: 3836738 - RNA, 20 nt, Shigella flexneri 2a str. 2457T
cguuucacugccggacguuc

SEQ ID NO: 3836739 - RNA, 15 nt, Shigella flexneri 2a str. 2457T
cguuucaucuucagu

SEQ ID NO: 3836740 - RNA, 14 nt, Shigella flexneri 2a str. 2457T
cguuucauucaggc

SEQ ID NO: 3836741 - RNA, 14 nt, Shigella flexneri 2a str. 2457T
cguuuccagcacca

SEQ ID NO: 3836742 - RNA, 17 nt, Shigella flexneri 2a str. 2457T
cguuuccagcaccaguu

SEQ ID NO: 3836743 - RNA, 19 nt, Shigella flexneri 2a str. 2457T
cguuuccagcaccaguuca

SEQ ID NO: 3836744 - RNA, 11 nt, Shigella flexneri 2a str. 2457T
cguuucccugu

SEQ ID NO: 3836745 - RNA, 20 nt, Shigella flexneri 2a str. 2457T
cguuucgaauuacacagcca

SEQ ID NO: 3836746 - RNA, 20 nt, Shigella flexneri 2a str. 2457T
cguuucucuguucagccuga

SEQ ID NO: 3836747 - RNA, 22 nt, Shigella flexneri 2a str. 2457T
cguuucuucgacacguuccuca

SEQ ID NO: 3836748 - RNA, 17 nt, Shigella flexneri 2a str. 2457T
cguuucuucuacaggcu

SEQ ID NO: 3836749 - RNA, 15 nt, Shigella flexneri 2a str. 2457T
cguuucuuucaucag

SEQ ID NO: 3836750 - RNA, 12 nt, Shigella flexneri 2a str. 2457T
cguuucuuuuuc

SEQ ID NO: 3836751 - RNA, 16 nt, Shigella flexneri 2a str. 2457T
cguuugcaggccugau

SEQ ID NO: 3836752 - RNA, 23 nt, Shigella flexneri 2a str. 2457T
cguuuggugguuuggcggcggcu

SEQ ID NO: 3836753 - RNA, 17 nt, Shigella flexneri 2a str. 2457T
cguuuguaggccggaua

SEQ ID NO: 3836754 - RNA, 13 nt, Shigella flexneri 2a str. 2457T
cguuugucaucag

SEQ ID NO: 3836755 - RNA, 14 nt, Shigella flexneri 2a str. 2457T
cguuuuacagcaac

SEQ ID NO: 3836756 - RNA, 19 nt, Shigella flexneri 2a str. 2457T
cguuuuacgcgucacgccu

SEQ ID NO: 3836757 - RNA, 19 nt, Shigella flexneri 2a str. 2457T
cguuuucguuacuccgcca

SEQ ID NO: 3836758 - RNA, 18 nt, Shigella flexneri 2a str. 2457T
cguuuucuauuaucagaa

SEQ ID NO: 3836759 - RNA, 16 nt, Shigella flexneri 2a str. 2457T
cguuuugccgccauca

SEQ ID NO: 3836760 - RNA, 16 nt, Shigella flexneri 2a str. 2457T
cguuuuggcagacaac

SEQ ID NO: 3836761 - RNA, 20 nt, Shigella flexneri 2a str. 2457T
cguuuuggugaagugagaau

SEQ ID NO: 3836762 - RNA, 17 nt, Shigella flexneri 2a str. 2457T
cguuuuuacccagcagc

SEQ ID NO: 3836763 - RNA, 17 nt, Shigella flexneri 2a str. 2457T
cguuuuucgcugucggu

SEQ ID NO: 3836764 - RNA, 18 nt, Shigella flexneri 2a str. 2457T
cguuuuucuucagcagcc

SEQ ID NO: 3836765 - RNA, 13 nt, Shigella flexneri 2a str. 2457T
cguuuuuuuucug

SEQ ID NO: 3836766 - RNA, 20 nt, Shigella flexneri 2a str. 2457T
cuaaaaacagcaucaauaau

SEQ ID NO: 3836767 - RNA, 20 nt, Shigella flexneri 2a str. 2457T
cuaaaaaguuauaaauaaaa

SEQ ID NO: 3836768 - RNA, 15 nt, Shigella flexneri 2a str. 2457T
cuaaaaauugcagac

SEQ ID NO: 3836769 - RNA, 18 nt, Shigella flexneri 2a str. 2457T
cuaaaaauugcagacccg

SEQ ID NO: 3836770 - RNA, 22 nt, Shigella flexneri 2a str. 2457T
cuaaaagcacgccagacaucac

SEQ ID NO: 3836771 - RNA, 20 nt, Shigella flexneri 2a str. 2457T
cuaaaagcgauuauuuauuc

SEQ ID NO: 3836772 - RNA, 15 nt, Shigella flexneri 2a str. 2457T
cuaaacgcuggcagg

SEQ ID NO: 3836773 - RNA, 16 nt, Shigella flexneri 2a str. 2457T
cuaaacguuuaaaaac

SEQ ID NO: 3836774 - RNA, 15 nt, Shigella flexneri 2a str. 2457T
cuaaagcaacuccau

SEQ ID NO: 3836775 - RNA, 18 nt, Shigella flexneri 2a str. 2457T
cuaaagcacccagcaauc

SEQ ID NO: 3836776 - RNA, 17 nt, Shigella flexneri 2a str. 2457T
cuaaaggcaaaaugcca

SEQ ID NO: 3836777 - RNA, 16 nt, Shigella flexneri 2a str. 2457T
cuaaaguuguuuucuu

SEQ ID NO: 3836778 - RNA, 19 nt, Shigella flexneri 2a str. 2457T
cuaaauccgccaucaacac

SEQ ID NO: 3836779 - RNA, 19 nt, Shigella flexneri 2a str. 2457T
cuaaaucuggugcuuuuuc

SEQ ID NO: 3836780 - RNA, 21 nt, Shigella flexneri 2a str. 2457T
cuaaaucuggugcuuuuucaa

SEQ ID NO: 3836781 - RNA, 17 nt, Shigella flexneri 2a str. 2457T
cuaaaucuuccgccggg

SEQ ID NO: 3836782 - RNA, 16 nt, Shigella flexneri 2a str. 2457T
cuaaauguagcgaacu

SEQ ID NO: 3836783 - RNA, 17 nt, Shigella flexneri 2a str. 2457T
cuaaauguucaauaagc

SEQ ID NO: 3836784 - RNA, 16 nt, Shigella flexneri 2a str. 2457T
cuaacaaggcuucgcu

SEQ ID NO: 3836785 - RNA, 17 nt, Shigella flexneri 2a str. 2457T
cuaacacugcguacagc

SEQ ID NO: 3836786 - RNA, 23 nt, Shigella flexneri 2a str. 2457T
cuaacaucauccccguaucuuca

SEQ ID NO: 3836787 - RNA, 12 nt, Shigella flexneri 2a str. 2457T
cuaacccucucc

SEQ ID NO: 3836788 - RNA, 15 nt, Shigella flexneri 2a str. 2457T
cuaacccucucccca

SEQ ID NO: 3836789 - RNA, 19 nt, Shigella flexneri 2a str. 2457T
cuaacccucuccccaaggg

SEQ ID NO: 3836790 - RNA, 15 nt, Shigella flexneri 2a str. 2457T
cuaacccucuccccg

SEQ ID NO: 3836791 - RNA, 22 nt, Shigella flexneri 2a str. 2457T
cuaaccgaauucaaauccuuca

SEQ ID NO: 3836792 - RNA, 17 nt, Shigella flexneri 2a str. 2457T
cuaaccgcuuuuccagc

SEQ ID NO: 3836793 - RNA, 13 nt, Shigella flexneri 2a str. 2457T
cuaaccucgaugc

SEQ ID NO: 3836794 - RNA, 20 nt, Shigella flexneri 2a str. 2457T
cuaacgauaccguguuauuc

SEQ ID NO: 3836795 - RNA, 17 nt, Shigella flexneri 2a str. 2457T
cuaacgaugccagcacc

SEQ ID NO: 3836796 - RNA, 16 nt, Shigella flexneri 2a str. 2457T
cuaacgcgucuuaucu

SEQ ID NO: 3836797 - RNA, 20 nt, Shigella flexneri 2a str. 2457T
cuaacgcgucuuaucuggcc

SEQ ID NO: 3836798 - RNA, 21 nt, Shigella flexneri 2a str. 2457T
cuaacgcgucuuaucuggccu

SEQ ID NO: 3836799 - RNA, 15 nt, Shigella flexneri 2a str. 2457T
cuaacggaauugcca

SEQ ID NO: 3836800 - RNA, 19 nt, Shigella flexneri 2a str. 2457T
cuaacguuuuacgcgucac

SEQ ID NO: 3836801 - RNA, 19 nt, Shigella flexneri 2a str. 2457T
cuaagaagccuuuaucugg

SEQ ID NO: 3836802 - RNA, 15 nt, Shigella flexneri 2a str. 2457T
cuaagaagucauugg

SEQ ID NO: 3836803 - RNA, 20 nt, Shigella flexneri 2a str. 2457T
cuaagaauguccauuauuuc

SEQ ID NO: 3836804 - RNA, 13 nt, Shigella flexneri 2a str. 2457T
cuaagccaguuca

SEQ ID NO: 3836805 - RNA, 20 nt, Shigella flexneri 2a str. 2457T
cuaagccauuuaacucaccg

SEQ ID NO: 3836806 - RNA, 16 nt, Shigella flexneri 2a str. 2457T
cuaagccgugcauaac

SEQ ID NO: 3836807 - RNA, 20 nt, Shigella flexneri 2a str. 2457T
cuaagccgugcauaacggag

SEQ ID NO: 3836808 - RNA, 14 nt, Shigella flexneri 2a str. 2457T
cuaaggcagccaga

SEQ ID NO: 3836809 - RNA, 21 nt, Shigella flexneri 2a str. 2457T
cuaaggguaaaacgacuggcc

SEQ ID NO: 3836810 - RNA, 17 nt, Shigella flexneri 2a str. 2457T
cuaaggucaccaguuca

SEQ ID NO: 3836811 - RNA, 15 nt, Shigella flexneri 2a str. 2457T
cuaauaaaucuaaaa

SEQ ID NO: 3836812 - RNA, 15 nt, Shigella flexneri 2a str. 2457T
cuaauaaugagcaga

SEQ ID NO: 3836813 - RNA, 16 nt, Shigella flexneri 2a str. 2457T
cuaauaaugagcagaa

SEQ ID NO: 3836814 - RNA, 17 nt, Shigella flexneri 2a str. 2457T
cuaauaaugagcagaaa

SEQ ID NO: 3836815 - RNA, 18 nt, Shigella flexneri 2a str. 2457T
cuaauaauuauccugugg

SEQ ID NO: 3836816 - RNA, 20 nt, Shigella flexneri 2a str. 2457T
cuaaucagcuuuuccauauc

SEQ ID NO: 3836817 - RNA, 14 nt, Shigella flexneri 2a str. 2457T
cuaaucaucaucag

SEQ ID NO: 3836818 - RNA, 15 nt, Shigella flexneri 2a str. 2457T
cuaauccugaagacg

SEQ ID NO: 3836819 - RNA, 17 nt, Shigella flexneri 2a str. 2457T
cuaaucgcuuuauagca

SEQ ID NO: 3836820 - RNA, 17 nt, Shigella flexneri 2a str. 2457T
cuaaucucuucaccaua

SEQ ID NO: 3836821 - RNA, 18 nt, Shigella flexneri 2a str. 2457T
cuaaugagucaggacagu

SEQ ID NO: 3836822 - RNA, 21 nt, Shigella flexneri 2a str. 2457T
cuaaugagucaggacaguaaa

SEQ ID NO: 3836823 - RNA, 21 nt, Shigella flexneri 2a str. 2457T
cuaaugcuuuuuccugcguca

SEQ ID NO: 3836824 - RNA, 13 nt, Shigella flexneri 2a str. 2457T
cuaauucaacgcc

SEQ ID NO: 3836825 - RNA, 22 nt, Shigella flexneri 2a str. 2457T
cuaauuucgccgaggcgcuggc

SEQ ID NO: 3836826 - RNA, 15 nt, Shigella flexneri 2a str. 2457T
cuaauuuuucccgac

SEQ ID NO: 3836827 - RNA, 15 nt, Shigella flexneri 2a str. 2457T
cuaauuuuuguuguu

SEQ ID NO: 3836828 - RNA, 15 nt, Shigella flexneri 2a str. 2457T
cuacaaaaacucaua

SEQ ID NO: 3836829 - RNA, 15 nt, Shigella flexneri 2a str. 2457T
cuacaaaaaugcccg

SEQ ID NO: 3836830 - RNA, 23 nt, Shigella flexneri 2a str. 2457T
cuacaaaaccaauuaaauucaau

SEQ ID NO: 3836831 - RNA, 19 nt, Shigella flexneri 2a str. 2457T
cuacaaacguugcugacug

SEQ ID NO: 3836832 - RNA, 22 nt, Shigella flexneri 2a str. 2457T
cuacaaauuugugcaaauucaa

SEQ ID NO: 3836833 - RNA, 23 nt, Shigella flexneri 2a str. 2457T
cuacaaauuugugcaaauucaau

SEQ ID NO: 3836834 - RNA, 22 nt, Shigella flexneri 2a str. 2457T
cuacaacuccguugaaauugcu

SEQ ID NO: 3836835 - RNA, 22 nt, Shigella flexneri 2a str. 2457T
cuacaaguccguugaaaaugcu

SEQ ID NO: 3836836 - RNA, 16 nt, Shigella flexneri 2a str. 2457T
cuacaauguuucugca

SEQ ID NO: 3836837 - RNA, 23 nt, Shigella flexneri 2a str. 2457T
cuacacagacgguuuuucaaguc

SEQ ID NO: 3836838 - RNA, 16 nt, Shigella flexneri 2a str. 2457T
cuacacauacuuauua

SEQ ID NO: 3836839 - RNA, 21 nt, Shigella flexneri 2a str. 2457T
cuacacauuaucucaacacac

SEQ ID NO: 3836840 - RNA, 15 nt, Shigella flexneri 2a str. 2457T
cuacaccaugccggu

SEQ ID NO: 3836841 - RNA, 17 nt, Shigella flexneri 2a str. 2457T
cuacaccaugccgguga

SEQ ID NO: 3836842 - RNA, 20 nt, Shigella flexneri 2a str. 2457T
cuacacgcuaccaaaaaauc

SEQ ID NO: 3836843 - RNA, 23 nt, Shigella flexneri 2a str. 2457T
cuacacgcuaccaaaaaaucaau

SEQ ID NO: 3836844 - RNA, 23 nt, Shigella flexneri 2a str. 2457T
cuacagagcgagggagaaaaccc

SEQ ID NO: 3836845 - RNA, 17 nt, Shigella flexneri 2a str. 2457T
cuacagaggaaucgcug

SEQ ID NO: 3836846 - RNA, 22 nt, Shigella flexneri 2a str. 2457T
cuacagaggaaucgcuguugag

SEQ ID NO: 3836847 - RNA, 20 nt, Shigella flexneri 2a str. 2457T
cuacagccaugcgaaugcca

SEQ ID NO: 3836848 - RNA, 17 nt, Shigella flexneri 2a str. 2457T
cuacaggauaucuggca

SEQ ID NO: 3836849 - RNA, 23 nt, Shigella flexneri 2a str. 2457T
cuacaggcaacgaccagaaaugc

SEQ ID NO: 3836850 - RNA, 14 nt, Shigella flexneri 2a str. 2457T
cuacagguaaggua

SEQ ID NO: 3836851 - RNA, 17 nt, Shigella flexneri 2a str. 2457T
cuacauauuuuucauau

SEQ ID NO: 3836852 - RNA, 14 nt, Shigella flexneri 2a str. 2457T
cuacaugauuucug

SEQ ID NO: 3836853 - RNA, 12 nt, Shigella flexneri 2a str. 2457T
cuaccacaugau

SEQ ID NO: 3836854 - RNA, 14 nt, Shigella flexneri 2a str. 2457T
cuaccacaugauua

SEQ ID NO: 3836855 - RNA, 11 nt, Shigella flexneri 2a str. 2457T
cuaccagcacc

SEQ ID NO: 3836856 - RNA, 15 nt, Shigella flexneri 2a str. 2457T
cuaccagcaccugcu

SEQ ID NO: 3836857 - RNA, 16 nt, Shigella flexneri 2a str. 2457T
cuaccagcgccaccgg

SEQ ID NO: 3836858 - RNA, 14 nt, Shigella flexneri 2a str. 2457T
cuaccagcgcggca

SEQ ID NO: 3836859 - RNA, 12 nt, Shigella flexneri 2a str. 2457T
cuaccagcucau

SEQ ID NO: 3836860 - RNA, 13 nt, Shigella flexneri 2a str. 2457T
cuaccagcugcca

SEQ ID NO: 3836861 - RNA, 13 nt, Shigella flexneri 2a str. 2457T
cuaccaucaaugg

SEQ ID NO: 3836862 - RNA, 18 nt, Shigella flexneri 2a str. 2457T
cuaccaugaugauaucac

SEQ ID NO: 3836863 - RNA, 19 nt, Shigella flexneri 2a str. 2457T
cuaccauuuguucuuuuuu

SEQ ID NO: 3836864 - RNA, 15 nt, Shigella flexneri 2a str. 2457T
cuacccauauuuaau

SEQ ID NO: 3836865 - RNA, 15 nt, Shigella flexneri 2a str. 2457T
cuacccggugaaucg

SEQ ID NO: 3836866 - RNA, 14 nt, Shigella flexneri 2a str. 2457T
cuacccuaaguggc

SEQ ID NO: 3836867 - RNA, 19 nt, Shigella flexneri 2a str. 2457T
cuaccgauccggcaccaau

SEQ ID NO: 3836868 - RNA, 17 nt, Shigella flexneri 2a str. 2457T
cuaccgcgaugacccaa

SEQ ID NO: 3836869 - RNA, 19 nt, Shigella flexneri 2a str. 2457T
cuaccgucuguaaccagau

SEQ ID NO: 3836870 - RNA, 20 nt, Shigella flexneri 2a str. 2457T
cuaccgugcuguacagcagu

SEQ ID NO: 3836871 - RNA, 20 nt, Shigella flexneri 2a str. 2457T
cuaccugagucaucaacuca

SEQ ID NO: 3836872 - RNA, 20 nt, Shigella flexneri 2a str. 2457T
cuaccuuaacgguaucuuuc

SEQ ID NO: 3836873 - RNA, 13 nt, Shigella flexneri 2a str. 2457T
cuaccuucuuccc

SEQ ID NO: 3836874 - RNA, 13 nt, Shigella flexneri 2a str. 2457T
cuaccuuucagug

SEQ ID NO: 3836875 - RNA, 19 nt, Shigella flexneri 2a str. 2457T
cuacgcagggauauuucac

SEQ ID NO: 3836876 - RNA, 18 nt, Shigella flexneri 2a str. 2457T
cuacgcucaucaggccua

SEQ ID NO: 3836877 - RNA, 21 nt, Shigella flexneri 2a str. 2457T
cuacgcucucuucaaacgcuu

SEQ ID NO: 3836878 - RNA, 18 nt, Shigella flexneri 2a str. 2457T
cuacgcuuaucaggccua

SEQ ID NO: 3836879 - RNA, 19 nt, Shigella flexneri 2a str. 2457T
cuacgcuuaucaggccuac

SEQ ID NO: 3836880 - RNA, 16 nt, Shigella flexneri 2a str. 2457T
cuacgguguaaccugc

SEQ ID NO: 3836881 - RNA, 22 nt, Shigella flexneri 2a str. 2457T
cuacguaggacagcguugccag

SEQ ID NO: 3836882 - RNA, 23 nt, Shigella flexneri 2a str. 2457T
cuacguaggacagcguugccagc

SEQ ID NO: 3836883 - RNA, 20 nt, Shigella flexneri 2a str. 2457T
cuacguuucuggugugcagc

SEQ ID NO: 3836884 - RNA, 21 nt, Shigella flexneri 2a str. 2457T
cuacuaugauuuuccugagga

SEQ ID NO: 3836885 - RNA, 20 nt, Shigella flexneri 2a str. 2457T
cuacuauggaacgcucaagc

SEQ ID NO: 3836886 - RNA, 16 nt, Shigella flexneri 2a str. 2457T
cuacuccaacccggca

SEQ ID NO: 3836887 - RNA, 20 nt, Shigella flexneri 2a str. 2457T
cuacucccaguagugcuuuc

SEQ ID NO: 3836888 - RNA, 17 nt, Shigella flexneri 2a str. 2457T
cuacuccccaaaauccc

SEQ ID NO: 3836889 - RNA, 14 nt, Shigella flexneri 2a str. 2457T
cuacugaaucccug

SEQ ID NO: 3836890 - RNA, 18 nt, Shigella flexneri 2a str. 2457T
cuacuggcaauccagcuc

SEQ ID NO: 3836891 - RNA, 11 nt, Shigella flexneri 2a str. 2457T
cuacuucuucg

SEQ ID NO: 3836892 - RNA, 20 nt, Shigella flexneri 2a str. 2457T
cuacuucuuucaccaucgca

SEQ ID NO: 3836893 - RNA, 22 nt, Shigella flexneri 2a str. 2457T
cuacuuugcgagucugcuccag

SEQ ID NO: 3836894 - RNA, 14 nt, Shigella flexneri 2a str. 2457T
cuacuuuuuuaaga

SEQ ID NO: 3836895 - RNA, 21 nt, Shigella flexneri 2a str. 2457T
cuacuuuuuuaagauccaguu

SEQ ID NO: 3836896 - RNA, 16 nt, Shigella flexneri 2a str. 2457T
cuagaaaucauucaau

SEQ ID NO: 3836897 - RNA, 19 nt, Shigella flexneri 2a str. 2457T
cuagaaaucauucaauacu

SEQ ID NO: 3836898 - RNA, 23 nt, Shigella flexneri 2a str. 2457T
cuagacagcgacucucugagcca

SEQ ID NO: 3836899 - RNA, 16 nt, Shigella flexneri 2a str. 2457T
cuagccucccugccuc

SEQ ID NO: 3836900 - RNA, 17 nt, Shigella flexneri 2a str. 2457T
cuagccucccugccucc

SEQ ID NO: 3836901 - RNA, 15 nt, Shigella flexneri 2a str. 2457T
cuagcggcuuuuuac

SEQ ID NO: 3836902 - RNA, 19 nt, Shigella flexneri 2a str. 2457T
cuaggaagccuuccgcaaa

SEQ ID NO: 3836903 - RNA, 13 nt, Shigella flexneri 2a str. 2457T
cuaggcauagaaa

SEQ ID NO: 3836904 - RNA, 15 nt, Shigella flexneri 2a str. 2457T
cuaggcgaacauucc

SEQ ID NO: 3836905 - RNA, 16 nt, Shigella flexneri 2a str. 2457T
cuagguugaccuggaa

SEQ ID NO: 3836906 - RNA, 17 nt, Shigella flexneri 2a str. 2457T
cuagguugaccuggaag

SEQ ID NO: 3836907 - RNA, 23 nt, Shigella flexneri 2a str. 2457T
cuagugcagauaguugauuaauu

SEQ ID NO: 3836908 - RNA, 14 nt, Shigella flexneri 2a str. 2457T
cuauaacaaaacug

SEQ ID NO: 3836909 - RNA, 18 nt, Shigella flexneri 2a str. 2457T
cuauaacaaaacugagag

SEQ ID NO: 3836910 - RNA, 21 nt, Shigella flexneri 2a str. 2457T
cuauaacguugccggauauac

SEQ ID NO: 3836911 - RNA, 13 nt, Shigella flexneri 2a str. 2457T
cuauacagcagcc

SEQ ID NO: 3836912 - RNA, 18 nt, Shigella flexneri 2a str. 2457T
cuauaccgccgaucgccg

SEQ ID NO: 3836913 - RNA, 16 nt, Shigella flexneri 2a str. 2457T
cuauauacccuucuca

SEQ ID NO: 3836914 - RNA, 16 nt, Shigella flexneri 2a str. 2457T
cuauauuccuuuauca

SEQ ID NO: 3836915 - RNA, 17 nt, Shigella flexneri 2a str. 2457T
cuaucaaccugaggcuc

SEQ ID NO: 3836916 - RNA, 13 nt, Shigella flexneri 2a str. 2457T
cuaucaacgacag

SEQ ID NO: 3836917 - RNA, 23 nt, Shigella flexneri 2a str. 2457T
cuaucagaccuacaaaaccugca

SEQ ID NO: 3836918 - RNA, 18 nt, Shigella flexneri 2a str. 2457T
cuaucagauuggcuucau

SEQ ID NO: 3836919 - RNA, 20 nt, Shigella flexneri 2a str. 2457T
cuaucagcaaacuaucccag

SEQ ID NO: 3836920 - RNA, 12 nt, Shigella flexneri 2a str. 2457T
cuaucagcgcca

SEQ ID NO: 3836921 - RNA, 13 nt, Shigella flexneri 2a str. 2457T
cuaucauacucau

SEQ ID NO: 3836922 - RNA, 13 nt, Shigella flexneri 2a str. 2457T
cuaucaucagcau

SEQ ID NO: 3836923 - RNA, 20 nt, Shigella flexneri 2a str. 2457T
cuauccacgucgacaacucc

SEQ ID NO: 3836924 - RNA, 11 nt, Shigella flexneri 2a str. 2457T
cuauccagcuc

SEQ ID NO: 3836925 - RNA, 16 nt, Shigella flexneri 2a str. 2457T
cuauccagcucaucca

SEQ ID NO: 3836926 - RNA, 20 nt, Shigella flexneri 2a str. 2457T
cuaucgaacaugcgggucuu

SEQ ID NO: 3836927 - RNA, 20 nt, Shigella flexneri 2a str. 2457T
cuaucgcugauauacccuuc

SEQ ID NO: 3836928 - RNA, 15 nt, Shigella flexneri 2a str. 2457T
cuaucguccacguca

SEQ ID NO: 3836929 - RNA, 21 nt, Shigella flexneri 2a str. 2457T
cuaucucaccccauuugccac

SEQ ID NO: 3836930 - RNA, 16 nt, Shigella flexneri 2a str. 2457T
cuaucugccguucagc

SEQ ID NO: 3836931 - RNA, 21 nt, Shigella flexneri 2a str. 2457T
cuaucugcugcuugcgguuug

SEQ ID NO: 3836932 - RNA, 15 nt, Shigella flexneri 2a str. 2457T
cuaucuguuugccag

SEQ ID NO: 3836933 - RNA, 15 nt, Shigella flexneri 2a str. 2457T
cuaucuucgauaaac

SEQ ID NO: 3836934 - RNA, 18 nt, Shigella flexneri 2a str. 2457T
cuaucuucgauaaacuca

SEQ ID NO: 3836935 - RNA, 17 nt, Shigella flexneri 2a str. 2457T
cuaugaaagaaaaucaa

SEQ ID NO: 3836936 - RNA, 18 nt, Shigella flexneri 2a str. 2457T
cuaugaacacgaucucac

SEQ ID NO: 3836937 - RNA, 17 nt, Shigella flexneri 2a str. 2457T
cuaugcggaugccauuc

SEQ ID NO: 3836938 - RNA, 18 nt, Shigella flexneri 2a str. 2457T
cuauggaacgcucaagcc

SEQ ID NO: 3836939 - RNA, 17 nt, Shigella flexneri 2a str. 2457T
cuaugggauauuuuuuu

SEQ ID NO: 3836940 - RNA, 14 nt, Shigella flexneri 2a str. 2457T
cuauggggaaaaau

SEQ ID NO: 3836941 - RNA, 16 nt, Shigella flexneri 2a str. 2457T
cuauguaauccugaug

SEQ ID NO: 3836942 - RNA, 18 nt, Shigella flexneri 2a str. 2457T
cuauuaaaaagcuucuca

SEQ ID NO: 3836943 - RNA, 24 nt, Shigella flexneri 2a str. 2457T
cuauuaagcuuuccggcaucacau

SEQ ID NO: 3836944 - RNA, 17 nt, Shigella flexneri 2a str. 2457T
cuauuaugacuccagcg

SEQ ID NO: 3836945 - RNA, 23 nt, Shigella flexneri 2a str. 2457T
cuauucacgaaucuauucauuua

SEQ ID NO: 3836946 - RNA, 12 nt, Shigella flexneri 2a str. 2457T
cuauucagcagu

SEQ ID NO: 3836947 - RNA, 17 nt, Shigella flexneri 2a str. 2457T
cuauucagcucuuccuu

SEQ ID NO: 3836948 - RNA, 20 nt, Shigella flexneri 2a str. 2457T
cuauuccguuacucuccgga

SEQ ID NO: 3836949 - RNA, 15 nt, Shigella flexneri 2a str. 2457T
cuauucgccagcacg

SEQ ID NO: 3836950 - RNA, 16 nt, Shigella flexneri 2a str. 2457T
cuauugauuuaacagc

SEQ ID NO: 3836951 - RNA, 17 nt, Shigella flexneri 2a str. 2457T
cuauuucaauaugauaa

SEQ ID NO: 3836952 - RNA, 22 nt, Shigella flexneri 2a str. 2457T
cuauuuccccggaaccugaacu

SEQ ID NO: 3836953 - RNA, 14 nt, Shigella flexneri 2a str. 2457T
cuauuugcgccugg

SEQ ID NO: 3836954 - RNA, 14 nt, Shigella flexneri 2a str. 2457T
cuauuuuagaaaaa

SEQ ID NO: 3836955 - RNA, 15 nt, Shigella flexneri 2a str. 2457T
cuauuuuagaaaaac

SEQ ID NO: 3836956 - RNA, 23 nt, Shigella flexneri 2a str. 2457T
cucaaaauuucuccuucacucua

SEQ ID NO: 3836957 - RNA, 19 nt, Shigella flexneri 2a str. 2457T
cucaaaccauuucugcgag

SEQ ID NO: 3836958 - RNA, 19 nt, Shigella flexneri 2a str. 2457T
cucaaacgaaucugcaauc

SEQ ID NO: 3836959 - RNA, 22 nt, Shigella flexneri 2a str. 2457T
cucaaagacgcgguaaaagccc

SEQ ID NO: 3836960 - RNA, 15 nt, Shigella flexneri 2a str. 2457T
cucaaagccgaauuu

SEQ ID NO: 3836961 - RNA, 16 nt, Shigella flexneri 2a str. 2457T
cucaaaggccgacagc

SEQ ID NO: 3836962 - RNA, 22 nt, Shigella flexneri 2a str. 2457T
cucaaagucgagaugaaacucg

SEQ ID NO: 3836963 - RNA, 21 nt, Shigella flexneri 2a str. 2457T
cucaacaggcccaacuguuga

SEQ ID NO: 3836964 - RNA, 22 nt, Shigella flexneri 2a str. 2457T
cucaacaggcccaacuguugau

SEQ ID NO: 3836965 - RNA, 13 nt, Shigella flexneri 2a str. 2457T
cucaaccagauuc

SEQ ID NO: 3836966 - RNA, 23 nt, Shigella flexneri 2a str. 2457T
cucaaccagauucggcgcaauga

SEQ ID NO: 3836967 - RNA, 13 nt, Shigella flexneri 2a str. 2457T
cucaaccgcuucu

SEQ ID NO: 3836968 - RNA, 18 nt, Shigella flexneri 2a str. 2457T
cucaaccgcuucuuucuc

SEQ ID NO: 3836969 - RNA, 14 nt, Shigella flexneri 2a str. 2457T
cucaaccuucagga

SEQ ID NO: 3836970 - RNA, 19 nt, Shigella flexneri 2a str. 2457T
cucaacggcaauuuuaccu

SEQ ID NO: 3836971 - RNA, 14 nt, Shigella flexneri 2a str. 2457T
cucaacucacgccc

SEQ ID NO: 3836972 - RNA, 19 nt, Shigella flexneri 2a str. 2457T
cucaacuucgcuaaaucug

SEQ ID NO: 3836973 - RNA, 14 nt, Shigella flexneri 2a str. 2457T
cucaacuuuaccuu

SEQ ID NO: 3836974 - RNA, 16 nt, Shigella flexneri 2a str. 2457T
cucaacuuuaccuuca

SEQ ID NO: 3836975 - RNA, 15 nt, Shigella flexneri 2a str. 2457T
cucaagaaugaccgc

SEQ ID NO: 3836976 - RNA, 14 nt, Shigella flexneri 2a str. 2457T
cucaagacaauuag

SEQ ID NO: 3836977 - RNA, 16 nt, Shigella flexneri 2a str. 2457T
cucaagcacccgccgc

SEQ ID NO: 3836978 - RNA, 22 nt, Shigella flexneri 2a str. 2457T
cucaagcaguugguuaaucuuu

SEQ ID NO: 3836979 - RNA, 21 nt, Shigella flexneri 2a str. 2457T
cucaagcucguugguuccacg

SEQ ID NO: 3836980 - RNA, 24 nt, Shigella flexneri 2a str. 2457T
cucaagcucguugguuccacggca

SEQ ID NO: 3836981 - RNA, 14 nt, Shigella flexneri 2a str. 2457T
cucaaguugcgaaa

SEQ ID NO: 3836982 - RNA, 21 nt, Shigella flexneri 2a str. 2457T
cucaaguugcgaaagcgagca

SEQ ID NO: 3836983 - RNA, 13 nt, Shigella flexneri 2a str. 2457T
cucaauaaucaau

SEQ ID NO: 3836984 - RNA, 15 nt, Shigella flexneri 2a str. 2457T
cucaauacaacccac

SEQ ID NO: 3836985 - RNA, 17 nt, Shigella flexneri 2a str. 2457T
cucaauaucaucauuug

SEQ ID NO: 3836986 - RNA, 15 nt, Shigella flexneri 2a str. 2457T
cucaauauccugacc

SEQ ID NO: 3836987 - RNA, 17 nt, Shigella flexneri 2a str. 2457T
cucaauauuagcauuaa

SEQ ID NO: 3836988 - RNA, 13 nt, Shigella flexneri 2a str. 2457T
cucaaucaaaaga

SEQ ID NO: 3836989 - RNA, 14 nt, Shigella flexneri 2a str. 2457T
cucaaucccuuucu

SEQ ID NO: 3836990 - RNA, 19 nt, Shigella flexneri 2a str. 2457T
cucaaucccuuucucuuca

SEQ ID NO: 3836991 - RNA, 22 nt, Shigella flexneri 2a str. 2457T
cucaaucgagauacgacugaua

SEQ ID NO: 3836992 - RNA, 14 nt, Shigella flexneri 2a str. 2457T
cucaaucgccacca

SEQ ID NO: 3836993 - RNA, 19 nt, Shigella flexneri 2a str. 2457T
cucaaucguaugaucaucc

SEQ ID NO: 3836994 - RNA, 17 nt, Shigella flexneri 2a str. 2457T
cucaaucucuuuuucca

SEQ ID NO: 3836995 - RNA, 22 nt, Shigella flexneri 2a str. 2457T
cucaaucucuuuuuccaccgca

SEQ ID NO: 3836996 - RNA, 13 nt, Shigella flexneri 2a str. 2457T
cucaaucuucacg

SEQ ID NO: 3836997 - RNA, 21 nt, Shigella flexneri 2a str. 2457T
cucaaucuucacgucuuucgg

SEQ ID NO: 3836998 - RNA, 14 nt, Shigella flexneri 2a str. 2457T
cucaaugccugaug

SEQ ID NO: 3836999 - RNA, 23 nt, Shigella flexneri 2a str. 2457T
cucaaugcggcggcgcaccggcc

SEQ ID NO: 3837000 - RNA, 15 nt, Shigella flexneri 2a str. 2457T
cucaauggauuuacc

SEQ ID NO: 3837001 - RNA, 14 nt, Shigella flexneri 2a str. 2457T
cucaauggcauccg

SEQ ID NO: 3837002 - RNA, 19 nt, Shigella flexneri 2a str. 2457T
cucaaugguguuuuccacc

SEQ ID NO: 3837003 - RNA, 11 nt, Shigella flexneri 2a str. 2457T
cucaauuacca

SEQ ID NO: 3837004 - RNA, 20 nt, Shigella flexneri 2a str. 2457T
cucaauuaccacaaguaaaa

SEQ ID NO: 3837005 - RNA, 22 nt, Shigella flexneri 2a str. 2457T
cucaauugacaguuuauuuucu

SEQ ID NO: 3837006 - RNA, 17 nt, Shigella flexneri 2a str. 2457T
cucacaaccccggcaaa

SEQ ID NO: 3837007 - RNA, 18 nt, Shigella flexneri 2a str. 2457T
cucacacuuaucuggagu

SEQ ID NO: 3837008 - RNA, 19 nt, Shigella flexneri 2a str. 2457T
cucacagaguauuuccagc

SEQ ID NO: 3837009 - RNA, 23 nt, Shigella flexneri 2a str. 2457T
cucacagaguauuuccagcucaa

SEQ ID NO: 3837010 - RNA, 21 nt, Shigella flexneri 2a str. 2457T
cucacaucaugcgucaccaac

SEQ ID NO: 3837011 - RNA, 19 nt, Shigella flexneri 2a str. 2457T
cucacaugaguugcuggac

SEQ ID NO: 3837012 - RNA, 20 nt, Shigella flexneri 2a str. 2457T
cucacaugaguugcuggacg

SEQ ID NO: 3837013 - RNA, 20 nt, Shigella flexneri 2a str. 2457T
cucaccacgcuccaucaugu

SEQ ID NO: 3837014 - RNA, 13 nt, Shigella flexneri 2a str. 2457T
cucaccagccgcg

SEQ ID NO: 3837015 - RNA, 13 nt, Shigella flexneri 2a str. 2457T
cucaccaucaagu

SEQ ID NO: 3837016 - RNA, 16 nt, Shigella flexneri 2a str. 2457T
cucacccgcuucauaa

SEQ ID NO: 3837017 - RNA, 21 nt, Shigella flexneri 2a str. 2457T
cucacccggaggaaagcaccu

SEQ ID NO: 3837018 - RNA, 19 nt, Shigella flexneri 2a str. 2457T
cucacccuaacccucuccc

SEQ ID NO: 3837019 - RNA, 13 nt, Shigella flexneri 2a str. 2457T
cucaccgccagca

SEQ ID NO: 3837020 - RNA, 13 nt, Shigella flexneri 2a str. 2457T
cucaccgccgccu

SEQ ID NO: 3837021 - RNA, 20 nt, Shigella flexneri 2a str. 2457T
cucaccugauacgcgccaau

SEQ ID NO: 3837022 - RNA, 14 nt, Shigella flexneri 2a str. 2457T
cucacgcauccucu

SEQ ID NO: 3837023 - RNA, 19 nt, Shigella flexneri 2a str. 2457T
cucacgcgcugccucucuu

SEQ ID NO: 3837024 - RNA, 13 nt, Shigella flexneri 2a str. 2457T
cucacguuccaga

SEQ ID NO: 3837025 - RNA, 22 nt, Shigella flexneri 2a str. 2457T
cucacuaauugcaaacagagcg

SEQ ID NO: 3837026 - RNA, 13 nt, Shigella flexneri 2a str. 2457T
cucacuaucgcug

SEQ ID NO: 3837027 - RNA, 15 nt, Shigella flexneri 2a str. 2457T
cucacuaucgcugag

SEQ ID NO: 3837028 - RNA, 20 nt, Shigella flexneri 2a str. 2457T
cucacucaucacuccccgca

SEQ ID NO: 3837029 - RNA, 18 nt, Shigella flexneri 2a str. 2457T
cucacuccagccagagcc

SEQ ID NO: 3837030 - RNA, 17 nt, Shigella flexneri 2a str. 2457T
cucacuccggccagagc

SEQ ID NO: 3837031 - RNA, 14 nt, Shigella flexneri 2a str. 2457T
cucacuguucacuu

SEQ ID NO: 3837032 - RNA, 16 nt, Shigella flexneri 2a str. 2457T
cucacuguucacuuuu

SEQ ID NO: 3837033 - RNA, 21 nt, Shigella flexneri 2a str. 2457T
cucacuguucacuuuugcugc

SEQ ID NO: 3837034 - RNA, 16 nt, Shigella flexneri 2a str. 2457T
cucacuguugaguaag

SEQ ID NO: 3837035 - RNA, 13 nt, Shigella flexneri 2a str. 2457T
cucacuuccuuuu

SEQ ID NO: 3837036 - RNA, 15 nt, Shigella flexneri 2a str. 2457T
cucacuuucuggcag

SEQ ID NO: 3837037 - RNA, 14 nt, Shigella flexneri 2a str. 2457T
cucagaaaggggga

SEQ ID NO: 3837038 - RNA, 17 nt, Shigella flexneri 2a str. 2457T
cucagaagacgcuccag

SEQ ID NO: 3837039 - RNA, 16 nt, Shigella flexneri 2a str. 2457T
cucagaaucacgccaa

SEQ ID NO: 3837040 - RNA, 17 nt, Shigella flexneri 2a str. 2457T
cucagaaucacgccaac

SEQ ID NO: 3837041 - RNA, 21 nt, Shigella flexneri 2a str. 2457T
cucagcaaauagauaaaauau

SEQ ID NO: 3837042 - RNA, 17 nt, Shigella flexneri 2a str. 2457T
cucagcaagugaauaaa

SEQ ID NO: 3837043 - RNA, 16 nt, Shigella flexneri 2a str. 2457T
cucagcacaccauaaa

SEQ ID NO: 3837044 - RNA, 19 nt, Shigella flexneri 2a str. 2457T
cucagccaaauccagcgca

SEQ ID NO: 3837045 - RNA, 14 nt, Shigella flexneri 2a str. 2457T
cucagccagcuggc

SEQ ID NO: 3837046 - RNA, 15 nt, Shigella flexneri 2a str. 2457T
cucagccagcuggca

SEQ ID NO: 3837047 - RNA, 15 nt, Shigella flexneri 2a str. 2457T
cucagcgccugcugc

SEQ ID NO: 3837048 - RNA, 16 nt, Shigella flexneri 2a str. 2457T
cucagcgccugcugca

SEQ ID NO: 3837049 - RNA, 18 nt, Shigella flexneri 2a str. 2457T
cucagcucauuaaaaaua

SEQ ID NO: 3837050 - RNA, 13 nt, Shigella flexneri 2a str. 2457T
cucaggaauagcg

SEQ ID NO: 3837051 - RNA, 23 nt, Shigella flexneri 2a str. 2457T
cucaggaauagcggcaagcccag

SEQ ID NO: 3837052 - RNA, 15 nt, Shigella flexneri 2a str. 2457T
cucaggcacuucuuc

SEQ ID NO: 3837053 - RNA, 18 nt, Shigella flexneri 2a str. 2457T
cucaggcaguacgcggcg

SEQ ID NO: 3837054 - RNA, 16 nt, Shigella flexneri 2a str. 2457T
cucaggccuacaaaau

SEQ ID NO: 3837055 - RNA, 19 nt, Shigella flexneri 2a str. 2457T
cucaggccuacaaaaucuu

SEQ ID NO: 3837056 - RNA, 22 nt, Shigella flexneri 2a str. 2457T
cucaggccuacaaaaucuugca

SEQ ID NO: 3837057 - RNA, 15 nt, Shigella flexneri 2a str. 2457T
cucaggcgcacgccg

SEQ ID NO: 3837058 - RNA, 13 nt, Shigella flexneri 2a str. 2457T
cucagguucaacc

SEQ ID NO: 3837059 - RNA, 13 nt, Shigella flexneri 2a str. 2457T
cucaguacaggcc

SEQ ID NO: 3837060 - RNA, 13 nt, Shigella flexneri 2a str. 2457T
cucagucgcccag

SEQ ID NO: 3837061 - RNA, 15 nt, Shigella flexneri 2a str. 2457T
cucagucggugcgau

SEQ ID NO: 3837062 - RNA, 17 nt, Shigella flexneri 2a str. 2457T
cucagugaccgaaccug

SEQ ID NO: 3837063 - RNA, 15 nt, Shigella flexneri 2a str. 2457T
cucaguuaacggcau

SEQ ID NO: 3837064 - RNA, 14 nt, Shigella flexneri 2a str. 2457T
cucaguuaaucgcg

SEQ ID NO: 3837065 - RNA, 19 nt, Shigella flexneri 2a str. 2457T
cucaguugguuagagcaca

SEQ ID NO: 3837066 - RNA, 23 nt, Shigella flexneri 2a str. 2457T
cucaguuuauagaacggcagaga

SEQ ID NO: 3837067 - RNA, 18 nt, Shigella flexneri 2a str. 2457T
cucauaaauucaaagugu

SEQ ID NO: 3837068 - RNA, 20 nt, Shigella flexneri 2a str. 2457T
cucauaauacaggcuacucc

SEQ ID NO: 3837069 - RNA, 19 nt, Shigella flexneri 2a str. 2457T
cucauagggugugacgaca

SEQ ID NO: 3837070 - RNA, 14 nt, Shigella flexneri 2a str. 2457T
cucauaugcagcau

SEQ ID NO: 3837071 - RNA, 15 nt, Shigella flexneri 2a str. 2457T
cucaucaacguuuuu

SEQ ID NO: 3837072 - RNA, 21 nt, Shigella flexneri 2a str. 2457T
cucaucaccacagacaaacag

SEQ ID NO: 3837073 - RNA, 12 nt, Shigella flexneri 2a str. 2457T
cucaucaccauu

SEQ ID NO: 3837074 - RNA, 15 nt, Shigella flexneri 2a str. 2457T
cucaucagcccggca

SEQ ID NO: 3837075 - RNA, 19 nt, Shigella flexneri 2a str. 2457T
cucaucagcgguaaaacgc

SEQ ID NO: 3837076 - RNA, 22 nt, Shigella flexneri 2a str. 2457T
cucaucaggccuggacucuuau

SEQ ID NO: 3837077 - RNA, 18 nt, Shigella flexneri 2a str. 2457T
cucaucagugaacccaua

SEQ ID NO: 3837078 - RNA, 18 nt, Shigella flexneri 2a str. 2457T
cucauccauaaauaccug

SEQ ID NO: 3837079 - RNA, 14 nt, Shigella flexneri 2a str. 2457T
cucauccaucaaau

SEQ ID NO: 3837080 - RNA, 19 nt, Shigella flexneri 2a str. 2457T
cucaucgccuuccagcgau

SEQ ID NO: 3837081 - RNA, 15 nt, Shigella flexneri 2a str. 2457T
cucaucgcugcgcuc

SEQ ID NO: 3837082 - RNA, 19 nt, Shigella flexneri 2a str. 2457T
cucaucggcauacagcgac

SEQ ID NO: 3837083 - RNA, 18 nt, Shigella flexneri 2a str. 2457T
cucaucguaugauuaauu

SEQ ID NO: 3837084 - RNA, 21 nt, Shigella flexneri 2a str. 2457T
cucaucguugcgaucgaccug

SEQ ID NO: 3837085 - RNA, 16 nt, Shigella flexneri 2a str. 2457T
cucaucuggcguacca

SEQ ID NO: 3837086 - RNA, 17 nt, Shigella flexneri 2a str. 2457T
cucaucuuugaaaucac

SEQ ID NO: 3837087 - RNA, 20 nt, Shigella flexneri 2a str. 2457T
cucaucuuugaaaucacgca

SEQ ID NO: 3837088 - RNA, 20 nt, Shigella flexneri 2a str. 2457T
cucaugggaccgcuaccacg

SEQ ID NO: 3837089 - RNA, 17 nt, Shigella flexneri 2a str. 2457T
cucaugggucugcggau

SEQ ID NO: 3837090 - RNA, 20 nt, Shigella flexneri 2a str. 2457T
cucauguagccgcuuuuucu

SEQ ID NO: 3837091 - RNA, 14 nt, Shigella flexneri 2a str. 2457T
cucauuaaaaauau

SEQ ID NO: 3837092 - RNA, 14 nt, Shigella flexneri 2a str. 2457T
cucauucaccaguu

SEQ ID NO: 3837093 - RNA, 23 nt, Shigella flexneri 2a str. 2457T
cucauugcuauuuccaccucccc

SEQ ID NO: 3837094 - RNA, 15 nt, Shigella flexneri 2a str. 2457T
cucauuguuagaugu

SEQ ID NO: 3837095 - RNA, 13 nt, Shigella flexneri 2a str. 2457T
cucauuuaaaauc

SEQ ID NO: 3837096 - RNA, 20 nt, Shigella flexneri 2a str. 2457T
cucauuuaaaaucgccccuc

SEQ ID NO: 3837097 - RNA, 14 nt, Shigella flexneri 2a str. 2457T
cucauuuacagaaa

SEQ ID NO: 3837098 - RNA, 18 nt, Shigella flexneri 2a str. 2457T
cucauuugauugccggau

SEQ ID NO: 3837099 - RNA, 14 nt, Shigella flexneri 2a str. 2457T
cucauuugcagaaa

SEQ ID NO: 3837100 - RNA, 23 nt, Shigella flexneri 2a str. 2457T
cucauuuuucagcguuccccaga

SEQ ID NO: 3837101 - RNA, 15 nt, Shigella flexneri 2a str. 2457T
cuccaacacaucgau

SEQ ID NO: 3837102 - RNA, 14 nt, Shigella flexneri 2a str. 2457T
cuccaacuuacuga

SEQ ID NO: 3837103 - RNA, 22 nt, Shigella flexneri 2a str. 2457T
cuccaaggucuccgcccagcgu

SEQ ID NO: 3837104 - RNA, 22 nt, Shigella flexneri 2a str. 2457T
cuccacacggaguaaugccagu

SEQ ID NO: 3837105 - RNA, 16 nt, Shigella flexneri 2a str. 2457T
cuccacagucaggcug

SEQ ID NO: 3837106 - RNA, 14 nt, Shigella flexneri 2a str. 2457T
cuccaccagcacca

SEQ ID NO: 3837107 - RNA, 14 nt, Shigella flexneri 2a str. 2457T
cuccaccgggcgca

SEQ ID NO: 3837108 - RNA, 17 nt, Shigella flexneri 2a str. 2457T
cuccaccuugcggaaac

SEQ ID NO: 3837109 - RNA, 19 nt, Shigella flexneri 2a str. 2457T
cuccacgauguucugagcg

SEQ ID NO: 3837110 - RNA, 20 nt, Shigella flexneri 2a str. 2457T
cuccacgauguucugagcga

SEQ ID NO: 3837111 - RNA, 22 nt, Shigella flexneri 2a str. 2457T
cuccacgauguucugagcgaag

SEQ ID NO: 3837112 - RNA, 11 nt, Shigella flexneri 2a str. 2457T
cuccacuuccu

SEQ ID NO: 3837113 - RNA, 13 nt, Shigella flexneri 2a str. 2457T
cuccacuuccugc

SEQ ID NO: 3837114 - RNA, 14 nt, Shigella flexneri 2a str. 2457T
cuccacuuccugcc

SEQ ID NO: 3837115 - RNA, 13 nt, Shigella flexneri 2a str. 2457T
cuccacuuuuaca

SEQ ID NO: 3837116 - RNA, 20 nt, Shigella flexneri 2a str. 2457T
cuccagacgccagaugcggc

SEQ ID NO: 3837117 - RNA, 23 nt, Shigella flexneri 2a str. 2457T
cuccagauccauaagguccucca

SEQ ID NO: 3837118 - RNA, 19 nt, Shigella flexneri 2a str. 2457T
cuccagauuaccagcgaca

SEQ ID NO: 3837119 - RNA, 23 nt, Shigella flexneri 2a str. 2457T
cuccagauuaccagcgacaucac

SEQ ID NO: 3837120 - RNA, 17 nt, Shigella flexneri 2a str. 2457T
cuccagcaauaacauua

SEQ ID NO: 3837121 - RNA, 12 nt, Shigella flexneri 2a str. 2457T
cuccagcaaugu

SEQ ID NO: 3837122 - RNA, 14 nt, Shigella flexneri 2a str. 2457T
cuccagcagugccg

SEQ ID NO: 3837123 - RNA, 16 nt, Shigella flexneri 2a str. 2457T
cuccagcagugccgca

SEQ ID NO: 3837124 - RNA, 15 nt, Shigella flexneri 2a str. 2457T
cuccagcccgcgucg

SEQ ID NO: 3837125 - RNA, 13 nt, Shigella flexneri 2a str. 2457T
cuccagcgccgcc

SEQ ID NO: 3837126 - RNA, 14 nt, Shigella flexneri 2a str. 2457T
cuccagcgccgcca

SEQ ID NO: 3837127 - RNA, 16 nt, Shigella flexneri 2a str. 2457T
cuccagcgccgccaga

SEQ ID NO: 3837128 - RNA, 20 nt, Shigella flexneri 2a str. 2457T
cuccagcgccgccagaauca

SEQ ID NO: 3837129 - RNA, 22 nt, Shigella flexneri 2a str. 2457T
cuccagcgcgucugcgcccagc

SEQ ID NO: 3837130 - RNA, 13 nt, Shigella flexneri 2a str. 2457T
cuccagcuauaac

SEQ ID NO: 3837131 - RNA, 17 nt, Shigella flexneri 2a str. 2457T
cuccaggagcguauuca

SEQ ID NO: 3837132 - RNA, 23 nt, Shigella flexneri 2a str. 2457T
cuccaggaguuccgggucaucca

SEQ ID NO: 3837133 - RNA, 13 nt, Shigella flexneri 2a str. 2457T
cuccagguccucc

SEQ ID NO: 3837134 - RNA, 20 nt, Shigella flexneri 2a str. 2457T
cuccaguuuguucagcugcg

SEQ ID NO: 3837135 - RNA, 11 nt, Shigella flexneri 2a str. 2457T
cuccauccagc

SEQ ID NO: 3837136 - RNA, 17 nt, Shigella flexneri 2a str. 2457T
cuccauccccagcucuu

SEQ ID NO: 3837137 - RNA, 22 nt, Shigella flexneri 2a str. 2457T
cuccauccgggaucacaucaua

SEQ ID NO: 3837138 - RNA, 18 nt, Shigella flexneri 2a str. 2457T
cuccaucucgccauccuu

SEQ ID NO: 3837139 - RNA, 15 nt, Shigella flexneri 2a str. 2457T
cuccauuaccuggau

SEQ ID NO: 3837140 - RNA, 19 nt, Shigella flexneri 2a str. 2457T
cucccacggaauagaaccu

SEQ ID NO: 3837141 - RNA, 15 nt, Shigella flexneri 2a str. 2457T
cucccagccucccau

SEQ ID NO: 3837142 - RNA, 19 nt, Shigella flexneri 2a str. 2457T
cucccaguagugcuuucag

SEQ ID NO: 3837143 - RNA, 22 nt, Shigella flexneri 2a str. 2457T
cuccccaaaauccccuggccug

SEQ ID NO: 3837144 - RNA, 14 nt, Shigella flexneri 2a str. 2457T
cuccccagaaucca

SEQ ID NO: 3837145 - RNA, 12 nt, Shigella flexneri 2a str. 2457T
cucccccagcau

SEQ ID NO: 3837146 - RNA, 13 nt, Shigella flexneri 2a str. 2457T
cucccgaaaaacc

SEQ ID NO: 3837147 - RNA, 18 nt, Shigella flexneri 2a str. 2457T
cucccgaaugaccgcccc

SEQ ID NO: 3837148 - RNA, 17 nt, Shigella flexneri 2a str. 2457T
cucccgcaggagcgccg

SEQ ID NO: 3837149 - RNA, 22 nt, Shigella flexneri 2a str. 2457T
cucccgcauacauugcguaacc

SEQ ID NO: 3837150 - RNA, 12 nt, Shigella flexneri 2a str. 2457T
cucccgccagcg

SEQ ID NO: 3837151 - RNA, 17 nt, Shigella flexneri 2a str. 2457T
cucccggauaucccagc

SEQ ID NO: 3837152 - RNA, 16 nt, Shigella flexneri 2a str. 2457T
cucccggcaaugcgcc

SEQ ID NO: 3837153 - RNA, 18 nt, Shigella flexneri 2a str. 2457T
cucccguucauucaacuu

SEQ ID NO: 3837154 - RNA, 16 nt, Shigella flexneri 2a str. 2457T
cucccguuucccuguc

SEQ ID NO: 3837155 - RNA, 15 nt, Shigella flexneri 2a str. 2457T
cucccugccccaucu

SEQ ID NO: 3837156 - RNA, 12 nt, Shigella flexneri 2a str. 2457T
cucccuucgcug

SEQ ID NO: 3837157 - RNA, 13 nt, Shigella flexneri 2a str. 2457T
cuccgaccagaag

SEQ ID NO: 3837158 - RNA, 14 nt, Shigella flexneri 2a str. 2457T
cuccgaucccugcg

SEQ ID NO: 3837159 - RNA, 10 nt, Shigella flexneri 2a str. 2457T
cuccgcaaug

SEQ ID NO: 3837160 - RNA, 11 nt, Shigella flexneri 2a str. 2457T
cuccgccagca

SEQ ID NO: 3837161 - RNA, 21 nt, Shigella flexneri 2a str. 2457T
cuccgccucgguaagcaaagc

SEQ ID NO: 3837162 - RNA, 18 nt, Shigella flexneri 2a str. 2457T
cuccgccugugcgcguca

SEQ ID NO: 3837163 - RNA, 17 nt, Shigella flexneri 2a str. 2457T
cuccgccuuugaaaaua

SEQ ID NO: 3837164 - RNA, 19 nt, Shigella flexneri 2a str. 2457T
cuccgcucucaaucucuuu

SEQ ID NO: 3837165 - RNA, 18 nt, Shigella flexneri 2a str. 2457T
cuccgcugagacgcgcuu

SEQ ID NO: 3837166 - RNA, 23 nt, Shigella flexneri 2a str. 2457T
cuccggaaauuuggggccguccc

SEQ ID NO: 3837167 - RNA, 21 nt, Shigella flexneri 2a str. 2457T
cuccgggaaaacgcuggcagc

SEQ ID NO: 3837168 - RNA, 16 nt, Shigella flexneri 2a str. 2457T
cuccgggcgcaccagu

SEQ ID NO: 3837169 - RNA, 14 nt, Shigella flexneri 2a str. 2457T
cuccgucagcacgc

SEQ ID NO: 3837170 - RNA, 11 nt, Shigella flexneri 2a str. 2457T
cuccguucccc

SEQ ID NO: 3837171 - RNA, 20 nt, Shigella flexneri 2a str. 2457T
cuccuaucaccagcgguggu

SEQ ID NO: 3837172 - RNA, 18 nt, Shigella flexneri 2a str. 2457T
cuccucgcgaaucuccac

SEQ ID NO: 3837173 - RNA, 14 nt, Shigella flexneri 2a str. 2457T
cuccucuucacguu

SEQ ID NO: 3837174 - RNA, 14 nt, Shigella flexneri 2a str. 2457T
cuccugaaacaauu

SEQ ID NO: 3837175 - RNA, 17 nt, Shigella flexneri 2a str. 2457T
cuccugaacuuucuccc

SEQ ID NO: 3837176 - RNA, 24 nt, Shigella flexneri 2a str. 2457T
cuccugagaauuccgacagagaaa

SEQ ID NO: 3837177 - RNA, 15 nt, Shigella flexneri 2a str. 2457T
cuccugauaacacag

SEQ ID NO: 3837178 - RNA, 16 nt, Shigella flexneri 2a str. 2457T
cuccugauaacacaga

SEQ ID NO: 3837179 - RNA, 21 nt, Shigella flexneri 2a str. 2457T
cuccugccaccacugcaauga

SEQ ID NO: 3837180 - RNA, 16 nt, Shigella flexneri 2a str. 2457T
cuccugcccuugccaa

SEQ ID NO: 3837181 - RNA, 20 nt, Shigella flexneri 2a str. 2457T
cuccugcgccucuccacacg

SEQ ID NO: 3837182 - RNA, 13 nt, Shigella flexneri 2a str. 2457T
cuccugcucauca

SEQ ID NO: 3837183 - RNA, 20 nt, Shigella flexneri 2a str. 2457T
cuccuggccgcaguacuggg

SEQ ID NO: 3837184 - RNA, 18 nt, Shigella flexneri 2a str. 2457T
cuccuggcgguuaauaau

SEQ ID NO: 3837185 - RNA, 20 nt, Shigella flexneri 2a str. 2457T
cuccuguaccuucacgcgcu

SEQ ID NO: 3837186 - RNA, 22 nt, Shigella flexneri 2a str. 2457T
cuccuguaucgucacugguuca

SEQ ID NO: 3837187 - RNA, 13 nt, Shigella flexneri 2a str. 2457T
cuccugucuuccc

SEQ ID NO: 3837188 - RNA, 14 nt, Shigella flexneri 2a str. 2457T
cuccugucuucccu

SEQ ID NO: 3837189 - RNA, 17 nt, Shigella flexneri 2a str. 2457T
cuccuguuaugccucaa

SEQ ID NO: 3837190 - RNA, 20 nt, Shigella flexneri 2a str. 2457T
cuccuguuuaauaugcaauu

SEQ ID NO: 3837191 - RNA, 14 nt, Shigella flexneri 2a str. 2457T
cuccuucacucuau

SEQ ID NO: 3837192 - RNA, 13 nt, Shigella flexneri 2a str. 2457T
cuccuuucggcca

SEQ ID NO: 3837193 - RNA, 19 nt, Shigella flexneri 2a str. 2457T
cuccuuucugagcaucaca

SEQ ID NO: 3837194 - RNA, 16 nt, Shigella flexneri 2a str. 2457T
cucgaacgccucugca

SEQ ID NO: 3837195 - RNA, 15 nt, Shigella flexneri 2a str. 2457T
cucgaaguuuuccuc

SEQ ID NO: 3837196 - RNA, 15 nt, Shigella flexneri 2a str. 2457T
cucgacaccaaacag

SEQ ID NO: 3837197 - RNA, 12 nt, Shigella flexneri 2a str. 2457T
cucgacgucaca

SEQ ID NO: 3837198 - RNA, 23 nt, Shigella flexneri 2a str. 2457T
cucgacuuuagucgcuugcagga

SEQ ID NO: 3837199 - RNA, 15 nt, Shigella flexneri 2a str. 2457T
cucgagaaauuuuua

SEQ ID NO: 3837200 - RNA, 21 nt, Shigella flexneri 2a str. 2457T
cucgaggagcuggaggaccuu

SEQ ID NO: 3837201 - RNA, 14 nt, Shigella flexneri 2a str. 2457T
cucgaguccuucca

SEQ ID NO: 3837202 - RNA, 17 nt, Shigella flexneri 2a str. 2457T
cucgaguccuuccaggu

SEQ ID NO: 3837203 - RNA, 13 nt, Shigella flexneri 2a str. 2457T
cucgauaaaaccu

SEQ ID NO: 3837204 - RNA, 17 nt, Shigella flexneri 2a str. 2457T
cucgauaaaaccuuccu

SEQ ID NO: 3837205 - RNA, 22 nt, Shigella flexneri 2a str. 2457T
cucgauacgacacgccuccugg

SEQ ID NO: 3837206 - RNA, 24 nt, Shigella flexneri 2a str. 2457T
cucgauacgacacgccuccuggcu

SEQ ID NO: 3837207 - RNA, 21 nt, Shigella flexneri 2a str. 2457T
cucgaucggcucuuccgcgaa

SEQ ID NO: 3837208 - RNA, 21 nt, Shigella flexneri 2a str. 2457T
cucgauguuguacaugcugcu

SEQ ID NO: 3837209 - RNA, 16 nt, Shigella flexneri 2a str. 2457T
cucgcaagccacgccg

SEQ ID NO: 3837210 - RNA, 16 nt, Shigella flexneri 2a str. 2457T
cucgcaucagggcgcu

SEQ ID NO: 3837211 - RNA, 14 nt, Shigella flexneri 2a str. 2457T
cucgcauccucuuu

SEQ ID NO: 3837212 - RNA, 14 nt, Shigella flexneri 2a str. 2457T
cucgccauccagug

SEQ ID NO: 3837213 - RNA, 15 nt, Shigella flexneri 2a str. 2457T
cucgcccagcagacg

SEQ ID NO: 3837214 - RNA, 23 nt, Shigella flexneri 2a str. 2457T
cucgcccauuuuucaugaucuuu

SEQ ID NO: 3837215 - RNA, 18 nt, Shigella flexneri 2a str. 2457T
cucgcccccgaagagggg

SEQ ID NO: 3837216 - RNA, 20 nt, Shigella flexneri 2a str. 2457T
cucgcccccuuggggagagg

SEQ ID NO: 3837217 - RNA, 19 nt, Shigella flexneri 2a str. 2457T
cucgccccgagaaaaauag

SEQ ID NO: 3837218 - RNA, 16 nt, Shigella flexneri 2a str. 2457T
cucgccccgugaugaa

SEQ ID NO: 3837219 - RNA, 14 nt, Shigella flexneri 2a str. 2457T
cucgccccuccggg

SEQ ID NO: 3837220 - RNA, 19 nt, Shigella flexneri 2a str. 2457T
cucgccggaugaaaaguca

SEQ ID NO: 3837221 - RNA, 15 nt, Shigella flexneri 2a str. 2457T
cucgcgaaccgccug

SEQ ID NO: 3837222 - RNA, 17 nt, Shigella flexneri 2a str. 2457T
cucgcgaaccgccuggc

SEQ ID NO: 3837223 - RNA, 21 nt, Shigella flexneri 2a str. 2457T
cucgcgacccaugaacaaaau

SEQ ID NO: 3837224 - RNA, 15 nt, Shigella flexneri 2a str. 2457T
cucgcgagaacggcg

SEQ ID NO: 3837225 - RNA, 13 nt, Shigella flexneri 2a str. 2457T
cucgcgcucuucu

SEQ ID NO: 3837226 - RNA, 18 nt, Shigella flexneri 2a str. 2457T
cucgcgcuugcggaagca

SEQ ID NO: 3837227 - RNA, 15 nt, Shigella flexneri 2a str. 2457T
cucgcggacugccug

SEQ ID NO: 3837228 - RNA, 17 nt, Shigella flexneri 2a str. 2457T
cucgcggacugccuggc

SEQ ID NO: 3837229 - RNA, 23 nt, Shigella flexneri 2a str. 2457T
cucgcguuacuaccggcgugcgu

SEQ ID NO: 3837230 - RNA, 21 nt, Shigella flexneri 2a str. 2457T
cucgcguucgauggcgcgcca

SEQ ID NO: 3837231 - RNA, 19 nt, Shigella flexneri 2a str. 2457T
cucgcuccauuccaucgcc

SEQ ID NO: 3837232 - RNA, 19 nt, Shigella flexneri 2a str. 2457T
cucgcucgagagagaaaau

SEQ ID NO: 3837233 - RNA, 20 nt, Shigella flexneri 2a str. 2457T
cucgcucuuguucuuccggc

SEQ ID NO: 3837234 - RNA, 13 nt, Shigella flexneri 2a str. 2457T
cucgcugccagca

SEQ ID NO: 3837235 - RNA, 14 nt, Shigella flexneri 2a str. 2457T
cucgcugccagcac

SEQ ID NO: 3837236 - RNA, 19 nt, Shigella flexneri 2a str. 2457T
cucgcuuaagccaucauca

SEQ ID NO: 3837237 - RNA, 18 nt, Shigella flexneri 2a str. 2457T
cucggauaaggcuucccg

SEQ ID NO: 3837238 - RNA, 13 nt, Shigella flexneri 2a str. 2457T
cucggcaaauuca

SEQ ID NO: 3837239 - RNA, 16 nt, Shigella flexneri 2a str. 2457T
cucggcaaucuguuau

SEQ ID NO: 3837240 - RNA, 13 nt, Shigella flexneri 2a str. 2457T
cucggcagaugag

SEQ ID NO: 3837241 - RNA, 15 nt, Shigella flexneri 2a str. 2457T
cucggcagaugagac

SEQ ID NO: 3837242 - RNA, 14 nt, Shigella flexneri 2a str. 2457T
cucggcuauuuccg

SEQ ID NO: 3837243 - RNA, 17 nt, Shigella flexneri 2a str. 2457T
cucggcuuugguaucga

SEQ ID NO: 3837244 - RNA, 14 nt, Shigella flexneri 2a str. 2457T
cucggggccacagg

SEQ ID NO: 3837245 - RNA, 18 nt, Shigella flexneri 2a str. 2457T
cucgguaaaacuaacgcc

SEQ ID NO: 3837246 - RNA, 19 nt, Shigella flexneri 2a str. 2457T
cucggucacugacaccagc

SEQ ID NO: 3837247 - RNA, 19 nt, Shigella flexneri 2a str. 2457T
cucggucuggacagacugg

SEQ ID NO: 3837248 - RNA, 22 nt, Shigella flexneri 2a str. 2457T
cucgguuuugcgguauuuguau

SEQ ID NO: 3837249 - RNA, 14 nt, Shigella flexneri 2a str. 2457T
cucguaaugcuccg

SEQ ID NO: 3837250 - RNA, 16 nt, Shigella flexneri 2a str. 2457T
cucguacuccaucucg

SEQ ID NO: 3837251 - RNA, 23 nt, Shigella flexneri 2a str. 2457T
cucguacuccaucucgccauccu

SEQ ID NO: 3837252 - RNA, 21 nt, Shigella flexneri 2a str. 2457T
cucguagguuucugccagcgu

SEQ ID NO: 3837253 - RNA, 17 nt, Shigella flexneri 2a str. 2457T
cucguaucaccccgccc

SEQ ID NO: 3837254 - RNA, 23 nt, Shigella flexneri 2a str. 2457T
cucguauuccgcguuacccauuc

SEQ ID NO: 3837255 - RNA, 21 nt, Shigella flexneri 2a str. 2457T
cucgucagcauuacccagaua

SEQ ID NO: 3837256 - RNA, 15 nt, Shigella flexneri 2a str. 2457T
cucgucagcuuauuc

SEQ ID NO: 3837257 - RNA, 14 nt, Shigella flexneri 2a str. 2457T
cucgucgaacucau

SEQ ID NO: 3837258 - RNA, 21 nt, Shigella flexneri 2a str. 2457T
cucgucgguaauuucacaagu

SEQ ID NO: 3837259 - RNA, 12 nt, Shigella flexneri 2a str. 2457T
cucgucgguggu

SEQ ID NO: 3837260 - RNA, 21 nt, Shigella flexneri 2a str. 2457T
cucgugaagagauggaucaac

SEQ ID NO: 3837261 - RNA, 17 nt, Shigella flexneri 2a str. 2457T
cucgugauaguccagcc

SEQ ID NO: 3837262 - RNA, 14 nt, Shigella flexneri 2a str. 2457T
cucgugccaccagu

SEQ ID NO: 3837263 - RNA, 17 nt, Shigella flexneri 2a str. 2457T
cucgugccaccagugca

SEQ ID NO: 3837264 - RNA, 15 nt, Shigella flexneri 2a str. 2457T
cucgugggauugccg

SEQ ID NO: 3837265 - RNA, 18 nt, Shigella flexneri 2a str. 2457T
cucguuaccagcgccgcc

SEQ ID NO: 3837266 - RNA, 14 nt, Shigella flexneri 2a str. 2457T
cucguucacauauu

SEQ ID NO: 3837267 - RNA, 23 nt, Shigella flexneri 2a str. 2457T
cucguucacauauugcagcuucu

SEQ ID NO: 3837268 - RNA, 23 nt, Shigella flexneri 2a str. 2457T
cucguugaucacccacaucagcg

SEQ ID NO: 3837269 - RNA, 16 nt, Shigella flexneri 2a str. 2457T
cucguuggucaucacu

SEQ ID NO: 3837270 - RNA, 14 nt, Shigella flexneri 2a str. 2457T
cucguuuauuaugc

SEQ ID NO: 3837271 - RNA, 13 nt, Shigella flexneri 2a str. 2457T
cucuaaaaucauc

SEQ ID NO: 3837272 - RNA, 17 nt, Shigella flexneri 2a str. 2457T
cucuaacccguauaaau

SEQ ID NO: 3837273 - RNA, 18 nt, Shigella flexneri 2a str. 2457T
cucuaacccuuccagauu

SEQ ID NO: 3837274 - RNA, 20 nt, Shigella flexneri 2a str. 2457T
cucuaacccuuccagauuca

SEQ ID NO: 3837275 - RNA, 21 nt, Shigella flexneri 2a str. 2457T
cucuacaauauccucaagcgu

SEQ ID NO: 3837276 - RNA, 13 nt, Shigella flexneri 2a str. 2457T
cucuacaccaacg

SEQ ID NO: 3837277 - RNA, 14 nt, Shigella flexneri 2a str. 2457T
cucuacaggaaugg

SEQ ID NO: 3837278 - RNA, 14 nt, Shigella flexneri 2a str. 2457T
cucuacgguaucgu

SEQ ID NO: 3837279 - RNA, 22 nt, Shigella flexneri 2a str. 2457T
cucuaucuguuugccagucugg

SEQ ID NO: 3837280 - RNA, 17 nt, Shigella flexneri 2a str. 2457T
cucuauggcaccuguug

SEQ ID NO: 3837281 - RNA, 18 nt, Shigella flexneri 2a str. 2457T
cucucaaccgagagggcu

SEQ ID NO: 3837282 - RNA, 22 nt, Shigella flexneri 2a str. 2457T
cucucaaucucuuuuuccaccg

SEQ ID NO: 3837283 - RNA, 19 nt, Shigella flexneri 2a str. 2457T
cucucaccacgcuccauca

SEQ ID NO: 3837284 - RNA, 21 nt, Shigella flexneri 2a str. 2457T
cucucaccacgcuccaucaug

SEQ ID NO: 3837285 - RNA, 22 nt, Shigella flexneri 2a str. 2457T
cucucagagagaaccucaacag

SEQ ID NO: 3837286 - RNA, 23 nt, Shigella flexneri 2a str. 2457T
cucucagcacaccauaaaacaaa

SEQ ID NO: 3837287 - RNA, 19 nt, Shigella flexneri 2a str. 2457T
cucucagccagcuggcaga

SEQ ID NO: 3837288 - RNA, 15 nt, Shigella flexneri 2a str. 2457T
cucucagucuuuccc

SEQ ID NO: 3837289 - RNA, 15 nt, Shigella flexneri 2a str. 2457T
cucucaucaauaccu

SEQ ID NO: 3837290 - RNA, 21 nt, Shigella flexneri 2a str. 2457T
cucucaucuuugaaaucacgc

SEQ ID NO: 3837291 - RNA, 21 nt, Shigella flexneri 2a str. 2457T
cucucccgaaugaccgccccu

SEQ ID NO: 3837292 - RNA, 14 nt, Shigella flexneri 2a str. 2457T
cucuccguaggcca

SEQ ID NO: 3837293 - RNA, 22 nt, Shigella flexneri 2a str. 2457T
cucuccucgcgagaggcuuuuu

SEQ ID NO: 3837294 - RNA, 23 nt, Shigella flexneri 2a str. 2457T
cucuccuguuuaauaugcaauuc

SEQ ID NO: 3837295 - RNA, 11 nt, Shigella flexneri 2a str. 2457T
cucuccuuucg

SEQ ID NO: 3837296 - RNA, 14 nt, Shigella flexneri 2a str. 2457T
cucucgacccgaca

SEQ ID NO: 3837297 - RNA, 19 nt, Shigella flexneri 2a str. 2457T
cucucgggaaggcccuucc

SEQ ID NO: 3837298 - RNA, 17 nt, Shigella flexneri 2a str. 2457T
cucucgggcaguaaauc

SEQ ID NO: 3837299 - RNA, 21 nt, Shigella flexneri 2a str. 2457T
cucucgggcaguaaaucaaua

SEQ ID NO: 3837300 - RNA, 21 nt, Shigella flexneri 2a str. 2457T
cucucugaaguagccaguacc

SEQ ID NO: 3837301 - RNA, 23 nt, Shigella flexneri 2a str. 2457T
cucucugaaguagccaguaccac

SEQ ID NO: 3837302 - RNA, 16 nt, Shigella flexneri 2a str. 2457T
cucucuggccgcuucc

SEQ ID NO: 3837303 - RNA, 18 nt, Shigella flexneri 2a str. 2457T
cucucuucaaacgcuucu

SEQ ID NO: 3837304 - RNA, 13 nt, Shigella flexneri 2a str. 2457T
cucucuuccaguu

SEQ ID NO: 3837305 - RNA, 12 nt, Shigella flexneri 2a str. 2457T
cucucuucgcug

SEQ ID NO: 3837306 - RNA, 18 nt, Shigella flexneri 2a str. 2457T
cucucuuucuccagcgua

SEQ ID NO: 3837307 - RNA, 15 nt, Shigella flexneri 2a str. 2457T
cucugaaauucgcuu

SEQ ID NO: 3837308 - RNA, 20 nt, Shigella flexneri 2a str. 2457T
cucugacgcgcauacucucc

SEQ ID NO: 3837309 - RNA, 14 nt, Shigella flexneri 2a str. 2457T
cucugauugccuuc

SEQ ID NO: 3837310 - RNA, 22 nt, Shigella flexneri 2a str. 2457T
cucugauugccuuccaccagau

SEQ ID NO: 3837311 - RNA, 16 nt, Shigella flexneri 2a str. 2457T
cucugcaaauauuaau

SEQ ID NO: 3837312 - RNA, 17 nt, Shigella flexneri 2a str. 2457T
cucugcaaauauuaaua

SEQ ID NO: 3837313 - RNA, 21 nt, Shigella flexneri 2a str. 2457T
cucugccagacgguaaccccu

SEQ ID NO: 3837314 - RNA, 19 nt, Shigella flexneri 2a str. 2457T
cucugccagacuccaggcg

SEQ ID NO: 3837315 - RNA, 15 nt, Shigella flexneri 2a str. 2457T
cucugccgcaauggc

SEQ ID NO: 3837316 - RNA, 21 nt, Shigella flexneri 2a str. 2457T
cucugccguaccaucgccagc

SEQ ID NO: 3837317 - RNA, 15 nt, Shigella flexneri 2a str. 2457T
cucugcgcgugcagu

SEQ ID NO: 3837318 - RNA, 14 nt, Shigella flexneri 2a str. 2457T
cucugcgcuuugug

SEQ ID NO: 3837319 - RNA, 12 nt, Shigella flexneri 2a str. 2457T
cucugcggcaag

SEQ ID NO: 3837320 - RNA, 18 nt, Shigella flexneri 2a str. 2457T
cucugcgucauuccggag

SEQ ID NO: 3837321 - RNA, 20 nt, Shigella flexneri 2a str. 2457T
cucugcuggcggaacaucgc

SEQ ID NO: 3837322 - RNA, 23 nt, Shigella flexneri 2a str. 2457T
cucugcuguaguuguucaacagu

SEQ ID NO: 3837323 - RNA, 17 nt, Shigella flexneri 2a str. 2457T
cucuggauuuauauaaa

SEQ ID NO: 3837324 - RNA, 14 nt, Shigella flexneri 2a str. 2457T
cucuggcacaugca

SEQ ID NO: 3837325 - RNA, 13 nt, Shigella flexneri 2a str. 2457T
cucuggccgcuuc

SEQ ID NO: 3837326 - RNA, 23 nt, Shigella flexneri 2a str. 2457T
cucuggcggagcucccaggcucc

SEQ ID NO: 3837327 - RNA, 17 nt, Shigella flexneri 2a str. 2457T
cucugggcuaacacccg

SEQ ID NO: 3837328 - RNA, 20 nt, Shigella flexneri 2a str. 2457T
cucugguguggagugcagca

SEQ ID NO: 3837329 - RNA, 21 nt, Shigella flexneri 2a str. 2457T
cucugguguggagugcagcau

SEQ ID NO: 3837330 - RNA, 15 nt, Shigella flexneri 2a str. 2457T
cucugguguucuuuu

SEQ ID NO: 3837331 - RNA, 17 nt, Shigella flexneri 2a str. 2457T
cucugguuuuacaacgu

SEQ ID NO: 3837332 - RNA, 19 nt, Shigella flexneri 2a str. 2457T
cucuguaaacuccuuucug

SEQ ID NO: 3837333 - RNA, 19 nt, Shigella flexneri 2a str. 2457T
cucuguaauugaaggcuua

SEQ ID NO: 3837334 - RNA, 20 nt, Shigella flexneri 2a str. 2457T
cucugucugaugauaaucag

SEQ ID NO: 3837335 - RNA, 17 nt, Shigella flexneri 2a str. 2457T
cucuguuggcgacguuu

SEQ ID NO: 3837336 - RNA, 14 nt, Shigella flexneri 2a str. 2457T
cucuguuuccagau

SEQ ID NO: 3837337 - RNA, 21 nt, Shigella flexneri 2a str. 2457T
cucuuaaaugcacaauaauau

SEQ ID NO: 3837338 - RNA, 18 nt, Shigella flexneri 2a str. 2457T
cucuuaaugcaggcagca

SEQ ID NO: 3837339 - RNA, 18 nt, Shigella flexneri 2a str. 2457T
cucuucaaacugaagauu

SEQ ID NO: 3837340 - RNA, 22 nt, Shigella flexneri 2a str. 2457T
cucuucaacacacugaauaaaa

SEQ ID NO: 3837341 - RNA, 18 nt, Shigella flexneri 2a str. 2457T
cucuucaacuucagcagc

SEQ ID NO: 3837342 - RNA, 14 nt, Shigella flexneri 2a str. 2457T
cucuucaaugguca

SEQ ID NO: 3837343 - RNA, 17 nt, Shigella flexneri 2a str. 2457T
cucuucaauuaacaaca

SEQ ID NO: 3837344 - RNA, 17 nt, Shigella flexneri 2a str. 2457T
cucuucaccgguacgga

SEQ ID NO: 3837345 - RNA, 13 nt, Shigella flexneri 2a str. 2457T
cucuucacugacu

SEQ ID NO: 3837346 - RNA, 18 nt, Shigella flexneri 2a str. 2457T
cucuucagcaaucucuuc

SEQ ID NO: 3837347 - RNA, 13 nt, Shigella flexneri 2a str. 2457T
cucuucagccccg

SEQ ID NO: 3837348 - RNA, 19 nt, Shigella flexneri 2a str. 2457T
cucuucagccgcaaaccug

SEQ ID NO: 3837349 - RNA, 16 nt, Shigella flexneri 2a str. 2457T
cucuucauacgcggca

SEQ ID NO: 3837350 - RNA, 19 nt, Shigella flexneri 2a str. 2457T
cucuucauuaccuucaaca

SEQ ID NO: 3837351 - RNA, 21 nt, Shigella flexneri 2a str. 2457T
cucuuccacauuuuccaucac

SEQ ID NO: 3837352 - RNA, 11 nt, Shigella flexneri 2a str. 2457T
cucuuccaguc

SEQ ID NO: 3837353 - RNA, 13 nt, Shigella flexneri 2a str. 2457T
cucuuccaguucg

SEQ ID NO: 3837354 - RNA, 21 nt, Shigella flexneri 2a str. 2457T
cucuuccauuucaucgccagc

SEQ ID NO: 3837355 - RNA, 17 nt, Shigella flexneri 2a str. 2457T
cucuuccuucagcuccc

SEQ ID NO: 3837356 - RNA, 14 nt, Shigella flexneri 2a str. 2457T
cucuucgccugccu

SEQ ID NO: 3837357 - RNA, 17 nt, Shigella flexneri 2a str. 2457T
cucuucgcgaucaaacg

SEQ ID NO: 3837358 - RNA, 17 nt, Shigella flexneri 2a str. 2457T
cucuucgcgugugccgg

SEQ ID NO: 3837359 - RNA, 17 nt, Shigella flexneri 2a str. 2457T
cucuucgguuggcauca

SEQ ID NO: 3837360 - RNA, 17 nt, Shigella flexneri 2a str. 2457T
cucuucguuuucaacgu

SEQ ID NO: 3837361 - RNA, 14 nt, Shigella flexneri 2a str. 2457T
cucuucugccuguc

SEQ ID NO: 3837362 - RNA, 16 nt, Shigella flexneri 2a str. 2457T
cucuucugccugucca

SEQ ID NO: 3837363 - RNA, 14 nt, Shigella flexneri 2a str. 2457T
cucuucuggcacca

SEQ ID NO: 3837364 - RNA, 14 nt, Shigella flexneri 2a str. 2457T
cucuucuuccggca

SEQ ID NO: 3837365 - RNA, 22 nt, Shigella flexneri 2a str. 2457T
cucuucuucgcgauaaaucaga

SEQ ID NO: 3837366 - RNA, 16 nt, Shigella flexneri 2a str. 2457T
cucuucuuugcaggga

SEQ ID NO: 3837367 - RNA, 11 nt, Shigella flexneri 2a str. 2457T
cucuugccagg

SEQ ID NO: 3837368 - RNA, 22 nt, Shigella flexneri 2a str. 2457T
cucuugcuccacaagcuccggc

SEQ ID NO: 3837369 - RNA, 22 nt, Shigella flexneri 2a str. 2457T
cucuugcuggcauuacaagaau

SEQ ID NO: 3837370 - RNA, 13 nt, Shigella flexneri 2a str. 2457T
cucuuuaaacaga

SEQ ID NO: 3837371 - RNA, 18 nt, Shigella flexneri 2a str. 2457T
cucuuuaacccauuuugu

SEQ ID NO: 3837372 - RNA, 12 nt, Shigella flexneri 2a str. 2457T
cucuuucaacuu

SEQ ID NO: 3837373 - RNA, 18 nt, Shigella flexneri 2a str. 2457T
cucuuucccggcaaucac

SEQ ID NO: 3837374 - RNA, 15 nt, Shigella flexneri 2a str. 2457T
cucuuucuggcauca

SEQ ID NO: 3837375 - RNA, 21 nt, Shigella flexneri 2a str. 2457T
cucuuugaacagccagaagcc

SEQ ID NO: 3837376 - RNA, 16 nt, Shigella flexneri 2a str. 2457T
cucuuugaugaaacau

SEQ ID NO: 3837377 - RNA, 15 nt, Shigella flexneri 2a str. 2457T
cucuuuuccagccau

SEQ ID NO: 3837378 - RNA, 12 nt, Shigella flexneri 2a str. 2457T
cucuuuuuucaa

SEQ ID NO: 3837379 - RNA, 14 nt, Shigella flexneri 2a str. 2457T
cugaaaacuucuug

SEQ ID NO: 3837380 - RNA, 21 nt, Shigella flexneri 2a str. 2457T
cugaaaagcgggcugagacug

SEQ ID NO: 3837381 - RNA, 14 nt, Shigella flexneri 2a str. 2457T
cugaaaaggucacu

SEQ ID NO: 3837382 - RNA, 16 nt, Shigella flexneri 2a str. 2457T
cugaaaaggucacucc

SEQ ID NO: 3837383 - RNA, 20 nt, Shigella flexneri 2a str. 2457T
cugaaacaauuuaccgaccu

SEQ ID NO: 3837384 - RNA, 22 nt, Shigella flexneri 2a str. 2457T
cugaaaccgugcaucuguuggu

SEQ ID NO: 3837385 - RNA, 24 nt, Shigella flexneri 2a str. 2457T
cugaaacggcgauggcuucuucag

SEQ ID NO: 3837386 - RNA, 19 nt, Shigella flexneri 2a str. 2457T
cugaaacucgaccagcagc

SEQ ID NO: 3837387 - RNA, 20 nt, Shigella flexneri 2a str. 2457T
cugaaacucgcguaaaucca

SEQ ID NO: 3837388 - RNA, 19 nt, Shigella flexneri 2a str. 2457T
cugaaagcgccgggaaugc

SEQ ID NO: 3837389 - RNA, 16 nt, Shigella flexneri 2a str. 2457T
cugaaagcgugucaug

SEQ ID NO: 3837390 - RNA, 13 nt, Shigella flexneri 2a str. 2457T
cugaaagguauug

SEQ ID NO: 3837391 - RNA, 18 nt, Shigella flexneri 2a str. 2457T
cugaaauacagacuccac

SEQ ID NO: 3837392 - RNA, 17 nt, Shigella flexneri 2a str. 2457T
cugaaauagaauggcau

SEQ ID NO: 3837393 - RNA, 14 nt, Shigella flexneri 2a str. 2457T
cugaaaucacagcg

SEQ ID NO: 3837394 - RNA, 11 nt, Shigella flexneri 2a str. 2457T
cugaaaucauc

SEQ ID NO: 3837395 - RNA, 19 nt, Shigella flexneri 2a str. 2457T
cugaaauguuugcaauaaa

SEQ ID NO: 3837396 - RNA, 22 nt, Shigella flexneri 2a str. 2457T
cugaacaacaguuuuaucucca

SEQ ID NO: 3837397 - RNA, 12 nt, Shigella flexneri 2a str. 2457T
cugaacaagaau

SEQ ID NO: 3837398 - RNA, 14 nt, Shigella flexneri 2a str. 2457T
cugaacaagaauac

SEQ ID NO: 3837399 - RNA, 14 nt, Shigella flexneri 2a str. 2457T
cugaacagcuuuuu

SEQ ID NO: 3837400 - RNA, 19 nt, Shigella flexneri 2a str. 2457T
cugaaccaucgacguccaa

SEQ ID NO: 3837401 - RNA, 16 nt, Shigella flexneri 2a str. 2457T
cugaaccgaaauggcu

SEQ ID NO: 3837402 - RNA, 15 nt, Shigella flexneri 2a str. 2457T
cugaacgcaccuucc

SEQ ID NO: 3837403 - RNA, 15 nt, Shigella flexneri 2a str. 2457T
cugaacgccacgcuc

SEQ ID NO: 3837404 - RNA, 23 nt, Shigella flexneri 2a str. 2457T
cugaacuaaagccuuuugccagu

SEQ ID NO: 3837405 - RNA, 14 nt, Shigella flexneri 2a str. 2457T
cugaacugaacaaa

SEQ ID NO: 3837406 - RNA, 16 nt, Shigella flexneri 2a str. 2457T
cugaacugaacaaaaa

SEQ ID NO: 3837407 - RNA, 19 nt, Shigella flexneri 2a str. 2457T
cugaagaaaucccccagca

SEQ ID NO: 3837408 - RNA, 20 nt, Shigella flexneri 2a str. 2457T
cugaagaaguaaaacagucg

SEQ ID NO: 3837409 - RNA, 14 nt, Shigella flexneri 2a str. 2457T
cugaagaguaaaaa

SEQ ID NO: 3837410 - RNA, 17 nt, Shigella flexneri 2a str. 2457T
cugaagauugaacagca

SEQ ID NO: 3837411 - RNA, 19 nt, Shigella flexneri 2a str. 2457T
cugaagauugaacagcaga

SEQ ID NO: 3837412 - RNA, 21 nt, Shigella flexneri 2a str. 2457T
cugaagauugaacagcagaac

SEQ ID NO: 3837413 - RNA, 13 nt, Shigella flexneri 2a str. 2457T
cugaagcaaacuu

SEQ ID NO: 3837414 - RNA, 14 nt, Shigella flexneri 2a str. 2457T
cugaagcaguuuca

SEQ ID NO: 3837415 - RNA, 21 nt, Shigella flexneri 2a str. 2457T
cugaagcaguuucaccagcag

SEQ ID NO: 3837416 - RNA, 22 nt, Shigella flexneri 2a str. 2457T
cugaagcauugccgaacgggua

SEQ ID NO: 3837417 - RNA, 17 nt, Shigella flexneri 2a str. 2457T
cugaagcgcuggggaaa

SEQ ID NO: 3837418 - RNA, 19 nt, Shigella flexneri 2a str. 2457T
cugaaggaauauucaggcu

SEQ ID NO: 3837419 - RNA, 20 nt, Shigella flexneri 2a str. 2457T
cugaaggaauauucaggcuc

SEQ ID NO: 3837420 - RNA, 18 nt, Shigella flexneri 2a str. 2457T
cugaaggucuucgguaag

SEQ ID NO: 3837421 - RNA, 15 nt, Shigella flexneri 2a str. 2457T
cugaaguuauaagcg

SEQ ID NO: 3837422 - RNA, 17 nt, Shigella flexneri 2a str. 2457T
cugaaguuauaagcguu

SEQ ID NO: 3837423 - RNA, 18 nt, Shigella flexneri 2a str. 2457T
cugaauaacaccagccag

SEQ ID NO: 3837424 - RNA, 23 nt, Shigella flexneri 2a str. 2457T
cugaauacgcaccgcuccaucgc

SEQ ID NO: 3837425 - RNA, 14 nt, Shigella flexneri 2a str. 2457T
cugaauacgcuggc

SEQ ID NO: 3837426 - RNA, 17 nt, Shigella flexneri 2a str. 2457T
cugaauaucacgggcgc

SEQ ID NO: 3837427 - RNA, 23 nt, Shigella flexneri 2a str. 2457T
cugaauaucaucccccugcgauu

SEQ ID NO: 3837428 - RNA, 20 nt, Shigella flexneri 2a str. 2457T
cugaauaugagucguaaaca

SEQ ID NO: 3837429 - RNA, 16 nt, Shigella flexneri 2a str. 2457T
cugaauauguaagauc

SEQ ID NO: 3837430 - RNA, 20 nt, Shigella flexneri 2a str. 2457T
cugaauauucggcuccagau

SEQ ID NO: 3837431 - RNA, 24 nt, Shigella flexneri 2a str. 2457T
cugaauauucggcuccagauuacu

SEQ ID NO: 3837432 - RNA, 15 nt, Shigella flexneri 2a str. 2457T
cugaaugauaacuuc

SEQ ID NO: 3837433 - RNA, 17 nt, Shigella flexneri 2a str. 2457T
cugaaugauaacuucua

SEQ ID NO: 3837434 - RNA, 17 nt, Shigella flexneri 2a str. 2457T
aaaaaaccagaaaggga

SEQ ID NO: 3837435 - RNA, 16 nt, Shigella flexneri 2a str. 2457T
aaaaaacgaucauuau

SEQ ID NO: 3837436 - RNA, 20 nt, Shigella flexneri 2a str. 2457T
aaaaaacuggaaaaauaauu

SEQ ID NO: 3837437 - RNA, 13 nt, Shigella flexneri 2a str. 2457T
aaaaaagaauuca

SEQ ID NO: 3837438 - RNA, 13 nt, Shigella flexneri 2a str. 2457T
aaaaaagauuggg

SEQ ID NO: 3837439 - RNA, 23 nt, Shigella flexneri 2a str. 2457T
aaaaaaucaaugcccaucacuau

SEQ ID NO: 3837440 - RNA, 12 nt, Shigella flexneri 2a str. 2457T
aaaaaaucacag

SEQ ID NO: 3837441 - RNA, 12 nt, Shigella flexneri 2a str. 2457T
aaaaaaugaaac

SEQ ID NO: 3837442 - RNA, 22 nt, Shigella flexneri 2a str. 2457T
aaaaaaugaaacuggaagauuu

SEQ ID NO: 3837443 - RNA, 16 nt, Shigella flexneri 2a str. 2457T
aaaaaaugagaaagcc

SEQ ID NO: 3837444 - RNA, 13 nt, Shigella flexneri 2a str. 2457T
aaaaaaugagaau

SEQ ID NO: 3837445 - RNA, 20 nt, Shigella flexneri 2a str. 2457T
aaaaaauggccagacauuau

SEQ ID NO: 3837446 - RNA, 20 nt, Shigella flexneri 2a str. 2457T
aaaaaauuacaaaaagugcu

SEQ ID NO: 3837447 - RNA, 22 nt, Shigella flexneri 2a str. 2457T
aaaaacaagccgaaacggaaau

SEQ ID NO: 3837448 - RNA, 12 nt, Shigella flexneri 2a str. 2457T
aaaaacacaaag

SEQ ID NO: 3837449 - RNA, 23 nt, Shigella flexneri 2a str. 2457T
aaaaacaccccauugccccaugu

SEQ ID NO: 3837450 - RNA, 20 nt, Shigella flexneri 2a str. 2457T
aaaaacacugggaugaaagu

SEQ ID NO: 3837451 - RNA, 15 nt, Shigella flexneri 2a str. 2457T
aaaaacagaggcccg

SEQ ID NO: 3837452 - RNA, 13 nt, Shigella flexneri 2a str. 2457T
aaaaacagcauca

SEQ ID NO: 3837453 - RNA, 16 nt, Shigella flexneri 2a str. 2457T
aaaaacagccagcagc

SEQ ID NO: 3837454 - RNA, 13 nt, Shigella flexneri 2a str. 2457T
aaaaacauaauca

SEQ ID NO: 3837455 - RNA, 15 nt, Shigella flexneri 2a str. 2457T
aaaaaccagacgaua

SEQ ID NO: 3837456 - RNA, 12 nt, Shigella flexneri 2a str. 2457T
aaaaaccagaga

SEQ ID NO: 3837457 - RNA, 22 nt, Shigella flexneri 2a str. 2457T
aaaaacccgccccugacaggcg

SEQ ID NO: 3837458 - RNA, 13 nt, Shigella flexneri 2a str. 2457T
aaaaacccuucuu

SEQ ID NO: 3837459 - RNA, 20 nt, Shigella flexneri 2a str. 2457T
aaaaacgcgguugccagaua

SEQ ID NO: 3837460 - RNA, 14 nt, Shigella flexneri 2a str. 2457T
aaaaacucauaaau

SEQ ID NO: 3837461 - RNA, 16 nt, Shigella flexneri 2a str. 2457T
aaaaacuugauacuga

SEQ ID NO: 3837462 - RNA, 14 nt, Shigella flexneri 2a str. 2457T
aaaaacuuuuguau

SEQ ID NO: 3837463 - RNA, 12 nt, Shigella flexneri 2a str. 2457T
aaaaagaaaguu

SEQ ID NO: 3837464 - RNA, 12 nt, Shigella flexneri 2a str. 2457T
aaaaagaacaac

SEQ ID NO: 3837465 - RNA, 13 nt, Shigella flexneri 2a str. 2457T
aaaaagaaggaaa

SEQ ID NO: 3837466 - RNA, 15 nt, Shigella flexneri 2a str. 2457T
aaaaagaaggaaaau

SEQ ID NO: 3837467 - RNA, 17 nt, Shigella flexneri 2a str. 2457T
aaaaagagauuguauuu

SEQ ID NO: 3837468 - RNA, 14 nt, Shigella flexneri 2a str. 2457T
aaaaagcaugaauu

SEQ ID NO: 3837469 - RNA, 15 nt, Shigella flexneri 2a str. 2457T
aaaaagcauuuaaua

SEQ ID NO: 3837470 - RNA, 16 nt, Shigella flexneri 2a str. 2457T
aaaaagcauuuaauac

SEQ ID NO: 3837471 - RNA, 16 nt, Shigella flexneri 2a str. 2457T
aaaaagccaaucacaa

SEQ ID NO: 3837472 - RNA, 14 nt, Shigella flexneri 2a str. 2457T
aaaaagccggauga

SEQ ID NO: 3837473 - RNA, 18 nt, Shigella flexneri 2a str. 2457T
aaaaagcguauccugacg

SEQ ID NO: 3837474 - RNA, 19 nt, Shigella flexneri 2a str. 2457T
aaaaagcguauccugacgg

SEQ ID NO: 3837475 - RNA, 19 nt, Shigella flexneri 2a str. 2457T
aaaaaggcgaaaggcuggc

SEQ ID NO: 3837476 - RNA, 20 nt, Shigella flexneri 2a str. 2457T
aaaaaggcugacaaaucaga

SEQ ID NO: 3837477 - RNA, 23 nt, Shigella flexneri 2a str. 2457T
aaaaagguccuguaaugagaaua

SEQ ID NO: 3837478 - RNA, 21 nt, Shigella flexneri 2a str. 2457T
aaaaaggugagucgcaaaacu

SEQ ID NO: 3837479 - RNA, 23 nt, Shigella flexneri 2a str. 2457T
aaaaaguaagaauugauaaaaaa

SEQ ID NO: 3837480 - RNA, 16 nt, Shigella flexneri 2a str. 2457T
aaaaagucagaucguu

SEQ ID NO: 3837481 - RNA, 18 nt, Shigella flexneri 2a str. 2457T
aaaaaguccaaaaggucc

SEQ ID NO: 3837482 - RNA, 14 nt, Shigella flexneri 2a str. 2457T
aaaaagucccuucc

SEQ ID NO: 3837483 - RNA, 20 nt, Shigella flexneri 2a str. 2457T
aaaaaguuuuauugcaaaac

SEQ ID NO: 3837484 - RNA, 11 nt, Shigella flexneri 2a str. 2457T
aaaaauaaaag

SEQ ID NO: 3837485 - RNA, 12 nt, Shigella flexneri 2a str. 2457T
aaaaauaaaugc

SEQ ID NO: 3837486 - RNA, 13 nt, Shigella flexneri 2a str. 2457T
aaaaauaacaaau

SEQ ID NO: 3837487 - RNA, 15 nt, Shigella flexneri 2a str. 2457T
aaaaauaauuuuaaa

SEQ ID NO: 3837488 - RNA, 20 nt, Shigella flexneri 2a str. 2457T
aaaaauacauacgcaaaaaa

SEQ ID NO: 3837489 - RNA, 20 nt, Shigella flexneri 2a str. 2457T
aaaaauacccuguauaauag

SEQ ID NO: 3837490 - RNA, 19 nt, Shigella flexneri 2a str. 2457T
aaaaauauugagcagaagg

SEQ ID NO: 3837491 - RNA, 14 nt, Shigella flexneri 2a str. 2457T
aaaaaucaaaaaac

SEQ ID NO: 3837492 - RNA, 15 nt, Shigella flexneri 2a str. 2457T
aaaaaucaaaaaacu

SEQ ID NO: 3837493 - RNA, 13 nt, Shigella flexneri 2a str. 2457T
aaaaaucaauaaa

SEQ ID NO: 3837494 - RNA, 21 nt, Shigella flexneri 2a str. 2457T
aaaaaucaugcaauaaauaug

SEQ ID NO: 3837495 - RNA, 12 nt, Shigella flexneri 2a str. 2457T
aaaaaucgccga

SEQ ID NO: 3837496 - RNA, 24 nt, Shigella flexneri 2a str. 2457T
aaaaaucgccgagcugaacaagaa

SEQ ID NO: 3837497 - RNA, 18 nt, Shigella flexneri 2a str. 2457T
aaaaaucuaaccuacuuu

SEQ ID NO: 3837498 - RNA, 20 nt, Shigella flexneri 2a str. 2457T
aaaaaugaccgggcuugaaa

SEQ ID NO: 3837499 - RNA, 12 nt, Shigella flexneri 2a str. 2457T
aaaaaugcccga

SEQ ID NO: 3837500 - RNA, 12 nt, Shigella flexneri 2a str. 2457T
aaaaauggcugg

SEQ ID NO: 3837501 - RNA, 13 nt, Shigella flexneri 2a str. 2457T
aaaaauggcuggc

SEQ ID NO: 3837502 - RNA, 17 nt, Shigella flexneri 2a str. 2457T
aaaaauggcuuuauucg

SEQ ID NO: 3837503 - RNA, 16 nt, Shigella flexneri 2a str. 2457T
aaaaauuacaaaaagu

SEQ ID NO: 3837504 - RNA, 18 nt, Shigella flexneri 2a str. 2457T
aaaaauucagaugaugau

SEQ ID NO: 3837505 - RNA, 23 nt, Shigella flexneri 2a str. 2457T
aaaaauucagaugaugauacuga

SEQ ID NO: 3837506 - RNA, 17 nt, Shigella flexneri 2a str. 2457T
aaaaauuuauugaaagc

SEQ ID NO: 3837507 - RNA, 13 nt, Shigella flexneri 2a str. 2457T
aaaacaaaaaccg

SEQ ID NO: 3837508 - RNA, 12 nt, Shigella flexneri 2a str. 2457T
aaaacaaacggc

SEQ ID NO: 3837509 - RNA, 23 nt, Shigella flexneri 2a str. 2457T
aaaacaacgagccaauaaaaaua

SEQ ID NO: 3837510 - RNA, 20 nt, Shigella flexneri 2a str. 2457T
aaaacaacggaacgaaaaaa

SEQ ID NO: 3837511 - RNA, 22 nt, Shigella flexneri 2a str. 2457T
aaaacaacggaacgaaaaaaau

SEQ ID NO: 3837512 - RNA, 13 nt, Shigella flexneri 2a str. 2457T
aaaacaagccgaa

SEQ ID NO: 3837513 - RNA, 21 nt, Shigella flexneri 2a str. 2457T
aaaacaagccgaaacggaaau

SEQ ID NO: 3837514 - RNA, 13 nt, Shigella flexneri 2a str. 2457T
aaaacaauauguc

SEQ ID NO: 3837515 - RNA, 18 nt, Shigella flexneri 2a str. 2457T
aaaacaccacaaaacgga

SEQ ID NO: 3837516 - RNA, 14 nt, Shigella flexneri 2a str. 2457T
aaaacacucuucaa

SEQ ID NO: 3837517 - RNA, 20 nt, Shigella flexneri 2a str. 2457T
aaaacagccagcgcugacgu

SEQ ID NO: 3837518 - RNA, 14 nt, Shigella flexneri 2a str. 2457T
aaaaucccggcaac

SEQ ID NO: 3837519 - RNA, 17 nt, Shigella flexneri 2a str. 2457T
aaaaucgacaucugcaa

SEQ ID NO: 3837520 - RNA, 15 nt, Shigella flexneri 2a str. 2457T
aaaaucgcaagaucu

SEQ ID NO: 3837521 - RNA, 13 nt, Shigella flexneri 2a str. 2457T
aaaaucgcuucag

SEQ ID NO: 3837522 - RNA, 12 nt, Shigella flexneri 2a str. 2457T
aaaaucggcaac

SEQ ID NO: 3837523 - RNA, 21 nt, Shigella flexneri 2a str. 2457T
aaaaucuauugcaacauguug

SEQ ID NO: 3837524 - RNA, 19 nt, Shigella flexneri 2a str. 2457T
aaaaucuccugccaauaca

SEQ ID NO: 3837525 - RNA, 14 nt, Shigella flexneri 2a str. 2457T
aaaaucugaauugu

SEQ ID NO: 3837526 - RNA, 22 nt, Shigella flexneri 2a str. 2457T
aaaaucugcgggaacauaugca

SEQ ID NO: 3837527 - RNA, 14 nt, Shigella flexneri 2a str. 2457T
aaaaucuucguuau

SEQ ID NO: 3837528 - RNA, 21 nt, Shigella flexneri 2a str. 2457T
aaaaucuucguuaucccaggc

SEQ ID NO: 3837529 - RNA, 22 nt, Shigella flexneri 2a str. 2457T
aaaaugauguagaccugauaca

SEQ ID NO: 3837530 - RNA, 20 nt, Shigella flexneri 2a str. 2457T
aaaaugcaucggcauaauca

SEQ ID NO: 3837531 - RNA, 13 nt, Shigella flexneri 2a str. 2457T
aaaaugccugaug

SEQ ID NO: 3837532 - RNA, 23 nt, Shigella flexneri 2a str. 2457T
aaaaugcgcggucagaaaauuau

SEQ ID NO: 3837533 - RNA, 16 nt, Shigella flexneri 2a str. 2457T
aaaaugcugcaauugc

SEQ ID NO: 3837534 - RNA, 16 nt, Shigella flexneri 2a str. 2457T
aaaauggccagccagc

SEQ ID NO: 3837535 - RNA, 22 nt, Shigella flexneri 2a str. 2457T
aaaauggcuuuauucgcuuaau

SEQ ID NO: 3837536 - RNA, 17 nt, Shigella flexneri 2a str. 2457T
aaaaugguggagauaaa

SEQ ID NO: 3837537 - RNA, 19 nt, Shigella flexneri 2a str. 2457T
aaaaugguuccuggaacug

SEQ ID NO: 3837538 - RNA, 12 nt, Shigella flexneri 2a str. 2457T
aaaauuacaaaa

SEQ ID NO: 3837539 - RNA, 23 nt, Shigella flexneri 2a str. 2457T
aaaauuacaaaaagugcuuucug

SEQ ID NO: 3837540 - RNA, 20 nt, Shigella flexneri 2a str. 2457T
aaaauuacggauuacaugga

SEQ ID NO: 3837541 - RNA, 22 nt, Shigella flexneri 2a str. 2457T
aaaauuacucccgugccagagc

SEQ ID NO: 3837542 - RNA, 15 nt, Shigella flexneri 2a str. 2457T
aaaauuauuuuaaau

SEQ ID NO: 3837543 - RNA, 13 nt, Shigella flexneri 2a str. 2457T
aaaauucaagaca

SEQ ID NO: 3837544 - RNA, 14 nt, Shigella flexneri 2a str. 2457T
aaaauucaagacau

SEQ ID NO: 3837545 - RNA, 14 nt, Shigella flexneri 2a str. 2457T
aaaauucagaugau

SEQ ID NO: 3837546 - RNA, 13 nt, Shigella flexneri 2a str. 2457T
aaaauucaucaaa

SEQ ID NO: 3837547 - RNA, 22 nt, Shigella flexneri 2a str. 2457T
aaaauucauucaauuaauaaca

SEQ ID NO: 3837548 - RNA, 15 nt, Shigella flexneri 2a str. 2457T
aaaauuggcuucguu

SEQ ID NO: 3837549 - RNA, 21 nt, Shigella flexneri 2a str. 2457T
aaaauuguguaaauucaauaa

SEQ ID NO: 3837550 - RNA, 19 nt, Shigella flexneri 2a str. 2457T
aaaauuucuccuucacucu

SEQ ID NO: 3837551 - RNA, 19 nt, Shigella flexneri 2a str. 2457T
aaaauuuuaguuuaaacau

SEQ ID NO: 3837552 - RNA, 14 nt, Shigella flexneri 2a str. 2457T
aaaauuuucauugc

SEQ ID NO: 3837553 - RNA, 14 nt, Shigella flexneri 2a str. 2457T
aaacaaauccgcuu

SEQ ID NO: 3837554 - RNA, 14 nt, Shigella flexneri 2a str. 2457T
aaacaacaugcuau

SEQ ID NO: 3837555 - RNA, 22 nt, Shigella flexneri 2a str. 2457T
aaacaacgagccaauaaaaaua

SEQ ID NO: 3837556 - RNA, 21 nt, Shigella flexneri 2a str. 2457T
aaacaacguggaacaaauaga

SEQ ID NO: 3837557 - RNA, 16 nt, Shigella flexneri 2a str. 2457T
aaacaagguuugaaaa

SEQ ID NO: 3837558 - RNA, 21 nt, Shigella flexneri 2a str. 2457T
aaacaauaagggcugacaguu

SEQ ID NO: 3837559 - RNA, 13 nt, Shigella flexneri 2a str. 2457T
aaacaauacgauc

SEQ ID NO: 3837560 - RNA, 11 nt, Shigella flexneri 2a str. 2457T
aaacaauaugu

SEQ ID NO: 3837561 - RNA, 23 nt, Shigella flexneri 2a str. 2457T
aaacaauguucaucugcauuccg

SEQ ID NO: 3837562 - RNA, 16 nt, Shigella flexneri 2a str. 2457T
aaacaauuaauauagu

SEQ ID NO: 3837563 - RNA, 17 nt, Shigella flexneri 2a str. 2457T
aaacaauuuucauugaa

SEQ ID NO: 3837564 - RNA, 13 nt, Shigella flexneri 2a str. 2457T
aaacacaaagucc

SEQ ID NO: 3837565 - RNA, 16 nt, Shigella flexneri 2a str. 2457T
aaacacaauauucaua

SEQ ID NO: 3837566 - RNA, 21 nt, Shigella flexneri 2a str. 2457T
aaacacaucaaugaugaacgc

SEQ ID NO: 3837567 - RNA, 13 nt, Shigella flexneri 2a str. 2457T
aaacaccagaaug

SEQ ID NO: 3837568 - RNA, 14 nt, Shigella flexneri 2a str. 2457T
aaacaccagaaugc

SEQ ID NO: 3837569 - RNA, 18 nt, Shigella flexneri 2a str. 2457T
aaacaccagaaugcccca

SEQ ID NO: 3837570 - RNA, 12 nt, Shigella flexneri 2a str. 2457T
aaacaccagcaa

SEQ ID NO: 3837571 - RNA, 14 nt, Shigella flexneri 2a str. 2457T
aaacaccgucgcaa

SEQ ID NO: 3837572 - RNA, 17 nt, Shigella flexneri 2a str. 2457T
aaacacgcgaccaaagg

SEQ ID NO: 3837573 - RNA, 19 nt, Shigella flexneri 2a str. 2457T
aaacacugcgcucuucugg

SEQ ID NO: 3837574 - RNA, 18 nt, Shigella flexneri 2a str. 2457T
aaacacugggaugaaagu

SEQ ID NO: 3837575 - RNA, 13 nt, Shigella flexneri 2a str. 2457T
aaacagaaauuca

SEQ ID NO: 3837576 - RNA, 13 nt, Shigella flexneri 2a str. 2457T
aaacagcaggcag

SEQ ID NO: 3837577 - RNA, 12 nt, Shigella flexneri 2a str. 2457T
aaacagccaacu

SEQ ID NO: 3837578 - RNA, 23 nt, Shigella flexneri 2a str. 2457T
aaacagccagcagcgaaucagcc

SEQ ID NO: 3837579 - RNA, 13 nt, Shigella flexneri 2a str. 2457T
aaacagcccaauc

SEQ ID NO: 3837580 - RNA, 22 nt, Shigella flexneri 2a str. 2457T
aaacagcccaaucaucgcggca

SEQ ID NO: 3837581 - RNA, 22 nt, Shigella flexneri 2a str. 2457T
aaacagcgcaccagaaacaaua

SEQ ID NO: 3837582 - RNA, 23 nt, Shigella flexneri 2a str. 2457T
aaacagcgcaccagaaacaauaa

SEQ ID NO: 3837583 - RNA, 13 nt, Shigella flexneri 2a str. 2457T
aaacagcgccaga

SEQ ID NO: 3837584 - RNA, 23 nt, Shigella flexneri 2a str. 2457T
aaacagcgcugcgaaaguaccau

SEQ ID NO: 3837585 - RNA, 18 nt, Shigella flexneri 2a str. 2457T
aaacagcggccacucuuu

SEQ ID NO: 3837586 - RNA, 15 nt, Shigella flexneri 2a str. 2457T
aaacaggaacaccag

SEQ ID NO: 3837587 - RNA, 16 nt, Shigella flexneri 2a str. 2457T
aaacagguaaagacca

SEQ ID NO: 3837588 - RNA, 22 nt, Shigella flexneri 2a str. 2457T
aaacaggucuguaugacaacaa

SEQ ID NO: 3837589 - RNA, 16 nt, Shigella flexneri 2a str. 2457T
aaacagucuggagcaa

SEQ ID NO: 3837590 - RNA, 18 nt, Shigella flexneri 2a str. 2457T
aaacagucuggagcaaaa

SEQ ID NO: 3837591 - RNA, 17 nt, Shigella flexneri 2a str. 2457T
aaacaguuucugcagcu

SEQ ID NO: 3837592 - RNA, 21 nt, Shigella flexneri 2a str. 2457T
aaacauaaucaauaaaaauac

SEQ ID NO: 3837593 - RNA, 12 nt, Shigella flexneri 2a str. 2457T
aaacaucaaaaa

SEQ ID NO: 3837594 - RNA, 14 nt, Shigella flexneri 2a str. 2457T
aaacaucaccaaug

SEQ ID NO: 3837595 - RNA, 19 nt, Shigella flexneri 2a str. 2457T
aaacaucaccaaugaaagc

SEQ ID NO: 3837596 - RNA, 14 nt, Shigella flexneri 2a str. 2457T
aaacaucagcuauu

SEQ ID NO: 3837597 - RNA, 21 nt, Shigella flexneri 2a str. 2457T
aaacaucagcuauucuuauaa

SEQ ID NO: 3837598 - RNA, 22 nt, Shigella flexneri 2a str. 2457T
aaacaucggcuuauucauauca

SEQ ID NO: 3837599 - RNA, 23 nt, Shigella flexneri 2a str. 2457T
aaacaucggcuuauucauaucaa

SEQ ID NO: 3837600 - RNA, 14 nt, Shigella flexneri 2a str. 2457T
aaacaugccaacaa

SEQ ID NO: 3837601 - RNA, 20 nt, Shigella flexneri 2a str. 2457T
aaacaugccaacaaaaucuu

SEQ ID NO: 3837602 - RNA, 15 nt, Shigella flexneri 2a str. 2457T
aaacauugcugccag

SEQ ID NO: 3837603 - RNA, 16 nt, Shigella flexneri 2a str. 2457T
aaacauuucagggaug

SEQ ID NO: 3837604 - RNA, 12 nt, Shigella flexneri 2a str. 2457T
aaacauuuuugc

SEQ ID NO: 3837605 - RNA, 20 nt, Shigella flexneri 2a str. 2457T
aaaccaaacuuaugcagcug

SEQ ID NO: 3837606 - RNA, 18 nt, Shigella flexneri 2a str. 2457T
aaaccacagaccggacug

SEQ ID NO: 3837607 - RNA, 19 nt, Shigella flexneri 2a str. 2457T
aaaccacagaccggacuga

SEQ ID NO: 3837608 - RNA, 17 nt, Shigella flexneri 2a str. 2457T
aaaccaccacuccccuc

SEQ ID NO: 3837609 - RNA, 18 nt, Shigella flexneri 2a str. 2457T
aaaccacccaccagcgcc

SEQ ID NO: 3837610 - RNA, 16 nt, Shigella flexneri 2a str. 2457T
aaaccacuccugacga

SEQ ID NO: 3837611 - RNA, 22 nt, Shigella flexneri 2a str. 2457T
aaaccacugcaacagcuguuga

SEQ ID NO: 3837612 - RNA, 17 nt, Shigella flexneri 2a str. 2457T
aaaccacuuaauuauua

SEQ ID NO: 3837613 - RNA, 20 nt, Shigella flexneri 2a str. 2457T
aaaccacuuaauuauuaaca

SEQ ID NO: 3837614 - RNA, 15 nt, Shigella flexneri 2a str. 2457T
aaaccagaaagggaa

SEQ ID NO: 3837615 - RNA, 21 nt, Shigella flexneri 2a str. 2457T
aaaccagaaagggaagaacau

SEQ ID NO: 3837616 - RNA, 14 nt, Shigella flexneri 2a str. 2457T
aaacuggaaaaaua

SEQ ID NO: 3837617 - RNA, 17 nt, Shigella flexneri 2a str. 2457T
aaacuggcguuuuucca

SEQ ID NO: 3837618 - RNA, 20 nt, Shigella flexneri 2a str. 2457T
aaacuggcugauaaaacucu

SEQ ID NO: 3837619 - RNA, 13 nt, Shigella flexneri 2a str. 2457T
aaacuggcugugc

SEQ ID NO: 3837620 - RNA, 21 nt, Shigella flexneri 2a str. 2457T
aaacuggguuuugaucuccag

SEQ ID NO: 3837621 - RNA, 23 nt, Shigella flexneri 2a str. 2457T
aaacugguagcuguagguaaaac

SEQ ID NO: 3837622 - RNA, 18 nt, Shigella flexneri 2a str. 2457T
aaacuggugguaagaaua

SEQ ID NO: 3837623 - RNA, 15 nt, Shigella flexneri 2a str. 2457T
aaacuucacuucccc

SEQ ID NO: 3837624 - RNA, 17 nt, Shigella flexneri 2a str. 2457T
aaacuuccggcagaaau

SEQ ID NO: 3837625 - RNA, 15 nt, Shigella flexneri 2a str. 2457T
aaacuucgucacagc

SEQ ID NO: 3837626 - RNA, 17 nt, Shigella flexneri 2a str. 2457T
aaacuucguuagguucu

SEQ ID NO: 3837627 - RNA, 23 nt, Shigella flexneri 2a str. 2457T
aaacuucuugcaauuuuuaccgc

SEQ ID NO: 3837628 - RNA, 18 nt, Shigella flexneri 2a str. 2457T
aaacuugaacgcgagaaa

SEQ ID NO: 3837629 - RNA, 22 nt, Shigella flexneri 2a str. 2457T
aaacuugaacgcgagaaaagca

SEQ ID NO: 3837630 - RNA, 14 nt, Shigella flexneri 2a str. 2457T
aaacuugauacuga

SEQ ID NO: 3837631 - RNA, 17 nt, Shigella flexneri 2a str. 2457T
aaacuugauacugaaca

SEQ ID NO: 3837632 - RNA, 17 nt, Shigella flexneri 2a str. 2457T
aaacuugauagaacaaa

SEQ ID NO: 3837633 - RNA, 17 nt, Shigella flexneri 2a str. 2457T
aaacuugcguaucgacc

SEQ ID NO: 3837634 - RNA, 12 nt, Shigella flexneri 2a str. 2457T
aaacuuuuaaau

SEQ ID NO: 3837635 - RNA, 13 nt, Shigella flexneri 2a str. 2457T
aaacuuuuaaauu

SEQ ID NO: 3837636 - RNA, 20 nt, Shigella flexneri 2a str. 2457T
aaacuuuucccuacugcuga

SEQ ID NO: 3837637 - RNA, 23 nt, Shigella flexneri 2a str. 2457T
aaacuuuucccuacugcugacau

SEQ ID NO: 3837638 - RNA, 11 nt, Shigella flexneri 2a str. 2457T
aaagaaaagau

SEQ ID NO: 3837639 - RNA, 12 nt, Shigella flexneri 2a str. 2457T
aaagaaaauaag

SEQ ID NO: 3837640 - RNA, 11 nt, Shigella flexneri 2a str. 2457T
aaagaaaaucu

SEQ ID NO: 3837641 - RNA, 16 nt, Shigella flexneri 2a str. 2457T
aaagaaaaucugaauu

SEQ ID NO: 3837642 - RNA, 15 nt, Shigella flexneri 2a str. 2457T
aaagaacgaguaaaa

SEQ ID NO: 3837643 - RNA, 18 nt, Shigella flexneri 2a str. 2457T
aaagaagcggugaaaaaa

SEQ ID NO: 3837644 - RNA, 13 nt, Shigella flexneri 2a str. 2457T
aaagaaggaaaau

SEQ ID NO: 3837645 - RNA, 16 nt, Shigella flexneri 2a str. 2457T
aaagaagucucugaaa

SEQ ID NO: 3837646 - RNA, 12 nt, Shigella flexneri 2a str. 2457T
aaagaauugcag

SEQ ID NO: 3837647 - RNA, 23 nt, Shigella flexneri 2a str. 2457T
aaagacaucgcccgauucacaua

SEQ ID NO: 3837648 - RNA, 18 nt, Shigella flexneri 2a str. 2457T
aaagaccaggaaacccaa

SEQ ID NO: 3837649 - RNA, 15 nt, Shigella flexneri 2a str. 2457T
aaagaccugaccaga

SEQ ID NO: 3837650 - RNA, 17 nt, Shigella flexneri 2a str. 2457T
aaagacgaagauuuuac

SEQ ID NO: 3837651 - RNA, 13 nt, Shigella flexneri 2a str. 2457T
aaagacguuaaaa

SEQ ID NO: 3837652 - RNA, 13 nt, Shigella flexneri 2a str. 2457T
aaagagaacucuu

SEQ ID NO: 3837653 - RNA, 13 nt, Shigella flexneri 2a str. 2457T
aaagagacagaau

SEQ ID NO: 3837654 - RNA, 16 nt, Shigella flexneri 2a str. 2457T
aaagagacgcugaaaa

SEQ ID NO: 3837655 - RNA, 16 nt, Shigella flexneri 2a str. 2457T
aaagagaguuacuggc

SEQ ID NO: 3837656 - RNA, 19 nt, Shigella flexneri 2a str. 2457T
aaagagcagcugauugaaa

SEQ ID NO: 3837657 - RNA, 16 nt, Shigella flexneri 2a str. 2457T
aaagaguaaaguuagu

SEQ ID NO: 3837658 - RNA, 17 nt, Shigella flexneri 2a str. 2457T
aaagagugugaauauuc

SEQ ID NO: 3837659 - RNA, 21 nt, Shigella flexneri 2a str. 2457T
aaagagugugaauauucagaa

SEQ ID NO: 3837660 - RNA, 17 nt, Shigella flexneri 2a str. 2457T
aaagaucgaucauuuuu

SEQ ID NO: 3837661 - RNA, 22 nt, Shigella flexneri 2a str. 2457T
aaagaucugcgugaguuuuugu

SEQ ID NO: 3837662 - RNA, 22 nt, Shigella flexneri 2a str. 2457T
aaagaugcgauggauuaucgac

SEQ ID NO: 3837663 - RNA, 21 nt, Shigella flexneri 2a str. 2457T
aaagauggcgcgcagaaagag

SEQ ID NO: 3837664 - RNA, 16 nt, Shigella flexneri 2a str. 2457T
aaagauggcggcgaau

SEQ ID NO: 3837665 - RNA, 17 nt, Shigella flexneri 2a str. 2457T
aaagauuaaaaaaacac

SEQ ID NO: 3837666 - RNA, 22 nt, Shigella flexneri 2a str. 2457T
aaagauuaacgugaccgccaau

SEQ ID NO: 3837667 - RNA, 23 nt, Shigella flexneri 2a str. 2457T
aaagauuauugcuugaucaggaa

SEQ ID NO: 3837668 - RNA, 20 nt, Shigella flexneri 2a str. 2457T
aaagauucaucgcccuuuuu

SEQ ID NO: 3837669 - RNA, 12 nt, Shigella flexneri 2a str. 2457T
aaagauugaauu

SEQ ID NO: 3837670 - RNA, 21 nt, Shigella flexneri 2a str. 2457T
aaagauuguuggcaaaaaaau

SEQ ID NO: 3837671 - RNA, 13 nt, Shigella flexneri 2a str. 2457T
aaagauuuuacca

SEQ ID NO: 3837672 - RNA, 13 nt, Shigella flexneri 2a str. 2457T
aaagcaaaaaaag

SEQ ID NO: 3837673 - RNA, 15 nt, Shigella flexneri 2a str. 2457T
aaagcaaaaaaagaa

SEQ ID NO: 3837674 - RNA, 13 nt, Shigella flexneri 2a str. 2457T
aaagcaaaaauaa

SEQ ID NO: 3837675 - RNA, 14 nt, Shigella flexneri 2a str. 2457T
aaagcaacguuaaa

SEQ ID NO: 3837676 - RNA, 11 nt, Shigella flexneri 2a str. 2457T
aaagcaacucc

SEQ ID NO: 3837677 - RNA, 12 nt, Shigella flexneri 2a str. 2457T
aaagcaacucca

SEQ ID NO: 3837678 - RNA, 14 nt, Shigella flexneri 2a str. 2457T
aaagcaagccaggu

SEQ ID NO: 3837679 - RNA, 16 nt, Shigella flexneri 2a str. 2457T
aaagcaauuccagcgc

SEQ ID NO: 3837680 - RNA, 17 nt, Shigella flexneri 2a str. 2457T
aaagcaauuccagcgcc

SEQ ID NO: 3837681 - RNA, 19 nt, Shigella flexneri 2a str. 2457T
aaagcacagaaucuaagau

SEQ ID NO: 3837682 - RNA, 14 nt, Shigella flexneri 2a str. 2457T
aaagcaccacuccu

SEQ ID NO: 3837683 - RNA, 19 nt, Shigella flexneri 2a str. 2457T
aaagcagacaacccacaca

SEQ ID NO: 3837684 - RNA, 21 nt, Shigella flexneri 2a str. 2457T
aaagcagacggcugucaucca

SEQ ID NO: 3837685 - RNA, 17 nt, Shigella flexneri 2a str. 2457T
aaagcagagcagggaag

SEQ ID NO: 3837686 - RNA, 22 nt, Shigella flexneri 2a str. 2457T
aaagcagcauguagaugccggu

SEQ ID NO: 3837687 - RNA, 12 nt, Shigella flexneri 2a str. 2457T
aaagcagcgaag

SEQ ID NO: 3837688 - RNA, 22 nt, Shigella flexneri 2a str. 2457T
aaagcaggcgauuuacuggcag

SEQ ID NO: 3837689 - RNA, 22 nt, Shigella flexneri 2a str. 2457T
aaagcaggcuggaguuacccag

SEQ ID NO: 3837690 - RNA, 23 nt, Shigella flexneri 2a str. 2457T
aaagcaguaaggucaucaaucau

SEQ ID NO: 3837691 - RNA, 19 nt, Shigella flexneri 2a str. 2457T
aaagcauucguaaugaaug

SEQ ID NO: 3837692 - RNA, 16 nt, Shigella flexneri 2a str. 2457T
aaagcauuuuuucaca

SEQ ID NO: 3837693 - RNA, 18 nt, Shigella flexneri 2a str. 2457T
aaagcauuuuuucacaug

SEQ ID NO: 3837694 - RNA, 13 nt, Shigella flexneri 2a str. 2457T
aaagccaacagca

SEQ ID NO: 3837695 - RNA, 14 nt, Shigella flexneri 2a str. 2457T
aaagccaacagcag

SEQ ID NO: 3837696 - RNA, 14 nt, Shigella flexneri 2a str. 2457T
aaagccaaccugcg

SEQ ID NO: 3837697 - RNA, 20 nt, Shigella flexneri 2a str. 2457T
aaagccaaccugcggguugg

SEQ ID NO: 3837698 - RNA, 17 nt, Shigella flexneri 2a str. 2457T
aaagcccauaccacagc

SEQ ID NO: 3837699 - RNA, 14 nt, Shigella flexneri 2a str. 2457T
aaagcccaucaucc

SEQ ID NO: 3837700 - RNA, 17 nt, Shigella flexneri 2a str. 2457T
aaagcccaucauccgcg

SEQ ID NO: 3837701 - RNA, 14 nt, Shigella flexneri 2a str. 2457T
aaagccccaccagc

SEQ ID NO: 3837702 - RNA, 16 nt, Shigella flexneri 2a str. 2457T
aaagccccaccagcaa

SEQ ID NO: 3837703 - RNA, 20 nt, Shigella flexneri 2a str. 2457T
aaagcccccgcaacauugcg

SEQ ID NO: 3837704 - RNA, 23 nt, Shigella flexneri 2a str. 2457T
aaagcccccgcaacauugcgccu

SEQ ID NO: 3837705 - RNA, 15 nt, Shigella flexneri 2a str. 2457T
aaagcccucaccgaa

SEQ ID NO: 3837706 - RNA, 20 nt, Shigella flexneri 2a str. 2457T
aaagccgccaucucuuccag

SEQ ID NO: 3837707 - RNA, 21 nt, Shigella flexneri 2a str. 2457T
aaagccgccaucucuuccagc

SEQ ID NO: 3837708 - RNA, 18 nt, Shigella flexneri 2a str. 2457T
aaagccgguuuugguuaa

SEQ ID NO: 3837709 - RNA, 21 nt, Shigella flexneri 2a str. 2457T
aaagccucucgcgaggagagg

SEQ ID NO: 3837710 - RNA, 13 nt, Shigella flexneri 2a str. 2457T
aaagccuuucacu

SEQ ID NO: 3837711 - RNA, 15 nt, Shigella flexneri 2a str. 2457T
aaagccuuuugccag

SEQ ID NO: 3837712 - RNA, 13 nt, Shigella flexneri 2a str. 2457T
aaagcgaagcgaa

SEQ ID NO: 3837713 - RNA, 19 nt, Shigella flexneri 2a str. 2457T
aaagcgacuuugccuggcg

SEQ ID NO: 3837714 - RNA, 14 nt, Shigella flexneri 2a str. 2457T
aaauacccaaaaaa

SEQ ID NO: 3837715 - RNA, 17 nt, Shigella flexneri 2a str. 2457T
aaauacccaaaaaauag

SEQ ID NO: 3837716 - RNA, 17 nt, Shigella flexneri 2a str. 2457T
aaauaccgagcagccac

SEQ ID NO: 3837717 - RNA, 20 nt, Shigella flexneri 2a str. 2457T
aaauaccggacacacuucau

SEQ ID NO: 3837718 - RNA, 14 nt, Shigella flexneri 2a str. 2457T
aaauaccguucauu

SEQ ID NO: 3837719 - RNA, 20 nt, Shigella flexneri 2a str. 2457T
aaauacgcuggcugaacauu

SEQ ID NO: 3837720 - RNA, 19 nt, Shigella flexneri 2a str. 2457T
aaauacguaggccugauaa

SEQ ID NO: 3837721 - RNA, 16 nt, Shigella flexneri 2a str. 2457T
aaauacguucucaccu

SEQ ID NO: 3837722 - RNA, 16 nt, Shigella flexneri 2a str. 2457T
aaauacugauguuugu

SEQ ID NO: 3837723 - RNA, 16 nt, Shigella flexneri 2a str. 2457T
aaauacuggcuaagaa

SEQ ID NO: 3837724 - RNA, 17 nt, Shigella flexneri 2a str. 2457T
aaauacuggcuaagaag

SEQ ID NO: 3837725 - RNA, 18 nt, Shigella flexneri 2a str. 2457T
aaauacuggcuaagaagc

SEQ ID NO: 3837726 - RNA, 22 nt, Shigella flexneri 2a str. 2457T
aaauacuguuuaucuucccagc

SEQ ID NO: 3837727 - RNA, 15 nt, Shigella flexneri 2a str. 2457T
aaauagaaagugacu

SEQ ID NO: 3837728 - RNA, 19 nt, Shigella flexneri 2a str. 2457T
aaauagaauggcaucagaa

SEQ ID NO: 3837729 - RNA, 19 nt, Shigella flexneri 2a str. 2457T
aaauagacacaagaaauau

SEQ ID NO: 3837730 - RNA, 23 nt, Shigella flexneri 2a str. 2457T
aaauagagaaaguaaaccaccag

SEQ ID NO: 3837731 - RNA, 15 nt, Shigella flexneri 2a str. 2457T
aaauagcaaaguaau

SEQ ID NO: 3837732 - RNA, 17 nt, Shigella flexneri 2a str. 2457T
aaauagcauaauauaac

SEQ ID NO: 3837733 - RNA, 17 nt, Shigella flexneri 2a str. 2457T
aaauagccaauucccag

SEQ ID NO: 3837734 - RNA, 15 nt, Shigella flexneri 2a str. 2457T
aaauagccagcagag

SEQ ID NO: 3837735 - RNA, 23 nt, Shigella flexneri 2a str. 2457T
aaauagccgagcgcguuaaagaa

SEQ ID NO: 3837736 - RNA, 14 nt, Shigella flexneri 2a str. 2457T
aaauagccugccag

SEQ ID NO: 3837737 - RNA, 15 nt, Shigella flexneri 2a str. 2457T
aaauagcucaaugaa

SEQ ID NO: 3837738 - RNA, 23 nt, Shigella flexneri 2a str. 2457T
aaauaggaauccgggucuguaaa

SEQ ID NO: 3837739 - RNA, 16 nt, Shigella flexneri 2a str. 2457T
aaauauaaaacaacgg

SEQ ID NO: 3837740 - RNA, 11 nt, Shigella flexneri 2a str. 2457T
aaauauauccu

SEQ ID NO: 3837741 - RNA, 12 nt, Shigella flexneri 2a str. 2457T
aaauauauccua

SEQ ID NO: 3837742 - RNA, 23 nt, Shigella flexneri 2a str. 2457T
aaauaucaaagacaaauuuugaa

SEQ ID NO: 3837743 - RNA, 23 nt, Shigella flexneri 2a str. 2457T
aaauaucacucggggcuuuucuc

SEQ ID NO: 3837744 - RNA, 21 nt, Shigella flexneri 2a str. 2457T
aaauauccguagugaaaaagc

SEQ ID NO: 3837745 - RNA, 11 nt, Shigella flexneri 2a str. 2457T
aaauaucugua

SEQ ID NO: 3837746 - RNA, 21 nt, Shigella flexneri 2a str. 2457T
aaauaugggugcaaugagaau

SEQ ID NO: 3837747 - RNA, 17 nt, Shigella flexneri 2a str. 2457T
aaauauggugaaaguaa

SEQ ID NO: 3837748 - RNA, 20 nt, Shigella flexneri 2a str. 2457T
aaauauggugaaaguaaaaa

SEQ ID NO: 3837749 - RNA, 21 nt, Shigella flexneri 2a str. 2457T
aaauauggugaaaguaaaaaa

SEQ ID NO: 3837750 - RNA, 18 nt, Shigella flexneri 2a str. 2457T
aaauauuaagaaaggcag

SEQ ID NO: 3837751 - RNA, 14 nt, Shigella flexneri 2a str. 2457T
aaauauuaauaaua

SEQ ID NO: 3837752 - RNA, 16 nt, Shigella flexneri 2a str. 2457T
aaauauuaauaauaca

SEQ ID NO: 3837753 - RNA, 19 nt, Shigella flexneri 2a str. 2457T
aaaucaaaaaacuggaaaa

SEQ ID NO: 3837754 - RNA, 15 nt, Shigella flexneri 2a str. 2457T
aaaucaaaauaaugu

SEQ ID NO: 3837755 - RNA, 15 nt, Shigella flexneri 2a str. 2457T
aaaucaaacagaaua

SEQ ID NO: 3837756 - RNA, 12 nt, Shigella flexneri 2a str. 2457T
aaaucaaaccaa

SEQ ID NO: 3837757 - RNA, 15 nt, Shigella flexneri 2a str. 2457T
aaaucaacaugaaaa

SEQ ID NO: 3837758 - RNA, 22 nt, Shigella flexneri 2a str. 2457T
aaaucaacgacaaaaauaccac

SEQ ID NO: 3837759 - RNA, 11 nt, Shigella flexneri 2a str. 2457T
aaaucaacgcc

SEQ ID NO: 3837760 - RNA, 15 nt, Shigella flexneri 2a str. 2457T
aaaucaacgccgcau

SEQ ID NO: 3837761 - RNA, 23 nt, Shigella flexneri 2a str. 2457T
aaaucaauccaguguaaaacagc

SEQ ID NO: 3837762 - RNA, 13 nt, Shigella flexneri 2a str. 2457T
aaaucaaugccuu

SEQ ID NO: 3837763 - RNA, 12 nt, Shigella flexneri 2a str. 2457T
aaaucaaugguc

SEQ ID NO: 3837764 - RNA, 11 nt, Shigella flexneri 2a str. 2457T
aaaucaccaca

SEQ ID NO: 3837765 - RNA, 14 nt, Shigella flexneri 2a str. 2457T
aaaucaccaccagc

SEQ ID NO: 3837766 - RNA, 17 nt, Shigella flexneri 2a str. 2457T
aaaucaccaccagcacc

SEQ ID NO: 3837767 - RNA, 18 nt, Shigella flexneri 2a str. 2457T
aaaucaccgccaccagcg

SEQ ID NO: 3837768 - RNA, 13 nt, Shigella flexneri 2a str. 2457T
aaaucacgcaucg

SEQ ID NO: 3837769 - RNA, 20 nt, Shigella flexneri 2a str. 2457T
aaaucacgcugcugauuaaa

SEQ ID NO: 3837770 - RNA, 21 nt, Shigella flexneri 2a str. 2457T
aaaucacgcugcugauuaaaa

SEQ ID NO: 3837771 - RNA, 14 nt, Shigella flexneri 2a str. 2457T
aaaucacgcuucac

SEQ ID NO: 3837772 - RNA, 22 nt, Shigella flexneri 2a str. 2457T
aaaucacuaaacccgaccacuu

SEQ ID NO: 3837773 - RNA, 20 nt, Shigella flexneri 2a str. 2457T
aaaucacuauuaaagaaagu

SEQ ID NO: 3837774 - RNA, 22 nt, Shigella flexneri 2a str. 2457T
aaaucacuauuaaagaaaguaa

SEQ ID NO: 3837775 - RNA, 14 nt, Shigella flexneri 2a str. 2457T
aaaucagaaaucac

SEQ ID NO: 3837776 - RNA, 19 nt, Shigella flexneri 2a str. 2457T
aaaucagaaggguugguga

SEQ ID NO: 3837777 - RNA, 20 nt, Shigella flexneri 2a str. 2457T
aaaucagaucgacgccgaug

SEQ ID NO: 3837778 - RNA, 19 nt, Shigella flexneri 2a str. 2457T
aaaucagguggcuauaaau

SEQ ID NO: 3837779 - RNA, 17 nt, Shigella flexneri 2a str. 2457T
aaaucauauaauuguuc

SEQ ID NO: 3837780 - RNA, 12 nt, Shigella flexneri 2a str. 2457T
aaaucaucaauc

SEQ ID NO: 3837781 - RNA, 19 nt, Shigella flexneri 2a str. 2457T
aaaucaucauugcuguuuu

SEQ ID NO: 3837782 - RNA, 22 nt, Shigella flexneri 2a str. 2457T
aaaucaucauugcuguuuuaca

SEQ ID NO: 3837783 - RNA, 16 nt, Shigella flexneri 2a str. 2457T
aaaucauccagacugc

SEQ ID NO: 3837784 - RNA, 21 nt, Shigella flexneri 2a str. 2457T
aaaucauccagacugcucagc

SEQ ID NO: 3837785 - RNA, 14 nt, Shigella flexneri 2a str. 2457T
aaaucauccagcac

SEQ ID NO: 3837786 - RNA, 14 nt, Shigella flexneri 2a str. 2457T
aaaucauccauccg

SEQ ID NO: 3837787 - RNA, 12 nt, Shigella flexneri 2a str. 2457T
aaaucauccgcu

SEQ ID NO: 3837788 - RNA, 20 nt, Shigella flexneri 2a str. 2457T
aaauccaaccucuucuuuua

SEQ ID NO: 3837789 - RNA, 21 nt, Shigella flexneri 2a str. 2457T
aaauccaccaguggacggcug

SEQ ID NO: 3837790 - RNA, 20 nt, Shigella flexneri 2a str. 2457T
aaauccagcgguugggcauc

SEQ ID NO: 3837791 - RNA, 17 nt, Shigella flexneri 2a str. 2457T
aaaucccagugccugca

SEQ ID NO: 3837792 - RNA, 18 nt, Shigella flexneri 2a str. 2457T
aaaucccagugccugcau

SEQ ID NO: 3837793 - RNA, 13 nt, Shigella flexneri 2a str. 2457T
aaaucccgccauu

SEQ ID NO: 3837794 - RNA, 13 nt, Shigella flexneri 2a str. 2457T
aaaucccgccgcu

SEQ ID NO: 3837795 - RNA, 23 nt, Shigella flexneri 2a str. 2457T
aaaucccgccgcuggcgggauuu

SEQ ID NO: 3837796 - RNA, 14 nt, Shigella flexneri 2a str. 2457T
aaaucccgcugaau

SEQ ID NO: 3837797 - RNA, 12 nt, Shigella flexneri 2a str. 2457T
aaaucccugauc

SEQ ID NO: 3837798 - RNA, 18 nt, Shigella flexneri 2a str. 2457T
aaauccgcacucaucuua

SEQ ID NO: 3837799 - RNA, 13 nt, Shigella flexneri 2a str. 2457T
aaauccgccacuu

SEQ ID NO: 3837800 - RNA, 22 nt, Shigella flexneri 2a str. 2457T
aaauccugucuggcgaauaaua

SEQ ID NO: 3837801 - RNA, 20 nt, Shigella flexneri 2a str. 2457T
aaauccuucacuuuugccag

SEQ ID NO: 3837802 - RNA, 20 nt, Shigella flexneri 2a str. 2457T
aaauccuucagcaacuuguu

SEQ ID NO: 3837803 - RNA, 18 nt, Shigella flexneri 2a str. 2457T
aaaucgauaaaacuuccc

SEQ ID NO: 3837804 - RNA, 20 nt, Shigella flexneri 2a str. 2457T
aaaucgccaacaaucucuuc

SEQ ID NO: 3837805 - RNA, 18 nt, Shigella flexneri 2a str. 2457T
aaaucggugggcugacau

SEQ ID NO: 3837806 - RNA, 16 nt, Shigella flexneri 2a str. 2457T
aaaucgucaaaauuag

SEQ ID NO: 3837807 - RNA, 17 nt, Shigella flexneri 2a str. 2457T
aaaucgucgagggauuu

SEQ ID NO: 3837808 - RNA, 17 nt, Shigella flexneri 2a str. 2457T
aaaucgugaaaaaucaa

SEQ ID NO: 3837809 - RNA, 17 nt, Shigella flexneri 2a str. 2457T
aaaucuauuauuauuuu

SEQ ID NO: 3837810 - RNA, 15 nt, Shigella flexneri 2a str. 2457T
aaaucuauugcaaca

SEQ ID NO: 3837811 - RNA, 22 nt, Shigella flexneri 2a str. 2457T
aaaucucacccgguacaucaau

SEQ ID NO: 3837812 - RNA, 19 nt, Shigella flexneri 2a str. 2457T
aaauugcuguuacgccaga

SEQ ID NO: 3837813 - RNA, 15 nt, Shigella flexneri 2a str. 2457T
aaauugugauaaaaa

SEQ ID NO: 3837814 - RNA, 21 nt, Shigella flexneri 2a str. 2457T
aaauugugauaaaaaucggca

SEQ ID NO: 3837815 - RNA, 18 nt, Shigella flexneri 2a str. 2457T
aaauuguuuuugauuuug

SEQ ID NO: 3837816 - RNA, 20 nt, Shigella flexneri 2a str. 2457T
aaauuguuuuugauuuugca

SEQ ID NO: 3837817 - RNA, 15 nt, Shigella flexneri 2a str. 2457T
aaauuuaauaauaag

SEQ ID NO: 3837818 - RNA, 18 nt, Shigella flexneri 2a str. 2457T
aaauuuagcaaauuuuua

SEQ ID NO: 3837819 - RNA, 21 nt, Shigella flexneri 2a str. 2457T
aaauuuaugcgcuaaauguuu

SEQ ID NO: 3837820 - RNA, 17 nt, Shigella flexneri 2a str. 2457T
aaauuucacugcuuaau

SEQ ID NO: 3837821 - RNA, 12 nt, Shigella flexneri 2a str. 2457T
aaauuucuccuu

SEQ ID NO: 3837822 - RNA, 15 nt, Shigella flexneri 2a str. 2457T
aaauuucuucccuuu

SEQ ID NO: 3837823 - RNA, 16 nt, Shigella flexneri 2a str. 2457T
aaauuucuucccuuuc

SEQ ID NO: 3837824 - RNA, 18 nt, Shigella flexneri 2a str. 2457T
aaauuucuucccuuucug

SEQ ID NO: 3837825 - RNA, 17 nt, Shigella flexneri 2a str. 2457T
aaauuugcggauaaagc

SEQ ID NO: 3837826 - RNA, 16 nt, Shigella flexneri 2a str. 2457T
aaauuuugcaucgucc

SEQ ID NO: 3837827 - RNA, 11 nt, Shigella flexneri 2a str. 2457T
aaauuuuuccg

SEQ ID NO: 3837828 - RNA, 18 nt, Shigella flexneri 2a str. 2457T
aaauuuuuccguuuucca

SEQ ID NO: 3837829 - RNA, 21 nt, Shigella flexneri 2a str. 2457T
aacaaaacucaacgguccaau

SEQ ID NO: 3837830 - RNA, 13 nt, Shigella flexneri 2a str. 2457T
aacaaaaucuucu

SEQ ID NO: 3837831 - RNA, 16 nt, Shigella flexneri 2a str. 2457T
aacaaaaucuucuaac

SEQ ID NO: 3837832 - RNA, 21 nt, Shigella flexneri 2a str. 2457T
aacaaacagcgcgccagccac

SEQ ID NO: 3837833 - RNA, 12 nt, Shigella flexneri 2a str. 2457T
aacaaacaguac

SEQ ID NO: 3837834 - RNA, 15 nt, Shigella flexneri 2a str. 2457T
aacaaacgcaaacac

SEQ ID NO: 3837835 - RNA, 14 nt, Shigella flexneri 2a str. 2457T
aacaaagaaauguu

SEQ ID NO: 3837836 - RNA, 18 nt, Shigella flexneri 2a str. 2457T
aacaaagaacgccauaaa

SEQ ID NO: 3837837 - RNA, 22 nt, Shigella flexneri 2a str. 2457T
aacaaagcgacccgccuugaua

SEQ ID NO: 3837838 - RNA, 14 nt, Shigella flexneri 2a str. 2457T
aacaaagcgcaccu

SEQ ID NO: 3837839 - RNA, 17 nt, Shigella flexneri 2a str. 2457T
aacaaaguuugcaacuu

SEQ ID NO: 3837840 - RNA, 14 nt, Shigella flexneri 2a str. 2457T
aacaaauaaaagca

SEQ ID NO: 3837841 - RNA, 12 nt, Shigella flexneri 2a str. 2457T
aacaaauuuuuc

SEQ ID NO: 3837842 - RNA, 19 nt, Shigella flexneri 2a str. 2457T
aacaacagaucaacauacu

SEQ ID NO: 3837843 - RNA, 19 nt, Shigella flexneri 2a str. 2457T
aacaacagcgauuauggau

SEQ ID NO: 3837844 - RNA, 21 nt, Shigella flexneri 2a str. 2457T
aacaacagcgauuauggauca

SEQ ID NO: 3837845 - RNA, 19 nt, Shigella flexneri 2a str. 2457T
aacaacccuaaagcaccca

SEQ ID NO: 3837846 - RNA, 21 nt, Shigella flexneri 2a str. 2457T
aacaacccuaaagcacccagc

SEQ ID NO: 3837847 - RNA, 20 nt, Shigella flexneri 2a str. 2457T
aacaaccgaugaacuggcuu

SEQ ID NO: 3837848 - RNA, 18 nt, Shigella flexneri 2a str. 2457T
aacaacgagccaauaaaa

SEQ ID NO: 3837849 - RNA, 20 nt, Shigella flexneri 2a str. 2457T
aacaacgccucguaaugcuc

SEQ ID NO: 3837850 - RNA, 21 nt, Shigella flexneri 2a str. 2457T
aacaacggcaaacacgcagcc

SEQ ID NO: 3837851 - RNA, 21 nt, Shigella flexneri 2a str. 2457T
aacaacgugugcuuuguucau

SEQ ID NO: 3837852 - RNA, 20 nt, Shigella flexneri 2a str. 2457T
aacaagccaguccagaaaug

SEQ ID NO: 3837853 - RNA, 12 nt, Shigella flexneri 2a str. 2457T
aacaagcgaauu

SEQ ID NO: 3837854 - RNA, 16 nt, Shigella flexneri 2a str. 2457T
aacaagcguacaaaau

SEQ ID NO: 3837855 - RNA, 18 nt, Shigella flexneri 2a str. 2457T
aacaauaaaaccaguaau

SEQ ID NO: 3837856 - RNA, 16 nt, Shigella flexneri 2a str. 2457T
aacaauacaaaugccu

SEQ ID NO: 3837857 - RNA, 13 nt, Shigella flexneri 2a str. 2457T
aacaauacaucuu

SEQ ID NO: 3837858 - RNA, 14 nt, Shigella flexneri 2a str. 2457T
aacaauagguuaua

SEQ ID NO: 3837859 - RNA, 14 nt, Shigella flexneri 2a str. 2457T
aacaauauuaacuc

SEQ ID NO: 3837860 - RNA, 18 nt, Shigella flexneri 2a str. 2457T
aacaaucacaauagaaau

SEQ ID NO: 3837861 - RNA, 18 nt, Shigella flexneri 2a str. 2457T
aacaaucucuuccagaau

SEQ ID NO: 3837862 - RNA, 23 nt, Shigella flexneri 2a str. 2457T
aacaaugagauauuuaaaugauu

SEQ ID NO: 3837863 - RNA, 17 nt, Shigella flexneri 2a str. 2457T
aacaaugccgauaaaua

SEQ ID NO: 3837864 - RNA, 19 nt, Shigella flexneri 2a str. 2457T
aacaaugccgauaaauaca

SEQ ID NO: 3837865 - RNA, 12 nt, Shigella flexneri 2a str. 2457T
aacaaugcguuu

SEQ ID NO: 3837866 - RNA, 14 nt, Shigella flexneri 2a str. 2457T
aacaauguuauccg

SEQ ID NO: 3837867 - RNA, 18 nt, Shigella flexneri 2a str. 2457T
aacaauguuauccggcua

SEQ ID NO: 3837868 - RNA, 22 nt, Shigella flexneri 2a str. 2457T
aacaauucccgcagcuccagcc

SEQ ID NO: 3837869 - RNA, 16 nt, Shigella flexneri 2a str. 2457T
aacaauugaagaauau

SEQ ID NO: 3837870 - RNA, 16 nt, Shigella flexneri 2a str. 2457T
aacaauuucuucuggu

SEQ ID NO: 3837871 - RNA, 18 nt, Shigella flexneri 2a str. 2457T
aacacaacgcuuucaaca

SEQ ID NO: 3837872 - RNA, 15 nt, Shigella flexneri 2a str. 2457T
aacacaauauucaua

SEQ ID NO: 3837873 - RNA, 14 nt, Shigella flexneri 2a str. 2457T
aacacacauuuauc

SEQ ID NO: 3837874 - RNA, 22 nt, Shigella flexneri 2a str. 2457T
aacacacuuuccaguuccggca

SEQ ID NO: 3837875 - RNA, 20 nt, Shigella flexneri 2a str. 2457T
aacacauaaccguacaaucg

SEQ ID NO: 3837876 - RNA, 24 nt, Shigella flexneri 2a str. 2457T
aacacauauauuaauugccguuaa

SEQ ID NO: 3837877 - RNA, 15 nt, Shigella flexneri 2a str. 2457T
aacacauccaguggc

SEQ ID NO: 3837878 - RNA, 19 nt, Shigella flexneri 2a str. 2457T
aacacauugugaaugauca

SEQ ID NO: 3837879 - RNA, 14 nt, Shigella flexneri 2a str. 2457T
aacaccaaacccug

SEQ ID NO: 3837880 - RNA, 13 nt, Shigella flexneri 2a str. 2457T
aacaccagcagua

SEQ ID NO: 3837881 - RNA, 13 nt, Shigella flexneri 2a str. 2457T
aacaccagccaga

SEQ ID NO: 3837882 - RNA, 12 nt, Shigella flexneri 2a str. 2457T
aacaccauaaug

SEQ ID NO: 3837883 - RNA, 22 nt, Shigella flexneri 2a str. 2457T
aacaccauaucuaugguuuuuu

SEQ ID NO: 3837884 - RNA, 18 nt, Shigella flexneri 2a str. 2457T
aacaccaucauauuuucc

SEQ ID NO: 3837885 - RNA, 20 nt, Shigella flexneri 2a str. 2457T
aacaccaucauauuuuccau

SEQ ID NO: 3837886 - RNA, 22 nt, Shigella flexneri 2a str. 2457T
aacacccauggggaugcugcag

SEQ ID NO: 3837887 - RNA, 21 nt, Shigella flexneri 2a str. 2457T
aacacccgaccaucaacuaaa

SEQ ID NO: 3837888 - RNA, 22 nt, Shigella flexneri 2a str. 2457T
aacaccgauuuuguaaaagaag

SEQ ID NO: 3837889 - RNA, 18 nt, Shigella flexneri 2a str. 2457T
aacaccgcuucaacagcg

SEQ ID NO: 3837890 - RNA, 12 nt, Shigella flexneri 2a str. 2457T
aacaccgggugc

SEQ ID NO: 3837891 - RNA, 15 nt, Shigella flexneri 2a str. 2457T
aacaccuaccggcug

SEQ ID NO: 3837892 - RNA, 12 nt, Shigella flexneri 2a str. 2457T
aacaccuggcgc

SEQ ID NO: 3837893 - RNA, 18 nt, Shigella flexneri 2a str. 2457T
aacaccugggcaauggug

SEQ ID NO: 3837894 - RNA, 15 nt, Shigella flexneri 2a str. 2457T
aacaccuguugcgcg

SEQ ID NO: 3837895 - RNA, 19 nt, Shigella flexneri 2a str. 2457T
aacaccuucauccagcauc

SEQ ID NO: 3837896 - RNA, 12 nt, Shigella flexneri 2a str. 2457T
aacacgccgaua

SEQ ID NO: 3837897 - RNA, 19 nt, Shigella flexneri 2a str. 2457T
aacacgcgaccaaaggcga

SEQ ID NO: 3837898 - RNA, 17 nt, Shigella flexneri 2a str. 2457T
aacacgcucccagcaga

SEQ ID NO: 3837899 - RNA, 21 nt, Shigella flexneri 2a str. 2457T
aacacggaucaggcggcucac

SEQ ID NO: 3837900 - RNA, 18 nt, Shigella flexneri 2a str. 2457T
aacacguugcacuagguu

SEQ ID NO: 3837901 - RNA, 13 nt, Shigella flexneri 2a str. 2457T
aacacucgcugug

SEQ ID NO: 3837902 - RNA, 22 nt, Shigella flexneri 2a str. 2457T
aacacucgugcgucgcauccgg

SEQ ID NO: 3837903 - RNA, 14 nt, Shigella flexneri 2a str. 2457T
aacacucuuuuuga

SEQ ID NO: 3837904 - RNA, 21 nt, Shigella flexneri 2a str. 2457T
aacacugcgcucuucuggcac

SEQ ID NO: 3837905 - RNA, 19 nt, Shigella flexneri 2a str. 2457T
aacacuuuacgcuuuuuga

SEQ ID NO: 3837906 - RNA, 20 nt, Shigella flexneri 2a str. 2457T
aacacuuugccgucagccac

SEQ ID NO: 3837907 - RNA, 16 nt, Shigella flexneri 2a str. 2457T
aacagaacaauaauaa

SEQ ID NO: 3837908 - RNA, 23 nt, Shigella flexneri 2a str. 2457T
aacagaacgcgccuuaaaaacca

SEQ ID NO: 3837909 - RNA, 15 nt, Shigella flexneri 2a str. 2457T
aaccacaaccacuuu

SEQ ID NO: 3837910 - RNA, 14 nt, Shigella flexneri 2a str. 2457T
aaccacaaugucac

SEQ ID NO: 3837911 - RNA, 13 nt, Shigella flexneri 2a str. 2457T
aaccacagcgccg

SEQ ID NO: 3837912 - RNA, 13 nt, Shigella flexneri 2a str. 2457T
aaccacaucaauc

SEQ ID NO: 3837913 - RNA, 13 nt, Shigella flexneri 2a str. 2457T
aaccacauucagc

SEQ ID NO: 3837914 - RNA, 14 nt, Shigella flexneri 2a str. 2457T
aaccaccaaacugc

SEQ ID NO: 3837915 - RNA, 14 nt, Shigella flexneri 2a str. 2457T
aaccacccaccagc

SEQ ID NO: 3837916 - RNA, 14 nt, Shigella flexneri 2a str. 2457T
aaccacccagcagc

SEQ ID NO: 3837917 - RNA, 20 nt, Shigella flexneri 2a str. 2457T
aaccaccccaccuuaccugu

SEQ ID NO: 3837918 - RNA, 20 nt, Shigella flexneri 2a str. 2457T
aaccaccgucgucccuuccg

SEQ ID NO: 3837919 - RNA, 21 nt, Shigella flexneri 2a str. 2457T
aaccaccuccacgcccagcgc

SEQ ID NO: 3837920 - RNA, 18 nt, Shigella flexneri 2a str. 2457T
aaccacgacuuuuugucu

SEQ ID NO: 3837921 - RNA, 23 nt, Shigella flexneri 2a str. 2457T
aaccacgccuaaaauccacaucg

SEQ ID NO: 3837922 - RNA, 15 nt, Shigella flexneri 2a str. 2457T
aaccacggcagcaac

SEQ ID NO: 3837923 - RNA, 19 nt, Shigella flexneri 2a str. 2457T
aaccacuauuauggcgcag

SEQ ID NO: 3837924 - RNA, 17 nt, Shigella flexneri 2a str. 2457T
aaccacucaccgccguu

SEQ ID NO: 3837925 - RNA, 20 nt, Shigella flexneri 2a str. 2457T
aaccagaaagggaagaacau

SEQ ID NO: 3837926 - RNA, 15 nt, Shigella flexneri 2a str. 2457T
aaccagagaauauua

SEQ ID NO: 3837927 - RNA, 17 nt, Shigella flexneri 2a str. 2457T
aaccagagaaucugcgu

SEQ ID NO: 3837928 - RNA, 13 nt, Shigella flexneri 2a str. 2457T
aaccagagacaga

SEQ ID NO: 3837929 - RNA, 17 nt, Shigella flexneri 2a str. 2457T
aaccagagacagaccaa

SEQ ID NO: 3837930 - RNA, 21 nt, Shigella flexneri 2a str. 2457T
aaccagagagcuuauccagca

SEQ ID NO: 3837931 - RNA, 15 nt, Shigella flexneri 2a str. 2457T
aaccagaucggacuu

SEQ ID NO: 3837932 - RNA, 20 nt, Shigella flexneri 2a str. 2457T
aaccagcacuucgccaucug

SEQ ID NO: 3837933 - RNA, 14 nt, Shigella flexneri 2a str. 2457T
aaccagcaggcugg

SEQ ID NO: 3837934 - RNA, 16 nt, Shigella flexneri 2a str. 2457T
aaccagcgcagacacc

SEQ ID NO: 3837935 - RNA, 18 nt, Shigella flexneri 2a str. 2457T
aaccagcgcagacaccag

SEQ ID NO: 3837936 - RNA, 14 nt, Shigella flexneri 2a str. 2457T
aaccagcgucagcc

SEQ ID NO: 3837937 - RNA, 21 nt, Shigella flexneri 2a str. 2457T
aaccagcguuuccagcaccag

SEQ ID NO: 3837938 - RNA, 23 nt, Shigella flexneri 2a str. 2457T
aaccagcguuuccagcaccaguu

SEQ ID NO: 3837939 - RNA, 21 nt, Shigella flexneri 2a str. 2457T
aaccagcuuaugccuguccuc

SEQ ID NO: 3837940 - RNA, 22 nt, Shigella flexneri 2a str. 2457T
aaccaggaagauguacgccagu

SEQ ID NO: 3837941 - RNA, 18 nt, Shigella flexneri 2a str. 2457T
aaccaggcgagaucggca

SEQ ID NO: 3837942 - RNA, 19 nt, Shigella flexneri 2a str. 2457T
aaccagggaaaaaagcccc

SEQ ID NO: 3837943 - RNA, 15 nt, Shigella flexneri 2a str. 2457T
aaccaguaaugaucg

SEQ ID NO: 3837944 - RNA, 22 nt, Shigella flexneri 2a str. 2457T
aaccagugccaaaccagaugaa

SEQ ID NO: 3837945 - RNA, 23 nt, Shigella flexneri 2a str. 2457T
aaccagugccaaaccagaugaau

SEQ ID NO: 3837946 - RNA, 20 nt, Shigella flexneri 2a str. 2457T
aaccaguugugcaccaccaa

SEQ ID NO: 3837947 - RNA, 15 nt, Shigella flexneri 2a str. 2457T
aaccauaaaaucaca

SEQ ID NO: 3837948 - RNA, 15 nt, Shigella flexneri 2a str. 2457T
aaccauccuaaaaaa

SEQ ID NO: 3837949 - RNA, 19 nt, Shigella flexneri 2a str. 2457T
aaccauccuaaaaaagcau

SEQ ID NO: 3837950 - RNA, 21 nt, Shigella flexneri 2a str. 2457T
aaccaucgagaaucagcgaga

SEQ ID NO: 3837951 - RNA, 17 nt, Shigella flexneri 2a str. 2457T
aaccaucgguacgcuuu

SEQ ID NO: 3837952 - RNA, 19 nt, Shigella flexneri 2a str. 2457T
aaccaugucgcauccgaca

SEQ ID NO: 3837953 - RNA, 14 nt, Shigella flexneri 2a str. 2457T
aaccauuucugcga

SEQ ID NO: 3837954 - RNA, 21 nt, Shigella flexneri 2a str. 2457T
aaccauuuguucguguuaaca

SEQ ID NO: 3837955 - RNA, 17 nt, Shigella flexneri 2a str. 2457T
aacccaacggcaaacau

SEQ ID NO: 3837956 - RNA, 14 nt, Shigella flexneri 2a str. 2457T
aacccaacguuacu

SEQ ID NO: 3837957 - RNA, 22 nt, Shigella flexneri 2a str. 2457T
aacccaacguucguacugcccu

SEQ ID NO: 3837958 - RNA, 12 nt, Shigella flexneri 2a str. 2457T
aacccacacauu

SEQ ID NO: 3837959 - RNA, 14 nt, Shigella flexneri 2a str. 2457T
aacccacacauuuc

SEQ ID NO: 3837960 - RNA, 17 nt, Shigella flexneri 2a str. 2457T
aacccaccaugccgaug

SEQ ID NO: 3837961 - RNA, 17 nt, Shigella flexneri 2a str. 2457T
aacccagccgccggaua

SEQ ID NO: 3837962 - RNA, 20 nt, Shigella flexneri 2a str. 2457T
aacccagggccaacuggcaa

SEQ ID NO: 3837963 - RNA, 18 nt, Shigella flexneri 2a str. 2457T
aacccaucaagcgaaaau

SEQ ID NO: 3837964 - RNA, 22 nt, Shigella flexneri 2a str. 2457T
aacccaugccggaugcgccagc

SEQ ID NO: 3837965 - RNA, 17 nt, Shigella flexneri 2a str. 2457T
aaccccggcaaaugucg

SEQ ID NO: 3837966 - RNA, 21 nt, Shigella flexneri 2a str. 2457T
aaccccuuucuaugguuuuga

SEQ ID NO: 3837967 - RNA, 16 nt, Shigella flexneri 2a str. 2457T
aacccgaccacuucca

SEQ ID NO: 3837968 - RNA, 17 nt, Shigella flexneri 2a str. 2457T
aacccgcagcuuaauga

SEQ ID NO: 3837969 - RNA, 13 nt, Shigella flexneri 2a str. 2457T
aacccgccagacc

SEQ ID NO: 3837970 - RNA, 19 nt, Shigella flexneri 2a str. 2457T
aacccgccagaccagcuac

SEQ ID NO: 3837971 - RNA, 23 nt, Shigella flexneri 2a str. 2457T
aacccgccaguuugucuggcaau

SEQ ID NO: 3837972 - RNA, 18 nt, Shigella flexneri 2a str. 2457T
aacccgcccagugccgag

SEQ ID NO: 3837973 - RNA, 16 nt, Shigella flexneri 2a str. 2457T
aacccgcucaaacacc

SEQ ID NO: 3837974 - RNA, 18 nt, Shigella flexneri 2a str. 2457T
aacccgcucauaauacag

SEQ ID NO: 3837975 - RNA, 14 nt, Shigella flexneri 2a str. 2457T
aacccgcugccauc

SEQ ID NO: 3837976 - RNA, 17 nt, Shigella flexneri 2a str. 2457T
aacccggcaccaacaaa

SEQ ID NO: 3837977 - RNA, 23 nt, Shigella flexneri 2a str. 2457T
aacccggccugcucccgaaccuu

SEQ ID NO: 3837978 - RNA, 17 nt, Shigella flexneri 2a str. 2457T
aacccuaacccaacauu

SEQ ID NO: 3837979 - RNA, 18 nt, Shigella flexneri 2a str. 2457T
aacccuaccagcugccac

SEQ ID NO: 3837980 - RNA, 22 nt, Shigella flexneri 2a str. 2457T
aacccugagugaauuguuuuau

SEQ ID NO: 3837981 - RNA, 22 nt, Shigella flexneri 2a str. 2457T
aacccugauuucgugauuguug

SEQ ID NO: 3837982 - RNA, 11 nt, Shigella flexneri 2a str. 2457T
aacccugcaga

SEQ ID NO: 3837983 - RNA, 14 nt, Shigella flexneri 2a str. 2457T
aacccuucuuccau

SEQ ID NO: 3837984 - RNA, 21 nt, Shigella flexneri 2a str. 2457T
aacccuugcguuucugacucu

SEQ ID NO: 3837985 - RNA, 16 nt, Shigella flexneri 2a str. 2457T
aaccgaacccagcagg

SEQ ID NO: 3837986 - RNA, 15 nt, Shigella flexneri 2a str. 2457T
aaccgaaggcaccau

SEQ ID NO: 3837987 - RNA, 18 nt, Shigella flexneri 2a str. 2457T
aaccgagguuaaugaucg

SEQ ID NO: 3837988 - RNA, 14 nt, Shigella flexneri 2a str. 2457T
aaccgaugaacugg

SEQ ID NO: 3837989 - RNA, 15 nt, Shigella flexneri 2a str. 2457T
aaccgaugaacuggc

SEQ ID NO: 3837990 - RNA, 21 nt, Shigella flexneri 2a str. 2457T
aaccgcaaaugauuagugcca

SEQ ID NO: 3837991 - RNA, 20 nt, Shigella flexneri 2a str. 2457T
aaccgcaccaggcaguuuau

SEQ ID NO: 3837992 - RNA, 15 nt, Shigella flexneri 2a str. 2457T
aaccgcagugauuuc

SEQ ID NO: 3837993 - RNA, 18 nt, Shigella flexneri 2a str. 2457T
aaccgcaguguaguucug

SEQ ID NO: 3837994 - RNA, 23 nt, Shigella flexneri 2a str. 2457T
aaccgcaguguaguucuggccuu

SEQ ID NO: 3837995 - RNA, 17 nt, Shigella flexneri 2a str. 2457T
aaccgcauccagauucu

SEQ ID NO: 3837996 - RNA, 22 nt, Shigella flexneri 2a str. 2457T
aaccgccaguaaucuggccaau

SEQ ID NO: 3837997 - RNA, 16 nt, Shigella flexneri 2a str. 2457T
aaccgccaucauggau

SEQ ID NO: 3837998 - RNA, 20 nt, Shigella flexneri 2a str. 2457T
aaccgcccagaccugcguuc

SEQ ID NO: 3837999 - RNA, 22 nt, Shigella flexneri 2a str. 2457T
aaccgcccagugccagcaccac

SEQ ID NO: 3838000 - RNA, 17 nt, Shigella flexneri 2a str. 2457T
aaccgccucaggcaaca

SEQ ID NO: 3838001 - RNA, 19 nt, Shigella flexneri 2a str. 2457T
aaccgccugcgaguuuuac

SEQ ID NO: 3838002 - RNA, 21 nt, Shigella flexneri 2a str. 2457T
aaccgccugcgaguuuuaccu

SEQ ID NO: 3838003 - RNA, 13 nt, Shigella flexneri 2a str. 2457T
aaccgccuggcgc

SEQ ID NO: 3838004 - RNA, 15 nt, Shigella flexneri 2a str. 2457T
aaccgcugcaaaaaa

SEQ ID NO: 3838005 - RNA, 19 nt, Shigella flexneri 2a str. 2457T
aaccggaccagcaacaaau

SEQ ID NO: 3838006 - RNA, 18 nt, Shigella flexneri 2a str. 2457T
aacgccuuauccggccua

SEQ ID NO: 3838007 - RNA, 20 nt, Shigella flexneri 2a str. 2457T
aacgccuuauccggccuaca

SEQ ID NO: 3838008 - RNA, 21 nt, Shigella flexneri 2a str. 2457T
aacgccuuauccggccuaccg

SEQ ID NO: 3838009 - RNA, 22 nt, Shigella flexneri 2a str. 2457T
aacgccuuauccggccuggaug

SEQ ID NO: 3838010 - RNA, 16 nt, Shigella flexneri 2a str. 2457T
aacgccuuauccggcu

SEQ ID NO: 3838011 - RNA, 21 nt, Shigella flexneri 2a str. 2457T
aacgccuuccgucagcaaagu

SEQ ID NO: 3838012 - RNA, 19 nt, Shigella flexneri 2a str. 2457T
aacgccuuucgcuguaaac

SEQ ID NO: 3838013 - RNA, 20 nt, Shigella flexneri 2a str. 2457T
aacgcgaaggccagaaccac

SEQ ID NO: 3838014 - RNA, 16 nt, Shigella flexneri 2a str. 2457T
aacgcgaccgccgcca

SEQ ID NO: 3838015 - RNA, 19 nt, Shigella flexneri 2a str. 2457T
aacgcgaucgacgcgucca

SEQ ID NO: 3838016 - RNA, 15 nt, Shigella flexneri 2a str. 2457T
aacgcgcaaccagca

SEQ ID NO: 3838017 - RNA, 13 nt, Shigella flexneri 2a str. 2457T
aacgcgccaagau

SEQ ID NO: 3838018 - RNA, 23 nt, Shigella flexneri 2a str. 2457T
aacgcgccaagauagaaccacgc

SEQ ID NO: 3838019 - RNA, 20 nt, Shigella flexneri 2a str. 2457T
aacgcgcccucagcccacau

SEQ ID NO: 3838020 - RNA, 20 nt, Shigella flexneri 2a str. 2457T
aacgcgcuacugaaucccug

SEQ ID NO: 3838021 - RNA, 14 nt, Shigella flexneri 2a str. 2457T
aacgcggcccaggc

SEQ ID NO: 3838022 - RNA, 15 nt, Shigella flexneri 2a str. 2457T
aacgcggcccaggcg

SEQ ID NO: 3838023 - RNA, 15 nt, Shigella flexneri 2a str. 2457T
aacgcguacccagca

SEQ ID NO: 3838024 - RNA, 14 nt, Shigella flexneri 2a str. 2457T
aacgcguucacugc

SEQ ID NO: 3838025 - RNA, 15 nt, Shigella flexneri 2a str. 2457T
aacgcguucacugcc

SEQ ID NO: 3838026 - RNA, 23 nt, Shigella flexneri 2a str. 2457T
aacgcguucacugccguacaggc

SEQ ID NO: 3838027 - RNA, 20 nt, Shigella flexneri 2a str. 2457T
aacgcucggcaacaccucag

SEQ ID NO: 3838028 - RNA, 18 nt, Shigella flexneri 2a str. 2457T
aacgcugacggugccagg

SEQ ID NO: 3838029 - RNA, 14 nt, Shigella flexneri 2a str. 2457T
aacgcuggcagcau

SEQ ID NO: 3838030 - RNA, 12 nt, Shigella flexneri 2a str. 2457T
aacgcuggugag

SEQ ID NO: 3838031 - RNA, 21 nt, Shigella flexneri 2a str. 2457T
aacgcuguccggcgcacuggu

SEQ ID NO: 3838032 - RNA, 18 nt, Shigella flexneri 2a str. 2457T
aacgcugugcguaaucgc

SEQ ID NO: 3838033 - RNA, 15 nt, Shigella flexneri 2a str. 2457T
aacgcuuaaaacgcu

SEQ ID NO: 3838034 - RNA, 15 nt, Shigella flexneri 2a str. 2457T
aacgcuucucccagc

SEQ ID NO: 3838035 - RNA, 18 nt, Shigella flexneri 2a str. 2457T
aacgcuucucccagccgc

SEQ ID NO: 3838036 - RNA, 20 nt, Shigella flexneri 2a str. 2457T
aacgcuuguaaaugaacuca

SEQ ID NO: 3838037 - RNA, 19 nt, Shigella flexneri 2a str. 2457T
aacgcuuucucaccaugac

SEQ ID NO: 3838038 - RNA, 22 nt, Shigella flexneri 2a str. 2457T
aacgcuuucucaccaugaccga

SEQ ID NO: 3838039 - RNA, 14 nt, Shigella flexneri 2a str. 2457T
aacgcuuucuuugg

SEQ ID NO: 3838040 - RNA, 20 nt, Shigella flexneri 2a str. 2457T
aacgcuuucuuuggcaucaa

SEQ ID NO: 3838041 - RNA, 17 nt, Shigella flexneri 2a str. 2457T
aacgcuuuugcaucggc

SEQ ID NO: 3838042 - RNA, 13 nt, Shigella flexneri 2a str. 2457T
aacggaccaauaa

SEQ ID NO: 3838043 - RNA, 15 nt, Shigella flexneri 2a str. 2457T
aacggacgaccgauu

SEQ ID NO: 3838044 - RNA, 17 nt, Shigella flexneri 2a str. 2457T
aacggaugcagcaucau

SEQ ID NO: 3838045 - RNA, 20 nt, Shigella flexneri 2a str. 2457T
aacggauucagugagcacau

SEQ ID NO: 3838046 - RNA, 22 nt, Shigella flexneri 2a str. 2457T
aacggcaaaccggacgaucgga

SEQ ID NO: 3838047 - RNA, 14 nt, Shigella flexneri 2a str. 2457T
aacggcaaacgcaa

SEQ ID NO: 3838048 - RNA, 21 nt, Shigella flexneri 2a str. 2457T
aacggcaagaucagcauccau

SEQ ID NO: 3838049 - RNA, 18 nt, Shigella flexneri 2a str. 2457T
aacggcacgacacugcug

SEQ ID NO: 3838050 - RNA, 18 nt, Shigella flexneri 2a str. 2457T
aacggcacgauaaauggc

SEQ ID NO: 3838051 - RNA, 17 nt, Shigella flexneri 2a str. 2457T
aacggcacggaaagcag

SEQ ID NO: 3838052 - RNA, 22 nt, Shigella flexneri 2a str. 2457T
aacggcacggaaagcagcauac

SEQ ID NO: 3838053 - RNA, 13 nt, Shigella flexneri 2a str. 2457T
aacggcagagaaa

SEQ ID NO: 3838054 - RNA, 22 nt, Shigella flexneri 2a str. 2457T
aacggcagagaaaccacaucaa

SEQ ID NO: 3838055 - RNA, 18 nt, Shigella flexneri 2a str. 2457T
aacggcauuauucaucug

SEQ ID NO: 3838056 - RNA, 17 nt, Shigella flexneri 2a str. 2457T
aacggccaaaguacgga

SEQ ID NO: 3838057 - RNA, 18 nt, Shigella flexneri 2a str. 2457T
aacggccaaauauccgcg

SEQ ID NO: 3838058 - RNA, 17 nt, Shigella flexneri 2a str. 2457T
aacggccugaccauuac

SEQ ID NO: 3838059 - RNA, 17 nt, Shigella flexneri 2a str. 2457T
aacggcgguuucgcaaa

SEQ ID NO: 3838060 - RNA, 21 nt, Shigella flexneri 2a str. 2457T
aacggcgguuucgcaaaccaa

SEQ ID NO: 3838061 - RNA, 21 nt, Shigella flexneri 2a str. 2457T
aacggcguuuucucaucgcug

SEQ ID NO: 3838062 - RNA, 18 nt, Shigella flexneri 2a str. 2457T
aacggcugauaacaauau

SEQ ID NO: 3838063 - RNA, 18 nt, Shigella flexneri 2a str. 2457T
aacgggauuccugcgcuu

SEQ ID NO: 3838064 - RNA, 18 nt, Shigella flexneri 2a str. 2457T
aacgggcaaucucauacc

SEQ ID NO: 3838065 - RNA, 21 nt, Shigella flexneri 2a str. 2457T
aacgggcaggguggugacacc

SEQ ID NO: 3838066 - RNA, 22 nt, Shigella flexneri 2a str. 2457T
aacgggcuguauacgcgccaca

SEQ ID NO: 3838067 - RNA, 23 nt, Shigella flexneri 2a str. 2457T
aacggggguuuuacuuuuuaacu

SEQ ID NO: 3838068 - RNA, 19 nt, Shigella flexneri 2a str. 2457T
aacgggugauuaaagaaaa

SEQ ID NO: 3838069 - RNA, 16 nt, Shigella flexneri 2a str. 2457T
aacggguuaaauccug

SEQ ID NO: 3838070 - RNA, 12 nt, Shigella flexneri 2a str. 2457T
aacgguaucuuu

SEQ ID NO: 3838071 - RNA, 13 nt, Shigella flexneri 2a str. 2457T
aacggucacggcu

SEQ ID NO: 3838072 - RNA, 16 nt, Shigella flexneri 2a str. 2457T
aacggucccucaacaa

SEQ ID NO: 3838073 - RNA, 18 nt, Shigella flexneri 2a str. 2457T
aacggucgccgcgcaaau

SEQ ID NO: 3838074 - RNA, 22 nt, Shigella flexneri 2a str. 2457T
aacggucgccgcgcaaauccac

SEQ ID NO: 3838075 - RNA, 18 nt, Shigella flexneri 2a str. 2457T
aacggugcgaccaaacug

SEQ ID NO: 3838076 - RNA, 22 nt, Shigella flexneri 2a str. 2457T
aacggugcggcucucuuucucc

SEQ ID NO: 3838077 - RNA, 15 nt, Shigella flexneri 2a str. 2457T
aacggugucgauacc

SEQ ID NO: 3838078 - RNA, 15 nt, Shigella flexneri 2a str. 2457T
aacguaaacgcagca

SEQ ID NO: 3838079 - RNA, 22 nt, Shigella flexneri 2a str. 2457T
aacguaaacgcagcaucaugcc

SEQ ID NO: 3838080 - RNA, 14 nt, Shigella flexneri 2a str. 2457T
aacguaacaaaacu

SEQ ID NO: 3838081 - RNA, 17 nt, Shigella flexneri 2a str. 2457T
aacguaacacauaacgc

SEQ ID NO: 3838082 - RNA, 16 nt, Shigella flexneri 2a str. 2457T
aacguaacaguacaau

SEQ ID NO: 3838083 - RNA, 14 nt, Shigella flexneri 2a str. 2457T
aacguacugcugaa

SEQ ID NO: 3838084 - RNA, 16 nt, Shigella flexneri 2a str. 2457T
aacguaggcacauucg

SEQ ID NO: 3838085 - RNA, 15 nt, Shigella flexneri 2a str. 2457T
aacgucccccagauc

SEQ ID NO: 3838086 - RNA, 22 nt, Shigella flexneri 2a str. 2457T
aacgucgcaagacgaaaaauga

SEQ ID NO: 3838087 - RNA, 15 nt, Shigella flexneri 2a str. 2457T
aacgucgcaucugac

SEQ ID NO: 3838088 - RNA, 12 nt, Shigella flexneri 2a str. 2457T
aacgucuucccg

SEQ ID NO: 3838089 - RNA, 13 nt, Shigella flexneri 2a str. 2457T
aacgucuugcuga

SEQ ID NO: 3838090 - RNA, 14 nt, Shigella flexneri 2a str. 2457T
aacgugacauucug

SEQ ID NO: 3838091 - RNA, 19 nt, Shigella flexneri 2a str. 2457T
aacgugcaaaaucaaacag

SEQ ID NO: 3838092 - RNA, 12 nt, Shigella flexneri 2a str. 2457T
aacgugcagcuu

SEQ ID NO: 3838093 - RNA, 21 nt, Shigella flexneri 2a str. 2457T
aacgugcagguuuuguagguc

SEQ ID NO: 3838094 - RNA, 20 nt, Shigella flexneri 2a str. 2457T
aacgugcggggguuuucucu

SEQ ID NO: 3838095 - RNA, 13 nt, Shigella flexneri 2a str. 2457T
aacguggccauga

SEQ ID NO: 3838096 - RNA, 15 nt, Shigella flexneri 2a str. 2457T
aacgugggccuggcg

SEQ ID NO: 3838097 - RNA, 20 nt, Shigella flexneri 2a str. 2457T
aacguggggugaauaaucgc

SEQ ID NO: 3838098 - RNA, 15 nt, Shigella flexneri 2a str. 2457T
aacgugguuugcggc

SEQ ID NO: 3838099 - RNA, 21 nt, Shigella flexneri 2a str. 2457T
aacgugugcuuuguucaugcc

SEQ ID NO: 3838100 - RNA, 20 nt, Shigella flexneri 2a str. 2457T
aacguguuuauauuugaaca

SEQ ID NO: 3838101 - RNA, 19 nt, Shigella flexneri 2a str. 2457T
aacguuacucuaaagaguu

SEQ ID NO: 3838102 - RNA, 12 nt, Shigella flexneri 2a str. 2457T
aacguuccagca

SEQ ID NO: 3838103 - RNA, 19 nt, Shigella flexneri 2a str. 2457T
aacuguagugaucaaacac

SEQ ID NO: 3838104 - RNA, 20 nt, Shigella flexneri 2a str. 2457T
aacuguagugaucaaacaca

SEQ ID NO: 3838105 - RNA, 13 nt, Shigella flexneri 2a str. 2457T
aacugucuaaugg

SEQ ID NO: 3838106 - RNA, 23 nt, Shigella flexneri 2a str. 2457T
aacugucuaauggugaacugaca

SEQ ID NO: 3838107 - RNA, 17 nt, Shigella flexneri 2a str. 2457T
aacugucuucaccauag

SEQ ID NO: 3838108 - RNA, 19 nt, Shigella flexneri 2a str. 2457T
aacuguggcgcgaagcccu

SEQ ID NO: 3838109 - RNA, 16 nt, Shigella flexneri 2a str. 2457T
aacugugguccuggcu

SEQ ID NO: 3838110 - RNA, 14 nt, Shigella flexneri 2a str. 2457T
aacuguguaaugcg

SEQ ID NO: 3838111 - RNA, 16 nt, Shigella flexneri 2a str. 2457T
aacuguugauccagga

SEQ ID NO: 3838112 - RNA, 19 nt, Shigella flexneri 2a str. 2457T
aacuguugauccaggagcu

SEQ ID NO: 3838113 - RNA, 17 nt, Shigella flexneri 2a str. 2457T
aacuuaacuugcuuaaa

SEQ ID NO: 3838114 - RNA, 15 nt, Shigella flexneri 2a str. 2457T
aacuuaagucuccau

SEQ ID NO: 3838115 - RNA, 22 nt, Shigella flexneri 2a str. 2457T
aacuuaccgccgcuccagaauc

SEQ ID NO: 3838116 - RNA, 20 nt, Shigella flexneri 2a str. 2457T
aacuuacugacaucaaaccc

SEQ ID NO: 3838117 - RNA, 21 nt, Shigella flexneri 2a str. 2457T
aacuuacugauaguguuuuau

SEQ ID NO: 3838118 - RNA, 14 nt, Shigella flexneri 2a str. 2457T
aacuuacugaugca

SEQ ID NO: 3838119 - RNA, 18 nt, Shigella flexneri 2a str. 2457T
aacuuaucuguaauuaaa

SEQ ID NO: 3838120 - RNA, 20 nt, Shigella flexneri 2a str. 2457T
aacuucaccagcacuucacu

SEQ ID NO: 3838121 - RNA, 16 nt, Shigella flexneri 2a str. 2457T
aacuucaccgguucau

SEQ ID NO: 3838122 - RNA, 21 nt, Shigella flexneri 2a str. 2457T
aacuucaccgguucaucacga

SEQ ID NO: 3838123 - RNA, 15 nt, Shigella flexneri 2a str. 2457T
aacuucacucucuuu

SEQ ID NO: 3838124 - RNA, 24 nt, Shigella flexneri 2a str. 2457T
aacuucacuuccccgagcucaaua

SEQ ID NO: 3838125 - RNA, 15 nt, Shigella flexneri 2a str. 2457T
aacuucccgcaucca

SEQ ID NO: 3838126 - RNA, 17 nt, Shigella flexneri 2a str. 2457T
aacuuccggcagaaaua

SEQ ID NO: 3838127 - RNA, 15 nt, Shigella flexneri 2a str. 2457T
aacuuccugagugaa

SEQ ID NO: 3838128 - RNA, 11 nt, Shigella flexneri 2a str. 2457T
aacuucgcgag

SEQ ID NO: 3838129 - RNA, 14 nt, Shigella flexneri 2a str. 2457T
aacuucgucacagc

SEQ ID NO: 3838130 - RNA, 21 nt, Shigella flexneri 2a str. 2457T
aacuucguuagguucucucag

SEQ ID NO: 3838131 - RNA, 20 nt, Shigella flexneri 2a str. 2457T
aacuucucgcaagccgaaua

SEQ ID NO: 3838132 - RNA, 18 nt, Shigella flexneri 2a str. 2457T
aacuucucuucuuccgcu

SEQ ID NO: 3838133 - RNA, 22 nt, Shigella flexneri 2a str. 2457T
aacuucucuucuuccgcuucaa

SEQ ID NO: 3838134 - RNA, 13 nt, Shigella flexneri 2a str. 2457T
aacuucucuuucg

SEQ ID NO: 3838135 - RNA, 19 nt, Shigella flexneri 2a str. 2457T
aacuucuucacaccaucaa

SEQ ID NO: 3838136 - RNA, 14 nt, Shigella flexneri 2a str. 2457T
aacuucuucaguuu

SEQ ID NO: 3838137 - RNA, 17 nt, Shigella flexneri 2a str. 2457T
aacuucuucaguuuuuc

SEQ ID NO: 3838138 - RNA, 22 nt, Shigella flexneri 2a str. 2457T
aacuucuuuacuggcuuucauu

SEQ ID NO: 3838139 - RNA, 18 nt, Shigella flexneri 2a str. 2457T
aacuucuuuuucgacaaa

SEQ ID NO: 3838140 - RNA, 18 nt, Shigella flexneri 2a str. 2457T
aacuugacucgccugaaa

SEQ ID NO: 3838141 - RNA, 12 nt, Shigella flexneri 2a str. 2457T
aacuugauacug

SEQ ID NO: 3838142 - RNA, 22 nt, Shigella flexneri 2a str. 2457T
aacuugcguaucgaccagaaua

SEQ ID NO: 3838143 - RNA, 19 nt, Shigella flexneri 2a str. 2457T
aacuuguagcuuucaacgc

SEQ ID NO: 3838144 - RNA, 16 nt, Shigella flexneri 2a str. 2457T
aacuuucgaucaguga

SEQ ID NO: 3838145 - RNA, 20 nt, Shigella flexneri 2a str. 2457T
aacuuugaagcccaguaccg

SEQ ID NO: 3838146 - RNA, 17 nt, Shigella flexneri 2a str. 2457T
aacuuugccgugaacaa

SEQ ID NO: 3838147 - RNA, 21 nt, Shigella flexneri 2a str. 2457T
aacuuuguuagcgaauaaagu

SEQ ID NO: 3838148 - RNA, 17 nt, Shigella flexneri 2a str. 2457T
aacuuuucaacaaauuc

SEQ ID NO: 3838149 - RNA, 18 nt, Shigella flexneri 2a str. 2457T
aacuuuucaacaaauucu

SEQ ID NO: 3838150 - RNA, 17 nt, Shigella flexneri 2a str. 2457T
aacuuuucccuacugcu

SEQ ID NO: 3838151 - RNA, 13 nt, Shigella flexneri 2a str. 2457T
aagaaaaaagauu

SEQ ID NO: 3838152 - RNA, 13 nt, Shigella flexneri 2a str. 2457T
aagaaaacggaag

SEQ ID NO: 3838153 - RNA, 23 nt, Shigella flexneri 2a str. 2457T
aagaaaaucaauccaguguaaaa

SEQ ID NO: 3838154 - RNA, 22 nt, Shigella flexneri 2a str. 2457T
aagaaaauggccagccagcaga

SEQ ID NO: 3838155 - RNA, 13 nt, Shigella flexneri 2a str. 2457T
aagaaacaccaga

SEQ ID NO: 3838156 - RNA, 21 nt, Shigella flexneri 2a str. 2457T
aagaaacaccagaaugcccca

SEQ ID NO: 3838157 - RNA, 15 nt, Shigella flexneri 2a str. 2457T
aagaaaccgaaguug

SEQ ID NO: 3838158 - RNA, 19 nt, Shigella flexneri 2a str. 2457T
aagaaaccgaaguuguagc

SEQ ID NO: 3838159 - RNA, 13 nt, Shigella flexneri 2a str. 2457T
aagaaaccgauga

SEQ ID NO: 3838160 - RNA, 16 nt, Shigella flexneri 2a str. 2457T
aagaaacgcuuaaaac

SEQ ID NO: 3838161 - RNA, 22 nt, Shigella flexneri 2a str. 2457T
aagaaacuaucaggcaaaaaaa

SEQ ID NO: 3838162 - RNA, 17 nt, Shigella flexneri 2a str. 2457T
aagaaagcaaugaaauu

SEQ ID NO: 3838163 - RNA, 21 nt, Shigella flexneri 2a str. 2457T
aagaaagcaaugaaauucauu

SEQ ID NO: 3838164 - RNA, 22 nt, Shigella flexneri 2a str. 2457T
aagaaaguuugcagaaauuguc

SEQ ID NO: 3838165 - RNA, 13 nt, Shigella flexneri 2a str. 2457T
aagaacaucauuc

SEQ ID NO: 3838166 - RNA, 15 nt, Shigella flexneri 2a str. 2457T
aagaaccugaacgcc

SEQ ID NO: 3838167 - RNA, 23 nt, Shigella flexneri 2a str. 2457T
aagaacugacuuccacuuccugc

SEQ ID NO: 3838168 - RNA, 23 nt, Shigella flexneri 2a str. 2457T
aagaagaucguggagaacaauau

SEQ ID NO: 3838169 - RNA, 11 nt, Shigella flexneri 2a str. 2457T
aagaagccgcc

SEQ ID NO: 3838170 - RNA, 22 nt, Shigella flexneri 2a str. 2457T
aagaagccuuuaucugguuguu

SEQ ID NO: 3838171 - RNA, 18 nt, Shigella flexneri 2a str. 2457T
aagaagcggugaaaaaau

SEQ ID NO: 3838172 - RNA, 20 nt, Shigella flexneri 2a str. 2457T
aagaagggcuggccaauugg

SEQ ID NO: 3838173 - RNA, 17 nt, Shigella flexneri 2a str. 2457T
aagaauaaaacgccuga

SEQ ID NO: 3838174 - RNA, 14 nt, Shigella flexneri 2a str. 2457T
aagaauagccgcaa

SEQ ID NO: 3838175 - RNA, 16 nt, Shigella flexneri 2a str. 2457T
aagaauaucuucuguu

SEQ ID NO: 3838176 - RNA, 21 nt, Shigella flexneri 2a str. 2457T
aagaauaugcuuugccuuauu

SEQ ID NO: 3838177 - RNA, 19 nt, Shigella flexneri 2a str. 2457T
aagaaucgggcaacguuga

SEQ ID NO: 3838178 - RNA, 22 nt, Shigella flexneri 2a str. 2457T
aagaaugacacuuucagcgcag

SEQ ID NO: 3838179 - RNA, 16 nt, Shigella flexneri 2a str. 2457T
aagaaugcgaaaacga

SEQ ID NO: 3838180 - RNA, 14 nt, Shigella flexneri 2a str. 2457T
aagaauggaaaaaa

SEQ ID NO: 3838181 - RNA, 20 nt, Shigella flexneri 2a str. 2457T
aagaauguccauuauuucaa

SEQ ID NO: 3838182 - RNA, 23 nt, Shigella flexneri 2a str. 2457T
aagaauugauaaaaaaaacgcca

SEQ ID NO: 3838183 - RNA, 16 nt, Shigella flexneri 2a str. 2457T
aagaauugcagauacc

SEQ ID NO: 3838184 - RNA, 23 nt, Shigella flexneri 2a str. 2457T
aagaauugcagauaccacaucaa

SEQ ID NO: 3838185 - RNA, 19 nt, Shigella flexneri 2a str. 2457T
aagaauuucaucgccggua

SEQ ID NO: 3838186 - RNA, 21 nt, Shigella flexneri 2a str. 2457T
aagaauuucuuuacugacagg

SEQ ID NO: 3838187 - RNA, 18 nt, Shigella flexneri 2a str. 2457T
aagaauuuguaggccgga

SEQ ID NO: 3838188 - RNA, 13 nt, Shigella flexneri 2a str. 2457T
aagaauuuuauac

SEQ ID NO: 3838189 - RNA, 13 nt, Shigella flexneri 2a str. 2457T
aagacaauuuaau

SEQ ID NO: 3838190 - RNA, 11 nt, Shigella flexneri 2a str. 2457T
aagacacacua

SEQ ID NO: 3838191 - RNA, 22 nt, Shigella flexneri 2a str. 2457T
aagacacuaacgcgucuuaucu

SEQ ID NO: 3838192 - RNA, 22 nt, Shigella flexneri 2a str. 2457T
aagacacugacgcgucuuaucu

SEQ ID NO: 3838193 - RNA, 21 nt, Shigella flexneri 2a str. 2457T
aagacauagcacauaaaaugg

SEQ ID NO: 3838194 - RNA, 19 nt, Shigella flexneri 2a str. 2457T
aagacaucaauaaacaaug

SEQ ID NO: 3838195 - RNA, 16 nt, Shigella flexneri 2a str. 2457T
aagacaucgcccgauu

SEQ ID NO: 3838196 - RNA, 16 nt, Shigella flexneri 2a str. 2457T
aagaccauugaugcuc

SEQ ID NO: 3838197 - RNA, 19 nt, Shigella flexneri 2a str. 2457T
aagaccguuucggugauga

SEQ ID NO: 3838198 - RNA, 20 nt, Shigella flexneri 2a str. 2457T
aagaccugacuguuccagca

SEQ ID NO: 3838199 - RNA, 19 nt, Shigella flexneri 2a str. 2457T
aagaccugccgggcugaug

SEQ ID NO: 3838200 - RNA, 17 nt, Shigella flexneri 2a str. 2457T
aagccaaucacaaaaag

SEQ ID NO: 3838201 - RNA, 13 nt, Shigella flexneri 2a str. 2457T
aagccaccacgcc

SEQ ID NO: 3838202 - RNA, 18 nt, Shigella flexneri 2a str. 2457T
aagccaccacgccaagaa

SEQ ID NO: 3838203 - RNA, 16 nt, Shigella flexneri 2a str. 2457T
aagccaccgaacaaaa

SEQ ID NO: 3838204 - RNA, 15 nt, Shigella flexneri 2a str. 2457T
aagccaccgcccaga

SEQ ID NO: 3838205 - RNA, 16 nt, Shigella flexneri 2a str. 2457T
aagccaccgcccagag

SEQ ID NO: 3838206 - RNA, 14 nt, Shigella flexneri 2a str. 2457T
aagccaccgccgcu

SEQ ID NO: 3838207 - RNA, 17 nt, Shigella flexneri 2a str. 2457T
aagccaccgcgccacga

SEQ ID NO: 3838208 - RNA, 19 nt, Shigella flexneri 2a str. 2457T
aagccacugugcgcgccag

SEQ ID NO: 3838209 - RNA, 17 nt, Shigella flexneri 2a str. 2457T
aagccaguccagaaaug

SEQ ID NO: 3838210 - RNA, 13 nt, Shigella flexneri 2a str. 2457T
aagccauccagca

SEQ ID NO: 3838211 - RNA, 20 nt, Shigella flexneri 2a str. 2457T
aagccaugcuuugcauccca

SEQ ID NO: 3838212 - RNA, 16 nt, Shigella flexneri 2a str. 2457T
aagcccaguaccgcca

SEQ ID NO: 3838213 - RNA, 18 nt, Shigella flexneri 2a str. 2457T
aagcccaguaccgccagu

SEQ ID NO: 3838214 - RNA, 14 nt, Shigella flexneri 2a str. 2457T
aagccccaccagca

SEQ ID NO: 3838215 - RNA, 13 nt, Shigella flexneri 2a str. 2457T
aagccccagcagg

SEQ ID NO: 3838216 - RNA, 17 nt, Shigella flexneri 2a str. 2457T
aagccccagcaggaugu

SEQ ID NO: 3838217 - RNA, 19 nt, Shigella flexneri 2a str. 2457T
aagccccggaauucucaaa

SEQ ID NO: 3838218 - RNA, 15 nt, Shigella flexneri 2a str. 2457T
aagcccgccaucgcc

SEQ ID NO: 3838219 - RNA, 13 nt, Shigella flexneri 2a str. 2457T
aagcccucaaaca

SEQ ID NO: 3838220 - RNA, 19 nt, Shigella flexneri 2a str. 2457T
aagccgccaucucuuccag

SEQ ID NO: 3838221 - RNA, 15 nt, Shigella flexneri 2a str. 2457T
aagccgccgccgcug

SEQ ID NO: 3838222 - RNA, 17 nt, Shigella flexneri 2a str. 2457T
aagccgcgugcgcugga

SEQ ID NO: 3838223 - RNA, 16 nt, Shigella flexneri 2a str. 2457T
aagccgcuaacagcag

SEQ ID NO: 3838224 - RNA, 21 nt, Shigella flexneri 2a str. 2457T
aagccggaugaucauccggcu

SEQ ID NO: 3838225 - RNA, 13 nt, Shigella flexneri 2a str. 2457T
aagccgugaauca

SEQ ID NO: 3838226 - RNA, 14 nt, Shigella flexneri 2a str. 2457T
aagccgugaaucac

SEQ ID NO: 3838227 - RNA, 23 nt, Shigella flexneri 2a str. 2457T
aagccuauggugaagcuuaucgu

SEQ ID NO: 3838228 - RNA, 18 nt, Shigella flexneri 2a str. 2457T
aagccugcuucaaacgcu

SEQ ID NO: 3838229 - RNA, 17 nt, Shigella flexneri 2a str. 2457T
aagccuuccgcaaacag

SEQ ID NO: 3838230 - RNA, 17 nt, Shigella flexneri 2a str. 2457T
aagccuucgccuuucag

SEQ ID NO: 3838231 - RNA, 19 nt, Shigella flexneri 2a str. 2457T
aagccuuuaccgcgcucga

SEQ ID NO: 3838232 - RNA, 18 nt, Shigella flexneri 2a str. 2457T
aagcgacuuugccuggcg

SEQ ID NO: 3838233 - RNA, 14 nt, Shigella flexneri 2a str. 2457T
aagcgagcaguaca

SEQ ID NO: 3838234 - RNA, 14 nt, Shigella flexneri 2a str. 2457T
aagcgauaacgcug

SEQ ID NO: 3838235 - RNA, 15 nt, Shigella flexneri 2a str. 2457T
aagcgaucuuucugu

SEQ ID NO: 3838236 - RNA, 21 nt, Shigella flexneri 2a str. 2457T
aagcgauucucgccgcccuga

SEQ ID NO: 3838237 - RNA, 15 nt, Shigella flexneri 2a str. 2457T
aagcgcaaaggccag

SEQ ID NO: 3838238 - RNA, 17 nt, Shigella flexneri 2a str. 2457T
aagcgcaaaggccagca

SEQ ID NO: 3838239 - RNA, 13 nt, Shigella flexneri 2a str. 2457T
aagcgcacaacgu

SEQ ID NO: 3838240 - RNA, 17 nt, Shigella flexneri 2a str. 2457T
aagcgcacaauggcggu

SEQ ID NO: 3838241 - RNA, 22 nt, Shigella flexneri 2a str. 2457T
aagcgcacguuguuacaauuua

SEQ ID NO: 3838242 - RNA, 14 nt, Shigella flexneri 2a str. 2457T
aagcgcagccaaaa

SEQ ID NO: 3838243 - RNA, 18 nt, Shigella flexneri 2a str. 2457T
aagcgcauccggcaccag

SEQ ID NO: 3838244 - RNA, 16 nt, Shigella flexneri 2a str. 2457T
aagcgccaaaucugcc

SEQ ID NO: 3838245 - RNA, 16 nt, Shigella flexneri 2a str. 2457T
aagcgccacaaucgcu

SEQ ID NO: 3838246 - RNA, 14 nt, Shigella flexneri 2a str. 2457T
aagcgccaucaaug

SEQ ID NO: 3838247 - RNA, 19 nt, Shigella flexneri 2a str. 2457T
aagcgccggacauugcguu

SEQ ID NO: 3838248 - RNA, 18 nt, Shigella flexneri 2a str. 2457T
aagcgcggauuuuauuca

SEQ ID NO: 3838249 - RNA, 15 nt, Shigella flexneri 2a str. 2457T
aagcgcgucaccacc

SEQ ID NO: 3838250 - RNA, 17 nt, Shigella flexneri 2a str. 2457T
aagcgcguguuacugga

SEQ ID NO: 3838251 - RNA, 20 nt, Shigella flexneri 2a str. 2457T
aagcgcucccgcaggagcgc

SEQ ID NO: 3838252 - RNA, 19 nt, Shigella flexneri 2a str. 2457T
aagcgcugagacgcgcuug

SEQ ID NO: 3838253 - RNA, 23 nt, Shigella flexneri 2a str. 2457T
aagcggcguuccaccgcucccag

SEQ ID NO: 3838254 - RNA, 14 nt, Shigella flexneri 2a str. 2457T
aagcggugaaaaaa

SEQ ID NO: 3838255 - RNA, 15 nt, Shigella flexneri 2a str. 2457T
aagcggugcgaugcc

SEQ ID NO: 3838256 - RNA, 22 nt, Shigella flexneri 2a str. 2457T
aagcguaaaaccucacgcaucc

SEQ ID NO: 3838257 - RNA, 17 nt, Shigella flexneri 2a str. 2457T
aagcguauccaucacua

SEQ ID NO: 3838258 - RNA, 14 nt, Shigella flexneri 2a str. 2457T
aagcguauguggug

SEQ ID NO: 3838259 - RNA, 13 nt, Shigella flexneri 2a str. 2457T
aagcgucagcuuu

SEQ ID NO: 3838260 - RNA, 16 nt, Shigella flexneri 2a str. 2457T
aagcucucuuccaguu

SEQ ID NO: 3838261 - RNA, 18 nt, Shigella flexneri 2a str. 2457T
aagcugaaaauggcgcug

SEQ ID NO: 3838262 - RNA, 13 nt, Shigella flexneri 2a str. 2457T
aagcugacaggcg

SEQ ID NO: 3838263 - RNA, 20 nt, Shigella flexneri 2a str. 2457T
aagcugacaggcgcugauga

SEQ ID NO: 3838264 - RNA, 14 nt, Shigella flexneri 2a str. 2457T
aagcugagcacaaa

SEQ ID NO: 3838265 - RNA, 22 nt, Shigella flexneri 2a str. 2457T
aagcugagcacaaaacaggucg

SEQ ID NO: 3838266 - RNA, 16 nt, Shigella flexneri 2a str. 2457T
aagcugcaaggugaaa

SEQ ID NO: 3838267 - RNA, 14 nt, Shigella flexneri 2a str. 2457T
aagcugcaggacca

SEQ ID NO: 3838268 - RNA, 17 nt, Shigella flexneri 2a str. 2457T
aagcugcauacggugaa

SEQ ID NO: 3838269 - RNA, 20 nt, Shigella flexneri 2a str. 2457T
aagcugcggauccugagcaa

SEQ ID NO: 3838270 - RNA, 21 nt, Shigella flexneri 2a str. 2457T
aagcugcggauccugagcaaa

SEQ ID NO: 3838271 - RNA, 17 nt, Shigella flexneri 2a str. 2457T
aagcuggaaaucaaugg

SEQ ID NO: 3838272 - RNA, 16 nt, Shigella flexneri 2a str. 2457T
aagcuggcauugaugu

SEQ ID NO: 3838273 - RNA, 22 nt, Shigella flexneri 2a str. 2457T
aagcuggcgauauuauccccug

SEQ ID NO: 3838274 - RNA, 14 nt, Shigella flexneri 2a str. 2457T
aagcuguagaggcg

SEQ ID NO: 3838275 - RNA, 24 nt, Shigella flexneri 2a str. 2457T
aagcuguaucccagcccagcggaa

SEQ ID NO: 3838276 - RNA, 14 nt, Shigella flexneri 2a str. 2457T
aagcugugccugaa

SEQ ID NO: 3838277 - RNA, 16 nt, Shigella flexneri 2a str. 2457T
aagcugugccugaaua

SEQ ID NO: 3838278 - RNA, 14 nt, Shigella flexneri 2a str. 2457T
aagcuguucuuccc

SEQ ID NO: 3838279 - RNA, 21 nt, Shigella flexneri 2a str. 2457T
aaggaaauccugccgcaguuu

SEQ ID NO: 3838280 - RNA, 20 nt, Shigella flexneri 2a str. 2457T
aaggacaaaaauucaggaau

SEQ ID NO: 3838281 - RNA, 20 nt, Shigella flexneri 2a str. 2457T
aaggacagugggauuaaaaa

SEQ ID NO: 3838282 - RNA, 18 nt, Shigella flexneri 2a str. 2457T
aaggaccaaagaaugaca

SEQ ID NO: 3838283 - RNA, 14 nt, Shigella flexneri 2a str. 2457T
aaggagauaaaccg

SEQ ID NO: 3838284 - RNA, 22 nt, Shigella flexneri 2a str. 2457T
aaggagcuaauaaugagcagaa

SEQ ID NO: 3838285 - RNA, 22 nt, Shigella flexneri 2a str. 2457T
aaggauaaaaaagggugcugca

SEQ ID NO: 3838286 - RNA, 13 nt, Shigella flexneri 2a str. 2457T
aaggaugagaagc

SEQ ID NO: 3838287 - RNA, 13 nt, Shigella flexneri 2a str. 2457T
aaggauuacucag

SEQ ID NO: 3838288 - RNA, 16 nt, Shigella flexneri 2a str. 2457T
aaggauuagccggaua

SEQ ID NO: 3838289 - RNA, 11 nt, Shigella flexneri 2a str. 2457T
aaggauuaucc

SEQ ID NO: 3838290 - RNA, 18 nt, Shigella flexneri 2a str. 2457T
aaggauugaucaauucua

SEQ ID NO: 3838291 - RNA, 12 nt, Shigella flexneri 2a str. 2457T
aaggcaaacugu

SEQ ID NO: 3838292 - RNA, 20 nt, Shigella flexneri 2a str. 2457T
aaggcaacgccccuucugcc

SEQ ID NO: 3838293 - RNA, 20 nt, Shigella flexneri 2a str. 2457T
aaggcaaucugcucuauccg

SEQ ID NO: 3838294 - RNA, 12 nt, Shigella flexneri 2a str. 2457T
aaggcagccuuu

SEQ ID NO: 3838295 - RNA, 15 nt, Shigella flexneri 2a str. 2457T
aaggcagccuuucuc

SEQ ID NO: 3838296 - RNA, 19 nt, Shigella flexneri 2a str. 2457T
aaggcauuaaacgcauaca

SEQ ID NO: 3838297 - RNA, 13 nt, Shigella flexneri 2a str. 2457T
aaggccagaacca

SEQ ID NO: 3838298 - RNA, 17 nt, Shigella flexneri 2a str. 2457T
aagucucaauuaguaau

SEQ ID NO: 3838299 - RNA, 12 nt, Shigella flexneri 2a str. 2457T
aagucucagaaa

SEQ ID NO: 3838300 - RNA, 16 nt, Shigella flexneri 2a str. 2457T
aagucuuuguauuuau

SEQ ID NO: 3838301 - RNA, 17 nt, Shigella flexneri 2a str. 2457T
aagugaauacagaacag

SEQ ID NO: 3838302 - RNA, 22 nt, Shigella flexneri 2a str. 2457T
aagugaauacagaacagugcca

SEQ ID NO: 3838303 - RNA, 20 nt, Shigella flexneri 2a str. 2457T
aagugaauagcgcccggaaa

SEQ ID NO: 3838304 - RNA, 23 nt, Shigella flexneri 2a str. 2457T
aagugagcuuuguucaugccgga

SEQ ID NO: 3838305 - RNA, 18 nt, Shigella flexneri 2a str. 2457T
aagugaguugguuauuca

SEQ ID NO: 3838306 - RNA, 19 nt, Shigella flexneri 2a str. 2457T
aagugcgcgcagcugcgca

SEQ ID NO: 3838307 - RNA, 18 nt, Shigella flexneri 2a str. 2457T
aagugcguucaccccuuu

SEQ ID NO: 3838308 - RNA, 16 nt, Shigella flexneri 2a str. 2457T
aagugcugggaaaccu

SEQ ID NO: 3838309 - RNA, 14 nt, Shigella flexneri 2a str. 2457T
aaguggacgaacag

SEQ ID NO: 3838310 - RNA, 17 nt, Shigella flexneri 2a str. 2457T
aaguggcgauacagugc

SEQ ID NO: 3838311 - RNA, 17 nt, Shigella flexneri 2a str. 2457T
aaguguuuaaauuucuu

SEQ ID NO: 3838312 - RNA, 19 nt, Shigella flexneri 2a str. 2457T
aaguuaauccacagcaaug

SEQ ID NO: 3838313 - RNA, 16 nt, Shigella flexneri 2a str. 2457T
aaguuacauuuuaaua

SEQ ID NO: 3838314 - RNA, 22 nt, Shigella flexneri 2a str. 2457T
aaguuagaguagccaauaccaa

SEQ ID NO: 3838315 - RNA, 23 nt, Shigella flexneri 2a str. 2457T
aaguuagucgcuuucauucagaa

SEQ ID NO: 3838316 - RNA, 15 nt, Shigella flexneri 2a str. 2457T
aaguuauaaauaaaa

SEQ ID NO: 3838317 - RNA, 21 nt, Shigella flexneri 2a str. 2457T
aaguuauacagacucaaacca

SEQ ID NO: 3838318 - RNA, 19 nt, Shigella flexneri 2a str. 2457T
aaguuaucaaguauuuuua

SEQ ID NO: 3838319 - RNA, 23 nt, Shigella flexneri 2a str. 2457T
aaguuccgauaaucggugcggca

SEQ ID NO: 3838320 - RNA, 17 nt, Shigella flexneri 2a str. 2457T
aaguuccuguaaagagu

SEQ ID NO: 3838321 - RNA, 21 nt, Shigella flexneri 2a str. 2457T
aaguucuucgaagcacucgua

SEQ ID NO: 3838322 - RNA, 18 nt, Shigella flexneri 2a str. 2457T
aaguugcagcgucaucaa

SEQ ID NO: 3838323 - RNA, 18 nt, Shigella flexneri 2a str. 2457T
aaguugccggauguguug

SEQ ID NO: 3838324 - RNA, 18 nt, Shigella flexneri 2a str. 2457T
aaguugcgaaagcgagca

SEQ ID NO: 3838325 - RNA, 17 nt, Shigella flexneri 2a str. 2457T
aaguugcucaagcugaa

SEQ ID NO: 3838326 - RNA, 13 nt, Shigella flexneri 2a str. 2457T
aaguuggcaccaa

SEQ ID NO: 3838327 - RNA, 20 nt, Shigella flexneri 2a str. 2457T
aaguuggugauguauaucgg

SEQ ID NO: 3838328 - RNA, 22 nt, Shigella flexneri 2a str. 2457T
aaguuuaacuaccguguucagc

SEQ ID NO: 3838329 - RNA, 22 nt, Shigella flexneri 2a str. 2457T
aaguuucacugggcgauuaaua

SEQ ID NO: 3838330 - RNA, 20 nt, Shigella flexneri 2a str. 2457T
aaguuugcaacuuucgcuuu

SEQ ID NO: 3838331 - RNA, 12 nt, Shigella flexneri 2a str. 2457T
aaguuuuccuca

SEQ ID NO: 3838332 - RNA, 13 nt, Shigella flexneri 2a str. 2457T
aaguuuuccucag

SEQ ID NO: 3838333 - RNA, 17 nt, Shigella flexneri 2a str. 2457T
aaguuuugucgcugauu

SEQ ID NO: 3838334 - RNA, 12 nt, Shigella flexneri 2a str. 2457T
aaguuuuuauga

SEQ ID NO: 3838335 - RNA, 14 nt, Shigella flexneri 2a str. 2457T
aaguuuuucaacac

SEQ ID NO: 3838336 - RNA, 19 nt, Shigella flexneri 2a str. 2457T
aauaaaaaaggcugcauaa

SEQ ID NO: 3838337 - RNA, 22 nt, Shigella flexneri 2a str. 2457T
aauaaaaauacauacgcaaaaa

SEQ ID NO: 3838338 - RNA, 14 nt, Shigella flexneri 2a str. 2457T
aauaaaagccagga

SEQ ID NO: 3838339 - RNA, 14 nt, Shigella flexneri 2a str. 2457T
aauaaaaggaaaca

SEQ ID NO: 3838340 - RNA, 13 nt, Shigella flexneri 2a str. 2457T
aauaaaauaucuu

SEQ ID NO: 3838341 - RNA, 15 nt, Shigella flexneri 2a str. 2457T
aauaaaaucuauuau

SEQ ID NO: 3838342 - RNA, 15 nt, Shigella flexneri 2a str. 2457T
aauaaacaucagcua

SEQ ID NO: 3838343 - RNA, 21 nt, Shigella flexneri 2a str. 2457T
aauaaacgccauauucugauc

SEQ ID NO: 3838344 - RNA, 12 nt, Shigella flexneri 2a str. 2457T
aauaaauagauc

SEQ ID NO: 3838345 - RNA, 22 nt, Shigella flexneri 2a str. 2457T
aauaaaucaaagucagaucaau

SEQ ID NO: 3838346 - RNA, 17 nt, Shigella flexneri 2a str. 2457T
aauaaaucuaaaagaug

SEQ ID NO: 3838347 - RNA, 12 nt, Shigella flexneri 2a str. 2457T
aauaaaugccac

SEQ ID NO: 3838348 - RNA, 13 nt, Shigella flexneri 2a str. 2457T
aauaaauuugguu

SEQ ID NO: 3838349 - RNA, 16 nt, Shigella flexneri 2a str. 2457T
aauaacacauauauua

SEQ ID NO: 3838350 - RNA, 17 nt, Shigella flexneri 2a str. 2457T
aauaacacauauauuaa

SEQ ID NO: 3838351 - RNA, 15 nt, Shigella flexneri 2a str. 2457T
aauaacacgcggcuu

SEQ ID NO: 3838352 - RNA, 22 nt, Shigella flexneri 2a str. 2457T
aauaacagggaaugugaugaaa

SEQ ID NO: 3838353 - RNA, 23 nt, Shigella flexneri 2a str. 2457T
aauaacagggaaugugaugaaaa

SEQ ID NO: 3838354 - RNA, 14 nt, Shigella flexneri 2a str. 2457T
aauaacaucgccag

SEQ ID NO: 3838355 - RNA, 13 nt, Shigella flexneri 2a str. 2457T
aauaaccauauau

SEQ ID NO: 3838356 - RNA, 18 nt, Shigella flexneri 2a str. 2457T
aauaaccauggcagaagc

SEQ ID NO: 3838357 - RNA, 19 nt, Shigella flexneri 2a str. 2457T
aauaaccauggcagaagca

SEQ ID NO: 3838358 - RNA, 22 nt, Shigella flexneri 2a str. 2457T
aauaacccgcuguaaaugcugc

SEQ ID NO: 3838359 - RNA, 17 nt, Shigella flexneri 2a str. 2457T
aauaaccgcugcaaaaa

SEQ ID NO: 3838360 - RNA, 18 nt, Shigella flexneri 2a str. 2457T
aauaaccgcugcaaaaaa

SEQ ID NO: 3838361 - RNA, 21 nt, Shigella flexneri 2a str. 2457T
aauaacgccggagagaaaaac

SEQ ID NO: 3838362 - RNA, 20 nt, Shigella flexneri 2a str. 2457T
aauaacggcugauaacaaua

SEQ ID NO: 3838363 - RNA, 16 nt, Shigella flexneri 2a str. 2457T
aauaacucuuugauga

SEQ ID NO: 3838364 - RNA, 15 nt, Shigella flexneri 2a str. 2457T
aauaacugcuauuca

SEQ ID NO: 3838365 - RNA, 19 nt, Shigella flexneri 2a str. 2457T
aauaacugcuauucaccag

SEQ ID NO: 3838366 - RNA, 21 nt, Shigella flexneri 2a str. 2457T
aauaacuggugcuaacagcaa

SEQ ID NO: 3838367 - RNA, 14 nt, Shigella flexneri 2a str. 2457T
aauaagacaauuga

SEQ ID NO: 3838368 - RNA, 19 nt, Shigella flexneri 2a str. 2457T
aauaagccaaauccagcgc

SEQ ID NO: 3838369 - RNA, 17 nt, Shigella flexneri 2a str. 2457T
aauaaggcuuucgugaa

SEQ ID NO: 3838370 - RNA, 17 nt, Shigella flexneri 2a str. 2457T
aauaaguacgauacaga

SEQ ID NO: 3838371 - RNA, 19 nt, Shigella flexneri 2a str. 2457T
aauaaguccgaacuaaaga

SEQ ID NO: 3838372 - RNA, 21 nt, Shigella flexneri 2a str. 2457T
aauaauacagcccagacaaau

SEQ ID NO: 3838373 - RNA, 22 nt, Shigella flexneri 2a str. 2457T
aauaauaccguucucuuuaaaa

SEQ ID NO: 3838374 - RNA, 12 nt, Shigella flexneri 2a str. 2457T
aauaauaucuuu

SEQ ID NO: 3838375 - RNA, 14 nt, Shigella flexneri 2a str. 2457T
aauaauaucuuuuu

SEQ ID NO: 3838376 - RNA, 23 nt, Shigella flexneri 2a str. 2457T
aauaaucaacgcgauauaauaaa

SEQ ID NO: 3838377 - RNA, 17 nt, Shigella flexneri 2a str. 2457T
aauaaucaacgcggcaa

SEQ ID NO: 3838378 - RNA, 14 nt, Shigella flexneri 2a str. 2457T
aauaaucaccacac

SEQ ID NO: 3838379 - RNA, 19 nt, Shigella flexneri 2a str. 2457T
aauaaucccgcgcaacaaa

SEQ ID NO: 3838380 - RNA, 18 nt, Shigella flexneri 2a str. 2457T
aauaaucgcaauuaccca

SEQ ID NO: 3838381 - RNA, 18 nt, Shigella flexneri 2a str. 2457T
aauaaucgggaauacaga

SEQ ID NO: 3838382 - RNA, 14 nt, Shigella flexneri 2a str. 2457T
aauaaucguaauca

SEQ ID NO: 3838383 - RNA, 15 nt, Shigella flexneri 2a str. 2457T
aauaaucucuacacc

SEQ ID NO: 3838384 - RNA, 16 nt, Shigella flexneri 2a str. 2457T
aauaaucucuacacca

SEQ ID NO: 3838385 - RNA, 23 nt, Shigella flexneri 2a str. 2457T
aauaaugaucaguggaagacguu

SEQ ID NO: 3838386 - RNA, 13 nt, Shigella flexneri 2a str. 2457T
aauaaugcaaaaa

SEQ ID NO: 3838387 - RNA, 12 nt, Shigella flexneri 2a str. 2457T
aauaaugcagau

SEQ ID NO: 3838388 - RNA, 13 nt, Shigella flexneri 2a str. 2457T
aauaaugcagauc

SEQ ID NO: 3838389 - RNA, 21 nt, Shigella flexneri 2a str. 2457T
aauaaugcccaucgugauaaa

SEQ ID NO: 3838390 - RNA, 19 nt, Shigella flexneri 2a str. 2457T
aauaauggccuuuucgcca

SEQ ID NO: 3838391 - RNA, 21 nt, Shigella flexneri 2a str. 2457T
aauaauggccuuuucgccacc

SEQ ID NO: 3838392 - RNA, 15 nt, Shigella flexneri 2a str. 2457T
aauaauuauccugug

SEQ ID NO: 3838393 - RNA, 15 nt, Shigella flexneri 2a str. 2457T
aauaauuucggcagc

SEQ ID NO: 3838394 - RNA, 14 nt, Shigella flexneri 2a str. 2457T
aauaauuuuaaaua

SEQ ID NO: 3838395 - RNA, 19 nt, Shigella flexneri 2a str. 2457T
aauaauuuuuucgccaacu

SEQ ID NO: 3838396 - RNA, 13 nt, Shigella flexneri 2a str. 2457T
aauacaaaugccu

SEQ ID NO: 3838397 - RNA, 23 nt, Shigella flexneri 2a str. 2457T
aauacaaaugccucuuucauccg

SEQ ID NO: 3838398 - RNA, 17 nt, Shigella flexneri 2a str. 2457T
aauacaacaacacccau

SEQ ID NO: 3838399 - RNA, 12 nt, Shigella flexneri 2a str. 2457T
aauacacccuga

SEQ ID NO: 3838400 - RNA, 17 nt, Shigella flexneri 2a str. 2457T
aauacacuaacagaaca

SEQ ID NO: 3838401 - RNA, 21 nt, Shigella flexneri 2a str. 2457T
aauacacuaacagaacaauaa

SEQ ID NO: 3838402 - RNA, 16 nt, Shigella flexneri 2a str. 2457T
aauacagcaauggaaa

SEQ ID NO: 3838403 - RNA, 17 nt, Shigella flexneri 2a str. 2457T
aauacagcaauggaaaa

SEQ ID NO: 3838404 - RNA, 20 nt, Shigella flexneri 2a str. 2457T
aauacagcaauggaaaaagu

SEQ ID NO: 3838405 - RNA, 15 nt, Shigella flexneri 2a str. 2457T
aauacagcauugucu

SEQ ID NO: 3838406 - RNA, 22 nt, Shigella flexneri 2a str. 2457T
aauacagccagccagcaccagg

SEQ ID NO: 3838407 - RNA, 23 nt, Shigella flexneri 2a str. 2457T
aauacagccagccagcaccaggc

SEQ ID NO: 3838408 - RNA, 21 nt, Shigella flexneri 2a str. 2457T
aauacagcccagacaaaugaa

SEQ ID NO: 3838409 - RNA, 19 nt, Shigella flexneri 2a str. 2457T
aauacagcuuaaucaccag

SEQ ID NO: 3838410 - RNA, 15 nt, Shigella flexneri 2a str. 2457T
aauacagggaaagaa

SEQ ID NO: 3838411 - RNA, 19 nt, Shigella flexneri 2a str. 2457T
aauacagggaaagaagucu

SEQ ID NO: 3838412 - RNA, 17 nt, Shigella flexneri 2a str. 2457T
aauacagguccccgcuu

SEQ ID NO: 3838413 - RNA, 15 nt, Shigella flexneri 2a str. 2457T
aauacaguugcgcca

SEQ ID NO: 3838414 - RNA, 16 nt, Shigella flexneri 2a str. 2457T
aauacauacgcaaaaa

SEQ ID NO: 3838415 - RNA, 19 nt, Shigella flexneri 2a str. 2457T
aauacauacgcaaaaaaca

SEQ ID NO: 3838416 - RNA, 11 nt, Shigella flexneri 2a str. 2457T
aauacauauau

SEQ ID NO: 3838417 - RNA, 17 nt, Shigella flexneri 2a str. 2457T
aauacauugauauacag

SEQ ID NO: 3838418 - RNA, 19 nt, Shigella flexneri 2a str. 2457T
aauaccaauaaucaauuua

SEQ ID NO: 3838419 - RNA, 12 nt, Shigella flexneri 2a str. 2457T
aauaccagccuu

SEQ ID NO: 3838420 - RNA, 17 nt, Shigella flexneri 2a str. 2457T
aauaccagccuucuuca

SEQ ID NO: 3838421 - RNA, 21 nt, Shigella flexneri 2a str. 2457T
aauaccagccuucuucaucca

SEQ ID NO: 3838422 - RNA, 14 nt, Shigella flexneri 2a str. 2457T
aauaccaucaccaa

SEQ ID NO: 3838423 - RNA, 22 nt, Shigella flexneri 2a str. 2457T
aauaccauggcucaccagcagc

SEQ ID NO: 3838424 - RNA, 23 nt, Shigella flexneri 2a str. 2457T
aauaccauggcucaccagcagcg

SEQ ID NO: 3838425 - RNA, 22 nt, Shigella flexneri 2a str. 2457T
aauacccaaaaaauagcaaagu

SEQ ID NO: 3838426 - RNA, 15 nt, Shigella flexneri 2a str. 2457T
aauaccgaagaguaa

SEQ ID NO: 3838427 - RNA, 15 nt, Shigella flexneri 2a str. 2457T
aauaccgacaucacg

SEQ ID NO: 3838428 - RNA, 23 nt, Shigella flexneri 2a str. 2457T
aauaccgagcagccacugcggca

SEQ ID NO: 3838429 - RNA, 19 nt, Shigella flexneri 2a str. 2457T
aauaccgcccaccaccagc

SEQ ID NO: 3838430 - RNA, 19 nt, Shigella flexneri 2a str. 2457T
aauaccgccugcaaauaaa

SEQ ID NO: 3838431 - RNA, 21 nt, Shigella flexneri 2a str. 2457T
aauaccggcgucccaucggca

SEQ ID NO: 3838432 - RNA, 18 nt, Shigella flexneri 2a str. 2457T
aauaccguaauauuuaaa

SEQ ID NO: 3838433 - RNA, 20 nt, Shigella flexneri 2a str. 2457T
aauaccguucauuaacgccc

SEQ ID NO: 3838434 - RNA, 20 nt, Shigella flexneri 2a str. 2457T
aauaccguucucuuuaaaaa

SEQ ID NO: 3838435 - RNA, 18 nt, Shigella flexneri 2a str. 2457T
aauaccugaccguuaauu

SEQ ID NO: 3838436 - RNA, 17 nt, Shigella flexneri 2a str. 2457T
aauacgauuaacgccag

SEQ ID NO: 3838437 - RNA, 17 nt, Shigella flexneri 2a str. 2457T
aauacgcccaucauuca

SEQ ID NO: 3838438 - RNA, 17 nt, Shigella flexneri 2a str. 2457T
aauacgccggucacgcc

SEQ ID NO: 3838439 - RNA, 20 nt, Shigella flexneri 2a str. 2457T
aauacgcucgaacagcuggu

SEQ ID NO: 3838440 - RNA, 20 nt, Shigella flexneri 2a str. 2457T
aauacgcuggcgcgccgccu

SEQ ID NO: 3838441 - RNA, 18 nt, Shigella flexneri 2a str. 2457T
aauacgcuuaaucuguac

SEQ ID NO: 3838442 - RNA, 21 nt, Shigella flexneri 2a str. 2457T
aauacggauauucaucuccag

SEQ ID NO: 3838443 - RNA, 23 nt, Shigella flexneri 2a str. 2457T
aauacggauauucaucuccagca

SEQ ID NO: 3838444 - RNA, 21 nt, Shigella flexneri 2a str. 2457T
aauacggcaaguaauaauauc

SEQ ID NO: 3838445 - RNA, 20 nt, Shigella flexneri 2a str. 2457T
aauacguaaugucggugaaa

SEQ ID NO: 3838446 - RNA, 15 nt, Shigella flexneri 2a str. 2457T
aauacguaggccuga

SEQ ID NO: 3838447 - RNA, 17 nt, Shigella flexneri 2a str. 2457T
aauacguaggccugaua

SEQ ID NO: 3838448 - RNA, 15 nt, Shigella flexneri 2a str. 2457T
aauacgucuuuagga

SEQ ID NO: 3838449 - RNA, 19 nt, Shigella flexneri 2a str. 2457T
aauacguugcuucaugccg

SEQ ID NO: 3838450 - RNA, 17 nt, Shigella flexneri 2a str. 2457T
aauacuccauaacuauu

SEQ ID NO: 3838451 - RNA, 12 nt, Shigella flexneri 2a str. 2457T
aauacuccccuu

SEQ ID NO: 3838452 - RNA, 19 nt, Shigella flexneri 2a str. 2457T
aauacuccccuuucuuauu

SEQ ID NO: 3838453 - RNA, 21 nt, Shigella flexneri 2a str. 2457T
aauacucgucccguccuucau

SEQ ID NO: 3838454 - RNA, 18 nt, Shigella flexneri 2a str. 2457T
aauacuuucacaaaaaua

SEQ ID NO: 3838455 - RNA, 20 nt, Shigella flexneri 2a str. 2457T
aauagaaccuaagaaccaga

SEQ ID NO: 3838456 - RNA, 20 nt, Shigella flexneri 2a str. 2457T
aauagaacuauaauugcuuu

SEQ ID NO: 3838457 - RNA, 17 nt, Shigella flexneri 2a str. 2457T
aauagagaucucucuug

SEQ ID NO: 3838458 - RNA, 18 nt, Shigella flexneri 2a str. 2457T
aauagagaucucucuugc

SEQ ID NO: 3838459 - RNA, 21 nt, Shigella flexneri 2a str. 2457T
aauagagugguuagagcacag

SEQ ID NO: 3838460 - RNA, 21 nt, Shigella flexneri 2a str. 2457T
aauagccagcagagcaaaaau

SEQ ID NO: 3838461 - RNA, 17 nt, Shigella flexneri 2a str. 2457T
aauagccgcagccauca

SEQ ID NO: 3838462 - RNA, 20 nt, Shigella flexneri 2a str. 2457T
aauagcgaacagacaaaaag

SEQ ID NO: 3838463 - RNA, 14 nt, Shigella flexneri 2a str. 2457T
aauagcgaagacug

SEQ ID NO: 3838464 - RNA, 20 nt, Shigella flexneri 2a str. 2457T
aauagcggaaaucuccagau

SEQ ID NO: 3838465 - RNA, 19 nt, Shigella flexneri 2a str. 2457T
aauagcgugauuguggcaa

SEQ ID NO: 3838466 - RNA, 19 nt, Shigella flexneri 2a str. 2457T
aauagcguuaaucaucaac

SEQ ID NO: 3838467 - RNA, 13 nt, Shigella flexneri 2a str. 2457T
aauagcucaauga

SEQ ID NO: 3838468 - RNA, 22 nt, Shigella flexneri 2a str. 2457T
aauaguuauagccguaacugua

SEQ ID NO: 3838469 - RNA, 19 nt, Shigella flexneri 2a str. 2457T
aauaguuucagccucugcc

SEQ ID NO: 3838470 - RNA, 14 nt, Shigella flexneri 2a str. 2457T
aauaguuucaguau

SEQ ID NO: 3838471 - RNA, 18 nt, Shigella flexneri 2a str. 2457T
aauaguuucugacauuuu

SEQ ID NO: 3838472 - RNA, 17 nt, Shigella flexneri 2a str. 2457T
aauauaaaacaacggaa

SEQ ID NO: 3838473 - RNA, 23 nt, Shigella flexneri 2a str. 2457T
aauauaaaacaacggaacgaaaa

SEQ ID NO: 3838474 - RNA, 23 nt, Shigella flexneri 2a str. 2457T
aauauaagucaggguauuaaccg

SEQ ID NO: 3838475 - RNA, 22 nt, Shigella flexneri 2a str. 2457T
aauauacaggcggguaaucuuu

SEQ ID NO: 3838476 - RNA, 23 nt, Shigella flexneri 2a str. 2457T
aauauaccauggaagaaaaauau

SEQ ID NO: 3838477 - RNA, 16 nt, Shigella flexneri 2a str. 2457T
aauauagcgccacgcu

SEQ ID NO: 3838478 - RNA, 20 nt, Shigella flexneri 2a str. 2457T
aauauaguagaucuugauuu

SEQ ID NO: 3838479 - RNA, 14 nt, Shigella flexneri 2a str. 2457T
aauauauaauuaaa

SEQ ID NO: 3838480 - RNA, 18 nt, Shigella flexneri 2a str. 2457T
aauauauaauuaaaaaua

SEQ ID NO: 3838481 - RNA, 21 nt, Shigella flexneri 2a str. 2457T
aauauaucagccugaaugcuu

SEQ ID NO: 3838482 - RNA, 20 nt, Shigella flexneri 2a str. 2457T
aauauauccgaaaaaggaua

SEQ ID NO: 3838483 - RNA, 11 nt, Shigella flexneri 2a str. 2457T
aauauauccua

SEQ ID NO: 3838484 - RNA, 15 nt, Shigella flexneri 2a str. 2457T
aauauaugcauugau

SEQ ID NO: 3838485 - RNA, 21 nt, Shigella flexneri 2a str. 2457T
aauauauucucuuuuguuacu

SEQ ID NO: 3838486 - RNA, 18 nt, Shigella flexneri 2a str. 2457T
aauaucaagaucaucaaa

SEQ ID NO: 3838487 - RNA, 14 nt, Shigella flexneri 2a str. 2457T
aauaucaauacauc

SEQ ID NO: 3838488 - RNA, 13 nt, Shigella flexneri 2a str. 2457T
aauaucaaucuuc

SEQ ID NO: 3838489 - RNA, 21 nt, Shigella flexneri 2a str. 2457T
aauaucacucggggcuuuucu

SEQ ID NO: 3838490 - RNA, 16 nt, Shigella flexneri 2a str. 2457T
aauaucaguuauuaca

SEQ ID NO: 3838491 - RNA, 11 nt, Shigella flexneri 2a str. 2457T
aaucagcgcag

SEQ ID NO: 3838492 - RNA, 11 nt, Shigella flexneri 2a str. 2457T
aaucagcggca

SEQ ID NO: 3838493 - RNA, 22 nt, Shigella flexneri 2a str. 2457T
aaucagcguaacgauggcaauu

SEQ ID NO: 3838494 - RNA, 17 nt, Shigella flexneri 2a str. 2457T
aaucagcuuuuccauau

SEQ ID NO: 3838495 - RNA, 19 nt, Shigella flexneri 2a str. 2457T
aaucagcuuuuccauauca

SEQ ID NO: 3838496 - RNA, 17 nt, Shigella flexneri 2a str. 2457T
aaucaggcaggucuuuc

SEQ ID NO: 3838497 - RNA, 22 nt, Shigella flexneri 2a str. 2457T
aaucagugguguagggcaggcg

SEQ ID NO: 3838498 - RNA, 16 nt, Shigella flexneri 2a str. 2457T
aaucaguucaaauuca

SEQ ID NO: 3838499 - RNA, 18 nt, Shigella flexneri 2a str. 2457T
aaucaguucuaccaucaa

SEQ ID NO: 3838500 - RNA, 18 nt, Shigella flexneri 2a str. 2457T
aaucaguuugaugccugc

SEQ ID NO: 3838501 - RNA, 19 nt, Shigella flexneri 2a str. 2457T
aaucauaauguugcugccu

SEQ ID NO: 3838502 - RNA, 18 nt, Shigella flexneri 2a str. 2457T
aaucauauuaaauuuuuu

SEQ ID NO: 3838503 - RNA, 15 nt, Shigella flexneri 2a str. 2457T
aaucauauucaccac

SEQ ID NO: 3838504 - RNA, 15 nt, Shigella flexneri 2a str. 2457T
aaucaucaguaccag

SEQ ID NO: 3838505 - RNA, 13 nt, Shigella flexneri 2a str. 2457T
aaucauccagcac

SEQ ID NO: 3838506 - RNA, 15 nt, Shigella flexneri 2a str. 2457T
aaucauccauauuuu

SEQ ID NO: 3838507 - RNA, 22 nt, Shigella flexneri 2a str. 2457T
aaucauccauauuuucagcagu

SEQ ID NO: 3838508 - RNA, 19 nt, Shigella flexneri 2a str. 2457T
aaucauccuaccgccaggu

SEQ ID NO: 3838509 - RNA, 17 nt, Shigella flexneri 2a str. 2457T
aaucaucgacuccagcg

SEQ ID NO: 3838510 - RNA, 20 nt, Shigella flexneri 2a str. 2457T
aaucaucgccuuaugcugcu

SEQ ID NO: 3838511 - RNA, 20 nt, Shigella flexneri 2a str. 2457T
aaucaucgcggcacacagca

SEQ ID NO: 3838512 - RNA, 19 nt, Shigella flexneri 2a str. 2457T
aaucaucugauaucucacc

SEQ ID NO: 3838513 - RNA, 20 nt, Shigella flexneri 2a str. 2457T
aaucaucugauaucucacca

SEQ ID NO: 3838514 - RNA, 12 nt, Shigella flexneri 2a str. 2457T
aaucaugcaaua

SEQ ID NO: 3838515 - RNA, 14 nt, Shigella flexneri 2a str. 2457T
aaucaugcaauaaa

SEQ ID NO: 3838516 - RNA, 17 nt, Shigella flexneri 2a str. 2457T
aaucaugcaauaaauau

SEQ ID NO: 3838517 - RNA, 18 nt, Shigella flexneri 2a str. 2457T
aaucauuacaguuucgga

SEQ ID NO: 3838518 - RNA, 13 nt, Shigella flexneri 2a str. 2457T
aaucauucccauu

SEQ ID NO: 3838519 - RNA, 22 nt, Shigella flexneri 2a str. 2457T
aaucauucgccgguuccagcuu

SEQ ID NO: 3838520 - RNA, 16 nt, Shigella flexneri 2a str. 2457T
aaucauuuuuugaagu

SEQ ID NO: 3838521 - RNA, 21 nt, Shigella flexneri 2a str. 2457T
aauccacaacggcauuauuca

SEQ ID NO: 3838522 - RNA, 14 nt, Shigella flexneri 2a str. 2457T
aauccacagcaaug

SEQ ID NO: 3838523 - RNA, 16 nt, Shigella flexneri 2a str. 2457T
aauccacgcgcgaaau

SEQ ID NO: 3838524 - RNA, 19 nt, Shigella flexneri 2a str. 2457T
aauccacgguuuaucggcg

SEQ ID NO: 3838525 - RNA, 22 nt, Shigella flexneri 2a str. 2457T
aauccacguuccuggaaccagu

SEQ ID NO: 3838526 - RNA, 15 nt, Shigella flexneri 2a str. 2457T
aauccagaacaccau

SEQ ID NO: 3838527 - RNA, 22 nt, Shigella flexneri 2a str. 2457T
aauccagauuuauaaaagaaaa

SEQ ID NO: 3838528 - RNA, 20 nt, Shigella flexneri 2a str. 2457T
aauccagcucuuuuccagcc

SEQ ID NO: 3838529 - RNA, 17 nt, Shigella flexneri 2a str. 2457T
aauccaguaagcugugc

SEQ ID NO: 3838530 - RNA, 14 nt, Shigella flexneri 2a str. 2457T
aauccaucccgcuc

SEQ ID NO: 3838531 - RNA, 12 nt, Shigella flexneri 2a str. 2457T
aauccaucgccu

SEQ ID NO: 3838532 - RNA, 15 nt, Shigella flexneri 2a str. 2457T
aauccauucaucgcc

SEQ ID NO: 3838533 - RNA, 15 nt, Shigella flexneri 2a str. 2457T
aaucccaaaauaaua

SEQ ID NO: 3838534 - RNA, 15 nt, Shigella flexneri 2a str. 2457T
aaucccccacuuuua

SEQ ID NO: 3838535 - RNA, 16 nt, Shigella flexneri 2a str. 2457T
aauccccuccagcgag

SEQ ID NO: 3838536 - RNA, 22 nt, Shigella flexneri 2a str. 2457T
aauccccucuucagccgcaaac

SEQ ID NO: 3838537 - RNA, 19 nt, Shigella flexneri 2a str. 2457T
aauccccuucucaaucccu

SEQ ID NO: 3838538 - RNA, 20 nt, Shigella flexneri 2a str. 2457T
aaucccgccauaacggcugu

SEQ ID NO: 3838539 - RNA, 12 nt, Shigella flexneri 2a str. 2457T
aaucccgccauu

SEQ ID NO: 3838540 - RNA, 13 nt, Shigella flexneri 2a str. 2457T
aaucccugcgaac

SEQ ID NO: 3838541 - RNA, 20 nt, Shigella flexneri 2a str. 2457T
aaucccuuagcuaauuuuug

SEQ ID NO: 3838542 - RNA, 12 nt, Shigella flexneri 2a str. 2457T
aaucccuucgac

SEQ ID NO: 3838543 - RNA, 13 nt, Shigella flexneri 2a str. 2457T
aauccgcaccaac

SEQ ID NO: 3838544 - RNA, 17 nt, Shigella flexneri 2a str. 2457T
aauccgcccuaacaucg

SEQ ID NO: 3838545 - RNA, 18 nt, Shigella flexneri 2a str. 2457T
aauccgcuuguucaguau

SEQ ID NO: 3838546 - RNA, 16 nt, Shigella flexneri 2a str. 2457T
aauccgggucuguaaa

SEQ ID NO: 3838547 - RNA, 18 nt, Shigella flexneri 2a str. 2457T
aauccgggugaacugcca

SEQ ID NO: 3838548 - RNA, 18 nt, Shigella flexneri 2a str. 2457T
aauccgguagguucaaca

SEQ ID NO: 3838549 - RNA, 22 nt, Shigella flexneri 2a str. 2457T
aauccgucagcgaguugaucac

SEQ ID NO: 3838550 - RNA, 17 nt, Shigella flexneri 2a str. 2457T
aauccugaguuaagcaa

SEQ ID NO: 3838551 - RNA, 20 nt, Shigella flexneri 2a str. 2457T
aauccugaguuaagcaaaaa

SEQ ID NO: 3838552 - RNA, 21 nt, Shigella flexneri 2a str. 2457T
aauccugaguuaagcaaaaaa

SEQ ID NO: 3838553 - RNA, 21 nt, Shigella flexneri 2a str. 2457T
aauccuucacuuuugccagac

SEQ ID NO: 3838554 - RNA, 22 nt, Shigella flexneri 2a str. 2457T
aauccuucacuuuugccagacg

SEQ ID NO: 3838555 - RNA, 23 nt, Shigella flexneri 2a str. 2457T
aauccuucacuuuugccagacga

SEQ ID NO: 3838556 - RNA, 19 nt, Shigella flexneri 2a str. 2457T
aaucgagauacguuugcca

SEQ ID NO: 3838557 - RNA, 20 nt, Shigella flexneri 2a str. 2457T
aaucgagcccagaugccgga

SEQ ID NO: 3838558 - RNA, 16 nt, Shigella flexneri 2a str. 2457T
aaucgauaaaccagca

SEQ ID NO: 3838559 - RNA, 24 nt, Shigella flexneri 2a str. 2457T
aaucgaucaucaccugagcuggca

SEQ ID NO: 3838560 - RNA, 17 nt, Shigella flexneri 2a str. 2457T
aaucgcaacgccuuccg

SEQ ID NO: 3838561 - RNA, 19 nt, Shigella flexneri 2a str. 2457T
aaucgcacguugucagcaa

SEQ ID NO: 3838562 - RNA, 19 nt, Shigella flexneri 2a str. 2457T
aaucgccacaacuucaacg

SEQ ID NO: 3838563 - RNA, 14 nt, Shigella flexneri 2a str. 2457T
aaucgccagcggca

SEQ ID NO: 3838564 - RNA, 18 nt, Shigella flexneri 2a str. 2457T
aaucgccagcggcagcuc

SEQ ID NO: 3838565 - RNA, 19 nt, Shigella flexneri 2a str. 2457T
aaucgccaucuuuacaccu

SEQ ID NO: 3838566 - RNA, 19 nt, Shigella flexneri 2a str. 2457T
aaucgccgaaccagugcuc

SEQ ID NO: 3838567 - RNA, 17 nt, Shigella flexneri 2a str. 2457T
aaucgccguauaauauc

SEQ ID NO: 3838568 - RNA, 23 nt, Shigella flexneri 2a str. 2457T
aaucgccuuaauaacccacacca

SEQ ID NO: 3838569 - RNA, 13 nt, Shigella flexneri 2a str. 2457T
aaucgcucagcgc

SEQ ID NO: 3838570 - RNA, 14 nt, Shigella flexneri 2a str. 2457T
aaucgcugaauauc

SEQ ID NO: 3838571 - RNA, 13 nt, Shigella flexneri 2a str. 2457T
aaucgcugcggca

SEQ ID NO: 3838572 - RNA, 22 nt, Shigella flexneri 2a str. 2457T
aaucgcuucagccggaauaauc

SEQ ID NO: 3838573 - RNA, 24 nt, Shigella flexneri 2a str. 2457T
aaucgcuuuuucugcaucaaccaa

SEQ ID NO: 3838574 - RNA, 16 nt, Shigella flexneri 2a str. 2457T
aaucggaaacaaauac

SEQ ID NO: 3838575 - RNA, 21 nt, Shigella flexneri 2a str. 2457T
aaucggcgaagagagcgccag

SEQ ID NO: 3838576 - RNA, 17 nt, Shigella flexneri 2a str. 2457T
aaucgggaaaaucugcg

SEQ ID NO: 3838577 - RNA, 20 nt, Shigella flexneri 2a str. 2457T
aaucgggaaaaucugcggga

SEQ ID NO: 3838578 - RNA, 14 nt, Shigella flexneri 2a str. 2457T
aaucgggaaauaac

SEQ ID NO: 3838579 - RNA, 20 nt, Shigella flexneri 2a str. 2457T
aaucgggagagauaagauaa

SEQ ID NO: 3838580 - RNA, 14 nt, Shigella flexneri 2a str. 2457T
aaucgguaacgcuu

SEQ ID NO: 3838581 - RNA, 17 nt, Shigella flexneri 2a str. 2457T
aaucggugcaaaugcca

SEQ ID NO: 3838582 - RNA, 19 nt, Shigella flexneri 2a str. 2457T
aaucgguucgccugcacca

SEQ ID NO: 3838583 - RNA, 12 nt, Shigella flexneri 2a str. 2457T
aaucgucaguuc

SEQ ID NO: 3838584 - RNA, 14 nt, Shigella flexneri 2a str. 2457T
aaucgucaguucac

SEQ ID NO: 3838585 - RNA, 19 nt, Shigella flexneri 2a str. 2457T
aaucgucaguuuuucacga

SEQ ID NO: 3838586 - RNA, 16 nt, Shigella flexneri 2a str. 2457T
aaucgucaucgacagc

SEQ ID NO: 3838587 - RNA, 17 nt, Shigella flexneri 2a str. 2457T
aaucgucgauuguuaua

SEQ ID NO: 3838588 - RNA, 21 nt, Shigella flexneri 2a str. 2457T
aaugccucgugcucagagcua

SEQ ID NO: 3838589 - RNA, 18 nt, Shigella flexneri 2a str. 2457T
aaugccucucaaaccccg

SEQ ID NO: 3838590 - RNA, 19 nt, Shigella flexneri 2a str. 2457T
aaugccucuccccagcgga

SEQ ID NO: 3838591 - RNA, 21 nt, Shigella flexneri 2a str. 2457T
aaugccugcacuuugugucag

SEQ ID NO: 3838592 - RNA, 17 nt, Shigella flexneri 2a str. 2457T
aaugccuuauccgaugg

SEQ ID NO: 3838593 - RNA, 14 nt, Shigella flexneri 2a str. 2457T
aaugccuuucucag

SEQ ID NO: 3838594 - RNA, 21 nt, Shigella flexneri 2a str. 2457T
aaugccuuugaaaucgaacag

SEQ ID NO: 3838595 - RNA, 21 nt, Shigella flexneri 2a str. 2457T
aaugcgaaaacgauguuugcu

SEQ ID NO: 3838596 - RNA, 14 nt, Shigella flexneri 2a str. 2457T
aaugcgacccaugc

SEQ ID NO: 3838597 - RNA, 14 nt, Shigella flexneri 2a str. 2457T
aaugcgcaaaauuc

SEQ ID NO: 3838598 - RNA, 18 nt, Shigella flexneri 2a str. 2457T
aaugcgcaucaaagccag

SEQ ID NO: 3838599 - RNA, 23 nt, Shigella flexneri 2a str. 2457T
aaugcgcccagcgucagcauaaa

SEQ ID NO: 3838600 - RNA, 21 nt, Shigella flexneri 2a str. 2457T
aaugcgcuguuuagcgcggca

SEQ ID NO: 3838601 - RNA, 18 nt, Shigella flexneri 2a str. 2457T
aaugcgggcgaaaacauc

SEQ ID NO: 3838602 - RNA, 17 nt, Shigella flexneri 2a str. 2457T
aaugcguggcgcguacc

SEQ ID NO: 3838603 - RNA, 15 nt, Shigella flexneri 2a str. 2457T
aaugcguuccagcau

SEQ ID NO: 3838604 - RNA, 21 nt, Shigella flexneri 2a str. 2457T
aaugcguugcuggcagauaaa

SEQ ID NO: 3838605 - RNA, 20 nt, Shigella flexneri 2a str. 2457T
aaugcguuuaaagugaauac

SEQ ID NO: 3838606 - RNA, 17 nt, Shigella flexneri 2a str. 2457T
aaugcguuuugagccug

SEQ ID NO: 3838607 - RNA, 22 nt, Shigella flexneri 2a str. 2457T
aaugcuacgcgcaauauccugc

SEQ ID NO: 3838608 - RNA, 19 nt, Shigella flexneri 2a str. 2457T
aaugcucuccguaggccag

SEQ ID NO: 3838609 - RNA, 16 nt, Shigella flexneri 2a str. 2457T
aaugcucucuucgcca

SEQ ID NO: 3838610 - RNA, 23 nt, Shigella flexneri 2a str. 2457T
aaugcucugcacguuuugcugau

SEQ ID NO: 3838611 - RNA, 16 nt, Shigella flexneri 2a str. 2457T
aaugcugacaaaaccg

SEQ ID NO: 3838612 - RNA, 15 nt, Shigella flexneri 2a str. 2457T
aaugcugcagccagg

SEQ ID NO: 3838613 - RNA, 22 nt, Shigella flexneri 2a str. 2457T
aaugcugucgguuuauggaaaa

SEQ ID NO: 3838614 - RNA, 18 nt, Shigella flexneri 2a str. 2457T
aaugcugugaagauggcu

SEQ ID NO: 3838615 - RNA, 12 nt, Shigella flexneri 2a str. 2457T
aaugcuucacac

SEQ ID NO: 3838616 - RNA, 13 nt, Shigella flexneri 2a str. 2457T
aaugcuucuaccg

SEQ ID NO: 3838617 - RNA, 13 nt, Shigella flexneri 2a str. 2457T
aaugcuuuaaaug

SEQ ID NO: 3838618 - RNA, 13 nt, Shigella flexneri 2a str. 2457T
aaugcuuuauacg

SEQ ID NO: 3838619 - RNA, 14 nt, Shigella flexneri 2a str. 2457T
aauggaaacagcac

SEQ ID NO: 3838620 - RNA, 17 nt, Shigella flexneri 2a str. 2457T
aauggaaagcccgcccc

SEQ ID NO: 3838621 - RNA, 22 nt, Shigella flexneri 2a str. 2457T
aauggaaagcccgccccgcucg

SEQ ID NO: 3838622 - RNA, 15 nt, Shigella flexneri 2a str. 2457T
aauggaaauuguuuu

SEQ ID NO: 3838623 - RNA, 23 nt, Shigella flexneri 2a str. 2457T
aauggaaucgcucucagagagaa

SEQ ID NO: 3838624 - RNA, 17 nt, Shigella flexneri 2a str. 2457T
aauggacacuauuuccc

SEQ ID NO: 3838625 - RNA, 18 nt, Shigella flexneri 2a str. 2457T
aauggagacgguuucugc

SEQ ID NO: 3838626 - RNA, 17 nt, Shigella flexneri 2a str. 2457T
aauggagcuaaacagcg

SEQ ID NO: 3838627 - RNA, 19 nt, Shigella flexneri 2a str. 2457T
aauggagcuaaacagcgcu

SEQ ID NO: 3838628 - RNA, 22 nt, Shigella flexneri 2a str. 2457T
aauggauuagcgaccgaacaga

SEQ ID NO: 3838629 - RNA, 14 nt, Shigella flexneri 2a str. 2457T
aauggcaaugacua

SEQ ID NO: 3838630 - RNA, 15 nt, Shigella flexneri 2a str. 2457T
aauggcaggcucaga

SEQ ID NO: 3838631 - RNA, 19 nt, Shigella flexneri 2a str. 2457T
aauggcaggcucagacuga

SEQ ID NO: 3838632 - RNA, 14 nt, Shigella flexneri 2a str. 2457T
aauggcaucugaua

SEQ ID NO: 3838633 - RNA, 19 nt, Shigella flexneri 2a str. 2457T
aauggcccauuuucucggc

SEQ ID NO: 3838634 - RNA, 23 nt, Shigella flexneri 2a str. 2457T
aauggccgucgccacaaccagcg

SEQ ID NO: 3838635 - RNA, 16 nt, Shigella flexneri 2a str. 2457T
aauggcgacuucugcu

SEQ ID NO: 3838636 - RNA, 19 nt, Shigella flexneri 2a str. 2457T
aauggcgcauccagccaac

SEQ ID NO: 3838637 - RNA, 14 nt, Shigella flexneri 2a str. 2457T
aauggcgcgaaaac

SEQ ID NO: 3838638 - RNA, 17 nt, Shigella flexneri 2a str. 2457T
aauggcuuuacgcgcca

SEQ ID NO: 3838639 - RNA, 13 nt, Shigella flexneri 2a str. 2457T
aauggcuuuugcc

SEQ ID NO: 3838640 - RNA, 17 nt, Shigella flexneri 2a str. 2457T
aaugguaacuuucugcc

SEQ ID NO: 3838641 - RNA, 13 nt, Shigella flexneri 2a str. 2457T
aaugguagccgcc

SEQ ID NO: 3838642 - RNA, 13 nt, Shigella flexneri 2a str. 2457T
aauggucagcgcc

SEQ ID NO: 3838643 - RNA, 18 nt, Shigella flexneri 2a str. 2457T
aaugguccgugacccgga

SEQ ID NO: 3838644 - RNA, 23 nt, Shigella flexneri 2a str. 2457T
aaugguccgugacccggaauaaa

SEQ ID NO: 3838645 - RNA, 19 nt, Shigella flexneri 2a str. 2457T
aauggucuggugaccuggg

SEQ ID NO: 3838646 - RNA, 20 nt, Shigella flexneri 2a str. 2457T
aauggucuggugaccuggga

SEQ ID NO: 3838647 - RNA, 22 nt, Shigella flexneri 2a str. 2457T
aauggugugcaugguguucaga

SEQ ID NO: 3838648 - RNA, 18 nt, Shigella flexneri 2a str. 2457T
aaugguuucauuccagua

SEQ ID NO: 3838649 - RNA, 19 nt, Shigella flexneri 2a str. 2457T
aauguaauacgcucaucug

SEQ ID NO: 3838650 - RNA, 22 nt, Shigella flexneri 2a str. 2457T
aaugucacaaauaaaaaaugag

SEQ ID NO: 3838651 - RNA, 23 nt, Shigella flexneri 2a str. 2457T
aaugucacaaauaaaaaaugaga

SEQ ID NO: 3838652 - RNA, 13 nt, Shigella flexneri 2a str. 2457T
aaugucaucagca

SEQ ID NO: 3838653 - RNA, 20 nt, Shigella flexneri 2a str. 2457T
aaugucaucucuggcacgag

SEQ ID NO: 3838654 - RNA, 21 nt, Shigella flexneri 2a str. 2457T
aaugucaucucuggcacgaga

SEQ ID NO: 3838655 - RNA, 23 nt, Shigella flexneri 2a str. 2457T
aaugucaucucuggcacgagauc

SEQ ID NO: 3838656 - RNA, 23 nt, Shigella flexneri 2a str. 2457T
aaugucgauaaaguuagagccag

SEQ ID NO: 3838657 - RNA, 18 nt, Shigella flexneri 2a str. 2457T
aaugucgauuaucgacuc

SEQ ID NO: 3838658 - RNA, 21 nt, Shigella flexneri 2a str. 2457T
aaugucggauuucgcagccau

SEQ ID NO: 3838659 - RNA, 18 nt, Shigella flexneri 2a str. 2457T
aaugucggcccgcauuau

SEQ ID NO: 3838660 - RNA, 15 nt, Shigella flexneri 2a str. 2457T
aaugugaaaacccug

SEQ ID NO: 3838661 - RNA, 22 nt, Shigella flexneri 2a str. 2457T
aauguggcaaugaguggugaaa

SEQ ID NO: 3838662 - RNA, 18 nt, Shigella flexneri 2a str. 2457T
aauguguuuauaagccau

SEQ ID NO: 3838663 - RNA, 13 nt, Shigella flexneri 2a str. 2457T
aauguuaacgcca

SEQ ID NO: 3838664 - RNA, 13 nt, Shigella flexneri 2a str. 2457T
aauguuacgaccu

SEQ ID NO: 3838665 - RNA, 19 nt, Shigella flexneri 2a str. 2457T
aauguuccaucaccagauu

SEQ ID NO: 3838666 - RNA, 21 nt, Shigella flexneri 2a str. 2457T
aauguuccggguuugccacau

SEQ ID NO: 3838667 - RNA, 19 nt, Shigella flexneri 2a str. 2457T
aauguucguccauuucagc

SEQ ID NO: 3838668 - RNA, 23 nt, Shigella flexneri 2a str. 2457T
aauguucguccauuucagcgcag

SEQ ID NO: 3838669 - RNA, 20 nt, Shigella flexneri 2a str. 2457T
aauguuguaagcuugacaua

SEQ ID NO: 3838670 - RNA, 15 nt, Shigella flexneri 2a str. 2457T
aauguuuaugccugg

SEQ ID NO: 3838671 - RNA, 12 nt, Shigella flexneri 2a str. 2457T
aauguuucugca

SEQ ID NO: 3838672 - RNA, 19 nt, Shigella flexneri 2a str. 2457T
aauguuucugcaauauauu

SEQ ID NO: 3838673 - RNA, 15 nt, Shigella flexneri 2a str. 2457T
aauguuugcaauaaa

SEQ ID NO: 3838674 - RNA, 17 nt, Shigella flexneri 2a str. 2457T
aauuaaacccgcaggcg

SEQ ID NO: 3838675 - RNA, 18 nt, Shigella flexneri 2a str. 2457T
aauuaaaccuaaaaagaa

SEQ ID NO: 3838676 - RNA, 22 nt, Shigella flexneri 2a str. 2457T
aauuaaacgccucugucagaaa

SEQ ID NO: 3838677 - RNA, 21 nt, Shigella flexneri 2a str. 2457T
aauuaacaccuagugcagaua

SEQ ID NO: 3838678 - RNA, 16 nt, Shigella flexneri 2a str. 2457T
aauuaacgaaaucuca

SEQ ID NO: 3838679 - RNA, 17 nt, Shigella flexneri 2a str. 2457T
aauuaauaaucacauaa

SEQ ID NO: 3838680 - RNA, 21 nt, Shigella flexneri 2a str. 2457T
aauuaauccuuucgaaaaacc

SEQ ID NO: 3838681 - RNA, 19 nt, Shigella flexneri 2a str. 2457T
aauuacacagcgacguaaa

SEQ ID NO: 3838682 - RNA, 17 nt, Shigella flexneri 2a str. 2457T
aauuacacccuuaauca

SEQ ID NO: 3838683 - RNA, 14 nt, Shigella flexneri 2a str. 2457T
aauuaccgcaaagc

SEQ ID NO: 3838684 - RNA, 19 nt, Shigella flexneri 2a str. 2457T
aauuaccgcaccaccagca

SEQ ID NO: 3838685 - RNA, 13 nt, Shigella flexneri 2a str. 2457T
aauuuaacaccau

SEQ ID NO: 3838686 - RNA, 17 nt, Shigella flexneri 2a str. 2457T
aauuuaccgacgcugcu

SEQ ID NO: 3838687 - RNA, 19 nt, Shigella flexneri 2a str. 2457T
aauuuaccgacgcugcuca

SEQ ID NO: 3838688 - RNA, 19 nt, Shigella flexneri 2a str. 2457T
aauuuacguuuuaaaccua

SEQ ID NO: 3838689 - RNA, 14 nt, Shigella flexneri 2a str. 2457T
aauuuagugaccaa

SEQ ID NO: 3838690 - RNA, 19 nt, Shigella flexneri 2a str. 2457T
aauuuagugaccaaucauu

SEQ ID NO: 3838691 - RNA, 19 nt, Shigella flexneri 2a str. 2457T
aauuuauaaucuuuaaaaa

SEQ ID NO: 3838692 - RNA, 14 nt, Shigella flexneri 2a str. 2457T
aauuuaucagacaa

SEQ ID NO: 3838693 - RNA, 17 nt, Shigella flexneri 2a str. 2457T
aauuucacguucaccca

SEQ ID NO: 3838694 - RNA, 12 nt, Shigella flexneri 2a str. 2457T
aauuucacugcu

SEQ ID NO: 3838695 - RNA, 13 nt, Shigella flexneri 2a str. 2457T
aauuucacuugcu

SEQ ID NO: 3838696 - RNA, 13 nt, Shigella flexneri 2a str. 2457T
aauuucagcaaua

SEQ ID NO: 3838697 - RNA, 13 nt, Shigella flexneri 2a str. 2457T
aauuucagcgccu

SEQ ID NO: 3838698 - RNA, 15 nt, Shigella flexneri 2a str. 2457T
aauuucagcgccuga

SEQ ID NO: 3838699 - RNA, 18 nt, Shigella flexneri 2a str. 2457T
aauuucagcgccugauac

SEQ ID NO: 3838700 - RNA, 17 nt, Shigella flexneri 2a str. 2457T
aauuucagcggcacugu

SEQ ID NO: 3838701 - RNA, 17 nt, Shigella flexneri 2a str. 2457T
aauuucagcguccugcc

SEQ ID NO: 3838702 - RNA, 22 nt, Shigella flexneri 2a str. 2457T
aauuucaucacugaauuucgcc

SEQ ID NO: 3838703 - RNA, 17 nt, Shigella flexneri 2a str. 2457T
aauuucaucgccgguaa

SEQ ID NO: 3838704 - RNA, 18 nt, Shigella flexneri 2a str. 2457T
aauuucaucgcuacacca

SEQ ID NO: 3838705 - RNA, 18 nt, Shigella flexneri 2a str. 2457T
aauuucauuaagaacucc

SEQ ID NO: 3838706 - RNA, 18 nt, Shigella flexneri 2a str. 2457T
aauuuccgccaccugauc

SEQ ID NO: 3838707 - RNA, 23 nt, Shigella flexneri 2a str. 2457T
aauuucgcguaguuaugaaaaua

SEQ ID NO: 3838708 - RNA, 18 nt, Shigella flexneri 2a str. 2457T
aauuucuccuucacucua

SEQ ID NO: 3838709 - RNA, 17 nt, Shigella flexneri 2a str. 2457T
aauuucugacugagcug

SEQ ID NO: 3838710 - RNA, 22 nt, Shigella flexneri 2a str. 2457T
aauuucugugcagccaaaaaug

SEQ ID NO: 3838711 - RNA, 18 nt, Shigella flexneri 2a str. 2457T
aauuucuuaccacugccg

SEQ ID NO: 3838712 - RNA, 18 nt, Shigella flexneri 2a str. 2457T
aauuucuucccuuucugc

SEQ ID NO: 3838713 - RNA, 15 nt, Shigella flexneri 2a str. 2457T
aauuugaacaaggug

SEQ ID NO: 3838714 - RNA, 13 nt, Shigella flexneri 2a str. 2457T
aauuugaggaagc

SEQ ID NO: 3838715 - RNA, 14 nt, Shigella flexneri 2a str. 2457T
aauuugaggaagcu

SEQ ID NO: 3838716 - RNA, 14 nt, Shigella flexneri 2a str. 2457T
aauuugaucaaaua

SEQ ID NO: 3838717 - RNA, 22 nt, Shigella flexneri 2a str. 2457T
aauuugccguuaaucccagacu

SEQ ID NO: 3838718 - RNA, 13 nt, Shigella flexneri 2a str. 2457T
aauuugcgcucaa

SEQ ID NO: 3838719 - RNA, 20 nt, Shigella flexneri 2a str. 2457T
aauuugcgcucaauaaucaa

SEQ ID NO: 3838720 - RNA, 18 nt, Shigella flexneri 2a str. 2457T
aauuugcuaccccugaga

SEQ ID NO: 3838721 - RNA, 14 nt, Shigella flexneri 2a str. 2457T
aauuugcuccagaa

SEQ ID NO: 3838722 - RNA, 20 nt, Shigella flexneri 2a str. 2457T
aauuugcuucuggcuggcgc

SEQ ID NO: 3838723 - RNA, 14 nt, Shigella flexneri 2a str. 2457T
aauuuggaagaauu

SEQ ID NO: 3838724 - RNA, 15 nt, Shigella flexneri 2a str. 2457T
aauuuggcuccucug

SEQ ID NO: 3838725 - RNA, 17 nt, Shigella flexneri 2a str. 2457T
aauuuguccaccaauag

SEQ ID NO: 3838726 - RNA, 17 nt, Shigella flexneri 2a str. 2457T
aauuuguuggcgaaaau

SEQ ID NO: 3838727 - RNA, 12 nt, Shigella flexneri 2a str. 2457T
aauuuuaaauau

SEQ ID NO: 3838728 - RNA, 15 nt, Shigella flexneri 2a str. 2457T
aauuuuaggaugcug

SEQ ID NO: 3838729 - RNA, 19 nt, Shigella flexneri 2a str. 2457T
aauuuuauacuuuuucgcc

SEQ ID NO: 3838730 - RNA, 19 nt, Shigella flexneri 2a str. 2457T
aauuuuccuugaaaaagag

SEQ ID NO: 3838731 - RNA, 19 nt, Shigella flexneri 2a str. 2457T
aauuuucgccaucucaaaa

SEQ ID NO: 3838732 - RNA, 20 nt, Shigella flexneri 2a str. 2457T
aauuuugaacgggugauuaa

SEQ ID NO: 3838733 - RNA, 14 nt, Shigella flexneri 2a str. 2457T
aauuuuuauuauuu

SEQ ID NO: 3838734 - RNA, 17 nt, Shigella flexneri 2a str. 2457T
aauuuuuguuguuuaaa

SEQ ID NO: 3838735 - RNA, 21 nt, Shigella flexneri 2a str. 2457T
aauuuuuucacuguucugaua

SEQ ID NO: 3838736 - RNA, 14 nt, Shigella flexneri 2a str. 2457T
acaaaaaaaacagc

SEQ ID NO: 3838737 - RNA, 14 nt, Shigella flexneri 2a str. 2457T
acaaaaaagaguaa

SEQ ID NO: 3838738 - RNA, 16 nt, Shigella flexneri 2a str. 2457T
acaaaaaagccaauca

SEQ ID NO: 3838739 - RNA, 15 nt, Shigella flexneri 2a str. 2457T
acaaaaaaugugaag

SEQ ID NO: 3838740 - RNA, 21 nt, Shigella flexneri 2a str. 2457T
acaaaaaguaguuccagcaug

SEQ ID NO: 3838741 - RNA, 20 nt, Shigella flexneri 2a str. 2457T
acaaaaagugcuuucugaac

SEQ ID NO: 3838742 - RNA, 18 nt, Shigella flexneri 2a str. 2457T
acaaaaaugcccgauccu

SEQ ID NO: 3838743 - RNA, 21 nt, Shigella flexneri 2a str. 2457T
acaaaaccacgacuuuuuguc

SEQ ID NO: 3838744 - RNA, 13 nt, Shigella flexneri 2a str. 2457T
acaaaaccugccg

SEQ ID NO: 3838745 - RNA, 14 nt, Shigella flexneri 2a str. 2457T
acaaaacgggggcu

SEQ ID NO: 3838746 - RNA, 20 nt, Shigella flexneri 2a str. 2457T
acaaaagacgauaguaauuu

SEQ ID NO: 3838747 - RNA, 18 nt, Shigella flexneri 2a str. 2457T
acaaaagcacguaaauuc

SEQ ID NO: 3838748 - RNA, 22 nt, Shigella flexneri 2a str. 2457T
acaaaaucacgucgauuuuuaa

SEQ ID NO: 3838749 - RNA, 17 nt, Shigella flexneri 2a str. 2457T
acaaaaucggaaacaaa

SEQ ID NO: 3838750 - RNA, 18 nt, Shigella flexneri 2a str. 2457T
acaaaaucggaaacaaau

SEQ ID NO: 3838751 - RNA, 23 nt, Shigella flexneri 2a str. 2457T
acaaaaucgugaaaaaucaauau

SEQ ID NO: 3838752 - RNA, 19 nt, Shigella flexneri 2a str. 2457T
acaaaaucuauugcaacau

SEQ ID NO: 3838753 - RNA, 15 nt, Shigella flexneri 2a str. 2457T
acaaaaucuuaaaga

SEQ ID NO: 3838754 - RNA, 15 nt, Shigella flexneri 2a str. 2457T
acaaaaucuucguua

SEQ ID NO: 3838755 - RNA, 12 nt, Shigella flexneri 2a str. 2457T
acaaaauuuaac

SEQ ID NO: 3838756 - RNA, 22 nt, Shigella flexneri 2a str. 2457T
acaaaauuuucagcgugcccac

SEQ ID NO: 3838757 - RNA, 14 nt, Shigella flexneri 2a str. 2457T
acaaacaauuaaua

SEQ ID NO: 3838758 - RNA, 14 nt, Shigella flexneri 2a str. 2457T
acaaacacaaaacu

SEQ ID NO: 3838759 - RNA, 18 nt, Shigella flexneri 2a str. 2457T
acaaacaccgaaccagag

SEQ ID NO: 3838760 - RNA, 23 nt, Shigella flexneri 2a str. 2457T
acaaacagcgccuguuuaccgcu

SEQ ID NO: 3838761 - RNA, 18 nt, Shigella flexneri 2a str. 2457T
acaaacauugcugccaga

SEQ ID NO: 3838762 - RNA, 14 nt, Shigella flexneri 2a str. 2457T
acaaacgacgggcc

SEQ ID NO: 3838763 - RNA, 18 nt, Shigella flexneri 2a str. 2457T
acaaacgcaaaauugccu

SEQ ID NO: 3838764 - RNA, 16 nt, Shigella flexneri 2a str. 2457T
acaaacgcaaacacca

SEQ ID NO: 3838765 - RNA, 19 nt, Shigella flexneri 2a str. 2457T
acaaacgccagauacauca

SEQ ID NO: 3838766 - RNA, 15 nt, Shigella flexneri 2a str. 2457T
acaaacgcugacaua

SEQ ID NO: 3838767 - RNA, 21 nt, Shigella flexneri 2a str. 2457T
acaaacgcuuuacucaacucc

SEQ ID NO: 3838768 - RNA, 16 nt, Shigella flexneri 2a str. 2457T
acaaacuuaccgccgc

SEQ ID NO: 3838769 - RNA, 21 nt, Shigella flexneri 2a str. 2457T
acaaacuugauagaacaaaag

SEQ ID NO: 3838770 - RNA, 15 nt, Shigella flexneri 2a str. 2457T
acaaagaagggaaug

SEQ ID NO: 3838771 - RNA, 19 nt, Shigella flexneri 2a str. 2457T
acaaagacaauuuaccgac

SEQ ID NO: 3838772 - RNA, 18 nt, Shigella flexneri 2a str. 2457T
acaaagacaucaaacccu

SEQ ID NO: 3838773 - RNA, 13 nt, Shigella flexneri 2a str. 2457T
acaaagagcuuuc

SEQ ID NO: 3838774 - RNA, 15 nt, Shigella flexneri 2a str. 2457T
acaaagccaacagca

SEQ ID NO: 3838775 - RNA, 18 nt, Shigella flexneri 2a str. 2457T
acaaagcgcacuuugcca

SEQ ID NO: 3838776 - RNA, 20 nt, Shigella flexneri 2a str. 2457T
acaaagggcgucgcuuaauu

SEQ ID NO: 3838777 - RNA, 13 nt, Shigella flexneri 2a str. 2457T
acaaauaaaaaau

SEQ ID NO: 3838778 - RNA, 21 nt, Shigella flexneri 2a str. 2457T
acaaauaaauagauccaggaa

SEQ ID NO: 3838779 - RNA, 16 nt, Shigella flexneri 2a str. 2457T
acaaauagacacaaga

SEQ ID NO: 3838780 - RNA, 21 nt, Shigella flexneri 2a str. 2457T
acaaauagacacaagaaauau

SEQ ID NO: 3838781 - RNA, 21 nt, Shigella flexneri 2a str. 2457T
acaaauagagauagaaugcca

SEQ ID NO: 3838782 - RNA, 23 nt, Shigella flexneri 2a str. 2457T
acaaauagagauagaaugccaag

SEQ ID NO: 3838783 - RNA, 23 nt, Shigella flexneri 2a str. 2457T
acagagaaagcaaaaauaaaugc

SEQ ID NO: 3838784 - RNA, 14 nt, Shigella flexneri 2a str. 2457T
acagauccgccauu

SEQ ID NO: 3838785 - RNA, 14 nt, Shigella flexneri 2a str. 2457T
acagauucaggcgc

SEQ ID NO: 3838786 - RNA, 16 nt, Shigella flexneri 2a str. 2457T
acagauugauaaaaau

SEQ ID NO: 3838787 - RNA, 14 nt, Shigella flexneri 2a str. 2457T
acagauuuugccag

SEQ ID NO: 3838788 - RNA, 18 nt, Shigella flexneri 2a str. 2457T
acagauuuugccagcaug

SEQ ID NO: 3838789 - RNA, 12 nt, Shigella flexneri 2a str. 2457T
acagcaaaacac

SEQ ID NO: 3838790 - RNA, 12 nt, Shigella flexneri 2a str. 2457T
acagcaaaacgc

SEQ ID NO: 3838791 - RNA, 20 nt, Shigella flexneri 2a str. 2457T
acagcaaagugcccccaacu

SEQ ID NO: 3838792 - RNA, 18 nt, Shigella flexneri 2a str. 2457T
acagcacaucagccagau

SEQ ID NO: 3838793 - RNA, 16 nt, Shigella flexneri 2a str. 2457T
acagcaccagcaggug

SEQ ID NO: 3838794 - RNA, 19 nt, Shigella flexneri 2a str. 2457T
acagcaccauccgcccaca

SEQ ID NO: 3838795 - RNA, 20 nt, Shigella flexneri 2a str. 2457T
acagcacgaugaaucuguua

SEQ ID NO: 3838796 - RNA, 20 nt, Shigella flexneri 2a str. 2457T
acagcacgccccggcggccg

SEQ ID NO: 3838797 - RNA, 18 nt, Shigella flexneri 2a str. 2457T
acagcacgccccggcugc

SEQ ID NO: 3838798 - RNA, 14 nt, Shigella flexneri 2a str. 2457T
acagcagagcaugg

SEQ ID NO: 3838799 - RNA, 16 nt, Shigella flexneri 2a str. 2457T
acagcagcaacgauga

SEQ ID NO: 3838800 - RNA, 16 nt, Shigella flexneri 2a str. 2457T
acagcagccacaccaa

SEQ ID NO: 3838801 - RNA, 19 nt, Shigella flexneri 2a str. 2457T
acagcagccacaccaauca

SEQ ID NO: 3838802 - RNA, 13 nt, Shigella flexneri 2a str. 2457T
acagcagcccuug

SEQ ID NO: 3838803 - RNA, 19 nt, Shigella flexneri 2a str. 2457T
acagcaggcagauccaguu

SEQ ID NO: 3838804 - RNA, 15 nt, Shigella flexneri 2a str. 2457T
acagcaggccaagau

SEQ ID NO: 3838805 - RNA, 13 nt, Shigella flexneri 2a str. 2457T
acagcaggcucag

SEQ ID NO: 3838806 - RNA, 17 nt, Shigella flexneri 2a str. 2457T
acagcaggcucagaaga

SEQ ID NO: 3838807 - RNA, 21 nt, Shigella flexneri 2a str. 2457T
acagcaggcucagaagacgcu

SEQ ID NO: 3838808 - RNA, 20 nt, Shigella flexneri 2a str. 2457T
acagcagguguuacccgcua

SEQ ID NO: 3838809 - RNA, 21 nt, Shigella flexneri 2a str. 2457T
acagcaguacgccgagaauaa

SEQ ID NO: 3838810 - RNA, 13 nt, Shigella flexneri 2a str. 2457T
acagcauaccuuc

SEQ ID NO: 3838811 - RNA, 21 nt, Shigella flexneri 2a str. 2457T
acagcauaccuucacagaagg

SEQ ID NO: 3838812 - RNA, 17 nt, Shigella flexneri 2a str. 2457T
acagcauauaaugcaac

SEQ ID NO: 3838813 - RNA, 22 nt, Shigella flexneri 2a str. 2457T
acagcaucaggcuaaucgccag

SEQ ID NO: 3838814 - RNA, 20 nt, Shigella flexneri 2a str. 2457T
acagcaucguccgccagccu

SEQ ID NO: 3838815 - RNA, 11 nt, Shigella flexneri 2a str. 2457T
acagcauuucc

SEQ ID NO: 3838816 - RNA, 13 nt, Shigella flexneri 2a str. 2457T
acagccaacacau

SEQ ID NO: 3838817 - RNA, 16 nt, Shigella flexneri 2a str. 2457T
acagccagaagcccgg

SEQ ID NO: 3838818 - RNA, 23 nt, Shigella flexneri 2a str. 2457T
acagccagauuaaaagugcuggg

SEQ ID NO: 3838819 - RNA, 13 nt, Shigella flexneri 2a str. 2457T
acagccagcagcg

SEQ ID NO: 3838820 - RNA, 17 nt, Shigella flexneri 2a str. 2457T
acagccagccagcacca

SEQ ID NO: 3838821 - RNA, 18 nt, Shigella flexneri 2a str. 2457T
acagccagccagcaccag

SEQ ID NO: 3838822 - RNA, 22 nt, Shigella flexneri 2a str. 2457T
acagccagccagcaccaggcuu

SEQ ID NO: 3838823 - RNA, 19 nt, Shigella flexneri 2a str. 2457T
acagccaugcgaaugccaa

SEQ ID NO: 3838824 - RNA, 22 nt, Shigella flexneri 2a str. 2457T
acagccccaggguuuugcccag

SEQ ID NO: 3838825 - RNA, 16 nt, Shigella flexneri 2a str. 2457T
acagccccugagcguu

SEQ ID NO: 3838826 - RNA, 13 nt, Shigella flexneri 2a str. 2457T
acagcccggcaug

SEQ ID NO: 3838827 - RNA, 18 nt, Shigella flexneri 2a str. 2457T
acagccgacaaugccaca

SEQ ID NO: 3838828 - RNA, 21 nt, Shigella flexneri 2a str. 2457T
acagccgccagacaauugccg

SEQ ID NO: 3838829 - RNA, 13 nt, Shigella flexneri 2a str. 2457T
acagccuaccaga

SEQ ID NO: 3838830 - RNA, 18 nt, Shigella flexneri 2a str. 2457T
acagccuaccagaccgca

SEQ ID NO: 3838831 - RNA, 22 nt, Shigella flexneri 2a str. 2457T
acagccuaccagaccgcacacc

SEQ ID NO: 3838832 - RNA, 18 nt, Shigella flexneri 2a str. 2457T
acagccuuauugucuuua

SEQ ID NO: 3838833 - RNA, 23 nt, Shigella flexneri 2a str. 2457T
acagccuucggacguuugccaug

SEQ ID NO: 3838834 - RNA, 17 nt, Shigella flexneri 2a str. 2457T
acagcgacaccagccau

SEQ ID NO: 3838835 - RNA, 14 nt, Shigella flexneri 2a str. 2457T
acagcgaccgcaga

SEQ ID NO: 3838836 - RNA, 16 nt, Shigella flexneri 2a str. 2457T
acagcgacguaaaaaa

SEQ ID NO: 3838837 - RNA, 15 nt, Shigella flexneri 2a str. 2457T
acagcgacucucuga

SEQ ID NO: 3838838 - RNA, 22 nt, Shigella flexneri 2a str. 2457T
acagcgauugcuucgaucucaa

SEQ ID NO: 3838839 - RNA, 22 nt, Shigella flexneri 2a str. 2457T
acagcgcaaaacgcaggaucca

SEQ ID NO: 3838840 - RNA, 15 nt, Shigella flexneri 2a str. 2457T
acagcgccagaaggg

SEQ ID NO: 3838841 - RNA, 14 nt, Shigella flexneri 2a str. 2457T
acagcgcccaacac

SEQ ID NO: 3838842 - RNA, 14 nt, Shigella flexneri 2a str. 2457T
acagcgcccgccag

SEQ ID NO: 3838843 - RNA, 15 nt, Shigella flexneri 2a str. 2457T
acagcgcgccagcca

SEQ ID NO: 3838844 - RNA, 14 nt, Shigella flexneri 2a str. 2457T
acagcgcgcugaca

SEQ ID NO: 3838845 - RNA, 19 nt, Shigella flexneri 2a str. 2457T
acagcgcugcgaaaguacc

SEQ ID NO: 3838846 - RNA, 14 nt, Shigella flexneri 2a str. 2457T
acagcggaguaauc

SEQ ID NO: 3838847 - RNA, 19 nt, Shigella flexneri 2a str. 2457T
acagcggaguaaucgccag

SEQ ID NO: 3838848 - RNA, 15 nt, Shigella flexneri 2a str. 2457T
acagcguguuaaugc

SEQ ID NO: 3838849 - RNA, 14 nt, Shigella flexneri 2a str. 2457T
acagcguuaaaaag

SEQ ID NO: 3838850 - RNA, 15 nt, Shigella flexneri 2a str. 2457T
acagcguuucuucga

SEQ ID NO: 3838851 - RNA, 20 nt, Shigella flexneri 2a str. 2457T
acagcuaaucaucaucagug

SEQ ID NO: 3838852 - RNA, 19 nt, Shigella flexneri 2a str. 2457T
acagcuuagcgccuucuac

SEQ ID NO: 3838853 - RNA, 14 nt, Shigella flexneri 2a str. 2457T
acagcuuuuuccug

SEQ ID NO: 3838854 - RNA, 22 nt, Shigella flexneri 2a str. 2457T
acaggaagcgaaucacguugcc

SEQ ID NO: 3838855 - RNA, 19 nt, Shigella flexneri 2a str. 2457T
acaggacaucuugaauaug

SEQ ID NO: 3838856 - RNA, 19 nt, Shigella flexneri 2a str. 2457T
acaggacgguaaagcaaca

SEQ ID NO: 3838857 - RNA, 14 nt, Shigella flexneri 2a str. 2457T
acaggauauauuuc

SEQ ID NO: 3838858 - RNA, 21 nt, Shigella flexneri 2a str. 2457T
acaggauauauuucaucaacu

SEQ ID NO: 3838859 - RNA, 23 nt, Shigella flexneri 2a str. 2457T
acaggcacaccgccgccgccacu

SEQ ID NO: 3838860 - RNA, 14 nt, Shigella flexneri 2a str. 2457T
acaggcagcaauca

SEQ ID NO: 3838861 - RNA, 13 nt, Shigella flexneri 2a str. 2457T
acaggcagcugcc

SEQ ID NO: 3838862 - RNA, 16 nt, Shigella flexneri 2a str. 2457T
acaggcagcugccaga

SEQ ID NO: 3838863 - RNA, 14 nt, Shigella flexneri 2a str. 2457T
acaggcagcuuaga

SEQ ID NO: 3838864 - RNA, 22 nt, Shigella flexneri 2a str. 2457T
acaggccaucacauccugauag

SEQ ID NO: 3838865 - RNA, 14 nt, Shigella flexneri 2a str. 2457T
acaggcgaaacccg

SEQ ID NO: 3838866 - RNA, 15 nt, Shigella flexneri 2a str. 2457T
acaggcgggaagaac

SEQ ID NO: 3838867 - RNA, 18 nt, Shigella flexneri 2a str. 2457T
acaggcugguuucucuuc

SEQ ID NO: 3838868 - RNA, 18 nt, Shigella flexneri 2a str. 2457T
acaggcuuuccugauaau

SEQ ID NO: 3838869 - RNA, 13 nt, Shigella flexneri 2a str. 2457T
acagggaaagaag

SEQ ID NO: 3838870 - RNA, 17 nt, Shigella flexneri 2a str. 2457T
acagggcucuuaagcac

SEQ ID NO: 3838871 - RNA, 19 nt, Shigella flexneri 2a str. 2457T
acaggggaugcuaugaaca

SEQ ID NO: 3838872 - RNA, 21 nt, Shigella flexneri 2a str. 2457T
acaggucaaaguaaccuuuga

SEQ ID NO: 3838873 - RNA, 14 nt, Shigella flexneri 2a str. 2457T
acaggucuguauga

SEQ ID NO: 3838874 - RNA, 16 nt, Shigella flexneri 2a str. 2457T
acaggugcaaaaaaac

SEQ ID NO: 3838875 - RNA, 15 nt, Shigella flexneri 2a str. 2457T
acaggugccggauuu

SEQ ID NO: 3838876 - RNA, 17 nt, Shigella flexneri 2a str. 2457T
acagguggcguuugcca

SEQ ID NO: 3838877 - RNA, 19 nt, Shigella flexneri 2a str. 2457T
acagguggcguuugccacc

SEQ ID NO: 3838878 - RNA, 18 nt, Shigella flexneri 2a str. 2457T
acagguuguugccuucac

SEQ ID NO: 3838879 - RNA, 14 nt, Shigella flexneri 2a str. 2457T
acagguuuaaacag

SEQ ID NO: 3838880 - RNA, 15 nt, Shigella flexneri 2a str. 2457T
acagguuuaaacaga

SEQ ID NO: 3838881 - RNA, 15 nt, Shigella flexneri 2a str. 2457T
acaugagaacaguuc

SEQ ID NO: 3838882 - RNA, 15 nt, Shigella flexneri 2a str. 2457T
acaugagagaaaauc

SEQ ID NO: 3838883 - RNA, 17 nt, Shigella flexneri 2a str. 2457T
acaugaugauggcuauc

SEQ ID NO: 3838884 - RNA, 15 nt, Shigella flexneri 2a str. 2457T
acaugauguggaucg

SEQ ID NO: 3838885 - RNA, 21 nt, Shigella flexneri 2a str. 2457T
acaugauguggugcaaggaaa

SEQ ID NO: 3838886 - RNA, 14 nt, Shigella flexneri 2a str. 2457T
acaugcagggcaaa

SEQ ID NO: 3838887 - RNA, 16 nt, Shigella flexneri 2a str. 2457T
acaugcagggcaaacu

SEQ ID NO: 3838888 - RNA, 17 nt, Shigella flexneri 2a str. 2457T
acaugccacuggcccca

SEQ ID NO: 3838889 - RNA, 15 nt, Shigella flexneri 2a str. 2457T
acaugccugcauaaa

SEQ ID NO: 3838890 - RNA, 17 nt, Shigella flexneri 2a str. 2457T
acaugcgauaaagcaua

SEQ ID NO: 3838891 - RNA, 18 nt, Shigella flexneri 2a str. 2457T
acaugcgauaaagcauac

SEQ ID NO: 3838892 - RNA, 18 nt, Shigella flexneri 2a str. 2457T
acaugcgaucccacgccg

SEQ ID NO: 3838893 - RNA, 20 nt, Shigella flexneri 2a str. 2457T
acaugcgaucccacgccgaa

SEQ ID NO: 3838894 - RNA, 21 nt, Shigella flexneri 2a str. 2457T
acaugcgcgacaaaaauuacu

SEQ ID NO: 3838895 - RNA, 23 nt, Shigella flexneri 2a str. 2457T
acaugcgcgacaaaaauuacugc

SEQ ID NO: 3838896 - RNA, 18 nt, Shigella flexneri 2a str. 2457T
acaugcuauugcgccagc

SEQ ID NO: 3838897 - RNA, 11 nt, Shigella flexneri 2a str. 2457T
acaugcugcuu

SEQ ID NO: 3838898 - RNA, 16 nt, Shigella flexneri 2a str. 2457T
acaugcuggaaccaca

SEQ ID NO: 3838899 - RNA, 23 nt, Shigella flexneri 2a str. 2457T
acaugcuggucacugacaccaua

SEQ ID NO: 3838900 - RNA, 22 nt, Shigella flexneri 2a str. 2457T
acaugcuucaggacuucuuugc

SEQ ID NO: 3838901 - RNA, 20 nt, Shigella flexneri 2a str. 2457T
acauggacgcaacuuccccu

SEQ ID NO: 3838902 - RNA, 22 nt, Shigella flexneri 2a str. 2457T
acauggcaaccgggucgauaaa

SEQ ID NO: 3838903 - RNA, 18 nt, Shigella flexneri 2a str. 2457T
acaugguuuacggcgguc

SEQ ID NO: 3838904 - RNA, 19 nt, Shigella flexneri 2a str. 2457T
acauguguuaaauauuuaa

SEQ ID NO: 3838905 - RNA, 15 nt, Shigella flexneri 2a str. 2457T
acauguguugucgcu

SEQ ID NO: 3838906 - RNA, 19 nt, Shigella flexneri 2a str. 2457T
acauguucggcgguuuuuu

SEQ ID NO: 3838907 - RNA, 16 nt, Shigella flexneri 2a str. 2457T
acauguugaaucuuca

SEQ ID NO: 3838908 - RNA, 23 nt, Shigella flexneri 2a str. 2457T
acauguugaaucuucaugcguuu

SEQ ID NO: 3838909 - RNA, 19 nt, Shigella flexneri 2a str. 2457T
acauuaccacgauuuugac

SEQ ID NO: 3838910 - RNA, 23 nt, Shigella flexneri 2a str. 2457T
acauuaggaauaaugucuuuaau

SEQ ID NO: 3838911 - RNA, 13 nt, Shigella flexneri 2a str. 2457T
acauuaucagaca

SEQ ID NO: 3838912 - RNA, 21 nt, Shigella flexneri 2a str. 2457T
acauuaucgcgucuaaauuuu

SEQ ID NO: 3838913 - RNA, 16 nt, Shigella flexneri 2a str. 2457T
acauuauuuaucugcc

SEQ ID NO: 3838914 - RNA, 12 nt, Shigella flexneri 2a str. 2457T
acauucccauca

SEQ ID NO: 3838915 - RNA, 21 nt, Shigella flexneri 2a str. 2457T
acauucccugcaccggugcau

SEQ ID NO: 3838916 - RNA, 19 nt, Shigella flexneri 2a str. 2457T
acauucgcgcacggugcau

SEQ ID NO: 3838917 - RNA, 20 nt, Shigella flexneri 2a str. 2457T
acauugacgauagcgccgcc

SEQ ID NO: 3838918 - RNA, 21 nt, Shigella flexneri 2a str. 2457T
acauugacgauagcgccgcca

SEQ ID NO: 3838919 - RNA, 15 nt, Shigella flexneri 2a str. 2457T
acauugagcuugcgu

SEQ ID NO: 3838920 - RNA, 21 nt, Shigella flexneri 2a str. 2457T
acauugagcuuugacgaccuu

SEQ ID NO: 3838921 - RNA, 18 nt, Shigella flexneri 2a str. 2457T
acauugauguuuucagac

SEQ ID NO: 3838922 - RNA, 23 nt, Shigella flexneri 2a str. 2457T
acauugauuaagugaauauacca

SEQ ID NO: 3838923 - RNA, 20 nt, Shigella flexneri 2a str. 2457T
acauugccguaauggucugc

SEQ ID NO: 3838924 - RNA, 15 nt, Shigella flexneri 2a str. 2457T
acauugcguaaccaa

SEQ ID NO: 3838925 - RNA, 18 nt, Shigella flexneri 2a str. 2457T
acauugcguaaccaauca

SEQ ID NO: 3838926 - RNA, 17 nt, Shigella flexneri 2a str. 2457T
acauugcguccaggccc

SEQ ID NO: 3838927 - RNA, 12 nt, Shigella flexneri 2a str. 2457T
acauugcugcug

SEQ ID NO: 3838928 - RNA, 13 nt, Shigella flexneri 2a str. 2457T
acauugcugcuga

SEQ ID NO: 3838929 - RNA, 19 nt, Shigella flexneri 2a str. 2457T
acauuguuaaagccuugcu

SEQ ID NO: 3838930 - RNA, 14 nt, Shigella flexneri 2a str. 2457T
acauuguuuuccag

SEQ ID NO: 3838931 - RNA, 20 nt, Shigella flexneri 2a str. 2457T
acauuuaaacaauuucagaa

SEQ ID NO: 3838932 - RNA, 22 nt, Shigella flexneri 2a str. 2457T
acauuuaaacaauuucagaaua

SEQ ID NO: 3838933 - RNA, 19 nt, Shigella flexneri 2a str. 2457T
acauuuaacccuucaagaa

SEQ ID NO: 3838934 - RNA, 12 nt, Shigella flexneri 2a str. 2457T
acauuuccagga

SEQ ID NO: 3838935 - RNA, 19 nt, Shigella flexneri 2a str. 2457T
acauuuccaggaaggccag

SEQ ID NO: 3838936 - RNA, 20 nt, Shigella flexneri 2a str. 2457T
acauuugcggcgaacugccg

SEQ ID NO: 3838937 - RNA, 18 nt, Shigella flexneri 2a str. 2457T
acauuugcuuuuguuaau

SEQ ID NO: 3838938 - RNA, 11 nt, Shigella flexneri 2a str. 2457T
acauuuuccau

SEQ ID NO: 3838939 - RNA, 13 nt, Shigella flexneri 2a str. 2457T
acauuuuccauca

SEQ ID NO: 3838940 - RNA, 12 nt, Shigella flexneri 2a str. 2457T
acauuuugaccc

SEQ ID NO: 3838941 - RNA, 17 nt, Shigella flexneri 2a str. 2457T
accaaaacagcgacacc

SEQ ID NO: 3838942 - RNA, 15 nt, Shigella flexneri 2a str. 2457T
accaaaacgugcagc

SEQ ID NO: 3838943 - RNA, 20 nt, Shigella flexneri 2a str. 2457T
accaaaacgugcagcugccu

SEQ ID NO: 3838944 - RNA, 23 nt, Shigella flexneri 2a str. 2457T
accaaaaucaggccgaggcacag

SEQ ID NO: 3838945 - RNA, 22 nt, Shigella flexneri 2a str. 2457T
accaaacccugagugaauuguu

SEQ ID NO: 3838946 - RNA, 14 nt, Shigella flexneri 2a str. 2457T
accaaacugauuua

SEQ ID NO: 3838947 - RNA, 21 nt, Shigella flexneri 2a str. 2457T
accaaagaaugacacuuucag

SEQ ID NO: 3838948 - RNA, 16 nt, Shigella flexneri 2a str. 2457T
accaaagccuuucacu

SEQ ID NO: 3838949 - RNA, 21 nt, Shigella flexneri 2a str. 2457T
accaaaggcgaguucaaucaa

SEQ ID NO: 3838950 - RNA, 14 nt, Shigella flexneri 2a str. 2457T
accaaauaaacgaa

SEQ ID NO: 3838951 - RNA, 19 nt, Shigella flexneri 2a str. 2457T
accaaauaaacgaaucugc

SEQ ID NO: 3838952 - RNA, 13 nt, Shigella flexneri 2a str. 2457T
accaaauacacgc

SEQ ID NO: 3838953 - RNA, 12 nt, Shigella flexneri 2a str. 2457T
accaaaugacuc

SEQ ID NO: 3838954 - RNA, 18 nt, Shigella flexneri 2a str. 2457T
accaaauuccagaaaaga

SEQ ID NO: 3838955 - RNA, 22 nt, Shigella flexneri 2a str. 2457T
accaacaaauagagauagaaug

SEQ ID NO: 3838956 - RNA, 19 nt, Shigella flexneri 2a str. 2457T
accaacaauaaaauugagg

SEQ ID NO: 3838957 - RNA, 18 nt, Shigella flexneri 2a str. 2457T
accaacaauugucgccac

SEQ ID NO: 3838958 - RNA, 17 nt, Shigella flexneri 2a str. 2457T
accaacacuccuaucac

SEQ ID NO: 3838959 - RNA, 13 nt, Shigella flexneri 2a str. 2457T
accaacgaggaga

SEQ ID NO: 3838960 - RNA, 23 nt, Shigella flexneri 2a str. 2457T
accaacgcaccggcuuguugccc

SEQ ID NO: 3838961 - RNA, 15 nt, Shigella flexneri 2a str. 2457T
accaacggcgagcca

SEQ ID NO: 3838962 - RNA, 23 nt, Shigella flexneri 2a str. 2457T
accaacggucgugcgagauaacc

SEQ ID NO: 3838963 - RNA, 14 nt, Shigella flexneri 2a str. 2457T
accaacuccagcgg

SEQ ID NO: 3838964 - RNA, 18 nt, Shigella flexneri 2a str. 2457T
accaacugauccugacaa

SEQ ID NO: 3838965 - RNA, 14 nt, Shigella flexneri 2a str. 2457T
accaagaccaaucc

SEQ ID NO: 3838966 - RNA, 19 nt, Shigella flexneri 2a str. 2457T
accaagaccaauccgccag

SEQ ID NO: 3838967 - RNA, 16 nt, Shigella flexneri 2a str. 2457T
accaauaaacgccagg

SEQ ID NO: 3838968 - RNA, 17 nt, Shigella flexneri 2a str. 2457T
accaauaacgcuuuucu

SEQ ID NO: 3838969 - RNA, 13 nt, Shigella flexneri 2a str. 2457T
accaauaaucaau

SEQ ID NO: 3838970 - RNA, 14 nt, Shigella flexneri 2a str. 2457T
accaauaccaauga

SEQ ID NO: 3838971 - RNA, 18 nt, Shigella flexneri 2a str. 2457T
accaauaccaaugaccag

SEQ ID NO: 3838972 - RNA, 18 nt, Shigella flexneri 2a str. 2457T
accaauaccgcccaccac

SEQ ID NO: 3838973 - RNA, 20 nt, Shigella flexneri 2a str. 2457T
accaauauaauuccauucac

SEQ ID NO: 3838974 - RNA, 18 nt, Shigella flexneri 2a str. 2457T
accaauaucaacguaaug

SEQ ID NO: 3838975 - RNA, 15 nt, Shigella flexneri 2a str. 2457T
accaaucaccgccac

SEQ ID NO: 3838976 - RNA, 21 nt, Shigella flexneri 2a str. 2457T
accaaucaccgccagcaaggc

SEQ ID NO: 3838977 - RNA, 14 nt, Shigella flexneri 2a str. 2457T
accaauccagccgg

SEQ ID NO: 3838978 - RNA, 12 nt, Shigella flexneri 2a str. 2457T
accaauccgcca

SEQ ID NO: 3838979 - RNA, 18 nt, Shigella flexneri 2a str. 2457T
accaaucgcgggcaacgu

SEQ ID NO: 3838980 - RNA, 16 nt, Shigella flexneri 2a str. 2457T
accaaucucccagccg

SEQ ID NO: 3838981 - RNA, 21 nt, Shigella flexneri 2a str. 2457T
accaaugaaagccccaccagc

SEQ ID NO: 3838982 - RNA, 17 nt, Shigella flexneri 2a str. 2457T
accaaugacguuaauaa

SEQ ID NO: 3838983 - RNA, 19 nt, Shigella flexneri 2a str. 2457T
accaaugauaaguuucacu

SEQ ID NO: 3838984 - RNA, 21 nt, Shigella flexneri 2a str. 2457T
accaaugauugggucauuucc

SEQ ID NO: 3838985 - RNA, 14 nt, Shigella flexneri 2a str. 2457T
accaaugccgcggc

SEQ ID NO: 3838986 - RNA, 13 nt, Shigella flexneri 2a str. 2457T
accaauggcaaua

SEQ ID NO: 3838987 - RNA, 13 nt, Shigella flexneri 2a str. 2457T
accaauggcuuuu

SEQ ID NO: 3838988 - RNA, 16 nt, Shigella flexneri 2a str. 2457T
accaaugucgaaagcc

SEQ ID NO: 3838989 - RNA, 23 nt, Shigella flexneri 2a str. 2457T
accaauguggguguuaagcgcag

SEQ ID NO: 3838990 - RNA, 12 nt, Shigella flexneri 2a str. 2457T
accacaaaagcg

SEQ ID NO: 3838991 - RNA, 13 nt, Shigella flexneri 2a str. 2457T
accacaaccgccg

SEQ ID NO: 3838992 - RNA, 13 nt, Shigella flexneri 2a str. 2457T
accacaacgacaa

SEQ ID NO: 3838993 - RNA, 16 nt, Shigella flexneri 2a str. 2457T
accacaaugaagaaag

SEQ ID NO: 3838994 - RNA, 12 nt, Shigella flexneri 2a str. 2457T
accacaccaacc

SEQ ID NO: 3838995 - RNA, 19 nt, Shigella flexneri 2a str. 2457T
accacaccggaccagacga

SEQ ID NO: 3838996 - RNA, 21 nt, Shigella flexneri 2a str. 2457T
accacaccggaccagacgauc

SEQ ID NO: 3838997 - RNA, 15 nt, Shigella flexneri 2a str. 2457T
accacacgaauucca

SEQ ID NO: 3838998 - RNA, 18 nt, Shigella flexneri 2a str. 2457T
accacagugacccgcagc

SEQ ID NO: 3838999 - RNA, 16 nt, Shigella flexneri 2a str. 2457T
accaccaaugucgaaa

SEQ ID NO: 3839000 - RNA, 14 nt, Shigella flexneri 2a str. 2457T
accaccagacgagc

SEQ ID NO: 3839001 - RNA, 13 nt, Shigella flexneri 2a str. 2457T
accaccagcacac

SEQ ID NO: 3839002 - RNA, 13 nt, Shigella flexneri 2a str. 2457T
accaccagcacug

SEQ ID NO: 3839003 - RNA, 15 nt, Shigella flexneri 2a str. 2457T
accaccagcagcugc

SEQ ID NO: 3839004 - RNA, 19 nt, Shigella flexneri 2a str. 2457T
accaccaguaaauugucgc

SEQ ID NO: 3839005 - RNA, 23 nt, Shigella flexneri 2a str. 2457T
accaccagugccauuaacaggcc

SEQ ID NO: 3839006 - RNA, 19 nt, Shigella flexneri 2a str. 2457T
accaccauauucgccaccg

SEQ ID NO: 3839007 - RNA, 11 nt, Shigella flexneri 2a str. 2457T
accaccaucac

SEQ ID NO: 3839008 - RNA, 23 nt, Shigella flexneri 2a str. 2457T
accaccaucacuuucaaaagccc

SEQ ID NO: 3839009 - RNA, 20 nt, Shigella flexneri 2a str. 2457T
accaccaugcuaauagcugc

SEQ ID NO: 3839010 - RNA, 17 nt, Shigella flexneri 2a str. 2457T
accacccagcagcgccg

SEQ ID NO: 3839011 - RNA, 12 nt, Shigella flexneri 2a str. 2457T
accacccagcgg

SEQ ID NO: 3839012 - RNA, 22 nt, Shigella flexneri 2a str. 2457T
accacccccagaugacggcugc

SEQ ID NO: 3839013 - RNA, 23 nt, Shigella flexneri 2a str. 2457T
accacccgcagcgaucugcaccu

SEQ ID NO: 3839014 - RNA, 21 nt, Shigella flexneri 2a str. 2457T
accaccgaugaucaacagcau

SEQ ID NO: 3839015 - RNA, 17 nt, Shigella flexneri 2a str. 2457T
accaccgcaaucgccag

SEQ ID NO: 3839016 - RNA, 16 nt, Shigella flexneri 2a str. 2457T
accaccgcaguaaucg

SEQ ID NO: 3839017 - RNA, 23 nt, Shigella flexneri 2a str. 2457T
accaccgcaucggcaucaaacca

SEQ ID NO: 3839018 - RNA, 22 nt, Shigella flexneri 2a str. 2457T
accaccggaauuguggugauca

SEQ ID NO: 3839019 - RNA, 20 nt, Shigella flexneri 2a str. 2457T
accaccggauaaaggcggcc

SEQ ID NO: 3839020 - RNA, 16 nt, Shigella flexneri 2a str. 2457T
accaccguuuucccgc

SEQ ID NO: 3839021 - RNA, 23 nt, Shigella flexneri 2a str. 2457T
accaccguuuuuucugccucugc

SEQ ID NO: 3839022 - RNA, 21 nt, Shigella flexneri 2a str. 2457T
accaccuccacgcccagcgca

SEQ ID NO: 3839023 - RNA, 20 nt, Shigella flexneri 2a str. 2457T
accaccuuacuuacacauca

SEQ ID NO: 3839024 - RNA, 15 nt, Shigella flexneri 2a str. 2457T
accacgaacgagguu

SEQ ID NO: 3839025 - RNA, 17 nt, Shigella flexneri 2a str. 2457T
accacgaagcaauggcg

SEQ ID NO: 3839026 - RNA, 18 nt, Shigella flexneri 2a str. 2457T
accacgauauguucagga

SEQ ID NO: 3839027 - RNA, 16 nt, Shigella flexneri 2a str. 2457T
accacgccgauaauca

SEQ ID NO: 3839028 - RNA, 14 nt, Shigella flexneri 2a str. 2457T
accacggaguugac

SEQ ID NO: 3839029 - RNA, 17 nt, Shigella flexneri 2a str. 2457T
accacggccacagccag

SEQ ID NO: 3839030 - RNA, 18 nt, Shigella flexneri 2a str. 2457T
accacggccuuccucggc

SEQ ID NO: 3839031 - RNA, 15 nt, Shigella flexneri 2a str. 2457T
accacguaccacggc

SEQ ID NO: 3839032 - RNA, 21 nt, Shigella flexneri 2a str. 2457T
accacguaccacggcauuucc

SEQ ID NO: 3839033 - RNA, 15 nt, Shigella flexneri 2a str. 2457T
accacguccagagug

SEQ ID NO: 3839034 - RNA, 16 nt, Shigella flexneri 2a str. 2457T
accacguucauuucau

SEQ ID NO: 3839035 - RNA, 17 nt, Shigella flexneri 2a str. 2457T
accacguugacaaacug

SEQ ID NO: 3839036 - RNA, 20 nt, Shigella flexneri 2a str. 2457T
accacguuuuucaauucacg

SEQ ID NO: 3839037 - RNA, 15 nt, Shigella flexneri 2a str. 2457T
accacuacaucaagu

SEQ ID NO: 3839038 - RNA, 17 nt, Shigella flexneri 2a str. 2457T
accacuauuauggcgca

SEQ ID NO: 3839039 - RNA, 21 nt, Shigella flexneri 2a str. 2457T
accacuauuauggcgcaggcc

SEQ ID NO: 3839040 - RNA, 13 nt, Shigella flexneri 2a str. 2457T
accacucaccgcc

SEQ ID NO: 3839041 - RNA, 13 nt, Shigella flexneri 2a str. 2457T
accacucaccgcu

SEQ ID NO: 3839042 - RNA, 13 nt, Shigella flexneri 2a str. 2457T
accacuccggcau

SEQ ID NO: 3839043 - RNA, 22 nt, Shigella flexneri 2a str. 2457T
accacugacacaggcagcaauc

SEQ ID NO: 3839044 - RNA, 15 nt, Shigella flexneri 2a str. 2457T
accacugauggaauu

SEQ ID NO: 3839045 - RNA, 14 nt, Shigella flexneri 2a str. 2457T
accacugcaaugac

SEQ ID NO: 3839046 - RNA, 22 nt, Shigella flexneri 2a str. 2457T
accacugcgacgcggcgguucu

SEQ ID NO: 3839047 - RNA, 16 nt, Shigella flexneri 2a str. 2457T
accacugcgcauaauc

SEQ ID NO: 3839048 - RNA, 22 nt, Shigella flexneri 2a str. 2457T
accacuggcgauauugccgcga

SEQ ID NO: 3839049 - RNA, 21 nt, Shigella flexneri 2a str. 2457T
accacuuaauuauuaacaaaa

SEQ ID NO: 3839050 - RNA, 14 nt, Shigella flexneri 2a str. 2457T
accacuucacccgc

SEQ ID NO: 3839051 - RNA, 15 nt, Shigella flexneri 2a str. 2457T
accacuucagaaccg

SEQ ID NO: 3839052 - RNA, 13 nt, Shigella flexneri 2a str. 2457T
accacuucaugcc

SEQ ID NO: 3839053 - RNA, 21 nt, Shigella flexneri 2a str. 2457T
accacuucaugccccauggac

SEQ ID NO: 3839054 - RNA, 20 nt, Shigella flexneri 2a str. 2457T
accacuuccacguuccccag

SEQ ID NO: 3839055 - RNA, 15 nt, Shigella flexneri 2a str. 2457T
accacuuccagcaga

SEQ ID NO: 3839056 - RNA, 14 nt, Shigella flexneri 2a str. 2457T
accacuuccugcuc

SEQ ID NO: 3839057 - RNA, 14 nt, Shigella flexneri 2a str. 2457T
accacuucggcaaa

SEQ ID NO: 3839058 - RNA, 19 nt, Shigella flexneri 2a str. 2457T
accacuugcagaccaaggu

SEQ ID NO: 3839059 - RNA, 16 nt, Shigella flexneri 2a str. 2457T
accagaaacaauaagu

SEQ ID NO: 3839060 - RNA, 23 nt, Shigella flexneri 2a str. 2457T
accagaagcguaaaucccagcac

SEQ ID NO: 3839061 - RNA, 14 nt, Shigella flexneri 2a str. 2457T
accagaaucaaucc

SEQ ID NO: 3839062 - RNA, 20 nt, Shigella flexneri 2a str. 2457T
accagaaucaaucccaucag

SEQ ID NO: 3839063 - RNA, 23 nt, Shigella flexneri 2a str. 2457T
accagaaucaaucccaucaggcg

SEQ ID NO: 3839064 - RNA, 14 nt, Shigella flexneri 2a str. 2457T
accagaaucgccag

SEQ ID NO: 3839065 - RNA, 21 nt, Shigella flexneri 2a str. 2457T
accagacaauggcccgccgca

SEQ ID NO: 3839066 - RNA, 15 nt, Shigella flexneri 2a str. 2457T
accagacauguggau

SEQ ID NO: 3839067 - RNA, 15 nt, Shigella flexneri 2a str. 2457T
accagaccgcacacc

SEQ ID NO: 3839068 - RNA, 24 nt, Shigella flexneri 2a str. 2457T
accagaccugaaaccgccuucugc

SEQ ID NO: 3839069 - RNA, 17 nt, Shigella flexneri 2a str. 2457T
accagaguaacgggcac

SEQ ID NO: 3839070 - RNA, 22 nt, Shigella flexneri 2a str. 2457T
accagaguaacgggcacguaaa

SEQ ID NO: 3839071 - RNA, 21 nt, Shigella flexneri 2a str. 2457T
accagauaagccugcgcgccc

SEQ ID NO: 3839072 - RNA, 18 nt, Shigella flexneri 2a str. 2457T
accagauaaucaccugcc

SEQ ID NO: 3839073 - RNA, 21 nt, Shigella flexneri 2a str. 2457T
accagaucguaauggucguuc

SEQ ID NO: 3839074 - RNA, 23 nt, Shigella flexneri 2a str. 2457T
accagaugcucuuuucugaagua

SEQ ID NO: 3839075 - RNA, 16 nt, Shigella flexneri 2a str. 2457T
accaucauaccgauca

SEQ ID NO: 3839076 - RNA, 14 nt, Shigella flexneri 2a str. 2457T
accaucauauuuuc

SEQ ID NO: 3839077 - RNA, 13 nt, Shigella flexneri 2a str. 2457T
accauccaggaga

SEQ ID NO: 3839078 - RNA, 15 nt, Shigella flexneri 2a str. 2457T
accauccuaaaaaag

SEQ ID NO: 3839079 - RNA, 14 nt, Shigella flexneri 2a str. 2457T
accauccugcuccu

SEQ ID NO: 3839080 - RNA, 22 nt, Shigella flexneri 2a str. 2457T
accaucgagaaucagcgagaca

SEQ ID NO: 3839081 - RNA, 23 nt, Shigella flexneri 2a str. 2457T
accaucgagaaucagcgagacaa

SEQ ID NO: 3839082 - RNA, 19 nt, Shigella flexneri 2a str. 2457T
accaucgauaccaucgcuu

SEQ ID NO: 3839083 - RNA, 20 nt, Shigella flexneri 2a str. 2457T
accaucgcauacugcguguc

SEQ ID NO: 3839084 - RNA, 19 nt, Shigella flexneri 2a str. 2457T
accaucgguuguuuucaga

SEQ ID NO: 3839085 - RNA, 22 nt, Shigella flexneri 2a str. 2457T
accaucguugcuaacggccacg

SEQ ID NO: 3839086 - RNA, 20 nt, Shigella flexneri 2a str. 2457T
accaucuuccaguugcacgc

SEQ ID NO: 3839087 - RNA, 15 nt, Shigella flexneri 2a str. 2457T
accaucuucuucacu

SEQ ID NO: 3839088 - RNA, 21 nt, Shigella flexneri 2a str. 2457T
accaucuucuucacuucuuca

SEQ ID NO: 3839089 - RNA, 17 nt, Shigella flexneri 2a str. 2457T
accaucuugagaaaaac

SEQ ID NO: 3839090 - RNA, 21 nt, Shigella flexneri 2a str. 2457T
accaugcaaaaugguuccugg

SEQ ID NO: 3839091 - RNA, 19 nt, Shigella flexneri 2a str. 2457T
accaugcaauuaccgccac

SEQ ID NO: 3839092 - RNA, 22 nt, Shigella flexneri 2a str. 2457T
accaugccggugaugccgccag

SEQ ID NO: 3839093 - RNA, 18 nt, Shigella flexneri 2a str. 2457T
accauggcagaagcauuu

SEQ ID NO: 3839094 - RNA, 13 nt, Shigella flexneri 2a str. 2457T
accaugucaucaa

SEQ ID NO: 3839095 - RNA, 14 nt, Shigella flexneri 2a str. 2457T
accaugucaucaau

SEQ ID NO: 3839096 - RNA, 21 nt, Shigella flexneri 2a str. 2457T
accauuaaggcugaugaagca

SEQ ID NO: 3839097 - RNA, 21 nt, Shigella flexneri 2a str. 2457T
accauuaaucgauaaaccagc

SEQ ID NO: 3839098 - RNA, 14 nt, Shigella flexneri 2a str. 2457T
accauuaucaaaca

SEQ ID NO: 3839099 - RNA, 14 nt, Shigella flexneri 2a str. 2457T
accauuaucaccaa

SEQ ID NO: 3839100 - RNA, 14 nt, Shigella flexneri 2a str. 2457T
accauucaggcugg

SEQ ID NO: 3839101 - RNA, 22 nt, Shigella flexneri 2a str. 2457T
accauugaggauugcgccuuua

SEQ ID NO: 3839102 - RNA, 15 nt, Shigella flexneri 2a str. 2457T
accauugauaaucca

SEQ ID NO: 3839103 - RNA, 15 nt, Shigella flexneri 2a str. 2457T
accauugcugccgcc

SEQ ID NO: 3839104 - RNA, 20 nt, Shigella flexneri 2a str. 2457T
accauugcugccgccaguuc

SEQ ID NO: 3839105 - RNA, 21 nt, Shigella flexneri 2a str. 2457T
accauugcugccgccaguucu

SEQ ID NO: 3839106 - RNA, 20 nt, Shigella flexneri 2a str. 2457T
accauuggcauugguaucgg

SEQ ID NO: 3839107 - RNA, 15 nt, Shigella flexneri 2a str. 2457T
accauuuaaaucaau

SEQ ID NO: 3839108 - RNA, 15 nt, Shigella flexneri 2a str. 2457T
acccaaaaaauagca

SEQ ID NO: 3839109 - RNA, 17 nt, Shigella flexneri 2a str. 2457T
acccaacgcaaagagag

SEQ ID NO: 3839110 - RNA, 16 nt, Shigella flexneri 2a str. 2457T
acccaagcuucgggau

SEQ ID NO: 3839111 - RNA, 12 nt, Shigella flexneri 2a str. 2457T
acccacaccccc

SEQ ID NO: 3839112 - RNA, 17 nt, Shigella flexneri 2a str. 2457T
acccacaucagcggcac

SEQ ID NO: 3839113 - RNA, 15 nt, Shigella flexneri 2a str. 2457T
acccaccgcaauaac

SEQ ID NO: 3839114 - RNA, 12 nt, Shigella flexneri 2a str. 2457T
acccaccgcagc

SEQ ID NO: 3839115 - RNA, 13 nt, Shigella flexneri 2a str. 2457T
acccaccgguccu

SEQ ID NO: 3839116 - RNA, 19 nt, Shigella flexneri 2a str. 2457T
acccacguuagcgcuuggc

SEQ ID NO: 3839117 - RNA, 13 nt, Shigella flexneri 2a str. 2457T
acccacuuccccu

SEQ ID NO: 3839118 - RNA, 19 nt, Shigella flexneri 2a str. 2457T
acccagcaagaccgcgacc

SEQ ID NO: 3839119 - RNA, 12 nt, Shigella flexneri 2a str. 2457T
acccagcaaucc

SEQ ID NO: 3839120 - RNA, 14 nt, Shigella flexneri 2a str. 2457T
acccagcaccagua

SEQ ID NO: 3839121 - RNA, 17 nt, Shigella flexneri 2a str. 2457T
acccagcaccaguacca

SEQ ID NO: 3839122 - RNA, 15 nt, Shigella flexneri 2a str. 2457T
acccagcaccgcaga

SEQ ID NO: 3839123 - RNA, 11 nt, Shigella flexneri 2a str. 2457T
acccagcagca

SEQ ID NO: 3839124 - RNA, 19 nt, Shigella flexneri 2a str. 2457T
acccagcagcgccgcgccu

SEQ ID NO: 3839125 - RNA, 16 nt, Shigella flexneri 2a str. 2457T
acccagccagacgcca

SEQ ID NO: 3839126 - RNA, 17 nt, Shigella flexneri 2a str. 2457T
acccagcgaauccagca

SEQ ID NO: 3839127 - RNA, 14 nt, Shigella flexneri 2a str. 2457T
acccagcgcgauac

SEQ ID NO: 3839128 - RNA, 22 nt, Shigella flexneri 2a str. 2457T
acccaggcccgcgugccggaag

SEQ ID NO: 3839129 - RNA, 15 nt, Shigella flexneri 2a str. 2457T
acccagguagacacc

SEQ ID NO: 3839130 - RNA, 22 nt, Shigella flexneri 2a str. 2457T
acccaguuucaugauauguuuu

SEQ ID NO: 3839131 - RNA, 19 nt, Shigella flexneri 2a str. 2457T
acccauauuuaaucaguuc

SEQ ID NO: 3839132 - RNA, 12 nt, Shigella flexneri 2a str. 2457T
acccaucgccag

SEQ ID NO: 3839133 - RNA, 18 nt, Shigella flexneri 2a str. 2457T
acccauguugaucgccac

SEQ ID NO: 3839134 - RNA, 15 nt, Shigella flexneri 2a str. 2457T
acccauuuauccagc

SEQ ID NO: 3839135 - RNA, 21 nt, Shigella flexneri 2a str. 2457T
accccaaaaagauuaaaaaaa

SEQ ID NO: 3839136 - RNA, 16 nt, Shigella flexneri 2a str. 2457T
accccaaaaaguugga

SEQ ID NO: 3839137 - RNA, 15 nt, Shigella flexneri 2a str. 2457T
accccaauguagccg

SEQ ID NO: 3839138 - RNA, 20 nt, Shigella flexneri 2a str. 2457T
accccaauguagccgcacgc

SEQ ID NO: 3839139 - RNA, 20 nt, Shigella flexneri 2a str. 2457T
accccacgauguauccggca

SEQ ID NO: 3839140 - RNA, 21 nt, Shigella flexneri 2a str. 2457T
accccacgcucucgcagcuca

SEQ ID NO: 3839141 - RNA, 22 nt, Shigella flexneri 2a str. 2457T
accccagcgcaagggccgcagc

SEQ ID NO: 3839142 - RNA, 20 nt, Shigella flexneri 2a str. 2457T
accccaggccgcguaccgca

SEQ ID NO: 3839143 - RNA, 23 nt, Shigella flexneri 2a str. 2457T
accccagguuuucaacgugucuu

SEQ ID NO: 3839144 - RNA, 14 nt, Shigella flexneri 2a str. 2457T
accccauuugccac

SEQ ID NO: 3839145 - RNA, 17 nt, Shigella flexneri 2a str. 2457T
acccccaccccggcccu

SEQ ID NO: 3839146 - RNA, 15 nt, Shigella flexneri 2a str. 2457T
acccccauccacgca

SEQ ID NO: 3839147 - RNA, 16 nt, Shigella flexneri 2a str. 2457T
acccccauccacgcau

SEQ ID NO: 3839148 - RNA, 13 nt, Shigella flexneri 2a str. 2457T
acccccgaacugg

SEQ ID NO: 3839149 - RNA, 14 nt, Shigella flexneri 2a str. 2457T
acccccuccuuuua

SEQ ID NO: 3839150 - RNA, 14 nt, Shigella flexneri 2a str. 2457T
accccgauggcuug

SEQ ID NO: 3839151 - RNA, 18 nt, Shigella flexneri 2a str. 2457T
accccgcuugcuguuccu

SEQ ID NO: 3839152 - RNA, 15 nt, Shigella flexneri 2a str. 2457T
accccggcccucucc

SEQ ID NO: 3839153 - RNA, 17 nt, Shigella flexneri 2a str. 2457T
accccggcccucucccu

SEQ ID NO: 3839154 - RNA, 14 nt, Shigella flexneri 2a str. 2457T
accccgucaccacu

SEQ ID NO: 3839155 - RNA, 18 nt, Shigella flexneri 2a str. 2457T
accccgucaccacuucac

SEQ ID NO: 3839156 - RNA, 19 nt, Shigella flexneri 2a str. 2457T
accccgucaccacuucacc

SEQ ID NO: 3839157 - RNA, 21 nt, Shigella flexneri 2a str. 2457T
accccucuauccagcucaucc

SEQ ID NO: 3839158 - RNA, 17 nt, Shigella flexneri 2a str. 2457T
accccucuucagccccg

SEQ ID NO: 3839159 - RNA, 14 nt, Shigella flexneri 2a str. 2457T
accccugauaaccg

SEQ ID NO: 3839160 - RNA, 13 nt, Shigella flexneri 2a str. 2457T
accccugauuuug

SEQ ID NO: 3839161 - RNA, 12 nt, Shigella flexneri 2a str. 2457T
accccugcggcc

SEQ ID NO: 3839162 - RNA, 16 nt, Shigella flexneri 2a str. 2457T
accccugcggccgguu

SEQ ID NO: 3839163 - RNA, 15 nt, Shigella flexneri 2a str. 2457T
accccuugccacccg

SEQ ID NO: 3839164 - RNA, 16 nt, Shigella flexneri 2a str. 2457T
acccgacgcacaccag

SEQ ID NO: 3839165 - RNA, 22 nt, Shigella flexneri 2a str. 2457T
acccgaucgccaucaugcacac

SEQ ID NO: 3839166 - RNA, 12 nt, Shigella flexneri 2a str. 2457T
acccgcaacagc

SEQ ID NO: 3839167 - RNA, 19 nt, Shigella flexneri 2a str. 2457T
acccgcaacauacugcccg

SEQ ID NO: 3839168 - RNA, 13 nt, Shigella flexneri 2a str. 2457T
acccgcaaucauc

SEQ ID NO: 3839169 - RNA, 14 nt, Shigella flexneri 2a str. 2457T
acccgcacagucac

SEQ ID NO: 3839170 - RNA, 21 nt, Shigella flexneri 2a str. 2457T
acccgcacggccgcaagcaga

SEQ ID NO: 3839171 - RNA, 15 nt, Shigella flexneri 2a str. 2457T
acccgcagccagcac

SEQ ID NO: 3839172 - RNA, 18 nt, Shigella flexneri 2a str. 2457T
acccgccacgaaauugag

SEQ ID NO: 3839173 - RNA, 18 nt, Shigella flexneri 2a str. 2457T
accgcccugagcaucaau

SEQ ID NO: 3839174 - RNA, 15 nt, Shigella flexneri 2a str. 2457T
accgccgaggaacau

SEQ ID NO: 3839175 - RNA, 15 nt, Shigella flexneri 2a str. 2457T
accgccgccaugcuu

SEQ ID NO: 3839176 - RNA, 17 nt, Shigella flexneri 2a str. 2457T
accgccugauaacgaau

SEQ ID NO: 3839177 - RNA, 16 nt, Shigella flexneri 2a str. 2457T
accgccugcaaauaaa

SEQ ID NO: 3839178 - RNA, 14 nt, Shigella flexneri 2a str. 2457T
accgccugcgggga

SEQ ID NO: 3839179 - RNA, 13 nt, Shigella flexneri 2a str. 2457T
accgcgaagaaca

SEQ ID NO: 3839180 - RNA, 21 nt, Shigella flexneri 2a str. 2457T
accgcgaaucauaacugccgu

SEQ ID NO: 3839181 - RNA, 23 nt, Shigella flexneri 2a str. 2457T
accgcgaggccuaacaccaucag

SEQ ID NO: 3839182 - RNA, 13 nt, Shigella flexneri 2a str. 2457T
accgcgaguaauc

SEQ ID NO: 3839183 - RNA, 14 nt, Shigella flexneri 2a str. 2457T
accgcgaucuucca

SEQ ID NO: 3839184 - RNA, 17 nt, Shigella flexneri 2a str. 2457T
accgcgcucagccagcc

SEQ ID NO: 3839185 - RNA, 19 nt, Shigella flexneri 2a str. 2457T
accgcgguguauaccagcu

SEQ ID NO: 3839186 - RNA, 23 nt, Shigella flexneri 2a str. 2457T
accgcguaauacaucagcuaaau

SEQ ID NO: 3839187 - RNA, 15 nt, Shigella flexneri 2a str. 2457T
accgcguaugcccag

SEQ ID NO: 3839188 - RNA, 17 nt, Shigella flexneri 2a str. 2457T
accgcgugcgcggcagc

SEQ ID NO: 3839189 - RNA, 15 nt, Shigella flexneri 2a str. 2457T
accgcuacuggcaau

SEQ ID NO: 3839190 - RNA, 17 nt, Shigella flexneri 2a str. 2457T
accgcuauuugcgccug

SEQ ID NO: 3839191 - RNA, 16 nt, Shigella flexneri 2a str. 2457T
accgcucaucgcccgg

SEQ ID NO: 3839192 - RNA, 17 nt, Shigella flexneri 2a str. 2457T
accgcucccagcaugac

SEQ ID NO: 3839193 - RNA, 17 nt, Shigella flexneri 2a str. 2457T
accgcuccgccaucuuc

SEQ ID NO: 3839194 - RNA, 19 nt, Shigella flexneri 2a str. 2457T
accgcucugcgaucugcgc

SEQ ID NO: 3839195 - RNA, 15 nt, Shigella flexneri 2a str. 2457T
accgcugacggcagc

SEQ ID NO: 3839196 - RNA, 22 nt, Shigella flexneri 2a str. 2457T
accgcugacggcagcgaagggu

SEQ ID NO: 3839197 - RNA, 22 nt, Shigella flexneri 2a str. 2457T
accgcugagcgauaaaaucaga

SEQ ID NO: 3839198 - RNA, 21 nt, Shigella flexneri 2a str. 2457T
accgcugcuuaauuacugccu

SEQ ID NO: 3839199 - RNA, 17 nt, Shigella flexneri 2a str. 2457T
accgcuucauaggucag

SEQ ID NO: 3839200 - RNA, 12 nt, Shigella flexneri 2a str. 2457T
accgcuucccuu

SEQ ID NO: 3839201 - RNA, 21 nt, Shigella flexneri 2a str. 2457T
accgcuucgcucacaucaugc

SEQ ID NO: 3839202 - RNA, 21 nt, Shigella flexneri 2a str. 2457T
accgcuuuuccagcauaaugu

SEQ ID NO: 3839203 - RNA, 16 nt, Shigella flexneri 2a str. 2457T
accggaaaaggcguuc

SEQ ID NO: 3839204 - RNA, 21 nt, Shigella flexneri 2a str. 2457T
accggaaaaggugauuuuuga

SEQ ID NO: 3839205 - RNA, 13 nt, Shigella flexneri 2a str. 2457T
accggaaccagcg

SEQ ID NO: 3839206 - RNA, 15 nt, Shigella flexneri 2a str. 2457T
accggaaggauuauc

SEQ ID NO: 3839207 - RNA, 18 nt, Shigella flexneri 2a str. 2457T
accggaaggauuaucccg

SEQ ID NO: 3839208 - RNA, 21 nt, Shigella flexneri 2a str. 2457T
accggacacacuucauuuucc

SEQ ID NO: 3839209 - RNA, 19 nt, Shigella flexneri 2a str. 2457T
accggacgaucggaugauc

SEQ ID NO: 3839210 - RNA, 19 nt, Shigella flexneri 2a str. 2457T
accggacuauccgccgcuu

SEQ ID NO: 3839211 - RNA, 15 nt, Shigella flexneri 2a str. 2457T
accggagucugugcu

SEQ ID NO: 3839212 - RNA, 18 nt, Shigella flexneri 2a str. 2457T
accggauaaaggcggccc

SEQ ID NO: 3839213 - RNA, 16 nt, Shigella flexneri 2a str. 2457T
accggauaaucggcaa

SEQ ID NO: 3839214 - RNA, 13 nt, Shigella flexneri 2a str. 2457T
accggauuuucac

SEQ ID NO: 3839215 - RNA, 19 nt, Shigella flexneri 2a str. 2457T
accggcacuucaacuucgc

SEQ ID NO: 3839216 - RNA, 21 nt, Shigella flexneri 2a str. 2457T
accggccagcaucgcaacaug

SEQ ID NO: 3839217 - RNA, 23 nt, Shigella flexneri 2a str. 2457T
accggccccugaucggccaugau

SEQ ID NO: 3839218 - RNA, 20 nt, Shigella flexneri 2a str. 2457T
accggccguaagaaagucau

SEQ ID NO: 3839219 - RNA, 19 nt, Shigella flexneri 2a str. 2457T
accggcuuucgcuucaacc

SEQ ID NO: 3839220 - RNA, 16 nt, Shigella flexneri 2a str. 2457T
accgggaagauccagg

SEQ ID NO: 3839221 - RNA, 14 nt, Shigella flexneri 2a str. 2457T
accgggcaguacca

SEQ ID NO: 3839222 - RNA, 17 nt, Shigella flexneri 2a str. 2457T
accgggcguccugcuug

SEQ ID NO: 3839223 - RNA, 17 nt, Shigella flexneri 2a str. 2457T
accggggacaggcgggc

SEQ ID NO: 3839224 - RNA, 21 nt, Shigella flexneri 2a str. 2457T
accggguuuucaaugauaaag

SEQ ID NO: 3839225 - RNA, 15 nt, Shigella flexneri 2a str. 2457T
accgguaaagaagag

SEQ ID NO: 3839226 - RNA, 20 nt, Shigella flexneri 2a str. 2457T
accgguaaagaagagcggca

SEQ ID NO: 3839227 - RNA, 17 nt, Shigella flexneri 2a str. 2457T
accgguaacgauuucau

SEQ ID NO: 3839228 - RNA, 17 nt, Shigella flexneri 2a str. 2457T
accgguacaaacaucau

SEQ ID NO: 3839229 - RNA, 20 nt, Shigella flexneri 2a str. 2457T
accggucccuucaaucucaa

SEQ ID NO: 3839230 - RNA, 22 nt, Shigella flexneri 2a str. 2457T
accgguucggggcuguuuucca

SEQ ID NO: 3839231 - RNA, 23 nt, Shigella flexneri 2a str. 2457T
accgguucggggcuguuuuccag

SEQ ID NO: 3839232 - RNA, 19 nt, Shigella flexneri 2a str. 2457T
accgguuucaauccaggua

SEQ ID NO: 3839233 - RNA, 15 nt, Shigella flexneri 2a str. 2457T
accguaaaagccugg

SEQ ID NO: 3839234 - RNA, 18 nt, Shigella flexneri 2a str. 2457T
accguaaacccuaacauc

SEQ ID NO: 3839235 - RNA, 23 nt, Shigella flexneri 2a str. 2457T
accguaaguaagauaaaagcaau

SEQ ID NO: 3839236 - RNA, 13 nt, Shigella flexneri 2a str. 2457T
accguaccggcac

SEQ ID NO: 3839237 - RNA, 22 nt, Shigella flexneri 2a str. 2457T
accguaguccauacccagcauc

SEQ ID NO: 3839238 - RNA, 23 nt, Shigella flexneri 2a str. 2457T
accguaguccauacccagcauca

SEQ ID NO: 3839239 - RNA, 16 nt, Shigella flexneri 2a str. 2457T
accguaucuaccacug

SEQ ID NO: 3839240 - RNA, 20 nt, Shigella flexneri 2a str. 2457T
accguaucuucauugugcgg

SEQ ID NO: 3839241 - RNA, 22 nt, Shigella flexneri 2a str. 2457T
accguaugaccggaaaagguga

SEQ ID NO: 3839242 - RNA, 14 nt, Shigella flexneri 2a str. 2457T
accguauucaacga

SEQ ID NO: 3839243 - RNA, 18 nt, Shigella flexneri 2a str. 2457T
accguauuuugguaauga

SEQ ID NO: 3839244 - RNA, 15 nt, Shigella flexneri 2a str. 2457T
accgucaaacacagc

SEQ ID NO: 3839245 - RNA, 15 nt, Shigella flexneri 2a str. 2457T
accgucaucgacaaa

SEQ ID NO: 3839246 - RNA, 14 nt, Shigella flexneri 2a str. 2457T
accguccucacugu

SEQ ID NO: 3839247 - RNA, 20 nt, Shigella flexneri 2a str. 2457T
accguccucuucccagaccc

SEQ ID NO: 3839248 - RNA, 22 nt, Shigella flexneri 2a str. 2457T
accguccucuucccagacccag

SEQ ID NO: 3839249 - RNA, 14 nt, Shigella flexneri 2a str. 2457T
accgucgaugaaag

SEQ ID NO: 3839250 - RNA, 14 nt, Shigella flexneri 2a str. 2457T
accgucgccuucau

SEQ ID NO: 3839251 - RNA, 16 nt, Shigella flexneri 2a str. 2457T
accgucucugcgcccu

SEQ ID NO: 3839252 - RNA, 14 nt, Shigella flexneri 2a str. 2457T
accgucugcuggaa

SEQ ID NO: 3839253 - RNA, 12 nt, Shigella flexneri 2a str. 2457T
accgucuguaac

SEQ ID NO: 3839254 - RNA, 20 nt, Shigella flexneri 2a str. 2457T
accgucuucccgcagccacg

SEQ ID NO: 3839255 - RNA, 23 nt, Shigella flexneri 2a str. 2457T
accgugcugacucagcggcugcc

SEQ ID NO: 3839256 - RNA, 16 nt, Shigella flexneri 2a str. 2457T
accguggcguaaauca

SEQ ID NO: 3839257 - RNA, 18 nt, Shigella flexneri 2a str. 2457T
accguggcguaaaucauc

SEQ ID NO: 3839258 - RNA, 18 nt, Shigella flexneri 2a str. 2457T
accguuaagaugguuacg

SEQ ID NO: 3839259 - RNA, 14 nt, Shigella flexneri 2a str. 2457T
accguucaggcaca

SEQ ID NO: 3839260 - RNA, 20 nt, Shigella flexneri 2a str. 2457T
accguucauuaacgccccaa

SEQ ID NO: 3839261 - RNA, 22 nt, Shigella flexneri 2a str. 2457T
accguucgccaggucagagagc

SEQ ID NO: 3839262 - RNA, 12 nt, Shigella flexneri 2a str. 2457T
accguucgugag

SEQ ID NO: 3839263 - RNA, 12 nt, Shigella flexneri 2a str. 2457T
accguugccgcg

SEQ ID NO: 3839264 - RNA, 23 nt, Shigella flexneri 2a str. 2457T
accguuggcgcguguuccagaga

SEQ ID NO: 3839265 - RNA, 19 nt, Shigella flexneri 2a str. 2457T
accguuuacgucauuaccg

SEQ ID NO: 3839266 - RNA, 21 nt, Shigella flexneri 2a str. 2457T
accguuuacgucauuaccgcg

SEQ ID NO: 3839267 - RNA, 19 nt, Shigella flexneri 2a str. 2457T
accguuucuuugccgagga

SEQ ID NO: 3839268 - RNA, 23 nt, Shigella flexneri 2a str. 2457T
accguuuugugcgcgugagcugg

SEQ ID NO: 3839269 - RNA, 21 nt, Shigella flexneri 2a str. 2457T
accguuuuugccgaugucucg

SEQ ID NO: 3839270 - RNA, 15 nt, Shigella flexneri 2a str. 2457T
acgaucgcuuucaac

SEQ ID NO: 3839271 - RNA, 16 nt, Shigella flexneri 2a str. 2457T
acgaucgcuuucaacg

SEQ ID NO: 3839272 - RNA, 17 nt, Shigella flexneri 2a str. 2457T
acgaugaaagaaaaaac

SEQ ID NO: 3839273 - RNA, 16 nt, Shigella flexneri 2a str. 2457T
acgaugaccgcaucaa

SEQ ID NO: 3839274 - RNA, 14 nt, Shigella flexneri 2a str. 2457T
acgaugacugguag

SEQ ID NO: 3839275 - RNA, 14 nt, Shigella flexneri 2a str. 2457T
acgaugccagcacc

SEQ ID NO: 3839276 - RNA, 22 nt, Shigella flexneri 2a str. 2457T
acgaugccgccgaggauacagc

SEQ ID NO: 3839277 - RNA, 19 nt, Shigella flexneri 2a str. 2457T
acgaugccugaugcgacgc

SEQ ID NO: 3839278 - RNA, 12 nt, Shigella flexneri 2a str. 2457T
acgauggcgcgc

SEQ ID NO: 3839279 - RNA, 20 nt, Shigella flexneri 2a str. 2457T
acgaugguguuggcaaucag

SEQ ID NO: 3839280 - RNA, 16 nt, Shigella flexneri 2a str. 2457T
acgauguauccggcaa

SEQ ID NO: 3839281 - RNA, 15 nt, Shigella flexneri 2a str. 2457T
acgaugucaaucagg

SEQ ID NO: 3839282 - RNA, 19 nt, Shigella flexneri 2a str. 2457T
acgauuaacgcuucuccca

SEQ ID NO: 3839283 - RNA, 13 nt, Shigella flexneri 2a str. 2457T
acgauuaauuaca

SEQ ID NO: 3839284 - RNA, 16 nt, Shigella flexneri 2a str. 2457T
acgauuaauuacacag

SEQ ID NO: 3839285 - RNA, 23 nt, Shigella flexneri 2a str. 2457T
acgauucgcccgcagccaucacu

SEQ ID NO: 3839286 - RNA, 16 nt, Shigella flexneri 2a str. 2457T
acgauucggcaaucac

SEQ ID NO: 3839287 - RNA, 15 nt, Shigella flexneri 2a str. 2457T
acgauugcugccgau

SEQ ID NO: 3839288 - RNA, 22 nt, Shigella flexneri 2a str. 2457T
acgauuugcggcguauccggcu

SEQ ID NO: 3839289 - RNA, 22 nt, Shigella flexneri 2a str. 2457T
acgauuuggccgaagaggaacu

SEQ ID NO: 3839290 - RNA, 22 nt, Shigella flexneri 2a str. 2457T
acgcaaaaccucuuccagcaga

SEQ ID NO: 3839291 - RNA, 14 nt, Shigella flexneri 2a str. 2457T
acgcaaaauugccu

SEQ ID NO: 3839292 - RNA, 19 nt, Shigella flexneri 2a str. 2457T
acgcaaacaccagcgaaug

SEQ ID NO: 3839293 - RNA, 17 nt, Shigella flexneri 2a str. 2457T
acgcaaaguagcggccu

SEQ ID NO: 3839294 - RNA, 19 nt, Shigella flexneri 2a str. 2457T
acgcaaaguagcggccuga

SEQ ID NO: 3839295 - RNA, 19 nt, Shigella flexneri 2a str. 2457T
acgcaacaucgcaauccuu

SEQ ID NO: 3839296 - RNA, 22 nt, Shigella flexneri 2a str. 2457T
acgcaacaugucagcaaucacc

SEQ ID NO: 3839297 - RNA, 13 nt, Shigella flexneri 2a str. 2457T
acgcaaccacaaa

SEQ ID NO: 3839298 - RNA, 18 nt, Shigella flexneri 2a str. 2457T
acgcaacuccagcuuagc

SEQ ID NO: 3839299 - RNA, 22 nt, Shigella flexneri 2a str. 2457T
acgcaacugccaguaaagcagc

SEQ ID NO: 3839300 - RNA, 18 nt, Shigella flexneri 2a str. 2457T
acgcaacugguccagccc

SEQ ID NO: 3839301 - RNA, 18 nt, Shigella flexneri 2a str. 2457T
acgcaagucauacagccg

SEQ ID NO: 3839302 - RNA, 24 nt, Shigella flexneri 2a str. 2457T
acgcaagucauacagccgguacau

SEQ ID NO: 3839303 - RNA, 16 nt, Shigella flexneri 2a str. 2457T
acgcaauaauggacaa

SEQ ID NO: 3839304 - RNA, 22 nt, Shigella flexneri 2a str. 2457T
acgcaaucaaauaccaccagcg

SEQ ID NO: 3839305 - RNA, 23 nt, Shigella flexneri 2a str. 2457T
acgcaauuccagcaagccacugg

SEQ ID NO: 3839306 - RNA, 18 nt, Shigella flexneri 2a str. 2457T
acgcacaggugcaaaaaa

SEQ ID NO: 3839307 - RNA, 15 nt, Shigella flexneri 2a str. 2457T
acgcaccaugcacgg

SEQ ID NO: 3839308 - RNA, 19 nt, Shigella flexneri 2a str. 2457T
acgcaccgcguauugcucu

SEQ ID NO: 3839309 - RNA, 17 nt, Shigella flexneri 2a str. 2457T
acgcaccucagcaagug

SEQ ID NO: 3839310 - RNA, 14 nt, Shigella flexneri 2a str. 2457T
acgcacugcuugaa

SEQ ID NO: 3839311 - RNA, 22 nt, Shigella flexneri 2a str. 2457T
acgcacuguuggcgaaaauccu

SEQ ID NO: 3839312 - RNA, 16 nt, Shigella flexneri 2a str. 2457T
acgcacuucuuccggg

SEQ ID NO: 3839313 - RNA, 16 nt, Shigella flexneri 2a str. 2457T
acgcagaaccagaagc

SEQ ID NO: 3839314 - RNA, 12 nt, Shigella flexneri 2a str. 2457T
acgcagaacuga

SEQ ID NO: 3839315 - RNA, 21 nt, Shigella flexneri 2a str. 2457T
acgcagaccaaagucaaacug

SEQ ID NO: 3839316 - RNA, 18 nt, Shigella flexneri 2a str. 2457T
acgcagagacaucaccaa

SEQ ID NO: 3839317 - RNA, 21 nt, Shigella flexneri 2a str. 2457T
acgcagcauuggguaaaaugg

SEQ ID NO: 3839318 - RNA, 20 nt, Shigella flexneri 2a str. 2457T
acgcagccgggucagcgggg

SEQ ID NO: 3839319 - RNA, 21 nt, Shigella flexneri 2a str. 2457T
acgcagcgguauaaucugcac

SEQ ID NO: 3839320 - RNA, 15 nt, Shigella flexneri 2a str. 2457T
acgcagcucacuucg

SEQ ID NO: 3839321 - RNA, 18 nt, Shigella flexneri 2a str. 2457T
acgcaggccacgaaucag

SEQ ID NO: 3839322 - RNA, 18 nt, Shigella flexneri 2a str. 2457T
acgcaggcggcuggcauc

SEQ ID NO: 3839323 - RNA, 17 nt, Shigella flexneri 2a str. 2457T
acgcaguaagcgccagg

SEQ ID NO: 3839324 - RNA, 15 nt, Shigella flexneri 2a str. 2457T
acgcagugauaacuc

SEQ ID NO: 3839325 - RNA, 20 nt, Shigella flexneri 2a str. 2457T
acgcagugguuaacaaucac

SEQ ID NO: 3839326 - RNA, 14 nt, Shigella flexneri 2a str. 2457T
acgcaguuaacgcg

SEQ ID NO: 3839327 - RNA, 13 nt, Shigella flexneri 2a str. 2457T
acgcauaaaacca

SEQ ID NO: 3839328 - RNA, 16 nt, Shigella flexneri 2a str. 2457T
acgcauaccagucuau

SEQ ID NO: 3839329 - RNA, 22 nt, Shigella flexneri 2a str. 2457T
acgcauacucuuugacaacauc

SEQ ID NO: 3839330 - RNA, 21 nt, Shigella flexneri 2a str. 2457T
acgcaucacgaaucgccgcau

SEQ ID NO: 3839331 - RNA, 17 nt, Shigella flexneri 2a str. 2457T
acgcauccaccagauaa

SEQ ID NO: 3839332 - RNA, 12 nt, Shigella flexneri 2a str. 2457T
acgcaucgacau

SEQ ID NO: 3839333 - RNA, 18 nt, Shigella flexneri 2a str. 2457T
acgcaucgcugcgcuuac

SEQ ID NO: 3839334 - RNA, 19 nt, Shigella flexneri 2a str. 2457T
acgcaucuucuccggccuu

SEQ ID NO: 3839335 - RNA, 12 nt, Shigella flexneri 2a str. 2457T
acgcaugcacau

SEQ ID NO: 3839336 - RNA, 20 nt, Shigella flexneri 2a str. 2457T
acgcauggacacugccggaa

SEQ ID NO: 3839337 - RNA, 13 nt, Shigella flexneri 2a str. 2457T
acgcauugcauuu

SEQ ID NO: 3839338 - RNA, 18 nt, Shigella flexneri 2a str. 2457T
acgcauugcucacuuccu

SEQ ID NO: 3839339 - RNA, 15 nt, Shigella flexneri 2a str. 2457T
acgccaaauucuuua

SEQ ID NO: 3839340 - RNA, 15 nt, Shigella flexneri 2a str. 2457T
acgccaaccagcuga

SEQ ID NO: 3839341 - RNA, 17 nt, Shigella flexneri 2a str. 2457T
acgccaagaaacaccag

SEQ ID NO: 3839342 - RNA, 20 nt, Shigella flexneri 2a str. 2457T
acgccaauaccgcccagacc

SEQ ID NO: 3839343 - RNA, 16 nt, Shigella flexneri 2a str. 2457T
acgccaaucugcaaaa

SEQ ID NO: 3839344 - RNA, 14 nt, Shigella flexneri 2a str. 2457T
acgccacagcaauu

SEQ ID NO: 3839345 - RNA, 20 nt, Shigella flexneri 2a str. 2457T
acgccaccuuucucggcauc

SEQ ID NO: 3839346 - RNA, 16 nt, Shigella flexneri 2a str. 2457T
acgccacgcucacuca

SEQ ID NO: 3839347 - RNA, 17 nt, Shigella flexneri 2a str. 2457T
acgccagacucgccaga

SEQ ID NO: 3839348 - RNA, 14 nt, Shigella flexneri 2a str. 2457T
acgccagacugcgc

SEQ ID NO: 3839349 - RNA, 19 nt, Shigella flexneri 2a str. 2457T
acgccagacugcgcuacca

SEQ ID NO: 3839350 - RNA, 20 nt, Shigella flexneri 2a str. 2457T
acgccagacugcgcuaccag

SEQ ID NO: 3839351 - RNA, 15 nt, Shigella flexneri 2a str. 2457T
acgccagauacauca

SEQ ID NO: 3839352 - RNA, 19 nt, Shigella flexneri 2a str. 2457T
acgccagcgcuuuuggcgc

SEQ ID NO: 3839353 - RNA, 13 nt, Shigella flexneri 2a str. 2457T
acgccagguuguu

SEQ ID NO: 3839354 - RNA, 22 nt, Shigella flexneri 2a str. 2457T
acgccagucacggugcagcucg

SEQ ID NO: 3839355 - RNA, 23 nt, Shigella flexneri 2a str. 2457T
acgccagucacggugcagcucgc

SEQ ID NO: 3839356 - RNA, 21 nt, Shigella flexneri 2a str. 2457T
acgccagucgcacacaacaga

SEQ ID NO: 3839357 - RNA, 16 nt, Shigella flexneri 2a str. 2457T
acgccaucgccaggaa

SEQ ID NO: 3839358 - RNA, 16 nt, Shigella flexneri 2a str. 2457T
acgccaugaagauggu

SEQ ID NO: 3839359 - RNA, 17 nt, Shigella flexneri 2a str. 2457T
acgccauuaaccgugcg

SEQ ID NO: 3839360 - RNA, 19 nt, Shigella flexneri 2a str. 2457T
acgcccaacuaaaugcugc

SEQ ID NO: 3839361 - RNA, 15 nt, Shigella flexneri 2a str. 2457T
acgcccaaugcccag

SEQ ID NO: 3839362 - RNA, 12 nt, Shigella flexneri 2a str. 2457T
acgcccagcgca

SEQ ID NO: 3839363 - RNA, 12 nt, Shigella flexneri 2a str. 2457T
acgcccagcgcg

SEQ ID NO: 3839364 - RNA, 19 nt, Shigella flexneri 2a str. 2457T
acgcccagcgcgcggccuu

SEQ ID NO: 3839365 - RNA, 21 nt, Shigella flexneri 2a str. 2457T
acgcccauaaauacgucuuua

SEQ ID NO: 3839366 - RNA, 16 nt, Shigella flexneri 2a str. 2457T
acgcccaucauucagu

SEQ ID NO: 3839367 - RNA, 22 nt, Shigella flexneri 2a str. 2457T
acgcguacccagcagcgccaca

SEQ ID NO: 3839368 - RNA, 20 nt, Shigella flexneri 2a str. 2457T
acgcgucagaguguugcggc

SEQ ID NO: 3839369 - RNA, 19 nt, Shigella flexneri 2a str. 2457T
acgcguccgguuucgugaa

SEQ ID NO: 3839370 - RNA, 12 nt, Shigella flexneri 2a str. 2457T
acgcgucuuauc

SEQ ID NO: 3839371 - RNA, 21 nt, Shigella flexneri 2a str. 2457T
acgcgucuuaucaggccuaca

SEQ ID NO: 3839372 - RNA, 17 nt, Shigella flexneri 2a str. 2457T
acgcguggcaauggcga

SEQ ID NO: 3839373 - RNA, 14 nt, Shigella flexneri 2a str. 2457T
acgcguuaauaccu

SEQ ID NO: 3839374 - RNA, 17 nt, Shigella flexneri 2a str. 2457T
acgcguuaauaccugau

SEQ ID NO: 3839375 - RNA, 20 nt, Shigella flexneri 2a str. 2457T
acgcguuauccggcuaacaa

SEQ ID NO: 3839376 - RNA, 23 nt, Shigella flexneri 2a str. 2457T
acgcguucgcaaagguuuuaccg

SEQ ID NO: 3839377 - RNA, 19 nt, Shigella flexneri 2a str. 2457T
acgcuaauuuugccaucag

SEQ ID NO: 3839378 - RNA, 22 nt, Shigella flexneri 2a str. 2457T
acgcuacauccgacaaaacgau

SEQ ID NO: 3839379 - RNA, 14 nt, Shigella flexneri 2a str. 2457T
acgcuaccaaaaaa

SEQ ID NO: 3839380 - RNA, 17 nt, Shigella flexneri 2a str. 2457T
acgcuacuuuuuucacc

SEQ ID NO: 3839381 - RNA, 15 nt, Shigella flexneri 2a str. 2457T
acgcucacgcgcugc

SEQ ID NO: 3839382 - RNA, 12 nt, Shigella flexneri 2a str. 2457T
acgcucacugca

SEQ ID NO: 3839383 - RNA, 15 nt, Shigella flexneri 2a str. 2457T
acgcucacugcaaaa

SEQ ID NO: 3839384 - RNA, 23 nt, Shigella flexneri 2a str. 2457T
acgcucaggcuacuuuuccaggu

SEQ ID NO: 3839385 - RNA, 14 nt, Shigella flexneri 2a str. 2457T
acgcucaguauggu

SEQ ID NO: 3839386 - RNA, 20 nt, Shigella flexneri 2a str. 2457T
acgcuccaguguggccagag

SEQ ID NO: 3839387 - RNA, 16 nt, Shigella flexneri 2a str. 2457T
acgcucccagcagaga

SEQ ID NO: 3839388 - RNA, 16 nt, Shigella flexneri 2a str. 2457T
acgcucgaacagcugg

SEQ ID NO: 3839389 - RNA, 17 nt, Shigella flexneri 2a str. 2457T
acgcucgccauuuuuca

SEQ ID NO: 3839390 - RNA, 21 nt, Shigella flexneri 2a str. 2457T
acgcucgcgcaguuugccaug

SEQ ID NO: 3839391 - RNA, 11 nt, Shigella flexneri 2a str. 2457T
acgcucggcaa

SEQ ID NO: 3839392 - RNA, 22 nt, Shigella flexneri 2a str. 2457T
acgcucuguucugcgcuugguu

SEQ ID NO: 3839393 - RNA, 23 nt, Shigella flexneri 2a str. 2457T
acgcucuucaauggucagccaca

SEQ ID NO: 3839394 - RNA, 18 nt, Shigella flexneri 2a str. 2457T
acgcucuuccaggguaaa

SEQ ID NO: 3839395 - RNA, 23 nt, Shigella flexneri 2a str. 2457T
acgcugaauacgcaccgcuccau

SEQ ID NO: 3839396 - RNA, 15 nt, Shigella flexneri 2a str. 2457T
acgcugacgcgucuu

SEQ ID NO: 3839397 - RNA, 19 nt, Shigella flexneri 2a str. 2457T
acgcugauauuucggcauu

SEQ ID NO: 3839398 - RNA, 18 nt, Shigella flexneri 2a str. 2457T
acgcugaugucagcacuu

SEQ ID NO: 3839399 - RNA, 17 nt, Shigella flexneri 2a str. 2457T
acgcugcacaauugcca

SEQ ID NO: 3839400 - RNA, 18 nt, Shigella flexneri 2a str. 2457T
acgcugcaucgccaaucu

SEQ ID NO: 3839401 - RNA, 22 nt, Shigella flexneri 2a str. 2457T
acgcugcaucgccaaucugcug

SEQ ID NO: 3839402 - RNA, 23 nt, Shigella flexneri 2a str. 2457T
acgcugccccugguuaucuucca

SEQ ID NO: 3839403 - RNA, 16 nt, Shigella flexneri 2a str. 2457T
acgcugcugccggcac

SEQ ID NO: 3839404 - RNA, 23 nt, Shigella flexneri 2a str. 2457T
acgcugcugccggcacaggcauc

SEQ ID NO: 3839405 - RNA, 13 nt, Shigella flexneri 2a str. 2457T
acgcuggcccagu

SEQ ID NO: 3839406 - RNA, 20 nt, Shigella flexneri 2a str. 2457T
acgcuggccgcgucuuaucc

SEQ ID NO: 3839407 - RNA, 23 nt, Shigella flexneri 2a str. 2457T
acgcuggcgcgucuuaucaggcc

SEQ ID NO: 3839408 - RNA, 17 nt, Shigella flexneri 2a str. 2457T
acgcugguaacggcguc

SEQ ID NO: 3839409 - RNA, 23 nt, Shigella flexneri 2a str. 2457T
acgcugguaguuguacaacugcu

SEQ ID NO: 3839410 - RNA, 15 nt, Shigella flexneri 2a str. 2457T
acgcuguaauuacca

SEQ ID NO: 3839411 - RNA, 20 nt, Shigella flexneri 2a str. 2457T
acgcugucggcaagauacug

SEQ ID NO: 3839412 - RNA, 21 nt, Shigella flexneri 2a str. 2457T
acgcuguuccggcggcagggu

SEQ ID NO: 3839413 - RNA, 14 nt, Shigella flexneri 2a str. 2457T
acgcuuaucaggcc

SEQ ID NO: 3839414 - RNA, 21 nt, Shigella flexneri 2a str. 2457T
acgcuuauuuauuggugagaa

SEQ ID NO: 3839415 - RNA, 20 nt, Shigella flexneri 2a str. 2457T
acgcuucaaucugauauuua

SEQ ID NO: 3839416 - RNA, 16 nt, Shigella flexneri 2a str. 2457T
acgcuugaagcacacg

SEQ ID NO: 3839417 - RNA, 21 nt, Shigella flexneri 2a str. 2457T
acgcuugaagcacacgacauc

SEQ ID NO: 3839418 - RNA, 19 nt, Shigella flexneri 2a str. 2457T
acgcuuguacggcuccgcc

SEQ ID NO: 3839419 - RNA, 12 nt, Shigella flexneri 2a str. 2457T
acgcuugucauc

SEQ ID NO: 3839420 - RNA, 20 nt, Shigella flexneri 2a str. 2457T
acgcuuuacguuccuggcuu

SEQ ID NO: 3839421 - RNA, 22 nt, Shigella flexneri 2a str. 2457T
acgcuuucacccggaucaauua

SEQ ID NO: 3839422 - RNA, 21 nt, Shigella flexneri 2a str. 2457T
acgcuuucacccggcgcuaau

SEQ ID NO: 3839423 - RNA, 14 nt, Shigella flexneri 2a str. 2457T
acgcuuucucacca

SEQ ID NO: 3839424 - RNA, 17 nt, Shigella flexneri 2a str. 2457T
acgcuuugcaggcuggu

SEQ ID NO: 3839425 - RNA, 14 nt, Shigella flexneri 2a str. 2457T
acgcuuuucagugc

SEQ ID NO: 3839426 - RNA, 15 nt, Shigella flexneri 2a str. 2457T
acgcuuuugcaucgg

SEQ ID NO: 3839427 - RNA, 19 nt, Shigella flexneri 2a str. 2457T
acgcuuuuucccugguaaa

SEQ ID NO: 3839428 - RNA, 14 nt, Shigella flexneri 2a str. 2457T
acggaaagcagcau

SEQ ID NO: 3839429 - RNA, 15 nt, Shigella flexneri 2a str. 2457T
acggaacgaaaaaaa

SEQ ID NO: 3839430 - RNA, 13 nt, Shigella flexneri 2a str. 2457T
acggaacguugcc

SEQ ID NO: 3839431 - RNA, 19 nt, Shigella flexneri 2a str. 2457T
acggaagacguucaguuca

SEQ ID NO: 3839432 - RNA, 14 nt, Shigella flexneri 2a str. 2457T
acggaauaaaccca

SEQ ID NO: 3839433 - RNA, 15 nt, Shigella flexneri 2a str. 2457T
acggaauaaccagcg

SEQ ID NO: 3839434 - RNA, 16 nt, Shigella flexneri 2a str. 2457T
acggaaugauauuggu

SEQ ID NO: 3839435 - RNA, 15 nt, Shigella flexneri 2a str. 2457T
acggacacuccuucc

SEQ ID NO: 3839436 - RNA, 15 nt, Shigella flexneri 2a str. 2457T
acggacaugccauug

SEQ ID NO: 3839437 - RNA, 15 nt, Shigella flexneri 2a str. 2457T
acggacgcgcggcga

SEQ ID NO: 3839438 - RNA, 14 nt, Shigella flexneri 2a str. 2457T
acggacuuccagcg

SEQ ID NO: 3839439 - RNA, 15 nt, Shigella flexneri 2a str. 2457T
acggacuuccagcgg

SEQ ID NO: 3839440 - RNA, 15 nt, Shigella flexneri 2a str. 2457T
acggauaugauuuaa

SEQ ID NO: 3839441 - RNA, 20 nt, Shigella flexneri 2a str. 2457T
acggaucaggcggcucaccu

SEQ ID NO: 3839442 - RNA, 16 nt, Shigella flexneri 2a str. 2457T
acggaugacacgcagg

SEQ ID NO: 3839443 - RNA, 11 nt, Shigella flexneri 2a str. 2457T
acggaugcagc

SEQ ID NO: 3839444 - RNA, 22 nt, Shigella flexneri 2a str. 2457T
acggcaccacauucugcaucgc

SEQ ID NO: 3839445 - RNA, 17 nt, Shigella flexneri 2a str. 2457T
acggcacggaaagcagc

SEQ ID NO: 3839446 - RNA, 18 nt, Shigella flexneri 2a str. 2457T
acggcacuccucuucacg

SEQ ID NO: 3839447 - RNA, 21 nt, Shigella flexneri 2a str. 2457T
acggcagagaaaccacaucaa

SEQ ID NO: 3839448 - RNA, 16 nt, Shigella flexneri 2a str. 2457T
acggcauaagccgucc

SEQ ID NO: 3839449 - RNA, 18 nt, Shigella flexneri 2a str. 2457T
acggcaugaaagcgaugc

SEQ ID NO: 3839450 - RNA, 21 nt, Shigella flexneri 2a str. 2457T
acggcauucugcacauuauca

SEQ ID NO: 3839451 - RNA, 17 nt, Shigella flexneri 2a str. 2457T
acggcauuuaguggauc

SEQ ID NO: 3839452 - RNA, 22 nt, Shigella flexneri 2a str. 2457T
acggcauuuccgccaaucaaga

SEQ ID NO: 3839453 - RNA, 15 nt, Shigella flexneri 2a str. 2457T
acggccaaaaucucu

SEQ ID NO: 3839454 - RNA, 22 nt, Shigella flexneri 2a str. 2457T
acggccgcacuuacagcaacgc

SEQ ID NO: 3839455 - RNA, 19 nt, Shigella flexneri 2a str. 2457T
acggccuucggugcgacaa

SEQ ID NO: 3839456 - RNA, 16 nt, Shigella flexneri 2a str. 2457T
acggcgaccgaagccu

SEQ ID NO: 3839457 - RNA, 14 nt, Shigella flexneri 2a str. 2457T
acggcgagccagcg

SEQ ID NO: 3839458 - RNA, 14 nt, Shigella flexneri 2a str. 2457T
acggcgauaccagu

SEQ ID NO: 3839459 - RNA, 15 nt, Shigella flexneri 2a str. 2457T
acggcgcaccagaau

SEQ ID NO: 3839460 - RNA, 14 nt, Shigella flexneri 2a str. 2457T
acggcgcagcuuca

SEQ ID NO: 3839461 - RNA, 15 nt, Shigella flexneri 2a str. 2457T
acggcgcaugccuca

SEQ ID NO: 3839462 - RNA, 22 nt, Shigella flexneri 2a str. 2457T
acggcgcgacuuuaaucaccug

SEQ ID NO: 3839463 - RNA, 16 nt, Shigella flexneri 2a str. 2457T
acggcggaaagggccg

SEQ ID NO: 3839464 - RNA, 14 nt, Shigella flexneri 2a str. 2457T
acgugacauucuga

SEQ ID NO: 3839465 - RNA, 14 nt, Shigella flexneri 2a str. 2457T
acgugagagauaau

SEQ ID NO: 3839466 - RNA, 23 nt, Shigella flexneri 2a str. 2457T
acgugaucgucuucaaccgcagu

SEQ ID NO: 3839467 - RNA, 15 nt, Shigella flexneri 2a str. 2457T
acgugcacaggcaac

SEQ ID NO: 3839468 - RNA, 13 nt, Shigella flexneri 2a str. 2457T
acgugcagcaucg

SEQ ID NO: 3839469 - RNA, 16 nt, Shigella flexneri 2a str. 2457T
acgugccgcagcuucu

SEQ ID NO: 3839470 - RNA, 18 nt, Shigella flexneri 2a str. 2457T
acgugccugugcagcgac

SEQ ID NO: 3839471 - RNA, 20 nt, Shigella flexneri 2a str. 2457T
acgugcggccguuccauuca

SEQ ID NO: 3839472 - RNA, 19 nt, Shigella flexneri 2a str. 2457T
acgugcucugcgccgccuu

SEQ ID NO: 3839473 - RNA, 15 nt, Shigella flexneri 2a str. 2457T
acguguaaguacagu

SEQ ID NO: 3839474 - RNA, 18 nt, Shigella flexneri 2a str. 2457T
acguguaggccugauaag

SEQ ID NO: 3839475 - RNA, 20 nt, Shigella flexneri 2a str. 2457T
acguguaggccugauaagcg

SEQ ID NO: 3839476 - RNA, 17 nt, Shigella flexneri 2a str. 2457T
acgugucuuaucaggcc

SEQ ID NO: 3839477 - RNA, 18 nt, Shigella flexneri 2a str. 2457T
acguguggucuuuucaac

SEQ ID NO: 3839478 - RNA, 23 nt, Shigella flexneri 2a str. 2457T
acguguggucuuuucaacaguuu

SEQ ID NO: 3839479 - RNA, 15 nt, Shigella flexneri 2a str. 2457T
acguuaacagccuuc

SEQ ID NO: 3839480 - RNA, 20 nt, Shigella flexneri 2a str. 2457T
acguuaacuacaaucacgau

SEQ ID NO: 3839481 - RNA, 13 nt, Shigella flexneri 2a str. 2457T
acguuaagaaaac

SEQ ID NO: 3839482 - RNA, 16 nt, Shigella flexneri 2a str. 2457T
acguuaccggguguuc

SEQ ID NO: 3839483 - RNA, 18 nt, Shigella flexneri 2a str. 2457T
acguuacguacuuccuua

SEQ ID NO: 3839484 - RNA, 12 nt, Shigella flexneri 2a str. 2457T
acguuagcacga

SEQ ID NO: 3839485 - RNA, 20 nt, Shigella flexneri 2a str. 2457T
acguuaguguggccaguucc

SEQ ID NO: 3839486 - RNA, 20 nt, Shigella flexneri 2a str. 2457T
acguuaucgcgccaucaaau

SEQ ID NO: 3839487 - RNA, 21 nt, Shigella flexneri 2a str. 2457T
acguuaucucgcgaucgccug

SEQ ID NO: 3839488 - RNA, 24 nt, Shigella flexneri 2a str. 2457T
acguuauucgcuuccucaaccacu

SEQ ID NO: 3839489 - RNA, 16 nt, Shigella flexneri 2a str. 2457T
acguucacccaucacu

SEQ ID NO: 3839490 - RNA, 16 nt, Shigella flexneri 2a str. 2457T
acguucacgcagcuca

SEQ ID NO: 3839491 - RNA, 13 nt, Shigella flexneri 2a str. 2457T
acguucagcaucu

SEQ ID NO: 3839492 - RNA, 13 nt, Shigella flexneri 2a str. 2457T
acguucagcgcaa

SEQ ID NO: 3839493 - RNA, 12 nt, Shigella flexneri 2a str. 2457T
acguucaguucc

SEQ ID NO: 3839494 - RNA, 19 nt, Shigella flexneri 2a str. 2457T
acguucaucgggcauugca

SEQ ID NO: 3839495 - RNA, 15 nt, Shigella flexneri 2a str. 2457T
acguucauggcgcga

SEQ ID NO: 3839496 - RNA, 12 nt, Shigella flexneri 2a str. 2457T
acguuccagcaa

SEQ ID NO: 3839497 - RNA, 12 nt, Shigella flexneri 2a str. 2457T
acguuccuuucu

SEQ ID NO: 3839498 - RNA, 15 nt, Shigella flexneri 2a str. 2457T
acguuccuuucuugc

SEQ ID NO: 3839499 - RNA, 21 nt, Shigella flexneri 2a str. 2457T
acguuccuuucuugcgcaaac

SEQ ID NO: 3839500 - RNA, 13 nt, Shigella flexneri 2a str. 2457T
acguucgcccacu

SEQ ID NO: 3839501 - RNA, 14 nt, Shigella flexneri 2a str. 2457T
acguucgcccacuu

SEQ ID NO: 3839502 - RNA, 22 nt, Shigella flexneri 2a str. 2457T
acguucggugauauacgucacu

SEQ ID NO: 3839503 - RNA, 14 nt, Shigella flexneri 2a str. 2457T
acguucucuucacu

SEQ ID NO: 3839504 - RNA, 18 nt, Shigella flexneri 2a str. 2457T
acguucugaucuuucuuc

SEQ ID NO: 3839505 - RNA, 19 nt, Shigella flexneri 2a str. 2457T
acguucugaucuuucuuca

SEQ ID NO: 3839506 - RNA, 21 nt, Shigella flexneri 2a str. 2457T
acguucuucgcugacaguacc

SEQ ID NO: 3839507 - RNA, 18 nt, Shigella flexneri 2a str. 2457T
acguugaacugacuguuu

SEQ ID NO: 3839508 - RNA, 21 nt, Shigella flexneri 2a str. 2457T
acguugagagguaaaaccuga

SEQ ID NO: 3839509 - RNA, 22 nt, Shigella flexneri 2a str. 2457T
acguugagagguaaaaccugac

SEQ ID NO: 3839510 - RNA, 22 nt, Shigella flexneri 2a str. 2457T
acguugauuuugucauggcgca

SEQ ID NO: 3839511 - RNA, 18 nt, Shigella flexneri 2a str. 2457T
acguugccggauauaccc

SEQ ID NO: 3839512 - RNA, 23 nt, Shigella flexneri 2a str. 2457T
acguugcugacuguaggccggau

SEQ ID NO: 3839513 - RNA, 21 nt, Shigella flexneri 2a str. 2457T
acguugcuguugguucagugg

SEQ ID NO: 3839514 - RNA, 14 nt, Shigella flexneri 2a str. 2457T
acguuggcgcauaa

SEQ ID NO: 3839515 - RNA, 17 nt, Shigella flexneri 2a str. 2457T
acguuggcggugccauc

SEQ ID NO: 3839516 - RNA, 18 nt, Shigella flexneri 2a str. 2457T
acguugucagcaaccugc

SEQ ID NO: 3839517 - RNA, 19 nt, Shigella flexneri 2a str. 2457T
acguugucagcaaccugcu

SEQ ID NO: 3839518 - RNA, 15 nt, Shigella flexneri 2a str. 2457T
acguugucgccgcug

SEQ ID NO: 3839519 - RNA, 23 nt, Shigella flexneri 2a str. 2457T
acguuguuccggcgcaauucccg

SEQ ID NO: 3839520 - RNA, 14 nt, Shigella flexneri 2a str. 2457T
acguuuauuauaga

SEQ ID NO: 3839521 - RNA, 17 nt, Shigella flexneri 2a str. 2457T
acguuuauucccgcgaa

SEQ ID NO: 3839522 - RNA, 17 nt, Shigella flexneri 2a str. 2457T
acguuucaaacaggcug

SEQ ID NO: 3839523 - RNA, 19 nt, Shigella flexneri 2a str. 2457T
acguuucaccagcacuucu

SEQ ID NO: 3839524 - RNA, 20 nt, Shigella flexneri 2a str. 2457T
acguuuccacggauaacaaa

SEQ ID NO: 3839525 - RNA, 15 nt, Shigella flexneri 2a str. 2457T
acguuuugcugaugc

SEQ ID NO: 3839526 - RNA, 14 nt, Shigella flexneri 2a str. 2457T
acguuuuuacguuc

SEQ ID NO: 3839527 - RNA, 20 nt, Shigella flexneri 2a str. 2457T
acuaaacccgaccacuucca

SEQ ID NO: 3839528 - RNA, 15 nt, Shigella flexneri 2a str. 2457T
acuaaaugcugcagc

SEQ ID NO: 3839529 - RNA, 19 nt, Shigella flexneri 2a str. 2457T
acuaacacuucaucacuac

SEQ ID NO: 3839530 - RNA, 16 nt, Shigella flexneri 2a str. 2457T
acuaacagaacaauaa

SEQ ID NO: 3839531 - RNA, 16 nt, Shigella flexneri 2a str. 2457T
acuaacgcgucuuauc

SEQ ID NO: 3839532 - RNA, 22 nt, Shigella flexneri 2a str. 2457T
acuaacuucugaucuacagccu

SEQ ID NO: 3839533 - RNA, 22 nt, Shigella flexneri 2a str. 2457T
acuaagaauguccauuauuuca

SEQ ID NO: 3839534 - RNA, 14 nt, Shigella flexneri 2a str. 2457T
acuaagauaaucca

SEQ ID NO: 3839535 - RNA, 19 nt, Shigella flexneri 2a str. 2457T
acuacaaauccaacaccag

SEQ ID NO: 3839536 - RNA, 15 nt, Shigella flexneri 2a str. 2457T
acuacacuaaacguc

SEQ ID NO: 3839537 - RNA, 20 nt, Shigella flexneri 2a str. 2457T
acuacagaggaaucgcuguu

SEQ ID NO: 3839538 - RNA, 13 nt, Shigella flexneri 2a str. 2457T
acuaccauaaaaa

SEQ ID NO: 3839539 - RNA, 15 nt, Shigella flexneri 2a str. 2457T
acuacccauauuuaa

SEQ ID NO: 3839540 - RNA, 23 nt, Shigella flexneri 2a str. 2457T
acuacccgcauuuucuucauucg

SEQ ID NO: 3839541 - RNA, 14 nt, Shigella flexneri 2a str. 2457T
acuaccggaaccca

SEQ ID NO: 3839542 - RNA, 19 nt, Shigella flexneri 2a str. 2457T
acuaccggaacccaccgca

SEQ ID NO: 3839543 - RNA, 16 nt, Shigella flexneri 2a str. 2457T
acuaccggggacaggc

SEQ ID NO: 3839544 - RNA, 17 nt, Shigella flexneri 2a str. 2457T
acuacgggcaccaguaa

SEQ ID NO: 3839545 - RNA, 14 nt, Shigella flexneri 2a str. 2457T
acuacguagaucau

SEQ ID NO: 3839546 - RNA, 23 nt, Shigella flexneri 2a str. 2457T
acuacucuauacaggauaauuag

SEQ ID NO: 3839547 - RNA, 17 nt, Shigella flexneri 2a str. 2457T
acuagacgaugaaaaag

SEQ ID NO: 3839548 - RNA, 18 nt, Shigella flexneri 2a str. 2457T
acuagaugugcaguuccu

SEQ ID NO: 3839549 - RNA, 14 nt, Shigella flexneri 2a str. 2457T
acuagugauaacca

SEQ ID NO: 3839550 - RNA, 19 nt, Shigella flexneri 2a str. 2457T
acuauacuccugauggucu

SEQ ID NO: 3839551 - RNA, 19 nt, Shigella flexneri 2a str. 2457T
acuauauucucaaaauaca

SEQ ID NO: 3839552 - RNA, 17 nt, Shigella flexneri 2a str. 2457T
acuaucaggcaaaaaaa

SEQ ID NO: 3839553 - RNA, 17 nt, Shigella flexneri 2a str. 2457T
acuaucauacucauuua

SEQ ID NO: 3839554 - RNA, 13 nt, Shigella flexneri 2a str. 2457T
acuaucaucgccg

SEQ ID NO: 3839555 - RNA, 23 nt, Shigella flexneri 2a str. 2457T
acuaucgaaaguuuaccagccaa

SEQ ID NO: 3839556 - RNA, 15 nt, Shigella flexneri 2a str. 2457T
acuaucuugccgaag

SEQ ID NO: 3839557 - RNA, 23 nt, Shigella flexneri 2a str. 2457T
acuauuaaacaggaugacacuga

SEQ ID NO: 3839558 - RNA, 16 nt, Shigella flexneri 2a str. 2457T
acuauuaaagaaagua

SEQ ID NO: 3839559 - RNA, 22 nt, Shigella flexneri 2a str. 2457T
acuauuggucuggaacuggcug

SEQ ID NO: 3839560 - RNA, 15 nt, Shigella flexneri 2a str. 2457T
acuauuucaauauga

SEQ ID NO: 3839561 - RNA, 12 nt, Shigella flexneri 2a str. 2457T
acucuuucccgg

SEQ ID NO: 3839562 - RNA, 23 nt, Shigella flexneri 2a str. 2457T
acucuuucucggaguaacuauaa

SEQ ID NO: 3839563 - RNA, 20 nt, Shigella flexneri 2a str. 2457T
acucuuugaugaaacaugau

SEQ ID NO: 3839564 - RNA, 18 nt, Shigella flexneri 2a str. 2457T
acucuuuuuccugcugca

SEQ ID NO: 3839565 - RNA, 22 nt, Shigella flexneri 2a str. 2457T
acucuuuuuuccgcuuugugua

SEQ ID NO: 3839566 - RNA, 13 nt, Shigella flexneri 2a str. 2457T
acugaacaaaaaa

SEQ ID NO: 3839567 - RNA, 16 nt, Shigella flexneri 2a str. 2457T
acugaacaaaaaagag

SEQ ID NO: 3839568 - RNA, 21 nt, Shigella flexneri 2a str. 2457T
acugaacaacuuaacuugcuu

SEQ ID NO: 3839569 - RNA, 16 nt, Shigella flexneri 2a str. 2457T
acugaagcauugccga

SEQ ID NO: 3839570 - RNA, 18 nt, Shigella flexneri 2a str. 2457T
acugaauaugagucguaa

SEQ ID NO: 3839571 - RNA, 19 nt, Shigella flexneri 2a str. 2457T
acugaaugaucacuuguuc

SEQ ID NO: 3839572 - RNA, 15 nt, Shigella flexneri 2a str. 2457T
acugacaaacugcgc

SEQ ID NO: 3839573 - RNA, 19 nt, Shigella flexneri 2a str. 2457T
acugacaauucaggggcau

SEQ ID NO: 3839574 - RNA, 14 nt, Shigella flexneri 2a str. 2457T
acugacaauuugcc

SEQ ID NO: 3839575 - RNA, 21 nt, Shigella flexneri 2a str. 2457T
acugacagggugagcagggca

SEQ ID NO: 3839576 - RNA, 14 nt, Shigella flexneri 2a str. 2457T
acugacaucaaacc

SEQ ID NO: 3839577 - RNA, 19 nt, Shigella flexneri 2a str. 2457T
acugacaucagcauccgca

SEQ ID NO: 3839578 - RNA, 18 nt, Shigella flexneri 2a str. 2457T
acugacauuacggauuaa

SEQ ID NO: 3839579 - RNA, 20 nt, Shigella flexneri 2a str. 2457T
acugacauuacggauuaaau

SEQ ID NO: 3839580 - RNA, 15 nt, Shigella flexneri 2a str. 2457T
acugacauugccuuc

SEQ ID NO: 3839581 - RNA, 15 nt, Shigella flexneri 2a str. 2457T
acugaccacaaaggc

SEQ ID NO: 3839582 - RNA, 14 nt, Shigella flexneri 2a str. 2457T
acugaccaccacca

SEQ ID NO: 3839583 - RNA, 23 nt, Shigella flexneri 2a str. 2457T
acugacgcccguuaaccgcucug

SEQ ID NO: 3839584 - RNA, 21 nt, Shigella flexneri 2a str. 2457T
acugacggaucccgccaacag

SEQ ID NO: 3839585 - RNA, 20 nt, Shigella flexneri 2a str. 2457T
acugacgggaaacucugcug

SEQ ID NO: 3839586 - RNA, 13 nt, Shigella flexneri 2a str. 2457T
acugacuauccug

SEQ ID NO: 3839587 - RNA, 18 nt, Shigella flexneri 2a str. 2457T
acugacuaugguguaacg

SEQ ID NO: 3839588 - RNA, 18 nt, Shigella flexneri 2a str. 2457T
acugacugacgugaugau

SEQ ID NO: 3839589 - RNA, 15 nt, Shigella flexneri 2a str. 2457T
acugacugacuucaa

SEQ ID NO: 3839590 - RNA, 13 nt, Shigella flexneri 2a str. 2457T
acugacuugcccg

SEQ ID NO: 3839591 - RNA, 14 nt, Shigella flexneri 2a str. 2457T
acugacuuucguuu

SEQ ID NO: 3839592 - RNA, 22 nt, Shigella flexneri 2a str. 2457T
acugagccaaacgcccagcuaa

SEQ ID NO: 3839593 - RNA, 21 nt, Shigella flexneri 2a str. 2457T
acugagucagcccaacaaagc

SEQ ID NO: 3839594 - RNA, 12 nt, Shigella flexneri 2a str. 2457T
acugaguugcag

SEQ ID NO: 3839595 - RNA, 15 nt, Shigella flexneri 2a str. 2457T
acugauaaaccuuca

SEQ ID NO: 3839596 - RNA, 23 nt, Shigella flexneri 2a str. 2457T
acugauaauuuucgguaaugacu

SEQ ID NO: 3839597 - RNA, 16 nt, Shigella flexneri 2a str. 2457T
acugauaguguuuuau

SEQ ID NO: 3839598 - RNA, 13 nt, Shigella flexneri 2a str. 2457T
acugaucaucauu

SEQ ID NO: 3839599 - RNA, 16 nt, Shigella flexneri 2a str. 2457T
acugaucgucaucaaa

SEQ ID NO: 3839600 - RNA, 22 nt, Shigella flexneri 2a str. 2457T
acugaugacaaacacaaaacug

SEQ ID NO: 3839601 - RNA, 20 nt, Shigella flexneri 2a str. 2457T
acugcaaauacccaaaaaau

SEQ ID NO: 3839602 - RNA, 14 nt, Shigella flexneri 2a str. 2457T
acugcaaaucacca

SEQ ID NO: 3839603 - RNA, 20 nt, Shigella flexneri 2a str. 2457T
acugcaucagcgccuuacca

SEQ ID NO: 3839604 - RNA, 16 nt, Shigella flexneri 2a str. 2457T
acugcaucuuccgugg

SEQ ID NO: 3839605 - RNA, 17 nt, Shigella flexneri 2a str. 2457T
acugcauucccaucgca

SEQ ID NO: 3839606 - RNA, 20 nt, Shigella flexneri 2a str. 2457T
acugccacaagggcauauuu

SEQ ID NO: 3839607 - RNA, 22 nt, Shigella flexneri 2a str. 2457T
acugccacacaggccauuuccc

SEQ ID NO: 3839608 - RNA, 23 nt, Shigella flexneri 2a str. 2457T
acugccaccagcagcguuuugua

SEQ ID NO: 3839609 - RNA, 13 nt, Shigella flexneri 2a str. 2457T
acugccagaauag

SEQ ID NO: 3839610 - RNA, 15 nt, Shigella flexneri 2a str. 2457T
acugccagaaucaag

SEQ ID NO: 3839611 - RNA, 18 nt, Shigella flexneri 2a str. 2457T
acugccaguucccccugc

SEQ ID NO: 3839612 - RNA, 12 nt, Shigella flexneri 2a str. 2457T
acugcccgagaa

SEQ ID NO: 3839613 - RNA, 14 nt, Shigella flexneri 2a str. 2457T
acugcccgagaaca

SEQ ID NO: 3839614 - RNA, 14 nt, Shigella flexneri 2a str. 2457T
acugccgaagcggu

SEQ ID NO: 3839615 - RNA, 14 nt, Shigella flexneri 2a str. 2457T
acugccgcgccuga

SEQ ID NO: 3839616 - RNA, 17 nt, Shigella flexneri 2a str. 2457T
acugccggaagagagca

SEQ ID NO: 3839617 - RNA, 16 nt, Shigella flexneri 2a str. 2457T
acugccggacguucgc

SEQ ID NO: 3839618 - RNA, 19 nt, Shigella flexneri 2a str. 2457T
acugccggaugcaucgcau

SEQ ID NO: 3839619 - RNA, 15 nt, Shigella flexneri 2a str. 2457T
acugccguacagaca

SEQ ID NO: 3839620 - RNA, 15 nt, Shigella flexneri 2a str. 2457T
acugccguacaggca

SEQ ID NO: 3839621 - RNA, 20 nt, Shigella flexneri 2a str. 2457T
acugccguacaggcagcuua

SEQ ID NO: 3839622 - RNA, 16 nt, Shigella flexneri 2a str. 2457T
acugccguugcugccg

SEQ ID NO: 3839623 - RNA, 14 nt, Shigella flexneri 2a str. 2457T
acugccuuaaucaa

SEQ ID NO: 3839624 - RNA, 15 nt, Shigella flexneri 2a str. 2457T
acugccuuaaucaag

SEQ ID NO: 3839625 - RNA, 22 nt, Shigella flexneri 2a str. 2457T
acugccuuugcccgcaagcugc

SEQ ID NO: 3839626 - RNA, 16 nt, Shigella flexneri 2a str. 2457T
acugcgaccgaucacc

SEQ ID NO: 3839627 - RNA, 13 nt, Shigella flexneri 2a str. 2457T
acugcgacgcggc

SEQ ID NO: 3839628 - RNA, 15 nt, Shigella flexneri 2a str. 2457T
acugcgccacucgau

SEQ ID NO: 3839629 - RNA, 18 nt, Shigella flexneri 2a str. 2457T
acugcgccaucaaugccg

SEQ ID NO: 3839630 - RNA, 21 nt, Shigella flexneri 2a str. 2457T
acugcgccaucaaugccgcaa

SEQ ID NO: 3839631 - RNA, 16 nt, Shigella flexneri 2a str. 2457T
acugcgcccgccagca

SEQ ID NO: 3839632 - RNA, 15 nt, Shigella flexneri 2a str. 2457T
acugcgccgaagcgc

SEQ ID NO: 3839633 - RNA, 12 nt, Shigella flexneri 2a str. 2457T
acugcgccgcuc

SEQ ID NO: 3839634 - RNA, 21 nt, Shigella flexneri 2a str. 2457T
acugcgcgauuaucauuuuac

SEQ ID NO: 3839635 - RNA, 14 nt, Shigella flexneri 2a str. 2457T
acugcggucuaaau

SEQ ID NO: 3839636 - RNA, 19 nt, Shigella flexneri 2a str. 2457T
acugcggucuaaaucuucc

SEQ ID NO: 3839637 - RNA, 22 nt, Shigella flexneri 2a str. 2457T
acugcggucuaaaucuuccgcc

SEQ ID NO: 3839638 - RNA, 23 nt, Shigella flexneri 2a str. 2457T
acugcguauuuccugccagaccu

SEQ ID NO: 3839639 - RNA, 20 nt, Shigella flexneri 2a str. 2457T
acugcgucauuucgaagaaa

SEQ ID NO: 3839640 - RNA, 12 nt, Shigella flexneri 2a str. 2457T
acugcgugcuga

SEQ ID NO: 3839641 - RNA, 12 nt, Shigella flexneri 2a str. 2457T
acugcgugguga

SEQ ID NO: 3839642 - RNA, 19 nt, Shigella flexneri 2a str. 2457T
acugcgugucguaagccac

SEQ ID NO: 3839643 - RNA, 14 nt, Shigella flexneri 2a str. 2457T
acugcguucugucg

SEQ ID NO: 3839644 - RNA, 20 nt, Shigella flexneri 2a str. 2457T
acugcucagacggugaccag

SEQ ID NO: 3839645 - RNA, 14 nt, Shigella flexneri 2a str. 2457T
acugcucagcuccu

SEQ ID NO: 3839646 - RNA, 14 nt, Shigella flexneri 2a str. 2457T
acugcucguucagc

SEQ ID NO: 3839647 - RNA, 16 nt, Shigella flexneri 2a str. 2457T
acugcucguucagcac

SEQ ID NO: 3839648 - RNA, 15 nt, Shigella flexneri 2a str. 2457T
acugcugaaugaggc

SEQ ID NO: 3839649 - RNA, 17 nt, Shigella flexneri 2a str. 2457T
acugcugaaugaggcuu

SEQ ID NO: 3839650 - RNA, 18 nt, Shigella flexneri 2a str. 2457T
acugcugauguuguuucu

SEQ ID NO: 3839651 - RNA, 20 nt, Shigella flexneri 2a str. 2457T
acugcugauuuggaaagugu

SEQ ID NO: 3839652 - RNA, 18 nt, Shigella flexneri 2a str. 2457T
acugcugcggaauugccg

SEQ ID NO: 3839653 - RNA, 17 nt, Shigella flexneri 2a str. 2457T
acugcugcucaaucugc

SEQ ID NO: 3839654 - RNA, 18 nt, Shigella flexneri 2a str. 2457T
acugcuggcuuaaaaaac

SEQ ID NO: 3839655 - RNA, 21 nt, Shigella flexneri 2a str. 2457T
acugcuuaauauuaacuuaau

SEQ ID NO: 3839656 - RNA, 15 nt, Shigella flexneri 2a str. 2457T
acugcuugagcgggg

SEQ ID NO: 3839657 - RNA, 21 nt, Shigella flexneri 2a str. 2457T
acuggaaaaauaauuuuaaau

SEQ ID NO: 3839658 - RNA, 22 nt, Shigella flexneri 2a str. 2457T
acuggaacggggcgauuuuguu

SEQ ID NO: 3839659 - RNA, 18 nt, Shigella flexneri 2a str. 2457T
acuuccuuuuuuauuuac

SEQ ID NO: 3839660 - RNA, 17 nt, Shigella flexneri 2a str. 2457T
acuucgaguacauccac

SEQ ID NO: 3839661 - RNA, 15 nt, Shigella flexneri 2a str. 2457T
acuucgccaacgccc

SEQ ID NO: 3839662 - RNA, 16 nt, Shigella flexneri 2a str. 2457T
acuucgccaucugcca

SEQ ID NO: 3839663 - RNA, 17 nt, Shigella flexneri 2a str. 2457T
acuucgccaucugccag

SEQ ID NO: 3839664 - RNA, 23 nt, Shigella flexneri 2a str. 2457T
acuucgcguucuguggcagggca

SEQ ID NO: 3839665 - RNA, 18 nt, Shigella flexneri 2a str. 2457T
acuucgcugguguacugc

SEQ ID NO: 3839666 - RNA, 15 nt, Shigella flexneri 2a str. 2457T
acuucgguuaccaca

SEQ ID NO: 3839667 - RNA, 23 nt, Shigella flexneri 2a str. 2457T
acuucucuucuuccgcuucaauc

SEQ ID NO: 3839668 - RNA, 12 nt, Shigella flexneri 2a str. 2457T
acuucucuuucg

SEQ ID NO: 3839669 - RNA, 18 nt, Shigella flexneri 2a str. 2457T
acuucugauguuguuuuu

SEQ ID NO: 3839670 - RNA, 13 nt, Shigella flexneri 2a str. 2457T
acuucugcgucga

SEQ ID NO: 3839671 - RNA, 22 nt, Shigella flexneri 2a str. 2457T
acuucuuagucccaaacagcag

SEQ ID NO: 3839672 - RNA, 24 nt, Shigella flexneri 2a str. 2457T
acuucuuagucccaaacagcagaa

SEQ ID NO: 3839673 - RNA, 11 nt, Shigella flexneri 2a str. 2457T
acuucuucaca

SEQ ID NO: 3839674 - RNA, 22 nt, Shigella flexneri 2a str. 2457T
acuucuucacaccaucaaagaa

SEQ ID NO: 3839675 - RNA, 11 nt, Shigella flexneri 2a str. 2457T
acuucuucagc

SEQ ID NO: 3839676 - RNA, 16 nt, Shigella flexneri 2a str. 2457T
acuucuucauucaucc

SEQ ID NO: 3839677 - RNA, 17 nt, Shigella flexneri 2a str. 2457T
acuucuucugucgggca

SEQ ID NO: 3839678 - RNA, 14 nt, Shigella flexneri 2a str. 2457T
acuucuuuuugaac

SEQ ID NO: 3839679 - RNA, 13 nt, Shigella flexneri 2a str. 2457T
acuugagcccugg

SEQ ID NO: 3839680 - RNA, 13 nt, Shigella flexneri 2a str. 2457T
acuugauacugaa

SEQ ID NO: 3839681 - RNA, 14 nt, Shigella flexneri 2a str. 2457T
acuugauacugaac

SEQ ID NO: 3839682 - RNA, 17 nt, Shigella flexneri 2a str. 2457T
acuugcaaucuuuagca

SEQ ID NO: 3839683 - RNA, 18 nt, Shigella flexneri 2a str. 2457T
acuugccagauaaacaua

SEQ ID NO: 3839684 - RNA, 14 nt, Shigella flexneri 2a str. 2457T
acuugccuccagcg

SEQ ID NO: 3839685 - RNA, 16 nt, Shigella flexneri 2a str. 2457T
acuugcggacccggcg

SEQ ID NO: 3839686 - RNA, 21 nt, Shigella flexneri 2a str. 2457T
acuugcucaaucgcauggcug

SEQ ID NO: 3839687 - RNA, 15 nt, Shigella flexneri 2a str. 2457T
acuugcuuaaaaaau

SEQ ID NO: 3839688 - RNA, 19 nt, Shigella flexneri 2a str. 2457T
acuugcuuaaaaaaucaca

SEQ ID NO: 3839689 - RNA, 14 nt, Shigella flexneri 2a str. 2457T
acuuggguaacagc

SEQ ID NO: 3839690 - RNA, 14 nt, Shigella flexneri 2a str. 2457T
acuuguaggacgga

SEQ ID NO: 3839691 - RNA, 17 nt, Shigella flexneri 2a str. 2457T
acuuuaaauucagcauu

SEQ ID NO: 3839692 - RNA, 15 nt, Shigella flexneri 2a str. 2457T
acuuuaagcugaaaa

SEQ ID NO: 3839693 - RNA, 19 nt, Shigella flexneri 2a str. 2457T
acuuuaauaaucucgccuu

SEQ ID NO: 3839694 - RNA, 23 nt, Shigella flexneri 2a str. 2457T
acuuuaaugccacauuagauaaa

SEQ ID NO: 3839695 - RNA, 14 nt, Shigella flexneri 2a str. 2457T
acuuuaauuuugug

SEQ ID NO: 3839696 - RNA, 16 nt, Shigella flexneri 2a str. 2457T
acuuuaauuuugugca

SEQ ID NO: 3839697 - RNA, 19 nt, Shigella flexneri 2a str. 2457T
acuuuaauuuugugcagca

SEQ ID NO: 3839698 - RNA, 20 nt, Shigella flexneri 2a str. 2457T
acuuuaauuuugugcagcau

SEQ ID NO: 3839699 - RNA, 23 nt, Shigella flexneri 2a str. 2457T
acuuuaauuuugugcagcaugca

SEQ ID NO: 3839700 - RNA, 22 nt, Shigella flexneri 2a str. 2457T
acuuuacccgguuugugaaugu

SEQ ID NO: 3839701 - RNA, 18 nt, Shigella flexneri 2a str. 2457T
acuuuagcgaaaucuucc

SEQ ID NO: 3839702 - RNA, 19 nt, Shigella flexneri 2a str. 2457T
acuuuaucgcgcaaaaaau

SEQ ID NO: 3839703 - RNA, 16 nt, Shigella flexneri 2a str. 2457T
acuuuaucugauuuga

SEQ ID NO: 3839704 - RNA, 18 nt, Shigella flexneri 2a str. 2457T
acuuucaaacgccacagc

SEQ ID NO: 3839705 - RNA, 16 nt, Shigella flexneri 2a str. 2457T
acuuucaacagguuaa

SEQ ID NO: 3839706 - RNA, 16 nt, Shigella flexneri 2a str. 2457T
acuuucacgcccauaa

SEQ ID NO: 3839707 - RNA, 22 nt, Shigella flexneri 2a str. 2457T
acuuucagcaagggcaucguaa

SEQ ID NO: 3839708 - RNA, 22 nt, Shigella flexneri 2a str. 2457T
acuuucaguggcuuaucuuccu

SEQ ID NO: 3839709 - RNA, 14 nt, Shigella flexneri 2a str. 2457T
acuuuccagccaca

SEQ ID NO: 3839710 - RNA, 20 nt, Shigella flexneri 2a str. 2457T
acuuuccagccacaguucga

SEQ ID NO: 3839711 - RNA, 16 nt, Shigella flexneri 2a str. 2457T
acuuuccaucuuuccu

SEQ ID NO: 3839712 - RNA, 20 nt, Shigella flexneri 2a str. 2457T
acuuuccaugccaucugcca

SEQ ID NO: 3839713 - RNA, 20 nt, Shigella flexneri 2a str. 2457T
acuuuccuuaacuccucgcc

SEQ ID NO: 3839714 - RNA, 21 nt, Shigella flexneri 2a str. 2457T
acuuucgagcaauuuuccuug

SEQ ID NO: 3839715 - RNA, 16 nt, Shigella flexneri 2a str. 2457T
acuuucucuucaucua

SEQ ID NO: 3839716 - RNA, 18 nt, Shigella flexneri 2a str. 2457T
acuuucucuucaucuaua

SEQ ID NO: 3839717 - RNA, 13 nt, Shigella flexneri 2a str. 2457T
acuuucugagauu

SEQ ID NO: 3839718 - RNA, 22 nt, Shigella flexneri 2a str. 2457T
acuuucuuuuuguugcgcugaa

SEQ ID NO: 3839719 - RNA, 16 nt, Shigella flexneri 2a str. 2457T
acuuugcaguuccugc

SEQ ID NO: 3839720 - RNA, 11 nt, Shigella flexneri 2a str. 2457T
acuuugccugg

SEQ ID NO: 3839721 - RNA, 15 nt, Shigella flexneri 2a str. 2457T
acuuugccuggcggc

SEQ ID NO: 3839722 - RNA, 13 nt, Shigella flexneri 2a str. 2457T
acuuugucaaaaa

SEQ ID NO: 3839723 - RNA, 17 nt, Shigella flexneri 2a str. 2457T
acuuuuaaaucgccaag

SEQ ID NO: 3839724 - RNA, 17 nt, Shigella flexneri 2a str. 2457T
acuuuuaaauugaagag

SEQ ID NO: 3839725 - RNA, 15 nt, Shigella flexneri 2a str. 2457T
acuuuuacucauuuc

SEQ ID NO: 3839726 - RNA, 16 nt, Shigella flexneri 2a str. 2457T
acuuuuauuaacucag

SEQ ID NO: 3839727 - RNA, 22 nt, Shigella flexneri 2a str. 2457T
acuuuucaccgcuuugccaaac

SEQ ID NO: 3839728 - RNA, 16 nt, Shigella flexneri 2a str. 2457T
acuuuucccuacugcu

SEQ ID NO: 3839729 - RNA, 22 nt, Shigella flexneri 2a str. 2457T
acuuuucccuacugcugacaua

SEQ ID NO: 3839730 - RNA, 16 nt, Shigella flexneri 2a str. 2457T
acuuuuggaccacgga

SEQ ID NO: 3839731 - RNA, 14 nt, Shigella flexneri 2a str. 2457T
acuuuuguauuuua

SEQ ID NO: 3839732 - RNA, 15 nt, Shigella flexneri 2a str. 2457T
acuuuuuaacuuuaa

SEQ ID NO: 3839733 - RNA, 18 nt, Shigella flexneri 2a str. 2457T
acuuuuuaugucauuaac

SEQ ID NO: 3839734 - RNA, 13 nt, Shigella flexneri 2a str. 2457T
acuuuuucaagaa

SEQ ID NO: 3839735 - RNA, 14 nt, Shigella flexneri 2a str. 2457T
acuuuuugcacaag

SEQ ID NO: 3839736 - RNA, 17 nt, Shigella flexneri 2a str. 2457T
agaaaaaccuccggcgu

SEQ ID NO: 3839737 - RNA, 23 nt, Shigella flexneri 2a str. 2457T
agaaaacgaaagcgccaucaaug

SEQ ID NO: 3839738 - RNA, 14 nt, Shigella flexneri 2a str. 2457T
agaaaacgaauacu

SEQ ID NO: 3839739 - RNA, 20 nt, Shigella flexneri 2a str. 2457T
agaaaacgguugauauacca

SEQ ID NO: 3839740 - RNA, 15 nt, Shigella flexneri 2a str. 2457T
agaaaacguuucaac

SEQ ID NO: 3839741 - RNA, 17 nt, Shigella flexneri 2a str. 2457T
agaaaacuuccggcaga

SEQ ID NO: 3839742 - RNA, 16 nt, Shigella flexneri 2a str. 2457T
agaaaaucgugccaga

SEQ ID NO: 3839743 - RNA, 17 nt, Shigella flexneri 2a str. 2457T
agaaaaucucaauguau

SEQ ID NO: 3839744 - RNA, 18 nt, Shigella flexneri 2a str. 2457T
agaaaaucucaauguauu

SEQ ID NO: 3839745 - RNA, 21 nt, Shigella flexneri 2a str. 2457T
agaaaauggccagccagcaga

SEQ ID NO: 3839746 - RNA, 19 nt, Shigella flexneri 2a str. 2457T
agaaaauuuuagggaagua

SEQ ID NO: 3839747 - RNA, 12 nt, Shigella flexneri 2a str. 2457T
agaaacaaaaaa

SEQ ID NO: 3839748 - RNA, 15 nt, Shigella flexneri 2a str. 2457T
agaaacaccagaaug

SEQ ID NO: 3839749 - RNA, 22 nt, Shigella flexneri 2a str. 2457T
agaaaccgaugacgcauacgug

SEQ ID NO: 3839750 - RNA, 20 nt, Shigella flexneri 2a str. 2457T
agaaaccugauuacgcaccg

SEQ ID NO: 3839751 - RNA, 17 nt, Shigella flexneri 2a str. 2457T
agaaacgcucauaaauu

SEQ ID NO: 3839752 - RNA, 19 nt, Shigella flexneri 2a str. 2457T
agaaacgcuuaaaacgcuc

SEQ ID NO: 3839753 - RNA, 19 nt, Shigella flexneri 2a str. 2457T
agaaacuaucaggcaaaaa

SEQ ID NO: 3839754 - RNA, 13 nt, Shigella flexneri 2a str. 2457T
agaaacucaguug

SEQ ID NO: 3839755 - RNA, 19 nt, Shigella flexneri 2a str. 2457T
agaaacuguaauugagaac

SEQ ID NO: 3839756 - RNA, 22 nt, Shigella flexneri 2a str. 2457T
agaaagcaauauugauggaaag

SEQ ID NO: 3839757 - RNA, 17 nt, Shigella flexneri 2a str. 2457T
agaaugcucgcuggcag

SEQ ID NO: 3839758 - RNA, 19 nt, Shigella flexneri 2a str. 2457T
agaaugcucgcuggcaggc

SEQ ID NO: 3839759 - RNA, 17 nt, Shigella flexneri 2a str. 2457T
agaauggcaucagaagg

SEQ ID NO: 3839760 - RNA, 15 nt, Shigella flexneri 2a str. 2457T
agaauggcuguaggg

SEQ ID NO: 3839761 - RNA, 20 nt, Shigella flexneri 2a str. 2457T
agaauguuaacgccaauuaa

SEQ ID NO: 3839762 - RNA, 13 nt, Shigella flexneri 2a str. 2457T
agaauuaaucgag

SEQ ID NO: 3839763 - RNA, 15 nt, Shigella flexneri 2a str. 2457T
agaauuacuggcaga

SEQ ID NO: 3839764 - RNA, 18 nt, Shigella flexneri 2a str. 2457T
agaauuagcguccggcug

SEQ ID NO: 3839765 - RNA, 16 nt, Shigella flexneri 2a str. 2457T
agaauucacgcacuuc

SEQ ID NO: 3839766 - RNA, 15 nt, Shigella flexneri 2a str. 2457T
agaauugauaaaaaa

SEQ ID NO: 3839767 - RNA, 18 nt, Shigella flexneri 2a str. 2457T
agaauuucaucgccggua

SEQ ID NO: 3839768 - RNA, 23 nt, Shigella flexneri 2a str. 2457T
agaauuuccuucgcuuccuguau

SEQ ID NO: 3839769 - RNA, 18 nt, Shigella flexneri 2a str. 2457T
agaauuucuuuacugaca

SEQ ID NO: 3839770 - RNA, 20 nt, Shigella flexneri 2a str. 2457T
agaauuucuuuacugacagg

SEQ ID NO: 3839771 - RNA, 17 nt, Shigella flexneri 2a str. 2457T
agaauuuguaggccgga

SEQ ID NO: 3839772 - RNA, 22 nt, Shigella flexneri 2a str. 2457T
agaauuuuauacuuuuucgcca

SEQ ID NO: 3839773 - RNA, 20 nt, Shigella flexneri 2a str. 2457T
agaauuuuucgcuaaaaaau

SEQ ID NO: 3839774 - RNA, 20 nt, Shigella flexneri 2a str. 2457T
agacaaauuuugaacagaac

SEQ ID NO: 3839775 - RNA, 15 nt, Shigella flexneri 2a str. 2457T
agacaacaacaucag

SEQ ID NO: 3839776 - RNA, 17 nt, Shigella flexneri 2a str. 2457T
agacaacaacaucagcg

SEQ ID NO: 3839777 - RNA, 21 nt, Shigella flexneri 2a str. 2457T
agacaacaugagaacaguuca

SEQ ID NO: 3839778 - RNA, 15 nt, Shigella flexneri 2a str. 2457T
agacaaccaaaauca

SEQ ID NO: 3839779 - RNA, 13 nt, Shigella flexneri 2a str. 2457T
agacaacuucccu

SEQ ID NO: 3839780 - RNA, 20 nt, Shigella flexneri 2a str. 2457T
agacaagaaguuccagggca

SEQ ID NO: 3839781 - RNA, 14 nt, Shigella flexneri 2a str. 2457T
agacaaucgccagu

SEQ ID NO: 3839782 - RNA, 21 nt, Shigella flexneri 2a str. 2457T
agacaauugauggaaaauugu

SEQ ID NO: 3839783 - RNA, 21 nt, Shigella flexneri 2a str. 2457T
agacaauugccgccagcucac

SEQ ID NO: 3839784 - RNA, 20 nt, Shigella flexneri 2a str. 2457T
agacaauuuuucauaaucau

SEQ ID NO: 3839785 - RNA, 11 nt, Shigella flexneri 2a str. 2457T
agacaccagaa

SEQ ID NO: 3839786 - RNA, 17 nt, Shigella flexneri 2a str. 2457T
agacaccccuucauuca

SEQ ID NO: 3839787 - RNA, 17 nt, Shigella flexneri 2a str. 2457T
agacacgcaauaccagc

SEQ ID NO: 3839788 - RNA, 16 nt, Shigella flexneri 2a str. 2457T
agacacuaacgcgucu

SEQ ID NO: 3839789 - RNA, 16 nt, Shigella flexneri 2a str. 2457T
agacacuccagagaau

SEQ ID NO: 3839790 - RNA, 16 nt, Shigella flexneri 2a str. 2457T
agacacugacgcgucu

SEQ ID NO: 3839791 - RNA, 14 nt, Shigella flexneri 2a str. 2457T
agacacuuuaucua

SEQ ID NO: 3839792 - RNA, 15 nt, Shigella flexneri 2a str. 2457T
agacagacagccuca

SEQ ID NO: 3839793 - RNA, 17 nt, Shigella flexneri 2a str. 2457T
agacagacagccucaag

SEQ ID NO: 3839794 - RNA, 18 nt, Shigella flexneri 2a str. 2457T
agacagcaaagugccccc

SEQ ID NO: 3839795 - RNA, 15 nt, Shigella flexneri 2a str. 2457T
agacagcgacucucu

SEQ ID NO: 3839796 - RNA, 15 nt, Shigella flexneri 2a str. 2457T
agacagcgucacauc

SEQ ID NO: 3839797 - RNA, 14 nt, Shigella flexneri 2a str. 2457T
agacaguucuuccu

SEQ ID NO: 3839798 - RNA, 20 nt, Shigella flexneri 2a str. 2457T
agacauaaggaaacuccagc

SEQ ID NO: 3839799 - RNA, 21 nt, Shigella flexneri 2a str. 2457T
agacauaaggaaacuccagcc

SEQ ID NO: 3839800 - RNA, 16 nt, Shigella flexneri 2a str. 2457T
agacaucaauaaacaa

SEQ ID NO: 3839801 - RNA, 19 nt, Shigella flexneri 2a str. 2457T
agacaucaauaaacaauga

SEQ ID NO: 3839802 - RNA, 17 nt, Shigella flexneri 2a str. 2457T
agacaucccagugcaau

SEQ ID NO: 3839803 - RNA, 18 nt, Shigella flexneri 2a str. 2457T
agacaugcugacaaaaua

SEQ ID NO: 3839804 - RNA, 22 nt, Shigella flexneri 2a str. 2457T
agacauuacguccaucacaauc

SEQ ID NO: 3839805 - RNA, 19 nt, Shigella flexneri 2a str. 2457T
agacauucgcgcacggugc

SEQ ID NO: 3839806 - RNA, 22 nt, Shigella flexneri 2a str. 2457T
agaccaaaacgugcagcugccu

SEQ ID NO: 3839807 - RNA, 14 nt, Shigella flexneri 2a str. 2457T
agaccaaacagcau

SEQ ID NO: 3839808 - RNA, 15 nt, Shigella flexneri 2a str. 2457T
agaccaaacagcaua

SEQ ID NO: 3839809 - RNA, 13 nt, Shigella flexneri 2a str. 2457T
agaccaauagaaa

SEQ ID NO: 3839810 - RNA, 14 nt, Shigella flexneri 2a str. 2457T
agaccaaucaccac

SEQ ID NO: 3839811 - RNA, 14 nt, Shigella flexneri 2a str. 2457T
agaccaauccagcc

SEQ ID NO: 3839812 - RNA, 18 nt, Shigella flexneri 2a str. 2457T
agaccaauccgccagcca

SEQ ID NO: 3839813 - RNA, 17 nt, Shigella flexneri 2a str. 2457T
agaccacucauuuuuuc

SEQ ID NO: 3839814 - RNA, 16 nt, Shigella flexneri 2a str. 2457T
agaccacuuuccucau

SEQ ID NO: 3839815 - RNA, 18 nt, Shigella flexneri 2a str. 2457T
agaccagaaacgccacca

SEQ ID NO: 3839816 - RNA, 22 nt, Shigella flexneri 2a str. 2457T
agaccagacugcuccuguauga

SEQ ID NO: 3839817 - RNA, 18 nt, Shigella flexneri 2a str. 2457T
agaccagauuaaucagca

SEQ ID NO: 3839818 - RNA, 14 nt, Shigella flexneri 2a str. 2457T
agaccagcaaaaau

SEQ ID NO: 3839819 - RNA, 19 nt, Shigella flexneri 2a str. 2457T
agaccaguaaagugcgcuu

SEQ ID NO: 3839820 - RNA, 17 nt, Shigella flexneri 2a str. 2457T
agaccauugcaucaucg

SEQ ID NO: 3839821 - RNA, 21 nt, Shigella flexneri 2a str. 2457T
agaccauuugaucgcuggcag

SEQ ID NO: 3839822 - RNA, 12 nt, Shigella flexneri 2a str. 2457T
agacccaguuuu

SEQ ID NO: 3839823 - RNA, 15 nt, Shigella flexneri 2a str. 2457T
agaccccagguuuuc

SEQ ID NO: 3839824 - RNA, 13 nt, Shigella flexneri 2a str. 2457T
agacccgccaccc

SEQ ID NO: 3839825 - RNA, 21 nt, Shigella flexneri 2a str. 2457T
agacccggcggcgcgccaggc

SEQ ID NO: 3839826 - RNA, 21 nt, Shigella flexneri 2a str. 2457T
agacccugcucuuucagcacc

SEQ ID NO: 3839827 - RNA, 17 nt, Shigella flexneri 2a str. 2457T
agaccgauacacaucgu

SEQ ID NO: 3839828 - RNA, 17 nt, Shigella flexneri 2a str. 2457T
agaccggcaaccagcac

SEQ ID NO: 3839829 - RNA, 16 nt, Shigella flexneri 2a str. 2457T
agaccguugcucagaa

SEQ ID NO: 3839830 - RNA, 18 nt, Shigella flexneri 2a str. 2457T
agaccguugcucagaauc

SEQ ID NO: 3839831 - RNA, 14 nt, Shigella flexneri 2a str. 2457T
agaccuaccaucuc

SEQ ID NO: 3839832 - RNA, 22 nt, Shigella flexneri 2a str. 2457T
agaccugaauuugcuccagaaa

SEQ ID NO: 3839833 - RNA, 15 nt, Shigella flexneri 2a str. 2457T
agaccugauccggau

SEQ ID NO: 3839834 - RNA, 13 nt, Shigella flexneri 2a str. 2457T
agaccugcguuca

SEQ ID NO: 3839835 - RNA, 21 nt, Shigella flexneri 2a str. 2457T
agaccugggcgaugcuggcag

SEQ ID NO: 3839836 - RNA, 22 nt, Shigella flexneri 2a str. 2457T
agaccuuaucacaaucggcuuu

SEQ ID NO: 3839837 - RNA, 15 nt, Shigella flexneri 2a str. 2457T
agaccuucugccaga

SEQ ID NO: 3839838 - RNA, 20 nt, Shigella flexneri 2a str. 2457T
agacgaacguuuaauaaaac

SEQ ID NO: 3839839 - RNA, 13 nt, Shigella flexneri 2a str. 2457T
agacgagagugac

SEQ ID NO: 3839840 - RNA, 15 nt, Shigella flexneri 2a str. 2457T
agacgagagugacga

SEQ ID NO: 3839841 - RNA, 16 nt, Shigella flexneri 2a str. 2457T
agacgagggaaaauaa

SEQ ID NO: 3839842 - RNA, 19 nt, Shigella flexneri 2a str. 2457T
agacgauagaaccuuccau

SEQ ID NO: 3839843 - RNA, 22 nt, Shigella flexneri 2a str. 2457T
agacgauaguaauuucaucugc

SEQ ID NO: 3839844 - RNA, 17 nt, Shigella flexneri 2a str. 2457T
agacgaugcgucuugcc

SEQ ID NO: 3839845 - RNA, 22 nt, Shigella flexneri 2a str. 2457T
agacgauuacucgccuuucaca

SEQ ID NO: 3839846 - RNA, 14 nt, Shigella flexneri 2a str. 2457T
agacgcaacagaaa

SEQ ID NO: 3839847 - RNA, 22 nt, Shigella flexneri 2a str. 2457T
agacgcagcguuuauugucguu

SEQ ID NO: 3839848 - RNA, 13 nt, Shigella flexneri 2a str. 2457T
agacgccacaauc

SEQ ID NO: 3839849 - RNA, 21 nt, Shigella flexneri 2a str. 2457T
agacgccacaaucucacccgc

SEQ ID NO: 3839850 - RNA, 14 nt, Shigella flexneri 2a str. 2457T
agacgccagccaca

SEQ ID NO: 3839851 - RNA, 14 nt, Shigella flexneri 2a str. 2457T
agacgccaucaauu

SEQ ID NO: 3839852 - RNA, 20 nt, Shigella flexneri 2a str. 2457T
agacgcgccagcgucgcauc

SEQ ID NO: 3839853 - RNA, 18 nt, Shigella flexneri 2a str. 2457T
agacgcgcuugcauuacu

SEQ ID NO: 3839854 - RNA, 20 nt, Shigella flexneri 2a str. 2457T
agacgcggcagcgucgcauc

SEQ ID NO: 3839855 - RNA, 21 nt, Shigella flexneri 2a str. 2457T
agacgcguaaagcgucgcauc

SEQ ID NO: 3839856 - RNA, 21 nt, Shigella flexneri 2a str. 2457T
agacgcgucaagcgucgcauc

SEQ ID NO: 3839857 - RNA, 20 nt, Shigella flexneri 2a str. 2457T
agacgcgucagcgucgcauc

SEQ ID NO: 3839858 - RNA, 16 nt, Shigella flexneri 2a str. 2457T
agacgcgucagugucu

SEQ ID NO: 3839859 - RNA, 18 nt, Shigella flexneri 2a str. 2457T
agacgcguuuacagagcc

SEQ ID NO: 3839860 - RNA, 21 nt, Shigella flexneri 2a str. 2457T
agacgcucguuaaaacgcgcg

SEQ ID NO: 3839861 - RNA, 15 nt, Shigella flexneri 2a str. 2457T
agacgcucugcggua

SEQ ID NO: 3839862 - RNA, 16 nt, Shigella flexneri 2a str. 2457T
agacggaacaucugcc

SEQ ID NO: 3839863 - RNA, 21 nt, Shigella flexneri 2a str. 2457T
agacggcugucauccagcagc

SEQ ID NO: 3839864 - RNA, 15 nt, Shigella flexneri 2a str. 2457T
agacgguacccgcug

SEQ ID NO: 3839865 - RNA, 20 nt, Shigella flexneri 2a str. 2457T
agacgguuaaaaacagccag

SEQ ID NO: 3839866 - RNA, 18 nt, Shigella flexneri 2a str. 2457T
agacgguuauauuuacaa

SEQ ID NO: 3839867 - RNA, 23 nt, Shigella flexneri 2a str. 2457T
agacgguuuaucucaucuuccac

SEQ ID NO: 3839868 - RNA, 12 nt, Shigella flexneri 2a str. 2457T
agacgguuuuuc

SEQ ID NO: 3839869 - RNA, 18 nt, Shigella flexneri 2a str. 2457T
agacguaaaaauagcgaa

SEQ ID NO: 3839870 - RNA, 18 nt, Shigella flexneri 2a str. 2457T
agacguuaacuacaauca

SEQ ID NO: 3839871 - RNA, 21 nt, Shigella flexneri 2a str. 2457T
agacguucuuccuguggaucg

SEQ ID NO: 3839872 - RNA, 23 nt, Shigella flexneri 2a str. 2457T
agacguugauucacuuucugaag

SEQ ID NO: 3839873 - RNA, 17 nt, Shigella flexneri 2a str. 2457T
agacuaaauuucacugc

SEQ ID NO: 3839874 - RNA, 16 nt, Shigella flexneri 2a str. 2457T
agacuaauugagcgug

SEQ ID NO: 3839875 - RNA, 14 nt, Shigella flexneri 2a str. 2457T
agacucaaaccaau

SEQ ID NO: 3839876 - RNA, 12 nt, Shigella flexneri 2a str. 2457T
agacucaagcag

SEQ ID NO: 3839877 - RNA, 17 nt, Shigella flexneri 2a str. 2457T
agacucauauaaaaacc

SEQ ID NO: 3839878 - RNA, 13 nt, Shigella flexneri 2a str. 2457T
agacucccagccu

SEQ ID NO: 3839879 - RNA, 14 nt, Shigella flexneri 2a str. 2457T
agacugaauacgcu

SEQ ID NO: 3839880 - RNA, 13 nt, Shigella flexneri 2a str. 2457T
agacugauauccc

SEQ ID NO: 3839881 - RNA, 19 nt, Shigella flexneri 2a str. 2457T
agacugauaucccgcgcgu

SEQ ID NO: 3839882 - RNA, 15 nt, Shigella flexneri 2a str. 2457T
agacugaucaucgcc

SEQ ID NO: 3839883 - RNA, 22 nt, Shigella flexneri 2a str. 2457T
agacugaugacaaacacaaaac

SEQ ID NO: 3839884 - RNA, 19 nt, Shigella flexneri 2a str. 2457T
agacugaugacaaacggaa

SEQ ID NO: 3839885 - RNA, 17 nt, Shigella flexneri 2a str. 2457T
agacugaugugauccau

SEQ ID NO: 3839886 - RNA, 15 nt, Shigella flexneri 2a str. 2457T
agacugcaagaauag

SEQ ID NO: 3839887 - RNA, 17 nt, Shigella flexneri 2a str. 2457T
agacugcgcuaccagga

SEQ ID NO: 3839888 - RNA, 19 nt, Shigella flexneri 2a str. 2457T
agacuggcaaaugacauaa

SEQ ID NO: 3839889 - RNA, 21 nt, Shigella flexneri 2a str. 2457T
agacuggcaaaugacauaaac

SEQ ID NO: 3839890 - RNA, 13 nt, Shigella flexneri 2a str. 2457T
agacugggcaaga

SEQ ID NO: 3839891 - RNA, 20 nt, Shigella flexneri 2a str. 2457T
agacuuaauccgggcaugau

SEQ ID NO: 3839892 - RNA, 19 nt, Shigella flexneri 2a str. 2457T
agacuuaccagcccuaaua

SEQ ID NO: 3839893 - RNA, 21 nt, Shigella flexneri 2a str. 2457T
agacuucccucccguuucccu

SEQ ID NO: 3839894 - RNA, 14 nt, Shigella flexneri 2a str. 2457T
agacuuuagcgcaa

SEQ ID NO: 3839895 - RNA, 18 nt, Shigella flexneri 2a str. 2457T
agacuuuagucaucaguc

SEQ ID NO: 3839896 - RNA, 13 nt, Shigella flexneri 2a str. 2457T
agacuuugcugcc

SEQ ID NO: 3839897 - RNA, 13 nt, Shigella flexneri 2a str. 2457T
agagaaaaccaau

SEQ ID NO: 3839898 - RNA, 12 nt, Shigella flexneri 2a str. 2457T
agagaaaauaau

SEQ ID NO: 3839899 - RNA, 16 nt, Shigella flexneri 2a str. 2457T
agagaaaccacaucaa

SEQ ID NO: 3839900 - RNA, 18 nt, Shigella flexneri 2a str. 2457T
agagaaacgccagcagca

SEQ ID NO: 3839901 - RNA, 21 nt, Shigella flexneri 2a str. 2457T
agagaaagaacgaguaaaagg

SEQ ID NO: 3839902 - RNA, 20 nt, Shigella flexneri 2a str. 2457T
agagaacaucaauccaaaca

SEQ ID NO: 3839903 - RNA, 16 nt, Shigella flexneri 2a str. 2457T
agagaacugcgccaga

SEQ ID NO: 3839904 - RNA, 20 nt, Shigella flexneri 2a str. 2457T
agagaacuguagacaaaaug

SEQ ID NO: 3839905 - RNA, 13 nt, Shigella flexneri 2a str. 2457T
agagaagcaccgc

SEQ ID NO: 3839906 - RNA, 13 nt, Shigella flexneri 2a str. 2457T
agagaaguuugac

SEQ ID NO: 3839907 - RNA, 21 nt, Shigella flexneri 2a str. 2457T
agagaauauuaacggucauuc

SEQ ID NO: 3839908 - RNA, 18 nt, Shigella flexneri 2a str. 2457T
agagaauggggucagcag

SEQ ID NO: 3839909 - RNA, 14 nt, Shigella flexneri 2a str. 2457T
agagacacaacaau

SEQ ID NO: 3839910 - RNA, 13 nt, Shigella flexneri 2a str. 2457T
agagacagaauca

SEQ ID NO: 3839911 - RNA, 20 nt, Shigella flexneri 2a str. 2457T
agagagccagccccacagca

SEQ ID NO: 3839912 - RNA, 16 nt, Shigella flexneri 2a str. 2457T
agagagcgccagaagu

SEQ ID NO: 3839913 - RNA, 18 nt, Shigella flexneri 2a str. 2457T
agagauaaacgaccacuc

SEQ ID NO: 3839914 - RNA, 20 nt, Shigella flexneri 2a str. 2457T
agagauccaccacgcuguag

SEQ ID NO: 3839915 - RNA, 13 nt, Shigella flexneri 2a str. 2457T
agagauccuggcg

SEQ ID NO: 3839916 - RNA, 22 nt, Shigella flexneri 2a str. 2457T
agagaucgauguuuucugccuc

SEQ ID NO: 3839917 - RNA, 20 nt, Shigella flexneri 2a str. 2457T
agagaucuugagaaauuaac

SEQ ID NO: 3839918 - RNA, 18 nt, Shigella flexneri 2a str. 2457T
agagauuacuuuauuuau

SEQ ID NO: 3839919 - RNA, 16 nt, Shigella flexneri 2a str. 2457T
agagauucuuuuccuu

SEQ ID NO: 3839920 - RNA, 19 nt, Shigella flexneri 2a str. 2457T
agagauuuuuccccaccuc

SEQ ID NO: 3839921 - RNA, 22 nt, Shigella flexneri 2a str. 2457T
agagcaaaaaucgacagcagga

SEQ ID NO: 3839922 - RNA, 12 nt, Shigella flexneri 2a str. 2457T
agagcaaauaaa

SEQ ID NO: 3839923 - RNA, 15 nt, Shigella flexneri 2a str. 2457T
agagcaaauaaaaca

SEQ ID NO: 3839924 - RNA, 20 nt, Shigella flexneri 2a str. 2457T
agagcaaauaaaacaucacc

SEQ ID NO: 3839925 - RNA, 13 nt, Shigella flexneri 2a str. 2457T
agagcaaccaccu

SEQ ID NO: 3839926 - RNA, 14 nt, Shigella flexneri 2a str. 2457T
agagcaacccccuc

SEQ ID NO: 3839927 - RNA, 14 nt, Shigella flexneri 2a str. 2457T
agagcaaucaccag

SEQ ID NO: 3839928 - RNA, 16 nt, Shigella flexneri 2a str. 2457T
agagcaaucaccagau

SEQ ID NO: 3839929 - RNA, 23 nt, Shigella flexneri 2a str. 2457T
agagcagcaucaauaacccuggu

SEQ ID NO: 3839930 - RNA, 20 nt, Shigella flexneri 2a str. 2457T
agagcaugaaaugaaaauca

SEQ ID NO: 3839931 - RNA, 12 nt, Shigella flexneri 2a str. 2457T
agagcauuacac

SEQ ID NO: 3839932 - RNA, 13 nt, Shigella flexneri 2a str. 2457T
agagccaccaacu

SEQ ID NO: 3839933 - RNA, 13 nt, Shigella flexneri 2a str. 2457T
agagccagcccca

SEQ ID NO: 3839934 - RNA, 18 nt, Shigella flexneri 2a str. 2457T
agagccagccccacagca

SEQ ID NO: 3839935 - RNA, 19 nt, Shigella flexneri 2a str. 2457T
agagccagccccacagcag

SEQ ID NO: 3839936 - RNA, 18 nt, Shigella flexneri 2a str. 2457T
agagccugaauaaacgcc

SEQ ID NO: 3839937 - RNA, 14 nt, Shigella flexneri 2a str. 2457T
agagcgagggagaa

SEQ ID NO: 3839938 - RNA, 14 nt, Shigella flexneri 2a str. 2457T
agagcgcggcgcag

SEQ ID NO: 3839939 - RNA, 15 nt, Shigella flexneri 2a str. 2457T
agagcggagcaauga

SEQ ID NO: 3839940 - RNA, 13 nt, Shigella flexneri 2a str. 2457T
agagcuaacugga

SEQ ID NO: 3839941 - RNA, 17 nt, Shigella flexneri 2a str. 2457T
agagcugaagcauggug

SEQ ID NO: 3839942 - RNA, 14 nt, Shigella flexneri 2a str. 2457T
agagcugauuuccg

SEQ ID NO: 3839943 - RNA, 21 nt, Shigella flexneri 2a str. 2457T
agagcuggcgaacgugcagga

SEQ ID NO: 3839944 - RNA, 22 nt, Shigella flexneri 2a str. 2457T
agagcuugugcaccagcuggcu

SEQ ID NO: 3839945 - RNA, 17 nt, Shigella flexneri 2a str. 2457T
agagcuuucauuucaau

SEQ ID NO: 3839946 - RNA, 22 nt, Shigella flexneri 2a str. 2457T
agagcuuuguugcgcugaagua

SEQ ID NO: 3839947 - RNA, 15 nt, Shigella flexneri 2a str. 2457T
agaggaaucgcuguu

SEQ ID NO: 3839948 - RNA, 13 nt, Shigella flexneri 2a str. 2457T
agaggagccauca

SEQ ID NO: 3839949 - RNA, 19 nt, Shigella flexneri 2a str. 2457T
agaggcguguggugaggug

SEQ ID NO: 3839950 - RNA, 18 nt, Shigella flexneri 2a str. 2457T
agaggcguuccugcaacg

SEQ ID NO: 3839951 - RNA, 23 nt, Shigella flexneri 2a str. 2457T
agaggcugaaggcgcuccccugc

SEQ ID NO: 3839952 - RNA, 20 nt, Shigella flexneri 2a str. 2457T
agagggccggggugggggug

SEQ ID NO: 3839953 - RNA, 11 nt, Shigella flexneri 2a str. 2457T
agaugauuuuu

SEQ ID NO: 3839954 - RNA, 23 nt, Shigella flexneri 2a str. 2457T
agaugcaccguuucuuugccgag

SEQ ID NO: 3839955 - RNA, 13 nt, Shigella flexneri 2a str. 2457T
agaugcagcggua

SEQ ID NO: 3839956 - RNA, 16 nt, Shigella flexneri 2a str. 2457T
agaugcaggaguagaa

SEQ ID NO: 3839957 - RNA, 21 nt, Shigella flexneri 2a str. 2457T
agaugcggaauuugaugagaa

SEQ ID NO: 3839958 - RNA, 16 nt, Shigella flexneri 2a str. 2457T
agaugcggcuucgcuu

SEQ ID NO: 3839959 - RNA, 14 nt, Shigella flexneri 2a str. 2457T
agaugcuacaacau

SEQ ID NO: 3839960 - RNA, 16 nt, Shigella flexneri 2a str. 2457T
agaugcuacaacaucg

SEQ ID NO: 3839961 - RNA, 12 nt, Shigella flexneri 2a str. 2457T
agaugcuggaga

SEQ ID NO: 3839962 - RNA, 22 nt, Shigella flexneri 2a str. 2457T
agaugcuugcgauauucuucag

SEQ ID NO: 3839963 - RNA, 16 nt, Shigella flexneri 2a str. 2457T
agauggauugcugaaa

SEQ ID NO: 3839964 - RNA, 18 nt, Shigella flexneri 2a str. 2457T
agauggauugcugaaaua

SEQ ID NO: 3839965 - RNA, 23 nt, Shigella flexneri 2a str. 2457T
agauggcccacgacgucuccauc

SEQ ID NO: 3839966 - RNA, 16 nt, Shigella flexneri 2a str. 2457T
agauggcgcgcagaaa

SEQ ID NO: 3839967 - RNA, 14 nt, Shigella flexneri 2a str. 2457T
agauggcggcuggc

SEQ ID NO: 3839968 - RNA, 23 nt, Shigella flexneri 2a str. 2457T
agauggcuauaaucacucaaaau

SEQ ID NO: 3839969 - RNA, 19 nt, Shigella flexneri 2a str. 2457T
agauggcuuugcccuuucu

SEQ ID NO: 3839970 - RNA, 20 nt, Shigella flexneri 2a str. 2457T
agauggcuuugcccuuucug

SEQ ID NO: 3839971 - RNA, 22 nt, Shigella flexneri 2a str. 2457T
agauggucuguaccaccagaau

SEQ ID NO: 3839972 - RNA, 17 nt, Shigella flexneri 2a str. 2457T
agaugguggucauauca

SEQ ID NO: 3839973 - RNA, 21 nt, Shigella flexneri 2a str. 2457T
agauguacgccagugcucccg

SEQ ID NO: 3839974 - RNA, 13 nt, Shigella flexneri 2a str. 2457T
agaugucccaucu

SEQ ID NO: 3839975 - RNA, 16 nt, Shigella flexneri 2a str. 2457T
agauguccccugcggu

SEQ ID NO: 3839976 - RNA, 21 nt, Shigella flexneri 2a str. 2457T
agaugugcaguuccugcaacu

SEQ ID NO: 3839977 - RNA, 16 nt, Shigella flexneri 2a str. 2457T
agaugugcgguggcuu

SEQ ID NO: 3839978 - RNA, 20 nt, Shigella flexneri 2a str. 2457T
agaugugggcaaucucacuc

SEQ ID NO: 3839979 - RNA, 15 nt, Shigella flexneri 2a str. 2457T
agauguuccgccauu

SEQ ID NO: 3839980 - RNA, 20 nt, Shigella flexneri 2a str. 2457T
agauguucuaucuuucagac

SEQ ID NO: 3839981 - RNA, 16 nt, Shigella flexneri 2a str. 2457T
agauguugucucagau

SEQ ID NO: 3839982 - RNA, 21 nt, Shigella flexneri 2a str. 2457T
agauguugucucagauucaga

SEQ ID NO: 3839983 - RNA, 21 nt, Shigella flexneri 2a str. 2457T
agauguuugauucacuggcaa

SEQ ID NO: 3839984 - RNA, 18 nt, Shigella flexneri 2a str. 2457T
agauuaaaggcaccaaua

SEQ ID NO: 3839985 - RNA, 20 nt, Shigella flexneri 2a str. 2457T
agauuaccagcgacaucacc

SEQ ID NO: 3839986 - RNA, 18 nt, Shigella flexneri 2a str. 2457T
agauuacgcucugacgac

SEQ ID NO: 3839987 - RNA, 23 nt, Shigella flexneri 2a str. 2457T
agauuagcccccguuuuguuguc

SEQ ID NO: 3839988 - RNA, 18 nt, Shigella flexneri 2a str. 2457T
agauuauauaauaugcau

SEQ ID NO: 3839989 - RNA, 13 nt, Shigella flexneri 2a str. 2457T
agauuauugacaa

SEQ ID NO: 3839990 - RNA, 14 nt, Shigella flexneri 2a str. 2457T
agauucaauuauag

SEQ ID NO: 3839991 - RNA, 14 nt, Shigella flexneri 2a str. 2457T
agauucagauuaug

SEQ ID NO: 3839992 - RNA, 18 nt, Shigella flexneri 2a str. 2457T
agauucagcgucgucagc

SEQ ID NO: 3839993 - RNA, 23 nt, Shigella flexneri 2a str. 2457T
agauucaugguacgggacagcag

SEQ ID NO: 3839994 - RNA, 22 nt, Shigella flexneri 2a str. 2457T
agauuccccgcaguuacagcag

SEQ ID NO: 3839995 - RNA, 23 nt, Shigella flexneri 2a str. 2457T
agauucgguaaccauccauucag

SEQ ID NO: 3839996 - RNA, 20 nt, Shigella flexneri 2a str. 2457T
agauucguuuuccagugcca

SEQ ID NO: 3839997 - RNA, 12 nt, Shigella flexneri 2a str. 2457T
agauucuuaaag

SEQ ID NO: 3839998 - RNA, 20 nt, Shigella flexneri 2a str. 2457T
agauugaacgcuggcggcag

SEQ ID NO: 3839999 - RNA, 14 nt, Shigella flexneri 2a str. 2457T
agauugauaaaaau

SEQ ID NO: 3840000 - RNA, 16 nt, Shigella flexneri 2a str. 2457T
agauugauaaaaauag

SEQ ID NO: 3840001 - RNA, 19 nt, Shigella flexneri 2a str. 2457T
agauugcaaauucucuauu

SEQ ID NO: 3840002 - RNA, 19 nt, Shigella flexneri 2a str. 2457T
agauugcagacaaagugag

SEQ ID NO: 3840003 - RNA, 18 nt, Shigella flexneri 2a str. 2457T
agauugcgaauauguacu

SEQ ID NO: 3840004 - RNA, 23 nt, Shigella flexneri 2a str. 2457T
agauugguaaugcguaacguuuc

SEQ ID NO: 3840005 - RNA, 18 nt, Shigella flexneri 2a str. 2457T
agauugucggcagccagu

SEQ ID NO: 3840006 - RNA, 22 nt, Shigella flexneri 2a str. 2457T
agauuguugauuaacaggcugc

SEQ ID NO: 3840007 - RNA, 19 nt, Shigella flexneri 2a str. 2457T
agauuguuggcaaaaaaau

SEQ ID NO: 3840008 - RNA, 16 nt, Shigella flexneri 2a str. 2457T
agauuuaacggcagca

SEQ ID NO: 3840009 - RNA, 18 nt, Shigella flexneri 2a str. 2457T
agauuuaacggcagcaag

SEQ ID NO: 3840010 - RNA, 15 nt, Shigella flexneri 2a str. 2457T
agauuuauaaaagaa

SEQ ID NO: 3840011 - RNA, 15 nt, Shigella flexneri 2a str. 2457T
agauuuauuuaccgc

SEQ ID NO: 3840012 - RNA, 20 nt, Shigella flexneri 2a str. 2457T
agauuucaaucuggccugag

SEQ ID NO: 3840013 - RNA, 21 nt, Shigella flexneri 2a str. 2457T
agauuuccaagcgcggcaggc

SEQ ID NO: 3840014 - RNA, 14 nt, Shigella flexneri 2a str. 2457T
agauuuuuauccag

SEQ ID NO: 3840015 - RNA, 14 nt, Shigella flexneri 2a str. 2457T
agauuuuuccccac

SEQ ID NO: 3840016 - RNA, 20 nt, Shigella flexneri 2a str. 2457T
agcaaaaauaaaugcuugac

SEQ ID NO: 3840017 - RNA, 17 nt, Shigella flexneri 2a str. 2457T
agcaaaaauaagcgacg

SEQ ID NO: 3840018 - RNA, 19 nt, Shigella flexneri 2a str. 2457T
agcaaaauagcuguuuauu

SEQ ID NO: 3840019 - RNA, 19 nt, Shigella flexneri 2a str. 2457T
agcaaaaucguaagcagga

SEQ ID NO: 3840020 - RNA, 19 nt, Shigella flexneri 2a str. 2457T
agcaaacaauaauuaucau

SEQ ID NO: 3840021 - RNA, 13 nt, Shigella flexneri 2a str. 2457T
agcaaacaggugc

SEQ ID NO: 3840022 - RNA, 22 nt, Shigella flexneri 2a str. 2457T
agcaaacgaaagcagggcggca

SEQ ID NO: 3840023 - RNA, 15 nt, Shigella flexneri 2a str. 2457T
agcaaacgauucaaa

SEQ ID NO: 3840024 - RNA, 20 nt, Shigella flexneri 2a str. 2457T
agcaaacuaucuguguaaug

SEQ ID NO: 3840025 - RNA, 13 nt, Shigella flexneri 2a str. 2457T
agcaaagcgugca

SEQ ID NO: 3840026 - RNA, 17 nt, Shigella flexneri 2a str. 2457T
agcaaaggaauggucgg

SEQ ID NO: 3840027 - RNA, 12 nt, Shigella flexneri 2a str. 2457T
agcaaaggugcc

SEQ ID NO: 3840028 - RNA, 22 nt, Shigella flexneri 2a str. 2457T
agcaaaguaccaucguccagca

SEQ ID NO: 3840029 - RNA, 22 nt, Shigella flexneri 2a str. 2457T
agcaaaguggcgcagagccuga

SEQ ID NO: 3840030 - RNA, 17 nt, Shigella flexneri 2a str. 2457T
agcaaauaaaacaucac

SEQ ID NO: 3840031 - RNA, 16 nt, Shigella flexneri 2a str. 2457T
agcaaauagauaaaau

SEQ ID NO: 3840032 - RNA, 23 nt, Shigella flexneri 2a str. 2457T
agcaaaucacccugugcgccacc

SEQ ID NO: 3840033 - RNA, 20 nt, Shigella flexneri 2a str. 2457T
agcaaauccaucauaugcgc

SEQ ID NO: 3840034 - RNA, 20 nt, Shigella flexneri 2a str. 2457T
agcaaaucgcggcaguggcu

SEQ ID NO: 3840035 - RNA, 21 nt, Shigella flexneri 2a str. 2457T
agcaaaucgcggcaguggcua

SEQ ID NO: 3840036 - RNA, 17 nt, Shigella flexneri 2a str. 2457T
agcaaaugaauuacacg

SEQ ID NO: 3840037 - RNA, 23 nt, Shigella flexneri 2a str. 2457T
agcaaauugaggaucugcgccug

SEQ ID NO: 3840038 - RNA, 13 nt, Shigella flexneri 2a str. 2457T
agcaacaaauaac

SEQ ID NO: 3840039 - RNA, 14 nt, Shigella flexneri 2a str. 2457T
agcaacaaauaacc

SEQ ID NO: 3840040 - RNA, 12 nt, Shigella flexneri 2a str. 2457T
agcaacaacagc

SEQ ID NO: 3840041 - RNA, 12 nt, Shigella flexneri 2a str. 2457T
agcaacaggcca

SEQ ID NO: 3840042 - RNA, 16 nt, Shigella flexneri 2a str. 2457T
agcaaccaaugccacc

SEQ ID NO: 3840043 - RNA, 21 nt, Shigella flexneri 2a str. 2457T
agcaaccucgcccauuuuuca

SEQ ID NO: 3840044 - RNA, 22 nt, Shigella flexneri 2a str. 2457T
agcaaccucgcccauuuuucau

SEQ ID NO: 3840045 - RNA, 16 nt, Shigella flexneri 2a str. 2457T
agcaaccugcacguua

SEQ ID NO: 3840046 - RNA, 17 nt, Shigella flexneri 2a str. 2457T
agcaacgaaacgccggu

SEQ ID NO: 3840047 - RNA, 22 nt, Shigella flexneri 2a str. 2457T
agcaacgagacgguuaaaaaca

SEQ ID NO: 3840048 - RNA, 23 nt, Shigella flexneri 2a str. 2457T
agcaacgccaaauuuaaacgaca

SEQ ID NO: 3840049 - RNA, 21 nt, Shigella flexneri 2a str. 2457T
agcaacucuuuuuccugcugc

SEQ ID NO: 3840050 - RNA, 16 nt, Shigella flexneri 2a str. 2457T
agcagaccagcaauaa

SEQ ID NO: 3840051 - RNA, 22 nt, Shigella flexneri 2a str. 2457T
agcagaccccagguuuucaacg

SEQ ID NO: 3840052 - RNA, 18 nt, Shigella flexneri 2a str. 2457T
agcagacgcuccauugcc

SEQ ID NO: 3840053 - RNA, 22 nt, Shigella flexneri 2a str. 2457T
agcagacuuuuugcggcagcaa

SEQ ID NO: 3840054 - RNA, 16 nt, Shigella flexneri 2a str. 2457T
agcagagaaacgccag

SEQ ID NO: 3840055 - RNA, 20 nt, Shigella flexneri 2a str. 2457T
agcagagaaacgccagcagc

SEQ ID NO: 3840056 - RNA, 17 nt, Shigella flexneri 2a str. 2457T
agcagagcaaucaccag

SEQ ID NO: 3840057 - RNA, 15 nt, Shigella flexneri 2a str. 2457T
agcagagcaugguua

SEQ ID NO: 3840058 - RNA, 18 nt, Shigella flexneri 2a str. 2457T
agcagauacggcgcaucu

SEQ ID NO: 3840059 - RNA, 19 nt, Shigella flexneri 2a str. 2457T
agcagauaucccgccagca

SEQ ID NO: 3840060 - RNA, 20 nt, Shigella flexneri 2a str. 2457T
agcagauaucccgccagcac

SEQ ID NO: 3840061 - RNA, 17 nt, Shigella flexneri 2a str. 2457T
agcagauguagcucacc

SEQ ID NO: 3840062 - RNA, 18 nt, Shigella flexneri 2a str. 2457T
agcagauguagcucaccu

SEQ ID NO: 3840063 - RNA, 21 nt, Shigella flexneri 2a str. 2457T
agcagcaaugcaggcaccugc

SEQ ID NO: 3840064 - RNA, 19 nt, Shigella flexneri 2a str. 2457T
agcagcacaaugccgguga

SEQ ID NO: 3840065 - RNA, 18 nt, Shigella flexneri 2a str. 2457T
agcagcaccaccgcccgu

SEQ ID NO: 3840066 - RNA, 16 nt, Shigella flexneri 2a str. 2457T
agcagcagagcaauca

SEQ ID NO: 3840067 - RNA, 20 nt, Shigella flexneri 2a str. 2457T
agcagcagagcaaucaccag

SEQ ID NO: 3840068 - RNA, 20 nt, Shigella flexneri 2a str. 2457T
agcagcagcgccaacgguga

SEQ ID NO: 3840069 - RNA, 15 nt, Shigella flexneri 2a str. 2457T
agcagcauacccacc

SEQ ID NO: 3840070 - RNA, 16 nt, Shigella flexneri 2a str. 2457T
agcagccacaccaauc

SEQ ID NO: 3840071 - RNA, 13 nt, Shigella flexneri 2a str. 2457T
agcagccaccacu

SEQ ID NO: 3840072 - RNA, 16 nt, Shigella flexneri 2a str. 2457T
agcagccaucugauga

SEQ ID NO: 3840073 - RNA, 12 nt, Shigella flexneri 2a str. 2457T
agcagcccugcc

SEQ ID NO: 3840074 - RNA, 18 nt, Shigella flexneri 2a str. 2457T
agcagcccugccggaacg

SEQ ID NO: 3840075 - RNA, 15 nt, Shigella flexneri 2a str. 2457T
agcagcccuugugcc

SEQ ID NO: 3840076 - RNA, 20 nt, Shigella flexneri 2a str. 2457T
agcagccuauuucgucgcua

SEQ ID NO: 3840077 - RNA, 15 nt, Shigella flexneri 2a str. 2457T
agcagcgcaauuaac

SEQ ID NO: 3840078 - RNA, 22 nt, Shigella flexneri 2a str. 2457T
agcagcgccaacggugaaaaac

SEQ ID NO: 3840079 - RNA, 20 nt, Shigella flexneri 2a str. 2457T
agcagcgccacacgagucau

SEQ ID NO: 3840080 - RNA, 16 nt, Shigella flexneri 2a str. 2457T
agcagcggcagaucaa

SEQ ID NO: 3840081 - RNA, 19 nt, Shigella flexneri 2a str. 2457T
agcagcggcagaucaaauu

SEQ ID NO: 3840082 - RNA, 19 nt, Shigella flexneri 2a str. 2457T
agcagcgguugagagaaga

SEQ ID NO: 3840083 - RNA, 21 nt, Shigella flexneri 2a str. 2457T
agcagcguaccucuaucuuga

SEQ ID NO: 3840084 - RNA, 23 nt, Shigella flexneri 2a str. 2457T
agcagcguaccucuaucuugauu

SEQ ID NO: 3840085 - RNA, 17 nt, Shigella flexneri 2a str. 2457T
agcagcuacuggugccu

SEQ ID NO: 3840086 - RNA, 13 nt, Shigella flexneri 2a str. 2457T
agcagcuccgcca

SEQ ID NO: 3840087 - RNA, 19 nt, Shigella flexneri 2a str. 2457T
agcagcugcucccagcgca

SEQ ID NO: 3840088 - RNA, 21 nt, Shigella flexneri 2a str. 2457T
agcagcugcucccagcgcauu

SEQ ID NO: 3840089 - RNA, 14 nt, Shigella flexneri 2a str. 2457T
agcagcuguagggu

SEQ ID NO: 3840090 - RNA, 19 nt, Shigella flexneri 2a str. 2457T
agcagcuuauggugcacag

SEQ ID NO: 3840091 - RNA, 12 nt, Shigella flexneri 2a str. 2457T
agcagcuuucag

SEQ ID NO: 3840092 - RNA, 20 nt, Shigella flexneri 2a str. 2457T
agcaggaauguuguccaggg

SEQ ID NO: 3840093 - RNA, 21 nt, Shigella flexneri 2a str. 2457T
agcaggaauguuguccagggc

SEQ ID NO: 3840094 - RNA, 14 nt, Shigella flexneri 2a str. 2457T
agcaggauggcugg

SEQ ID NO: 3840095 - RNA, 21 nt, Shigella flexneri 2a str. 2457T
agcaggauggcuggccgugca

SEQ ID NO: 3840096 - RNA, 14 nt, Shigella flexneri 2a str. 2457T
agcaggauguuccg

SEQ ID NO: 3840097 - RNA, 21 nt, Shigella flexneri 2a str. 2457T
agcaggauguuccggcaaagu

SEQ ID NO: 3840098 - RNA, 17 nt, Shigella flexneri 2a str. 2457T
agcaggcauccugaucg

SEQ ID NO: 3840099 - RNA, 22 nt, Shigella flexneri 2a str. 2457T
agcaggccggguuuucucccuc

SEQ ID NO: 3840100 - RNA, 17 nt, Shigella flexneri 2a str. 2457T
agcaggccgucgcgcag

SEQ ID NO: 3840101 - RNA, 20 nt, Shigella flexneri 2a str. 2457T
agcaggcgauuuacuggcag

SEQ ID NO: 3840102 - RNA, 18 nt, Shigella flexneri 2a str. 2457T
agcaggcguuaaaacagg

SEQ ID NO: 3840103 - RNA, 13 nt, Shigella flexneri 2a str. 2457T
agcagggccugaa

SEQ ID NO: 3840104 - RNA, 22 nt, Shigella flexneri 2a str. 2457T
agcaggguuucaucgguggugu

SEQ ID NO: 3840105 - RNA, 16 nt, Shigella flexneri 2a str. 2457T
agcagguaaucugcca

SEQ ID NO: 3840106 - RNA, 19 nt, Shigella flexneri 2a str. 2457T
agcaguaauugcagcagcu

SEQ ID NO: 3840107 - RNA, 22 nt, Shigella flexneri 2a str. 2457T
agcagugaauacccagaaucuc

SEQ ID NO: 3840108 - RNA, 18 nt, Shigella flexneri 2a str. 2457T
agcaguguuuccggcauu

SEQ ID NO: 3840109 - RNA, 23 nt, Shigella flexneri 2a str. 2457T
agcaguuacuccgauuaccggca

SEQ ID NO: 3840110 - RNA, 15 nt, Shigella flexneri 2a str. 2457T
agcaguucacgcagc

SEQ ID NO: 3840111 - RNA, 21 nt, Shigella flexneri 2a str. 2457T
agcaguucaugcacuugguuc

SEQ ID NO: 3840112 - RNA, 22 nt, Shigella flexneri 2a str. 2457T
agcaguucguaauuaagcccgg

SEQ ID NO: 3840113 - RNA, 16 nt, Shigella flexneri 2a str. 2457T
agcaguucugccaggc

SEQ ID NO: 3840114 - RNA, 18 nt, Shigella flexneri 2a str. 2457T
agcaguugcuucaucuca

SEQ ID NO: 3840115 - RNA, 15 nt, Shigella flexneri 2a str. 2457T
agcaguuucaccagc

SEQ ID NO: 3840116 - RNA, 16 nt, Shigella flexneri 2a str. 2457T
agcaguuucaccagca

SEQ ID NO: 3840117 - RNA, 19 nt, Shigella flexneri 2a str. 2457T
agcaguuucaccagcagua

SEQ ID NO: 3840118 - RNA, 13 nt, Shigella flexneri 2a str. 2457T
agcauaauaagcu

SEQ ID NO: 3840119 - RNA, 16 nt, Shigella flexneri 2a str. 2457T
agcauaauaagcuuuu

SEQ ID NO: 3840120 - RNA, 14 nt, Shigella flexneri 2a str. 2457T
agcauaaucaccag

SEQ ID NO: 3840121 - RNA, 18 nt, Shigella flexneri 2a str. 2457T
agcauaaucaccaucagc

SEQ ID NO: 3840122 - RNA, 23 nt, Shigella flexneri 2a str. 2457T
agcauagccccagcgcagacggc

SEQ ID NO: 3840123 - RNA, 21 nt, Shigella flexneri 2a str. 2457T
agcauagcucgcuucaucugc

SEQ ID NO: 3840124 - RNA, 15 nt, Shigella flexneri 2a str. 2457T
agcauaggcauuaaa

SEQ ID NO: 3840125 - RNA, 22 nt, Shigella flexneri 2a str. 2457T
agcauauaaugcaacauuuuga

SEQ ID NO: 3840126 - RNA, 19 nt, Shigella flexneri 2a str. 2457T
agcauauaggaggccucgg

SEQ ID NO: 3840127 - RNA, 22 nt, Shigella flexneri 2a str. 2457T
agcauauguuuacgcuggcgga

SEQ ID NO: 3840128 - RNA, 14 nt, Shigella flexneri 2a str. 2457T
agcauauugcaggc

SEQ ID NO: 3840129 - RNA, 18 nt, Shigella flexneri 2a str. 2457T
agcauauuuagguaauga

SEQ ID NO: 3840130 - RNA, 15 nt, Shigella flexneri 2a str. 2457T
agcaucaaacuuuua

SEQ ID NO: 3840131 - RNA, 13 nt, Shigella flexneri 2a str. 2457T
agcaucaauaacc

SEQ ID NO: 3840132 - RNA, 15 nt, Shigella flexneri 2a str. 2457T
agcaucaauugcuac

SEQ ID NO: 3840133 - RNA, 19 nt, Shigella flexneri 2a str. 2457T
agcaucagcccaaagcaga

SEQ ID NO: 3840134 - RNA, 23 nt, Shigella flexneri 2a str. 2457T
agcaucauauggaagaaacgcuu

SEQ ID NO: 3840135 - RNA, 15 nt, Shigella flexneri 2a str. 2457T
agcaucaucgcaaug

SEQ ID NO: 3840136 - RNA, 23 nt, Shigella flexneri 2a str. 2457T
agcaucaucgcaaugauuuugau

SEQ ID NO: 3840137 - RNA, 14 nt, Shigella flexneri 2a str. 2457T
agcaucaugaauau

SEQ ID NO: 3840138 - RNA, 16 nt, Shigella flexneri 2a str. 2457T
agcaucaugaauauau

SEQ ID NO: 3840139 - RNA, 14 nt, Shigella flexneri 2a str. 2457T
agcauccaacugau

SEQ ID NO: 3840140 - RNA, 15 nt, Shigella flexneri 2a str. 2457T
agcauccccauaucc

SEQ ID NO: 3840141 - RNA, 21 nt, Shigella flexneri 2a str. 2457T
agcauccccggcaaccacacc

SEQ ID NO: 3840142 - RNA, 23 nt, Shigella flexneri 2a str. 2457T
agcaucccggcagccccaaacag

SEQ ID NO: 3840143 - RNA, 16 nt, Shigella flexneri 2a str. 2457T
agcaucgcaacaugcu

SEQ ID NO: 3840144 - RNA, 21 nt, Shigella flexneri 2a str. 2457T
agcaucgcaacaugcuggccu

SEQ ID NO: 3840145 - RNA, 19 nt, Shigella flexneri 2a str. 2457T
agcaucgcauccggcacuu

SEQ ID NO: 3840146 - RNA, 19 nt, Shigella flexneri 2a str. 2457T
agcaucgcccaggcgacca

SEQ ID NO: 3840147 - RNA, 15 nt, Shigella flexneri 2a str. 2457T
agccaugcccgugcu

SEQ ID NO: 3840148 - RNA, 23 nt, Shigella flexneri 2a str. 2457T
agccaugcggcaucuucuccacg

SEQ ID NO: 3840149 - RNA, 23 nt, Shigella flexneri 2a str. 2457T
agccaugcuuugcaucccagaaa

SEQ ID NO: 3840150 - RNA, 17 nt, Shigella flexneri 2a str. 2457T
agccauguuuaacuccu

SEQ ID NO: 3840151 - RNA, 20 nt, Shigella flexneri 2a str. 2457T
agccauguuuaacuccuucu

SEQ ID NO: 3840152 - RNA, 17 nt, Shigella flexneri 2a str. 2457T
agccauuaaacaccagu

SEQ ID NO: 3840153 - RNA, 21 nt, Shigella flexneri 2a str. 2457T
agccauuaaacaccaguaccu

SEQ ID NO: 3840154 - RNA, 14 nt, Shigella flexneri 2a str. 2457T
agccauucccccuu

SEQ ID NO: 3840155 - RNA, 18 nt, Shigella flexneri 2a str. 2457T
agccauucccucuacauu

SEQ ID NO: 3840156 - RNA, 20 nt, Shigella flexneri 2a str. 2457T
agcccaaucaucgcggcaca

SEQ ID NO: 3840157 - RNA, 11 nt, Shigella flexneri 2a str. 2457T
agcccagaaca

SEQ ID NO: 3840158 - RNA, 14 nt, Shigella flexneri 2a str. 2457T
agcccagaugccgg

SEQ ID NO: 3840159 - RNA, 17 nt, Shigella flexneri 2a str. 2457T
agcccaguucagcggcu

SEQ ID NO: 3840160 - RNA, 23 nt, Shigella flexneri 2a str. 2457T
agcccauaccacagcaaaacacc

SEQ ID NO: 3840161 - RNA, 22 nt, Shigella flexneri 2a str. 2457T
agcccaucaccgcgaggccuaa

SEQ ID NO: 3840162 - RNA, 20 nt, Shigella flexneri 2a str. 2457T
agcccaucaguacaccaccu

SEQ ID NO: 3840163 - RNA, 23 nt, Shigella flexneri 2a str. 2457T
agcccaucaguacaccaccuaac

SEQ ID NO: 3840164 - RNA, 22 nt, Shigella flexneri 2a str. 2457T
agcccaugaaucagcaaggaaa

SEQ ID NO: 3840165 - RNA, 14 nt, Shigella flexneri 2a str. 2457T
agccccaccagcaa

SEQ ID NO: 3840166 - RNA, 20 nt, Shigella flexneri 2a str. 2457T
agccccagcgucagcaucau

SEQ ID NO: 3840167 - RNA, 21 nt, Shigella flexneri 2a str. 2457T
agccccgcuuuuuucagcgcc

SEQ ID NO: 3840168 - RNA, 22 nt, Shigella flexneri 2a str. 2457T
agccccggcaaaugacgaugca

SEQ ID NO: 3840169 - RNA, 13 nt, Shigella flexneri 2a str. 2457T
agccccguagcca

SEQ ID NO: 3840170 - RNA, 19 nt, Shigella flexneri 2a str. 2457T
agccccuggaaaaagugcc

SEQ ID NO: 3840171 - RNA, 23 nt, Shigella flexneri 2a str. 2457T
agcccgaaucaguaaugauucgg

SEQ ID NO: 3840172 - RNA, 24 nt, Shigella flexneri 2a str. 2457T
agcccgaugauaaauccaucgggc

SEQ ID NO: 3840173 - RNA, 20 nt, Shigella flexneri 2a str. 2457T
agcccgauggcaucaccauc

SEQ ID NO: 3840174 - RNA, 19 nt, Shigella flexneri 2a str. 2457T
agcccgccaucgcccaucc

SEQ ID NO: 3840175 - RNA, 22 nt, Shigella flexneri 2a str. 2457T
agcccgccuuugaucucaaacg

SEQ ID NO: 3840176 - RNA, 22 nt, Shigella flexneri 2a str. 2457T
agcccgcgcgaugagccgcugg

SEQ ID NO: 3840177 - RNA, 22 nt, Shigella flexneri 2a str. 2457T
agcccgcugccgcagauauucc

SEQ ID NO: 3840178 - RNA, 16 nt, Shigella flexneri 2a str. 2457T
agcccgguagcaugaa

SEQ ID NO: 3840179 - RNA, 14 nt, Shigella flexneri 2a str. 2457T
agcccggucaucag

SEQ ID NO: 3840180 - RNA, 17 nt, Shigella flexneri 2a str. 2457T
agcccguaacucacuga

SEQ ID NO: 3840181 - RNA, 18 nt, Shigella flexneri 2a str. 2457T
agcccgugcauaggcggc

SEQ ID NO: 3840182 - RNA, 18 nt, Shigella flexneri 2a str. 2457T
agcccucaccgaagcgag

SEQ ID NO: 3840183 - RNA, 16 nt, Shigella flexneri 2a str. 2457T
agcccucgacauguuc

SEQ ID NO: 3840184 - RNA, 12 nt, Shigella flexneri 2a str. 2457T
agcccugccgga

SEQ ID NO: 3840185 - RNA, 17 nt, Shigella flexneri 2a str. 2457T
agcccuggcucugcacu

SEQ ID NO: 3840186 - RNA, 12 nt, Shigella flexneri 2a str. 2457T
agcccuucacgc

SEQ ID NO: 3840187 - RNA, 18 nt, Shigella flexneri 2a str. 2457T
agcccuugcuucgccagu

SEQ ID NO: 3840188 - RNA, 18 nt, Shigella flexneri 2a str. 2457T
agccgaaacggaaaucgc

SEQ ID NO: 3840189 - RNA, 23 nt, Shigella flexneri 2a str. 2457T
agccgaagccguuagucaucauc

SEQ ID NO: 3840190 - RNA, 21 nt, Shigella flexneri 2a str. 2457T
agccgaagcugucagaacggu

SEQ ID NO: 3840191 - RNA, 13 nt, Shigella flexneri 2a str. 2457T
agccgaucaggcu

SEQ ID NO: 3840192 - RNA, 12 nt, Shigella flexneri 2a str. 2457T
agccgauuaaaa

SEQ ID NO: 3840193 - RNA, 13 nt, Shigella flexneri 2a str. 2457T
agccgcaaaccug

SEQ ID NO: 3840194 - RNA, 16 nt, Shigella flexneri 2a str. 2457T
agccgcaaacuccgug

SEQ ID NO: 3840195 - RNA, 14 nt, Shigella flexneri 2a str. 2457T
agccgcagccauca

SEQ ID NO: 3840196 - RNA, 16 nt, Shigella flexneri 2a str. 2457T
agccgcaucaccgcac

SEQ ID NO: 3840197 - RNA, 14 nt, Shigella flexneri 2a str. 2457T
agccgccacgaccu

SEQ ID NO: 3840198 - RNA, 14 nt, Shigella flexneri 2a str. 2457T
agccgccagacaau

SEQ ID NO: 3840199 - RNA, 14 nt, Shigella flexneri 2a str. 2457T
agccgccaucucuu

SEQ ID NO: 3840200 - RNA, 22 nt, Shigella flexneri 2a str. 2457T
agccgcccccgacuccagcagu

SEQ ID NO: 3840201 - RNA, 17 nt, Shigella flexneri 2a str. 2457T
agccgcgcuuucuucuu

SEQ ID NO: 3840202 - RNA, 15 nt, Shigella flexneri 2a str. 2457T
agccgcgugcgcugg

SEQ ID NO: 3840203 - RNA, 16 nt, Shigella flexneri 2a str. 2457T
agccgcuaacagcagc

SEQ ID NO: 3840204 - RNA, 14 nt, Shigella flexneri 2a str. 2457T
agccgcuaccagcg

SEQ ID NO: 3840205 - RNA, 14 nt, Shigella flexneri 2a str. 2457T
agccgcuucugcag

SEQ ID NO: 3840206 - RNA, 17 nt, Shigella flexneri 2a str. 2457T
agccgcuucugcagcuu

SEQ ID NO: 3840207 - RNA, 23 nt, Shigella flexneri 2a str. 2457T
agccgcuucugcagcuuuaacga

SEQ ID NO: 3840208 - RNA, 14 nt, Shigella flexneri 2a str. 2457T
agccggacccacac

SEQ ID NO: 3840209 - RNA, 15 nt, Shigella flexneri 2a str. 2457T
agccggacccacacc

SEQ ID NO: 3840210 - RNA, 21 nt, Shigella flexneri 2a str. 2457T
agccggagaaauaccacccgu

SEQ ID NO: 3840211 - RNA, 15 nt, Shigella flexneri 2a str. 2457T
agccggaggugaaaa

SEQ ID NO: 3840212 - RNA, 15 nt, Shigella flexneri 2a str. 2457T
agccggaguggggga

SEQ ID NO: 3840213 - RNA, 17 nt, Shigella flexneri 2a str. 2457T
agccggaguugcagauu

SEQ ID NO: 3840214 - RNA, 17 nt, Shigella flexneri 2a str. 2457T
agccggauaaacaaugu

SEQ ID NO: 3840215 - RNA, 19 nt, Shigella flexneri 2a str. 2457T
agccggaugaucauccggc

SEQ ID NO: 3840216 - RNA, 17 nt, Shigella flexneri 2a str. 2457T
agccggugcuugcaccg

SEQ ID NO: 3840217 - RNA, 12 nt, Shigella flexneri 2a str. 2457T
agccguacugca

SEQ ID NO: 3840218 - RNA, 19 nt, Shigella flexneri 2a str. 2457T
agccguacugcauaaugcc

SEQ ID NO: 3840219 - RNA, 13 nt, Shigella flexneri 2a str. 2457T
agccguauucuga

SEQ ID NO: 3840220 - RNA, 16 nt, Shigella flexneri 2a str. 2457T
agccgucaccgccugc

SEQ ID NO: 3840221 - RNA, 18 nt, Shigella flexneri 2a str. 2457T
agccgucgagggccugaa

SEQ ID NO: 3840222 - RNA, 16 nt, Shigella flexneri 2a str. 2457T
agccgugaaucacucc

SEQ ID NO: 3840223 - RNA, 23 nt, Shigella flexneri 2a str. 2457T
agccuaagccauuuaacucaccg

SEQ ID NO: 3840224 - RNA, 14 nt, Shigella flexneri 2a str. 2457T
agccuacaaaaacu

SEQ ID NO: 3840225 - RNA, 15 nt, Shigella flexneri 2a str. 2457T
agccucaaauuccuu

SEQ ID NO: 3840226 - RNA, 19 nt, Shigella flexneri 2a str. 2457T
agccucacgguucauuagu

SEQ ID NO: 3840227 - RNA, 15 nt, Shigella flexneri 2a str. 2457T
agccugaaaacgaaa

SEQ ID NO: 3840228 - RNA, 21 nt, Shigella flexneri 2a str. 2457T
agccugaacuaaagccuuuug

SEQ ID NO: 3840229 - RNA, 10 nt, Shigella flexneri 2a str. 2457T
agccugaagg

SEQ ID NO: 3840230 - RNA, 18 nt, Shigella flexneri 2a str. 2457T
agccugauacaggaaggc

SEQ ID NO: 3840231 - RNA, 19 nt, Shigella flexneri 2a str. 2457T
agccugauacaggaaggcc

SEQ ID NO: 3840232 - RNA, 14 nt, Shigella flexneri 2a str. 2457T
agccugaugaugag

SEQ ID NO: 3840233 - RNA, 19 nt, Shigella flexneri 2a str. 2457T
agccugcagugaaauuaaa

SEQ ID NO: 3840234 - RNA, 22 nt, Shigella flexneri 2a str. 2457T
agccugcagugaaauuaaacug

SEQ ID NO: 3840235 - RNA, 14 nt, Shigella flexneri 2a str. 2457T
agccugcgcuucuu

SEQ ID NO: 3840236 - RNA, 14 nt, Shigella flexneri 2a str. 2457T
agccugcucaguug

SEQ ID NO: 3840237 - RNA, 18 nt, Shigella flexneri 2a str. 2457T
agccugcuucaaacgcug

SEQ ID NO: 3840238 - RNA, 14 nt, Shigella flexneri 2a str. 2457T
agccuggcuggauu

SEQ ID NO: 3840239 - RNA, 17 nt, Shigella flexneri 2a str. 2457T
agccuguaccacaaccu

SEQ ID NO: 3840240 - RNA, 20 nt, Shigella flexneri 2a str. 2457T
agccuguaccacaaccugca

SEQ ID NO: 3840241 - RNA, 18 nt, Shigella flexneri 2a str. 2457T
agccugugucaggccggc

SEQ ID NO: 3840242 - RNA, 19 nt, Shigella flexneri 2a str. 2457T
agccugugucaggccggca

SEQ ID NO: 3840243 - RNA, 19 nt, Shigella flexneri 2a str. 2457T
agccuguuccagacgcugc

SEQ ID NO: 3840244 - RNA, 16 nt, Shigella flexneri 2a str. 2457T
agcgccucaagcucgc

SEQ ID NO: 3840245 - RNA, 18 nt, Shigella flexneri 2a str. 2457T
agcgccucuuccauaauc

SEQ ID NO: 3840246 - RNA, 19 nt, Shigella flexneri 2a str. 2457T
agcgccuucuacagcuuca

SEQ ID NO: 3840247 - RNA, 16 nt, Shigella flexneri 2a str. 2457T
agcgcgaggguaaaca

SEQ ID NO: 3840248 - RNA, 19 nt, Shigella flexneri 2a str. 2457T
agcgcgcaguuugucuuca

SEQ ID NO: 3840249 - RNA, 13 nt, Shigella flexneri 2a str. 2457T
agcgcgcugacau

SEQ ID NO: 3840250 - RNA, 19 nt, Shigella flexneri 2a str. 2457T
agcgcggauuuuauucagc

SEQ ID NO: 3840251 - RNA, 16 nt, Shigella flexneri 2a str. 2457T
agcgcggggaucacug

SEQ ID NO: 3840252 - RNA, 16 nt, Shigella flexneri 2a str. 2457T
agcgcggugacgcaca

SEQ ID NO: 3840253 - RNA, 21 nt, Shigella flexneri 2a str. 2457T
agcgcguaaauaccuuccggc

SEQ ID NO: 3840254 - RNA, 24 nt, Shigella flexneri 2a str. 2457T
agcgcgucuggaacggcagaucca

SEQ ID NO: 3840255 - RNA, 18 nt, Shigella flexneri 2a str. 2457T
agcgcugacgugauuuag

SEQ ID NO: 3840256 - RNA, 19 nt, Shigella flexneri 2a str. 2457T
agcgcugcgcgcuucgccc

SEQ ID NO: 3840257 - RNA, 20 nt, Shigella flexneri 2a str. 2457T
agcgcugcggcgcgcaucuu

SEQ ID NO: 3840258 - RNA, 16 nt, Shigella flexneri 2a str. 2457T
agcgcuuuuggcgcgu

SEQ ID NO: 3840259 - RNA, 20 nt, Shigella flexneri 2a str. 2457T
agcggaaacguaacguacug

SEQ ID NO: 3840260 - RNA, 12 nt, Shigella flexneri 2a str. 2457T
agcggaaaucac

SEQ ID NO: 3840261 - RNA, 13 nt, Shigella flexneri 2a str. 2457T
agcggaaaucacg

SEQ ID NO: 3840262 - RNA, 12 nt, Shigella flexneri 2a str. 2457T
agcggaaaucuc

SEQ ID NO: 3840263 - RNA, 17 nt, Shigella flexneri 2a str. 2457T
agcggaaaucuccagau

SEQ ID NO: 3840264 - RNA, 13 nt, Shigella flexneri 2a str. 2457T
agcggaacugaag

SEQ ID NO: 3840265 - RNA, 16 nt, Shigella flexneri 2a str. 2457T
agcggaauauuuuuac

SEQ ID NO: 3840266 - RNA, 14 nt, Shigella flexneri 2a str. 2457T
agcggacaaugccu

SEQ ID NO: 3840267 - RNA, 14 nt, Shigella flexneri 2a str. 2457T
agcggagguaauaa

SEQ ID NO: 3840268 - RNA, 15 nt, Shigella flexneri 2a str. 2457T
agcggaucaagaaag

SEQ ID NO: 3840269 - RNA, 19 nt, Shigella flexneri 2a str. 2457T
agcggaucaguuccagcag

SEQ ID NO: 3840270 - RNA, 19 nt, Shigella flexneri 2a str. 2457T
agcggcaggaaaaaagcgc

SEQ ID NO: 3840271 - RNA, 13 nt, Shigella flexneri 2a str. 2457T
agcggcaggccgu

SEQ ID NO: 3840272 - RNA, 23 nt, Shigella flexneri 2a str. 2457T
agcggcaggccguggaucacauc

SEQ ID NO: 3840273 - RNA, 18 nt, Shigella flexneri 2a str. 2457T
agcggcauaaaacgaaug

SEQ ID NO: 3840274 - RNA, 15 nt, Shigella flexneri 2a str. 2457T
agcggccgucagauc

SEQ ID NO: 3840275 - RNA, 12 nt, Shigella flexneri 2a str. 2457T
agcggcggcaaa

SEQ ID NO: 3840276 - RNA, 21 nt, Shigella flexneri 2a str. 2457T
agcggcggcaauggcugcggc

SEQ ID NO: 3840277 - RNA, 16 nt, Shigella flexneri 2a str. 2457T
agcggcgggcuuuaau

SEQ ID NO: 3840278 - RNA, 21 nt, Shigella flexneri 2a str. 2457T
agcggcgggcuuuaaucaccc

SEQ ID NO: 3840279 - RNA, 19 nt, Shigella flexneri 2a str. 2457T
agcggcggucuucucaccg

SEQ ID NO: 3840280 - RNA, 23 nt, Shigella flexneri 2a str. 2457T
agcggcggugucuaacgaugcca

SEQ ID NO: 3840281 - RNA, 16 nt, Shigella flexneri 2a str. 2457T
agcggcguaucuucca

SEQ ID NO: 3840282 - RNA, 23 nt, Shigella flexneri 2a str. 2457T
agcggcguuuuguagagcagcac

SEQ ID NO: 3840283 - RNA, 16 nt, Shigella flexneri 2a str. 2457T
agcggcugccagcaug

SEQ ID NO: 3840284 - RNA, 18 nt, Shigella flexneri 2a str. 2457T
agcggcuucaugcaucgg

SEQ ID NO: 3840285 - RNA, 22 nt, Shigella flexneri 2a str. 2457T
agcggcuuuuuacgcgacacaa

SEQ ID NO: 3840286 - RNA, 21 nt, Shigella flexneri 2a str. 2457T
agcgggcagacaaaacauacc

SEQ ID NO: 3840287 - RNA, 16 nt, Shigella flexneri 2a str. 2457T
agcgggcgcgcaggcg

SEQ ID NO: 3840288 - RNA, 13 nt, Shigella flexneri 2a str. 2457T
agcggggaacacc

SEQ ID NO: 3840289 - RNA, 18 nt, Shigella flexneri 2a str. 2457T
agcggggaacaucaggca

SEQ ID NO: 3840290 - RNA, 20 nt, Shigella flexneri 2a str. 2457T
agcgggguucuccugagaau

SEQ ID NO: 3840291 - RNA, 17 nt, Shigella flexneri 2a str. 2457T
agcgguaaaauggucag

SEQ ID NO: 3840292 - RNA, 22 nt, Shigella flexneri 2a str. 2457T
agcgguaaagaacugagcgccg

SEQ ID NO: 3840293 - RNA, 20 nt, Shigella flexneri 2a str. 2457T
agcggucggagguucgaauc

SEQ ID NO: 3840294 - RNA, 19 nt, Shigella flexneri 2a str. 2457T
agcggugaaaaaauuaaac

SEQ ID NO: 3840295 - RNA, 22 nt, Shigella flexneri 2a str. 2457T
agcgguggugaaaagagcggua

SEQ ID NO: 3840296 - RNA, 15 nt, Shigella flexneri 2a str. 2457T
agcgguggugacugg

SEQ ID NO: 3840297 - RNA, 20 nt, Shigella flexneri 2a str. 2457T
agcgguuuacccugcucgcu

SEQ ID NO: 3840298 - RNA, 15 nt, Shigella flexneri 2a str. 2457T
agcgguuuucaaaga

SEQ ID NO: 3840299 - RNA, 16 nt, Shigella flexneri 2a str. 2457T
agcgguuuugccagcg

SEQ ID NO: 3840300 - RNA, 22 nt, Shigella flexneri 2a str. 2457T
agcguaaaggcggcagaacaga

SEQ ID NO: 3840301 - RNA, 19 nt, Shigella flexneri 2a str. 2457T
agcguacaauagccacauu

SEQ ID NO: 3840302 - RNA, 18 nt, Shigella flexneri 2a str. 2457T
agcguacggcaugcguuc

SEQ ID NO: 3840303 - RNA, 14 nt, Shigella flexneri 2a str. 2457T
agcguagcgcauca

SEQ ID NO: 3840304 - RNA, 17 nt, Shigella flexneri 2a str. 2457T
agcguagcgcaucgggc

SEQ ID NO: 3840305 - RNA, 23 nt, Shigella flexneri 2a str. 2457T
agcguaucccagugcggcaucgc

SEQ ID NO: 3840306 - RNA, 22 nt, Shigella flexneri 2a str. 2457T
agcguauccguggcgcuaugcu

SEQ ID NO: 3840307 - RNA, 16 nt, Shigella flexneri 2a str. 2457T
agcguauucagcaauu

SEQ ID NO: 3840308 - RNA, 20 nt, Shigella flexneri 2a str. 2457T
agcguauucgugacaauauc

SEQ ID NO: 3840309 - RNA, 13 nt, Shigella flexneri 2a str. 2457T
agcgucacaucag

SEQ ID NO: 3840310 - RNA, 17 nt, Shigella flexneri 2a str. 2457T
agcgucagcaccagaga

SEQ ID NO: 3840311 - RNA, 18 nt, Shigella flexneri 2a str. 2457T
agcgucagccagaaagaa

SEQ ID NO: 3840312 - RNA, 21 nt, Shigella flexneri 2a str. 2457T
agcgucagccagaaagaaccg

SEQ ID NO: 3840313 - RNA, 16 nt, Shigella flexneri 2a str. 2457T
agcgucaguagauuuc

SEQ ID NO: 3840314 - RNA, 14 nt, Shigella flexneri 2a str. 2457T
agcgucauuucuac

SEQ ID NO: 3840315 - RNA, 19 nt, Shigella flexneri 2a str. 2457T
agcguccacagccaacaca

SEQ ID NO: 3840316 - RNA, 21 nt, Shigella flexneri 2a str. 2457T
agcguccacagccaacacauu

SEQ ID NO: 3840317 - RNA, 15 nt, Shigella flexneri 2a str. 2457T
agcgucccaguaacg

SEQ ID NO: 3840318 - RNA, 19 nt, Shigella flexneri 2a str. 2457T
agcgucccaguaacguccc

SEQ ID NO: 3840319 - RNA, 20 nt, Shigella flexneri 2a str. 2457T
agcguccggcugccagccag

SEQ ID NO: 3840320 - RNA, 21 nt, Shigella flexneri 2a str. 2457T
agcguccggcugccagccagg

SEQ ID NO: 3840321 - RNA, 16 nt, Shigella flexneri 2a str. 2457T
agcgucgcauccgaca

SEQ ID NO: 3840322 - RNA, 15 nt, Shigella flexneri 2a str. 2457T
agcgucgccuggugu

SEQ ID NO: 3840323 - RNA, 18 nt, Shigella flexneri 2a str. 2457T
agcgucgcgguugcuguc

SEQ ID NO: 3840324 - RNA, 20 nt, Shigella flexneri 2a str. 2457T
agcgucggcgucaucgacau

SEQ ID NO: 3840325 - RNA, 23 nt, Shigella flexneri 2a str. 2457T
agcgucugcuccuccuucucacc

SEQ ID NO: 3840326 - RNA, 18 nt, Shigella flexneri 2a str. 2457T
agcgugaaacaaaucacu

SEQ ID NO: 3840327 - RNA, 21 nt, Shigella flexneri 2a str. 2457T
agcgugacaccagcacaucau

SEQ ID NO: 3840328 - RNA, 14 nt, Shigella flexneri 2a str. 2457T
agcgugacuggcag

SEQ ID NO: 3840329 - RNA, 20 nt, Shigella flexneri 2a str. 2457T
agcgugauuguggcaaucau

SEQ ID NO: 3840330 - RNA, 16 nt, Shigella flexneri 2a str. 2457T
agcgugcauagcagca

SEQ ID NO: 3840331 - RNA, 14 nt, Shigella flexneri 2a str. 2457T
agcgugcucucaaa

SEQ ID NO: 3840332 - RNA, 23 nt, Shigella flexneri 2a str. 2457T
agcgugcucucaaauaucugccg

SEQ ID NO: 3840333 - RNA, 14 nt, Shigella flexneri 2a str. 2457T
agcguggucauggc

SEQ ID NO: 3840334 - RNA, 20 nt, Shigella flexneri 2a str. 2457T
agcguggugauaccagacca

SEQ ID NO: 3840335 - RNA, 22 nt, Shigella flexneri 2a str. 2457T
agcguguaaaaagauaaacggc

SEQ ID NO: 3840336 - RNA, 15 nt, Shigella flexneri 2a str. 2457T
agcguuaaucaucaa

SEQ ID NO: 3840337 - RNA, 15 nt, Shigella flexneri 2a str. 2457T
agcguuaccagcaaa

SEQ ID NO: 3840338 - RNA, 20 nt, Shigella flexneri 2a str. 2457T
agcguuacgccccaacacaa

SEQ ID NO: 3840339 - RNA, 16 nt, Shigella flexneri 2a str. 2457T
agcguuacuucaccuu

SEQ ID NO: 3840340 - RNA, 16 nt, Shigella flexneri 2a str. 2457T
agcguuauagcgcaug

SEQ ID NO: 3840341 - RNA, 18 nt, Shigella flexneri 2a str. 2457T
agcuucaccgcaucguca

SEQ ID NO: 3840342 - RNA, 15 nt, Shigella flexneri 2a str. 2457T
agcuucaccuuccag

SEQ ID NO: 3840343 - RNA, 21 nt, Shigella flexneri 2a str. 2457T
agcuucacgcgccagcuuagu

SEQ ID NO: 3840344 - RNA, 18 nt, Shigella flexneri 2a str. 2457T
agcuucaucaucgcagau

SEQ ID NO: 3840345 - RNA, 15 nt, Shigella flexneri 2a str. 2457T
agcuucgcuucccaa

SEQ ID NO: 3840346 - RNA, 13 nt, Shigella flexneri 2a str. 2457T
agcuucucauccu

SEQ ID NO: 3840347 - RNA, 16 nt, Shigella flexneri 2a str. 2457T
agcuucuguuauucca

SEQ ID NO: 3840348 - RNA, 18 nt, Shigella flexneri 2a str. 2457T
agcuucuuauccagcugc

SEQ ID NO: 3840349 - RNA, 21 nt, Shigella flexneri 2a str. 2457T
agcuucuucaaaaaagucaga

SEQ ID NO: 3840350 - RNA, 16 nt, Shigella flexneri 2a str. 2457T
agcuugaucaauaacg

SEQ ID NO: 3840351 - RNA, 14 nt, Shigella flexneri 2a str. 2457T
agcuugcgauccug

SEQ ID NO: 3840352 - RNA, 18 nt, Shigella flexneri 2a str. 2457T
agcuugcgauccugcaga

SEQ ID NO: 3840353 - RNA, 16 nt, Shigella flexneri 2a str. 2457T
agcuugcgucgccagu

SEQ ID NO: 3840354 - RNA, 20 nt, Shigella flexneri 2a str. 2457T
agcuugcguguuuuauauaa

SEQ ID NO: 3840355 - RNA, 13 nt, Shigella flexneri 2a str. 2457T
agcuuggcagagc

SEQ ID NO: 3840356 - RNA, 17 nt, Shigella flexneri 2a str. 2457T
agcuugugcaccagcug

SEQ ID NO: 3840357 - RNA, 17 nt, Shigella flexneri 2a str. 2457T
agcuuuaaauuacugag

SEQ ID NO: 3840358 - RNA, 20 nt, Shigella flexneri 2a str. 2457T
agcuuuauccugcccacucc

SEQ ID NO: 3840359 - RNA, 18 nt, Shigella flexneri 2a str. 2457T
agcuuucuuuuucugaca

SEQ ID NO: 3840360 - RNA, 19 nt, Shigella flexneri 2a str. 2457T
agcuuuuuaaucgccaucu

SEQ ID NO: 3840361 - RNA, 15 nt, Shigella flexneri 2a str. 2457T
agcuuuuuauagcaa

SEQ ID NO: 3840362 - RNA, 11 nt, Shigella flexneri 2a str. 2457T
aggaaaaaccg

SEQ ID NO: 3840363 - RNA, 13 nt, Shigella flexneri 2a str. 2457T
aggaaaauacagc

SEQ ID NO: 3840364 - RNA, 19 nt, Shigella flexneri 2a str. 2457T
aggaaacccaacgcaaaga

SEQ ID NO: 3840365 - RNA, 13 nt, Shigella flexneri 2a str. 2457T
aggaaaguaaauu

SEQ ID NO: 3840366 - RNA, 11 nt, Shigella flexneri 2a str. 2457T
aggaaauaaau

SEQ ID NO: 3840367 - RNA, 14 nt, Shigella flexneri 2a str. 2457T
aggaaauaaauaau

SEQ ID NO: 3840368 - RNA, 13 nt, Shigella flexneri 2a str. 2457T
aggaaauaauaua

SEQ ID NO: 3840369 - RNA, 18 nt, Shigella flexneri 2a str. 2457T
aggaaauuaccgcaaagc

SEQ ID NO: 3840370 - RNA, 16 nt, Shigella flexneri 2a str. 2457T
aggaacagaagaaagc

SEQ ID NO: 3840371 - RNA, 21 nt, Shigella flexneri 2a str. 2457T
aggaacagaagaaagcaauga

SEQ ID NO: 3840372 - RNA, 22 nt, Shigella flexneri 2a str. 2457T
aggaacaucugaguugccauca

SEQ ID NO: 3840373 - RNA, 18 nt, Shigella flexneri 2a str. 2457T
aggaaccuccauguccag

SEQ ID NO: 3840374 - RNA, 19 nt, Shigella flexneri 2a str. 2457T
aggaaccuccauguccagc

SEQ ID NO: 3840375 - RNA, 16 nt, Shigella flexneri 2a str. 2457T
aggaaccugugacagc

SEQ ID NO: 3840376 - RNA, 15 nt, Shigella flexneri 2a str. 2457T
aggaacggcauuuac

SEQ ID NO: 3840377 - RNA, 21 nt, Shigella flexneri 2a str. 2457T
aggaacgggauugccagcaua

SEQ ID NO: 3840378 - RNA, 12 nt, Shigella flexneri 2a str. 2457T
aggaacuccaga

SEQ ID NO: 3840379 - RNA, 15 nt, Shigella flexneri 2a str. 2457T
aggaagauuacgcug

SEQ ID NO: 3840380 - RNA, 20 nt, Shigella flexneri 2a str. 2457T
aggaagccggaauuuuccuu

SEQ ID NO: 3840381 - RNA, 22 nt, Shigella flexneri 2a str. 2457T
aggaagccggaauuuuccuucg

SEQ ID NO: 3840382 - RNA, 13 nt, Shigella flexneri 2a str. 2457T
aggaaggcaagaa

SEQ ID NO: 3840383 - RNA, 17 nt, Shigella flexneri 2a str. 2457T
aggaaggcaagaaagcg

SEQ ID NO: 3840384 - RNA, 21 nt, Shigella flexneri 2a str. 2457T
aggaagggauugugcaggcgc

SEQ ID NO: 3840385 - RNA, 16 nt, Shigella flexneri 2a str. 2457T
aggaaggucauccaaa

SEQ ID NO: 3840386 - RNA, 17 nt, Shigella flexneri 2a str. 2457T
aggaauaugguuagaga

SEQ ID NO: 3840387 - RNA, 19 nt, Shigella flexneri 2a str. 2457T
aggaaucacguaggccuga

SEQ ID NO: 3840388 - RNA, 20 nt, Shigella flexneri 2a str. 2457T
aggaaucacguaggccugau

SEQ ID NO: 3840389 - RNA, 14 nt, Shigella flexneri 2a str. 2457T
aggaaucagauacu

SEQ ID NO: 3840390 - RNA, 14 nt, Shigella flexneri 2a str. 2457T
aggaaucaggcagg

SEQ ID NO: 3840391 - RNA, 12 nt, Shigella flexneri 2a str. 2457T
aggaauccgggu

SEQ ID NO: 3840392 - RNA, 16 nt, Shigella flexneri 2a str. 2457T
aggaaucgcuguugag

SEQ ID NO: 3840393 - RNA, 17 nt, Shigella flexneri 2a str. 2457T
aggaaucugauuacuuc

SEQ ID NO: 3840394 - RNA, 19 nt, Shigella flexneri 2a str. 2457T
aggaaugacgacuaaaucu

SEQ ID NO: 3840395 - RNA, 12 nt, Shigella flexneri 2a str. 2457T
aggaauuaaaac

SEQ ID NO: 3840396 - RNA, 20 nt, Shigella flexneri 2a str. 2457T
aggaauucagaaaaauacaa

SEQ ID NO: 3840397 - RNA, 19 nt, Shigella flexneri 2a str. 2457T
aggaauuuuacagcccugg

SEQ ID NO: 3840398 - RNA, 21 nt, Shigella flexneri 2a str. 2457T
aggacagagacgcacugcuug

SEQ ID NO: 3840399 - RNA, 12 nt, Shigella flexneri 2a str. 2457T
aggacagcaucg

SEQ ID NO: 3840400 - RNA, 19 nt, Shigella flexneri 2a str. 2457T
aggacagugggauuaaaaa

SEQ ID NO: 3840401 - RNA, 22 nt, Shigella flexneri 2a str. 2457T
aggacaucccggcagagaaaau

SEQ ID NO: 3840402 - RNA, 19 nt, Shigella flexneri 2a str. 2457T
aggaccuuauggaucugga

SEQ ID NO: 3840403 - RNA, 18 nt, Shigella flexneri 2a str. 2457T
aggacuuauucauuucgu

SEQ ID NO: 3840404 - RNA, 22 nt, Shigella flexneri 2a str. 2457T
aggacuucaucacgaugcaaau

SEQ ID NO: 3840405 - RNA, 17 nt, Shigella flexneri 2a str. 2457T
aggagaagcaaauucuu

SEQ ID NO: 3840406 - RNA, 18 nt, Shigella flexneri 2a str. 2457T
aggagacacgcugccccu

SEQ ID NO: 3840407 - RNA, 13 nt, Shigella flexneri 2a str. 2457T
aggagacgcgcaa

SEQ ID NO: 3840408 - RNA, 18 nt, Shigella flexneri 2a str. 2457T
aggagaguaugcgcguca

SEQ ID NO: 3840409 - RNA, 20 nt, Shigella flexneri 2a str. 2457T
aggagaguaugcgcgucaga

SEQ ID NO: 3840410 - RNA, 14 nt, Shigella flexneri 2a str. 2457T
aggagauaaaccga

SEQ ID NO: 3840411 - RNA, 17 nt, Shigella flexneri 2a str. 2457T
aggagcacgccuggaaa

SEQ ID NO: 3840412 - RNA, 19 nt, Shigella flexneri 2a str. 2457T
aggagcgauuaugaaacaa

SEQ ID NO: 3840413 - RNA, 20 nt, Shigella flexneri 2a str. 2457T
aggaggcguaauuuccacgc

SEQ ID NO: 3840414 - RNA, 23 nt, Shigella flexneri 2a str. 2457T
aggaggcguaauuuccacgccaa

SEQ ID NO: 3840415 - RNA, 22 nt, Shigella flexneri 2a str. 2457T
aggaggucgcacugcucuuuuu

SEQ ID NO: 3840416 - RNA, 20 nt, Shigella flexneri 2a str. 2457T
aggaguuugaacauaucagc

SEQ ID NO: 3840417 - RNA, 15 nt, Shigella flexneri 2a str. 2457T
aggauaaauuuucug

SEQ ID NO: 3840418 - RNA, 21 nt, Shigella flexneri 2a str. 2457T
aggauaugcaucaugaaaacc

SEQ ID NO: 3840419 - RNA, 16 nt, Shigella flexneri 2a str. 2457T
aggaucguuacgcccc

SEQ ID NO: 3840420 - RNA, 22 nt, Shigella flexneri 2a str. 2457T
aggaucuggcuugccagcaggg

SEQ ID NO: 3840421 - RNA, 21 nt, Shigella flexneri 2a str. 2457T
aggaugcacucgcauccucuu

SEQ ID NO: 3840422 - RNA, 22 nt, Shigella flexneri 2a str. 2457T
aggaugcacucgcauccucuuu

SEQ ID NO: 3840423 - RNA, 23 nt, Shigella flexneri 2a str. 2457T
aggaugcugcaauaaaauaucuu

SEQ ID NO: 3840424 - RNA, 14 nt, Shigella flexneri 2a str. 2457T
aggauggccgggca

SEQ ID NO: 3840425 - RNA, 20 nt, Shigella flexneri 2a str. 2457T
aggaugggcaacgcgcaugg

SEQ ID NO: 3840426 - RNA, 18 nt, Shigella flexneri 2a str. 2457T
aggauguuccggcaaagu

SEQ ID NO: 3840427 - RNA, 18 nt, Shigella flexneri 2a str. 2457T
aggauucgcuaacguuuu

SEQ ID NO: 3840428 - RNA, 17 nt, Shigella flexneri 2a str. 2457T
aggauugaucaauucua

SEQ ID NO: 3840429 - RNA, 16 nt, Shigella flexneri 2a str. 2457T
aggauuuucuaauauu

SEQ ID NO: 3840430 - RNA, 17 nt, Shigella flexneri 2a str. 2457T
aggcaaaaaaaaugccc

SEQ ID NO: 3840431 - RNA, 21 nt, Shigella flexneri 2a str. 2457T
aggcaaaauacguucucaccu

SEQ ID NO: 3840432 - RNA, 14 nt, Shigella flexneri 2a str. 2457T
aggcaaaaugccag

SEQ ID NO: 3840433 - RNA, 17 nt, Shigella flexneri 2a str. 2457T
aggcaaaaugccagccc

SEQ ID NO: 3840434 - RNA, 12 nt, Shigella flexneri 2a str. 2457T
aggcaaaccagu

SEQ ID NO: 3840435 - RNA, 23 nt, Shigella flexneri 2a str. 2457T
aggcaaacugucuaauggugaac

SEQ ID NO: 3840436 - RNA, 18 nt, Shigella flexneri 2a str. 2457T
aggcaacaugaaacagaa

SEQ ID NO: 3840437 - RNA, 19 nt, Shigella flexneri 2a str. 2457T
aggcaacgaccagaaaugc

SEQ ID NO: 3840438 - RNA, 15 nt, Shigella flexneri 2a str. 2457T
aggcguucacgccgc

SEQ ID NO: 3840439 - RNA, 18 nt, Shigella flexneri 2a str. 2457T
aggcguucacgccgcauc

SEQ ID NO: 3840440 - RNA, 20 nt, Shigella flexneri 2a str. 2457T
aggcguucacgccgcauccg

SEQ ID NO: 3840441 - RNA, 23 nt, Shigella flexneri 2a str. 2457T
aggcguucacgccgcaucuggca

SEQ ID NO: 3840442 - RNA, 21 nt, Shigella flexneri 2a str. 2457T
aggcguucuacauaaaacgcu

SEQ ID NO: 3840443 - RNA, 20 nt, Shigella flexneri 2a str. 2457T
aggcguuuacgccgcaucag

SEQ ID NO: 3840444 - RNA, 20 nt, Shigella flexneri 2a str. 2457T
aggcguuuacgccgcauccg

SEQ ID NO: 3840445 - RNA, 23 nt, Shigella flexneri 2a str. 2457T
aggcguuuacgccgcauccggca

SEQ ID NO: 3840446 - RNA, 22 nt, Shigella flexneri 2a str. 2457T
aggcguuuucgccgcauccggc

SEQ ID NO: 3840447 - RNA, 22 nt, Shigella flexneri 2a str. 2457T
aggcuaauaccgucgaugccaa

SEQ ID NO: 3840448 - RNA, 23 nt, Shigella flexneri 2a str. 2457T
aggcuaauaccgucgaugccaau

SEQ ID NO: 3840449 - RNA, 18 nt, Shigella flexneri 2a str. 2457T
aggcuagguugaccugga

SEQ ID NO: 3840450 - RNA, 19 nt, Shigella flexneri 2a str. 2457T
aggcuaucgaacaugcggg

SEQ ID NO: 3840451 - RNA, 23 nt, Shigella flexneri 2a str. 2457T
aggcuauuccacgcaucaagcau

SEQ ID NO: 3840452 - RNA, 24 nt, Shigella flexneri 2a str. 2457T
aggcuauuuugcguuuagcaucag

SEQ ID NO: 3840453 - RNA, 19 nt, Shigella flexneri 2a str. 2457T
aggcugaaaaucuucucuc

SEQ ID NO: 3840454 - RNA, 20 nt, Shigella flexneri 2a str. 2457T
aggcugccagaucaucguuu

SEQ ID NO: 3840455 - RNA, 19 nt, Shigella flexneri 2a str. 2457T
aggcugcgaguccuguugu

SEQ ID NO: 3840456 - RNA, 15 nt, Shigella flexneri 2a str. 2457T
aggcuggaucagacg

SEQ ID NO: 3840457 - RNA, 21 nt, Shigella flexneri 2a str. 2457T
aggcuguuuuuuauacuugca

SEQ ID NO: 3840458 - RNA, 16 nt, Shigella flexneri 2a str. 2457T
aggcuucccaauugca

SEQ ID NO: 3840459 - RNA, 14 nt, Shigella flexneri 2a str. 2457T
aggcuucgacgcuc

SEQ ID NO: 3840460 - RNA, 16 nt, Shigella flexneri 2a str. 2457T
aggcuucgacgcucag

SEQ ID NO: 3840461 - RNA, 15 nt, Shigella flexneri 2a str. 2457T
aggcuucgguaauga

SEQ ID NO: 3840462 - RNA, 14 nt, Shigella flexneri 2a str. 2457T
aggcuugcugaugc

SEQ ID NO: 3840463 - RNA, 12 nt, Shigella flexneri 2a str. 2457T
aggcuugcugca

SEQ ID NO: 3840464 - RNA, 19 nt, Shigella flexneri 2a str. 2457T
aggcuuuccgucagcggca

SEQ ID NO: 3840465 - RNA, 19 nt, Shigella flexneri 2a str. 2457T
aggcuuuccugauaaucca

SEQ ID NO: 3840466 - RNA, 19 nt, Shigella flexneri 2a str. 2457T
aggcuuuuuuauugccauc

SEQ ID NO: 3840467 - RNA, 18 nt, Shigella flexneri 2a str. 2457T
aggcuuuuuugguaauga

SEQ ID NO: 3840468 - RNA, 16 nt, Shigella flexneri 2a str. 2457T
agggaaacaacaccgu

SEQ ID NO: 3840469 - RNA, 21 nt, Shigella flexneri 2a str. 2457T
agggaaagagcgauccguuca

SEQ ID NO: 3840470 - RNA, 13 nt, Shigella flexneri 2a str. 2457T
agggaauggcaga

SEQ ID NO: 3840471 - RNA, 19 nt, Shigella flexneri 2a str. 2457T
agggaaugugaugaaaaaa

SEQ ID NO: 3840472 - RNA, 22 nt, Shigella flexneri 2a str. 2457T
agggagcaggcuaguaaaaagc

SEQ ID NO: 3840473 - RNA, 23 nt, Shigella flexneri 2a str. 2457T
agggaguaugcggucaaaagcug

SEQ ID NO: 3840474 - RNA, 22 nt, Shigella flexneri 2a str. 2457T
agggagucuugcuggaugccag

SEQ ID NO: 3840475 - RNA, 22 nt, Shigella flexneri 2a str. 2457T
agggaucauccacccgcagcaa

SEQ ID NO: 3840476 - RNA, 18 nt, Shigella flexneri 2a str. 2457T
agggaugaaauagacauu

SEQ ID NO: 3840477 - RNA, 14 nt, Shigella flexneri 2a str. 2457T
agggcaaacaccgc

SEQ ID NO: 3840478 - RNA, 15 nt, Shigella flexneri 2a str. 2457T
agggcaaagucagau

SEQ ID NO: 3840479 - RNA, 20 nt, Shigella flexneri 2a str. 2457T
agggcaagcgccuaaaucca

SEQ ID NO: 3840480 - RNA, 21 nt, Shigella flexneri 2a str. 2457T
agggcaauaaucucuacacca

SEQ ID NO: 3840481 - RNA, 22 nt, Shigella flexneri 2a str. 2457T
agggcaccggcguaacgccacg

SEQ ID NO: 3840482 - RNA, 22 nt, Shigella flexneri 2a str. 2457T
agggcacuuuuauccugucagu

SEQ ID NO: 3840483 - RNA, 13 nt, Shigella flexneri 2a str. 2457T
agggcaucaagaa

SEQ ID NO: 3840484 - RNA, 17 nt, Shigella flexneri 2a str. 2457T
agggcaucaagaaugcu

SEQ ID NO: 3840485 - RNA, 18 nt, Shigella flexneri 2a str. 2457T
agggcaugacacagaauc

SEQ ID NO: 3840486 - RNA, 15 nt, Shigella flexneri 2a str. 2457T
agggccaacuggcaa

SEQ ID NO: 3840487 - RNA, 17 nt, Shigella flexneri 2a str. 2457T
agggcgaauucuugccu

SEQ ID NO: 3840488 - RNA, 18 nt, Shigella flexneri 2a str. 2457T
agggcgauuauccgccag

SEQ ID NO: 3840489 - RNA, 17 nt, Shigella flexneri 2a str. 2457T
agggcggacaaccagcu

SEQ ID NO: 3840490 - RNA, 17 nt, Shigella flexneri 2a str. 2457T
agggcuaacgugcaggu

SEQ ID NO: 3840491 - RNA, 19 nt, Shigella flexneri 2a str. 2457T
agggcugccggaaggcagc

SEQ ID NO: 3840492 - RNA, 14 nt, Shigella flexneri 2a str. 2457T
agggcuggcaauga

SEQ ID NO: 3840493 - RNA, 21 nt, Shigella flexneri 2a str. 2457T
agggcuguuuaucgugaauuc

SEQ ID NO: 3840494 - RNA, 16 nt, Shigella flexneri 2a str. 2457T
agggcuuucacugccc

SEQ ID NO: 3840495 - RNA, 18 nt, Shigella flexneri 2a str. 2457T
agggcuuuuuuauuucau

SEQ ID NO: 3840496 - RNA, 14 nt, Shigella flexneri 2a str. 2457T
aggggaacagacca

SEQ ID NO: 3840497 - RNA, 16 nt, Shigella flexneri 2a str. 2457T
aggggcuucuuccggc

SEQ ID NO: 3840498 - RNA, 18 nt, Shigella flexneri 2a str. 2457T
aggggucguuuuuuauuc

SEQ ID NO: 3840499 - RNA, 15 nt, Shigella flexneri 2a str. 2457T
aggggugaaaaaaac

SEQ ID NO: 3840500 - RNA, 17 nt, Shigella flexneri 2a str. 2457T
aggguaaacaacaugcu

SEQ ID NO: 3840501 - RNA, 20 nt, Shigella flexneri 2a str. 2457T
aggguaguguccauaaaaca

SEQ ID NO: 3840502 - RNA, 23 nt, Shigella flexneri 2a str. 2457T
agggucuuccagcaaauccauca

SEQ ID NO: 3840503 - RNA, 20 nt, Shigella flexneri 2a str. 2457T
aggguggcucaaucgccacc

SEQ ID NO: 3840504 - RNA, 17 nt, Shigella flexneri 2a str. 2457T
aggguugaaauauaucc

SEQ ID NO: 3840505 - RNA, 13 nt, Shigella flexneri 2a str. 2457T
aggguugccggau

SEQ ID NO: 3840506 - RNA, 22 nt, Shigella flexneri 2a str. 2457T
aggguuucggcuuuuuccugcc

SEQ ID NO: 3840507 - RNA, 13 nt, Shigella flexneri 2a str. 2457T
agguaaaaccuga

SEQ ID NO: 3840508 - RNA, 17 nt, Shigella flexneri 2a str. 2457T
agguaacaauaaacacc

SEQ ID NO: 3840509 - RNA, 23 nt, Shigella flexneri 2a str. 2457T
agguaacgucgguuucaucacau

SEQ ID NO: 3840510 - RNA, 18 nt, Shigella flexneri 2a str. 2457T
agguaagauguucuaucu

SEQ ID NO: 3840511 - RNA, 23 nt, Shigella flexneri 2a str. 2457T
agguaaggcgcgagguuuuccuu

SEQ ID NO: 3840512 - RNA, 23 nt, Shigella flexneri 2a str. 2457T
agguaaucugucuuuuacaucau

SEQ ID NO: 3840513 - RNA, 13 nt, Shigella flexneri 2a str. 2457T
agguacaaagcca

SEQ ID NO: 3840514 - RNA, 23 nt, Shigella flexneri 2a str. 2457T
agguacaaccgcaaagguugcug

SEQ ID NO: 3840515 - RNA, 20 nt, Shigella flexneri 2a str. 2457T
agguaccagcauuagcaaug

SEQ ID NO: 3840516 - RNA, 16 nt, Shigella flexneri 2a str. 2457T
agguacgcuccagcag

SEQ ID NO: 3840517 - RNA, 22 nt, Shigella flexneri 2a str. 2457T
agguagacaccaaggaacugug

SEQ ID NO: 3840518 - RNA, 23 nt, Shigella flexneri 2a str. 2457T
agguaggcagucauaaaaucaau

SEQ ID NO: 3840519 - RNA, 20 nt, Shigella flexneri 2a str. 2457T
agguauaccgaaaucgccau

SEQ ID NO: 3840520 - RNA, 18 nt, Shigella flexneri 2a str. 2457T
agguaucgcgaaaaaaag

SEQ ID NO: 3840521 - RNA, 20 nt, Shigella flexneri 2a str. 2457T
agguaucgcgaaaaaaagau

SEQ ID NO: 3840522 - RNA, 11 nt, Shigella flexneri 2a str. 2457T
agguauucgcc

SEQ ID NO: 3840523 - RNA, 13 nt, Shigella flexneri 2a str. 2457T
agguauuuuguca

SEQ ID NO: 3840524 - RNA, 15 nt, Shigella flexneri 2a str. 2457T
agguauuuugucagc

SEQ ID NO: 3840525 - RNA, 15 nt, Shigella flexneri 2a str. 2457T
aggucaaagaaucaa

SEQ ID NO: 3840526 - RNA, 22 nt, Shigella flexneri 2a str. 2457T
aggucaaccuagccuuccuugu

SEQ ID NO: 3840527 - RNA, 17 nt, Shigella flexneri 2a str. 2457T
aggucacuuuuuucgcu

SEQ ID NO: 3840528 - RNA, 20 nt, Shigella flexneri 2a str. 2457T
aggucagagagccagcccca

SEQ ID NO: 3840529 - RNA, 20 nt, Shigella flexneri 2a str. 2457T
aggucagcaggagcagcccc

SEQ ID NO: 3840530 - RNA, 18 nt, Shigella flexneri 2a str. 2457T
aggucagguuugacauaa

SEQ ID NO: 3840531 - RNA, 13 nt, Shigella flexneri 2a str. 2457T
aggucaguaauga

SEQ ID NO: 3840532 - RNA, 19 nt, Shigella flexneri 2a str. 2457T
aggucaguaaugagcacag

SEQ ID NO: 3840533 - RNA, 16 nt, Shigella flexneri 2a str. 2457T
aggucaucacauccca

SEQ ID NO: 3840534 - RNA, 19 nt, Shigella flexneri 2a str. 2457T
aguaauuuugaacggguga

SEQ ID NO: 3840535 - RNA, 17 nt, Shigella flexneri 2a str. 2457T
aguacagccgccagaca

SEQ ID NO: 3840536 - RNA, 20 nt, Shigella flexneri 2a str. 2457T
aguacagcgcauaaaagcua

SEQ ID NO: 3840537 - RNA, 21 nt, Shigella flexneri 2a str. 2457T
aguacaggccgcaccaggauc

SEQ ID NO: 3840538 - RNA, 16 nt, Shigella flexneri 2a str. 2457T
aguacaucuuccacuu

SEQ ID NO: 3840539 - RNA, 17 nt, Shigella flexneri 2a str. 2457T
aguacaugaagcacugc

SEQ ID NO: 3840540 - RNA, 13 nt, Shigella flexneri 2a str. 2457T
aguacauuaaaau

SEQ ID NO: 3840541 - RNA, 18 nt, Shigella flexneri 2a str. 2457T
aguacauuguuuuccaga

SEQ ID NO: 3840542 - RNA, 18 nt, Shigella flexneri 2a str. 2457T
aguaccaucguccagcag

SEQ ID NO: 3840543 - RNA, 20 nt, Shigella flexneri 2a str. 2457T
aguaccaucguccagcagca

SEQ ID NO: 3840544 - RNA, 19 nt, Shigella flexneri 2a str. 2457T
aguaccauuugcauagcga

SEQ ID NO: 3840545 - RNA, 19 nt, Shigella flexneri 2a str. 2457T
aguaccauuuucgcuggca

SEQ ID NO: 3840546 - RNA, 22 nt, Shigella flexneri 2a str. 2457T
aguacccgaugcgcgaacugga

SEQ ID NO: 3840547 - RNA, 19 nt, Shigella flexneri 2a str. 2457T
aguaccgaacggagucggg

SEQ ID NO: 3840548 - RNA, 19 nt, Shigella flexneri 2a str. 2457T
aguaccgccaccaccagac

SEQ ID NO: 3840549 - RNA, 23 nt, Shigella flexneri 2a str. 2457T
aguaccgccgccauaaacagcag

SEQ ID NO: 3840550 - RNA, 21 nt, Shigella flexneri 2a str. 2457T
aguaccuccuggaucacaauc

SEQ ID NO: 3840551 - RNA, 15 nt, Shigella flexneri 2a str. 2457T
aguaccugcaaaccg

SEQ ID NO: 3840552 - RNA, 14 nt, Shigella flexneri 2a str. 2457T
aguacgaaauaacu

SEQ ID NO: 3840553 - RNA, 19 nt, Shigella flexneri 2a str. 2457T
aguacgccaaucugcaaaa

SEQ ID NO: 3840554 - RNA, 16 nt, Shigella flexneri 2a str. 2457T
aguacgccaucacgca

SEQ ID NO: 3840555 - RNA, 18 nt, Shigella flexneri 2a str. 2457T
aguacgcguacacuuucc

SEQ ID NO: 3840556 - RNA, 19 nt, Shigella flexneri 2a str. 2457T
aguacgcguacacuuuccu

SEQ ID NO: 3840557 - RNA, 13 nt, Shigella flexneri 2a str. 2457T
aguacggcagcaa

SEQ ID NO: 3840558 - RNA, 15 nt, Shigella flexneri 2a str. 2457T
aguacggcagcaauc

SEQ ID NO: 3840559 - RNA, 23 nt, Shigella flexneri 2a str. 2457T
aguacugugaaccucgaucagag

SEQ ID NO: 3840560 - RNA, 14 nt, Shigella flexneri 2a str. 2457T
aguacuuuggaagu

SEQ ID NO: 3840561 - RNA, 18 nt, Shigella flexneri 2a str. 2457T
aguacuuuggaaguauaa

SEQ ID NO: 3840562 - RNA, 15 nt, Shigella flexneri 2a str. 2457T
aguagaagaggaacc

SEQ ID NO: 3840563 - RNA, 13 nt, Shigella flexneri 2a str. 2457T
aguagagauaaac

SEQ ID NO: 3840564 - RNA, 21 nt, Shigella flexneri 2a str. 2457T
aguagagugguuuuucaacau

SEQ ID NO: 3840565 - RNA, 13 nt, Shigella flexneri 2a str. 2457T
aguagaucaacac

SEQ ID NO: 3840566 - RNA, 17 nt, Shigella flexneri 2a str. 2457T
aguagauucaacauaau

SEQ ID NO: 3840567 - RNA, 10 nt, Shigella flexneri 2a str. 2457T
aguagcaaag

SEQ ID NO: 3840568 - RNA, 20 nt, Shigella flexneri 2a str. 2457T
aguagccaauaccaaaauca

SEQ ID NO: 3840569 - RNA, 14 nt, Shigella flexneri 2a str. 2457T
aguagccagacaau

SEQ ID NO: 3840570 - RNA, 15 nt, Shigella flexneri 2a str. 2457T
aguagccaguaccac

SEQ ID NO: 3840571 - RNA, 14 nt, Shigella flexneri 2a str. 2457T
aguagccauuugau

SEQ ID NO: 3840572 - RNA, 20 nt, Shigella flexneri 2a str. 2457T
aguagcccaccuacaccggc

SEQ ID NO: 3840573 - RNA, 17 nt, Shigella flexneri 2a str. 2457T
aguagcgcaaucaccac

SEQ ID NO: 3840574 - RNA, 17 nt, Shigella flexneri 2a str. 2457T
aguagcggccugaccgc

SEQ ID NO: 3840575 - RNA, 19 nt, Shigella flexneri 2a str. 2457T
aguagcgucgccagcaguu

SEQ ID NO: 3840576 - RNA, 20 nt, Shigella flexneri 2a str. 2457T
aguagugguaacgcacacau

SEQ ID NO: 3840577 - RNA, 16 nt, Shigella flexneri 2a str. 2457T
aguaguucauccccuc

SEQ ID NO: 3840578 - RNA, 15 nt, Shigella flexneri 2a str. 2457T
aguauaacuacugau

SEQ ID NO: 3840579 - RNA, 14 nt, Shigella flexneri 2a str. 2457T
aguauagcggcaug

SEQ ID NO: 3840580 - RNA, 12 nt, Shigella flexneri 2a str. 2457T
aguaucaccauc

SEQ ID NO: 3840581 - RNA, 11 nt, Shigella flexneri 2a str. 2457T
aguaucaucau

SEQ ID NO: 3840582 - RNA, 22 nt, Shigella flexneri 2a str. 2457T
aguauccacacagacaauaaac

SEQ ID NO: 3840583 - RNA, 14 nt, Shigella flexneri 2a str. 2457T
aguauccacaggua

SEQ ID NO: 3840584 - RNA, 22 nt, Shigella flexneri 2a str. 2457T
aguauccaugcgcauuaagcca

SEQ ID NO: 3840585 - RNA, 21 nt, Shigella flexneri 2a str. 2457T
aguaucgcucaauauccugac

SEQ ID NO: 3840586 - RNA, 11 nt, Shigella flexneri 2a str. 2457T
aguaucuauuc

SEQ ID NO: 3840587 - RNA, 16 nt, Shigella flexneri 2a str. 2457T
aguaugagcaaacaau

SEQ ID NO: 3840588 - RNA, 15 nt, Shigella flexneri 2a str. 2457T
aguaugcgcgucaga

SEQ ID NO: 3840589 - RNA, 18 nt, Shigella flexneri 2a str. 2457T
aguauggaucaaaucucg

SEQ ID NO: 3840590 - RNA, 16 nt, Shigella flexneri 2a str. 2457T
aguauuaagccaguuc

SEQ ID NO: 3840591 - RNA, 18 nt, Shigella flexneri 2a str. 2457T
aguauucgcuccccugca

SEQ ID NO: 3840592 - RNA, 12 nt, Shigella flexneri 2a str. 2457T
aguauucuuuua

SEQ ID NO: 3840593 - RNA, 13 nt, Shigella flexneri 2a str. 2457T
aguauuuccagcu

SEQ ID NO: 3840594 - RNA, 19 nt, Shigella flexneri 2a str. 2457T
aguauuuggcggaauuucu

SEQ ID NO: 3840595 - RNA, 12 nt, Shigella flexneri 2a str. 2457T
aguauuuuuaau

SEQ ID NO: 3840596 - RNA, 19 nt, Shigella flexneri 2a str. 2457T
agucaaaagccuccgaccg

SEQ ID NO: 3840597 - RNA, 22 nt, Shigella flexneri 2a str. 2457T
agucaacaccuguugcgcgucg

SEQ ID NO: 3840598 - RNA, 14 nt, Shigella flexneri 2a str. 2457T
agucacaaacauca

SEQ ID NO: 3840599 - RNA, 15 nt, Shigella flexneri 2a str. 2457T
agucacaaacaucau

SEQ ID NO: 3840600 - RNA, 17 nt, Shigella flexneri 2a str. 2457T
agucaccgcccagugca

SEQ ID NO: 3840601 - RNA, 16 nt, Shigella flexneri 2a str. 2457T
agucacgacaaagaca

SEQ ID NO: 3840602 - RNA, 20 nt, Shigella flexneri 2a str. 2457T
agucacggaaucccguaauc

SEQ ID NO: 3840603 - RNA, 23 nt, Shigella flexneri 2a str. 2457T
agucacguuguaccacugguuga

SEQ ID NO: 3840604 - RNA, 15 nt, Shigella flexneri 2a str. 2457T
agucacuuuuuuccg

SEQ ID NO: 3840605 - RNA, 15 nt, Shigella flexneri 2a str. 2457T
agucagcccaacaaa

SEQ ID NO: 3840606 - RNA, 16 nt, Shigella flexneri 2a str. 2457T
agucagcgaacaccag

SEQ ID NO: 3840607 - RNA, 15 nt, Shigella flexneri 2a str. 2457T
agucagcucucagcc

SEQ ID NO: 3840608 - RNA, 17 nt, Shigella flexneri 2a str. 2457T
agucagucucaagggag

SEQ ID NO: 3840609 - RNA, 21 nt, Shigella flexneri 2a str. 2457T
agucaguguuaucaaaucacc

SEQ ID NO: 3840610 - RNA, 20 nt, Shigella flexneri 2a str. 2457T
agucaguuaucgcauuauca

SEQ ID NO: 3840611 - RNA, 17 nt, Shigella flexneri 2a str. 2457T
agucauaaccaguccau

SEQ ID NO: 3840612 - RNA, 16 nt, Shigella flexneri 2a str. 2457T
agucauacagccggua

SEQ ID NO: 3840613 - RNA, 15 nt, Shigella flexneri 2a str. 2457T
agucauagguucuuu

SEQ ID NO: 3840614 - RNA, 14 nt, Shigella flexneri 2a str. 2457T
agucauauucugaa

SEQ ID NO: 3840615 - RNA, 12 nt, Shigella flexneri 2a str. 2457T
agucaucaaucg

SEQ ID NO: 3840616 - RNA, 17 nt, Shigella flexneri 2a str. 2457T
agucaucacuuucagac

SEQ ID NO: 3840617 - RNA, 19 nt, Shigella flexneri 2a str. 2457T
agucaucacuuucagaccg

SEQ ID NO: 3840618 - RNA, 15 nt, Shigella flexneri 2a str. 2457T
agucaucagucugag

SEQ ID NO: 3840619 - RNA, 12 nt, Shigella flexneri 2a str. 2457T
agucaucaucag

SEQ ID NO: 3840620 - RNA, 16 nt, Shigella flexneri 2a str. 2457T
agucauccggcucgua

SEQ ID NO: 3840621 - RNA, 20 nt, Shigella flexneri 2a str. 2457T
agucauccuuaaagaaaaag

SEQ ID NO: 3840622 - RNA, 15 nt, Shigella flexneri 2a str. 2457T
agucaucgcauacaa

SEQ ID NO: 3840623 - RNA, 23 nt, Shigella flexneri 2a str. 2457T
agucaucgcauacaaaaacacau

SEQ ID NO: 3840624 - RNA, 16 nt, Shigella flexneri 2a str. 2457T
agucaucgcuuucgga

SEQ ID NO: 3840625 - RNA, 16 nt, Shigella flexneri 2a str. 2457T
agucaugcgagaagca

SEQ ID NO: 3840626 - RNA, 14 nt, Shigella flexneri 2a str. 2457T
agucaugcggugga

SEQ ID NO: 3840627 - RNA, 16 nt, Shigella flexneri 2a str. 2457T
agucauuaugcuggaa

SEQ ID NO: 3840628 - RNA, 15 nt, Shigella flexneri 2a str. 2457T
agucauuccggcccc

SEQ ID NO: 3840629 - RNA, 13 nt, Shigella flexneri 2a str. 2457T
agucauuccuuca

SEQ ID NO: 3840630 - RNA, 14 nt, Shigella flexneri 2a str. 2457T
agucauuccuucaa

SEQ ID NO: 3840631 - RNA, 22 nt, Shigella flexneri 2a str. 2457T
agucauugauucgaucaaacaa

SEQ ID NO: 3840632 - RNA, 18 nt, Shigella flexneri 2a str. 2457T
agugcccgaccacuucau

SEQ ID NO: 3840633 - RNA, 23 nt, Shigella flexneri 2a str. 2457T
agugccgcauccugcaccacgac

SEQ ID NO: 3840634 - RNA, 19 nt, Shigella flexneri 2a str. 2457T
agugccgcccaccacucga

SEQ ID NO: 3840635 - RNA, 21 nt, Shigella flexneri 2a str. 2457T
agugccggauguuugcauccg

SEQ ID NO: 3840636 - RNA, 17 nt, Shigella flexneri 2a str. 2457T
agugccgguggaagggc

SEQ ID NO: 3840637 - RNA, 16 nt, Shigella flexneri 2a str. 2457T
agugccguuccagcca

SEQ ID NO: 3840638 - RNA, 18 nt, Shigella flexneri 2a str. 2457T
agugccucgcuaaucucu

SEQ ID NO: 3840639 - RNA, 17 nt, Shigella flexneri 2a str. 2457T
agugccugugcaggcgu

SEQ ID NO: 3840640 - RNA, 22 nt, Shigella flexneri 2a str. 2457T
agugcgcguuuuuuaugccgga

SEQ ID NO: 3840641 - RNA, 17 nt, Shigella flexneri 2a str. 2457T
agugcgcucuucaacuu

SEQ ID NO: 3840642 - RNA, 18 nt, Shigella flexneri 2a str. 2457T
agugcggcagcggcuuca

SEQ ID NO: 3840643 - RNA, 16 nt, Shigella flexneri 2a str. 2457T
agugcguaagcgcgga

SEQ ID NO: 3840644 - RNA, 13 nt, Shigella flexneri 2a str. 2457T
agugcguacccag

SEQ ID NO: 3840645 - RNA, 23 nt, Shigella flexneri 2a str. 2457T
agugcguaucaauagcaguaauu

SEQ ID NO: 3840646 - RNA, 15 nt, Shigella flexneri 2a str. 2457T
agugcgugcgcugcu

SEQ ID NO: 3840647 - RNA, 21 nt, Shigella flexneri 2a str. 2457T
agugcuaugcgccacggaagc

SEQ ID NO: 3840648 - RNA, 20 nt, Shigella flexneri 2a str. 2457T
agugcugaguuucagaccaa

SEQ ID NO: 3840649 - RNA, 16 nt, Shigella flexneri 2a str. 2457T
agugcugccaucuucu

SEQ ID NO: 3840650 - RNA, 18 nt, Shigella flexneri 2a str. 2457T
agugcugcuuuugcuucu

SEQ ID NO: 3840651 - RNA, 22 nt, Shigella flexneri 2a str. 2457T
agugcuucgcggacaucgucca

SEQ ID NO: 3840652 - RNA, 19 nt, Shigella flexneri 2a str. 2457T
agugcuuucaucaaaaaau

SEQ ID NO: 3840653 - RNA, 19 nt, Shigella flexneri 2a str. 2457T
agugcuuucugaacugaac

SEQ ID NO: 3840654 - RNA, 18 nt, Shigella flexneri 2a str. 2457T
aguggaaaaauaacaaau

SEQ ID NO: 3840655 - RNA, 21 nt, Shigella flexneri 2a str. 2457T
aguggacgaacaguucaacgc

SEQ ID NO: 3840656 - RNA, 20 nt, Shigella flexneri 2a str. 2457T
aguggaucccagaagaauau

SEQ ID NO: 3840657 - RNA, 19 nt, Shigella flexneri 2a str. 2457T
aguggaugcgccauaccau

SEQ ID NO: 3840658 - RNA, 14 nt, Shigella flexneri 2a str. 2457T
aguggauuaucuuc

SEQ ID NO: 3840659 - RNA, 15 nt, Shigella flexneri 2a str. 2457T
aguggccacagauaa

SEQ ID NO: 3840660 - RNA, 13 nt, Shigella flexneri 2a str. 2457T
aguggcgcagagc

SEQ ID NO: 3840661 - RNA, 18 nt, Shigella flexneri 2a str. 2457T
aguggcuauuuaccaaua

SEQ ID NO: 3840662 - RNA, 15 nt, Shigella flexneri 2a str. 2457T
agugggauucaccaa

SEQ ID NO: 3840663 - RNA, 18 nt, Shigella flexneri 2a str. 2457T
aguggggcggagaugcgg

SEQ ID NO: 3840664 - RNA, 15 nt, Shigella flexneri 2a str. 2457T
aguggguuguaucaa

SEQ ID NO: 3840665 - RNA, 14 nt, Shigella flexneri 2a str. 2457T
aguggugcggcuga

SEQ ID NO: 3840666 - RNA, 12 nt, Shigella flexneri 2a str. 2457T
aguguaaaacag

SEQ ID NO: 3840667 - RNA, 13 nt, Shigella flexneri 2a str. 2457T
aguguaaaauucu

SEQ ID NO: 3840668 - RNA, 22 nt, Shigella flexneri 2a str. 2457T
aguguacagcggcagggaaaac

SEQ ID NO: 3840669 - RNA, 19 nt, Shigella flexneri 2a str. 2457T
aguguagcgcaucaggcuu

SEQ ID NO: 3840670 - RNA, 12 nt, Shigella flexneri 2a str. 2457T
aguguaguucug

SEQ ID NO: 3840671 - RNA, 14 nt, Shigella flexneri 2a str. 2457T
aguguccagcggca

SEQ ID NO: 3840672 - RNA, 18 nt, Shigella flexneri 2a str. 2457T
agugucuuaucuggcauu

SEQ ID NO: 3840673 - RNA, 19 nt, Shigella flexneri 2a str. 2457T
agugugaauauucagaaua

SEQ ID NO: 3840674 - RNA, 12 nt, Shigella flexneri 2a str. 2457T
aguguggcggcu

SEQ ID NO: 3840675 - RNA, 16 nt, Shigella flexneri 2a str. 2457T
agugugggaaaaauug

SEQ ID NO: 3840676 - RNA, 21 nt, Shigella flexneri 2a str. 2457T
aguguggggaaugauauuuuc

SEQ ID NO: 3840677 - RNA, 16 nt, Shigella flexneri 2a str. 2457T
aguguuggaucugauc

SEQ ID NO: 3840678 - RNA, 15 nt, Shigella flexneri 2a str. 2457T
aguguuggcgucaga

SEQ ID NO: 3840679 - RNA, 21 nt, Shigella flexneri 2a str. 2457T
aguguuggcgucagaccggca

SEQ ID NO: 3840680 - RNA, 15 nt, Shigella flexneri 2a str. 2457T
aguguuuaaauuucu

SEQ ID NO: 3840681 - RNA, 17 nt, Shigella flexneri 2a str. 2457T
aguguuuuauguucaga

SEQ ID NO: 3840682 - RNA, 21 nt, Shigella flexneri 2a str. 2457T
aguguuuuauguucagauaau

SEQ ID NO: 3840683 - RNA, 20 nt, Shigella flexneri 2a str. 2457T
aguuaaaauucaagacauca

SEQ ID NO: 3840684 - RNA, 19 nt, Shigella flexneri 2a str. 2457T
aguuaaacuuucauaaaca

SEQ ID NO: 3840685 - RNA, 19 nt, Shigella flexneri 2a str. 2457T
aguuaaaggugguguugac

SEQ ID NO: 3840686 - RNA, 20 nt, Shigella flexneri 2a str. 2457T
aguuaaccugaaaccggaaa

SEQ ID NO: 3840687 - RNA, 12 nt, Shigella flexneri 2a str. 2457T
aguuaagcaaaa

SEQ ID NO: 3840688 - RNA, 13 nt, Shigella flexneri 2a str. 2457T
aguuaagcaaaaa

SEQ ID NO: 3840689 - RNA, 23 nt, Shigella flexneri 2a str. 2457T
aguuaagcccaguucagcggcug

SEQ ID NO: 3840690 - RNA, 16 nt, Shigella flexneri 2a str. 2457T
aguuaauccacagcaa

SEQ ID NO: 3840691 - RNA, 18 nt, Shigella flexneri 2a str. 2457T
aguuaauccacagcaaug

SEQ ID NO: 3840692 - RNA, 23 nt, Shigella flexneri 2a str. 2457T
aguuaauucugagagcaugaaau

SEQ ID NO: 3840693 - RNA, 13 nt, Shigella flexneri 2a str. 2457T
aguuacacaucau

SEQ ID NO: 3840694 - RNA, 13 nt, Shigella flexneri 2a str. 2457T
aguuacagcucuc

SEQ ID NO: 3840695 - RNA, 19 nt, Shigella flexneri 2a str. 2457T
aguuacauuuuaauaauga

SEQ ID NO: 3840696 - RNA, 15 nt, Shigella flexneri 2a str. 2457T
aguuaccacgccuug

SEQ ID NO: 3840697 - RNA, 13 nt, Shigella flexneri 2a str. 2457T
aguuaccuguggc

SEQ ID NO: 3840698 - RNA, 14 nt, Shigella flexneri 2a str. 2457T
aguuacgugcugcg

SEQ ID NO: 3840699 - RNA, 14 nt, Shigella flexneri 2a str. 2457T
aguuagaguagcca

SEQ ID NO: 3840700 - RNA, 19 nt, Shigella flexneri 2a str. 2457T
aguuagcaaggauguggcu

SEQ ID NO: 3840701 - RNA, 15 nt, Shigella flexneri 2a str. 2457T
aguuauaacgacgaa

SEQ ID NO: 3840702 - RNA, 21 nt, Shigella flexneri 2a str. 2457T
aguuauacagacucaaaccaa

SEQ ID NO: 3840703 - RNA, 18 nt, Shigella flexneri 2a str. 2457T
aguuauuucauaaaucaa

SEQ ID NO: 3840704 - RNA, 22 nt, Shigella flexneri 2a str. 2457T
aguucaacgcccgcuuucacca

SEQ ID NO: 3840705 - RNA, 21 nt, Shigella flexneri 2a str. 2457T
aguucaacgccgcuaucagau

SEQ ID NO: 3840706 - RNA, 10 nt, Shigella flexneri 2a str. 2457T
aguucaacgg

SEQ ID NO: 3840707 - RNA, 17 nt, Shigella flexneri 2a str. 2457T
aguucaacggugucgau

SEQ ID NO: 3840708 - RNA, 14 nt, Shigella flexneri 2a str. 2457T
aguucacagcgcag

SEQ ID NO: 3840709 - RNA, 18 nt, Shigella flexneri 2a str. 2457T
aguucacccucauucacc

SEQ ID NO: 3840710 - RNA, 16 nt, Shigella flexneri 2a str. 2457T
aguucacgcagcuucu

SEQ ID NO: 3840711 - RNA, 20 nt, Shigella flexneri 2a str. 2457T
aguucacgcagguuagaaua

SEQ ID NO: 3840712 - RNA, 19 nt, Shigella flexneri 2a str. 2457T
aguucacgcgauuucucau

SEQ ID NO: 3840713 - RNA, 12 nt, Shigella flexneri 2a str. 2457T
aguucacugccg

SEQ ID NO: 3840714 - RNA, 23 nt, Shigella flexneri 2a str. 2457T
aguucacuugugcuguguggccu

SEQ ID NO: 3840715 - RNA, 22 nt, Shigella flexneri 2a str. 2457T
aguucagaagcugaagcagaaa

SEQ ID NO: 3840716 - RNA, 14 nt, Shigella flexneri 2a str. 2457T
aguucagcggcuga

SEQ ID NO: 3840717 - RNA, 19 nt, Shigella flexneri 2a str. 2457T
aguucaguaugaucuugcc

SEQ ID NO: 3840718 - RNA, 23 nt, Shigella flexneri 2a str. 2457T
aguucaguaugaucuugcccgga

SEQ ID NO: 3840719 - RNA, 16 nt, Shigella flexneri 2a str. 2457T
aguucagucagcagug

SEQ ID NO: 3840720 - RNA, 12 nt, Shigella flexneri 2a str. 2457T
aguucaucaacg

SEQ ID NO: 3840721 - RNA, 17 nt, Shigella flexneri 2a str. 2457T
aguucauccccucuucc

SEQ ID NO: 3840722 - RNA, 21 nt, Shigella flexneri 2a str. 2457T
aguucauccccucuuccauuu

SEQ ID NO: 3840723 - RNA, 18 nt, Shigella flexneri 2a str. 2457T
aguucauuuuucucaacg

SEQ ID NO: 3840724 - RNA, 20 nt, Shigella flexneri 2a str. 2457T
aguuccacauaaaguagcca

SEQ ID NO: 3840725 - RNA, 18 nt, Shigella flexneri 2a str. 2457T
aguuccacuauuucaaua

SEQ ID NO: 3840726 - RNA, 13 nt, Shigella flexneri 2a str. 2457T
aguuccagcauga

SEQ ID NO: 3840727 - RNA, 13 nt, Shigella flexneri 2a str. 2457T
aguuccaguucau

SEQ ID NO: 3840728 - RNA, 17 nt, Shigella flexneri 2a str. 2457T
aguuccgggaucaccag

SEQ ID NO: 3840729 - RNA, 18 nt, Shigella flexneri 2a str. 2457T
auaaacccaacggcaaac

SEQ ID NO: 3840730 - RNA, 23 nt, Shigella flexneri 2a str. 2457T
auaaaccgaugcaccacuuaacu

SEQ ID NO: 3840731 - RNA, 22 nt, Shigella flexneri 2a str. 2457T
auaaacgccauauucugaucgu

SEQ ID NO: 3840732 - RNA, 22 nt, Shigella flexneri 2a str. 2457T
auaaacgccggaugacacauca

SEQ ID NO: 3840733 - RNA, 21 nt, Shigella flexneri 2a str. 2457T
auaaacgccgucaucacaccg

SEQ ID NO: 3840734 - RNA, 22 nt, Shigella flexneri 2a str. 2457T
auaaacgccugcuuaucgcccu

SEQ ID NO: 3840735 - RNA, 16 nt, Shigella flexneri 2a str. 2457T
auaaacgcucggcaac

SEQ ID NO: 3840736 - RNA, 20 nt, Shigella flexneri 2a str. 2457T
auaaacgguuucagcagcgg

SEQ ID NO: 3840737 - RNA, 14 nt, Shigella flexneri 2a str. 2457T
auaaacuauccugu

SEQ ID NO: 3840738 - RNA, 17 nt, Shigella flexneri 2a str. 2457T
auaaacucaaucaggcu

SEQ ID NO: 3840739 - RNA, 16 nt, Shigella flexneri 2a str. 2457T
auaaacucaugggucu

SEQ ID NO: 3840740 - RNA, 21 nt, Shigella flexneri 2a str. 2457T
auaaacuuacugacaucaaac

SEQ ID NO: 3840741 - RNA, 13 nt, Shigella flexneri 2a str. 2457T
auaaagaaaaucu

SEQ ID NO: 3840742 - RNA, 15 nt, Shigella flexneri 2a str. 2457T
auaaagcagagcagg

SEQ ID NO: 3840743 - RNA, 15 nt, Shigella flexneri 2a str. 2457T
auaaagcagccuauu

SEQ ID NO: 3840744 - RNA, 13 nt, Shigella flexneri 2a str. 2457T
auaaagcgauaaa

SEQ ID NO: 3840745 - RNA, 17 nt, Shigella flexneri 2a str. 2457T
auaaagcugaucacaua

SEQ ID NO: 3840746 - RNA, 15 nt, Shigella flexneri 2a str. 2457T
auaaaggucaucaca

SEQ ID NO: 3840747 - RNA, 23 nt, Shigella flexneri 2a str. 2457T
auaaaggucaucacaucccagca

SEQ ID NO: 3840748 - RNA, 19 nt, Shigella flexneri 2a str. 2457T
auaaaggucgacagcagcc

SEQ ID NO: 3840749 - RNA, 14 nt, Shigella flexneri 2a str. 2457T
auaaaguagaaauu

SEQ ID NO: 3840750 - RNA, 23 nt, Shigella flexneri 2a str. 2457T
auaaaguguugagcuuuauccug

SEQ ID NO: 3840751 - RNA, 19 nt, Shigella flexneri 2a str. 2457T
auaaaguuagagccaggga

SEQ ID NO: 3840752 - RNA, 14 nt, Shigella flexneri 2a str. 2457T
auaaauaaaaagag

SEQ ID NO: 3840753 - RNA, 13 nt, Shigella flexneri 2a str. 2457T
auaaauaaaaauu

SEQ ID NO: 3840754 - RNA, 16 nt, Shigella flexneri 2a str. 2457T
auaaauaagaugcgag

SEQ ID NO: 3840755 - RNA, 18 nt, Shigella flexneri 2a str. 2457T
auaaauacagcguuaaaa

SEQ ID NO: 3840756 - RNA, 20 nt, Shigella flexneri 2a str. 2457T
auaaauauaaucaacaugau

SEQ ID NO: 3840757 - RNA, 15 nt, Shigella flexneri 2a str. 2457T
auaaauauauaaaaa

SEQ ID NO: 3840758 - RNA, 15 nt, Shigella flexneri 2a str. 2457T
auaaauaucaaagac

SEQ ID NO: 3840759 - RNA, 19 nt, Shigella flexneri 2a str. 2457T
auaaauauggugaaaguaa

SEQ ID NO: 3840760 - RNA, 10 nt, Shigella flexneri 2a str. 2457T
auaaaucccg

SEQ ID NO: 3840761 - RNA, 22 nt, Shigella flexneri 2a str. 2457T
auaaauccuuuguacaggauau

SEQ ID NO: 3840762 - RNA, 14 nt, Shigella flexneri 2a str. 2457T
auaaaucuccauuu

SEQ ID NO: 3840763 - RNA, 15 nt, Shigella flexneri 2a str. 2457T
auaaaugccgcaaug

SEQ ID NO: 3840764 - RNA, 13 nt, Shigella flexneri 2a str. 2457T
auaaauggcgaac

SEQ ID NO: 3840765 - RNA, 24 nt, Shigella flexneri 2a str. 2457T
auaaauuaacugcgcgauuaucau

SEQ ID NO: 3840766 - RNA, 13 nt, Shigella flexneri 2a str. 2457T
auaaauuccccgc

SEQ ID NO: 3840767 - RNA, 20 nt, Shigella flexneri 2a str. 2457T
auaaauucccgcagauaaau

SEQ ID NO: 3840768 - RNA, 17 nt, Shigella flexneri 2a str. 2457T
auaaauuccuaaaguug

SEQ ID NO: 3840769 - RNA, 19 nt, Shigella flexneri 2a str. 2457T
auaaauuccuaaaguuguu

SEQ ID NO: 3840770 - RNA, 16 nt, Shigella flexneri 2a str. 2457T
auaaauuucugccauu

SEQ ID NO: 3840771 - RNA, 21 nt, Shigella flexneri 2a str. 2457T
auaaauuucugccauuuugcu

SEQ ID NO: 3840772 - RNA, 21 nt, Shigella flexneri 2a str. 2457T
auaaauuugguucaauuuguu

SEQ ID NO: 3840773 - RNA, 19 nt, Shigella flexneri 2a str. 2457T
auaacaauacaucuuuuca

SEQ ID NO: 3840774 - RNA, 14 nt, Shigella flexneri 2a str. 2457T
auaacaccagccag

SEQ ID NO: 3840775 - RNA, 16 nt, Shigella flexneri 2a str. 2457T
auaacaccgauuuugu

SEQ ID NO: 3840776 - RNA, 10 nt, Shigella flexneri 2a str. 2457T
auaacagaau

SEQ ID NO: 3840777 - RNA, 23 nt, Shigella flexneri 2a str. 2457T
auaacagaccuuucgaacccaac

SEQ ID NO: 3840778 - RNA, 21 nt, Shigella flexneri 2a str. 2457T
auaacaggauuuucuaauauu

SEQ ID NO: 3840779 - RNA, 20 nt, Shigella flexneri 2a str. 2457T
auaacauccaacgguuugaa

SEQ ID NO: 3840780 - RNA, 14 nt, Shigella flexneri 2a str. 2457T
auaaccaaauaaaa

SEQ ID NO: 3840781 - RNA, 14 nt, Shigella flexneri 2a str. 2457T
auaaccaaaugacu

SEQ ID NO: 3840782 - RNA, 23 nt, Shigella flexneri 2a str. 2457T
auaaccaacggcgagccagcgca

SEQ ID NO: 3840783 - RNA, 21 nt, Shigella flexneri 2a str. 2457T
auaaccaauguggguguuaag

SEQ ID NO: 3840784 - RNA, 21 nt, Shigella flexneri 2a str. 2457T
auaaccagcguuuccagcacc

SEQ ID NO: 3840785 - RNA, 15 nt, Shigella flexneri 2a str. 2457T
auaaccaucagcucu

SEQ ID NO: 3840786 - RNA, 10 nt, Shigella flexneri 2a str. 2457T
auaaccaucg

SEQ ID NO: 3840787 - RNA, 21 nt, Shigella flexneri 2a str. 2457T
auaacccgcuguaaaugcugc

SEQ ID NO: 3840788 - RNA, 15 nt, Shigella flexneri 2a str. 2457T
auaaccgaaucccgc

SEQ ID NO: 3840789 - RNA, 20 nt, Shigella flexneri 2a str. 2457T
auaaccgaaucccgcugcaa

SEQ ID NO: 3840790 - RNA, 21 nt, Shigella flexneri 2a str. 2457T
auaaccgcaucaacagugcca

SEQ ID NO: 3840791 - RNA, 23 nt, Shigella flexneri 2a str. 2457T
auaaccgcugcaaaaaauugcgu

SEQ ID NO: 3840792 - RNA, 23 nt, Shigella flexneri 2a str. 2457T
auaaccguaauaguuauagccgu

SEQ ID NO: 3840793 - RNA, 22 nt, Shigella flexneri 2a str. 2457T
auaaccguacgcaucaccagac

SEQ ID NO: 3840794 - RNA, 19 nt, Shigella flexneri 2a str. 2457T
auaaccgucagcgcaugau

SEQ ID NO: 3840795 - RNA, 13 nt, Shigella flexneri 2a str. 2457T
auaaccguccagu

SEQ ID NO: 3840796 - RNA, 11 nt, Shigella flexneri 2a str. 2457T
auaaccuucaa

SEQ ID NO: 3840797 - RNA, 15 nt, Shigella flexneri 2a str. 2457T
auaacgaucucuuuc

SEQ ID NO: 3840798 - RNA, 20 nt, Shigella flexneri 2a str. 2457T
auaacgcaucggcuaaacca

SEQ ID NO: 3840799 - RNA, 18 nt, Shigella flexneri 2a str. 2457T
auaacgccggagagaaaa

SEQ ID NO: 3840800 - RNA, 17 nt, Shigella flexneri 2a str. 2457T
auaacgccuggcagugg

SEQ ID NO: 3840801 - RNA, 15 nt, Shigella flexneri 2a str. 2457T
auaacgcuuuucuca

SEQ ID NO: 3840802 - RNA, 21 nt, Shigella flexneri 2a str. 2457T
auaacggcaacggcggaucac

SEQ ID NO: 3840803 - RNA, 15 nt, Shigella flexneri 2a str. 2457T
auaacggugcaaccc

SEQ ID NO: 3840804 - RNA, 23 nt, Shigella flexneri 2a str. 2457T
auaacggugcaacccgccagguu

SEQ ID NO: 3840805 - RNA, 16 nt, Shigella flexneri 2a str. 2457T
auaacguaaaaacccg

SEQ ID NO: 3840806 - RNA, 17 nt, Shigella flexneri 2a str. 2457T
auaacguaggccugaua

SEQ ID NO: 3840807 - RNA, 19 nt, Shigella flexneri 2a str. 2457T
auaacgugacggcuuuuuu

SEQ ID NO: 3840808 - RNA, 15 nt, Shigella flexneri 2a str. 2457T
auaacguuauauccc

SEQ ID NO: 3840809 - RNA, 16 nt, Shigella flexneri 2a str. 2457T
auaacguuugacauag

SEQ ID NO: 3840810 - RNA, 16 nt, Shigella flexneri 2a str. 2457T
auaacucauauaacgc

SEQ ID NO: 3840811 - RNA, 21 nt, Shigella flexneri 2a str. 2457T
auaacuccccgagaaauacug

SEQ ID NO: 3840812 - RNA, 18 nt, Shigella flexneri 2a str. 2457T
auaacucuuugaugaaac

SEQ ID NO: 3840813 - RNA, 16 nt, Shigella flexneri 2a str. 2457T
auaacugaauaauaca

SEQ ID NO: 3840814 - RNA, 15 nt, Shigella flexneri 2a str. 2457T
auaacuggucaucaa

SEQ ID NO: 3840815 - RNA, 16 nt, Shigella flexneri 2a str. 2457T
auaacuggucaucaaa

SEQ ID NO: 3840816 - RNA, 12 nt, Shigella flexneri 2a str. 2457T
auaacuuccuga

SEQ ID NO: 3840817 - RNA, 17 nt, Shigella flexneri 2a str. 2457T
auaagacgcguuagcau

SEQ ID NO: 3840818 - RNA, 22 nt, Shigella flexneri 2a str. 2457T
auaagacuggcaaaugacauaa

SEQ ID NO: 3840819 - RNA, 19 nt, Shigella flexneri 2a str. 2457T
auaagauaacccugcauau

SEQ ID NO: 3840820 - RNA, 11 nt, Shigella flexneri 2a str. 2457T
auaagauacug

SEQ ID NO: 3840821 - RNA, 14 nt, Shigella flexneri 2a str. 2457T
auaagauacuggau

SEQ ID NO: 3840822 - RNA, 19 nt, Shigella flexneri 2a str. 2457T
auaagcaacgcggcgguga

SEQ ID NO: 3840823 - RNA, 13 nt, Shigella flexneri 2a str. 2457T
auaagcaaggcaa

SEQ ID NO: 3840824 - RNA, 20 nt, Shigella flexneri 2a str. 2457T
auaagcccagaacaaauaaa

SEQ ID NO: 3840825 - RNA, 15 nt, Shigella flexneri 2a str. 2457T
auaagcgcaagggua

SEQ ID NO: 3840826 - RNA, 14 nt, Shigella flexneri 2a str. 2457T
auacagcggccagc

SEQ ID NO: 3840827 - RNA, 16 nt, Shigella flexneri 2a str. 2457T
auacaggaacagccac

SEQ ID NO: 3840828 - RNA, 22 nt, Shigella flexneri 2a str. 2457T
auacaggcggguaaucuuucca

SEQ ID NO: 3840829 - RNA, 14 nt, Shigella flexneri 2a str. 2457T
auacagggaaagaa

SEQ ID NO: 3840830 - RNA, 21 nt, Shigella flexneri 2a str. 2457T
auacaggggccaguuccgccg

SEQ ID NO: 3840831 - RNA, 21 nt, Shigella flexneri 2a str. 2457T
auacauaaagucuuucuuacc

SEQ ID NO: 3840832 - RNA, 16 nt, Shigella flexneri 2a str. 2457T
auacauacgcaaaaaa

SEQ ID NO: 3840833 - RNA, 16 nt, Shigella flexneri 2a str. 2457T
auacauagcacaacag

SEQ ID NO: 3840834 - RNA, 22 nt, Shigella flexneri 2a str. 2457T
auacauagcgccucuuuauaaa

SEQ ID NO: 3840835 - RNA, 15 nt, Shigella flexneri 2a str. 2457T
auacaucgcgccaac

SEQ ID NO: 3840836 - RNA, 19 nt, Shigella flexneri 2a str. 2457T
auacaucugcaaauccugu

SEQ ID NO: 3840837 - RNA, 17 nt, Shigella flexneri 2a str. 2457T
auacaucuucaucaucc

SEQ ID NO: 3840838 - RNA, 21 nt, Shigella flexneri 2a str. 2457T
auacauguacauggugcacau

SEQ ID NO: 3840839 - RNA, 18 nt, Shigella flexneri 2a str. 2457T
auaccaaaaucaucaauu

SEQ ID NO: 3840840 - RNA, 21 nt, Shigella flexneri 2a str. 2457T
auaccaaaaucaucaauugcc

SEQ ID NO: 3840841 - RNA, 23 nt, Shigella flexneri 2a str. 2457T
auaccaagucucaagagugaaca

SEQ ID NO: 3840842 - RNA, 12 nt, Shigella flexneri 2a str. 2457T
auaccacacccg

SEQ ID NO: 3840843 - RNA, 16 nt, Shigella flexneri 2a str. 2457T
auaccacccgcaguga

SEQ ID NO: 3840844 - RNA, 21 nt, Shigella flexneri 2a str. 2457T
auaccaccggaauugugguga

SEQ ID NO: 3840845 - RNA, 17 nt, Shigella flexneri 2a str. 2457T
auaccacuuccagcaga

SEQ ID NO: 3840846 - RNA, 15 nt, Shigella flexneri 2a str. 2457T
auaccagaccuuuac

SEQ ID NO: 3840847 - RNA, 18 nt, Shigella flexneri 2a str. 2457T
auaccagcucgaucagau

SEQ ID NO: 3840848 - RNA, 20 nt, Shigella flexneri 2a str. 2457T
auaccaguccacccacguua

SEQ ID NO: 3840849 - RNA, 15 nt, Shigella flexneri 2a str. 2457T
auaccaucacaccuc

SEQ ID NO: 3840850 - RNA, 16 nt, Shigella flexneri 2a str. 2457T
auaccaucacaccucg

SEQ ID NO: 3840851 - RNA, 13 nt, Shigella flexneri 2a str. 2457T
auaccaucggcag

SEQ ID NO: 3840852 - RNA, 23 nt, Shigella flexneri 2a str. 2457T
auaccaucggcagcgccaaucgc

SEQ ID NO: 3840853 - RNA, 19 nt, Shigella flexneri 2a str. 2457T
auaccauggaagaaaaaua

SEQ ID NO: 3840854 - RNA, 20 nt, Shigella flexneri 2a str. 2457T
auaccauggaagaaaaauau

SEQ ID NO: 3840855 - RNA, 15 nt, Shigella flexneri 2a str. 2457T
auacccaaaaaauag

SEQ ID NO: 3840856 - RNA, 19 nt, Shigella flexneri 2a str. 2457T
auacccaacguaacaaaac

SEQ ID NO: 3840857 - RNA, 20 nt, Shigella flexneri 2a str. 2457T
auacccaacguaacaaaacu

SEQ ID NO: 3840858 - RNA, 17 nt, Shigella flexneri 2a str. 2457T
auacccaccgguccuaa

SEQ ID NO: 3840859 - RNA, 21 nt, Shigella flexneri 2a str. 2457T
auacccacugcgcaguguuug

SEQ ID NO: 3840860 - RNA, 21 nt, Shigella flexneri 2a str. 2457T
auacccagaaucucuuuuguu

SEQ ID NO: 3840861 - RNA, 12 nt, Shigella flexneri 2a str. 2457T
auacccagcacc

SEQ ID NO: 3840862 - RNA, 17 nt, Shigella flexneri 2a str. 2457T
auacccaguuucaugau

SEQ ID NO: 3840863 - RNA, 21 nt, Shigella flexneri 2a str. 2457T
auacccccaguaaaugacagc

SEQ ID NO: 3840864 - RNA, 20 nt, Shigella flexneri 2a str. 2457T
auacccgcauucgccgcugg

SEQ ID NO: 3840865 - RNA, 17 nt, Shigella flexneri 2a str. 2457T
auacccgccaaaccacu

SEQ ID NO: 3840866 - RNA, 16 nt, Shigella flexneri 2a str. 2457T
auaccgaaaucgccau

SEQ ID NO: 3840867 - RNA, 16 nt, Shigella flexneri 2a str. 2457T
auaccgauaucgccau

SEQ ID NO: 3840868 - RNA, 18 nt, Shigella flexneri 2a str. 2457T
auaccgccugcaaauaaa

SEQ ID NO: 3840869 - RNA, 23 nt, Shigella flexneri 2a str. 2457T
auaccgcguaauacaucagcuaa

SEQ ID NO: 3840870 - RNA, 19 nt, Shigella flexneri 2a str. 2457T
auaccggacacacuucauu

SEQ ID NO: 3840871 - RNA, 23 nt, Shigella flexneri 2a str. 2457T
auaccggacgacggcaucgccau

SEQ ID NO: 3840872 - RNA, 22 nt, Shigella flexneri 2a str. 2457T
auaccggagacgguuauauuua

SEQ ID NO: 3840873 - RNA, 15 nt, Shigella flexneri 2a str. 2457T
auaccggaucgcauc

SEQ ID NO: 3840874 - RNA, 16 nt, Shigella flexneri 2a str. 2457T
auaccggaucgcaucg

SEQ ID NO: 3840875 - RNA, 19 nt, Shigella flexneri 2a str. 2457T
auaccggcgucccaucggc

SEQ ID NO: 3840876 - RNA, 15 nt, Shigella flexneri 2a str. 2457T
auaccgggaucaggu

SEQ ID NO: 3840877 - RNA, 20 nt, Shigella flexneri 2a str. 2457T
auaccgucagcgaucagcau

SEQ ID NO: 3840878 - RNA, 18 nt, Shigella flexneri 2a str. 2457T
auaccgugcacaauauuu

SEQ ID NO: 3840879 - RNA, 22 nt, Shigella flexneri 2a str. 2457T
auaccuaacacgaucagccaua

SEQ ID NO: 3840880 - RNA, 17 nt, Shigella flexneri 2a str. 2457T
auaccuggcgcagcugc

SEQ ID NO: 3840881 - RNA, 15 nt, Shigella flexneri 2a str. 2457T
auaccugguccuuca

SEQ ID NO: 3840882 - RNA, 22 nt, Shigella flexneri 2a str. 2457T
auaccuucacagaaggccagga

SEQ ID NO: 3840883 - RNA, 15 nt, Shigella flexneri 2a str. 2457T
auaccuugcugcucc

SEQ ID NO: 3840884 - RNA, 18 nt, Shigella flexneri 2a str. 2457T
auaccuuucgauuucucu

SEQ ID NO: 3840885 - RNA, 14 nt, Shigella flexneri 2a str. 2457T
auacgaacgccugc

SEQ ID NO: 3840886 - RNA, 19 nt, Shigella flexneri 2a str. 2457T
auacgauuugucagcagcu

SEQ ID NO: 3840887 - RNA, 13 nt, Shigella flexneri 2a str. 2457T
auacgcaccgcuc

SEQ ID NO: 3840888 - RNA, 18 nt, Shigella flexneri 2a str. 2457T
auacgcauagcggcucac

SEQ ID NO: 3840889 - RNA, 17 nt, Shigella flexneri 2a str. 2457T
auacgcauaugcaucag

SEQ ID NO: 3840890 - RNA, 15 nt, Shigella flexneri 2a str. 2457T
auacgccaucgccag

SEQ ID NO: 3840891 - RNA, 16 nt, Shigella flexneri 2a str. 2457T
auacgccaucgccagc

SEQ ID NO: 3840892 - RNA, 19 nt, Shigella flexneri 2a str. 2457T
auacgccucacagggcucu

SEQ ID NO: 3840893 - RNA, 16 nt, Shigella flexneri 2a str. 2457T
auacgcgccacaucag

SEQ ID NO: 3840894 - RNA, 16 nt, Shigella flexneri 2a str. 2457T
auacgcucaucggcau

SEQ ID NO: 3840895 - RNA, 16 nt, Shigella flexneri 2a str. 2457T
auacgcuggcugaaca

SEQ ID NO: 3840896 - RNA, 21 nt, Shigella flexneri 2a str. 2457T
auacgcuggcugaacauuaaa

SEQ ID NO: 3840897 - RNA, 17 nt, Shigella flexneri 2a str. 2457T
auacggguuuuccccuu

SEQ ID NO: 3840898 - RNA, 15 nt, Shigella flexneri 2a str. 2457T
auacgucaucccaac

SEQ ID NO: 3840899 - RNA, 20 nt, Shigella flexneri 2a str. 2457T
auacgugccgguaaugcuga

SEQ ID NO: 3840900 - RNA, 22 nt, Shigella flexneri 2a str. 2457T
auacguugcauaaaugccgcaa

SEQ ID NO: 3840901 - RNA, 18 nt, Shigella flexneri 2a str. 2457T
auacguuucaccagcacu

SEQ ID NO: 3840902 - RNA, 21 nt, Shigella flexneri 2a str. 2457T
auacuccugauggucuauugc

SEQ ID NO: 3840903 - RNA, 13 nt, Shigella flexneri 2a str. 2457T
auacucuccucca

SEQ ID NO: 3840904 - RNA, 22 nt, Shigella flexneri 2a str. 2457T
auacucuuugacaacaucaucu

SEQ ID NO: 3840905 - RNA, 13 nt, Shigella flexneri 2a str. 2457T
auacugacauuaa

SEQ ID NO: 3840906 - RNA, 23 nt, Shigella flexneri 2a str. 2457T
auacugauaauaaauaacagugc

SEQ ID NO: 3840907 - RNA, 16 nt, Shigella flexneri 2a str. 2457T
auacugaucaucauua

SEQ ID NO: 3840908 - RNA, 14 nt, Shigella flexneri 2a str. 2457T
auacugcaucagcg

SEQ ID NO: 3840909 - RNA, 18 nt, Shigella flexneri 2a str. 2457T
auacugcgauugucgauc

SEQ ID NO: 3840910 - RNA, 22 nt, Shigella flexneri 2a str. 2457T
auacugcgauugucgaucgcau

SEQ ID NO: 3840911 - RNA, 22 nt, Shigella flexneri 2a str. 2457T
auacugcuccccgaacgauugu

SEQ ID NO: 3840912 - RNA, 17 nt, Shigella flexneri 2a str. 2457T
auacuggauuucauucg

SEQ ID NO: 3840913 - RNA, 16 nt, Shigella flexneri 2a str. 2457T
auacuggcuaagaagc

SEQ ID NO: 3840914 - RNA, 18 nt, Shigella flexneri 2a str. 2457T
auacuguuuaucuuccca

SEQ ID NO: 3840915 - RNA, 19 nt, Shigella flexneri 2a str. 2457T
auacuguuuaucuucccag

SEQ ID NO: 3840916 - RNA, 20 nt, Shigella flexneri 2a str. 2457T
auacuguuuaucuucccagc

SEQ ID NO: 3840917 - RNA, 16 nt, Shigella flexneri 2a str. 2457T
auacuuaaauaaugcu

SEQ ID NO: 3840918 - RNA, 17 nt, Shigella flexneri 2a str. 2457T
auacuuauaagcucaau

SEQ ID NO: 3840919 - RNA, 16 nt, Shigella flexneri 2a str. 2457T
auacuucaauauaugc

SEQ ID NO: 3840920 - RNA, 20 nt, Shigella flexneri 2a str. 2457T
auacuugcaagaucgcgcau

SEQ ID NO: 3840921 - RNA, 13 nt, Shigella flexneri 2a str. 2457T
auacuuucacaaa

SEQ ID NO: 3840922 - RNA, 17 nt, Shigella flexneri 2a str. 2457T
auacuuucacaaaaaua

SEQ ID NO: 3840923 - RNA, 18 nt, Shigella flexneri 2a str. 2457T
auauauccgaaaaaggau

SEQ ID NO: 3840924 - RNA, 17 nt, Shigella flexneri 2a str. 2457T
auauauugaauuugcau

SEQ ID NO: 3840925 - RNA, 19 nt, Shigella flexneri 2a str. 2457T
auauauugcaaucaucuug

SEQ ID NO: 3840926 - RNA, 16 nt, Shigella flexneri 2a str. 2457T
auauauuuuuaaauau

SEQ ID NO: 3840927 - RNA, 18 nt, Shigella flexneri 2a str. 2457T
auauauuuuuaaauauaa

SEQ ID NO: 3840928 - RNA, 13 nt, Shigella flexneri 2a str. 2457T
auaucaaauaaaa

SEQ ID NO: 3840929 - RNA, 19 nt, Shigella flexneri 2a str. 2457T
auaucaacaauacgcaccg

SEQ ID NO: 3840930 - RNA, 17 nt, Shigella flexneri 2a str. 2457T
auaucaaccaguugugc

SEQ ID NO: 3840931 - RNA, 12 nt, Shigella flexneri 2a str. 2457T
auaucaaccuga

SEQ ID NO: 3840932 - RNA, 14 nt, Shigella flexneri 2a str. 2457T
auaucaagcaugau

SEQ ID NO: 3840933 - RNA, 14 nt, Shigella flexneri 2a str. 2457T
auaucaagccaugc

SEQ ID NO: 3840934 - RNA, 13 nt, Shigella flexneri 2a str. 2457T
auaucaauaguaa

SEQ ID NO: 3840935 - RNA, 15 nt, Shigella flexneri 2a str. 2457T
auaucaucauuugca

SEQ ID NO: 3840936 - RNA, 22 nt, Shigella flexneri 2a str. 2457T
auauccacgcgauacuuuuuca

SEQ ID NO: 3840937 - RNA, 16 nt, Shigella flexneri 2a str. 2457T
auauccagcgccgagg

SEQ ID NO: 3840938 - RNA, 12 nt, Shigella flexneri 2a str. 2457T
auauccaggcua

SEQ ID NO: 3840939 - RNA, 22 nt, Shigella flexneri 2a str. 2457T
auauccaguucugcuucaacau

SEQ ID NO: 3840940 - RNA, 21 nt, Shigella flexneri 2a str. 2457T
auauccauagucacuaccugu

SEQ ID NO: 3840941 - RNA, 19 nt, Shigella flexneri 2a str. 2457T
auaucccgccagcaccagc

SEQ ID NO: 3840942 - RNA, 14 nt, Shigella flexneri 2a str. 2457T
auaucccuuccucc

SEQ ID NO: 3840943 - RNA, 18 nt, Shigella flexneri 2a str. 2457T
auauccguagugaaaaag

SEQ ID NO: 3840944 - RNA, 18 nt, Shigella flexneri 2a str. 2457T
auauccgucacuucagga

SEQ ID NO: 3840945 - RNA, 16 nt, Shigella flexneri 2a str. 2457T
auauccucaagaauau

SEQ ID NO: 3840946 - RNA, 14 nt, Shigella flexneri 2a str. 2457T
auauccugauacuc

SEQ ID NO: 3840947 - RNA, 13 nt, Shigella flexneri 2a str. 2457T
auauccugcaaau

SEQ ID NO: 3840948 - RNA, 16 nt, Shigella flexneri 2a str. 2457T
auauccugcaaauuca

SEQ ID NO: 3840949 - RNA, 19 nt, Shigella flexneri 2a str. 2457T
auauccugcgcuuccugca

SEQ ID NO: 3840950 - RNA, 16 nt, Shigella flexneri 2a str. 2457T
auaucgaagaacugcu

SEQ ID NO: 3840951 - RNA, 19 nt, Shigella flexneri 2a str. 2457T
auaucgacgaaccauuucg

SEQ ID NO: 3840952 - RNA, 21 nt, Shigella flexneri 2a str. 2457T
auaucgacgaaccauuucgau

SEQ ID NO: 3840953 - RNA, 14 nt, Shigella flexneri 2a str. 2457T
auaucgacgaccug

SEQ ID NO: 3840954 - RNA, 17 nt, Shigella flexneri 2a str. 2457T
auaucgccauuaaacaa

SEQ ID NO: 3840955 - RNA, 19 nt, Shigella flexneri 2a str. 2457T
auaucgccauuaaacaacc

SEQ ID NO: 3840956 - RNA, 15 nt, Shigella flexneri 2a str. 2457T
auaucgcgcagaaau

SEQ ID NO: 3840957 - RNA, 16 nt, Shigella flexneri 2a str. 2457T
auaucgcgcagaaauu

SEQ ID NO: 3840958 - RNA, 17 nt, Shigella flexneri 2a str. 2457T
auaucgcggauaugcag

SEQ ID NO: 3840959 - RNA, 16 nt, Shigella flexneri 2a str. 2457T
auaucgcuggcagaaa

SEQ ID NO: 3840960 - RNA, 19 nt, Shigella flexneri 2a str. 2457T
auaucgcugucgccauccc

SEQ ID NO: 3840961 - RNA, 14 nt, Shigella flexneri 2a str. 2457T
auaucggcauugcu

SEQ ID NO: 3840962 - RNA, 19 nt, Shigella flexneri 2a str. 2457T
auaucggccaucuguucug

SEQ ID NO: 3840963 - RNA, 19 nt, Shigella flexneri 2a str. 2457T
auaucggcccggcuuucuu

SEQ ID NO: 3840964 - RNA, 13 nt, Shigella flexneri 2a str. 2457T
auaucguggcacg

SEQ ID NO: 3840965 - RNA, 24 nt, Shigella flexneri 2a str. 2457T
auaucguucaagagacugcuggcu

SEQ ID NO: 3840966 - RNA, 20 nt, Shigella flexneri 2a str. 2457T
auaucuaugguuuuuucuac

SEQ ID NO: 3840967 - RNA, 21 nt, Shigella flexneri 2a str. 2457T
auaucugccagauaauggcug

SEQ ID NO: 3840968 - RNA, 19 nt, Shigella flexneri 2a str. 2457T
auaucugccggaagacaca

SEQ ID NO: 3840969 - RNA, 15 nt, Shigella flexneri 2a str. 2457T
auaucuucaacgcac

SEQ ID NO: 3840970 - RNA, 12 nt, Shigella flexneri 2a str. 2457T
auaucuuuuuug

SEQ ID NO: 3840971 - RNA, 21 nt, Shigella flexneri 2a str. 2457T
auaugaccauugguaauggga

SEQ ID NO: 3840972 - RNA, 20 nt, Shigella flexneri 2a str. 2457T
auaugagcgauuuuuuauag

SEQ ID NO: 3840973 - RNA, 15 nt, Shigella flexneri 2a str. 2457T
auaugagcgcaaaug

SEQ ID NO: 3840974 - RNA, 14 nt, Shigella flexneri 2a str. 2457T
auaugauuuaaaaa

SEQ ID NO: 3840975 - RNA, 22 nt, Shigella flexneri 2a str. 2457T
auaugcaacguuaccguaacca

SEQ ID NO: 3840976 - RNA, 22 nt, Shigella flexneri 2a str. 2457T
auaugcacaugaugauggcuau

SEQ ID NO: 3840977 - RNA, 19 nt, Shigella flexneri 2a str. 2457T
auaugcaccuuugucacuu

SEQ ID NO: 3840978 - RNA, 16 nt, Shigella flexneri 2a str. 2457T
auaugcagcagccagu

SEQ ID NO: 3840979 - RNA, 20 nt, Shigella flexneri 2a str. 2457T
auaugccgcccuaaagggcg

SEQ ID NO: 3840980 - RNA, 15 nt, Shigella flexneri 2a str. 2457T
auaugccggcaucaa

SEQ ID NO: 3840981 - RNA, 16 nt, Shigella flexneri 2a str. 2457T
auaugccggcaucaaa

SEQ ID NO: 3840982 - RNA, 13 nt, Shigella flexneri 2a str. 2457T
auaugcgcuggca

SEQ ID NO: 3840983 - RNA, 15 nt, Shigella flexneri 2a str. 2457T
auaugcgcuggcagu

SEQ ID NO: 3840984 - RNA, 19 nt, Shigella flexneri 2a str. 2457T
auaugcgggcguuuugcuu

SEQ ID NO: 3840985 - RNA, 15 nt, Shigella flexneri 2a str. 2457T
auaugcuggcagugg

SEQ ID NO: 3840986 - RNA, 13 nt, Shigella flexneri 2a str. 2457T
auauggaaaaaua

SEQ ID NO: 3840987 - RNA, 16 nt, Shigella flexneri 2a str. 2457T
auauggcccaucaucu

SEQ ID NO: 3840988 - RNA, 18 nt, Shigella flexneri 2a str. 2457T
auauggccguuuucccca

SEQ ID NO: 3840989 - RNA, 18 nt, Shigella flexneri 2a str. 2457T
auauggggcagaugggcu

SEQ ID NO: 3840990 - RNA, 13 nt, Shigella flexneri 2a str. 2457T
auaugucgcgcca

SEQ ID NO: 3840991 - RNA, 17 nt, Shigella flexneri 2a str. 2457T
auaugucguuauauaaa

SEQ ID NO: 3840992 - RNA, 13 nt, Shigella flexneri 2a str. 2457T
auauguucagaaa

SEQ ID NO: 3840993 - RNA, 22 nt, Shigella flexneri 2a str. 2457T
auauuaaauuuuuucacuguuc

SEQ ID NO: 3840994 - RNA, 13 nt, Shigella flexneri 2a str. 2457T
auauuaacgacaa

SEQ ID NO: 3840995 - RNA, 19 nt, Shigella flexneri 2a str. 2457T
auauuaaggguaaaaggau

SEQ ID NO: 3840996 - RNA, 18 nt, Shigella flexneri 2a str. 2457T
auauuacaacguauuaua

SEQ ID NO: 3840997 - RNA, 17 nt, Shigella flexneri 2a str. 2457T
auauuacaucuuaaucu

SEQ ID NO: 3840998 - RNA, 16 nt, Shigella flexneri 2a str. 2457T
auauuacgaauauaaa

SEQ ID NO: 3840999 - RNA, 18 nt, Shigella flexneri 2a str. 2457T
auauuacgaauauaaaua

SEQ ID NO: 3841000 - RNA, 20 nt, Shigella flexneri 2a str. 2457T
auauuacgaauauaaauauu

SEQ ID NO: 3841001 - RNA, 22 nt, Shigella flexneri 2a str. 2457T
auauuacgaauauaaauauuuu

SEQ ID NO: 3841002 - RNA, 19 nt, Shigella flexneri 2a str. 2457T
auauuacgagucacaaaca

SEQ ID NO: 3841003 - RNA, 23 nt, Shigella flexneri 2a str. 2457T
auauuacgagucacaaacaucau

SEQ ID NO: 3841004 - RNA, 17 nt, Shigella flexneri 2a str. 2457T
auauuagcauuaaguaa

SEQ ID NO: 3841005 - RNA, 20 nt, Shigella flexneri 2a str. 2457T
auauuagccgccagcucuuu

SEQ ID NO: 3841006 - RNA, 22 nt, Shigella flexneri 2a str. 2457T
auauuaucagcaaagcaaauuu

SEQ ID NO: 3841007 - RNA, 21 nt, Shigella flexneri 2a str. 2457T
auauuauuaauagcauaucga

SEQ ID NO: 3841008 - RNA, 17 nt, Shigella flexneri 2a str. 2457T
auauuauugaaaucacu

SEQ ID NO: 3841009 - RNA, 15 nt, Shigella flexneri 2a str. 2457T
auauucaacaccgau

SEQ ID NO: 3841010 - RNA, 17 nt, Shigella flexneri 2a str. 2457T
auauucaacaccgaugc

SEQ ID NO: 3841011 - RNA, 17 nt, Shigella flexneri 2a str. 2457T
auauucaacgucacugg

SEQ ID NO: 3841012 - RNA, 13 nt, Shigella flexneri 2a str. 2457T
auauucaauugga

SEQ ID NO: 3841013 - RNA, 12 nt, Shigella flexneri 2a str. 2457T
auauucaccacg

SEQ ID NO: 3841014 - RNA, 13 nt, Shigella flexneri 2a str. 2457T
auauucagcagca

SEQ ID NO: 3841015 - RNA, 14 nt, Shigella flexneri 2a str. 2457T
auauucagcagcag

SEQ ID NO: 3841016 - RNA, 20 nt, Shigella flexneri 2a str. 2457T
auauucaggcguugaaaaau

SEQ ID NO: 3841017 - RNA, 21 nt, Shigella flexneri 2a str. 2457T
auauucaggcguugaaaaauc

SEQ ID NO: 3841018 - RNA, 11 nt, Shigella flexneri 2a str. 2457T
auauucauuuu

SEQ ID NO: 3841019 - RNA, 21 nt, Shigella flexneri 2a str. 2457T
auauuccccggucagcagcac

SEQ ID NO: 3841020 - RNA, 21 nt, Shigella flexneri 2a str. 2457T
auauuccgcaccugccagcgc

SEQ ID NO: 3841021 - RNA, 22 nt, Shigella flexneri 2a str. 2457T
aucaauagcaacugauuuauag

SEQ ID NO: 3841022 - RNA, 20 nt, Shigella flexneri 2a str. 2457T
aucaauagcaguaauuuuac

SEQ ID NO: 3841023 - RNA, 18 nt, Shigella flexneri 2a str. 2457T
aucaauagugaacugacu

SEQ ID NO: 3841024 - RNA, 13 nt, Shigella flexneri 2a str. 2457T
aucaauauauugc

SEQ ID NO: 3841025 - RNA, 14 nt, Shigella flexneri 2a str. 2457T
aucaauauccaccg

SEQ ID NO: 3841026 - RNA, 15 nt, Shigella flexneri 2a str. 2457T
aucaauauccaccgg

SEQ ID NO: 3841027 - RNA, 12 nt, Shigella flexneri 2a str. 2457T
aucaauauuaag

SEQ ID NO: 3841028 - RNA, 22 nt, Shigella flexneri 2a str. 2457T
aucaauccaguguaaaacagca

SEQ ID NO: 3841029 - RNA, 15 nt, Shigella flexneri 2a str. 2457T
aucaaucccaucagg

SEQ ID NO: 3841030 - RNA, 15 nt, Shigella flexneri 2a str. 2457T
aucaaucgcaaucug

SEQ ID NO: 3841031 - RNA, 18 nt, Shigella flexneri 2a str. 2457T
aucaaucuuuacacacaa

SEQ ID NO: 3841032 - RNA, 16 nt, Shigella flexneri 2a str. 2457T
aucaaugaugaacgcc

SEQ ID NO: 3841033 - RNA, 15 nt, Shigella flexneri 2a str. 2457T
aucaauugcaggaag

SEQ ID NO: 3841034 - RNA, 20 nt, Shigella flexneri 2a str. 2457T
aucaauugcguuaaaaucag

SEQ ID NO: 3841035 - RNA, 15 nt, Shigella flexneri 2a str. 2457T
aucaauugcuaccga

SEQ ID NO: 3841036 - RNA, 23 nt, Shigella flexneri 2a str. 2457T
aucacaaaacgaauaauugcugg

SEQ ID NO: 3841037 - RNA, 23 nt, Shigella flexneri 2a str. 2457T
aucacaaucggcuuucaccgccu

SEQ ID NO: 3841038 - RNA, 14 nt, Shigella flexneri 2a str. 2457T
aucacacagcgguu

SEQ ID NO: 3841039 - RNA, 12 nt, Shigella flexneri 2a str. 2457T
aucacaccgcga

SEQ ID NO: 3841040 - RNA, 20 nt, Shigella flexneri 2a str. 2457T
aucacaccgcgaucuuccac

SEQ ID NO: 3841041 - RNA, 13 nt, Shigella flexneri 2a str. 2457T
aucacaggcgcga

SEQ ID NO: 3841042 - RNA, 21 nt, Shigella flexneri 2a str. 2457T
aucacaucaucaucgccaggc

SEQ ID NO: 3841043 - RNA, 12 nt, Shigella flexneri 2a str. 2457T
aucacauccagc

SEQ ID NO: 3841044 - RNA, 13 nt, Shigella flexneri 2a str. 2457T
aucacaucccagc

SEQ ID NO: 3841045 - RNA, 20 nt, Shigella flexneri 2a str. 2457T
aucacauccggcaauauuca

SEQ ID NO: 3841046 - RNA, 17 nt, Shigella flexneri 2a str. 2457T
aucacaucgcgcucgua

SEQ ID NO: 3841047 - RNA, 16 nt, Shigella flexneri 2a str. 2457T
aucacaucgcuggugg

SEQ ID NO: 3841048 - RNA, 22 nt, Shigella flexneri 2a str. 2457T
aucaccaauacgcauaugcauc

SEQ ID NO: 3841049 - RNA, 22 nt, Shigella flexneri 2a str. 2457T
aucaccacaauauuauggcugu

SEQ ID NO: 3841050 - RNA, 15 nt, Shigella flexneri 2a str. 2457T
aucaccacagacaaa

SEQ ID NO: 3841051 - RNA, 22 nt, Shigella flexneri 2a str. 2457T
aucaccaccaacgcacacaugc

SEQ ID NO: 3841052 - RNA, 15 nt, Shigella flexneri 2a str. 2457T
aucaccaccacgacc

SEQ ID NO: 3841053 - RNA, 22 nt, Shigella flexneri 2a str. 2457T
aucaccagaucguaauggucgu

SEQ ID NO: 3841054 - RNA, 15 nt, Shigella flexneri 2a str. 2457T
aucaccagauugaac

SEQ ID NO: 3841055 - RNA, 12 nt, Shigella flexneri 2a str. 2457T
aucaccagcgca

SEQ ID NO: 3841056 - RNA, 22 nt, Shigella flexneri 2a str. 2457T
aucaccagcggugguagcgaug

SEQ ID NO: 3841057 - RNA, 16 nt, Shigella flexneri 2a str. 2457T
aucaccauaaaucaga

SEQ ID NO: 3841058 - RNA, 17 nt, Shigella flexneri 2a str. 2457T
aucaccccgcccgauaa

SEQ ID NO: 3841059 - RNA, 17 nt, Shigella flexneri 2a str. 2457T
aucaccgcacggcgagu

SEQ ID NO: 3841060 - RNA, 20 nt, Shigella flexneri 2a str. 2457T
aucaccgccacuaccaucag

SEQ ID NO: 3841061 - RNA, 22 nt, Shigella flexneri 2a str. 2457T
aucaccgccacuaccaucaggu

SEQ ID NO: 3841062 - RNA, 15 nt, Shigella flexneri 2a str. 2457T
aucaccgccagcaag

SEQ ID NO: 3841063 - RNA, 16 nt, Shigella flexneri 2a str. 2457T
aucaccgccagcggcg

SEQ ID NO: 3841064 - RNA, 17 nt, Shigella flexneri 2a str. 2457T
aucaccguucagcuugc

SEQ ID NO: 3841065 - RNA, 19 nt, Shigella flexneri 2a str. 2457T
aucaccguuuaggcgucac

SEQ ID NO: 3841066 - RNA, 16 nt, Shigella flexneri 2a str. 2457T
aucaccucuuuuucca

SEQ ID NO: 3841067 - RNA, 22 nt, Shigella flexneri 2a str. 2457T
aucaccucuuuuuccacuucca

SEQ ID NO: 3841068 - RNA, 19 nt, Shigella flexneri 2a str. 2457T
aucaccugcauacaaauaa

SEQ ID NO: 3841069 - RNA, 15 nt, Shigella flexneri 2a str. 2457T
aucaccugcuggacg

SEQ ID NO: 3841070 - RNA, 23 nt, Shigella flexneri 2a str. 2457T
aucaccuuacggcacuccucuuc

SEQ ID NO: 3841071 - RNA, 11 nt, Shigella flexneri 2a str. 2457T
aucacgaugca

SEQ ID NO: 3841072 - RNA, 18 nt, Shigella flexneri 2a str. 2457T
aucacgcaaccacaacgc

SEQ ID NO: 3841073 - RNA, 12 nt, Shigella flexneri 2a str. 2457T
aucacgcaucac

SEQ ID NO: 3841074 - RNA, 13 nt, Shigella flexneri 2a str. 2457T
aucacgcaucacc

SEQ ID NO: 3841075 - RNA, 17 nt, Shigella flexneri 2a str. 2457T
aucacgcaucgcgaaau

SEQ ID NO: 3841076 - RNA, 14 nt, Shigella flexneri 2a str. 2457T
aucacgcauggaca

SEQ ID NO: 3841077 - RNA, 20 nt, Shigella flexneri 2a str. 2457T
aucacgccaauaccgcccag

SEQ ID NO: 3841078 - RNA, 15 nt, Shigella flexneri 2a str. 2457T
aucacgcgccugcca

SEQ ID NO: 3841079 - RNA, 17 nt, Shigella flexneri 2a str. 2457T
aucacgcugcugauuaa

SEQ ID NO: 3841080 - RNA, 18 nt, Shigella flexneri 2a str. 2457T
aucacggguaggagccac

SEQ ID NO: 3841081 - RNA, 19 nt, Shigella flexneri 2a str. 2457T
aucacgucggcguuuucug

SEQ ID NO: 3841082 - RNA, 21 nt, Shigella flexneri 2a str. 2457T
aucacguugcuguugguucag

SEQ ID NO: 3841083 - RNA, 14 nt, Shigella flexneri 2a str. 2457T
aucacuaacgacau

SEQ ID NO: 3841084 - RNA, 17 nt, Shigella flexneri 2a str. 2457T
aucacuaccuucuuccc

SEQ ID NO: 3841085 - RNA, 23 nt, Shigella flexneri 2a str. 2457T
aucacuccauccagcaacaacag

SEQ ID NO: 3841086 - RNA, 14 nt, Shigella flexneri 2a str. 2457T
aucacucggggcuu

SEQ ID NO: 3841087 - RNA, 19 nt, Shigella flexneri 2a str. 2457T
aucacucggggcuuuucuc

SEQ ID NO: 3841088 - RNA, 14 nt, Shigella flexneri 2a str. 2457T
aucacucugccgua

SEQ ID NO: 3841089 - RNA, 14 nt, Shigella flexneri 2a str. 2457T
aucacuuccagcag

SEQ ID NO: 3841090 - RNA, 17 nt, Shigella flexneri 2a str. 2457T
aucacuuucaaaagccc

SEQ ID NO: 3841091 - RNA, 18 nt, Shigella flexneri 2a str. 2457T
aucacuuugcgcucgcug

SEQ ID NO: 3841092 - RNA, 17 nt, Shigella flexneri 2a str. 2457T
aucacuuuugaaaucaa

SEQ ID NO: 3841093 - RNA, 18 nt, Shigella flexneri 2a str. 2457T
aucagaaacacacuuucc

SEQ ID NO: 3841094 - RNA, 19 nt, Shigella flexneri 2a str. 2457T
aucagaaacacacuuucca

SEQ ID NO: 3841095 - RNA, 14 nt, Shigella flexneri 2a str. 2457T
aucagaacguaaac

SEQ ID NO: 3841096 - RNA, 19 nt, Shigella flexneri 2a str. 2457T
aucagaaugcgcucuuccg

SEQ ID NO: 3841097 - RNA, 14 nt, Shigella flexneri 2a str. 2457T
aucagaauuuuucg

SEQ ID NO: 3841098 - RNA, 22 nt, Shigella flexneri 2a str. 2457T
aucagaauuuuucgcuaaaaaa

SEQ ID NO: 3841099 - RNA, 20 nt, Shigella flexneri 2a str. 2457T
aucagacaaaugucacugcu

SEQ ID NO: 3841100 - RNA, 22 nt, Shigella flexneri 2a str. 2457T
aucagacacaauaauuuuauug

SEQ ID NO: 3841101 - RNA, 21 nt, Shigella flexneri 2a str. 2457T
aucagaccuacaaaaccugca

SEQ ID NO: 3841102 - RNA, 19 nt, Shigella flexneri 2a str. 2457T
aucagaccuucgcuaucaa

SEQ ID NO: 3841103 - RNA, 16 nt, Shigella flexneri 2a str. 2457T
aucagacgacccacga

SEQ ID NO: 3841104 - RNA, 16 nt, Shigella flexneri 2a str. 2457T
aucagacgcuuacguu

SEQ ID NO: 3841105 - RNA, 21 nt, Shigella flexneri 2a str. 2457T
aucagacuggcgauuauccau

SEQ ID NO: 3841106 - RNA, 11 nt, Shigella flexneri 2a str. 2457T
aucagagauuc

SEQ ID NO: 3841107 - RNA, 18 nt, Shigella flexneri 2a str. 2457T
aucagaguugaaaaacau

SEQ ID NO: 3841108 - RNA, 15 nt, Shigella flexneri 2a str. 2457T
aucagauaaaauaca

SEQ ID NO: 3841109 - RNA, 23 nt, Shigella flexneri 2a str. 2457T
aucagaucguugaacccggcauc

SEQ ID NO: 3841110 - RNA, 16 nt, Shigella flexneri 2a str. 2457T
aucagauggcggcugg

SEQ ID NO: 3841111 - RNA, 19 nt, Shigella flexneri 2a str. 2457T
aucagauggcggcuggcgc

SEQ ID NO: 3841112 - RNA, 22 nt, Shigella flexneri 2a str. 2457T
aucagauucacgguauuauuca

SEQ ID NO: 3841113 - RNA, 17 nt, Shigella flexneri 2a str. 2457T
aucagauugccacagga

SEQ ID NO: 3841114 - RNA, 13 nt, Shigella flexneri 2a str. 2457T
aucagcaaaucca

SEQ ID NO: 3841115 - RNA, 16 nt, Shigella flexneri 2a str. 2457T
aucagcaacgaaguaa

SEQ ID NO: 3841116 - RNA, 18 nt, Shigella flexneri 2a str. 2457T
aucagcaacucuggugga

SEQ ID NO: 3841117 - RNA, 13 nt, Shigella flexneri 2a str. 2457T
aucagcaacuggc

SEQ ID NO: 3841118 - RNA, 17 nt, Shigella flexneri 2a str. 2457T
aucauggcauccuguuu

SEQ ID NO: 3841119 - RNA, 19 nt, Shigella flexneri 2a str. 2457T
aucauggcgaugagaauca

SEQ ID NO: 3841120 - RNA, 14 nt, Shigella flexneri 2a str. 2457T
aucauggcucagau

SEQ ID NO: 3841121 - RNA, 20 nt, Shigella flexneri 2a str. 2457T
aucaugguuuauuucccaga

SEQ ID NO: 3841122 - RNA, 20 nt, Shigella flexneri 2a str. 2457T
aucauguggacgaggggaga

SEQ ID NO: 3841123 - RNA, 22 nt, Shigella flexneri 2a str. 2457T
aucauuagcuggaaauguccgc

SEQ ID NO: 3841124 - RNA, 22 nt, Shigella flexneri 2a str. 2457T
aucauuaguaccuuccuuauuu

SEQ ID NO: 3841125 - RNA, 15 nt, Shigella flexneri 2a str. 2457T
aucauucaccagccc

SEQ ID NO: 3841126 - RNA, 13 nt, Shigella flexneri 2a str. 2457T
aucauucccgccc

SEQ ID NO: 3841127 - RNA, 23 nt, Shigella flexneri 2a str. 2457T
aucauucgccgguuccagcuuca

SEQ ID NO: 3841128 - RNA, 16 nt, Shigella flexneri 2a str. 2457T
aucauuucuggaagca

SEQ ID NO: 3841129 - RNA, 23 nt, Shigella flexneri 2a str. 2457T
aucauuuuacguugcauuuccau

SEQ ID NO: 3841130 - RNA, 18 nt, Shigella flexneri 2a str. 2457T
aucauuuuuucccauuac

SEQ ID NO: 3841131 - RNA, 15 nt, Shigella flexneri 2a str. 2457T
auccaacaauagugc

SEQ ID NO: 3841132 - RNA, 19 nt, Shigella flexneri 2a str. 2457T
auccaacgguuugaaugaa

SEQ ID NO: 3841133 - RNA, 19 nt, Shigella flexneri 2a str. 2457T
auccaaugccgcagcggcg

SEQ ID NO: 3841134 - RNA, 20 nt, Shigella flexneri 2a str. 2457T
auccacaacgugggccuggc

SEQ ID NO: 3841135 - RNA, 13 nt, Shigella flexneri 2a str. 2457T
auccacagcaaug

SEQ ID NO: 3841136 - RNA, 16 nt, Shigella flexneri 2a str. 2457T
auccacagcaaugcau

SEQ ID NO: 3841137 - RNA, 15 nt, Shigella flexneri 2a str. 2457T
auccaccagcaugaa

SEQ ID NO: 3841138 - RNA, 14 nt, Shigella flexneri 2a str. 2457T
auccaccagcccca

SEQ ID NO: 3841139 - RNA, 14 nt, Shigella flexneri 2a str. 2457T
auccaccagugacu

SEQ ID NO: 3841140 - RNA, 20 nt, Shigella flexneri 2a str. 2457T
auccaccaguggacggcuga

SEQ ID NO: 3841141 - RNA, 23 nt, Shigella flexneri 2a str. 2457T
auccaccauuggcgcauagccgu

SEQ ID NO: 3841142 - RNA, 17 nt, Shigella flexneri 2a str. 2457T
auccacccgcagcaagc

SEQ ID NO: 3841143 - RNA, 14 nt, Shigella flexneri 2a str. 2457T
auccacccgcagcc

SEQ ID NO: 3841144 - RNA, 19 nt, Shigella flexneri 2a str. 2457T
auccaccgaaauaaucaga

SEQ ID NO: 3841145 - RNA, 22 nt, Shigella flexneri 2a str. 2457T
auccaccuucuguaacuggaag

SEQ ID NO: 3841146 - RNA, 18 nt, Shigella flexneri 2a str. 2457T
auccacgauacgcugcac

SEQ ID NO: 3841147 - RNA, 15 nt, Shigella flexneri 2a str. 2457T
auccacgauuaucac

SEQ ID NO: 3841148 - RNA, 19 nt, Shigella flexneri 2a str. 2457T
auccacgcauuaauaaggu

SEQ ID NO: 3841149 - RNA, 22 nt, Shigella flexneri 2a str. 2457T
auccacggugcuuugacgaugc

SEQ ID NO: 3841150 - RNA, 21 nt, Shigella flexneri 2a str. 2457T
auccacugccugucacggcgc

SEQ ID NO: 3841151 - RNA, 17 nt, Shigella flexneri 2a str. 2457T
auccacugucaaaucca

SEQ ID NO: 3841152 - RNA, 24 nt, Shigella flexneri 2a str. 2457T
auccagacuaauuuuucccucuuc

SEQ ID NO: 3841153 - RNA, 14 nt, Shigella flexneri 2a str. 2457T
auccagacugcuca

SEQ ID NO: 3841154 - RNA, 20 nt, Shigella flexneri 2a str. 2457T
auccagaucugaaucauuca

SEQ ID NO: 3841155 - RNA, 16 nt, Shigella flexneri 2a str. 2457T
auccagauuuauaaaa

SEQ ID NO: 3841156 - RNA, 21 nt, Shigella flexneri 2a str. 2457T
auccagauuuauaaaagaaaa

SEQ ID NO: 3841157 - RNA, 14 nt, Shigella flexneri 2a str. 2457T
auccagcaaagcgu

SEQ ID NO: 3841158 - RNA, 16 nt, Shigella flexneri 2a str. 2457T
auccagcaccuuuugc

SEQ ID NO: 3841159 - RNA, 19 nt, Shigella flexneri 2a str. 2457T
auccagcagcccuugcuuc

SEQ ID NO: 3841160 - RNA, 20 nt, Shigella flexneri 2a str. 2457T
auccagcagugacucacgaa

SEQ ID NO: 3841161 - RNA, 11 nt, Shigella flexneri 2a str. 2457T
auccagccaaa

SEQ ID NO: 3841162 - RNA, 17 nt, Shigella flexneri 2a str. 2457T
auccagccacggcucca

SEQ ID NO: 3841163 - RNA, 14 nt, Shigella flexneri 2a str. 2457T
auccagccagucuu

SEQ ID NO: 3841164 - RNA, 23 nt, Shigella flexneri 2a str. 2457T
auccagcccugccaggucaucau

SEQ ID NO: 3841165 - RNA, 18 nt, Shigella flexneri 2a str. 2457T
auccagccggcaaagugg

SEQ ID NO: 3841166 - RNA, 17 nt, Shigella flexneri 2a str. 2457T
auccagccuacaaauuu

SEQ ID NO: 3841167 - RNA, 21 nt, Shigella flexneri 2a str. 2457T
auccagccuacaaauuugugc

SEQ ID NO: 3841168 - RNA, 21 nt, Shigella flexneri 2a str. 2457T
auccagcgcggcgaaggugcc

SEQ ID NO: 3841169 - RNA, 21 nt, Shigella flexneri 2a str. 2457T
auccagcgcguaaauaccuuc

SEQ ID NO: 3841170 - RNA, 17 nt, Shigella flexneri 2a str. 2457T
auccagcggaucaagaa

SEQ ID NO: 3841171 - RNA, 21 nt, Shigella flexneri 2a str. 2457T
auccagcggugcgcgauuaug

SEQ ID NO: 3841172 - RNA, 13 nt, Shigella flexneri 2a str. 2457T
auccagcucaucc

SEQ ID NO: 3841173 - RNA, 16 nt, Shigella flexneri 2a str. 2457T
auccagcucuuuucca

SEQ ID NO: 3841174 - RNA, 20 nt, Shigella flexneri 2a str. 2457T
auccagcuuuuagaucacuc

SEQ ID NO: 3841175 - RNA, 17 nt, Shigella flexneri 2a str. 2457T
auccagcuuuucccagc

SEQ ID NO: 3841176 - RNA, 21 nt, Shigella flexneri 2a str. 2457T
auccagcuuuuuaaucgccau

SEQ ID NO: 3841177 - RNA, 15 nt, Shigella flexneri 2a str. 2457T
auccaggaacagaag

SEQ ID NO: 3841178 - RNA, 17 nt, Shigella flexneri 2a str. 2457T
auccaggaacuccagau

SEQ ID NO: 3841179 - RNA, 20 nt, Shigella flexneri 2a str. 2457T
auccaggaacuccagaucca

SEQ ID NO: 3841180 - RNA, 21 nt, Shigella flexneri 2a str. 2457T
auccaggaagggcauaucagc

SEQ ID NO: 3841181 - RNA, 14 nt, Shigella flexneri 2a str. 2457T
auccaggagcucca

SEQ ID NO: 3841182 - RNA, 16 nt, Shigella flexneri 2a str. 2457T
auccaggagcuccagg

SEQ ID NO: 3841183 - RNA, 20 nt, Shigella flexneri 2a str. 2457T
auccaggagcuccagguccu

SEQ ID NO: 3841184 - RNA, 22 nt, Shigella flexneri 2a str. 2457T
auccaggcagauuuuuuaacug

SEQ ID NO: 3841185 - RNA, 17 nt, Shigella flexneri 2a str. 2457T
auccagguguauuguuc

SEQ ID NO: 3841186 - RNA, 16 nt, Shigella flexneri 2a str. 2457T
auccagguuucuucca

SEQ ID NO: 3841187 - RNA, 17 nt, Shigella flexneri 2a str. 2457T
auccaguacgccuucac

SEQ ID NO: 3841188 - RNA, 16 nt, Shigella flexneri 2a str. 2457T
auccagugaaacgcuu

SEQ ID NO: 3841189 - RNA, 20 nt, Shigella flexneri 2a str. 2457T
auccagugcucauccuucag

SEQ ID NO: 3841190 - RNA, 20 nt, Shigella flexneri 2a str. 2457T
auccaguguaaaacagcacu

SEQ ID NO: 3841191 - RNA, 20 nt, Shigella flexneri 2a str. 2457T
auccaguucugcuucaacau

SEQ ID NO: 3841192 - RNA, 15 nt, Shigella flexneri 2a str. 2457T
auccauaagauugca

SEQ ID NO: 3841193 - RNA, 14 nt, Shigella flexneri 2a str. 2457T
auccauaagguccu

SEQ ID NO: 3841194 - RNA, 22 nt, Shigella flexneri 2a str. 2457T
auccauacggcagagaucgccg

SEQ ID NO: 3841195 - RNA, 14 nt, Shigella flexneri 2a str. 2457T
auccaucaaagguu

SEQ ID NO: 3841196 - RNA, 18 nt, Shigella flexneri 2a str. 2457T
auccaucaaagguuuuuc

SEQ ID NO: 3841197 - RNA, 19 nt, Shigella flexneri 2a str. 2457T
auccaucaaagguuuuuca

SEQ ID NO: 3841198 - RNA, 19 nt, Shigella flexneri 2a str. 2457T
auccaugacgaggagcugc

SEQ ID NO: 3841199 - RNA, 23 nt, Shigella flexneri 2a str. 2457T
auccaugauauuggcaucgccag

SEQ ID NO: 3841200 - RNA, 19 nt, Shigella flexneri 2a str. 2457T
auccaugccgaguggcauu

SEQ ID NO: 3841201 - RNA, 16 nt, Shigella flexneri 2a str. 2457T
auccauucaucgccuu

SEQ ID NO: 3841202 - RNA, 20 nt, Shigella flexneri 2a str. 2457T
auccauucggcgauuaacaa

SEQ ID NO: 3841203 - RNA, 21 nt, Shigella flexneri 2a str. 2457T
auccauucggcgauuaacaag

SEQ ID NO: 3841204 - RNA, 22 nt, Shigella flexneri 2a str. 2457T
aucccaacuguagugaucaaac

SEQ ID NO: 3841205 - RNA, 17 nt, Shigella flexneri 2a str. 2457T
aucccaauacccgcaac

SEQ ID NO: 3841206 - RNA, 19 nt, Shigella flexneri 2a str. 2457T
aucccagucacgcaacaug

SEQ ID NO: 3841207 - RNA, 16 nt, Shigella flexneri 2a str. 2457T
aucccagucuucauca

SEQ ID NO: 3841208 - RNA, 19 nt, Shigella flexneri 2a str. 2457T
aucccagugcggcaucgcu

SEQ ID NO: 3841209 - RNA, 18 nt, Shigella flexneri 2a str. 2457T
aucccaucgccgguaaug

SEQ ID NO: 3841210 - RNA, 21 nt, Shigella flexneri 2a str. 2457T
aucccauuacguccagcgauu

SEQ ID NO: 3841211 - RNA, 18 nt, Shigella flexneri 2a str. 2457T
auccccagacaaaagcga

SEQ ID NO: 3841212 - RNA, 12 nt, Shigella flexneri 2a str. 2457T
aucccccacuuu

SEQ ID NO: 3841213 - RNA, 19 nt, Shigella flexneri 2a str. 2457T
auccccgggcggccucuuc

SEQ ID NO: 3841214 - RNA, 21 nt, Shigella flexneri 2a str. 2457T
auccccuucucaaucccuuuc

SEQ ID NO: 3841215 - RNA, 16 nt, Shigella flexneri 2a str. 2457T
aucgacaaaaucggaa

SEQ ID NO: 3841216 - RNA, 18 nt, Shigella flexneri 2a str. 2457T
aucgacagaacggauauc

SEQ ID NO: 3841217 - RNA, 16 nt, Shigella flexneri 2a str. 2457T
aucgacaguaccagca

SEQ ID NO: 3841218 - RNA, 19 nt, Shigella flexneri 2a str. 2457T
aucgacaguuucaccugcu

SEQ ID NO: 3841219 - RNA, 13 nt, Shigella flexneri 2a str. 2457T
aucgaccaaccuu

SEQ ID NO: 3841220 - RNA, 18 nt, Shigella flexneri 2a str. 2457T
aucgaccaaccuugcgcc

SEQ ID NO: 3841221 - RNA, 11 nt, Shigella flexneri 2a str. 2457T
aucgacgauga

SEQ ID NO: 3841222 - RNA, 21 nt, Shigella flexneri 2a str. 2457T
aucgacgcugcugcguauggu

SEQ ID NO: 3841223 - RNA, 18 nt, Shigella flexneri 2a str. 2457T
aucgacggcguauugcau

SEQ ID NO: 3841224 - RNA, 14 nt, Shigella flexneri 2a str. 2457T
aucgacguucugcc

SEQ ID NO: 3841225 - RNA, 20 nt, Shigella flexneri 2a str. 2457T
aucgacuaacuucugaucua

SEQ ID NO: 3841226 - RNA, 17 nt, Shigella flexneri 2a str. 2457T
aucgagauugucggcag

SEQ ID NO: 3841227 - RNA, 14 nt, Shigella flexneri 2a str. 2457T
aucgagccgauuaa

SEQ ID NO: 3841228 - RNA, 22 nt, Shigella flexneri 2a str. 2457T
aucgagcgccguugcgcccauc

SEQ ID NO: 3841229 - RNA, 18 nt, Shigella flexneri 2a str. 2457T
aucgaggccauauuucac

SEQ ID NO: 3841230 - RNA, 14 nt, Shigella flexneri 2a str. 2457T
aucgauaaaccagc

SEQ ID NO: 3841231 - RNA, 15 nt, Shigella flexneri 2a str. 2457T
aucgauaaacggcac

SEQ ID NO: 3841232 - RNA, 23 nt, Shigella flexneri 2a str. 2457T
aucgauaugaccauugguaaugg

SEQ ID NO: 3841233 - RNA, 18 nt, Shigella flexneri 2a str. 2457T
aucgaucauauuuccuuc

SEQ ID NO: 3841234 - RNA, 18 nt, Shigella flexneri 2a str. 2457T
aucgaugggauauaaccc

SEQ ID NO: 3841235 - RNA, 19 nt, Shigella flexneri 2a str. 2457T
aucgaugggauauaacccu

SEQ ID NO: 3841236 - RNA, 23 nt, Shigella flexneri 2a str. 2457T
aucgaugguugcccugcugguga

SEQ ID NO: 3841237 - RNA, 13 nt, Shigella flexneri 2a str. 2457T
aucgauuuucaaa

SEQ ID NO: 3841238 - RNA, 18 nt, Shigella flexneri 2a str. 2457T
aucgcaaaccagacgcgc

SEQ ID NO: 3841239 - RNA, 14 nt, Shigella flexneri 2a str. 2457T
aucgcaauccuuuc

SEQ ID NO: 3841240 - RNA, 15 nt, Shigella flexneri 2a str. 2457T
aucgcaccaaacggg

SEQ ID NO: 3841241 - RNA, 21 nt, Shigella flexneri 2a str. 2457T
aucgcacguugucagcaacug

SEQ ID NO: 3841242 - RNA, 15 nt, Shigella flexneri 2a str. 2457T
aucgcagcaaacgaa

SEQ ID NO: 3841243 - RNA, 21 nt, Shigella flexneri 2a str. 2457T
aucgcagcgcaagcugaacag

SEQ ID NO: 3841244 - RNA, 14 nt, Shigella flexneri 2a str. 2457T
aucgcauacaaaaa

SEQ ID NO: 3841245 - RNA, 16 nt, Shigella flexneri 2a str. 2457T
aucgcauacaaaaaca

SEQ ID NO: 3841246 - RNA, 18 nt, Shigella flexneri 2a str. 2457T
aucgcaucaaucuuuuuc

SEQ ID NO: 3841247 - RNA, 15 nt, Shigella flexneri 2a str. 2457T
aucgcaucaggcaau

SEQ ID NO: 3841248 - RNA, 17 nt, Shigella flexneri 2a str. 2457T
aucgcauugacgccaaa

SEQ ID NO: 3841249 - RNA, 13 nt, Shigella flexneri 2a str. 2457T
aucgccaaauuug

SEQ ID NO: 3841250 - RNA, 18 nt, Shigella flexneri 2a str. 2457T
aucgccaacaaucucuuc

SEQ ID NO: 3841251 - RNA, 16 nt, Shigella flexneri 2a str. 2457T
aucgccaaugaagugg

SEQ ID NO: 3841252 - RNA, 14 nt, Shigella flexneri 2a str. 2457T
aucgccaccacccu

SEQ ID NO: 3841253 - RNA, 17 nt, Shigella flexneri 2a str. 2457T
aucgccacugcugggga

SEQ ID NO: 3841254 - RNA, 23 nt, Shigella flexneri 2a str. 2457T
aucgccagcaaaaucaccaucac

SEQ ID NO: 3841255 - RNA, 12 nt, Shigella flexneri 2a str. 2457T
aucgccagcauc

SEQ ID NO: 3841256 - RNA, 17 nt, Shigella flexneri 2a str. 2457T
aucgccagcaucggcag

SEQ ID NO: 3841257 - RNA, 15 nt, Shigella flexneri 2a str. 2457T
aucgccagcucaaac

SEQ ID NO: 3841258 - RNA, 13 nt, Shigella flexneri 2a str. 2457T
aucgccaggaaca

SEQ ID NO: 3841259 - RNA, 18 nt, Shigella flexneri 2a str. 2457T
aucgccaguaguaaccac

SEQ ID NO: 3841260 - RNA, 20 nt, Shigella flexneri 2a str. 2457T
aucgccauaauaagcgccau

SEQ ID NO: 3841261 - RNA, 17 nt, Shigella flexneri 2a str. 2457T
aucgccauauccgcaau

SEQ ID NO: 3841262 - RNA, 21 nt, Shigella flexneri 2a str. 2457T
aucgccaucuuuacaccuuac

SEQ ID NO: 3841263 - RNA, 20 nt, Shigella flexneri 2a str. 2457T
aucgcccaguugaucaccag

SEQ ID NO: 3841264 - RNA, 21 nt, Shigella flexneri 2a str. 2457T
aucgcccccgucaccggcaca

SEQ ID NO: 3841265 - RNA, 19 nt, Shigella flexneri 2a str. 2457T
aucgccccggaagcaucaa

SEQ ID NO: 3841266 - RNA, 17 nt, Shigella flexneri 2a str. 2457T
aucgccccggucaucaa

SEQ ID NO: 3841267 - RNA, 14 nt, Shigella flexneri 2a str. 2457T
aucgccccuccccc

SEQ ID NO: 3841268 - RNA, 19 nt, Shigella flexneri 2a str. 2457T
aucgcccgcuuccagcgca

SEQ ID NO: 3841269 - RNA, 21 nt, Shigella flexneri 2a str. 2457T
aucgcccggauauccacccgc

SEQ ID NO: 3841270 - RNA, 18 nt, Shigella flexneri 2a str. 2457T
aucgcccugauggcgcgc

SEQ ID NO: 3841271 - RNA, 18 nt, Shigella flexneri 2a str. 2457T
aucgcccugcuccagcaa

SEQ ID NO: 3841272 - RNA, 23 nt, Shigella flexneri 2a str. 2457T
aucgccgcguagagaaaaccaau

SEQ ID NO: 3841273 - RNA, 17 nt, Shigella flexneri 2a str. 2457T
aucgccgcuggaaauga

SEQ ID NO: 3841274 - RNA, 16 nt, Shigella flexneri 2a str. 2457T
aucgccgcuggcgcgg

SEQ ID NO: 3841275 - RNA, 18 nt, Shigella flexneri 2a str. 2457T
aucgccuaccaacgacau

SEQ ID NO: 3841276 - RNA, 15 nt, Shigella flexneri 2a str. 2457T
aucgccuccagcgcu

SEQ ID NO: 3841277 - RNA, 17 nt, Shigella flexneri 2a str. 2457T
aucgccucuaaaguaug

SEQ ID NO: 3841278 - RNA, 13 nt, Shigella flexneri 2a str. 2457T
aucgccugccgca

SEQ ID NO: 3841279 - RNA, 19 nt, Shigella flexneri 2a str. 2457T
aucgccugguaccagcacc

SEQ ID NO: 3841280 - RNA, 22 nt, Shigella flexneri 2a str. 2457T
aucgccuguggcguaaagccuu

SEQ ID NO: 3841281 - RNA, 20 nt, Shigella flexneri 2a str. 2457T
aucgcgaaaaaaagauggcu

SEQ ID NO: 3841282 - RNA, 12 nt, Shigella flexneri 2a str. 2457T
aucgcgaccaau

SEQ ID NO: 3841283 - RNA, 15 nt, Shigella flexneri 2a str. 2457T
aucgcgaccaaucac

SEQ ID NO: 3841284 - RNA, 20 nt, Shigella flexneri 2a str. 2457T
aucgcgaugggucgccgcaa

SEQ ID NO: 3841285 - RNA, 14 nt, Shigella flexneri 2a str. 2457T
aucgcgccaaucag

SEQ ID NO: 3841286 - RNA, 14 nt, Shigella flexneri 2a str. 2457T
aucgcgccagccag

SEQ ID NO: 3841287 - RNA, 18 nt, Shigella flexneri 2a str. 2457T
aucgcgccaucaaaucug

SEQ ID NO: 3841288 - RNA, 23 nt, Shigella flexneri 2a str. 2457T
aucgcgccgccgcccaugaugac

SEQ ID NO: 3841289 - RNA, 17 nt, Shigella flexneri 2a str. 2457T
aucgcgcguguugcgcc

SEQ ID NO: 3841290 - RNA, 18 nt, Shigella flexneri 2a str. 2457T
aucgcgcuaauuccaguc

SEQ ID NO: 3841291 - RNA, 21 nt, Shigella flexneri 2a str. 2457T
aucgcgcuuaucgccagcgcc

SEQ ID NO: 3841292 - RNA, 14 nt, Shigella flexneri 2a str. 2457T
aucgcggcacacag

SEQ ID NO: 3841293 - RNA, 16 nt, Shigella flexneri 2a str. 2457T
aucgcggcacacagca

SEQ ID NO: 3841294 - RNA, 21 nt, Shigella flexneri 2a str. 2457T
aucgcggcgauauccagcgcg

SEQ ID NO: 3841295 - RNA, 23 nt, Shigella flexneri 2a str. 2457T
aucgcggcuuauugcuucaagau

SEQ ID NO: 3841296 - RNA, 13 nt, Shigella flexneri 2a str. 2457T
aucgcguaaggcu

SEQ ID NO: 3841297 - RNA, 22 nt, Shigella flexneri 2a str. 2457T
aucgcguaaggcuucaaucaau

SEQ ID NO: 3841298 - RNA, 18 nt, Shigella flexneri 2a str. 2457T
aucgcguacucaccgcuc

SEQ ID NO: 3841299 - RNA, 14 nt, Shigella flexneri 2a str. 2457T
aucgcguugucaua

SEQ ID NO: 3841300 - RNA, 22 nt, Shigella flexneri 2a str. 2457T
aucgcuauuaacccgcaacagc

SEQ ID NO: 3841301 - RNA, 15 nt, Shigella flexneri 2a str. 2457T
aucgcucagcgcauc

SEQ ID NO: 3841302 - RNA, 17 nt, Shigella flexneri 2a str. 2457T
aucgcucagcgcauccu

SEQ ID NO: 3841303 - RNA, 18 nt, Shigella flexneri 2a str. 2457T
aucgcucaucugcugcgu

SEQ ID NO: 3841304 - RNA, 14 nt, Shigella flexneri 2a str. 2457T
aucgcuccacgcca

SEQ ID NO: 3841305 - RNA, 15 nt, Shigella flexneri 2a str. 2457T
aucgcucucagagag

SEQ ID NO: 3841306 - RNA, 15 nt, Shigella flexneri 2a str. 2457T
aucgcugaaagaugg

SEQ ID NO: 3841307 - RNA, 16 nt, Shigella flexneri 2a str. 2457T
aucgcugaaagauggc

SEQ ID NO: 3841308 - RNA, 17 nt, Shigella flexneri 2a str. 2457T
aucgcugaaagauggcg

SEQ ID NO: 3841309 - RNA, 16 nt, Shigella flexneri 2a str. 2457T
aucgcugaacgcaccu

SEQ ID NO: 3841310 - RNA, 18 nt, Shigella flexneri 2a str. 2457T
aucgcugaacgcaccuuc

SEQ ID NO: 3841311 - RNA, 17 nt, Shigella flexneri 2a str. 2457T
aucgcugacacgggaaa

SEQ ID NO: 3841312 - RNA, 19 nt, Shigella flexneri 2a str. 2457T
aucgcugagcuccugcauu

SEQ ID NO: 3841313 - RNA, 17 nt, Shigella flexneri 2a str. 2457T
aucucaaucgcacccgc

SEQ ID NO: 3841314 - RNA, 16 nt, Shigella flexneri 2a str. 2457T
aucucaauuuucacuu

SEQ ID NO: 3841315 - RNA, 21 nt, Shigella flexneri 2a str. 2457T
aucucaauuuucacuuucggc

SEQ ID NO: 3841316 - RNA, 14 nt, Shigella flexneri 2a str. 2457T
aucucacaaucauc

SEQ ID NO: 3841317 - RNA, 13 nt, Shigella flexneri 2a str. 2457T
aucucaccagauu

SEQ ID NO: 3841318 - RNA, 16 nt, Shigella flexneri 2a str. 2457T
aucucagauaaaugca

SEQ ID NO: 3841319 - RNA, 19 nt, Shigella flexneri 2a str. 2457T
aucucagauaaaugcaaac

SEQ ID NO: 3841320 - RNA, 13 nt, Shigella flexneri 2a str. 2457T
aucucauccauca

SEQ ID NO: 3841321 - RNA, 13 nt, Shigella flexneri 2a str. 2457T
aucucaucuucca

SEQ ID NO: 3841322 - RNA, 16 nt, Shigella flexneri 2a str. 2457T
aucuccacagucaggc

SEQ ID NO: 3841323 - RNA, 22 nt, Shigella flexneri 2a str. 2457T
aucuccagaucuuuuugcgcaa

SEQ ID NO: 3841324 - RNA, 13 nt, Shigella flexneri 2a str. 2457T
aucuccagcgcau

SEQ ID NO: 3841325 - RNA, 18 nt, Shigella flexneri 2a str. 2457T
aucuccaguggugauacc

SEQ ID NO: 3841326 - RNA, 12 nt, Shigella flexneri 2a str. 2457T
aucuccauuuca

SEQ ID NO: 3841327 - RNA, 21 nt, Shigella flexneri 2a str. 2457T
aucucccuguaucccaguucg

SEQ ID NO: 3841328 - RNA, 14 nt, Shigella flexneri 2a str. 2457T
aucuccgcuggagc

SEQ ID NO: 3841329 - RNA, 14 nt, Shigella flexneri 2a str. 2457T
aucuccggccugca

SEQ ID NO: 3841330 - RNA, 16 nt, Shigella flexneri 2a str. 2457T
aucuccuugcuggugg

SEQ ID NO: 3841331 - RNA, 17 nt, Shigella flexneri 2a str. 2457T
aucucgaucgagaagac

SEQ ID NO: 3841332 - RNA, 23 nt, Shigella flexneri 2a str. 2457T
aucucggggcuuauuaacuuccc

SEQ ID NO: 3841333 - RNA, 22 nt, Shigella flexneri 2a str. 2457T
aucucgguggaaaauagcauaa

SEQ ID NO: 3841334 - RNA, 17 nt, Shigella flexneri 2a str. 2457T
aucucguggucaauauu

SEQ ID NO: 3841335 - RNA, 14 nt, Shigella flexneri 2a str. 2457T
aucucguugaucac

SEQ ID NO: 3841336 - RNA, 12 nt, Shigella flexneri 2a str. 2457T
aucucuccuuuc

SEQ ID NO: 3841337 - RNA, 14 nt, Shigella flexneri 2a str. 2457T
aucucucgcaucag

SEQ ID NO: 3841338 - RNA, 23 nt, Shigella flexneri 2a str. 2457T
aucucugacgcgcauacucuccu

SEQ ID NO: 3841339 - RNA, 22 nt, Shigella flexneri 2a str. 2457T
aucucugcgcuauccagcgcau

SEQ ID NO: 3841340 - RNA, 19 nt, Shigella flexneri 2a str. 2457T
aucucuggcacgagaucgu

SEQ ID NO: 3841341 - RNA, 21 nt, Shigella flexneri 2a str. 2457T
aucucugguuuguuuucagau

SEQ ID NO: 3841342 - RNA, 21 nt, Shigella flexneri 2a str. 2457T
aucucuuaucauccaggugaa

SEQ ID NO: 3841343 - RNA, 13 nt, Shigella flexneri 2a str. 2457T
aucucuucaccau

SEQ ID NO: 3841344 - RNA, 17 nt, Shigella flexneri 2a str. 2457T
aucucuuccagcgauaa

SEQ ID NO: 3841345 - RNA, 20 nt, Shigella flexneri 2a str. 2457T
aucucuuccggcaccacaaa

SEQ ID NO: 3841346 - RNA, 14 nt, Shigella flexneri 2a str. 2457T
aucucuucgccugc

SEQ ID NO: 3841347 - RNA, 20 nt, Shigella flexneri 2a str. 2457T
aucucuucgcgaucaaacgc

SEQ ID NO: 3841348 - RNA, 15 nt, Shigella flexneri 2a str. 2457T
aucucuucggcacug

SEQ ID NO: 3841349 - RNA, 18 nt, Shigella flexneri 2a str. 2457T
aucucuucguuuucaacg

SEQ ID NO: 3841350 - RNA, 21 nt, Shigella flexneri 2a str. 2457T
aucucuucuucaagccaggcu

SEQ ID NO: 3841351 - RNA, 16 nt, Shigella flexneri 2a str. 2457T
aucucuugcuggcauu

SEQ ID NO: 3841352 - RNA, 21 nt, Shigella flexneri 2a str. 2457T
aucugaauauucggcuccaga

SEQ ID NO: 3841353 - RNA, 23 nt, Shigella flexneri 2a str. 2457T
aucugaccacggccacagccagc

SEQ ID NO: 3841354 - RNA, 18 nt, Shigella flexneri 2a str. 2457T
aucugaccgaaugcaguc

SEQ ID NO: 3841355 - RNA, 21 nt, Shigella flexneri 2a str. 2457T
aucugaguugccaucaucacc

SEQ ID NO: 3841356 - RNA, 23 nt, Shigella flexneri 2a str. 2457T
aucugaguugccaucaucaccag

SEQ ID NO: 3841357 - RNA, 19 nt, Shigella flexneri 2a str. 2457T
aucugauagugauccauca

SEQ ID NO: 3841358 - RNA, 14 nt, Shigella flexneri 2a str. 2457T
aucugaucaauaua

SEQ ID NO: 3841359 - RNA, 22 nt, Shigella flexneri 2a str. 2457T
aucugaugauauuuuucccuga

SEQ ID NO: 3841360 - RNA, 15 nt, Shigella flexneri 2a str. 2457T
aucugauuaauauug

SEQ ID NO: 3841361 - RNA, 17 nt, Shigella flexneri 2a str. 2457T
aucugauuugucggcag

SEQ ID NO: 3841362 - RNA, 15 nt, Shigella flexneri 2a str. 2457T
aucugcaaaucugcg

SEQ ID NO: 3841363 - RNA, 17 nt, Shigella flexneri 2a str. 2457T
aucugcauucaacugga

SEQ ID NO: 3841364 - RNA, 13 nt, Shigella flexneri 2a str. 2457T
aucugccagccau

SEQ ID NO: 3841365 - RNA, 16 nt, Shigella flexneri 2a str. 2457T
aucugccagcguaaau

SEQ ID NO: 3841366 - RNA, 14 nt, Shigella flexneri 2a str. 2457T
aucugccccauugc

SEQ ID NO: 3841367 - RNA, 23 nt, Shigella flexneri 2a str. 2457T
aucugccccauugcugaugcacc

SEQ ID NO: 3841368 - RNA, 12 nt, Shigella flexneri 2a str. 2457T
aucugcccgcac

SEQ ID NO: 3841369 - RNA, 22 nt, Shigella flexneri 2a str. 2457T
aucugcgccuacggcauucugc

SEQ ID NO: 3841370 - RNA, 15 nt, Shigella flexneri 2a str. 2457T
aucugcgcuggaaca

SEQ ID NO: 3841371 - RNA, 19 nt, Shigella flexneri 2a str. 2457T
aucugcgcuggaacaacgc

SEQ ID NO: 3841372 - RNA, 14 nt, Shigella flexneri 2a str. 2457T
aucugcgggaacau

SEQ ID NO: 3841373 - RNA, 22 nt, Shigella flexneri 2a str. 2457T
aucugcgggaacauaugcacau

SEQ ID NO: 3841374 - RNA, 19 nt, Shigella flexneri 2a str. 2457T
aucugcggguuagucugca

SEQ ID NO: 3841375 - RNA, 21 nt, Shigella flexneri 2a str. 2457T
aucugcguaucgcccugccaa

SEQ ID NO: 3841376 - RNA, 15 nt, Shigella flexneri 2a str. 2457T
aucugcguggcgcgc

SEQ ID NO: 3841377 - RNA, 18 nt, Shigella flexneri 2a str. 2457T
aucugcuccuguugaugu

SEQ ID NO: 3841378 - RNA, 23 nt, Shigella flexneri 2a str. 2457T
aucugcucuucuuucaucaugug

SEQ ID NO: 3841379 - RNA, 23 nt, Shigella flexneri 2a str. 2457T
aucuggaaagucugaaugaugug

SEQ ID NO: 3841380 - RNA, 14 nt, Shigella flexneri 2a str. 2457T
aucuggauccacga

SEQ ID NO: 3841381 - RNA, 19 nt, Shigella flexneri 2a str. 2457T
aucuggcaagccugaaaac

SEQ ID NO: 3841382 - RNA, 20 nt, Shigella flexneri 2a str. 2457T
aucuggcauaaacaaagcgc

SEQ ID NO: 3841383 - RNA, 16 nt, Shigella flexneri 2a str. 2457T
aucuggcauuugcacu

SEQ ID NO: 3841384 - RNA, 15 nt, Shigella flexneri 2a str. 2457T
aucuggccuacagau

SEQ ID NO: 3841385 - RNA, 16 nt, Shigella flexneri 2a str. 2457T
aucuggcuugccagca

SEQ ID NO: 3841386 - RNA, 20 nt, Shigella flexneri 2a str. 2457T
aucugggcugccugagcugu

SEQ ID NO: 3841387 - RNA, 23 nt, Shigella flexneri 2a str. 2457T
aucugguaggacgaaaaaucaau

SEQ ID NO: 3841388 - RNA, 22 nt, Shigella flexneri 2a str. 2457T
aucugguguuaaaucuguucau

SEQ ID NO: 3841389 - RNA, 15 nt, Shigella flexneri 2a str. 2457T
aucugucagguaaca

SEQ ID NO: 3841390 - RNA, 18 nt, Shigella flexneri 2a str. 2457T
aucugucugauaaaaaac

SEQ ID NO: 3841391 - RNA, 23 nt, Shigella flexneri 2a str. 2457T
aucugucuguacggcagugaaca

SEQ ID NO: 3841392 - RNA, 13 nt, Shigella flexneri 2a str. 2457T
aucugugaacuca

SEQ ID NO: 3841393 - RNA, 22 nt, Shigella flexneri 2a str. 2457T
aucugugugggcacucgaagau

SEQ ID NO: 3841394 - RNA, 20 nt, Shigella flexneri 2a str. 2457T
aucuguuucuucgucaauuu

SEQ ID NO: 3841395 - RNA, 14 nt, Shigella flexneri 2a str. 2457T
aucuuagguaauga

SEQ ID NO: 3841396 - RNA, 17 nt, Shigella flexneri 2a str. 2457T
aucuuagguaaugacuc

SEQ ID NO: 3841397 - RNA, 21 nt, Shigella flexneri 2a str. 2457T
aucuuauagaaagcaaaacgg

SEQ ID NO: 3841398 - RNA, 23 nt, Shigella flexneri 2a str. 2457T
aucuuaucacgaugcuaaaaaca

SEQ ID NO: 3841399 - RNA, 18 nt, Shigella flexneri 2a str. 2457T
aucuucaaucagaugugc

SEQ ID NO: 3841400 - RNA, 15 nt, Shigella flexneri 2a str. 2457T
aucuucacacacauc

SEQ ID NO: 3841401 - RNA, 16 nt, Shigella flexneri 2a str. 2457T
aucuucacacacaucg

SEQ ID NO: 3841402 - RNA, 18 nt, Shigella flexneri 2a str. 2457T
aucuucacacugaugaca

SEQ ID NO: 3841403 - RNA, 15 nt, Shigella flexneri 2a str. 2457T
aucuucacaucauca

SEQ ID NO: 3841404 - RNA, 16 nt, Shigella flexneri 2a str. 2457T
aucuucacaucaucau

SEQ ID NO: 3841405 - RNA, 21 nt, Shigella flexneri 2a str. 2457T
aucuucaucgauacugcucug

SEQ ID NO: 3841406 - RNA, 15 nt, Shigella flexneri 2a str. 2457T
aucuucauggagaac

SEQ ID NO: 3841407 - RNA, 15 nt, Shigella flexneri 2a str. 2457T
aucuuccacgccugc

SEQ ID NO: 3841408 - RNA, 15 nt, Shigella flexneri 2a str. 2457T
aucuuccagaucacc

SEQ ID NO: 3841409 - RNA, 15 nt, Shigella flexneri 2a str. 2457T
aucuucccagccaau

SEQ ID NO: 3841410 - RNA, 13 nt, Shigella flexneri 2a str. 2457T
augauauuuuucc

SEQ ID NO: 3841411 - RNA, 21 nt, Shigella flexneri 2a str. 2457T
augaucaacagcaucaucgca

SEQ ID NO: 3841412 - RNA, 22 nt, Shigella flexneri 2a str. 2457T
augaucaaccgcuauaccgccg

SEQ ID NO: 3841413 - RNA, 14 nt, Shigella flexneri 2a str. 2457T
augaucaccugcau

SEQ ID NO: 3841414 - RNA, 14 nt, Shigella flexneri 2a str. 2457T
augaucauccgccu

SEQ ID NO: 3841415 - RNA, 20 nt, Shigella flexneri 2a str. 2457T
augauccugcaauaccgccg

SEQ ID NO: 3841416 - RNA, 14 nt, Shigella flexneri 2a str. 2457T
augauccuggauuu

SEQ ID NO: 3841417 - RNA, 23 nt, Shigella flexneri 2a str. 2457T
augaucgccaucagugccaguac

SEQ ID NO: 3841418 - RNA, 12 nt, Shigella flexneri 2a str. 2457T
augaucgccgga

SEQ ID NO: 3841419 - RNA, 20 nt, Shigella flexneri 2a str. 2457T
augaugacuugccuccagcg

SEQ ID NO: 3841420 - RNA, 13 nt, Shigella flexneri 2a str. 2457T
augaugccugaug

SEQ ID NO: 3841421 - RNA, 15 nt, Shigella flexneri 2a str. 2457T
augauggccuuuuug

SEQ ID NO: 3841422 - RNA, 20 nt, Shigella flexneri 2a str. 2457T
augauggccuuuuugugcuu

SEQ ID NO: 3841423 - RNA, 22 nt, Shigella flexneri 2a str. 2457T
augaugucaaaaucaaaauaau

SEQ ID NO: 3841424 - RNA, 14 nt, Shigella flexneri 2a str. 2457T
augauuaauuacac

SEQ ID NO: 3841425 - RNA, 16 nt, Shigella flexneri 2a str. 2457T
augauucccagucagg

SEQ ID NO: 3841426 - RNA, 13 nt, Shigella flexneri 2a str. 2457T
augauuccggcaa

SEQ ID NO: 3841427 - RNA, 14 nt, Shigella flexneri 2a str. 2457T
augauugccugaug

SEQ ID NO: 3841428 - RNA, 17 nt, Shigella flexneri 2a str. 2457T
augauuucauaacugau

SEQ ID NO: 3841429 - RNA, 23 nt, Shigella flexneri 2a str. 2457T
augauuuccggcagcauguguaa

SEQ ID NO: 3841430 - RNA, 19 nt, Shigella flexneri 2a str. 2457T
augauuucgucauccggug

SEQ ID NO: 3841431 - RNA, 12 nt, Shigella flexneri 2a str. 2457T
augauuuuccug

SEQ ID NO: 3841432 - RNA, 17 nt, Shigella flexneri 2a str. 2457T
augauuuugauggaaga

SEQ ID NO: 3841433 - RNA, 19 nt, Shigella flexneri 2a str. 2457T
augcaacgauccuucaaac

SEQ ID NO: 3841434 - RNA, 15 nt, Shigella flexneri 2a str. 2457T
augcaacuguuuuac

SEQ ID NO: 3841435 - RNA, 20 nt, Shigella flexneri 2a str. 2457T
augcaagaggguuauuuguu

SEQ ID NO: 3841436 - RNA, 22 nt, Shigella flexneri 2a str. 2457T
augcaagaggguuauuuguuca

SEQ ID NO: 3841437 - RNA, 13 nt, Shigella flexneri 2a str. 2457T
augcaauaaauau

SEQ ID NO: 3841438 - RNA, 18 nt, Shigella flexneri 2a str. 2457T
augcaaugauucaggcau

SEQ ID NO: 3841439 - RNA, 20 nt, Shigella flexneri 2a str. 2457T
augcaauggaauggcuggca

SEQ ID NO: 3841440 - RNA, 21 nt, Shigella flexneri 2a str. 2457T
augcacaccccgcgcagcuga

SEQ ID NO: 3841441 - RNA, 14 nt, Shigella flexneri 2a str. 2457T
augcacagaaccgg

SEQ ID NO: 3841442 - RNA, 17 nt, Shigella flexneri 2a str. 2457T
augcaccaacaaauaga

SEQ ID NO: 3841443 - RNA, 22 nt, Shigella flexneri 2a str. 2457T
augcaccuggggcuugccagag

SEQ ID NO: 3841444 - RNA, 20 nt, Shigella flexneri 2a str. 2457T
augcacgcagugguuaacaa

SEQ ID NO: 3841445 - RNA, 17 nt, Shigella flexneri 2a str. 2457T
augcacgcucuguucug

SEQ ID NO: 3841446 - RNA, 18 nt, Shigella flexneri 2a str. 2457T
augcacgcucuguucugc

SEQ ID NO: 3841447 - RNA, 18 nt, Shigella flexneri 2a str. 2457T
augcacucgcauccucuu

SEQ ID NO: 3841448 - RNA, 14 nt, Shigella flexneri 2a str. 2457T
augcagauaaucgu

SEQ ID NO: 3841449 - RNA, 13 nt, Shigella flexneri 2a str. 2457T
augcagccuucau

SEQ ID NO: 3841450 - RNA, 11 nt, Shigella flexneri 2a str. 2457T
augcagcgaug

SEQ ID NO: 3841451 - RNA, 18 nt, Shigella flexneri 2a str. 2457T
augcagcuccaccgauuu

SEQ ID NO: 3841452 - RNA, 13 nt, Shigella flexneri 2a str. 2457T
augcagcugcucg

SEQ ID NO: 3841453 - RNA, 14 nt, Shigella flexneri 2a str. 2457T
augcaggaucgcuc

SEQ ID NO: 3841454 - RNA, 14 nt, Shigella flexneri 2a str. 2457T
augcaguaccagau

SEQ ID NO: 3841455 - RNA, 13 nt, Shigella flexneri 2a str. 2457T
augcauaaaaaaa

SEQ ID NO: 3841456 - RNA, 15 nt, Shigella flexneri 2a str. 2457T
augcauaaaaaaacg

SEQ ID NO: 3841457 - RNA, 17 nt, Shigella flexneri 2a str. 2457T
augcaucagaucggcag

SEQ ID NO: 3841458 - RNA, 18 nt, Shigella flexneri 2a str. 2457T
augcaucaugaaaaccgu

SEQ ID NO: 3841459 - RNA, 12 nt, Shigella flexneri 2a str. 2457T
augcaucccgcc

SEQ ID NO: 3841460 - RNA, 17 nt, Shigella flexneri 2a str. 2457T
augcauccggcagucag

SEQ ID NO: 3841461 - RNA, 16 nt, Shigella flexneri 2a str. 2457T
augcaugauccggcau

SEQ ID NO: 3841462 - RNA, 11 nt, Shigella flexneri 2a str. 2457T
augcauuauau

SEQ ID NO: 3841463 - RNA, 20 nt, Shigella flexneri 2a str. 2457T
augcauuuaagaaaaaagau

SEQ ID NO: 3841464 - RNA, 21 nt, Shigella flexneri 2a str. 2457T
augccaaaaauaaucuauuga

SEQ ID NO: 3841465 - RNA, 16 nt, Shigella flexneri 2a str. 2457T
augccaaauauuucuu

SEQ ID NO: 3841466 - RNA, 19 nt, Shigella flexneri 2a str. 2457T
augccaaucagcagaaccg

SEQ ID NO: 3841467 - RNA, 15 nt, Shigella flexneri 2a str. 2457T
augccaaucuucaca

SEQ ID NO: 3841468 - RNA, 18 nt, Shigella flexneri 2a str. 2457T
augccacaaacgccgugc

SEQ ID NO: 3841469 - RNA, 19 nt, Shigella flexneri 2a str. 2457T
augccacaaacgccgugca

SEQ ID NO: 3841470 - RNA, 21 nt, Shigella flexneri 2a str. 2457T
augccacagaauucccccauu

SEQ ID NO: 3841471 - RNA, 23 nt, Shigella flexneri 2a str. 2457T
augccacauuagauaaaaaugaa

SEQ ID NO: 3841472 - RNA, 20 nt, Shigella flexneri 2a str. 2457T
augccacgacguuuuccauc

SEQ ID NO: 3841473 - RNA, 21 nt, Shigella flexneri 2a str. 2457T
augccacgacguuuuccaucg

SEQ ID NO: 3841474 - RNA, 19 nt, Shigella flexneri 2a str. 2457T
augccacgugagcuuuucu

SEQ ID NO: 3841475 - RNA, 21 nt, Shigella flexneri 2a str. 2457T
augccacgugagcuuuucugc

SEQ ID NO: 3841476 - RNA, 18 nt, Shigella flexneri 2a str. 2457T
augccacugucaacugcu

SEQ ID NO: 3841477 - RNA, 15 nt, Shigella flexneri 2a str. 2457T
augccagauaagaca

SEQ ID NO: 3841478 - RNA, 16 nt, Shigella flexneri 2a str. 2457T
augccagauaagacac

SEQ ID NO: 3841479 - RNA, 22 nt, Shigella flexneri 2a str. 2457T
augccagaugcgacgcugacgc

SEQ ID NO: 3841480 - RNA, 19 nt, Shigella flexneri 2a str. 2457T
augccagcacagaucgcac

SEQ ID NO: 3841481 - RNA, 14 nt, Shigella flexneri 2a str. 2457T
augccagcgaagaa

SEQ ID NO: 3841482 - RNA, 14 nt, Shigella flexneri 2a str. 2457T
augccagcuuucac

SEQ ID NO: 3841483 - RNA, 15 nt, Shigella flexneri 2a str. 2457T
augccagucaaugaa

SEQ ID NO: 3841484 - RNA, 21 nt, Shigella flexneri 2a str. 2457T
augcccaacaggcgcugguca

SEQ ID NO: 3841485 - RNA, 15 nt, Shigella flexneri 2a str. 2457T
augcccaucacuauc

SEQ ID NO: 3841486 - RNA, 21 nt, Shigella flexneri 2a str. 2457T
augcccccucacaugaguugc

SEQ ID NO: 3841487 - RNA, 21 nt, Shigella flexneri 2a str. 2457T
augccccuguaucaugcagua

SEQ ID NO: 3841488 - RNA, 19 nt, Shigella flexneri 2a str. 2457T
augcccgauaagcaaaaug

SEQ ID NO: 3841489 - RNA, 20 nt, Shigella flexneri 2a str. 2457T
augcccggucgcuccggcua

SEQ ID NO: 3841490 - RNA, 20 nt, Shigella flexneri 2a str. 2457T
augcccucaauaucuuuccc

SEQ ID NO: 3841491 - RNA, 14 nt, Shigella flexneri 2a str. 2457T
augccgaguggcau

SEQ ID NO: 3841492 - RNA, 20 nt, Shigella flexneri 2a str. 2457T
augccgaucaucauccagca

SEQ ID NO: 3841493 - RNA, 18 nt, Shigella flexneri 2a str. 2457T
augccgaugccgacgaug

SEQ ID NO: 3841494 - RNA, 19 nt, Shigella flexneri 2a str. 2457T
augccgauuguauacgcug

SEQ ID NO: 3841495 - RNA, 14 nt, Shigella flexneri 2a str. 2457T
augccgcagcaccc

SEQ ID NO: 3841496 - RNA, 18 nt, Shigella flexneri 2a str. 2457T
augccgccauugacagaa

SEQ ID NO: 3841497 - RNA, 18 nt, Shigella flexneri 2a str. 2457T
augccgccgacaguuauc

SEQ ID NO: 3841498 - RNA, 15 nt, Shigella flexneri 2a str. 2457T
augccgccguagaaa

SEQ ID NO: 3841499 - RNA, 22 nt, Shigella flexneri 2a str. 2457T
augccgcggcgcggcggguuaa

SEQ ID NO: 3841500 - RNA, 20 nt, Shigella flexneri 2a str. 2457T
augccgcguggccuggaauu

SEQ ID NO: 3841501 - RNA, 18 nt, Shigella flexneri 2a str. 2457T
augccggaugcgccagca

SEQ ID NO: 3841502 - RNA, 22 nt, Shigella flexneri 2a str. 2457T
augccggaugcgccagcauccg

SEQ ID NO: 3841503 - RNA, 15 nt, Shigella flexneri 2a str. 2457T
augccggaugcggag

SEQ ID NO: 3841504 - RNA, 18 nt, Shigella flexneri 2a str. 2457T
augccggguaauuucauu

SEQ ID NO: 3841505 - RNA, 22 nt, Shigella flexneri 2a str. 2457T
augccggguuugccgugugccg

SEQ ID NO: 3841506 - RNA, 11 nt, Shigella flexneri 2a str. 2457T
augccggugau

SEQ ID NO: 3841507 - RNA, 16 nt, Shigella flexneri 2a str. 2457T
auggcaaaacggcucu

SEQ ID NO: 3841508 - RNA, 16 nt, Shigella flexneri 2a str. 2457T
auggcaaacaaacugc

SEQ ID NO: 3841509 - RNA, 12 nt, Shigella flexneri 2a str. 2457T
auggcacaaugg

SEQ ID NO: 3841510 - RNA, 17 nt, Shigella flexneri 2a str. 2457T
auggcagaguaucgcca

SEQ ID NO: 3841511 - RNA, 20 nt, Shigella flexneri 2a str. 2457T
auggcagaguugccacccgg

SEQ ID NO: 3841512 - RNA, 21 nt, Shigella flexneri 2a str. 2457T
auggcagaguugccacccggc

SEQ ID NO: 3841513 - RNA, 15 nt, Shigella flexneri 2a str. 2457T
auggcaggaguggca

SEQ ID NO: 3841514 - RNA, 16 nt, Shigella flexneri 2a str. 2457T
auggcauaacguugca

SEQ ID NO: 3841515 - RNA, 20 nt, Shigella flexneri 2a str. 2457T
auggcauaccauccggcaua

SEQ ID NO: 3841516 - RNA, 15 nt, Shigella flexneri 2a str. 2457T
auggcaucaccaucg

SEQ ID NO: 3841517 - RNA, 21 nt, Shigella flexneri 2a str. 2457T
auggcauccgccacuuuaugc

SEQ ID NO: 3841518 - RNA, 13 nt, Shigella flexneri 2a str. 2457T
auggcauccuguu

SEQ ID NO: 3841519 - RNA, 21 nt, Shigella flexneri 2a str. 2457T
auggcaucuacgcucucuuca

SEQ ID NO: 3841520 - RNA, 15 nt, Shigella flexneri 2a str. 2457T
auggcauuaauaugc

SEQ ID NO: 3841521 - RNA, 20 nt, Shigella flexneri 2a str. 2457T
auggcauucucacuccagcc

SEQ ID NO: 3841522 - RNA, 23 nt, Shigella flexneri 2a str. 2457T
auggcauuuuuauuugugguugg

SEQ ID NO: 3841523 - RNA, 13 nt, Shigella flexneri 2a str. 2457T
auggccagccagc

SEQ ID NO: 3841524 - RNA, 19 nt, Shigella flexneri 2a str. 2457T
auggcccgcuugccagaug

SEQ ID NO: 3841525 - RNA, 22 nt, Shigella flexneri 2a str. 2457T
auggccgguuuguuauccaccg

SEQ ID NO: 3841526 - RNA, 13 nt, Shigella flexneri 2a str. 2457T
auggccuuucugg

SEQ ID NO: 3841527 - RNA, 22 nt, Shigella flexneri 2a str. 2457T
auggcgaauuuaucgugauggu

SEQ ID NO: 3841528 - RNA, 16 nt, Shigella flexneri 2a str. 2457T
auggcgacuucugcuu

SEQ ID NO: 3841529 - RNA, 12 nt, Shigella flexneri 2a str. 2457T
auggcgauacuc

SEQ ID NO: 3841530 - RNA, 23 nt, Shigella flexneri 2a str. 2457T
auggcgauuagaaacagaaugau

SEQ ID NO: 3841531 - RNA, 15 nt, Shigella flexneri 2a str. 2457T
auggcgauuauauga

SEQ ID NO: 3841532 - RNA, 23 nt, Shigella flexneri 2a str. 2457T
auggcgcaggauaucguggcacg

SEQ ID NO: 3841533 - RNA, 16 nt, Shigella flexneri 2a str. 2457T
auggcgcgaaaacaac

SEQ ID NO: 3841534 - RNA, 15 nt, Shigella flexneri 2a str. 2457T
auggcgcgcagaaag

SEQ ID NO: 3841535 - RNA, 14 nt, Shigella flexneri 2a str. 2457T
auggcgcgccaccu

SEQ ID NO: 3841536 - RNA, 16 nt, Shigella flexneri 2a str. 2457T
auggcgcugcggcgga

SEQ ID NO: 3841537 - RNA, 18 nt, Shigella flexneri 2a str. 2457T
auggcggcuaggacgcac

SEQ ID NO: 3841538 - RNA, 11 nt, Shigella flexneri 2a str. 2457T
auggcggcugg

SEQ ID NO: 3841539 - RNA, 15 nt, Shigella flexneri 2a str. 2457T
auggcggcuuagcug

SEQ ID NO: 3841540 - RNA, 16 nt, Shigella flexneri 2a str. 2457T
auggcgggauguguaa

SEQ ID NO: 3841541 - RNA, 13 nt, Shigella flexneri 2a str. 2457T
auggcguacucaa

SEQ ID NO: 3841542 - RNA, 14 nt, Shigella flexneri 2a str. 2457T
auggcgucgauaau

SEQ ID NO: 3841543 - RNA, 19 nt, Shigella flexneri 2a str. 2457T
auggcguucgcaacaccgu

SEQ ID NO: 3841544 - RNA, 21 nt, Shigella flexneri 2a str. 2457T
auggcguugucggcagauaac

SEQ ID NO: 3841545 - RNA, 20 nt, Shigella flexneri 2a str. 2457T
auggcuaaaguacguaaaac

SEQ ID NO: 3841546 - RNA, 16 nt, Shigella flexneri 2a str. 2457T
auggcuacguagcuca

SEQ ID NO: 3841547 - RNA, 14 nt, Shigella flexneri 2a str. 2457T
auggcuaucaagau

SEQ ID NO: 3841548 - RNA, 14 nt, Shigella flexneri 2a str. 2457T
auggcucagauuga

SEQ ID NO: 3841549 - RNA, 13 nt, Shigella flexneri 2a str. 2457T
auggcuccgggug

SEQ ID NO: 3841550 - RNA, 16 nt, Shigella flexneri 2a str. 2457T
auggcucuucaccugc

SEQ ID NO: 3841551 - RNA, 19 nt, Shigella flexneri 2a str. 2457T
auggcugaaagcgccggga

SEQ ID NO: 3841552 - RNA, 23 nt, Shigella flexneri 2a str. 2457T
auggcugccuuuuuuacaggugu

SEQ ID NO: 3841553 - RNA, 14 nt, Shigella flexneri 2a str. 2457T
auggcuuugcccuu

SEQ ID NO: 3841554 - RNA, 18 nt, Shigella flexneri 2a str. 2457T
augggaaaugacauucac

SEQ ID NO: 3841555 - RNA, 20 nt, Shigella flexneri 2a str. 2457T
augggaccgcuaccacggaa

SEQ ID NO: 3841556 - RNA, 11 nt, Shigella flexneri 2a str. 2457T
augggagcaga

SEQ ID NO: 3841557 - RNA, 16 nt, Shigella flexneri 2a str. 2457T
augggcguuucacugg

SEQ ID NO: 3841558 - RNA, 23 nt, Shigella flexneri 2a str. 2457T
auggggucaggugggaccaccgc

SEQ ID NO: 3841559 - RNA, 21 nt, Shigella flexneri 2a str. 2457T
augggguggaacggugaaaac

SEQ ID NO: 3841560 - RNA, 16 nt, Shigella flexneri 2a str. 2457T
auggguauauuugcca

SEQ ID NO: 3841561 - RNA, 13 nt, Shigella flexneri 2a str. 2457T
auggguaugugac

SEQ ID NO: 3841562 - RNA, 22 nt, Shigella flexneri 2a str. 2457T
augggucgccgcaaucagccgg

SEQ ID NO: 3841563 - RNA, 15 nt, Shigella flexneri 2a str. 2457T
augguagccgcccug

SEQ ID NO: 3841564 - RNA, 17 nt, Shigella flexneri 2a str. 2457T
augguaucgggcaguuu

SEQ ID NO: 3841565 - RNA, 17 nt, Shigella flexneri 2a str. 2457T
auggucaacauucccug

SEQ ID NO: 3841566 - RNA, 19 nt, Shigella flexneri 2a str. 2457T
auggucaacgucaacuuug

SEQ ID NO: 3841567 - RNA, 22 nt, Shigella flexneri 2a str. 2457T
auggucaaugauuucugccagc

SEQ ID NO: 3841568 - RNA, 14 nt, Shigella flexneri 2a str. 2457T
auggucagcuucac

SEQ ID NO: 3841569 - RNA, 21 nt, Shigella flexneri 2a str. 2457T
auggucagguauuuugucagc

SEQ ID NO: 3841570 - RNA, 20 nt, Shigella flexneri 2a str. 2457T
auggucaguacgccgccguu

SEQ ID NO: 3841571 - RNA, 22 nt, Shigella flexneri 2a str. 2457T
auggucgcaucauuuaaaaaga

SEQ ID NO: 3841572 - RNA, 17 nt, Shigella flexneri 2a str. 2457T
auggucgccccggaacg

SEQ ID NO: 3841573 - RNA, 21 nt, Shigella flexneri 2a str. 2457T
auggucggcagagaguuguau

SEQ ID NO: 3841574 - RNA, 18 nt, Shigella flexneri 2a str. 2457T
auggucuauugcgcuaaa

SEQ ID NO: 3841575 - RNA, 20 nt, Shigella flexneri 2a str. 2457T
auggucucgccgauagucag

SEQ ID NO: 3841576 - RNA, 19 nt, Shigella flexneri 2a str. 2457T
auggucuuguaggccagau

SEQ ID NO: 3841577 - RNA, 18 nt, Shigella flexneri 2a str. 2457T
auggugcaccgauugccg

SEQ ID NO: 3841578 - RNA, 14 nt, Shigella flexneri 2a str. 2457T
augguggagauaaa

SEQ ID NO: 3841579 - RNA, 18 nt, Shigella flexneri 2a str. 2457T
augguggagauaaacucc

SEQ ID NO: 3841580 - RNA, 20 nt, Shigella flexneri 2a str. 2457T
augguggagauaaacuccac

SEQ ID NO: 3841581 - RNA, 20 nt, Shigella flexneri 2a str. 2457T
augguggccgccacgcguga

SEQ ID NO: 3841582 - RNA, 17 nt, Shigella flexneri 2a str. 2457T
augguguaaaugccggu

SEQ ID NO: 3841583 - RNA, 14 nt, Shigella flexneri 2a str. 2457T
augguguacucauc

SEQ ID NO: 3841584 - RNA, 17 nt, Shigella flexneri 2a str. 2457T
augguguucagauggcc

SEQ ID NO: 3841585 - RNA, 17 nt, Shigella flexneri 2a str. 2457T
augguguucaggcauag

SEQ ID NO: 3841586 - RNA, 22 nt, Shigella flexneri 2a str. 2457T
augguguuggcaaucagcggca

SEQ ID NO: 3841587 - RNA, 19 nt, Shigella flexneri 2a str. 2457T
augguguuuuccaccguga

SEQ ID NO: 3841588 - RNA, 21 nt, Shigella flexneri 2a str. 2457T
augguuacgcagauauucguu

SEQ ID NO: 3841589 - RNA, 13 nt, Shigella flexneri 2a str. 2457T
augguuacgcaua

SEQ ID NO: 3841590 - RNA, 17 nt, Shigella flexneri 2a str. 2457T
augguuacuuuuuaugu

SEQ ID NO: 3841591 - RNA, 19 nt, Shigella flexneri 2a str. 2457T
augguugaacggauauuuu

SEQ ID NO: 3841592 - RNA, 16 nt, Shigella flexneri 2a str. 2457T
augguugucacugcau

SEQ ID NO: 3841593 - RNA, 17 nt, Shigella flexneri 2a str. 2457T
augguuucauuccagua

SEQ ID NO: 3841594 - RNA, 13 nt, Shigella flexneri 2a str. 2457T
augguuucauucu

SEQ ID NO: 3841595 - RNA, 11 nt, Shigella flexneri 2a str. 2457T
augguuuucaa

SEQ ID NO: 3841596 - RNA, 20 nt, Shigella flexneri 2a str. 2457T
augguuuuuggguucagcau

SEQ ID NO: 3841597 - RNA, 19 nt, Shigella flexneri 2a str. 2457T
auguaaaaggcgcuaaaaa

SEQ ID NO: 3841598 - RNA, 21 nt, Shigella flexneri 2a str. 2457T
auguaaaaggcgcuaaaaaua

SEQ ID NO: 3841599 - RNA, 16 nt, Shigella flexneri 2a str. 2457T
auguaagaugaaauag

SEQ ID NO: 3841600 - RNA, 23 nt, Shigella flexneri 2a str. 2457T
auguacaugucgcuguuucugga

SEQ ID NO: 3841601 - RNA, 14 nt, Shigella flexneri 2a str. 2457T
auguagcgcugcaa

SEQ ID NO: 3841602 - RNA, 24 nt, Shigella flexneri 2a str. 2457T
auguagcgcugcaaaccacgguuc

SEQ ID NO: 3841603 - RNA, 14 nt, Shigella flexneri 2a str. 2457T
auguagcucaccuu

SEQ ID NO: 3841604 - RNA, 22 nt, Shigella flexneri 2a str. 2457T
auuaaaguaggccagauaagac

SEQ ID NO: 3841605 - RNA, 22 nt, Shigella flexneri 2a str. 2457T
auuaaauucaaugaauuaaaaa

SEQ ID NO: 3841606 - RNA, 14 nt, Shigella flexneri 2a str. 2457T
auuaacaacgggcu

SEQ ID NO: 3841607 - RNA, 15 nt, Shigella flexneri 2a str. 2457T
auuaacaacgggcua

SEQ ID NO: 3841608 - RNA, 15 nt, Shigella flexneri 2a str. 2457T
auuaacagcaaacag

SEQ ID NO: 3841609 - RNA, 12 nt, Shigella flexneri 2a str. 2457T
auuaacagguau

SEQ ID NO: 3841610 - RNA, 16 nt, Shigella flexneri 2a str. 2457T
auuaacagguauagaa

SEQ ID NO: 3841611 - RNA, 18 nt, Shigella flexneri 2a str. 2457T
auuaacagucagucucaa

SEQ ID NO: 3841612 - RNA, 22 nt, Shigella flexneri 2a str. 2457T
auuaacagucagucucaaggga

SEQ ID NO: 3841613 - RNA, 17 nt, Shigella flexneri 2a str. 2457T
auuaacaguccgccguu

SEQ ID NO: 3841614 - RNA, 18 nt, Shigella flexneri 2a str. 2457T
auuaaccucaaccacuca

SEQ ID NO: 3841615 - RNA, 15 nt, Shigella flexneri 2a str. 2457T
auuaacgaaaucuca

SEQ ID NO: 3841616 - RNA, 22 nt, Shigella flexneri 2a str. 2457T
auuaacgacgcauacucuuuga

SEQ ID NO: 3841617 - RNA, 15 nt, Shigella flexneri 2a str. 2457T
auuaacgauacuucu

SEQ ID NO: 3841618 - RNA, 16 nt, Shigella flexneri 2a str. 2457T
auuaacgauacuucug

SEQ ID NO: 3841619 - RNA, 20 nt, Shigella flexneri 2a str. 2457T
auuaacgauacuucugguga

SEQ ID NO: 3841620 - RNA, 15 nt, Shigella flexneri 2a str. 2457T
auuaacgcaauaaug

SEQ ID NO: 3841621 - RNA, 18 nt, Shigella flexneri 2a str. 2457T
auuaacgccagacucgcc

SEQ ID NO: 3841622 - RNA, 20 nt, Shigella flexneri 2a str. 2457T
auuaacgccagccuguucca

SEQ ID NO: 3841623 - RNA, 19 nt, Shigella flexneri 2a str. 2457T
auuaacgcuuguaaaugaa

SEQ ID NO: 3841624 - RNA, 23 nt, Shigella flexneri 2a str. 2457T
auuaacggcguuuccuucguuau

SEQ ID NO: 3841625 - RNA, 20 nt, Shigella flexneri 2a str. 2457T
auuaacgugaucaaaucaug

SEQ ID NO: 3841626 - RNA, 14 nt, Shigella flexneri 2a str. 2457T
auuaacguuuccau

SEQ ID NO: 3841627 - RNA, 16 nt, Shigella flexneri 2a str. 2457T
auuaacucaauaccug

SEQ ID NO: 3841628 - RNA, 22 nt, Shigella flexneri 2a str. 2457T
auuaacucagcauuauuuuuaa

SEQ ID NO: 3841629 - RNA, 20 nt, Shigella flexneri 2a str. 2457T
auuaacuuaauaaacaucag

SEQ ID NO: 3841630 - RNA, 18 nt, Shigella flexneri 2a str. 2457T
auuaacuucccaccuuua

SEQ ID NO: 3841631 - RNA, 21 nt, Shigella flexneri 2a str. 2457T
auuaagaagucgcaaugagua

SEQ ID NO: 3841632 - RNA, 18 nt, Shigella flexneri 2a str. 2457T
auuaagccaugaaugaug

SEQ ID NO: 3841633 - RNA, 17 nt, Shigella flexneri 2a str. 2457T
auuaagcccggucauca

SEQ ID NO: 3841634 - RNA, 17 nt, Shigella flexneri 2a str. 2457T
auuaagcgcaaaggcca

SEQ ID NO: 3841635 - RNA, 20 nt, Shigella flexneri 2a str. 2457T
auuaagcgcaaaggccagca

SEQ ID NO: 3841636 - RNA, 22 nt, Shigella flexneri 2a str. 2457T
auuaagcgcaaaggccagcaau

SEQ ID NO: 3841637 - RNA, 17 nt, Shigella flexneri 2a str. 2457T
auuaagcgucgguacaa

SEQ ID NO: 3841638 - RNA, 17 nt, Shigella flexneri 2a str. 2457T
auuaaggcaagaaaauu

SEQ ID NO: 3841639 - RNA, 17 nt, Shigella flexneri 2a str. 2457T
auuaaggguaaaaggau

SEQ ID NO: 3841640 - RNA, 17 nt, Shigella flexneri 2a str. 2457T
auuaauaaaauuaucca

SEQ ID NO: 3841641 - RNA, 11 nt, Shigella flexneri 2a str. 2457T
auuaauacaac

SEQ ID NO: 3841642 - RNA, 14 nt, Shigella flexneri 2a str. 2457T
auuaaucagcagau

SEQ ID NO: 3841643 - RNA, 21 nt, Shigella flexneri 2a str. 2457T
auuaaucccugcuucggucag

SEQ ID NO: 3841644 - RNA, 22 nt, Shigella flexneri 2a str. 2457T
auuaaucgagauaccuaacauu

SEQ ID NO: 3841645 - RNA, 23 nt, Shigella flexneri 2a str. 2457T
auuaaucgauaaaccagcaacca

SEQ ID NO: 3841646 - RNA, 18 nt, Shigella flexneri 2a str. 2457T
auuaaucgugaaaagcug

SEQ ID NO: 3841647 - RNA, 20 nt, Shigella flexneri 2a str. 2457T
auuaaugccucgugcucaga

SEQ ID NO: 3841648 - RNA, 23 nt, Shigella flexneri 2a str. 2457T
auuaauggugauggucgucaauc

SEQ ID NO: 3841649 - RNA, 14 nt, Shigella flexneri 2a str. 2457T
auuaauuucauuuu

SEQ ID NO: 3841650 - RNA, 18 nt, Shigella flexneri 2a str. 2457T
auuacaagaaucaugcca

SEQ ID NO: 3841651 - RNA, 12 nt, Shigella flexneri 2a str. 2457T
auuacacagcca

SEQ ID NO: 3841652 - RNA, 17 nt, Shigella flexneri 2a str. 2457T
auuacacccuuaaucaa

SEQ ID NO: 3841653 - RNA, 14 nt, Shigella flexneri 2a str. 2457T
auuacagagguuuu

SEQ ID NO: 3841654 - RNA, 17 nt, Shigella flexneri 2a str. 2457T
auuacagagguuuuaug

SEQ ID NO: 3841655 - RNA, 14 nt, Shigella flexneri 2a str. 2457T
auuacagcaccuua

SEQ ID NO: 3841656 - RNA, 20 nt, Shigella flexneri 2a str. 2457T
auuacaucgcgaagaaagcg

SEQ ID NO: 3841657 - RNA, 17 nt, Shigella flexneri 2a str. 2457T
auuaccaacucaucgcc

SEQ ID NO: 3841658 - RNA, 12 nt, Shigella flexneri 2a str. 2457T
auuaccauuuca

SEQ ID NO: 3841659 - RNA, 20 nt, Shigella flexneri 2a str. 2457T
auuacccguugcaauacuuc

SEQ ID NO: 3841660 - RNA, 22 nt, Shigella flexneri 2a str. 2457T
auuacccuucgcccugcgucgc

SEQ ID NO: 3841661 - RNA, 22 nt, Shigella flexneri 2a str. 2457T
auuaccgaugugaacccugauu

SEQ ID NO: 3841662 - RNA, 18 nt, Shigella flexneri 2a str. 2457T
auuaccgcaccaccagca

SEQ ID NO: 3841663 - RNA, 20 nt, Shigella flexneri 2a str. 2457T
auuaccgcgggaugcucuuu

SEQ ID NO: 3841664 - RNA, 22 nt, Shigella flexneri 2a str. 2457T
auuaccgcgggaugcucuuuuc

SEQ ID NO: 3841665 - RNA, 19 nt, Shigella flexneri 2a str. 2457T
auuaccguuaaaaccaucg

SEQ ID NO: 3841666 - RNA, 13 nt, Shigella flexneri 2a str. 2457T
auuaccuuaucaa

SEQ ID NO: 3841667 - RNA, 17 nt, Shigella flexneri 2a str. 2457T
auuaccuuuuuacccau

SEQ ID NO: 3841668 - RNA, 19 nt, Shigella flexneri 2a str. 2457T
auuaccuuuuuacccaugg

SEQ ID NO: 3841669 - RNA, 21 nt, Shigella flexneri 2a str. 2457T
auuacgaauauaaauauuuuc

SEQ ID NO: 3841670 - RNA, 20 nt, Shigella flexneri 2a str. 2457T
auuacgagucacaaacauca

SEQ ID NO: 3841671 - RNA, 21 nt, Shigella flexneri 2a str. 2457T
auuacgcaaugcguacuucuu

SEQ ID NO: 3841672 - RNA, 18 nt, Shigella flexneri 2a str. 2457T
auuacgcccgacgaggcg

SEQ ID NO: 3841673 - RNA, 11 nt, Shigella flexneri 2a str. 2457T
auuacgcgccc

SEQ ID NO: 3841674 - RNA, 14 nt, Shigella flexneri 2a str. 2457T
auuacgcucacugc

SEQ ID NO: 3841675 - RNA, 18 nt, Shigella flexneri 2a str. 2457T
auuacgcuguucaucccg

SEQ ID NO: 3841676 - RNA, 14 nt, Shigella flexneri 2a str. 2457T
auuacggauuaaau

SEQ ID NO: 3841677 - RNA, 21 nt, Shigella flexneri 2a str. 2457T
auuacgggcgaaguucgccau

SEQ ID NO: 3841678 - RNA, 15 nt, Shigella flexneri 2a str. 2457T
auuacggucaaauua

SEQ ID NO: 3841679 - RNA, 16 nt, Shigella flexneri 2a str. 2457T
auuacucaacagguaa

SEQ ID NO: 3841680 - RNA, 12 nt, Shigella flexneri 2a str. 2457T
auuacucagcaa

SEQ ID NO: 3841681 - RNA, 12 nt, Shigella flexneri 2a str. 2457T
auuacucagcgc

SEQ ID NO: 3841682 - RNA, 12 nt, Shigella flexneri 2a str. 2457T
auuacugauugc

SEQ ID NO: 3841683 - RNA, 23 nt, Shigella flexneri 2a str. 2457T
auuacugccuugaugaaaaaacc

SEQ ID NO: 3841684 - RNA, 15 nt, Shigella flexneri 2a str. 2457T
auuacuuccuucaug

SEQ ID NO: 3841685 - RNA, 16 nt, Shigella flexneri 2a str. 2457T
auuacuuuauuuauau

SEQ ID NO: 3841686 - RNA, 18 nt, Shigella flexneri 2a str. 2457T
auuacuuuccaucuuucc

SEQ ID NO: 3841687 - RNA, 21 nt, Shigella flexneri 2a str. 2457T
auuacuuucggugacuucaaa

SEQ ID NO: 3841688 - RNA, 16 nt, Shigella flexneri 2a str. 2457T
auuagauaaaaaugaa

SEQ ID NO: 3841689 - RNA, 17 nt, Shigella flexneri 2a str. 2457T
auuagcaauauuuuuau

SEQ ID NO: 3841690 - RNA, 18 nt, Shigella flexneri 2a str. 2457T
auuagcaauauuuuuaug

SEQ ID NO: 3841691 - RNA, 17 nt, Shigella flexneri 2a str. 2457T
auuagcacgauuuugua

SEQ ID NO: 3841692 - RNA, 15 nt, Shigella flexneri 2a str. 2457T
auuagcacuuuucgu

SEQ ID NO: 3841693 - RNA, 16 nt, Shigella flexneri 2a str. 2457T
auuagcauugaugcgu

SEQ ID NO: 3841694 - RNA, 12 nt, Shigella flexneri 2a str. 2457T
auuagccaggca

SEQ ID NO: 3841695 - RNA, 14 nt, Shigella flexneri 2a str. 2457T
auuagcccaauaau

SEQ ID NO: 3841696 - RNA, 19 nt, Shigella flexneri 2a str. 2457T
auuagcccgguagcaugaa

SEQ ID NO: 3841697 - RNA, 19 nt, Shigella flexneri 2a str. 2457T
auuagccugaauauccaga

SEQ ID NO: 3841698 - RNA, 20 nt, Shigella flexneri 2a str. 2457T
auuagcgaccgaacagauca

SEQ ID NO: 3841699 - RNA, 22 nt, Shigella flexneri 2a str. 2457T
auuagcgcuaucaaagggcacc

SEQ ID NO: 3841700 - RNA, 18 nt, Shigella flexneri 2a str. 2457T
auuaggaauaaugucuuu

SEQ ID NO: 3841701 - RNA, 14 nt, Shigella flexneri 2a str. 2457T
auucauaaugccca

SEQ ID NO: 3841702 - RNA, 15 nt, Shigella flexneri 2a str. 2457T
auucauaugcgccag

SEQ ID NO: 3841703 - RNA, 13 nt, Shigella flexneri 2a str. 2457T
auucaucaaaugg

SEQ ID NO: 3841704 - RNA, 19 nt, Shigella flexneri 2a str. 2457T
auucaucgcccuuuuuuca

SEQ ID NO: 3841705 - RNA, 14 nt, Shigella flexneri 2a str. 2457T
auucaucuccagca

SEQ ID NO: 3841706 - RNA, 22 nt, Shigella flexneri 2a str. 2457T
auucauggcaggaguggcagca

SEQ ID NO: 3841707 - RNA, 18 nt, Shigella flexneri 2a str. 2457T
auucauggcauuuucucg

SEQ ID NO: 3841708 - RNA, 16 nt, Shigella flexneri 2a str. 2457T
auucauggugaauauc

SEQ ID NO: 3841709 - RNA, 15 nt, Shigella flexneri 2a str. 2457T
auucauuacucaacg

SEQ ID NO: 3841710 - RNA, 22 nt, Shigella flexneri 2a str. 2457T
auucauucaauuaauaacacau

SEQ ID NO: 3841711 - RNA, 13 nt, Shigella flexneri 2a str. 2457T
auucauuccuuga

SEQ ID NO: 3841712 - RNA, 23 nt, Shigella flexneri 2a str. 2457T
auucauugccugaugcgacgcuu

SEQ ID NO: 3841713 - RNA, 17 nt, Shigella flexneri 2a str. 2457T
auucauuuauguucagc

SEQ ID NO: 3841714 - RNA, 18 nt, Shigella flexneri 2a str. 2457T
auucauuugaauaguuaa

SEQ ID NO: 3841715 - RNA, 13 nt, Shigella flexneri 2a str. 2457T
auucauuuugcug

SEQ ID NO: 3841716 - RNA, 13 nt, Shigella flexneri 2a str. 2457T
auuccacgcauca

SEQ ID NO: 3841717 - RNA, 14 nt, Shigella flexneri 2a str. 2457T
auuccagaaaagag

SEQ ID NO: 3841718 - RNA, 14 nt, Shigella flexneri 2a str. 2457T
auuccaguccacau

SEQ ID NO: 3841719 - RNA, 21 nt, Shigella flexneri 2a str. 2457T
auuccaguuuucaaauaucua

SEQ ID NO: 3841720 - RNA, 21 nt, Shigella flexneri 2a str. 2457T
auuccauuucccugacaaauc

SEQ ID NO: 3841721 - RNA, 22 nt, Shigella flexneri 2a str. 2457T
auuccauuucccugacaaauca

SEQ ID NO: 3841722 - RNA, 18 nt, Shigella flexneri 2a str. 2457T
auucccauuuauuuuucc

SEQ ID NO: 3841723 - RNA, 22 nt, Shigella flexneri 2a str. 2457T
auucccauuuauuuuuccucca

SEQ ID NO: 3841724 - RNA, 22 nt, Shigella flexneri 2a str. 2457T
auucccccuuugaccagccagu

SEQ ID NO: 3841725 - RNA, 19 nt, Shigella flexneri 2a str. 2457T
auuccccggucagcagcac

SEQ ID NO: 3841726 - RNA, 19 nt, Shigella flexneri 2a str. 2457T
auucccgcgaacuaaacaa

SEQ ID NO: 3841727 - RNA, 17 nt, Shigella flexneri 2a str. 2457T
auucccgggcacacuua

SEQ ID NO: 3841728 - RNA, 24 nt, Shigella flexneri 2a str. 2457T
auucccugcagucaccugcccucc

SEQ ID NO: 3841729 - RNA, 19 nt, Shigella flexneri 2a str. 2457T
auucccugcgccagcggca

SEQ ID NO: 3841730 - RNA, 19 nt, Shigella flexneri 2a str. 2457T
auucccugcuuugcaagcg

SEQ ID NO: 3841731 - RNA, 15 nt, Shigella flexneri 2a str. 2457T
auucccuugcucugg

SEQ ID NO: 3841732 - RNA, 15 nt, Shigella flexneri 2a str. 2457T
auuccgcaccugcca

SEQ ID NO: 3841733 - RNA, 22 nt, Shigella flexneri 2a str. 2457T
auuccgcaccugccagcgccga

SEQ ID NO: 3841734 - RNA, 23 nt, Shigella flexneri 2a str. 2457T
auuccgccaccugcgaacuguaa

SEQ ID NO: 3841735 - RNA, 15 nt, Shigella flexneri 2a str. 2457T
auuccgccaguucuu

SEQ ID NO: 3841736 - RNA, 15 nt, Shigella flexneri 2a str. 2457T
auuccgccaguugcg

SEQ ID NO: 3841737 - RNA, 18 nt, Shigella flexneri 2a str. 2457T
auuccgcgugaaaugcca

SEQ ID NO: 3841738 - RNA, 23 nt, Shigella flexneri 2a str. 2457T
auuccgggaaacgaaccauaaaa

SEQ ID NO: 3841739 - RNA, 16 nt, Shigella flexneri 2a str. 2457T
auuccuaugcaacaac

SEQ ID NO: 3841740 - RNA, 14 nt, Shigella flexneri 2a str. 2457T
auuccuauuuuguu

SEQ ID NO: 3841741 - RNA, 21 nt, Shigella flexneri 2a str. 2457T
auuccucccguuaugaucagc

SEQ ID NO: 3841742 - RNA, 20 nt, Shigella flexneri 2a str. 2457T
auuccugacccagcaccagu

SEQ ID NO: 3841743 - RNA, 22 nt, Shigella flexneri 2a str. 2457T
auuccugccgcguuggcaaugu

SEQ ID NO: 3841744 - RNA, 21 nt, Shigella flexneri 2a str. 2457T
auuccugcgcuuccagcucca

SEQ ID NO: 3841745 - RNA, 22 nt, Shigella flexneri 2a str. 2457T
auuccugcuuauuguauuucuu

SEQ ID NO: 3841746 - RNA, 18 nt, Shigella flexneri 2a str. 2457T
auuccuuucccuauuuuu

SEQ ID NO: 3841747 - RNA, 22 nt, Shigella flexneri 2a str. 2457T
auuccuuucccuauuuuuucgu

SEQ ID NO: 3841748 - RNA, 15 nt, Shigella flexneri 2a str. 2457T
auucgaaauagagaa

SEQ ID NO: 3841749 - RNA, 12 nt, Shigella flexneri 2a str. 2457T
auucgaaaucug

SEQ ID NO: 3841750 - RNA, 23 nt, Shigella flexneri 2a str. 2457T
auucgaaugccgucgaggaacau

SEQ ID NO: 3841751 - RNA, 16 nt, Shigella flexneri 2a str. 2457T
auucgacgcgcgcaca

SEQ ID NO: 3841752 - RNA, 20 nt, Shigella flexneri 2a str. 2457T
auucgaucaaacaauuuuca

SEQ ID NO: 3841753 - RNA, 16 nt, Shigella flexneri 2a str. 2457T
auucgauucacauuua

SEQ ID NO: 3841754 - RNA, 18 nt, Shigella flexneri 2a str. 2457T
auucgauucacauuuaaa

SEQ ID NO: 3841755 - RNA, 20 nt, Shigella flexneri 2a str. 2457T
auucgauucacauuuaaaca

SEQ ID NO: 3841756 - RNA, 22 nt, Shigella flexneri 2a str. 2457T
auucgccagaccuaccaucucc

SEQ ID NO: 3841757 - RNA, 15 nt, Shigella flexneri 2a str. 2457T
auucgcgauauguac

SEQ ID NO: 3841758 - RNA, 18 nt, Shigella flexneri 2a str. 2457T
auucgcgcacggugcauc

SEQ ID NO: 3841759 - RNA, 20 nt, Shigella flexneri 2a str. 2457T
auucgcuaacguuuuuaaaa

SEQ ID NO: 3841760 - RNA, 21 nt, Shigella flexneri 2a str. 2457T
auucgcuuccucaaccacuuu

SEQ ID NO: 3841761 - RNA, 15 nt, Shigella flexneri 2a str. 2457T
auucgcuuucacuca

SEQ ID NO: 3841762 - RNA, 17 nt, Shigella flexneri 2a str. 2457T
auucgcuuucagcgagu

SEQ ID NO: 3841763 - RNA, 19 nt, Shigella flexneri 2a str. 2457T
auucggauugcuauuuaac

SEQ ID NO: 3841764 - RNA, 13 nt, Shigella flexneri 2a str. 2457T
auucggccaguaa

SEQ ID NO: 3841765 - RNA, 17 nt, Shigella flexneri 2a str. 2457T
auucggcuacuacggcg

SEQ ID NO: 3841766 - RNA, 19 nt, Shigella flexneri 2a str. 2457T
auucggguucauguucaga

SEQ ID NO: 3841767 - RNA, 15 nt, Shigella flexneri 2a str. 2457T
auucggucaggugac

SEQ ID NO: 3841768 - RNA, 15 nt, Shigella flexneri 2a str. 2457T
auucguauuuaaaac

SEQ ID NO: 3841769 - RNA, 15 nt, Shigella flexneri 2a str. 2457T
auucgugacaauauc

SEQ ID NO: 3841770 - RNA, 24 nt, Shigella flexneri 2a str. 2457T
auucuacuuugcgagucugcucca

SEQ ID NO: 3841771 - RNA, 23 nt, Shigella flexneri 2a str. 2457T
auucuauacaaacuuaccgccgc

SEQ ID NO: 3841772 - RNA, 19 nt, Shigella flexneri 2a str. 2457T
auucuaucgcccccucuuc

SEQ ID NO: 3841773 - RNA, 16 nt, Shigella flexneri 2a str. 2457T
auucucaaaauacagu

SEQ ID NO: 3841774 - RNA, 16 nt, Shigella flexneri 2a str. 2457T
auucucacuccagcca

SEQ ID NO: 3841775 - RNA, 19 nt, Shigella flexneri 2a str. 2457T
auucucagcugcaagauga

SEQ ID NO: 3841776 - RNA, 22 nt, Shigella flexneri 2a str. 2457T
auucucagcugcaagaugaaua

SEQ ID NO: 3841777 - RNA, 15 nt, Shigella flexneri 2a str. 2457T
auucucagugguugu

SEQ ID NO: 3841778 - RNA, 22 nt, Shigella flexneri 2a str. 2457T
auucuccaaugccguucucugg

SEQ ID NO: 3841779 - RNA, 20 nt, Shigella flexneri 2a str. 2457T
auucucccucaucauuugaa

SEQ ID NO: 3841780 - RNA, 16 nt, Shigella flexneri 2a str. 2457T
auucuccggcaggaaa

SEQ ID NO: 3841781 - RNA, 15 nt, Shigella flexneri 2a str. 2457T
auucucgccgcccug

SEQ ID NO: 3841782 - RNA, 18 nt, Shigella flexneri 2a str. 2457T
auucucuauuucacccgc

SEQ ID NO: 3841783 - RNA, 15 nt, Shigella flexneri 2a str. 2457T
auucucuuuuguuac

SEQ ID NO: 3841784 - RNA, 20 nt, Shigella flexneri 2a str. 2457T
auucucuuuuguuacuuauu

SEQ ID NO: 3841785 - RNA, 17 nt, Shigella flexneri 2a str. 2457T
auucugacgccaccauu

SEQ ID NO: 3841786 - RNA, 13 nt, Shigella flexneri 2a str. 2457T
auucugacugggu

SEQ ID NO: 3841787 - RNA, 21 nt, Shigella flexneri 2a str. 2457T
auucugagagcaugaaaugaa

SEQ ID NO: 3841788 - RNA, 14 nt, Shigella flexneri 2a str. 2457T
auucugauaugcag

SEQ ID NO: 3841789 - RNA, 13 nt, Shigella flexneri 2a str. 2457T
auucugauccugc

SEQ ID NO: 3841790 - RNA, 22 nt, Shigella flexneri 2a str. 2457T
auucugcaaggcaaaauacguu

SEQ ID NO: 3841791 - RNA, 18 nt, Shigella flexneri 2a str. 2457T
auucugcccaagcgggga

SEQ ID NO: 3841792 - RNA, 17 nt, Shigella flexneri 2a str. 2457T
auucugcgcugacucua

SEQ ID NO: 3841793 - RNA, 15 nt, Shigella flexneri 2a str. 2457T
auucugcugauuaac

SEQ ID NO: 3841794 - RNA, 18 nt, Shigella flexneri 2a str. 2457T
auucuggagcuggacggu

SEQ ID NO: 3841795 - RNA, 16 nt, Shigella flexneri 2a str. 2457T
auucuggccacuucug

SEQ ID NO: 3841796 - RNA, 17 nt, Shigella flexneri 2a str. 2457T
auucuggcggcaauaac

SEQ ID NO: 3841797 - RNA, 16 nt, Shigella flexneri 2a str. 2457T
auucugggaacuauau

SEQ ID NO: 3841798 - RNA, 19 nt, Shigella flexneri 2a str. 2457T
auugcguuuaguuacacca

SEQ ID NO: 3841799 - RNA, 17 nt, Shigella flexneri 2a str. 2457T
auugcuauuuccaccuc

SEQ ID NO: 3841800 - RNA, 12 nt, Shigella flexneri 2a str. 2457T
auugcucaaagu

SEQ ID NO: 3841801 - RNA, 12 nt, Shigella flexneri 2a str. 2457T
auugcuccaucc

SEQ ID NO: 3841802 - RNA, 15 nt, Shigella flexneri 2a str. 2457T
auugcugaaauacag

SEQ ID NO: 3841803 - RNA, 16 nt, Shigella flexneri 2a str. 2457T
auugcugaaauacaga

SEQ ID NO: 3841804 - RNA, 23 nt, Shigella flexneri 2a str. 2457T
auugcugccgauggcacaaucuc

SEQ ID NO: 3841805 - RNA, 20 nt, Shigella flexneri 2a str. 2457T
auugcugcugaagcaacagu

SEQ ID NO: 3841806 - RNA, 19 nt, Shigella flexneri 2a str. 2457T
auugcugugccggaagggg

SEQ ID NO: 3841807 - RNA, 14 nt, Shigella flexneri 2a str. 2457T
auugcuguuuuaca

SEQ ID NO: 3841808 - RNA, 13 nt, Shigella flexneri 2a str. 2457T
auugcuucaagau

SEQ ID NO: 3841809 - RNA, 16 nt, Shigella flexneri 2a str. 2457T
auugcuucaccagcag

SEQ ID NO: 3841810 - RNA, 13 nt, Shigella flexneri 2a str. 2457T
auugcuucugcuu

SEQ ID NO: 3841811 - RNA, 16 nt, Shigella flexneri 2a str. 2457T
auugcuuuaccgcauc

SEQ ID NO: 3841812 - RNA, 22 nt, Shigella flexneri 2a str. 2457T
auugcuuuuacauuauccagcg

SEQ ID NO: 3841813 - RNA, 20 nt, Shigella flexneri 2a str. 2457T
auugcuuuuaccauacugga

SEQ ID NO: 3841814 - RNA, 21 nt, Shigella flexneri 2a str. 2457T
auugcuuuuuuccauaagccc

SEQ ID NO: 3841815 - RNA, 17 nt, Shigella flexneri 2a str. 2457T
auuggaauacauauauu

SEQ ID NO: 3841816 - RNA, 17 nt, Shigella flexneri 2a str. 2457T
auuggagacugaugaca

SEQ ID NO: 3841817 - RNA, 20 nt, Shigella flexneri 2a str. 2457T
auuggagacugaugacaaac

SEQ ID NO: 3841818 - RNA, 22 nt, Shigella flexneri 2a str. 2457T
auuggagaguugcaccagcaac

SEQ ID NO: 3841819 - RNA, 19 nt, Shigella flexneri 2a str. 2457T
auuggcagagcgaucaacc

SEQ ID NO: 3841820 - RNA, 13 nt, Shigella flexneri 2a str. 2457T
auuggcaucgcca

SEQ ID NO: 3841821 - RNA, 22 nt, Shigella flexneri 2a str. 2457T
auuggcgaagaacgcauugcca

SEQ ID NO: 3841822 - RNA, 17 nt, Shigella flexneri 2a str. 2457T
auuggcggcguccugga

SEQ ID NO: 3841823 - RNA, 16 nt, Shigella flexneri 2a str. 2457T
auugggauuaaagcgc

SEQ ID NO: 3841824 - RNA, 17 nt, Shigella flexneri 2a str. 2457T
auugggcgaaagaaaag

SEQ ID NO: 3841825 - RNA, 14 nt, Shigella flexneri 2a str. 2457T
auuggguauucauu

SEQ ID NO: 3841826 - RNA, 18 nt, Shigella flexneri 2a str. 2457T
auugguacauaacacaau

SEQ ID NO: 3841827 - RNA, 19 nt, Shigella flexneri 2a str. 2457T
auuggucauuagugauuaa

SEQ ID NO: 3841828 - RNA, 16 nt, Shigella flexneri 2a str. 2457T
auuggugaauugcacg

SEQ ID NO: 3841829 - RNA, 16 nt, Shigella flexneri 2a str. 2457T
auugguuuuuugguaa

SEQ ID NO: 3841830 - RNA, 14 nt, Shigella flexneri 2a str. 2457T
auuguaaucuauug

SEQ ID NO: 3841831 - RNA, 23 nt, Shigella flexneri 2a str. 2457T
auuguagacaacgugggcuuugu

SEQ ID NO: 3841832 - RNA, 22 nt, Shigella flexneri 2a str. 2457T
auuguauuuaaagugcaaaaau

SEQ ID NO: 3841833 - RNA, 19 nt, Shigella flexneri 2a str. 2457T
auugucagcugguggcgua

SEQ ID NO: 3841834 - RNA, 18 nt, Shigella flexneri 2a str. 2457T
auugucauagcgacuacc

SEQ ID NO: 3841835 - RNA, 20 nt, Shigella flexneri 2a str. 2457T
auugucauucgccugacgca

SEQ ID NO: 3841836 - RNA, 16 nt, Shigella flexneri 2a str. 2457T
auugucgauacgccuc

SEQ ID NO: 3841837 - RNA, 19 nt, Shigella flexneri 2a str. 2457T
auugucucccacaugcugg

SEQ ID NO: 3841838 - RNA, 23 nt, Shigella flexneri 2a str. 2457T
auugucuuaaaccggacaauaaa

SEQ ID NO: 3841839 - RNA, 22 nt, Shigella flexneri 2a str. 2457T
auugucuucaagaucagcggca

SEQ ID NO: 3841840 - RNA, 15 nt, Shigella flexneri 2a str. 2457T
auugugcgccauuuu

SEQ ID NO: 3841841 - RNA, 23 nt, Shigella flexneri 2a str. 2457T
auuguggugaucacccagacgca

SEQ ID NO: 3841842 - RNA, 14 nt, Shigella flexneri 2a str. 2457T
auugugucaacucc

SEQ ID NO: 3841843 - RNA, 17 nt, Shigella flexneri 2a str. 2457T
auugugugauacuucuu

SEQ ID NO: 3841844 - RNA, 14 nt, Shigella flexneri 2a str. 2457T
auuguuaaucacau

SEQ ID NO: 3841845 - RNA, 17 nt, Shigella flexneri 2a str. 2457T
auuguuauaccagucca

SEQ ID NO: 3841846 - RNA, 14 nt, Shigella flexneri 2a str. 2457T
auuguucugcgcug

SEQ ID NO: 3841847 - RNA, 16 nt, Shigella flexneri 2a str. 2457T
auuguugauaaggaaa

SEQ ID NO: 3841848 - RNA, 19 nt, Shigella flexneri 2a str. 2457T
auuguugcccgcgccucaa

SEQ ID NO: 3841849 - RNA, 17 nt, Shigella flexneri 2a str. 2457T
auuguuuccauauguac

SEQ ID NO: 3841850 - RNA, 14 nt, Shigella flexneri 2a str. 2457T
auuguuugucauga

SEQ ID NO: 3841851 - RNA, 13 nt, Shigella flexneri 2a str. 2457T
auuuaaaaagaaa

SEQ ID NO: 3841852 - RNA, 20 nt, Shigella flexneri 2a str. 2457T
auuuaaaaagaaaaaacuaa

SEQ ID NO: 3841853 - RNA, 11 nt, Shigella flexneri 2a str. 2457T
auuuaaaacca

SEQ ID NO: 3841854 - RNA, 17 nt, Shigella flexneri 2a str. 2457T
auuuaaacaauuucaga

SEQ ID NO: 3841855 - RNA, 16 nt, Shigella flexneri 2a str. 2457T
auuuaaagugcaaaaa

SEQ ID NO: 3841856 - RNA, 18 nt, Shigella flexneri 2a str. 2457T
auuuaaauucgcugcgga

SEQ ID NO: 3841857 - RNA, 22 nt, Shigella flexneri 2a str. 2457T
auuuaaauugcgguuuuuaagg

SEQ ID NO: 3841858 - RNA, 13 nt, Shigella flexneri 2a str. 2457T
auuuaacagcaaa

SEQ ID NO: 3841859 - RNA, 16 nt, Shigella flexneri 2a str. 2457T
auuuaacaguugucca

SEQ ID NO: 3841860 - RNA, 18 nt, Shigella flexneri 2a str. 2457T
auuuaacccuucaagaau

SEQ ID NO: 3841861 - RNA, 14 nt, Shigella flexneri 2a str. 2457T
auuuaacggcagca

SEQ ID NO: 3841862 - RNA, 16 nt, Shigella flexneri 2a str. 2457T
auuuaagaaaaaagau

SEQ ID NO: 3841863 - RNA, 16 nt, Shigella flexneri 2a str. 2457T
auuuaagguguugcgu

SEQ ID NO: 3841864 - RNA, 18 nt, Shigella flexneri 2a str. 2457T
auuuaagguuaugcaagu

SEQ ID NO: 3841865 - RNA, 23 nt, Shigella flexneri 2a str. 2457T
auuuaauaagaauaagcuauaaa

SEQ ID NO: 3841866 - RNA, 15 nt, Shigella flexneri 2a str. 2457T
auuuaauaauaagua

SEQ ID NO: 3841867 - RNA, 14 nt, Shigella flexneri 2a str. 2457T
auuuaauuacugag

SEQ ID NO: 3841868 - RNA, 15 nt, Shigella flexneri 2a str. 2457T
auuuacaaaucuuua

SEQ ID NO: 3841869 - RNA, 12 nt, Shigella flexneri 2a str. 2457T
auuuacacuuca

SEQ ID NO: 3841870 - RNA, 21 nt, Shigella flexneri 2a str. 2457T
auuuacacuucauccuucaca

SEQ ID NO: 3841871 - RNA, 17 nt, Shigella flexneri 2a str. 2457T
auuuaccagcauuuaag

SEQ ID NO: 3841872 - RNA, 20 nt, Shigella flexneri 2a str. 2457T
auuuaccggaaggauuaucc

SEQ ID NO: 3841873 - RNA, 23 nt, Shigella flexneri 2a str. 2457T
auuuacgcugucuuuugaucaaa

SEQ ID NO: 3841874 - RNA, 16 nt, Shigella flexneri 2a str. 2457T
auuuacgcuuuucuuc

SEQ ID NO: 3841875 - RNA, 16 nt, Shigella flexneri 2a str. 2457T
auuuacgguauaaccc

SEQ ID NO: 3841876 - RNA, 15 nt, Shigella flexneri 2a str. 2457T
auuuacguucuuaca

SEQ ID NO: 3841877 - RNA, 19 nt, Shigella flexneri 2a str. 2457T
auuuacguuuuaaaccuac

SEQ ID NO: 3841878 - RNA, 15 nt, Shigella flexneri 2a str. 2457T
auuuacuauuauuuu

SEQ ID NO: 3841879 - RNA, 18 nt, Shigella flexneri 2a str. 2457T
auuuacuauuauuuuuca

SEQ ID NO: 3841880 - RNA, 14 nt, Shigella flexneri 2a str. 2457T
auuuacuucugcug

SEQ ID NO: 3841881 - RNA, 14 nt, Shigella flexneri 2a str. 2457T
auuuauaaaagaaa

SEQ ID NO: 3841882 - RNA, 15 nt, Shigella flexneri 2a str. 2457T
auuuauagauuuacu

SEQ ID NO: 3841883 - RNA, 19 nt, Shigella flexneri 2a str. 2457T
auuuauaggguaaauuacc

SEQ ID NO: 3841884 - RNA, 13 nt, Shigella flexneri 2a str. 2457T
auuuauauaaaua

SEQ ID NO: 3841885 - RNA, 19 nt, Shigella flexneri 2a str. 2457T
auuuauauaaauauaauca

SEQ ID NO: 3841886 - RNA, 12 nt, Shigella flexneri 2a str. 2457T
auuuauaucagu

SEQ ID NO: 3841887 - RNA, 20 nt, Shigella flexneri 2a str. 2457T
auuuauauuacgaauauaaa

SEQ ID NO: 3841888 - RNA, 22 nt, Shigella flexneri 2a str. 2457T
auuuaucgacugccagagucaa

SEQ ID NO: 3841889 - RNA, 12 nt, Shigella flexneri 2a str. 2457T
auuuaucuuccc

SEQ ID NO: 3841890 - RNA, 17 nt, Shigella flexneri 2a str. 2457T
auuuaugaggaugcaga

SEQ ID NO: 3841891 - RNA, 14 nt, Shigella flexneri 2a str. 2457T
auuuaugauauuuu

SEQ ID NO: 3841892 - RNA, 22 nt, Shigella flexneri 2a str. 2457T
auuuaugccauguucaucaagc

SEQ ID NO: 3841893 - RNA, 19 nt, Shigella flexneri 2a str. 2457T
auuuaugcgcuaaauguuu

SEQ ID NO: 3841894 - RNA, 18 nt, Shigella flexneri 2a str. 2457T
auuuauggugcuaguuau

SEQ ID NO: 3841895 - RNA, 18 nt, Shigella flexneri 2a str. 2457T
auuuauuaccuuuuuacc

SEQ ID NO: 3841896 - RNA, 14 nt, Shigella flexneri 2a str. 2457T
auuugucagcagcu

SEQ ID NO: 3841897 - RNA, 22 nt, Shigella flexneri 2a str. 2457T
auuugucgccaacuucaugacc

SEQ ID NO: 3841898 - RNA, 15 nt, Shigella flexneri 2a str. 2457T
auuugugcaaauuca

SEQ ID NO: 3841899 - RNA, 16 nt, Shigella flexneri 2a str. 2457T
auuugugcacgugcca

SEQ ID NO: 3841900 - RNA, 18 nt, Shigella flexneri 2a str. 2457T
auuuguggugaagccacc

SEQ ID NO: 3841901 - RNA, 16 nt, Shigella flexneri 2a str. 2457T
auuuguucagcaaaug

SEQ ID NO: 3841902 - RNA, 17 nt, Shigella flexneri 2a str. 2457T
auuuguugagcuggaag

SEQ ID NO: 3841903 - RNA, 18 nt, Shigella flexneri 2a str. 2457T
auuuuaaauuuccucuug

SEQ ID NO: 3841904 - RNA, 14 nt, Shigella flexneri 2a str. 2457T
auuuuaagcaagug

SEQ ID NO: 3841905 - RNA, 15 nt, Shigella flexneri 2a str. 2457T
auuuuaauaaaucac

SEQ ID NO: 3841906 - RNA, 17 nt, Shigella flexneri 2a str. 2457T
auuuuaauaaugagcgu

SEQ ID NO: 3841907 - RNA, 20 nt, Shigella flexneri 2a str. 2457T
auuuuacaggguaaaaccau

SEQ ID NO: 3841908 - RNA, 13 nt, Shigella flexneri 2a str. 2457T
auuuuacauccug

SEQ ID NO: 3841909 - RNA, 13 nt, Shigella flexneri 2a str. 2457T
auuuuauacuuuu

SEQ ID NO: 3841910 - RNA, 17 nt, Shigella flexneri 2a str. 2457T
auuuuauacuuuuucgc

SEQ ID NO: 3841911 - RNA, 17 nt, Shigella flexneri 2a str. 2457T
auuuucaauaaccugca

SEQ ID NO: 3841912 - RNA, 20 nt, Shigella flexneri 2a str. 2457T
auuuucaauaaccugcaaaa

SEQ ID NO: 3841913 - RNA, 22 nt, Shigella flexneri 2a str. 2457T
auuuucagaaggauaauuaauc

SEQ ID NO: 3841914 - RNA, 17 nt, Shigella flexneri 2a str. 2457T
auuuucagccaucaucc

SEQ ID NO: 3841915 - RNA, 13 nt, Shigella flexneri 2a str. 2457T
auuuucagcgugc

SEQ ID NO: 3841916 - RNA, 21 nt, Shigella flexneri 2a str. 2457T
auuuucagcgugcccacguuc

SEQ ID NO: 3841917 - RNA, 18 nt, Shigella flexneri 2a str. 2457T
auuuucagcguggccaua

SEQ ID NO: 3841918 - RNA, 21 nt, Shigella flexneri 2a str. 2457T
auuuucauugccgcaucgaau

SEQ ID NO: 3841919 - RNA, 14 nt, Shigella flexneri 2a str. 2457T
auuuucgccacuuc

SEQ ID NO: 3841920 - RNA, 14 nt, Shigella flexneri 2a str. 2457T
auuuucucacccgc

SEQ ID NO: 3841921 - RNA, 22 nt, Shigella flexneri 2a str. 2457T
auuuucucacccgcaaacagga

SEQ ID NO: 3841922 - RNA, 14 nt, Shigella flexneri 2a str. 2457T
auuuucucuuucag

SEQ ID NO: 3841923 - RNA, 15 nt, Shigella flexneri 2a str. 2457T
auuuucugcccauuu

SEQ ID NO: 3841924 - RNA, 19 nt, Shigella flexneri 2a str. 2457T
auuuucugcgcauuuccca

SEQ ID NO: 3841925 - RNA, 14 nt, Shigella flexneri 2a str. 2457T
auuuucuucauucg

SEQ ID NO: 3841926 - RNA, 18 nt, Shigella flexneri 2a str. 2457T
auuuugaagucuuuuuuc

SEQ ID NO: 3841927 - RNA, 18 nt, Shigella flexneri 2a str. 2457T
auuuugacuuuuacagcu

SEQ ID NO: 3841928 - RNA, 20 nt, Shigella flexneri 2a str. 2457T
auuuugacuuuuacagcuua

SEQ ID NO: 3841929 - RNA, 21 nt, Shigella flexneri 2a str. 2457T
auuuugaugauaucagccugc

SEQ ID NO: 3841930 - RNA, 22 nt, Shigella flexneri 2a str. 2457T
auuuugaugauaucagccugca

SEQ ID NO: 3841931 - RNA, 17 nt, Shigella flexneri 2a str. 2457T
auuuugcagaucgccaa

SEQ ID NO: 3841932 - RNA, 17 nt, Shigella flexneri 2a str. 2457T
auuuugcaucguccacu

SEQ ID NO: 3841933 - RNA, 20 nt, Shigella flexneri 2a str. 2457T
auuuugcaucguccacuuga

SEQ ID NO: 3841934 - RNA, 22 nt, Shigella flexneri 2a str. 2457T
auuuugccuucauacugcggcg

SEQ ID NO: 3841935 - RNA, 17 nt, Shigella flexneri 2a str. 2457T
auuuugcugauauuuau

SEQ ID NO: 3841936 - RNA, 20 nt, Shigella flexneri 2a str. 2457T
auuuugcugaugcagcgaug

SEQ ID NO: 3841937 - RNA, 19 nt, Shigella flexneri 2a str. 2457T
auuuugcugccguuuucaa

SEQ ID NO: 3841938 - RNA, 16 nt, Shigella flexneri 2a str. 2457T
auuuugcuggaaaagu

SEQ ID NO: 3841939 - RNA, 23 nt, Shigella flexneri 2a str. 2457T
auuuugcuuccggcaagcaaaug

SEQ ID NO: 3841940 - RNA, 19 nt, Shigella flexneri 2a str. 2457T
auuuuggguuccacuucug

SEQ ID NO: 3841941 - RNA, 14 nt, Shigella flexneri 2a str. 2457T
auuuuguaaaagaa

SEQ ID NO: 3841942 - RNA, 16 nt, Shigella flexneri 2a str. 2457T
auuuugugauauguau

SEQ ID NO: 3841943 - RNA, 20 nt, Shigella flexneri 2a str. 2457T
auuuugugauauguaugaag

SEQ ID NO: 3841944 - RNA, 16 nt, Shigella flexneri 2a str. 2457T
auuuugugcagcaugc

SEQ ID NO: 3841945 - RNA, 23 nt, Shigella flexneri 2a str. 2457T
auuuugugcagcaugcacccuca

SEQ ID NO: 3841946 - RNA, 15 nt, Shigella flexneri 2a str. 2457T
auuuuuaagcgccau

SEQ ID NO: 3841947 - RNA, 20 nt, Shigella flexneri 2a str. 2457T
auuuuuauauagccagccuc

SEQ ID NO: 3841948 - RNA, 22 nt, Shigella flexneri 2a str. 2457T
auuuuuaucucaaaaauuacuc

SEQ ID NO: 3841949 - RNA, 14 nt, Shigella flexneri 2a str. 2457T
auuuuucaauaucc

SEQ ID NO: 3841950 - RNA, 13 nt, Shigella flexneri 2a str. 2457T
auuuuucauaauc

SEQ ID NO: 3841951 - RNA, 17 nt, Shigella flexneri 2a str. 2457T
auuuuuccagcauuucu

SEQ ID NO: 3841952 - RNA, 22 nt, Shigella flexneri 2a str. 2457T
auuuuucgagggugcgaauaag

SEQ ID NO: 3841953 - RNA, 15 nt, Shigella flexneri 2a str. 2457T
auuuuucgcuaaaaa

SEQ ID NO: 3841954 - RNA, 17 nt, Shigella flexneri 2a str. 2457T
auuuuucugcacuacgc

SEQ ID NO: 3841955 - RNA, 22 nt, Shigella flexneri 2a str. 2457T
auuuuugcagaaacauaauaua

SEQ ID NO: 3841956 - RNA, 15 nt, Shigella flexneri 2a str. 2457T
auuuuugcagcaaac

SEQ ID NO: 3841957 - RNA, 14 nt, Shigella flexneri 2a str. 2457T
auuuuugugaagaa

SEQ ID NO: 3841958 - RNA, 16 nt, Shigella flexneri 2a str. 2457T
auuuuugugaagaaua

SEQ ID NO: 3841959 - RNA, 18 nt, Shigella flexneri 2a str. 2457T
auuuuugugaagaauaaa

SEQ ID NO: 3841960 - RNA, 22 nt, Shigella flexneri 2a str. 2457T
auuuuuucacauguucauuuau

SEQ ID NO: 3841961 - RNA, 15 nt, Shigella flexneri 2a str. 2457T
auuuuuugaaguauu

SEQ ID NO: 3841962 - RNA, 20 nt, Shigella flexneri 2a str. 2457T
auuuuuugcucauaaaauca

SEQ ID NO: 3841963 - RNA, 16 nt, Shigella flexneri 2a str. 2457T
auuuuuuuucaggaaa

SEQ ID NO: 3841964 - RNA, 20 nt, Shigella flexneri 2a str. 2457T
auuuuuuuucaggaaauaaa

SEQ ID NO: 3841965 - RNA, 13 nt, Shigella flexneri 2a str. 2457T
caaaaaaacauaa

SEQ ID NO: 3841966 - RNA, 17 nt, Shigella flexneri 2a str. 2457T
caaaaaaacuugauacu

SEQ ID NO: 3841967 - RNA, 19 nt, Shigella flexneri 2a str. 2457T
caaaaaaacuugauacuga

SEQ ID NO: 3841968 - RNA, 15 nt, Shigella flexneri 2a str. 2457T
caaaaaaagaacaac

SEQ ID NO: 3841969 - RNA, 19 nt, Shigella flexneri 2a str. 2457T
caaaaaaagaauucagacc

SEQ ID NO: 3841970 - RNA, 20 nt, Shigella flexneri 2a str. 2457T
caaaaaaaugcacauauucu

SEQ ID NO: 3841971 - RNA, 13 nt, Shigella flexneri 2a str. 2457T
caaaaaaccaucc

SEQ ID NO: 3841972 - RNA, 18 nt, Shigella flexneri 2a str. 2457T
caaaaaacuggaaaaaua

SEQ ID NO: 3841973 - RNA, 19 nt, Shigella flexneri 2a str. 2457T
caaaaaacuggaaaaauaa

SEQ ID NO: 3841974 - RNA, 20 nt, Shigella flexneri 2a str. 2457T
caaaaaacuucuucacacca

SEQ ID NO: 3841975 - RNA, 12 nt, Shigella flexneri 2a str. 2457T
caaaaaagaggg

SEQ ID NO: 3841976 - RNA, 23 nt, Shigella flexneri 2a str. 2457T
caaaaaagccaaucacaaaaagu

SEQ ID NO: 3841977 - RNA, 18 nt, Shigella flexneri 2a str. 2457T
caaaaaaugaaacuguua

SEQ ID NO: 3841978 - RNA, 17 nt, Shigella flexneri 2a str. 2457T
caaaaaauugcgucagu

SEQ ID NO: 3841979 - RNA, 13 nt, Shigella flexneri 2a str. 2457T
caaaaacaaagaa

SEQ ID NO: 3841980 - RNA, 20 nt, Shigella flexneri 2a str. 2457T
caaaaacaacgagccaauaa

SEQ ID NO: 3841981 - RNA, 15 nt, Shigella flexneri 2a str. 2457T
caaaaacccugccgu

SEQ ID NO: 3841982 - RNA, 20 nt, Shigella flexneri 2a str. 2457T
caaaaaccgcugauuccugc

SEQ ID NO: 3841983 - RNA, 12 nt, Shigella flexneri 2a str. 2457T
caaaaacgccau

SEQ ID NO: 3841984 - RNA, 18 nt, Shigella flexneri 2a str. 2457T
caaaaacucauaaauuca

SEQ ID NO: 3841985 - RNA, 16 nt, Shigella flexneri 2a str. 2457T
caaaaagauuaaaaaa

SEQ ID NO: 3841986 - RNA, 18 nt, Shigella flexneri 2a str. 2457T
caaaaagcguauccugac

SEQ ID NO: 3841987 - RNA, 18 nt, Shigella flexneri 2a str. 2457T
caaaaagcucaaucgaga

SEQ ID NO: 3841988 - RNA, 21 nt, Shigella flexneri 2a str. 2457T
caaaaauccagauuuauaaaa

SEQ ID NO: 3841989 - RNA, 15 nt, Shigella flexneri 2a str. 2457T
caaaaaucggcaaca

SEQ ID NO: 3841990 - RNA, 14 nt, Shigella flexneri 2a str. 2457T
caaaaauggcuuua

SEQ ID NO: 3841991 - RNA, 23 nt, Shigella flexneri 2a str. 2457T
caaaaauugcgcgacuuuuuccu

SEQ ID NO: 3841992 - RNA, 15 nt, Shigella flexneri 2a str. 2457T
caaaacacucuucaa

SEQ ID NO: 3841993 - RNA, 17 nt, Shigella flexneri 2a str. 2457T
caaaugucagcugccag

SEQ ID NO: 3841994 - RNA, 22 nt, Shigella flexneri 2a str. 2457T
caaauguugcaucgccugcgcg

SEQ ID NO: 3841995 - RNA, 19 nt, Shigella flexneri 2a str. 2457T
caaauguugcguucaucag

SEQ ID NO: 3841996 - RNA, 22 nt, Shigella flexneri 2a str. 2457T
caaauuacuggcggcaaaacug

SEQ ID NO: 3841997 - RNA, 18 nt, Shigella flexneri 2a str. 2457T
caaauuauuaccaucggu

SEQ ID NO: 3841998 - RNA, 21 nt, Shigella flexneri 2a str. 2457T
caaauucaauaaauugcagga

SEQ ID NO: 3841999 - RNA, 16 nt, Shigella flexneri 2a str. 2457T
caaauucaauauauug

SEQ ID NO: 3842000 - RNA, 18 nt, Shigella flexneri 2a str. 2457T
caaauucaauauauugca

SEQ ID NO: 3842001 - RNA, 15 nt, Shigella flexneri 2a str. 2457T
caaauucauuaccaa

SEQ ID NO: 3842002 - RNA, 19 nt, Shigella flexneri 2a str. 2457T
caaauucauugcguaacau

SEQ ID NO: 3842003 - RNA, 16 nt, Shigella flexneri 2a str. 2457T
caaauuccgaacaaaa

SEQ ID NO: 3842004 - RNA, 21 nt, Shigella flexneri 2a str. 2457T
caaauucuggcggcaauaacu

SEQ ID NO: 3842005 - RNA, 18 nt, Shigella flexneri 2a str. 2457T
caaauugcaccauccauu

SEQ ID NO: 3842006 - RNA, 22 nt, Shigella flexneri 2a str. 2457T
caaauugcaccauccauuuuuc

SEQ ID NO: 3842007 - RNA, 16 nt, Shigella flexneri 2a str. 2457T
caaauugcugguauuu

SEQ ID NO: 3842008 - RNA, 16 nt, Shigella flexneri 2a str. 2457T
caaauuuaaacgacaa

SEQ ID NO: 3842009 - RNA, 20 nt, Shigella flexneri 2a str. 2457T
caaauuuaauuugcugcgga

SEQ ID NO: 3842010 - RNA, 21 nt, Shigella flexneri 2a str. 2457T
caaauuuggcaucgaggaucu

SEQ ID NO: 3842011 - RNA, 17 nt, Shigella flexneri 2a str. 2457T
caaauuugugcucuggc

SEQ ID NO: 3842012 - RNA, 15 nt, Shigella flexneri 2a str. 2457T
caaauuuugaacaga

SEQ ID NO: 3842013 - RNA, 18 nt, Shigella flexneri 2a str. 2457T
caaauuuugaacagaacu

SEQ ID NO: 3842014 - RNA, 22 nt, Shigella flexneri 2a str. 2457T
caaauuuugaacagaacuggcg

SEQ ID NO: 3842015 - RNA, 16 nt, Shigella flexneri 2a str. 2457T
caacaaacgcaaacac

SEQ ID NO: 3842016 - RNA, 18 nt, Shigella flexneri 2a str. 2457T
caacaacagucucugccg

SEQ ID NO: 3842017 - RNA, 17 nt, Shigella flexneri 2a str. 2457T
caacaaccagaagguga

SEQ ID NO: 3842018 - RNA, 16 nt, Shigella flexneri 2a str. 2457T
caacaaccuugcguuu

SEQ ID NO: 3842019 - RNA, 15 nt, Shigella flexneri 2a str. 2457T
caacaacgcaacucc

SEQ ID NO: 3842020 - RNA, 20 nt, Shigella flexneri 2a str. 2457T
caacaagugggugcuucacu

SEQ ID NO: 3842021 - RNA, 23 nt, Shigella flexneri 2a str. 2457T
caacaauaaaaccaguaaugauc

SEQ ID NO: 3842022 - RNA, 13 nt, Shigella flexneri 2a str. 2457T
caacaauaaaauu

SEQ ID NO: 3842023 - RNA, 15 nt, Shigella flexneri 2a str. 2457T
caacaauaaaauuga

SEQ ID NO: 3842024 - RNA, 17 nt, Shigella flexneri 2a str. 2457T
caacaauaaccgucagc

SEQ ID NO: 3842025 - RNA, 14 nt, Shigella flexneri 2a str. 2457T
caacaauacaaaug

SEQ ID NO: 3842026 - RNA, 13 nt, Shigella flexneri 2a str. 2457T
caacaauagugcc

SEQ ID NO: 3842027 - RNA, 14 nt, Shigella flexneri 2a str. 2457T
caacaaucgucagc

SEQ ID NO: 3842028 - RNA, 22 nt, Shigella flexneri 2a str. 2457T
caacaaucgucagcucgcugcc

SEQ ID NO: 3842029 - RNA, 20 nt, Shigella flexneri 2a str. 2457T
caacaaucugcaaaucgauc

SEQ ID NO: 3842030 - RNA, 15 nt, Shigella flexneri 2a str. 2457T
caacaaugccacgcc

SEQ ID NO: 3842031 - RNA, 17 nt, Shigella flexneri 2a str. 2457T
caacaaugccacgccac

SEQ ID NO: 3842032 - RNA, 22 nt, Shigella flexneri 2a str. 2457T
caacaaugcucucuucgccaau

SEQ ID NO: 3842033 - RNA, 14 nt, Shigella flexneri 2a str. 2457T
caacaauggcauuu

SEQ ID NO: 3842034 - RNA, 21 nt, Shigella flexneri 2a str. 2457T
caacaauucccgcagcuccag

SEQ ID NO: 3842035 - RNA, 16 nt, Shigella flexneri 2a str. 2457T
caacaauucguuguuu

SEQ ID NO: 3842036 - RNA, 16 nt, Shigella flexneri 2a str. 2457T
caacacaauuuguggc

SEQ ID NO: 3842037 - RNA, 19 nt, Shigella flexneri 2a str. 2457T
caacacacugaauaaaaau

SEQ ID NO: 3842038 - RNA, 22 nt, Shigella flexneri 2a str. 2457T
caacacacugaauaaaaaugug

SEQ ID NO: 3842039 - RNA, 20 nt, Shigella flexneri 2a str. 2457T
caacacagauugauaaaaau

SEQ ID NO: 3842040 - RNA, 13 nt, Shigella flexneri 2a str. 2457T
caacaccacugcc

SEQ ID NO: 3842041 - RNA, 14 nt, Shigella flexneri 2a str. 2457T
caacaccacugcca

SEQ ID NO: 3842042 - RNA, 16 nt, Shigella flexneri 2a str. 2457T
caacaccuaccggcug

SEQ ID NO: 3842043 - RNA, 20 nt, Shigella flexneri 2a str. 2457T
caacaccuguugcgcgucgc

SEQ ID NO: 3842044 - RNA, 13 nt, Shigella flexneri 2a str. 2457T
caacacgccagcg

SEQ ID NO: 3842045 - RNA, 19 nt, Shigella flexneri 2a str. 2457T
caacacgccagcguuaucc

SEQ ID NO: 3842046 - RNA, 17 nt, Shigella flexneri 2a str. 2457T
caacacuuucacuacaa

SEQ ID NO: 3842047 - RNA, 16 nt, Shigella flexneri 2a str. 2457T
caacagaaacgccauc

SEQ ID NO: 3842048 - RNA, 12 nt, Shigella flexneri 2a str. 2457T
caacagaaauaa

SEQ ID NO: 3842049 - RNA, 16 nt, Shigella flexneri 2a str. 2457T
caacagcagccacacc

SEQ ID NO: 3842050 - RNA, 14 nt, Shigella flexneri 2a str. 2457T
caacagcaucaucg

SEQ ID NO: 3842051 - RNA, 22 nt, Shigella flexneri 2a str. 2457T
caacagcgugaacugggccugc

SEQ ID NO: 3842052 - RNA, 19 nt, Shigella flexneri 2a str. 2457T
caacagcguuucuucgaca

SEQ ID NO: 3842053 - RNA, 17 nt, Shigella flexneri 2a str. 2457T
caacaggguugaaucug

SEQ ID NO: 3842054 - RNA, 19 nt, Shigella flexneri 2a str. 2457T
caacaggguugaaucugca

SEQ ID NO: 3842055 - RNA, 17 nt, Shigella flexneri 2a str. 2457T
caacagguaaggcgcga

SEQ ID NO: 3842056 - RNA, 15 nt, Shigella flexneri 2a str. 2457T
caacaguaauaaugc

SEQ ID NO: 3842057 - RNA, 23 nt, Shigella flexneri 2a str. 2457T
caacaguacgguaaagccgugcu

SEQ ID NO: 3842058 - RNA, 17 nt, Shigella flexneri 2a str. 2457T
caacagucgccacgcgc

SEQ ID NO: 3842059 - RNA, 17 nt, Shigella flexneri 2a str. 2457T
caacagugaaacacaug

SEQ ID NO: 3842060 - RNA, 12 nt, Shigella flexneri 2a str. 2457T
caacagugaaau

SEQ ID NO: 3842061 - RNA, 12 nt, Shigella flexneri 2a str. 2457T
caacauaaagcc

SEQ ID NO: 3842062 - RNA, 14 nt, Shigella flexneri 2a str. 2457T
caacauaacgcauc

SEQ ID NO: 3842063 - RNA, 17 nt, Shigella flexneri 2a str. 2457T
caacauacugcuccaua

SEQ ID NO: 3842064 - RNA, 18 nt, Shigella flexneri 2a str. 2457T
caacauacuguaacugcg

SEQ ID NO: 3842065 - RNA, 19 nt, Shigella flexneri 2a str. 2457T
caacauauaucgaaaaauc

SEQ ID NO: 3842066 - RNA, 23 nt, Shigella flexneri 2a str. 2457T
caacauauuccgcaccugccagc

SEQ ID NO: 3842067 - RNA, 11 nt, Shigella flexneri 2a str. 2457T
caacaucaucu

SEQ ID NO: 3842068 - RNA, 21 nt, Shigella flexneri 2a str. 2457T
caacaucgcaauccuuucccu

SEQ ID NO: 3842069 - RNA, 15 nt, Shigella flexneri 2a str. 2457T
caacaugaaaauaac

SEQ ID NO: 3842070 - RNA, 22 nt, Shigella flexneri 2a str. 2457T
caacaugaaaauaaccauauau

SEQ ID NO: 3842071 - RNA, 14 nt, Shigella flexneri 2a str. 2457T
caacaugaaacaga

SEQ ID NO: 3842072 - RNA, 16 nt, Shigella flexneri 2a str. 2457T
caacaugaaacagaaa

SEQ ID NO: 3842073 - RNA, 12 nt, Shigella flexneri 2a str. 2457T
caacaugccgaa

SEQ ID NO: 3842074 - RNA, 20 nt, Shigella flexneri 2a str. 2457T
caacaugcggugauuuugcc

SEQ ID NO: 3842075 - RNA, 19 nt, Shigella flexneri 2a str. 2457T
caacaugucagcaaucacc

SEQ ID NO: 3842076 - RNA, 14 nt, Shigella flexneri 2a str. 2457T
caacauguugaaau

SEQ ID NO: 3842077 - RNA, 20 nt, Shigella flexneri 2a str. 2457T
caacauuuugaauuagcacg

SEQ ID NO: 3842078 - RNA, 14 nt, Shigella flexneri 2a str. 2457T
caaccaacggccuu

SEQ ID NO: 3842079 - RNA, 16 nt, Shigella flexneri 2a str. 2457T
caaccaaucgcggcga

SEQ ID NO: 3842080 - RNA, 20 nt, Shigella flexneri 2a str. 2457T
caaccaauucuccaaugccg

SEQ ID NO: 3842081 - RNA, 14 nt, Shigella flexneri 2a str. 2457T
caaccacacccaca

SEQ ID NO: 3842082 - RNA, 12 nt, Shigella flexneri 2a str. 2457T
caaccacauuca

SEQ ID NO: 3842083 - RNA, 22 nt, Shigella flexneri 2a str. 2457T
caaccacuuuaucgagaauacu

SEQ ID NO: 3842084 - RNA, 20 nt, Shigella flexneri 2a str. 2457T
caaccagcaccgaaauauua

SEQ ID NO: 3842085 - RNA, 21 nt, Shigella flexneri 2a str. 2457T
caaccagcagauguagcucac

SEQ ID NO: 3842086 - RNA, 14 nt, Shigella flexneri 2a str. 2457T
caaccagcgucagc

SEQ ID NO: 3842087 - RNA, 18 nt, Shigella flexneri 2a str. 2457T
caaccagcuuaugccugu

SEQ ID NO: 3842088 - RNA, 19 nt, Shigella flexneri 2a str. 2457T
caaccaguugugcaccacc

SEQ ID NO: 3842089 - RNA, 14 nt, Shigella flexneri 2a str. 2457T
caaccaugccgccc

SEQ ID NO: 3842090 - RNA, 15 nt, Shigella flexneri 2a str. 2457T
caacucugguggaca

SEQ ID NO: 3842091 - RNA, 20 nt, Shigella flexneri 2a str. 2457T
caacugccugaugcgaugcu

SEQ ID NO: 3842092 - RNA, 20 nt, Shigella flexneri 2a str. 2457T
caacugcgugcugagcggcg

SEQ ID NO: 3842093 - RNA, 16 nt, Shigella flexneri 2a str. 2457T
caacuggagcaggaac

SEQ ID NO: 3842094 - RNA, 14 nt, Shigella flexneri 2a str. 2457T
caacuggcaaaaga

SEQ ID NO: 3842095 - RNA, 20 nt, Shigella flexneri 2a str. 2457T
caacuggcaaccagaagaga

SEQ ID NO: 3842096 - RNA, 22 nt, Shigella flexneri 2a str. 2457T
caacuguacgccgacgcccugc

SEQ ID NO: 3842097 - RNA, 17 nt, Shigella flexneri 2a str. 2457T
caacuguugauccagga

SEQ ID NO: 3842098 - RNA, 19 nt, Shigella flexneri 2a str. 2457T
caacuguugauccaggagc

SEQ ID NO: 3842099 - RNA, 22 nt, Shigella flexneri 2a str. 2457T
caacuuaacuugcuuaaaaaau

SEQ ID NO: 3842100 - RNA, 19 nt, Shigella flexneri 2a str. 2457T
caacuucaaggucaacauu

SEQ ID NO: 3842101 - RNA, 16 nt, Shigella flexneri 2a str. 2457T
caacuucagcagcagc

SEQ ID NO: 3842102 - RNA, 12 nt, Shigella flexneri 2a str. 2457T
caacuuccccuc

SEQ ID NO: 3842103 - RNA, 23 nt, Shigella flexneri 2a str. 2457T
caacuucgaguacauccacugca

SEQ ID NO: 3842104 - RNA, 21 nt, Shigella flexneri 2a str. 2457T
caacuucuaauuuuuccagca

SEQ ID NO: 3842105 - RNA, 19 nt, Shigella flexneri 2a str. 2457T
caacuucucuuucggcagu

SEQ ID NO: 3842106 - RNA, 23 nt, Shigella flexneri 2a str. 2457T
caacuucucuuucggcagugcca

SEQ ID NO: 3842107 - RNA, 15 nt, Shigella flexneri 2a str. 2457T
caacuuuagcgaugu

SEQ ID NO: 3842108 - RNA, 15 nt, Shigella flexneri 2a str. 2457T
caacuuuaucuucga

SEQ ID NO: 3842109 - RNA, 21 nt, Shigella flexneri 2a str. 2457T
caacuuuaucuucgagauucu

SEQ ID NO: 3842110 - RNA, 17 nt, Shigella flexneri 2a str. 2457T
caagaaaauuauucgcc

SEQ ID NO: 3842111 - RNA, 22 nt, Shigella flexneri 2a str. 2457T
caagaaacaccagaaugcccca

SEQ ID NO: 3842112 - RNA, 16 nt, Shigella flexneri 2a str. 2457T
caagaaacagcaguuc

SEQ ID NO: 3842113 - RNA, 15 nt, Shigella flexneri 2a str. 2457T
caagaaaccgaaguu

SEQ ID NO: 3842114 - RNA, 12 nt, Shigella flexneri 2a str. 2457T
caagaaaugaca

SEQ ID NO: 3842115 - RNA, 19 nt, Shigella flexneri 2a str. 2457T
caagaaccaaagaaaucag

SEQ ID NO: 3842116 - RNA, 21 nt, Shigella flexneri 2a str. 2457T
caagaacgcauaccccaucag

SEQ ID NO: 3842117 - RNA, 17 nt, Shigella flexneri 2a str. 2457T
caagaauacuguccaua

SEQ ID NO: 3842118 - RNA, 13 nt, Shigella flexneri 2a str. 2457T
caagaaucaugcc

SEQ ID NO: 3842119 - RNA, 16 nt, Shigella flexneri 2a str. 2457T
caagaaucaugccaaa

SEQ ID NO: 3842120 - RNA, 19 nt, Shigella flexneri 2a str. 2457T
caagaaucaugccaaaaau

SEQ ID NO: 3842121 - RNA, 19 nt, Shigella flexneri 2a str. 2457T
caagaaucucuucuucgcu

SEQ ID NO: 3842122 - RNA, 19 nt, Shigella flexneri 2a str. 2457T
caagaaugccugccagcuu

SEQ ID NO: 3842123 - RNA, 15 nt, Shigella flexneri 2a str. 2457T
caagaauuaaaauau

SEQ ID NO: 3842124 - RNA, 16 nt, Shigella flexneri 2a str. 2457T
caagaauuaaaauauc

SEQ ID NO: 3842125 - RNA, 17 nt, Shigella flexneri 2a str. 2457T
caagaauuacuucuuga

SEQ ID NO: 3842126 - RNA, 17 nt, Shigella flexneri 2a str. 2457T
caagacgaaaaaugaau

SEQ ID NO: 3842127 - RNA, 20 nt, Shigella flexneri 2a str. 2457T
caagacgaauaccuucuucc

SEQ ID NO: 3842128 - RNA, 18 nt, Shigella flexneri 2a str. 2457T
caagagacugcuggcuua

SEQ ID NO: 3842129 - RNA, 14 nt, Shigella flexneri 2a str. 2457T
caagagguaaauuu

SEQ ID NO: 3842130 - RNA, 16 nt, Shigella flexneri 2a str. 2457T
caagaguaacccacgu

SEQ ID NO: 3842131 - RNA, 15 nt, Shigella flexneri 2a str. 2457T
caagagugaacacgu

SEQ ID NO: 3842132 - RNA, 16 nt, Shigella flexneri 2a str. 2457T
caagauacugcauaau

SEQ ID NO: 3842133 - RNA, 21 nt, Shigella flexneri 2a str. 2457T
caagauauuucaccagcgcac

SEQ ID NO: 3842134 - RNA, 13 nt, Shigella flexneri 2a str. 2457T
caagauauuuugg

SEQ ID NO: 3842135 - RNA, 14 nt, Shigella flexneri 2a str. 2457T
caagaucauacuga

SEQ ID NO: 3842136 - RNA, 16 nt, Shigella flexneri 2a str. 2457T
caagaucgcccugagg

SEQ ID NO: 3842137 - RNA, 15 nt, Shigella flexneri 2a str. 2457T
caagaucgcgcauca

SEQ ID NO: 3842138 - RNA, 21 nt, Shigella flexneri 2a str. 2457T
caagaucucauuccaccgaaa

SEQ ID NO: 3842139 - RNA, 17 nt, Shigella flexneri 2a str. 2457T
caagaugcuugcgauau

SEQ ID NO: 3842140 - RNA, 23 nt, Shigella flexneri 2a str. 2457T
caagauguuugauucacuggcaa

SEQ ID NO: 3842141 - RNA, 17 nt, Shigella flexneri 2a str. 2457T
caagauuaaaagugauu

SEQ ID NO: 3842142 - RNA, 16 nt, Shigella flexneri 2a str. 2457T
caagauugauccccgc

SEQ ID NO: 3842143 - RNA, 23 nt, Shigella flexneri 2a str. 2457T
caagauugauccccgcuuccugc

SEQ ID NO: 3842144 - RNA, 14 nt, Shigella flexneri 2a str. 2457T
caagauugccugau

SEQ ID NO: 3842145 - RNA, 15 nt, Shigella flexneri 2a str. 2457T
caagcaaggccaggu

SEQ ID NO: 3842146 - RNA, 23 nt, Shigella flexneri 2a str. 2457T
caagcaaggccagguuuucuuuc

SEQ ID NO: 3842147 - RNA, 16 nt, Shigella flexneri 2a str. 2457T
caagcacaugcugaca

SEQ ID NO: 3842148 - RNA, 18 nt, Shigella flexneri 2a str. 2457T
caagcaggacgcccggua

SEQ ID NO: 3842149 - RNA, 21 nt, Shigella flexneri 2a str. 2457T
caagcaguugguuaaucuuuu

SEQ ID NO: 3842150 - RNA, 19 nt, Shigella flexneri 2a str. 2457T
caagcaugaucgaggcaaa

SEQ ID NO: 3842151 - RNA, 19 nt, Shigella flexneri 2a str. 2457T
caagcaugggugaacugcu

SEQ ID NO: 3842152 - RNA, 20 nt, Shigella flexneri 2a str. 2457T
caagcauuaaggcaagaaaa

SEQ ID NO: 3842153 - RNA, 22 nt, Shigella flexneri 2a str. 2457T
caagccacaauaaacgcgcagg

SEQ ID NO: 3842154 - RNA, 19 nt, Shigella flexneri 2a str. 2457T
caagccaggacgcagucca

SEQ ID NO: 3842155 - RNA, 22 nt, Shigella flexneri 2a str. 2457T
caagccagguuuugaccagucg

SEQ ID NO: 3842156 - RNA, 21 nt, Shigella flexneri 2a str. 2457T
caagccaucguuaauuaacgc

SEQ ID NO: 3842157 - RNA, 14 nt, Shigella flexneri 2a str. 2457T
caagcccagccccc

SEQ ID NO: 3842158 - RNA, 16 nt, Shigella flexneri 2a str. 2457T
caagccccagcaggau

SEQ ID NO: 3842159 - RNA, 23 nt, Shigella flexneri 2a str. 2457T
caagcccguguuucugauacagc

SEQ ID NO: 3842160 - RNA, 17 nt, Shigella flexneri 2a str. 2457T
caagccgaaacggaaau

SEQ ID NO: 3842161 - RNA, 22 nt, Shigella flexneri 2a str. 2457T
caagccgcuaacagcagcagcg

SEQ ID NO: 3842162 - RNA, 21 nt, Shigella flexneri 2a str. 2457T
caagccggaauuauccgguga

SEQ ID NO: 3842163 - RNA, 17 nt, Shigella flexneri 2a str. 2457T
caagcgaaugaggcagc

SEQ ID NO: 3842164 - RNA, 13 nt, Shigella flexneri 2a str. 2457T
caagcgccgccag

SEQ ID NO: 3842165 - RNA, 13 nt, Shigella flexneri 2a str. 2457T
caagcgcugagac

SEQ ID NO: 3842166 - RNA, 22 nt, Shigella flexneri 2a str. 2457T
caagcggagaagguuggcgucg

SEQ ID NO: 3842167 - RNA, 23 nt, Shigella flexneri 2a str. 2457T
caagcggcauccagguuucuucc

SEQ ID NO: 3842168 - RNA, 24 nt, Shigella flexneri 2a str. 2457T
caagcggugcgaugccuggcaaug

SEQ ID NO: 3842169 - RNA, 20 nt, Shigella flexneri 2a str. 2457T
caagcguaugauugccugau

SEQ ID NO: 3842170 - RNA, 18 nt, Shigella flexneri 2a str. 2457T
caagcgucgcaucaggca

SEQ ID NO: 3842171 - RNA, 19 nt, Shigella flexneri 2a str. 2457T
caagcgucgcaucaggcau

SEQ ID NO: 3842172 - RNA, 21 nt, Shigella flexneri 2a str. 2457T
caagcgucgcaucaggcaugg

SEQ ID NO: 3842173 - RNA, 14 nt, Shigella flexneri 2a str. 2457T
caagcguugcuuca

SEQ ID NO: 3842174 - RNA, 17 nt, Shigella flexneri 2a str. 2457T
caagcguuucaucuuca

SEQ ID NO: 3842175 - RNA, 15 nt, Shigella flexneri 2a str. 2457T
caagcugugccugaa

SEQ ID NO: 3842176 - RNA, 17 nt, Shigella flexneri 2a str. 2457T
caagcuuacguuaccca

SEQ ID NO: 3842177 - RNA, 18 nt, Shigella flexneri 2a str. 2457T
caagcuuacguuacccag

SEQ ID NO: 3842178 - RNA, 22 nt, Shigella flexneri 2a str. 2457T
caagcuuacguuacccagcacg

SEQ ID NO: 3842179 - RNA, 23 nt, Shigella flexneri 2a str. 2457T
caagcuuacguuacccagcacgg

SEQ ID NO: 3842180 - RNA, 12 nt, Shigella flexneri 2a str. 2457T
caaggaaauaau

SEQ ID NO: 3842181 - RNA, 17 nt, Shigella flexneri 2a str. 2457T
caaggaagccugacagg

SEQ ID NO: 3842182 - RNA, 21 nt, Shigella flexneri 2a str. 2457T
caaggaagccugacagggaag

SEQ ID NO: 3842183 - RNA, 16 nt, Shigella flexneri 2a str. 2457T
caaggaaggcguaaag

SEQ ID NO: 3842184 - RNA, 18 nt, Shigella flexneri 2a str. 2457T
caaggcagagucauuucu

SEQ ID NO: 3842185 - RNA, 19 nt, Shigella flexneri 2a str. 2457T
caaggcauauaccacaccc

SEQ ID NO: 3842186 - RNA, 15 nt, Shigella flexneri 2a str. 2457T
caaggcaucgugauc

SEQ ID NO: 3842187 - RNA, 14 nt, Shigella flexneri 2a str. 2457T
caaucacugccaga

SEQ ID NO: 3842188 - RNA, 17 nt, Shigella flexneri 2a str. 2457T
caaucacugccagaaua

SEQ ID NO: 3842189 - RNA, 12 nt, Shigella flexneri 2a str. 2457T
caaucagauaaa

SEQ ID NO: 3842190 - RNA, 14 nt, Shigella flexneri 2a str. 2457T
caaucagauaaaau

SEQ ID NO: 3842191 - RNA, 16 nt, Shigella flexneri 2a str. 2457T
caaucagauaaaauac

SEQ ID NO: 3842192 - RNA, 14 nt, Shigella flexneri 2a str. 2457T
caaucagcaauaaa

SEQ ID NO: 3842193 - RNA, 21 nt, Shigella flexneri 2a str. 2457T
caaucagcacacauaagagcg

SEQ ID NO: 3842194 - RNA, 12 nt, Shigella flexneri 2a str. 2457T
caaucagcaccg

SEQ ID NO: 3842195 - RNA, 12 nt, Shigella flexneri 2a str. 2457T
caaucagcggca

SEQ ID NO: 3842196 - RNA, 23 nt, Shigella flexneri 2a str. 2457T
caaucagguaagcgauaaaaaua

SEQ ID NO: 3842197 - RNA, 16 nt, Shigella flexneri 2a str. 2457T
caaucauauucaccac

SEQ ID NO: 3842198 - RNA, 18 nt, Shigella flexneri 2a str. 2457T
caaucaucgccuuaugcu

SEQ ID NO: 3842199 - RNA, 21 nt, Shigella flexneri 2a str. 2457T
caaucaucgcggcacacagca

SEQ ID NO: 3842200 - RNA, 19 nt, Shigella flexneri 2a str. 2457T
caaucaucucucgcaucag

SEQ ID NO: 3842201 - RNA, 19 nt, Shigella flexneri 2a str. 2457T
caaucaucuuguaggccug

SEQ ID NO: 3842202 - RNA, 20 nt, Shigella flexneri 2a str. 2457T
caaucaucuuguaggccuga

SEQ ID NO: 3842203 - RNA, 15 nt, Shigella flexneri 2a str. 2457T
caauccacgguuuau

SEQ ID NO: 3842204 - RNA, 18 nt, Shigella flexneri 2a str. 2457T
caauccaguacaugaagc

SEQ ID NO: 3842205 - RNA, 13 nt, Shigella flexneri 2a str. 2457T
caauccaguccac

SEQ ID NO: 3842206 - RNA, 15 nt, Shigella flexneri 2a str. 2457T
caaucccaaaauaau

SEQ ID NO: 3842207 - RNA, 18 nt, Shigella flexneri 2a str. 2457T
caaucccaaaauaauaaa

SEQ ID NO: 3842208 - RNA, 20 nt, Shigella flexneri 2a str. 2457T
caaucccuuucucuucaaac

SEQ ID NO: 3842209 - RNA, 20 nt, Shigella flexneri 2a str. 2457T
caauccgccaaaacaucuuc

SEQ ID NO: 3842210 - RNA, 15 nt, Shigella flexneri 2a str. 2457T
caauccggaaaccaa

SEQ ID NO: 3842211 - RNA, 20 nt, Shigella flexneri 2a str. 2457T
caauccggccuacaaauuca

SEQ ID NO: 3842212 - RNA, 21 nt, Shigella flexneri 2a str. 2457T
caaucgaaaaagaaucgauua

SEQ ID NO: 3842213 - RNA, 19 nt, Shigella flexneri 2a str. 2457T
caaucgaccaggccaucag

SEQ ID NO: 3842214 - RNA, 15 nt, Shigella flexneri 2a str. 2457T
caaucgacuuuucau

SEQ ID NO: 3842215 - RNA, 18 nt, Shigella flexneri 2a str. 2457T
caaucgagauacgacuga

SEQ ID NO: 3842216 - RNA, 13 nt, Shigella flexneri 2a str. 2457T
caaucgagcccag

SEQ ID NO: 3842217 - RNA, 22 nt, Shigella flexneri 2a str. 2457T
caaucgagcccagaugccggau

SEQ ID NO: 3842218 - RNA, 15 nt, Shigella flexneri 2a str. 2457T
caaucgcauagccag

SEQ ID NO: 3842219 - RNA, 15 nt, Shigella flexneri 2a str. 2457T
caaucgccagcggca

SEQ ID NO: 3842220 - RNA, 21 nt, Shigella flexneri 2a str. 2457T
caaucgcccccgucaccggca

SEQ ID NO: 3842221 - RNA, 18 nt, Shigella flexneri 2a str. 2457T
caaucgccuccagcgcug

SEQ ID NO: 3842222 - RNA, 19 nt, Shigella flexneri 2a str. 2457T
caaucgccuccagcgcugg

SEQ ID NO: 3842223 - RNA, 21 nt, Shigella flexneri 2a str. 2457T
caaucgcgccagaacacgcuc

SEQ ID NO: 3842224 - RNA, 13 nt, Shigella flexneri 2a str. 2457T
caaucgcggcgau

SEQ ID NO: 3842225 - RNA, 22 nt, Shigella flexneri 2a str. 2457T
caaucgcggcgauauccagcgc

SEQ ID NO: 3842226 - RNA, 14 nt, Shigella flexneri 2a str. 2457T
caaucgcugcggca

SEQ ID NO: 3842227 - RNA, 21 nt, Shigella flexneri 2a str. 2457T
caaucgcugcuaauuuaucgg

SEQ ID NO: 3842228 - RNA, 15 nt, Shigella flexneri 2a str. 2457T
caaucgcuucaucgc

SEQ ID NO: 3842229 - RNA, 22 nt, Shigella flexneri 2a str. 2457T
caaucggcuuucaccgccugau

SEQ ID NO: 3842230 - RNA, 15 nt, Shigella flexneri 2a str. 2457T
caaucggcuuuuuau

SEQ ID NO: 3842231 - RNA, 22 nt, Shigella flexneri 2a str. 2457T
caaucgguaacgcuuguacggc

SEQ ID NO: 3842232 - RNA, 14 nt, Shigella flexneri 2a str. 2457T
caaucggugcaaau

SEQ ID NO: 3842233 - RNA, 17 nt, Shigella flexneri 2a str. 2457T
caaucguaugaucaucc

SEQ ID NO: 3842234 - RNA, 20 nt, Shigella flexneri 2a str. 2457T
caaucguaugaucauccgcc

SEQ ID NO: 3842235 - RNA, 21 nt, Shigella flexneri 2a str. 2457T
caaucguaugaucauccgccu

SEQ ID NO: 3842236 - RNA, 17 nt, Shigella flexneri 2a str. 2457T
caaucgucaaacgcacg

SEQ ID NO: 3842237 - RNA, 14 nt, Shigella flexneri 2a str. 2457T
caaucuacaaaaga

SEQ ID NO: 3842238 - RNA, 18 nt, Shigella flexneri 2a str. 2457T
caaucuacaaaagauuau

SEQ ID NO: 3842239 - RNA, 12 nt, Shigella flexneri 2a str. 2457T
caaucucacucc

SEQ ID NO: 3842240 - RNA, 14 nt, Shigella flexneri 2a str. 2457T
caaucucagcaaga

SEQ ID NO: 3842241 - RNA, 12 nt, Shigella flexneri 2a str. 2457T
caaucucagcga

SEQ ID NO: 3842242 - RNA, 20 nt, Shigella flexneri 2a str. 2457T
caaucucauaccagguaccg

SEQ ID NO: 3842243 - RNA, 20 nt, Shigella flexneri 2a str. 2457T
caaucuccguguaggccuga

SEQ ID NO: 3842244 - RNA, 16 nt, Shigella flexneri 2a str. 2457T
caaucucgcgcccguc

SEQ ID NO: 3842245 - RNA, 20 nt, Shigella flexneri 2a str. 2457T
caaucucguggucaauauua

SEQ ID NO: 3842246 - RNA, 21 nt, Shigella flexneri 2a str. 2457T
caaucucugguuuguuuucag

SEQ ID NO: 3842247 - RNA, 14 nt, Shigella flexneri 2a str. 2457T
caaucucuucacag

SEQ ID NO: 3842248 - RNA, 15 nt, Shigella flexneri 2a str. 2457T
caaucucuuccagaa

SEQ ID NO: 3842249 - RNA, 18 nt, Shigella flexneri 2a str. 2457T
caaucucuuuuuccaccg

SEQ ID NO: 3842250 - RNA, 15 nt, Shigella flexneri 2a str. 2457T
caaucugaagccgca

SEQ ID NO: 3842251 - RNA, 18 nt, Shigella flexneri 2a str. 2457T
caaucugauagugaucca

SEQ ID NO: 3842252 - RNA, 17 nt, Shigella flexneri 2a str. 2457T
caaucugcgcuucucgc

SEQ ID NO: 3842253 - RNA, 15 nt, Shigella flexneri 2a str. 2457T
caaucuucucuuccc

SEQ ID NO: 3842254 - RNA, 19 nt, Shigella flexneri 2a str. 2457T
caaugaaacgcaaauacug

SEQ ID NO: 3842255 - RNA, 20 nt, Shigella flexneri 2a str. 2457T
caaugaaagccccaccagca

SEQ ID NO: 3842256 - RNA, 18 nt, Shigella flexneri 2a str. 2457T
caaugaaaggcuucccaa

SEQ ID NO: 3842257 - RNA, 19 nt, Shigella flexneri 2a str. 2457T
caaugaagaaccgcaccag

SEQ ID NO: 3842258 - RNA, 20 nt, Shigella flexneri 2a str. 2457T
caaugaccgcgccauccaua

SEQ ID NO: 3842259 - RNA, 13 nt, Shigella flexneri 2a str. 2457T
caaugacgggcuu

SEQ ID NO: 3842260 - RNA, 17 nt, Shigella flexneri 2a str. 2457T
caaugacgggcuuaacu

SEQ ID NO: 3842261 - RNA, 17 nt, Shigella flexneri 2a str. 2457T
caaugacguuaauaaaa

SEQ ID NO: 3842262 - RNA, 19 nt, Shigella flexneri 2a str. 2457T
caaugaguggugaaaaaaa

SEQ ID NO: 3842263 - RNA, 17 nt, Shigella flexneri 2a str. 2457T
caaugaguucgcgcgcu

SEQ ID NO: 3842264 - RNA, 13 nt, Shigella flexneri 2a str. 2457T
caaugauaagccu

SEQ ID NO: 3842265 - RNA, 14 nt, Shigella flexneri 2a str. 2457T
caaugauucaggca

SEQ ID NO: 3842266 - RNA, 19 nt, Shigella flexneri 2a str. 2457T
caaugauuuugauggaaga

SEQ ID NO: 3842267 - RNA, 17 nt, Shigella flexneri 2a str. 2457T
caaugcaggcaccugcc

SEQ ID NO: 3842268 - RNA, 17 nt, Shigella flexneri 2a str. 2457T
caaugcaguuccauaug

SEQ ID NO: 3842269 - RNA, 17 nt, Shigella flexneri 2a str. 2457T
caaugcauuaucagaga

SEQ ID NO: 3842270 - RNA, 18 nt, Shigella flexneri 2a str. 2457T
caaugcauuaucagagau

SEQ ID NO: 3842271 - RNA, 16 nt, Shigella flexneri 2a str. 2457T
caaugcccaucacuau

SEQ ID NO: 3842272 - RNA, 23 nt, Shigella flexneri 2a str. 2457T
caaugccugaugcgcuucgcuua

SEQ ID NO: 3842273 - RNA, 11 nt, Shigella flexneri 2a str. 2457T
caaugcgcauc

SEQ ID NO: 3842274 - RNA, 14 nt, Shigella flexneri 2a str. 2457T
caaugcgcaucaaa

SEQ ID NO: 3842275 - RNA, 18 nt, Shigella flexneri 2a str. 2457T
caaugcgcguaauuugcg

SEQ ID NO: 3842276 - RNA, 22 nt, Shigella flexneri 2a str. 2457T
caaugcguagcugagcaacaaa

SEQ ID NO: 3842277 - RNA, 18 nt, Shigella flexneri 2a str. 2457T
caaugcucucuucgccaa

SEQ ID NO: 3842278 - RNA, 19 nt, Shigella flexneri 2a str. 2457T
caauggagcacauugccug

SEQ ID NO: 3842279 - RNA, 20 nt, Shigella flexneri 2a str. 2457T
caauggcaggcucagacuga

SEQ ID NO: 3842280 - RNA, 14 nt, Shigella flexneri 2a str. 2457T
caauggcccgccgc

SEQ ID NO: 3842281 - RNA, 18 nt, Shigella flexneri 2a str. 2457T
caauggccguuccggcaa

SEQ ID NO: 3842282 - RNA, 11 nt, Shigella flexneri 2a str. 2457T
caauggcgucu

SEQ ID NO: 3842283 - RNA, 22 nt, Shigella flexneri 2a str. 2457T
caauggcuggccccgucagcaa

SEQ ID NO: 3842284 - RNA, 14 nt, Shigella flexneri 2a str. 2457T
caauggcuggccug

SEQ ID NO: 3842285 - RNA, 22 nt, Shigella flexneri 2a str. 2457T
cacaaucccuuaguaacgccag

SEQ ID NO: 3842286 - RNA, 22 nt, Shigella flexneri 2a str. 2457T
cacaaucgcagcgcaagcugaa

SEQ ID NO: 3842287 - RNA, 20 nt, Shigella flexneri 2a str. 2457T
cacaaucggcuuucaccgcc

SEQ ID NO: 3842288 - RNA, 23 nt, Shigella flexneri 2a str. 2457T
cacaaucugauaauccagacuau

SEQ ID NO: 3842289 - RNA, 15 nt, Shigella flexneri 2a str. 2457T
cacaaugccugaugc

SEQ ID NO: 3842290 - RNA, 19 nt, Shigella flexneri 2a str. 2457T
cacaaugccugaugcgcuu

SEQ ID NO: 3842291 - RNA, 20 nt, Shigella flexneri 2a str. 2457T
cacaaugcuguaaccagcgc

SEQ ID NO: 3842292 - RNA, 20 nt, Shigella flexneri 2a str. 2457T
cacaauggcggugaucccaa

SEQ ID NO: 3842293 - RNA, 22 nt, Shigella flexneri 2a str. 2457T
cacaaugucacaaauaaaaaau

SEQ ID NO: 3842294 - RNA, 16 nt, Shigella flexneri 2a str. 2457T
cacaaugucauggcag

SEQ ID NO: 3842295 - RNA, 14 nt, Shigella flexneri 2a str. 2457T
cacaauuaccuucc

SEQ ID NO: 3842296 - RNA, 23 nt, Shigella flexneri 2a str. 2457T
cacaauuaccuuccacaauggca

SEQ ID NO: 3842297 - RNA, 22 nt, Shigella flexneri 2a str. 2457T
cacacacugcuuaacugcgcuu

SEQ ID NO: 3842298 - RNA, 14 nt, Shigella flexneri 2a str. 2457T
cacacagacaauaa

SEQ ID NO: 3842299 - RNA, 16 nt, Shigella flexneri 2a str. 2457T
cacacagauguaauga

SEQ ID NO: 3842300 - RNA, 18 nt, Shigella flexneri 2a str. 2457T
cacacauuauaggccuga

SEQ ID NO: 3842301 - RNA, 16 nt, Shigella flexneri 2a str. 2457T
cacaccacugcgcaua

SEQ ID NO: 3842302 - RNA, 21 nt, Shigella flexneri 2a str. 2457T
cacaccacugcgcauaaucca

SEQ ID NO: 3842303 - RNA, 12 nt, Shigella flexneri 2a str. 2457T
cacaccaucaaa

SEQ ID NO: 3842304 - RNA, 17 nt, Shigella flexneri 2a str. 2457T
cacaccauugauaaucc

SEQ ID NO: 3842305 - RNA, 13 nt, Shigella flexneri 2a str. 2457T
cacacccccgcug

SEQ ID NO: 3842306 - RNA, 16 nt, Shigella flexneri 2a str. 2457T
cacaccccgcgccgcu

SEQ ID NO: 3842307 - RNA, 18 nt, Shigella flexneri 2a str. 2457T
cacacccgguaucaaacc

SEQ ID NO: 3842308 - RNA, 19 nt, Shigella flexneri 2a str. 2457T
cacacccgguaucaaaccc

SEQ ID NO: 3842309 - RNA, 20 nt, Shigella flexneri 2a str. 2457T
cacacccgguaucaaacccu

SEQ ID NO: 3842310 - RNA, 16 nt, Shigella flexneri 2a str. 2457T
cacacccuugccagau

SEQ ID NO: 3842311 - RNA, 19 nt, Shigella flexneri 2a str. 2457T
cacaccgaagacaucgcag

SEQ ID NO: 3842312 - RNA, 13 nt, Shigella flexneri 2a str. 2457T
cacaccggcacca

SEQ ID NO: 3842313 - RNA, 13 nt, Shigella flexneri 2a str. 2457T
cacaccugcucag

SEQ ID NO: 3842314 - RNA, 20 nt, Shigella flexneri 2a str. 2457T
cacacgacauccgugcagaa

SEQ ID NO: 3842315 - RNA, 22 nt, Shigella flexneri 2a str. 2457T
cacacgagaguuaguguuaacc

SEQ ID NO: 3842316 - RNA, 15 nt, Shigella flexneri 2a str. 2457T
cacacgcccagcuca

SEQ ID NO: 3842317 - RNA, 13 nt, Shigella flexneri 2a str. 2457T
cacacgcgcugag

SEQ ID NO: 3842318 - RNA, 14 nt, Shigella flexneri 2a str. 2457T
cacacgcucuucca

SEQ ID NO: 3842319 - RNA, 14 nt, Shigella flexneri 2a str. 2457T
cacacggucuauca

SEQ ID NO: 3842320 - RNA, 20 nt, Shigella flexneri 2a str. 2457T
cacacuccagucccaguuca

SEQ ID NO: 3842321 - RNA, 18 nt, Shigella flexneri 2a str. 2457T
cacacugaugacaggcua

SEQ ID NO: 3842322 - RNA, 13 nt, Shigella flexneri 2a str. 2457T
cacacugcuuaac

SEQ ID NO: 3842323 - RNA, 17 nt, Shigella flexneri 2a str. 2457T
cacacugcuuaacugcg

SEQ ID NO: 3842324 - RNA, 15 nt, Shigella flexneri 2a str. 2457T
cacacugguucccaa

SEQ ID NO: 3842325 - RNA, 20 nt, Shigella flexneri 2a str. 2457T
cacacuucauuuuccacaau

SEQ ID NO: 3842326 - RNA, 20 nt, Shigella flexneri 2a str. 2457T
cacagaaucgggcugagaug

SEQ ID NO: 3842327 - RNA, 21 nt, Shigella flexneri 2a str. 2457T
cacagaauucccccauugaaa

SEQ ID NO: 3842328 - RNA, 17 nt, Shigella flexneri 2a str. 2457T
cacagacaauaaacggc

SEQ ID NO: 3842329 - RNA, 18 nt, Shigella flexneri 2a str. 2457T
cacagaccggacugacuc

SEQ ID NO: 3842330 - RNA, 19 nt, Shigella flexneri 2a str. 2457T
cacagaccggacugacucc

SEQ ID NO: 3842331 - RNA, 13 nt, Shigella flexneri 2a str. 2457T
cacagacgaaggu

SEQ ID NO: 3842332 - RNA, 16 nt, Shigella flexneri 2a str. 2457T
cacagaggucuuuucu

SEQ ID NO: 3842333 - RNA, 22 nt, Shigella flexneri 2a str. 2457T
cacagauaauaauguguucaac

SEQ ID NO: 3842334 - RNA, 17 nt, Shigella flexneri 2a str. 2457T
cacagaugcaggauuuc

SEQ ID NO: 3842335 - RNA, 19 nt, Shigella flexneri 2a str. 2457T
cacagauugauaaaaauag

SEQ ID NO: 3842336 - RNA, 22 nt, Shigella flexneri 2a str. 2457T
cacagauugauaaaaauaguua

SEQ ID NO: 3842337 - RNA, 18 nt, Shigella flexneri 2a str. 2457T
cacagcaaaacacccgca

SEQ ID NO: 3842338 - RNA, 14 nt, Shigella flexneri 2a str. 2457T
cacagcaguccagc

SEQ ID NO: 3842339 - RNA, 13 nt, Shigella flexneri 2a str. 2457T
cacagccaacaca

SEQ ID NO: 3842340 - RNA, 14 nt, Shigella flexneri 2a str. 2457T
cacagccaacacau

SEQ ID NO: 3842341 - RNA, 16 nt, Shigella flexneri 2a str. 2457T
cacagcgccagacacu

SEQ ID NO: 3842342 - RNA, 22 nt, Shigella flexneri 2a str. 2457T
cacagcggaguaaucgccagca

SEQ ID NO: 3842343 - RNA, 13 nt, Shigella flexneri 2a str. 2457T
cacagcggcgaau

SEQ ID NO: 3842344 - RNA, 16 nt, Shigella flexneri 2a str. 2457T
cacagcgugcauagca

SEQ ID NO: 3842345 - RNA, 12 nt, Shigella flexneri 2a str. 2457T
cacagcucugcu

SEQ ID NO: 3842346 - RNA, 13 nt, Shigella flexneri 2a str. 2457T
cacagcucugcug

SEQ ID NO: 3842347 - RNA, 22 nt, Shigella flexneri 2a str. 2457T
cacaggaaaaacuuuuaccugc

SEQ ID NO: 3842348 - RNA, 19 nt, Shigella flexneri 2a str. 2457T
cacaggcaaaacacugcgc

SEQ ID NO: 3842349 - RNA, 14 nt, Shigella flexneri 2a str. 2457T
cacaggcaucguga

SEQ ID NO: 3842350 - RNA, 15 nt, Shigella flexneri 2a str. 2457T
cacaggccaucacau

SEQ ID NO: 3842351 - RNA, 20 nt, Shigella flexneri 2a str. 2457T
cacaggccggagccagccgu

SEQ ID NO: 3842352 - RNA, 18 nt, Shigella flexneri 2a str. 2457T
cacaggccugauaagacg

SEQ ID NO: 3842353 - RNA, 17 nt, Shigella flexneri 2a str. 2457T
cacagggugaucaccag

SEQ ID NO: 3842354 - RNA, 20 nt, Shigella flexneri 2a str. 2457T
cacaggguggcccaaauggc

SEQ ID NO: 3842355 - RNA, 14 nt, Shigella flexneri 2a str. 2457T
cacaguaaugauuu

SEQ ID NO: 3842356 - RNA, 21 nt, Shigella flexneri 2a str. 2457T
cacaguaaugcgccagguucu

SEQ ID NO: 3842357 - RNA, 12 nt, Shigella flexneri 2a str. 2457T
cacagugacccg

SEQ ID NO: 3842358 - RNA, 22 nt, Shigella flexneri 2a str. 2457T
cacagugcugauuuugcaacaa

SEQ ID NO: 3842359 - RNA, 20 nt, Shigella flexneri 2a str. 2457T
cacaguggcgagcuuccugu

SEQ ID NO: 3842360 - RNA, 21 nt, Shigella flexneri 2a str. 2457T
cacaguuaaguuaauucugag

SEQ ID NO: 3842361 - RNA, 14 nt, Shigella flexneri 2a str. 2457T
cacaguuauaaaau

SEQ ID NO: 3842362 - RNA, 18 nt, Shigella flexneri 2a str. 2457T
cacaguuauaaaaugaua

SEQ ID NO: 3842363 - RNA, 18 nt, Shigella flexneri 2a str. 2457T
cacaguuucagccccauc

SEQ ID NO: 3842364 - RNA, 21 nt, Shigella flexneri 2a str. 2457T
cacauaaacagguaaagacca

SEQ ID NO: 3842365 - RNA, 20 nt, Shigella flexneri 2a str. 2457T
cacauaaaguagccaauccc

SEQ ID NO: 3842366 - RNA, 13 nt, Shigella flexneri 2a str. 2457T
cacauaaauucug

SEQ ID NO: 3842367 - RNA, 21 nt, Shigella flexneri 2a str. 2457T
cacauaaccguacaaucguuu

SEQ ID NO: 3842368 - RNA, 19 nt, Shigella flexneri 2a str. 2457T
cacauaacggcccggcgac

SEQ ID NO: 3842369 - RNA, 21 nt, Shigella flexneri 2a str. 2457T
cacauaagagcgggacaacaa

SEQ ID NO: 3842370 - RNA, 17 nt, Shigella flexneri 2a str. 2457T
cacauaagaucaucggc

SEQ ID NO: 3842371 - RNA, 15 nt, Shigella flexneri 2a str. 2457T
cacauaauccagaca

SEQ ID NO: 3842372 - RNA, 20 nt, Shigella flexneri 2a str. 2457T
cacauacgacgcuucaguuc

SEQ ID NO: 3842373 - RNA, 20 nt, Shigella flexneri 2a str. 2457T
cacauagcgugacaccagca

SEQ ID NO: 3842374 - RNA, 13 nt, Shigella flexneri 2a str. 2457T
cacauauauuaau

SEQ ID NO: 3842375 - RNA, 21 nt, Shigella flexneri 2a str. 2457T
cacauauuauugaaaucacua

SEQ ID NO: 3842376 - RNA, 15 nt, Shigella flexneri 2a str. 2457T
cacaucaaaucccca

SEQ ID NO: 3842377 - RNA, 23 nt, Shigella flexneri 2a str. 2457T
cacaucaaugaugaacgccacau

SEQ ID NO: 3842378 - RNA, 16 nt, Shigella flexneri 2a str. 2457T
cacaucaccuccagcg

SEQ ID NO: 3842379 - RNA, 17 nt, Shigella flexneri 2a str. 2457T
cacaucaccuccagcga

SEQ ID NO: 3842380 - RNA, 13 nt, Shigella flexneri 2a str. 2457T
cacaucacuccau

SEQ ID NO: 3842381 - RNA, 15 nt, Shigella flexneri 2a str. 2457T
cacaucaucaaagcc

SEQ ID NO: 3842382 - RNA, 20 nt, Shigella flexneri 2a str. 2457T
caccagcgaaaucaccgcca

SEQ ID NO: 3842383 - RNA, 19 nt, Shigella flexneri 2a str. 2457T
caccagcgauuguucaccc

SEQ ID NO: 3842384 - RNA, 20 nt, Shigella flexneri 2a str. 2457T
caccagcgcaauauguuucc

SEQ ID NO: 3842385 - RNA, 13 nt, Shigella flexneri 2a str. 2457T
caccagcgcacgc

SEQ ID NO: 3842386 - RNA, 16 nt, Shigella flexneri 2a str. 2457T
caccagcgccgcgcca

SEQ ID NO: 3842387 - RNA, 14 nt, Shigella flexneri 2a str. 2457T
caccagcggcacgc

SEQ ID NO: 3842388 - RNA, 21 nt, Shigella flexneri 2a str. 2457T
caccagcgucagaaacaguug

SEQ ID NO: 3842389 - RNA, 17 nt, Shigella flexneri 2a str. 2457T
caccagcuccggcaccu

SEQ ID NO: 3842390 - RNA, 19 nt, Shigella flexneri 2a str. 2457T
caccaggaacgcgccaaga

SEQ ID NO: 3842391 - RNA, 20 nt, Shigella flexneri 2a str. 2457T
caccaggaacgcgccaagau

SEQ ID NO: 3842392 - RNA, 22 nt, Shigella flexneri 2a str. 2457T
caccaggaacgcgccaagauag

SEQ ID NO: 3842393 - RNA, 22 nt, Shigella flexneri 2a str. 2457T
caccaggcucuuuaaacaguuu

SEQ ID NO: 3842394 - RNA, 13 nt, Shigella flexneri 2a str. 2457T
caccaggcuugcu

SEQ ID NO: 3842395 - RNA, 14 nt, Shigella flexneri 2a str. 2457T
caccagggaaauaa

SEQ ID NO: 3842396 - RNA, 16 nt, Shigella flexneri 2a str. 2457T
caccagggaaauaauc

SEQ ID NO: 3842397 - RNA, 21 nt, Shigella flexneri 2a str. 2457T
caccaguaaauugucgccgga

SEQ ID NO: 3842398 - RNA, 16 nt, Shigella flexneri 2a str. 2457T
caccaguaacaggauc

SEQ ID NO: 3842399 - RNA, 20 nt, Shigella flexneri 2a str. 2457T
caccaguaaggcaucuucuu

SEQ ID NO: 3842400 - RNA, 21 nt, Shigella flexneri 2a str. 2457T
caccaguaaggcaucuucuuc

SEQ ID NO: 3842401 - RNA, 22 nt, Shigella flexneri 2a str. 2457T
caccaguaaggcaucuucuuca

SEQ ID NO: 3842402 - RNA, 15 nt, Shigella flexneri 2a str. 2457T
caccaguaccgccac

SEQ ID NO: 3842403 - RNA, 23 nt, Shigella flexneri 2a str. 2457T
caccaguaccucuucgcuggcaa

SEQ ID NO: 3842404 - RNA, 22 nt, Shigella flexneri 2a str. 2457T
caccagucagcgaacaccagca

SEQ ID NO: 3842405 - RNA, 14 nt, Shigella flexneri 2a str. 2457T
caccaguccaucgg

SEQ ID NO: 3842406 - RNA, 23 nt, Shigella flexneri 2a str. 2457T
caccagugcaggcaccagccccu

SEQ ID NO: 3842407 - RNA, 22 nt, Shigella flexneri 2a str. 2457T
caccagugccauuaacaggcca

SEQ ID NO: 3842408 - RNA, 21 nt, Shigella flexneri 2a str. 2457T
caccaguuuucggauuuaccg

SEQ ID NO: 3842409 - RNA, 21 nt, Shigella flexneri 2a str. 2457T
caccauaaaucagaucgacgc

SEQ ID NO: 3842410 - RNA, 16 nt, Shigella flexneri 2a str. 2457T
caccauauucagcagc

SEQ ID NO: 3842411 - RNA, 12 nt, Shigella flexneri 2a str. 2457T
caccaucacuuu

SEQ ID NO: 3842412 - RNA, 13 nt, Shigella flexneri 2a str. 2457T
caccaucagcagc

SEQ ID NO: 3842413 - RNA, 15 nt, Shigella flexneri 2a str. 2457T
caccaucagcagcaa

SEQ ID NO: 3842414 - RNA, 13 nt, Shigella flexneri 2a str. 2457T
caccaucaguggc

SEQ ID NO: 3842415 - RNA, 20 nt, Shigella flexneri 2a str. 2457T
caccaucccgguaucaugug

SEQ ID NO: 3842416 - RNA, 17 nt, Shigella flexneri 2a str. 2457T
caccauccgcccacacc

SEQ ID NO: 3842417 - RNA, 17 nt, Shigella flexneri 2a str. 2457T
caccaucgcaaacagua

SEQ ID NO: 3842418 - RNA, 21 nt, Shigella flexneri 2a str. 2457T
caccaucgggccucuuuuuau

SEQ ID NO: 3842419 - RNA, 14 nt, Shigella flexneri 2a str. 2457T
caccaucuuccuca

SEQ ID NO: 3842420 - RNA, 22 nt, Shigella flexneri 2a str. 2457T
caccaucuugagaaaaaccuca

SEQ ID NO: 3842421 - RNA, 16 nt, Shigella flexneri 2a str. 2457T
caccaugccacagaau

SEQ ID NO: 3842422 - RNA, 22 nt, Shigella flexneri 2a str. 2457T
caccauggcuauaccccacccc

SEQ ID NO: 3842423 - RNA, 22 nt, Shigella flexneri 2a str. 2457T
caccaugucccggaacaggcag

SEQ ID NO: 3842424 - RNA, 14 nt, Shigella flexneri 2a str. 2457T
caccauuaccgccg

SEQ ID NO: 3842425 - RNA, 13 nt, Shigella flexneri 2a str. 2457T
caccauucugcgc

SEQ ID NO: 3842426 - RNA, 15 nt, Shigella flexneri 2a str. 2457T
caccauucugcgcug

SEQ ID NO: 3842427 - RNA, 19 nt, Shigella flexneri 2a str. 2457T
caccauugauaauccauca

SEQ ID NO: 3842428 - RNA, 17 nt, Shigella flexneri 2a str. 2457T
caccauugcugccgcca

SEQ ID NO: 3842429 - RNA, 21 nt, Shigella flexneri 2a str. 2457T
caccauuuccggagacagcuu

SEQ ID NO: 3842430 - RNA, 21 nt, Shigella flexneri 2a str. 2457T
caccauuuuacguccgcgcac

SEQ ID NO: 3842431 - RNA, 18 nt, Shigella flexneri 2a str. 2457T
cacccaacacucaaacag

SEQ ID NO: 3842432 - RNA, 14 nt, Shigella flexneri 2a str. 2457T
cacccacaucagcg

SEQ ID NO: 3842433 - RNA, 18 nt, Shigella flexneri 2a str. 2457T
cacccaccgcagcccaga

SEQ ID NO: 3842434 - RNA, 22 nt, Shigella flexneri 2a str. 2457T
cacccacggcguuaacuguaca

SEQ ID NO: 3842435 - RNA, 19 nt, Shigella flexneri 2a str. 2457T
cacccacgguuacgcuacc

SEQ ID NO: 3842436 - RNA, 15 nt, Shigella flexneri 2a str. 2457T
cacccagcagcgccg

SEQ ID NO: 3842437 - RNA, 23 nt, Shigella flexneri 2a str. 2457T
cacccagcgaagcaaaccaggcc

SEQ ID NO: 3842438 - RNA, 15 nt, Shigella flexneri 2a str. 2457T
cacccagcgccgcca

SEQ ID NO: 3842439 - RNA, 19 nt, Shigella flexneri 2a str. 2457T
cacccagcgccgccauagc

SEQ ID NO: 3842440 - RNA, 15 nt, Shigella flexneri 2a str. 2457T
cacccauagcuucaa

SEQ ID NO: 3842441 - RNA, 14 nt, Shigella flexneri 2a str. 2457T
cacccaucacuacc

SEQ ID NO: 3842442 - RNA, 16 nt, Shigella flexneri 2a str. 2457T
caccccagacuucccc

SEQ ID NO: 3842443 - RNA, 13 nt, Shigella flexneri 2a str. 2457T
cacccccaccccg

SEQ ID NO: 3842444 - RNA, 16 nt, Shigella flexneri 2a str. 2457T
cacccccaccccggcc

SEQ ID NO: 3842445 - RNA, 20 nt, Shigella flexneri 2a str. 2457T
caccccgcgcagcugagaaa

SEQ ID NO: 3842446 - RNA, 20 nt, Shigella flexneri 2a str. 2457T
caccccgcgccgcugagaaa

SEQ ID NO: 3842447 - RNA, 19 nt, Shigella flexneri 2a str. 2457T
caccccguugguuggauaa

SEQ ID NO: 3842448 - RNA, 15 nt, Shigella flexneri 2a str. 2457T
caccccugauaaccg

SEQ ID NO: 3842449 - RNA, 21 nt, Shigella flexneri 2a str. 2457T
caccccuuuacugacuguccc

SEQ ID NO: 3842450 - RNA, 14 nt, Shigella flexneri 2a str. 2457T
cacccgcagcacgg

SEQ ID NO: 3842451 - RNA, 15 nt, Shigella flexneri 2a str. 2457T
cacccgcagccauca

SEQ ID NO: 3842452 - RNA, 14 nt, Shigella flexneri 2a str. 2457T
cacccgcagugauu

SEQ ID NO: 3842453 - RNA, 24 nt, Shigella flexneri 2a str. 2457T
cacccgcauaugcggugcggagua

SEQ ID NO: 3842454 - RNA, 18 nt, Shigella flexneri 2a str. 2457T
cacccgccaguaucagcg

SEQ ID NO: 3842455 - RNA, 22 nt, Shigella flexneri 2a str. 2457T
cacccgccuguugcgucgccgc

SEQ ID NO: 3842456 - RNA, 15 nt, Shigella flexneri 2a str. 2457T
cacccgcgaccacca

SEQ ID NO: 3842457 - RNA, 14 nt, Shigella flexneri 2a str. 2457T
cacccggaucucag

SEQ ID NO: 3842458 - RNA, 15 nt, Shigella flexneri 2a str. 2457T
cacccgguaccuuug

SEQ ID NO: 3842459 - RNA, 19 nt, Shigella flexneri 2a str. 2457T
cacccgugagaacugcugc

SEQ ID NO: 3842460 - RNA, 19 nt, Shigella flexneri 2a str. 2457T
cacccuaacccucucccca

SEQ ID NO: 3842461 - RNA, 22 nt, Shigella flexneri 2a str. 2457T
cacccucaaaauuucuccuuca

SEQ ID NO: 3842462 - RNA, 23 nt, Shigella flexneri 2a str. 2457T
cacccugcccguuucucuuaaau

SEQ ID NO: 3842463 - RNA, 14 nt, Shigella flexneri 2a str. 2457T
cacccugugcgcca

SEQ ID NO: 3842464 - RNA, 13 nt, Shigella flexneri 2a str. 2457T
caccgaagacgug

SEQ ID NO: 3842465 - RNA, 15 nt, Shigella flexneri 2a str. 2457T
caccgaccaucggca

SEQ ID NO: 3842466 - RNA, 16 nt, Shigella flexneri 2a str. 2457T
caccgagcagcacaau

SEQ ID NO: 3842467 - RNA, 15 nt, Shigella flexneri 2a str. 2457T
caccgaggcauucag

SEQ ID NO: 3842468 - RNA, 17 nt, Shigella flexneri 2a str. 2457T
caccgaggccaaaacca

SEQ ID NO: 3842469 - RNA, 14 nt, Shigella flexneri 2a str. 2457T
caccgaguucuuca

SEQ ID NO: 3842470 - RNA, 19 nt, Shigella flexneri 2a str. 2457T
caccgaugaucaacagcau

SEQ ID NO: 3842471 - RNA, 21 nt, Shigella flexneri 2a str. 2457T
caccgaugaucaacagcauca

SEQ ID NO: 3842472 - RNA, 15 nt, Shigella flexneri 2a str. 2457T
caccgaugcacagca

SEQ ID NO: 3842473 - RNA, 16 nt, Shigella flexneri 2a str. 2457T
caccgaugcacagcac

SEQ ID NO: 3842474 - RNA, 18 nt, Shigella flexneri 2a str. 2457T
caccgauuuuguaaaaga

SEQ ID NO: 3842475 - RNA, 20 nt, Shigella flexneri 2a str. 2457T
caccgauuuuguaaaagaag

SEQ ID NO: 3842476 - RNA, 22 nt, Shigella flexneri 2a str. 2457T
caccgauuuuguaaaagaaggc

SEQ ID NO: 3842477 - RNA, 15 nt, Shigella flexneri 2a str. 2457T
caccgcaaucgccag

SEQ ID NO: 3842478 - RNA, 15 nt, Shigella flexneri 2a str. 2457T
caccgcacagaccau

SEQ ID NO: 3842479 - RNA, 19 nt, Shigella flexneri 2a str. 2457T
cacgaauuccaagcagacg

SEQ ID NO: 3842480 - RNA, 19 nt, Shigella flexneri 2a str. 2457T
cacgacaaaugcgccgcca

SEQ ID NO: 3842481 - RNA, 18 nt, Shigella flexneri 2a str. 2457T
cacgacagaacucguuca

SEQ ID NO: 3842482 - RNA, 21 nt, Shigella flexneri 2a str. 2457T
cacgacauaaacauuccacuu

SEQ ID NO: 3842483 - RNA, 19 nt, Shigella flexneri 2a str. 2457T
cacgacauacaccgcagcc

SEQ ID NO: 3842484 - RNA, 14 nt, Shigella flexneri 2a str. 2457T
cacgacgaccaccg

SEQ ID NO: 3842485 - RNA, 16 nt, Shigella flexneri 2a str. 2457T
cacgacgucuccauca

SEQ ID NO: 3842486 - RNA, 14 nt, Shigella flexneri 2a str. 2457T
cacgagaaaaaaug

SEQ ID NO: 3842487 - RNA, 23 nt, Shigella flexneri 2a str. 2457T
cacgaggcuggcuuuaucacuga

SEQ ID NO: 3842488 - RNA, 14 nt, Shigella flexneri 2a str. 2457T
cacgaguguuacgc

SEQ ID NO: 3842489 - RNA, 19 nt, Shigella flexneri 2a str. 2457T
cacgauaaguuugcgcauc

SEQ ID NO: 3842490 - RNA, 17 nt, Shigella flexneri 2a str. 2457T
cacgauauccagcguca

SEQ ID NO: 3842491 - RNA, 14 nt, Shigella flexneri 2a str. 2457T
cacgaucucacgcu

SEQ ID NO: 3842492 - RNA, 16 nt, Shigella flexneri 2a str. 2457T
cacgaugcuaaaaaca

SEQ ID NO: 3842493 - RNA, 15 nt, Shigella flexneri 2a str. 2457T
cacgauuaucaccug

SEQ ID NO: 3842494 - RNA, 12 nt, Shigella flexneri 2a str. 2457T
cacgauugcugc

SEQ ID NO: 3842495 - RNA, 20 nt, Shigella flexneri 2a str. 2457T
cacgauuguuaaucacaucg

SEQ ID NO: 3842496 - RNA, 15 nt, Shigella flexneri 2a str. 2457T
cacgcaacagaccag

SEQ ID NO: 3842497 - RNA, 19 nt, Shigella flexneri 2a str. 2457T
cacgcaagguuucaguaac

SEQ ID NO: 3842498 - RNA, 13 nt, Shigella flexneri 2a str. 2457T
cacgcaauaccag

SEQ ID NO: 3842499 - RNA, 15 nt, Shigella flexneri 2a str. 2457T
cacgcacagcccgcc

SEQ ID NO: 3842500 - RNA, 21 nt, Shigella flexneri 2a str. 2457T
cacgcacaggugcaaaaaaac

SEQ ID NO: 3842501 - RNA, 20 nt, Shigella flexneri 2a str. 2457T
cacgcagaagcgcagaucga

SEQ ID NO: 3842502 - RNA, 15 nt, Shigella flexneri 2a str. 2457T
cacgcagcaagccgu

SEQ ID NO: 3842503 - RNA, 19 nt, Shigella flexneri 2a str. 2457T
cacgcagggggucgcgggu

SEQ ID NO: 3842504 - RNA, 21 nt, Shigella flexneri 2a str. 2457T
cacgcagggugugcuccaguc

SEQ ID NO: 3842505 - RNA, 23 nt, Shigella flexneri 2a str. 2457T
cacgcaucacuuucggugacaga

SEQ ID NO: 3842506 - RNA, 23 nt, Shigella flexneri 2a str. 2457T
cacgcauccucuauauuucaccg

SEQ ID NO: 3842507 - RNA, 13 nt, Shigella flexneri 2a str. 2457T
cacgcaucgcgaa

SEQ ID NO: 3842508 - RNA, 13 nt, Shigella flexneri 2a str. 2457T
cacgcauuaauaa

SEQ ID NO: 3842509 - RNA, 12 nt, Shigella flexneri 2a str. 2457T
cacgccaacaaa

SEQ ID NO: 3842510 - RNA, 14 nt, Shigella flexneri 2a str. 2457T
cacgccaacaaaca

SEQ ID NO: 3842511 - RNA, 19 nt, Shigella flexneri 2a str. 2457T
cacgccaacaaacaguaca

SEQ ID NO: 3842512 - RNA, 11 nt, Shigella flexneri 2a str. 2457T
cacgccaagcu

SEQ ID NO: 3842513 - RNA, 13 nt, Shigella flexneri 2a str. 2457T
cacgccaauaccg

SEQ ID NO: 3842514 - RNA, 21 nt, Shigella flexneri 2a str. 2457T
cacgccaauguguuuauaagc

SEQ ID NO: 3842515 - RNA, 12 nt, Shigella flexneri 2a str. 2457T
cacgccacaaua

SEQ ID NO: 3842516 - RNA, 22 nt, Shigella flexneri 2a str. 2457T
cacgccagacaucaccaguacc

SEQ ID NO: 3842517 - RNA, 17 nt, Shigella flexneri 2a str. 2457T
cacgccaggccacgcuu

SEQ ID NO: 3842518 - RNA, 17 nt, Shigella flexneri 2a str. 2457T
cacgcccagcucaaacg

SEQ ID NO: 3842519 - RNA, 15 nt, Shigella flexneri 2a str. 2457T
cacgccgaagugcgc

SEQ ID NO: 3842520 - RNA, 20 nt, Shigella flexneri 2a str. 2457T
cacgccgaagugcgcgcagc

SEQ ID NO: 3842521 - RNA, 17 nt, Shigella flexneri 2a str. 2457T
cacgccgaucgaagaga

SEQ ID NO: 3842522 - RNA, 14 nt, Shigella flexneri 2a str. 2457T
cacgccgcauccgg

SEQ ID NO: 3842523 - RNA, 21 nt, Shigella flexneri 2a str. 2457T
cacgccgcauccggcagccgu

SEQ ID NO: 3842524 - RNA, 22 nt, Shigella flexneri 2a str. 2457T
cacgccgcauccggcaugaaca

SEQ ID NO: 3842525 - RNA, 14 nt, Shigella flexneri 2a str. 2457T
cacgccgcauuacc

SEQ ID NO: 3842526 - RNA, 14 nt, Shigella flexneri 2a str. 2457T
cacgccgccagacc

SEQ ID NO: 3842527 - RNA, 24 nt, Shigella flexneri 2a str. 2457T
cacgccgcugucuaccagcaccug

SEQ ID NO: 3842528 - RNA, 17 nt, Shigella flexneri 2a str. 2457T
cacgccgguucccagac

SEQ ID NO: 3842529 - RNA, 12 nt, Shigella flexneri 2a str. 2457T
cacgccuccugg

SEQ ID NO: 3842530 - RNA, 13 nt, Shigella flexneri 2a str. 2457T
cacgccuccuggc

SEQ ID NO: 3842531 - RNA, 19 nt, Shigella flexneri 2a str. 2457T
cacgccuccuggcucagcg

SEQ ID NO: 3842532 - RNA, 16 nt, Shigella flexneri 2a str. 2457T
cacgccugcauccgcc

SEQ ID NO: 3842533 - RNA, 15 nt, Shigella flexneri 2a str. 2457T
cacgccuggcaguca

SEQ ID NO: 3842534 - RNA, 15 nt, Shigella flexneri 2a str. 2457T
cacgccuucuccggc

SEQ ID NO: 3842535 - RNA, 23 nt, Shigella flexneri 2a str. 2457T
cacgccuugcggaaauuccagcg

SEQ ID NO: 3842536 - RNA, 20 nt, Shigella flexneri 2a str. 2457T
cacgccuuuuuucacuaugu

SEQ ID NO: 3842537 - RNA, 22 nt, Shigella flexneri 2a str. 2457T
cacgcgaacaacagaucaacau

SEQ ID NO: 3842538 - RNA, 13 nt, Shigella flexneri 2a str. 2457T
cacgcgcuccagg

SEQ ID NO: 3842539 - RNA, 14 nt, Shigella flexneri 2a str. 2457T
cacgcgcuccagga

SEQ ID NO: 3842540 - RNA, 15 nt, Shigella flexneri 2a str. 2457T
cacgcgcuccaggag

SEQ ID NO: 3842541 - RNA, 12 nt, Shigella flexneri 2a str. 2457T
cacgcgcugacc

SEQ ID NO: 3842542 - RNA, 17 nt, Shigella flexneri 2a str. 2457T
cacgcgguuacgcaccg

SEQ ID NO: 3842543 - RNA, 13 nt, Shigella flexneri 2a str. 2457T
cacgcuaccuuga

SEQ ID NO: 3842544 - RNA, 16 nt, Shigella flexneri 2a str. 2457T
cacgcucaaagacgcg

SEQ ID NO: 3842545 - RNA, 16 nt, Shigella flexneri 2a str. 2457T
cacgcucacucaucac

SEQ ID NO: 3842546 - RNA, 19 nt, Shigella flexneri 2a str. 2457T
cacgcucacucaucacucc

SEQ ID NO: 3842547 - RNA, 22 nt, Shigella flexneri 2a str. 2457T
cacgcucacucaucacuccccg

SEQ ID NO: 3842548 - RNA, 14 nt, Shigella flexneri 2a str. 2457T
cacgcucagcaauu

SEQ ID NO: 3842549 - RNA, 15 nt, Shigella flexneri 2a str. 2457T
cacgcucagcaauug

SEQ ID NO: 3842550 - RNA, 13 nt, Shigella flexneri 2a str. 2457T
cacgcucccagca

SEQ ID NO: 3842551 - RNA, 14 nt, Shigella flexneri 2a str. 2457T
cacgcucuguucug

SEQ ID NO: 3842552 - RNA, 17 nt, Shigella flexneri 2a str. 2457T
cacgcucuguucugcgc

SEQ ID NO: 3842553 - RNA, 17 nt, Shigella flexneri 2a str. 2457T
cacgcugcgguuuacgc

SEQ ID NO: 3842554 - RNA, 14 nt, Shigella flexneri 2a str. 2457T
cacgcugcucaucu

SEQ ID NO: 3842555 - RNA, 13 nt, Shigella flexneri 2a str. 2457T
cacgcuggcguca

SEQ ID NO: 3842556 - RNA, 17 nt, Shigella flexneri 2a str. 2457T
cacgcugucggcacuga

SEQ ID NO: 3842557 - RNA, 17 nt, Shigella flexneri 2a str. 2457T
cacgcugucuggcgucu

SEQ ID NO: 3842558 - RNA, 22 nt, Shigella flexneri 2a str. 2457T
cacgcugucuggcgucuccugc

SEQ ID NO: 3842559 - RNA, 15 nt, Shigella flexneri 2a str. 2457T
cacgcuuaacaaccc

SEQ ID NO: 3842560 - RNA, 12 nt, Shigella flexneri 2a str. 2457T
cacgcuugauaa

SEQ ID NO: 3842561 - RNA, 17 nt, Shigella flexneri 2a str. 2457T
cacggaaagcagcauac

SEQ ID NO: 3842562 - RNA, 15 nt, Shigella flexneri 2a str. 2457T
cacggaaucaccgcc

SEQ ID NO: 3842563 - RNA, 11 nt, Shigella flexneri 2a str. 2457T
cacggacaggu

SEQ ID NO: 3842564 - RNA, 17 nt, Shigella flexneri 2a str. 2457T
cacggagauauccagcg

SEQ ID NO: 3842565 - RNA, 20 nt, Shigella flexneri 2a str. 2457T
cacggaucaggcggcucacc

SEQ ID NO: 3842566 - RNA, 13 nt, Shigella flexneri 2a str. 2457T
cacggcaccagcc

SEQ ID NO: 3842567 - RNA, 13 nt, Shigella flexneri 2a str. 2457T
cacggcagcaacu

SEQ ID NO: 3842568 - RNA, 15 nt, Shigella flexneri 2a str. 2457T
cacggcauaagccgu

SEQ ID NO: 3842569 - RNA, 18 nt, Shigella flexneri 2a str. 2457T
cacggcauaagccguccc

SEQ ID NO: 3842570 - RNA, 14 nt, Shigella flexneri 2a str. 2457T
cacggcaugaaagc

SEQ ID NO: 3842571 - RNA, 18 nt, Shigella flexneri 2a str. 2457T
cacggcgcugacggucug

SEQ ID NO: 3842572 - RNA, 23 nt, Shigella flexneri 2a str. 2457T
cacggcguggcaucaauaccgcg

SEQ ID NO: 3842573 - RNA, 20 nt, Shigella flexneri 2a str. 2457T
cacgggcgcggaaagcaccu

SEQ ID NO: 3842574 - RNA, 13 nt, Shigella flexneri 2a str. 2457T
cacgguaaugacu

SEQ ID NO: 3842575 - RNA, 14 nt, Shigella flexneri 2a str. 2457T
cacgguaaugacuc

SEQ ID NO: 3842576 - RNA, 17 nt, Shigella flexneri 2a str. 2457T
cacgguaguuagccgga

SEQ ID NO: 3842577 - RNA, 19 nt, Shigella flexneri 2a str. 2457T
cacugcgcauaauccacuu

SEQ ID NO: 3842578 - RNA, 13 nt, Shigella flexneri 2a str. 2457T
cacugcgcccgcc

SEQ ID NO: 3842579 - RNA, 18 nt, Shigella flexneri 2a str. 2457T
cacugcgcccgccagcau

SEQ ID NO: 3842580 - RNA, 17 nt, Shigella flexneri 2a str. 2457T
cacugcucaaucaucac

SEQ ID NO: 3842581 - RNA, 14 nt, Shigella flexneri 2a str. 2457T
cacugcucaccgaa

SEQ ID NO: 3842582 - RNA, 19 nt, Shigella flexneri 2a str. 2457T
cacugcucuuuuugcauaa

SEQ ID NO: 3842583 - RNA, 18 nt, Shigella flexneri 2a str. 2457T
cacugcugauaauccagu

SEQ ID NO: 3842584 - RNA, 22 nt, Shigella flexneri 2a str. 2457T
cacugcuguuccgcaaagcgcc

SEQ ID NO: 3842585 - RNA, 23 nt, Shigella flexneri 2a str. 2457T
cacuggaggagucaugcggugga

SEQ ID NO: 3842586 - RNA, 14 nt, Shigella flexneri 2a str. 2457T
cacuggcaaaauca

SEQ ID NO: 3842587 - RNA, 19 nt, Shigella flexneri 2a str. 2457T
cacuggcaaucaguggcuu

SEQ ID NO: 3842588 - RNA, 19 nt, Shigella flexneri 2a str. 2457T
cacuggcagccaggcgcga

SEQ ID NO: 3842589 - RNA, 21 nt, Shigella flexneri 2a str. 2457T
cacuggcccaacaacggcuuu

SEQ ID NO: 3842590 - RNA, 18 nt, Shigella flexneri 2a str. 2457T
cacuggcgauauugccgc

SEQ ID NO: 3842591 - RNA, 15 nt, Shigella flexneri 2a str. 2457T
cacuggguucaaaaa

SEQ ID NO: 3842592 - RNA, 22 nt, Shigella flexneri 2a str. 2457T
cacuggguucaaaaacuaauuc

SEQ ID NO: 3842593 - RNA, 17 nt, Shigella flexneri 2a str. 2457T
cacuggucugacgcuga

SEQ ID NO: 3842594 - RNA, 20 nt, Shigella flexneri 2a str. 2457T
cacuggucugacgcugaaua

SEQ ID NO: 3842595 - RNA, 15 nt, Shigella flexneri 2a str. 2457T
cacugguucaaagua

SEQ ID NO: 3842596 - RNA, 17 nt, Shigella flexneri 2a str. 2457T
cacugguucccaacaac

SEQ ID NO: 3842597 - RNA, 19 nt, Shigella flexneri 2a str. 2457T
cacugguuccgguuuaucc

SEQ ID NO: 3842598 - RNA, 21 nt, Shigella flexneri 2a str. 2457T
cacugguuccgguuuauccau

SEQ ID NO: 3842599 - RNA, 14 nt, Shigella flexneri 2a str. 2457T
cacuguaugaaaca

SEQ ID NO: 3842600 - RNA, 18 nt, Shigella flexneri 2a str. 2457T
cacuguaugaaacaacgu

SEQ ID NO: 3842601 - RNA, 18 nt, Shigella flexneri 2a str. 2457T
cacugucaaauccagacu

SEQ ID NO: 3842602 - RNA, 17 nt, Shigella flexneri 2a str. 2457T
cacugugggauugcuuc

SEQ ID NO: 3842603 - RNA, 20 nt, Shigella flexneri 2a str. 2457T
cacugugggauugcuucagu

SEQ ID NO: 3842604 - RNA, 19 nt, Shigella flexneri 2a str. 2457T
cacuguucacuuuugcugc

SEQ ID NO: 3842605 - RNA, 14 nt, Shigella flexneri 2a str. 2457T
cacuguucauuaaa

SEQ ID NO: 3842606 - RNA, 20 nt, Shigella flexneri 2a str. 2457T
cacuguucauuaaagccgcc

SEQ ID NO: 3842607 - RNA, 19 nt, Shigella flexneri 2a str. 2457T
cacuguuggcgaaaauccu

SEQ ID NO: 3842608 - RNA, 21 nt, Shigella flexneri 2a str. 2457T
cacuuaacccauuacaagccc

SEQ ID NO: 3842609 - RNA, 23 nt, Shigella flexneri 2a str. 2457T
cacuuaauaagaagaaaccgcua

SEQ ID NO: 3842610 - RNA, 21 nt, Shigella flexneri 2a str. 2457T
cacuuaaucgcccucgccuuu

SEQ ID NO: 3842611 - RNA, 13 nt, Shigella flexneri 2a str. 2457T
cacuuaaugaauc

SEQ ID NO: 3842612 - RNA, 17 nt, Shigella flexneri 2a str. 2457T
cacuuaauggucugaaa

SEQ ID NO: 3842613 - RNA, 19 nt, Shigella flexneri 2a str. 2457T
cacuuaauuauuaacaaaa

SEQ ID NO: 3842614 - RNA, 16 nt, Shigella flexneri 2a str. 2457T
cacuuacagcaacgcc

SEQ ID NO: 3842615 - RNA, 17 nt, Shigella flexneri 2a str. 2457T
cacuucaaccacauuca

SEQ ID NO: 3842616 - RNA, 22 nt, Shigella flexneri 2a str. 2457T
cacuucaauauuaaugcugacc

SEQ ID NO: 3842617 - RNA, 21 nt, Shigella flexneri 2a str. 2457T
cacuucaccgcgaauauaagc

SEQ ID NO: 3842618 - RNA, 16 nt, Shigella flexneri 2a str. 2457T
cacuucagccaucaaa

SEQ ID NO: 3842619 - RNA, 20 nt, Shigella flexneri 2a str. 2457T
cacuucauagugcgcggugu

SEQ ID NO: 3842620 - RNA, 12 nt, Shigella flexneri 2a str. 2457T
cacuucaucaag

SEQ ID NO: 3842621 - RNA, 15 nt, Shigella flexneri 2a str. 2457T
cacuucaucaagcaa

SEQ ID NO: 3842622 - RNA, 23 nt, Shigella flexneri 2a str. 2457T
cacuucaucacuaccuucuuccc

SEQ ID NO: 3842623 - RNA, 19 nt, Shigella flexneri 2a str. 2457T
cacuucauuaaccacgauc

SEQ ID NO: 3842624 - RNA, 20 nt, Shigella flexneri 2a str. 2457T
cacuuccaccacuuccugcu

SEQ ID NO: 3842625 - RNA, 17 nt, Shigella flexneri 2a str. 2457T
cacuuccaccagcggcu

SEQ ID NO: 3842626 - RNA, 22 nt, Shigella flexneri 2a str. 2457T
cacuuccggugccgguuucacg

SEQ ID NO: 3842627 - RNA, 15 nt, Shigella flexneri 2a str. 2457T
cacuuccucaagcgu

SEQ ID NO: 3842628 - RNA, 11 nt, Shigella flexneri 2a str. 2457T
cacuuccugcc

SEQ ID NO: 3842629 - RNA, 21 nt, Shigella flexneri 2a str. 2457T
cacuucgccaacgcccagcgc

SEQ ID NO: 3842630 - RNA, 21 nt, Shigella flexneri 2a str. 2457T
cacuucgcgcaaccaguccuc

SEQ ID NO: 3842631 - RNA, 18 nt, Shigella flexneri 2a str. 2457T
cacuucgcuuacgccugc

SEQ ID NO: 3842632 - RNA, 16 nt, Shigella flexneri 2a str. 2457T
cacuucgucagaaaug

SEQ ID NO: 3842633 - RNA, 19 nt, Shigella flexneri 2a str. 2457T
cacuucguucuguuugcag

SEQ ID NO: 3842634 - RNA, 23 nt, Shigella flexneri 2a str. 2457T
cacuucugaguucggcauggggu

SEQ ID NO: 3842635 - RNA, 16 nt, Shigella flexneri 2a str. 2457T
cacuucuucagccagu

SEQ ID NO: 3842636 - RNA, 19 nt, Shigella flexneri 2a str. 2457T
cacuugcagcucauauucc

SEQ ID NO: 3842637 - RNA, 20 nt, Shigella flexneri 2a str. 2457T
cacuugcaggaacagugccu

SEQ ID NO: 3842638 - RNA, 17 nt, Shigella flexneri 2a str. 2457T
cacuuguucagcgaugu

SEQ ID NO: 3842639 - RNA, 13 nt, Shigella flexneri 2a str. 2457T
cacuuuacccggu

SEQ ID NO: 3842640 - RNA, 11 nt, Shigella flexneri 2a str. 2457T
cacuuuacugg

SEQ ID NO: 3842641 - RNA, 13 nt, Shigella flexneri 2a str. 2457T
cacuuucaaaagc

SEQ ID NO: 3842642 - RNA, 16 nt, Shigella flexneri 2a str. 2457T
cacuuucacggucagc

SEQ ID NO: 3842643 - RNA, 14 nt, Shigella flexneri 2a str. 2457T
cacuuucagcacgu

SEQ ID NO: 3842644 - RNA, 12 nt, Shigella flexneri 2a str. 2457T
cacuuucaguuu

SEQ ID NO: 3842645 - RNA, 15 nt, Shigella flexneri 2a str. 2457T
cacuuuccaguuccg

SEQ ID NO: 3842646 - RNA, 14 nt, Shigella flexneri 2a str. 2457T
cacuuuccccggca

SEQ ID NO: 3842647 - RNA, 12 nt, Shigella flexneri 2a str. 2457T
cacuuucgcggc

SEQ ID NO: 3842648 - RNA, 14 nt, Shigella flexneri 2a str. 2457T
cacuuucuggcagc

SEQ ID NO: 3842649 - RNA, 23 nt, Shigella flexneri 2a str. 2457T
cacuuugccgucagccacuucuu

SEQ ID NO: 3842650 - RNA, 13 nt, Shigella flexneri 2a str. 2457T
cacuuugugucag

SEQ ID NO: 3842651 - RNA, 17 nt, Shigella flexneri 2a str. 2457T
cacuuugugucagcgcc

SEQ ID NO: 3842652 - RNA, 22 nt, Shigella flexneri 2a str. 2457T
cacuuuuauuaacucagcauua

SEQ ID NO: 3842653 - RNA, 15 nt, Shigella flexneri 2a str. 2457T
cacuuuuauuucacc

SEQ ID NO: 3842654 - RNA, 15 nt, Shigella flexneri 2a str. 2457T
cacuuuugccagacg

SEQ ID NO: 3842655 - RNA, 22 nt, Shigella flexneri 2a str. 2457T
cacuuuuuucgcugucggcagu

SEQ ID NO: 3842656 - RNA, 20 nt, Shigella flexneri 2a str. 2457T
cagaaaaaaaguagggcuga

SEQ ID NO: 3842657 - RNA, 13 nt, Shigella flexneri 2a str. 2457T
cagaaaaagagca

SEQ ID NO: 3842658 - RNA, 18 nt, Shigella flexneri 2a str. 2457T
cagaaaacgguugauaua

SEQ ID NO: 3842659 - RNA, 13 nt, Shigella flexneri 2a str. 2457T
cagaaaagaaccu

SEQ ID NO: 3842660 - RNA, 17 nt, Shigella flexneri 2a str. 2457T
cagaaaagagacgcuga

SEQ ID NO: 3842661 - RNA, 23 nt, Shigella flexneri 2a str. 2457T
cagaaaauuacggauuacaugga

SEQ ID NO: 3842662 - RNA, 17 nt, Shigella flexneri 2a str. 2457T
cagaaacaaacgcaaaa

SEQ ID NO: 3842663 - RNA, 17 nt, Shigella flexneri 2a str. 2457T
cagaaacacacuuucca

SEQ ID NO: 3842664 - RNA, 23 nt, Shigella flexneri 2a str. 2457T
cagaaacaguguauuuccugauu

SEQ ID NO: 3842665 - RNA, 18 nt, Shigella flexneri 2a str. 2457T
cagaaacauaauauaaau

SEQ ID NO: 3842666 - RNA, 23 nt, Shigella flexneri 2a str. 2457T
cagaaaccugauuacgcaccggg

SEQ ID NO: 3842667 - RNA, 19 nt, Shigella flexneri 2a str. 2457T
cagaaacgccaucucuuua

SEQ ID NO: 3842668 - RNA, 16 nt, Shigella flexneri 2a str. 2457T
cagaaacuguaauuga

SEQ ID NO: 3842669 - RNA, 20 nt, Shigella flexneri 2a str. 2457T
cagaaagcccgaaucaguaa

SEQ ID NO: 3842670 - RNA, 14 nt, Shigella flexneri 2a str. 2457T
cagaaagcgccagc

SEQ ID NO: 3842671 - RNA, 18 nt, Shigella flexneri 2a str. 2457T
cagaaagcgccagcaaga

SEQ ID NO: 3842672 - RNA, 23 nt, Shigella flexneri 2a str. 2457T
cagaaagcggaucaguuccagca

SEQ ID NO: 3842673 - RNA, 20 nt, Shigella flexneri 2a str. 2457T
cagaaagggggaguuaaccu

SEQ ID NO: 3842674 - RNA, 23 nt, Shigella flexneri 2a str. 2457T
cagacaccagaaugguguuaacc

SEQ ID NO: 3842675 - RNA, 16 nt, Shigella flexneri 2a str. 2457T
cagacaccagccaggu

SEQ ID NO: 3842676 - RNA, 17 nt, Shigella flexneri 2a str. 2457T
cagacaccgauugcccc

SEQ ID NO: 3842677 - RNA, 19 nt, Shigella flexneri 2a str. 2457T
cagacacgccgccagacca

SEQ ID NO: 3842678 - RNA, 13 nt, Shigella flexneri 2a str. 2457T
cagacacugcuga

SEQ ID NO: 3842679 - RNA, 22 nt, Shigella flexneri 2a str. 2457T
cagacaggcgaaacccgcugcc

SEQ ID NO: 3842680 - RNA, 23 nt, Shigella flexneri 2a str. 2457T
cagacaggcgaaacccgcugcca

SEQ ID NO: 3842681 - RNA, 16 nt, Shigella flexneri 2a str. 2457T
cagacaguaauacggu

SEQ ID NO: 3842682 - RNA, 12 nt, Shigella flexneri 2a str. 2457T
cagacaucaagu

SEQ ID NO: 3842683 - RNA, 15 nt, Shigella flexneri 2a str. 2457T
cagacaucaccagua

SEQ ID NO: 3842684 - RNA, 23 nt, Shigella flexneri 2a str. 2457T
cagacauuauaaauucuggccac

SEQ ID NO: 3842685 - RNA, 23 nt, Shigella flexneri 2a str. 2457T
cagaccaaaacgugcagcugccu

SEQ ID NO: 3842686 - RNA, 15 nt, Shigella flexneri 2a str. 2457T
cagaccaaucaccac

SEQ ID NO: 3842687 - RNA, 17 nt, Shigella flexneri 2a str. 2457T
cagaccaaucccgccau

SEQ ID NO: 3842688 - RNA, 18 nt, Shigella flexneri 2a str. 2457T
cagaccaaucccgccaua

SEQ ID NO: 3842689 - RNA, 13 nt, Shigella flexneri 2a str. 2457T
cagaccacuuucc

SEQ ID NO: 3842690 - RNA, 14 nt, Shigella flexneri 2a str. 2457T
cagaccacuuuccu

SEQ ID NO: 3842691 - RNA, 21 nt, Shigella flexneri 2a str. 2457T
cagaccagaaugcuccgcacc

SEQ ID NO: 3842692 - RNA, 13 nt, Shigella flexneri 2a str. 2457T
cagaccagcaccg

SEQ ID NO: 3842693 - RNA, 14 nt, Shigella flexneri 2a str. 2457T
cagaccagcaccgg

SEQ ID NO: 3842694 - RNA, 17 nt, Shigella flexneri 2a str. 2457T
cagaccagcuaccacgc

SEQ ID NO: 3842695 - RNA, 19 nt, Shigella flexneri 2a str. 2457T
cagaccagcuaccacgccg

SEQ ID NO: 3842696 - RNA, 16 nt, Shigella flexneri 2a str. 2457T
cagaccauuccucuuc

SEQ ID NO: 3842697 - RNA, 21 nt, Shigella flexneri 2a str. 2457T
cagacccagguagacaccaag

SEQ ID NO: 3842698 - RNA, 11 nt, Shigella flexneri 2a str. 2457T
cagacccaguu

SEQ ID NO: 3842699 - RNA, 18 nt, Shigella flexneri 2a str. 2457T
cagacccuucaucgcucc

SEQ ID NO: 3842700 - RNA, 20 nt, Shigella flexneri 2a str. 2457T
cagaccgacuacccgcgcac

SEQ ID NO: 3842701 - RNA, 17 nt, Shigella flexneri 2a str. 2457T
cagaccgcucagcuccu

SEQ ID NO: 3842702 - RNA, 21 nt, Shigella flexneri 2a str. 2457T
cagaccggcaaucgcgccaga

SEQ ID NO: 3842703 - RNA, 20 nt, Shigella flexneri 2a str. 2457T
cagaccuacaaaaccugcac

SEQ ID NO: 3842704 - RNA, 18 nt, Shigella flexneri 2a str. 2457T
cagaccuccguuuuucug

SEQ ID NO: 3842705 - RNA, 12 nt, Shigella flexneri 2a str. 2457T
cagaccugaauu

SEQ ID NO: 3842706 - RNA, 17 nt, Shigella flexneri 2a str. 2457T
cagaccugaauuugcuc

SEQ ID NO: 3842707 - RNA, 20 nt, Shigella flexneri 2a str. 2457T
cagaccugaauuugcuccag

SEQ ID NO: 3842708 - RNA, 16 nt, Shigella flexneri 2a str. 2457T
cagaccugcgucacca

SEQ ID NO: 3842709 - RNA, 17 nt, Shigella flexneri 2a str. 2457T
cagaccugcguucagca

SEQ ID NO: 3842710 - RNA, 23 nt, Shigella flexneri 2a str. 2457T
cagaccuucauagguaaacauca

SEQ ID NO: 3842711 - RNA, 15 nt, Shigella flexneri 2a str. 2457T
cagaccuucugccag

SEQ ID NO: 3842712 - RNA, 23 nt, Shigella flexneri 2a str. 2457T
cagaccuuucgaacccaacccua

SEQ ID NO: 3842713 - RNA, 19 nt, Shigella flexneri 2a str. 2457T
cagacgaauaaaacagaaa

SEQ ID NO: 3842714 - RNA, 18 nt, Shigella flexneri 2a str. 2457T
cagacgagggaaaauaaa

SEQ ID NO: 3842715 - RNA, 22 nt, Shigella flexneri 2a str. 2457T
cagacgcaaaguagcggccuga

SEQ ID NO: 3842716 - RNA, 14 nt, Shigella flexneri 2a str. 2457T
cagacgcaacagaa

SEQ ID NO: 3842717 - RNA, 16 nt, Shigella flexneri 2a str. 2457T
cagacgcaggcgcgcu

SEQ ID NO: 3842718 - RNA, 17 nt, Shigella flexneri 2a str. 2457T
cagacgccagccacagg

SEQ ID NO: 3842719 - RNA, 16 nt, Shigella flexneri 2a str. 2457T
cagacgcgcagcuuca

SEQ ID NO: 3842720 - RNA, 23 nt, Shigella flexneri 2a str. 2457T
cagacgcgcagcuucacuucuua

SEQ ID NO: 3842721 - RNA, 22 nt, Shigella flexneri 2a str. 2457T
cagacgcuacuuuuuucaccca

SEQ ID NO: 3842722 - RNA, 15 nt, Shigella flexneri 2a str. 2457T
cagacgcucgccauu

SEQ ID NO: 3842723 - RNA, 19 nt, Shigella flexneri 2a str. 2457T
cagacgcucgccauuuuuc

SEQ ID NO: 3842724 - RNA, 13 nt, Shigella flexneri 2a str. 2457T
cagacgcucuuca

SEQ ID NO: 3842725 - RNA, 21 nt, Shigella flexneri 2a str. 2457T
cagacgcugaaucaacaggcg

SEQ ID NO: 3842726 - RNA, 22 nt, Shigella flexneri 2a str. 2457T
cagacgcuuacguuuacgcauc

SEQ ID NO: 3842727 - RNA, 20 nt, Shigella flexneri 2a str. 2457T
cagacggaacaucugcccca

SEQ ID NO: 3842728 - RNA, 15 nt, Shigella flexneri 2a str. 2457T
cagacggcguaaucg

SEQ ID NO: 3842729 - RNA, 17 nt, Shigella flexneri 2a str. 2457T
cagacggcucaucaccc

SEQ ID NO: 3842730 - RNA, 15 nt, Shigella flexneri 2a str. 2457T
cagacggcucaucuc

SEQ ID NO: 3842731 - RNA, 17 nt, Shigella flexneri 2a str. 2457T
cagacggcugucuuccu

SEQ ID NO: 3842732 - RNA, 20 nt, Shigella flexneri 2a str. 2457T
cagacgguaaccccucuuca

SEQ ID NO: 3842733 - RNA, 16 nt, Shigella flexneri 2a str. 2457T
cagacgguacccgcug

SEQ ID NO: 3842734 - RNA, 23 nt, Shigella flexneri 2a str. 2457T
cagacguguugucagcucaucca

SEQ ID NO: 3842735 - RNA, 15 nt, Shigella flexneri 2a str. 2457T
cagacguucuuccug

SEQ ID NO: 3842736 - RNA, 13 nt, Shigella flexneri 2a str. 2457T
cagacguuuuuuc

SEQ ID NO: 3842737 - RNA, 15 nt, Shigella flexneri 2a str. 2457T
cagacguuuuuucug

SEQ ID NO: 3842738 - RNA, 22 nt, Shigella flexneri 2a str. 2457T
cagacuaauuuuucccucuuca

SEQ ID NO: 3842739 - RNA, 14 nt, Shigella flexneri 2a str. 2457T
cagacucaaaccaa

SEQ ID NO: 3842740 - RNA, 13 nt, Shigella flexneri 2a str. 2457T
cagacucaacagg

SEQ ID NO: 3842741 - RNA, 21 nt, Shigella flexneri 2a str. 2457T
cagacucauauaaaaaccggu

SEQ ID NO: 3842742 - RNA, 23 nt, Shigella flexneri 2a str. 2457T
cagacucuuuuucgaaccacaaa

SEQ ID NO: 3842743 - RNA, 16 nt, Shigella flexneri 2a str. 2457T
cagacugaauacgcuc

SEQ ID NO: 3842744 - RNA, 21 nt, Shigella flexneri 2a str. 2457T
cagacugaucaucgcccaguu

SEQ ID NO: 3842745 - RNA, 15 nt, Shigella flexneri 2a str. 2457T
cagacugaugugauc

SEQ ID NO: 3842746 - RNA, 15 nt, Shigella flexneri 2a str. 2457T
cagacuggagcacug

SEQ ID NO: 3842747 - RNA, 15 nt, Shigella flexneri 2a str. 2457T
cagacuugacgccuu

SEQ ID NO: 3842748 - RNA, 20 nt, Shigella flexneri 2a str. 2457T
cagacuugacgccuuuaccg

SEQ ID NO: 3842749 - RNA, 21 nt, Shigella flexneri 2a str. 2457T
cagacuugacgccuuuaccgc

SEQ ID NO: 3842750 - RNA, 18 nt, Shigella flexneri 2a str. 2457T
cagacuuuuugcggcagc

SEQ ID NO: 3842751 - RNA, 22 nt, Shigella flexneri 2a str. 2457T
cagacuuuuugcggcagcaaug

SEQ ID NO: 3842752 - RNA, 16 nt, Shigella flexneri 2a str. 2457T
cagagaaaccacauca

SEQ ID NO: 3842753 - RNA, 15 nt, Shigella flexneri 2a str. 2457T
cagagaaacgccagc

SEQ ID NO: 3842754 - RNA, 20 nt, Shigella flexneri 2a str. 2457T
cagagaaacgccagcagcag

SEQ ID NO: 3842755 - RNA, 13 nt, Shigella flexneri 2a str. 2457T
cagagaaagcaaa

SEQ ID NO: 3842756 - RNA, 21 nt, Shigella flexneri 2a str. 2457T
cagagaacgugguauggaguu

SEQ ID NO: 3842757 - RNA, 18 nt, Shigella flexneri 2a str. 2457T
cagagaacuggcggcaaa

SEQ ID NO: 3842758 - RNA, 19 nt, Shigella flexneri 2a str. 2457T
cagagaacuguagacaaaa

SEQ ID NO: 3842759 - RNA, 15 nt, Shigella flexneri 2a str. 2457T
cagagaagaacaccg

SEQ ID NO: 3842760 - RNA, 18 nt, Shigella flexneri 2a str. 2457T
cagagacgcacugcuuga

SEQ ID NO: 3842761 - RNA, 22 nt, Shigella flexneri 2a str. 2457T
cagagacgcacugcuugaagcg

SEQ ID NO: 3842762 - RNA, 22 nt, Shigella flexneri 2a str. 2457T
cagagagccagccccacagcag

SEQ ID NO: 3842763 - RNA, 14 nt, Shigella flexneri 2a str. 2457T
cagagagcgaauau

SEQ ID NO: 3842764 - RNA, 18 nt, Shigella flexneri 2a str. 2457T
cagagagcuuauccagca

SEQ ID NO: 3842765 - RNA, 15 nt, Shigella flexneri 2a str. 2457T
cagagauagaacugc

SEQ ID NO: 3842766 - RNA, 19 nt, Shigella flexneri 2a str. 2457T
cagagauagaacugcauug

SEQ ID NO: 3842767 - RNA, 19 nt, Shigella flexneri 2a str. 2457T
cagagaucagauaauauuu

SEQ ID NO: 3842768 - RNA, 22 nt, Shigella flexneri 2a str. 2457T
cagagauggccgguuuguuauc

SEQ ID NO: 3842769 - RNA, 13 nt, Shigella flexneri 2a str. 2457T
cagagauucuuuu

SEQ ID NO: 3842770 - RNA, 18 nt, Shigella flexneri 2a str. 2457T
cagagauuugcuccagcg

SEQ ID NO: 3842771 - RNA, 23 nt, Shigella flexneri 2a str. 2457T
cagauguugucucagauucagau

SEQ ID NO: 3842772 - RNA, 21 nt, Shigella flexneri 2a str. 2457T
cagauuauaagccaguaagac

SEQ ID NO: 3842773 - RNA, 16 nt, Shigella flexneri 2a str. 2457T
cagauucagccacauu

SEQ ID NO: 3842774 - RNA, 17 nt, Shigella flexneri 2a str. 2457T
cagauucggguucaugu

SEQ ID NO: 3842775 - RNA, 15 nt, Shigella flexneri 2a str. 2457T
cagauugauaaaaau

SEQ ID NO: 3842776 - RNA, 14 nt, Shigella flexneri 2a str. 2457T
cagauugccacagg

SEQ ID NO: 3842777 - RNA, 20 nt, Shigella flexneri 2a str. 2457T
cagauugccgugaaccugcg

SEQ ID NO: 3842778 - RNA, 21 nt, Shigella flexneri 2a str. 2457T
cagauuguugauuaacaggcu

SEQ ID NO: 3842779 - RNA, 22 nt, Shigella flexneri 2a str. 2457T
cagauuguugauuaacaggcug

SEQ ID NO: 3842780 - RNA, 16 nt, Shigella flexneri 2a str. 2457T
cagauuuauaaaagaa

SEQ ID NO: 3842781 - RNA, 17 nt, Shigella flexneri 2a str. 2457T
cagauuuauaaaagaaa

SEQ ID NO: 3842782 - RNA, 23 nt, Shigella flexneri 2a str. 2457T
cagauuuauuuacuucugcugca

SEQ ID NO: 3842783 - RNA, 18 nt, Shigella flexneri 2a str. 2457T
cagauuugccaguaccga

SEQ ID NO: 3842784 - RNA, 21 nt, Shigella flexneri 2a str. 2457T
cagauuuuaagguugauacga

SEQ ID NO: 3842785 - RNA, 16 nt, Shigella flexneri 2a str. 2457T
cagauuuugccagcau

SEQ ID NO: 3842786 - RNA, 22 nt, Shigella flexneri 2a str. 2457T
cagcaaaaauuugcgcgaugcc

SEQ ID NO: 3842787 - RNA, 15 nt, Shigella flexneri 2a str. 2457T
cagcaaaacacccgc

SEQ ID NO: 3842788 - RNA, 15 nt, Shigella flexneri 2a str. 2457T
cagcaaaaucaccau

SEQ ID NO: 3842789 - RNA, 16 nt, Shigella flexneri 2a str. 2457T
cagcaaaaucaccauc

SEQ ID NO: 3842790 - RNA, 15 nt, Shigella flexneri 2a str. 2457T
cagcaaaaugcauaa

SEQ ID NO: 3842791 - RNA, 16 nt, Shigella flexneri 2a str. 2457T
cagcaaacuaucccag

SEQ ID NO: 3842792 - RNA, 18 nt, Shigella flexneri 2a str. 2457T
cagcaaacuaucccagcc

SEQ ID NO: 3842793 - RNA, 14 nt, Shigella flexneri 2a str. 2457T
cagcaaagcaaauu

SEQ ID NO: 3842794 - RNA, 20 nt, Shigella flexneri 2a str. 2457T
cagcaaagcgugcaaauaua

SEQ ID NO: 3842795 - RNA, 11 nt, Shigella flexneri 2a str. 2457T
cagcaaaggaa

SEQ ID NO: 3842796 - RNA, 22 nt, Shigella flexneri 2a str. 2457T
cagcaaaucacccugugcgcca

SEQ ID NO: 3842797 - RNA, 16 nt, Shigella flexneri 2a str. 2457T
cagcaaauccacaacg

SEQ ID NO: 3842798 - RNA, 17 nt, Shigella flexneri 2a str. 2457T
cagcaaauccaucauau

SEQ ID NO: 3842799 - RNA, 21 nt, Shigella flexneri 2a str. 2457T
cagcaaauggcccauuuucuc

SEQ ID NO: 3842800 - RNA, 22 nt, Shigella flexneri 2a str. 2457T
cagcaacaaauaaccgccugau

SEQ ID NO: 3842801 - RNA, 19 nt, Shigella flexneri 2a str. 2457T
cagcaacaagcccaccguu

SEQ ID NO: 3842802 - RNA, 11 nt, Shigella flexneri 2a str. 2457T
cagcaacauag

SEQ ID NO: 3842803 - RNA, 10 nt, Shigella flexneri 2a str. 2457T
cagcaaccaa

SEQ ID NO: 3842804 - RNA, 13 nt, Shigella flexneri 2a str. 2457T
cagcaaccaggua

SEQ ID NO: 3842805 - RNA, 16 nt, Shigella flexneri 2a str. 2457T
cagcaaccgcuuccgg

SEQ ID NO: 3842806 - RNA, 17 nt, Shigella flexneri 2a str. 2457T
cagcaaccggaggucag

SEQ ID NO: 3842807 - RNA, 23 nt, Shigella flexneri 2a str. 2457T
cagcaaccugcuuaauaucccuu

SEQ ID NO: 3842808 - RNA, 23 nt, Shigella flexneri 2a str. 2457T
cagcaacgcuucaaccaacgcac

SEQ ID NO: 3842809 - RNA, 17 nt, Shigella flexneri 2a str. 2457T
cagcaacucugguggac

SEQ ID NO: 3842810 - RNA, 23 nt, Shigella flexneri 2a str. 2457T
cagcaacugauggcccaucguca

SEQ ID NO: 3842811 - RNA, 20 nt, Shigella flexneri 2a str. 2457T
cagcaacuguaguuguuaau

SEQ ID NO: 3842812 - RNA, 16 nt, Shigella flexneri 2a str. 2457T
cagcaacuuaaucauc

SEQ ID NO: 3842813 - RNA, 12 nt, Shigella flexneri 2a str. 2457T
cagcaagaacca

SEQ ID NO: 3842814 - RNA, 20 nt, Shigella flexneri 2a str. 2457T
cagcaagaccgcgaccaccg

SEQ ID NO: 3842815 - RNA, 17 nt, Shigella flexneri 2a str. 2457T
cagcaagagcaaauaaa

SEQ ID NO: 3842816 - RNA, 12 nt, Shigella flexneri 2a str. 2457T
cagcaagccacu

SEQ ID NO: 3842817 - RNA, 16 nt, Shigella flexneri 2a str. 2457T
cagcaagccacuggcg

SEQ ID NO: 3842818 - RNA, 21 nt, Shigella flexneri 2a str. 2457T
cagcaagccacuggcgcgaau

SEQ ID NO: 3842819 - RNA, 16 nt, Shigella flexneri 2a str. 2457T
cagcaagcgauaauuu

SEQ ID NO: 3842820 - RNA, 18 nt, Shigella flexneri 2a str. 2457T
cagcaaggguucaccggu

SEQ ID NO: 3842821 - RNA, 16 nt, Shigella flexneri 2a str. 2457T
cagcaauaaucagaug

SEQ ID NO: 3842822 - RNA, 13 nt, Shigella flexneri 2a str. 2457T
cagcaaucacugc

SEQ ID NO: 3842823 - RNA, 15 nt, Shigella flexneri 2a str. 2457T
cagcaaucccaaaau

SEQ ID NO: 3842824 - RNA, 13 nt, Shigella flexneri 2a str. 2457T
cagcaauccccag

SEQ ID NO: 3842825 - RNA, 15 nt, Shigella flexneri 2a str. 2457T
cagcaauccccagac

SEQ ID NO: 3842826 - RNA, 18 nt, Shigella flexneri 2a str. 2457T
cagcaaucucuucaagcu

SEQ ID NO: 3842827 - RNA, 15 nt, Shigella flexneri 2a str. 2457T
cagcaauggaaaaag

SEQ ID NO: 3842828 - RNA, 16 nt, Shigella flexneri 2a str. 2457T
cagcaauguuucucug

SEQ ID NO: 3842829 - RNA, 18 nt, Shigella flexneri 2a str. 2457T
cagcaauugucgcagaag

SEQ ID NO: 3842830 - RNA, 13 nt, Shigella flexneri 2a str. 2457T
cagcaauuuacgc

SEQ ID NO: 3842831 - RNA, 23 nt, Shigella flexneri 2a str. 2457T
cagcaauuuacgcuuuucuuccg

SEQ ID NO: 3842832 - RNA, 15 nt, Shigella flexneri 2a str. 2457T
cagcacaaugccggu

SEQ ID NO: 3842833 - RNA, 21 nt, Shigella flexneri 2a str. 2457T
cagcacaccacaucgccgacc

SEQ ID NO: 3842834 - RNA, 22 nt, Shigella flexneri 2a str. 2457T
cagcacaccacaucgccgaccg

SEQ ID NO: 3842835 - RNA, 15 nt, Shigella flexneri 2a str. 2457T
cagcacacuguaagc

SEQ ID NO: 3842836 - RNA, 22 nt, Shigella flexneri 2a str. 2457T
cagcacauaagucagcccguga

SEQ ID NO: 3842837 - RNA, 15 nt, Shigella flexneri 2a str. 2457T
cagcacaucagccag

SEQ ID NO: 3842838 - RNA, 15 nt, Shigella flexneri 2a str. 2457T
cagcacaucaucaaa

SEQ ID NO: 3842839 - RNA, 16 nt, Shigella flexneri 2a str. 2457T
cagcaccaccgcccgu

SEQ ID NO: 3842840 - RNA, 13 nt, Shigella flexneri 2a str. 2457T
cagcaccacuucc

SEQ ID NO: 3842841 - RNA, 19 nt, Shigella flexneri 2a str. 2457T
cagcaccacuuccggcaac

SEQ ID NO: 3842842 - RNA, 12 nt, Shigella flexneri 2a str. 2457T
cagcaccagaga

SEQ ID NO: 3842843 - RNA, 17 nt, Shigella flexneri 2a str. 2457T
cagcaccagagaacuga

SEQ ID NO: 3842844 - RNA, 14 nt, Shigella flexneri 2a str. 2457T
cagcaccagcuccg

SEQ ID NO: 3842845 - RNA, 18 nt, Shigella flexneri 2a str. 2457T
cagcaccagcuccggcac

SEQ ID NO: 3842846 - RNA, 17 nt, Shigella flexneri 2a str. 2457T
cagcaccaucccgcuaa

SEQ ID NO: 3842847 - RNA, 21 nt, Shigella flexneri 2a str. 2457T
cagcaccgcacagaccaucaa

SEQ ID NO: 3842848 - RNA, 14 nt, Shigella flexneri 2a str. 2457T
cagcaccgcagaga

SEQ ID NO: 3842849 - RNA, 15 nt, Shigella flexneri 2a str. 2457T
cagcaccgcagagau

SEQ ID NO: 3842850 - RNA, 17 nt, Shigella flexneri 2a str. 2457T
cagcaccgcgacaauca

SEQ ID NO: 3842851 - RNA, 18 nt, Shigella flexneri 2a str. 2457T
cagcaccgcgacaaucag

SEQ ID NO: 3842852 - RNA, 16 nt, Shigella flexneri 2a str. 2457T
cagcaccguaccggca

SEQ ID NO: 3842853 - RNA, 14 nt, Shigella flexneri 2a str. 2457T
cagcaccgucaaac

SEQ ID NO: 3842854 - RNA, 15 nt, Shigella flexneri 2a str. 2457T
cagcaccugcuugaa

SEQ ID NO: 3842855 - RNA, 19 nt, Shigella flexneri 2a str. 2457T
cagcaccuuaugcgggcca

SEQ ID NO: 3842856 - RNA, 17 nt, Shigella flexneri 2a str. 2457T
cagcacgacuauuauga

SEQ ID NO: 3842857 - RNA, 15 nt, Shigella flexneri 2a str. 2457T
cagcacgcauucgaa

SEQ ID NO: 3842858 - RNA, 14 nt, Shigella flexneri 2a str. 2457T
cagcacgccccggc

SEQ ID NO: 3842859 - RNA, 15 nt, Shigella flexneri 2a str. 2457T
cagcacgccccggcg

SEQ ID NO: 3842860 - RNA, 14 nt, Shigella flexneri 2a str. 2457T
cagcacgcugaagg

SEQ ID NO: 3842861 - RNA, 23 nt, Shigella flexneri 2a str. 2457T
cagcacgcuuuucagugccaggu

SEQ ID NO: 3842862 - RNA, 13 nt, Shigella flexneri 2a str. 2457T
cagcacggagaga

SEQ ID NO: 3842863 - RNA, 14 nt, Shigella flexneri 2a str. 2457T
cagcacggagagac

SEQ ID NO: 3842864 - RNA, 20 nt, Shigella flexneri 2a str. 2457T
cagcacggagagacguugcg

SEQ ID NO: 3842865 - RNA, 13 nt, Shigella flexneri 2a str. 2457T
cagcacggucagg

SEQ ID NO: 3842866 - RNA, 22 nt, Shigella flexneri 2a str. 2457T
cagcacggugaagaagcggaaa

SEQ ID NO: 3842867 - RNA, 20 nt, Shigella flexneri 2a str. 2457T
cagcacguuuaacacgcucu

SEQ ID NO: 3842868 - RNA, 16 nt, Shigella flexneri 2a str. 2457T
cagcacuacaccccag

SEQ ID NO: 3842869 - RNA, 21 nt, Shigella flexneri 2a str. 2457T
cagcauucgccgcauugucua

SEQ ID NO: 3842870 - RNA, 17 nt, Shigella flexneri 2a str. 2457T
cagcauucucaucacca

SEQ ID NO: 3842871 - RNA, 19 nt, Shigella flexneri 2a str. 2457T
cagcauucucaucaccauu

SEQ ID NO: 3842872 - RNA, 15 nt, Shigella flexneri 2a str. 2457T
cagcauucucggccc

SEQ ID NO: 3842873 - RNA, 21 nt, Shigella flexneri 2a str. 2457T
cagcauugcucaccgccagca

SEQ ID NO: 3842874 - RNA, 22 nt, Shigella flexneri 2a str. 2457T
cagcauuucuggugucacagug

SEQ ID NO: 3842875 - RNA, 14 nt, Shigella flexneri 2a str. 2457T
cagcauuucuucca

SEQ ID NO: 3842876 - RNA, 19 nt, Shigella flexneri 2a str. 2457T
cagcauuucuuccagcguu

SEQ ID NO: 3842877 - RNA, 14 nt, Shigella flexneri 2a str. 2457T
cagccaaaaaugac

SEQ ID NO: 3842878 - RNA, 15 nt, Shigella flexneri 2a str. 2457T
cagccaaauccagcg

SEQ ID NO: 3842879 - RNA, 15 nt, Shigella flexneri 2a str. 2457T
cagccaaccacauga

SEQ ID NO: 3842880 - RNA, 19 nt, Shigella flexneri 2a str. 2457T
cagccaacuggagaacgcg

SEQ ID NO: 3842881 - RNA, 17 nt, Shigella flexneri 2a str. 2457T
cagccaaugcaggcauc

SEQ ID NO: 3842882 - RNA, 15 nt, Shigella flexneri 2a str. 2457T
cagccacaccaauca

SEQ ID NO: 3842883 - RNA, 12 nt, Shigella flexneri 2a str. 2457T
cagccacagggu

SEQ ID NO: 3842884 - RNA, 20 nt, Shigella flexneri 2a str. 2457T
cagccacagggugaucacca

SEQ ID NO: 3842885 - RNA, 20 nt, Shigella flexneri 2a str. 2457T
cagccacauuugcggcgaac

SEQ ID NO: 3842886 - RNA, 18 nt, Shigella flexneri 2a str. 2457T
cagccaccagguucaaca

SEQ ID NO: 3842887 - RNA, 22 nt, Shigella flexneri 2a str. 2457T
cagccaccgcguuccacgggga

SEQ ID NO: 3842888 - RNA, 22 nt, Shigella flexneri 2a str. 2457T
cagccacgcgaaugugcguuuu

SEQ ID NO: 3842889 - RNA, 16 nt, Shigella flexneri 2a str. 2457T
cagccacggcuccagc

SEQ ID NO: 3842890 - RNA, 17 nt, Shigella flexneri 2a str. 2457T
cagccacggcuccagca

SEQ ID NO: 3842891 - RNA, 12 nt, Shigella flexneri 2a str. 2457T
cagccacugcgg

SEQ ID NO: 3842892 - RNA, 12 nt, Shigella flexneri 2a str. 2457T
cagccacuuccu

SEQ ID NO: 3842893 - RNA, 17 nt, Shigella flexneri 2a str. 2457T
cagccagaaagaaccgu

SEQ ID NO: 3842894 - RNA, 16 nt, Shigella flexneri 2a str. 2457T
cagccagaaugucccc

SEQ ID NO: 3842895 - RNA, 16 nt, Shigella flexneri 2a str. 2457T
cagccagaauuacccc

SEQ ID NO: 3842896 - RNA, 23 nt, Shigella flexneri 2a str. 2457T
cagccagacgccagccacaggcu

SEQ ID NO: 3842897 - RNA, 16 nt, Shigella flexneri 2a str. 2457T
cagccagagccaccaa

SEQ ID NO: 3842898 - RNA, 17 nt, Shigella flexneri 2a str. 2457T
cagccagcaccaggcuu

SEQ ID NO: 3842899 - RNA, 12 nt, Shigella flexneri 2a str. 2457T
cagccagcacug

SEQ ID NO: 3842900 - RNA, 15 nt, Shigella flexneri 2a str. 2457T
cagccagcacugccg

SEQ ID NO: 3842901 - RNA, 12 nt, Shigella flexneri 2a str. 2457T
cagccagcagcg

SEQ ID NO: 3842902 - RNA, 14 nt, Shigella flexneri 2a str. 2457T
cagccagcagcgaa

SEQ ID NO: 3842903 - RNA, 20 nt, Shigella flexneri 2a str. 2457T
cagccagccgaacagcgcca

SEQ ID NO: 3842904 - RNA, 22 nt, Shigella flexneri 2a str. 2457T
cagccagccgaacagcgccaga

SEQ ID NO: 3842905 - RNA, 14 nt, Shigella flexneri 2a str. 2457T
cagccagcgcgccu

SEQ ID NO: 3842906 - RNA, 13 nt, Shigella flexneri 2a str. 2457T
cagccagcgcuga

SEQ ID NO: 3842907 - RNA, 22 nt, Shigella flexneri 2a str. 2457T
cagccaguauugccaugcacgc

SEQ ID NO: 3842908 - RNA, 17 nt, Shigella flexneri 2a str. 2457T
cagccagugauuaacgc

SEQ ID NO: 3842909 - RNA, 19 nt, Shigella flexneri 2a str. 2457T
cagccaguucgagaaaaau

SEQ ID NO: 3842910 - RNA, 21 nt, Shigella flexneri 2a str. 2457T
cagccaguuuacccagcgaau

SEQ ID NO: 3842911 - RNA, 19 nt, Shigella flexneri 2a str. 2457T
cagccaguuuuucagcgcc

SEQ ID NO: 3842912 - RNA, 20 nt, Shigella flexneri 2a str. 2457T
cagccauaaagaaaucaccu

SEQ ID NO: 3842913 - RNA, 23 nt, Shigella flexneri 2a str. 2457T
cagccauaaagaaaucaccugcc

SEQ ID NO: 3842914 - RNA, 18 nt, Shigella flexneri 2a str. 2457T
cagccauacguugcauaa

SEQ ID NO: 3842915 - RNA, 15 nt, Shigella flexneri 2a str. 2457T
cagccaucaccacgc

SEQ ID NO: 3842916 - RNA, 14 nt, Shigella flexneri 2a str. 2457T
cagccaucauccau

SEQ ID NO: 3842917 - RNA, 19 nt, Shigella flexneri 2a str. 2457T
cagccaucuguuccggcgu

SEQ ID NO: 3842918 - RNA, 17 nt, Shigella flexneri 2a str. 2457T
cagccauuaaccagcca

SEQ ID NO: 3842919 - RNA, 14 nt, Shigella flexneri 2a str. 2457T
cagccauucaaucu

SEQ ID NO: 3842920 - RNA, 13 nt, Shigella flexneri 2a str. 2457T
cagccauuuugca

SEQ ID NO: 3842921 - RNA, 22 nt, Shigella flexneri 2a str. 2457T
cagccauuuugcacauuccaga

SEQ ID NO: 3842922 - RNA, 15 nt, Shigella flexneri 2a str. 2457T
cagcccaaagcagag

SEQ ID NO: 3842923 - RNA, 13 nt, Shigella flexneri 2a str. 2457T
cagcccaaccacg

SEQ ID NO: 3842924 - RNA, 13 nt, Shigella flexneri 2a str. 2457T
cagcccaauaccu

SEQ ID NO: 3842925 - RNA, 22 nt, Shigella flexneri 2a str. 2457T
cagcccaaucaucgcggcacac

SEQ ID NO: 3842926 - RNA, 14 nt, Shigella flexneri 2a str. 2457T
cagcccagacaaau

SEQ ID NO: 3842927 - RNA, 22 nt, Shigella flexneri 2a str. 2457T
cagcccauuggcgagauaucga

SEQ ID NO: 3842928 - RNA, 13 nt, Shigella flexneri 2a str. 2457T
cagccccacagca

SEQ ID NO: 3842929 - RNA, 16 nt, Shigella flexneri 2a str. 2457T
cagccccaucaacgcc

SEQ ID NO: 3842930 - RNA, 16 nt, Shigella flexneri 2a str. 2457T
cagccccugcgccagc

SEQ ID NO: 3842931 - RNA, 17 nt, Shigella flexneri 2a str. 2457T
cagccccugcgccagcg

SEQ ID NO: 3842932 - RNA, 18 nt, Shigella flexneri 2a str. 2457T
cagcccgaucggcuggca

SEQ ID NO: 3842933 - RNA, 14 nt, Shigella flexneri 2a str. 2457T
cagcccgccgccau

SEQ ID NO: 3842934 - RNA, 18 nt, Shigella flexneri 2a str. 2457T
cagcccggcauguuucaa

SEQ ID NO: 3842935 - RNA, 20 nt, Shigella flexneri 2a str. 2457T
cagcccgucucagcgccgcu

SEQ ID NO: 3842936 - RNA, 14 nt, Shigella flexneri 2a str. 2457T
cagcccuucuuuca

SEQ ID NO: 3842937 - RNA, 16 nt, Shigella flexneri 2a str. 2457T
cagccgaacagcgcca

SEQ ID NO: 3842938 - RNA, 19 nt, Shigella flexneri 2a str. 2457T
cagccgaagggaaagagcg

SEQ ID NO: 3842939 - RNA, 17 nt, Shigella flexneri 2a str. 2457T
cagccgacaaugccaca

SEQ ID NO: 3842940 - RNA, 20 nt, Shigella flexneri 2a str. 2457T
cagccgacaaugccacaaac

SEQ ID NO: 3842941 - RNA, 22 nt, Shigella flexneri 2a str. 2457T
cagccgaguagaucaacacauc

SEQ ID NO: 3842942 - RNA, 20 nt, Shigella flexneri 2a str. 2457T
cagccgcaaaccuggcaaca

SEQ ID NO: 3842943 - RNA, 15 nt, Shigella flexneri 2a str. 2457T
cagccgcacaccugc

SEQ ID NO: 3842944 - RNA, 16 nt, Shigella flexneri 2a str. 2457T
cagccgcacuuuuuaa

SEQ ID NO: 3842945 - RNA, 13 nt, Shigella flexneri 2a str. 2457T
cagccgccagaaa

SEQ ID NO: 3842946 - RNA, 22 nt, Shigella flexneri 2a str. 2457T
cagccgccagggcaagcgccua

SEQ ID NO: 3842947 - RNA, 16 nt, Shigella flexneri 2a str. 2457T
cagccgccgcuccuca

SEQ ID NO: 3842948 - RNA, 13 nt, Shigella flexneri 2a str. 2457T
cagccgcgucuga

SEQ ID NO: 3842949 - RNA, 14 nt, Shigella flexneri 2a str. 2457T
cagccggaauaauc

SEQ ID NO: 3842950 - RNA, 15 nt, Shigella flexneri 2a str. 2457T
cagccggacccacac

SEQ ID NO: 3842951 - RNA, 21 nt, Shigella flexneri 2a str. 2457T
cagccggacccacacccccgc

SEQ ID NO: 3842952 - RNA, 13 nt, Shigella flexneri 2a str. 2457T
cagccggcaaagu

SEQ ID NO: 3842953 - RNA, 22 nt, Shigella flexneri 2a str. 2457T
cagccggguaagaaaagcugca

SEQ ID NO: 3842954 - RNA, 17 nt, Shigella flexneri 2a str. 2457T
cagccgguauccagcgc

SEQ ID NO: 3842955 - RNA, 13 nt, Shigella flexneri 2a str. 2457T
cagccgugcccaa

SEQ ID NO: 3842956 - RNA, 22 nt, Shigella flexneri 2a str. 2457T
cagccuaagccauuuaacucac

SEQ ID NO: 3842957 - RNA, 15 nt, Shigella flexneri 2a str. 2457T
cagccuacaaaaacu

SEQ ID NO: 3842958 - RNA, 17 nt, Shigella flexneri 2a str. 2457T
cagccuacaaaaacuca

SEQ ID NO: 3842959 - RNA, 21 nt, Shigella flexneri 2a str. 2457T
cagccuacaaaaacucauaaa

SEQ ID NO: 3842960 - RNA, 20 nt, Shigella flexneri 2a str. 2457T
cagccuaccagaccgcacac

SEQ ID NO: 3842961 - RNA, 19 nt, Shigella flexneri 2a str. 2457T
cagccuauaacgaaacccg

SEQ ID NO: 3842962 - RNA, 19 nt, Shigella flexneri 2a str. 2457T
cagccuauuucgucgcuaa

SEQ ID NO: 3842963 - RNA, 20 nt, Shigella flexneri 2a str. 2457T
cagccucaagcacccgccgc

SEQ ID NO: 3842964 - RNA, 15 nt, Shigella flexneri 2a str. 2457T
cagccucccauuucc

SEQ ID NO: 3842965 - RNA, 12 nt, Shigella flexneri 2a str. 2457T
cagccucugccg

SEQ ID NO: 3842966 - RNA, 13 nt, Shigella flexneri 2a str. 2457T
cagccucugccgc

SEQ ID NO: 3842967 - RNA, 17 nt, Shigella flexneri 2a str. 2457T
cagcgcggcgaacuuaa

SEQ ID NO: 3842968 - RNA, 13 nt, Shigella flexneri 2a str. 2457T
cagcgcggcgaag

SEQ ID NO: 3842969 - RNA, 18 nt, Shigella flexneri 2a str. 2457T
cagcgcggugacgcacag

SEQ ID NO: 3842970 - RNA, 19 nt, Shigella flexneri 2a str. 2457T
cagcgcggugauaaccguu

SEQ ID NO: 3842971 - RNA, 16 nt, Shigella flexneri 2a str. 2457T
cagcgcgucgucaauc

SEQ ID NO: 3842972 - RNA, 13 nt, Shigella flexneri 2a str. 2457T
cagcgcuaaccgc

SEQ ID NO: 3842973 - RNA, 17 nt, Shigella flexneri 2a str. 2457T
cagcgcuaaccgccuga

SEQ ID NO: 3842974 - RNA, 15 nt, Shigella flexneri 2a str. 2457T
cagcgcuaauacgau

SEQ ID NO: 3842975 - RNA, 22 nt, Shigella flexneri 2a str. 2457T
cagcgcugaguaauccuucccc

SEQ ID NO: 3842976 - RNA, 20 nt, Shigella flexneri 2a str. 2457T
cagcgcugcgaaaguaccau

SEQ ID NO: 3842977 - RNA, 23 nt, Shigella flexneri 2a str. 2457T
cagcgcugcgaaaguaccauuaa

SEQ ID NO: 3842978 - RNA, 21 nt, Shigella flexneri 2a str. 2457T
cagcgcugcggcgcgcaucuu

SEQ ID NO: 3842979 - RNA, 13 nt, Shigella flexneri 2a str. 2457T
cagcgcuucgcuc

SEQ ID NO: 3842980 - RNA, 21 nt, Shigella flexneri 2a str. 2457T
cagcgcuuuuggcgcguuccc

SEQ ID NO: 3842981 - RNA, 23 nt, Shigella flexneri 2a str. 2457T
cagcggaaugcagucacgccagu

SEQ ID NO: 3842982 - RNA, 20 nt, Shigella flexneri 2a str. 2457T
cagcggaauuuuugcacggg

SEQ ID NO: 3842983 - RNA, 16 nt, Shigella flexneri 2a str. 2457T
cagcggauacaggaag

SEQ ID NO: 3842984 - RNA, 22 nt, Shigella flexneri 2a str. 2457T
cagcggauacaggaagcgaauc

SEQ ID NO: 3842985 - RNA, 19 nt, Shigella flexneri 2a str. 2457T
cagcggcaaacgacgcaga

SEQ ID NO: 3842986 - RNA, 15 nt, Shigella flexneri 2a str. 2457T
cagcggcaaccagcc

SEQ ID NO: 3842987 - RNA, 18 nt, Shigella flexneri 2a str. 2457T
cagcggcaaccagcccau

SEQ ID NO: 3842988 - RNA, 12 nt, Shigella flexneri 2a str. 2457T
cagcggcaauuc

SEQ ID NO: 3842989 - RNA, 22 nt, Shigella flexneri 2a str. 2457T
cagcggcauuacgcgccccuuc

SEQ ID NO: 3842990 - RNA, 15 nt, Shigella flexneri 2a str. 2457T
cagcggccagcgcac

SEQ ID NO: 3842991 - RNA, 21 nt, Shigella flexneri 2a str. 2457T
cagcggcgaauguuccaucac

SEQ ID NO: 3842992 - RNA, 15 nt, Shigella flexneri 2a str. 2457T
cagcggcggcacagc

SEQ ID NO: 3842993 - RNA, 16 nt, Shigella flexneri 2a str. 2457T
cagcggcugcugaugu

SEQ ID NO: 3842994 - RNA, 16 nt, Shigella flexneri 2a str. 2457T
cagcggcuuccaccgc

SEQ ID NO: 3842995 - RNA, 15 nt, Shigella flexneri 2a str. 2457T
cagcggcuucgacga

SEQ ID NO: 3842996 - RNA, 22 nt, Shigella flexneri 2a str. 2457T
cagcgggaucggcguacuggca

SEQ ID NO: 3842997 - RNA, 11 nt, Shigella flexneri 2a str. 2457T
cagcgggcgaa

SEQ ID NO: 3842998 - RNA, 22 nt, Shigella flexneri 2a str. 2457T
cagcgggugcauuuucacuuca

SEQ ID NO: 3842999 - RNA, 12 nt, Shigella flexneri 2a str. 2457T
cagcggguuaau

SEQ ID NO: 3843000 - RNA, 21 nt, Shigella flexneri 2a str. 2457T
cagcgguaacuuaucuguaau

SEQ ID NO: 3843001 - RNA, 17 nt, Shigella flexneri 2a str. 2457T
cagcgguuuacccugcu

SEQ ID NO: 3843002 - RNA, 12 nt, Shigella flexneri 2a str. 2457T
cagcgguuuugc

SEQ ID NO: 3843003 - RNA, 15 nt, Shigella flexneri 2a str. 2457T
cagcgguuuugccag

SEQ ID NO: 3843004 - RNA, 17 nt, Shigella flexneri 2a str. 2457T
cagcgguuuugccagcg

SEQ ID NO: 3843005 - RNA, 18 nt, Shigella flexneri 2a str. 2457T
cagcguaaaggcggcaga

SEQ ID NO: 3843006 - RNA, 23 nt, Shigella flexneri 2a str. 2457T
cagcguaaaggcggcagaacaga

SEQ ID NO: 3843007 - RNA, 22 nt, Shigella flexneri 2a str. 2457T
cagcguaaaggucaauuccuuc

SEQ ID NO: 3843008 - RNA, 21 nt, Shigella flexneri 2a str. 2457T
cagcguaaauccugacgcugg

SEQ ID NO: 3843009 - RNA, 20 nt, Shigella flexneri 2a str. 2457T
cagcguaacgauggcaauuu

SEQ ID NO: 3843010 - RNA, 21 nt, Shigella flexneri 2a str. 2457T
cagcguaccaugauccugcaa

SEQ ID NO: 3843011 - RNA, 21 nt, Shigella flexneri 2a str. 2457T
cagcgucacaucaggccaucc

SEQ ID NO: 3843012 - RNA, 13 nt, Shigella flexneri 2a str. 2457T
cagcgucacguca

SEQ ID NO: 3843013 - RNA, 17 nt, Shigella flexneri 2a str. 2457T
cagcgucagcauaaaaa

SEQ ID NO: 3843014 - RNA, 23 nt, Shigella flexneri 2a str. 2457T
cagcgucagcaucauaccuccgc

SEQ ID NO: 3843015 - RNA, 13 nt, Shigella flexneri 2a str. 2457T
cagcgucagcgaa

SEQ ID NO: 3843016 - RNA, 12 nt, Shigella flexneri 2a str. 2457T
cagcgucaucaa

SEQ ID NO: 3843017 - RNA, 13 nt, Shigella flexneri 2a str. 2457T
cagcgucaucaac

SEQ ID NO: 3843018 - RNA, 16 nt, Shigella flexneri 2a str. 2457T
cagcgucgcacccggc

SEQ ID NO: 3843019 - RNA, 17 nt, Shigella flexneri 2a str. 2457T
cagcgucgcacccggca

SEQ ID NO: 3843020 - RNA, 17 nt, Shigella flexneri 2a str. 2457T
cagcgucgcaucaggca

SEQ ID NO: 3843021 - RNA, 18 nt, Shigella flexneri 2a str. 2457T
cagcgucgcaucaggcau

SEQ ID NO: 3843022 - RNA, 16 nt, Shigella flexneri 2a str. 2457T
cagcgucgcauccgac

SEQ ID NO: 3843023 - RNA, 20 nt, Shigella flexneri 2a str. 2457T
cagcgucgcaucuggcauaa

SEQ ID NO: 3843024 - RNA, 17 nt, Shigella flexneri 2a str. 2457T
cagcgucggacuaaaua

SEQ ID NO: 3843025 - RNA, 14 nt, Shigella flexneri 2a str. 2457T
cagcgucgucagca

SEQ ID NO: 3843026 - RNA, 22 nt, Shigella flexneri 2a str. 2457T
cagcgucgugaaacgcgucuga

SEQ ID NO: 3843027 - RNA, 14 nt, Shigella flexneri 2a str. 2457T
cagcgucucauacc

SEQ ID NO: 3843028 - RNA, 20 nt, Shigella flexneri 2a str. 2457T
cagcgugaacugggccugca

SEQ ID NO: 3843029 - RNA, 15 nt, Shigella flexneri 2a str. 2457T
cagcgugacuggcag

SEQ ID NO: 3843030 - RNA, 18 nt, Shigella flexneri 2a str. 2457T
cagcgugcucucaaauau

SEQ ID NO: 3843031 - RNA, 15 nt, Shigella flexneri 2a str. 2457T
cagcguguugaggaa

SEQ ID NO: 3843032 - RNA, 16 nt, Shigella flexneri 2a str. 2457T
cagcguguugaggaag

SEQ ID NO: 3843033 - RNA, 21 nt, Shigella flexneri 2a str. 2457T
cagcguguugcggagcuuguu

SEQ ID NO: 3843034 - RNA, 20 nt, Shigella flexneri 2a str. 2457T
cagcguuaucccaucccacu

SEQ ID NO: 3843035 - RNA, 22 nt, Shigella flexneri 2a str. 2457T
cagcguucauaaauacagagca

SEQ ID NO: 3843036 - RNA, 15 nt, Shigella flexneri 2a str. 2457T
cagcguuccccagaa

SEQ ID NO: 3843037 - RNA, 19 nt, Shigella flexneri 2a str. 2457T
cagcguugcccccugaagc

SEQ ID NO: 3843038 - RNA, 22 nt, Shigella flexneri 2a str. 2457T
cagcguugcccccugaagcagu

SEQ ID NO: 3843039 - RNA, 13 nt, Shigella flexneri 2a str. 2457T
cagcguuuccagc

SEQ ID NO: 3843040 - RNA, 16 nt, Shigella flexneri 2a str. 2457T
cagcguuuccagcacc

SEQ ID NO: 3843041 - RNA, 17 nt, Shigella flexneri 2a str. 2457T
cagcguuuccagcacca

SEQ ID NO: 3843042 - RNA, 14 nt, Shigella flexneri 2a str. 2457T
cagcguuuccagcc

SEQ ID NO: 3843043 - RNA, 20 nt, Shigella flexneri 2a str. 2457T
cagcguuucgaacaggccga

SEQ ID NO: 3843044 - RNA, 18 nt, Shigella flexneri 2a str. 2457T
cagcguuuuguagaccug

SEQ ID NO: 3843045 - RNA, 16 nt, Shigella flexneri 2a str. 2457T
cagcuaaucaucauca

SEQ ID NO: 3843046 - RNA, 20 nt, Shigella flexneri 2a str. 2457T
cagcucaaacggcguuuucu

SEQ ID NO: 3843047 - RNA, 20 nt, Shigella flexneri 2a str. 2457T
cagcucaaucaacuccauua

SEQ ID NO: 3843048 - RNA, 15 nt, Shigella flexneri 2a str. 2457T
cagcucacuucgauc

SEQ ID NO: 3843049 - RNA, 13 nt, Shigella flexneri 2a str. 2457T
cagcucagugacc

SEQ ID NO: 3843050 - RNA, 18 nt, Shigella flexneri 2a str. 2457T
cagcucauauuccugcau

SEQ ID NO: 3843051 - RNA, 14 nt, Shigella flexneri 2a str. 2457T
cagcucauccagcg

SEQ ID NO: 3843052 - RNA, 17 nt, Shigella flexneri 2a str. 2457T
cagcucauucagccggg

SEQ ID NO: 3843053 - RNA, 19 nt, Shigella flexneri 2a str. 2457T
cagcuccagcccgcgucgu

SEQ ID NO: 3843054 - RNA, 22 nt, Shigella flexneri 2a str. 2457T
cagcucccccaaaguuaaggug

SEQ ID NO: 3843055 - RNA, 22 nt, Shigella flexneri 2a str. 2457T
cagcuccgccagcuccgggcug

SEQ ID NO: 3843056 - RNA, 19 nt, Shigella flexneri 2a str. 2457T
cagcuccgguauacguccc

SEQ ID NO: 3843057 - RNA, 21 nt, Shigella flexneri 2a str. 2457T
cagcuccucuuucaucucccg

SEQ ID NO: 3843058 - RNA, 14 nt, Shigella flexneri 2a str. 2457T
cagcucgaccgcug

SEQ ID NO: 3843059 - RNA, 18 nt, Shigella flexneri 2a str. 2457T
cagcucgaugauguguuc

SEQ ID NO: 3843060 - RNA, 18 nt, Shigella flexneri 2a str. 2457T
cagcucggauaaggcuuc

SEQ ID NO: 3843061 - RNA, 16 nt, Shigella flexneri 2a str. 2457T
cagcucggcaaucugu

SEQ ID NO: 3843062 - RNA, 22 nt, Shigella flexneri 2a str. 2457T
cagcucgugcagaacauccagc

SEQ ID NO: 3843063 - RNA, 22 nt, Shigella flexneri 2a str. 2457T
cagcucucagacgauuacucgc

SEQ ID NO: 3843064 - RNA, 23 nt, Shigella flexneri 2a str. 2457T
cagcucucagacgauuacucgcc

SEQ ID NO: 3843065 - RNA, 20 nt, Shigella flexneri 2a str. 2457T
cagcucucagccagcuggca

SEQ ID NO: 3843066 - RNA, 22 nt, Shigella flexneri 2a str. 2457T
cagcucugcugucaccgaagcg

SEQ ID NO: 3843067 - RNA, 20 nt, Shigella flexneri 2a str. 2457T
cagcucugggcuaacacccg

SEQ ID NO: 3843068 - RNA, 12 nt, Shigella flexneri 2a str. 2457T
cagcucuuccuu

SEQ ID NO: 3843069 - RNA, 20 nt, Shigella flexneri 2a str. 2457T
cagcucuuccuucagcuccc

SEQ ID NO: 3843070 - RNA, 16 nt, Shigella flexneri 2a str. 2457T
cagcugccgacgccag

SEQ ID NO: 3843071 - RNA, 17 nt, Shigella flexneri 2a str. 2457T
cagcugccgacgccagu

SEQ ID NO: 3843072 - RNA, 15 nt, Shigella flexneri 2a str. 2457T
cagcugccgccaggc

SEQ ID NO: 3843073 - RNA, 19 nt, Shigella flexneri 2a str. 2457T
cagcugcgcaucaugccac

SEQ ID NO: 3843074 - RNA, 16 nt, Shigella flexneri 2a str. 2457T
cagcugcgcguuaucu

SEQ ID NO: 3843075 - RNA, 20 nt, Shigella flexneri 2a str. 2457T
cagcugcgcuucaauacgcu

SEQ ID NO: 3843076 - RNA, 13 nt, Shigella flexneri 2a str. 2457T
cagcugcucccag

SEQ ID NO: 3843077 - RNA, 15 nt, Shigella flexneri 2a str. 2457T
cagcugcucccagcg

SEQ ID NO: 3843078 - RNA, 14 nt, Shigella flexneri 2a str. 2457T
cagcugggcgauuu

SEQ ID NO: 3843079 - RNA, 22 nt, Shigella flexneri 2a str. 2457T
cagcugguguaacugcgccaga

SEQ ID NO: 3843080 - RNA, 23 nt, Shigella flexneri 2a str. 2457T
cagcugguguaacugcgccagac

SEQ ID NO: 3843081 - RNA, 22 nt, Shigella flexneri 2a str. 2457T
cagcuguggucuuuaaugacac

SEQ ID NO: 3843082 - RNA, 15 nt, Shigella flexneri 2a str. 2457T
cagcuuaaucaccag

SEQ ID NO: 3843083 - RNA, 19 nt, Shigella flexneri 2a str. 2457T
cagcuuacgagugcgcucu

SEQ ID NO: 3843084 - RNA, 16 nt, Shigella flexneri 2a str. 2457T
cagcuuagaaaucgac

SEQ ID NO: 3843085 - RNA, 16 nt, Shigella flexneri 2a str. 2457T
cagcuuagaaauucac

SEQ ID NO: 3843086 - RNA, 14 nt, Shigella flexneri 2a str. 2457T
cagcuuagcgccuu

SEQ ID NO: 3843087 - RNA, 15 nt, Shigella flexneri 2a str. 2457T
cagcuuaucuuuuuc

SEQ ID NO: 3843088 - RNA, 13 nt, Shigella flexneri 2a str. 2457T
cagcuuauucacc

SEQ ID NO: 3843089 - RNA, 12 nt, Shigella flexneri 2a str. 2457T
cagcuucaacga

SEQ ID NO: 3843090 - RNA, 18 nt, Shigella flexneri 2a str. 2457T
cagcuucacaaaggcuug

SEQ ID NO: 3843091 - RNA, 16 nt, Shigella flexneri 2a str. 2457T
cagcuucaccuuccag

SEQ ID NO: 3843092 - RNA, 18 nt, Shigella flexneri 2a str. 2457T
cagcuucacgcgccagcu

SEQ ID NO: 3843093 - RNA, 13 nt, Shigella flexneri 2a str. 2457T
cagcuucacggaa

SEQ ID NO: 3843094 - RNA, 16 nt, Shigella flexneri 2a str. 2457T
cagcuucagcgcgucg

SEQ ID NO: 3843095 - RNA, 22 nt, Shigella flexneri 2a str. 2457T
cagcuucauaaggaaaauaauc

SEQ ID NO: 3843096 - RNA, 15 nt, Shigella flexneri 2a str. 2457T
cagcuucaucaucgc

SEQ ID NO: 3843097 - RNA, 16 nt, Shigella flexneri 2a str. 2457T
cagcuuccaucaacau

SEQ ID NO: 3843098 - RNA, 16 nt, Shigella flexneri 2a str. 2457T
cagcuucccaaagauc

SEQ ID NO: 3843099 - RNA, 20 nt, Shigella flexneri 2a str. 2457T
cagcuucgccaguuuuucaa

SEQ ID NO: 3843100 - RNA, 23 nt, Shigella flexneri 2a str. 2457T
cagcuucgcuaccugagucauca

SEQ ID NO: 3843101 - RNA, 14 nt, Shigella flexneri 2a str. 2457T
cagcuucgcuuccc

SEQ ID NO: 3843102 - RNA, 18 nt, Shigella flexneri 2a str. 2457T
cagcuucgguuucaccga

SEQ ID NO: 3843103 - RNA, 19 nt, Shigella flexneri 2a str. 2457T
cagcuucucgugaaacuca

SEQ ID NO: 3843104 - RNA, 19 nt, Shigella flexneri 2a str. 2457T
cagcuucuuauccagcugc

SEQ ID NO: 3843105 - RNA, 17 nt, Shigella flexneri 2a str. 2457T
cagcuugcgauccugca

SEQ ID NO: 3843106 - RNA, 15 nt, Shigella flexneri 2a str. 2457T
cagcuugcuuuccag

SEQ ID NO: 3843107 - RNA, 22 nt, Shigella flexneri 2a str. 2457T
cagcuugucuacgccuuguuuc

SEQ ID NO: 3843108 - RNA, 21 nt, Shigella flexneri 2a str. 2457T
cagcuuuaaauuacugagcaa

SEQ ID NO: 3843109 - RNA, 13 nt, Shigella flexneri 2a str. 2457T
cagcuuucagaga

SEQ ID NO: 3843110 - RNA, 15 nt, Shigella flexneri 2a str. 2457T
cagcuuucagcagcg

SEQ ID NO: 3843111 - RNA, 21 nt, Shigella flexneri 2a str. 2457T
cagcuuugcccgaucaucaaa

SEQ ID NO: 3843112 - RNA, 23 nt, Shigella flexneri 2a str. 2457T
cagcuuuucgauaacccggcggc

SEQ ID NO: 3843113 - RNA, 22 nt, Shigella flexneri 2a str. 2457T
cagcuuuuuagcgaucucgguc

SEQ ID NO: 3843114 - RNA, 19 nt, Shigella flexneri 2a str. 2457T
caggaaaagguaggccuga

SEQ ID NO: 3843115 - RNA, 10 nt, Shigella flexneri 2a str. 2457T
caggaaaauc

SEQ ID NO: 3843116 - RNA, 16 nt, Shigella flexneri 2a str. 2457T
caggaaaaucagcauc

SEQ ID NO: 3843117 - RNA, 15 nt, Shigella flexneri 2a str. 2457T
caggaaacccaacgc

SEQ ID NO: 3843118 - RNA, 12 nt, Shigella flexneri 2a str. 2457T
caggaaauaaau

SEQ ID NO: 3843119 - RNA, 15 nt, Shigella flexneri 2a str. 2457T
caggaaauaaauaau

SEQ ID NO: 3843120 - RNA, 13 nt, Shigella flexneri 2a str. 2457T
caggaaaugggug

SEQ ID NO: 3843121 - RNA, 22 nt, Shigella flexneri 2a str. 2457T
caggaaauuauggaucaccauc

SEQ ID NO: 3843122 - RNA, 13 nt, Shigella flexneri 2a str. 2457T
caggaacagccac

SEQ ID NO: 3843123 - RNA, 18 nt, Shigella flexneri 2a str. 2457T
caggaacgcgccaagaua

SEQ ID NO: 3843124 - RNA, 13 nt, Shigella flexneri 2a str. 2457T
caggaacugcuca

SEQ ID NO: 3843125 - RNA, 18 nt, Shigella flexneri 2a str. 2457T
caggaacuguuucaccau

SEQ ID NO: 3843126 - RNA, 16 nt, Shigella flexneri 2a str. 2457T
caggaagaccugcagc

SEQ ID NO: 3843127 - RNA, 14 nt, Shigella flexneri 2a str. 2457T
caggaagccccagc

SEQ ID NO: 3843128 - RNA, 15 nt, Shigella flexneri 2a str. 2457T
caggaagccccagcu

SEQ ID NO: 3843129 - RNA, 12 nt, Shigella flexneri 2a str. 2457T
caggaaggccag

SEQ ID NO: 3843130 - RNA, 15 nt, Shigella flexneri 2a str. 2457T
caggaaggccagcag

SEQ ID NO: 3843131 - RNA, 17 nt, Shigella flexneri 2a str. 2457T
caggaaggccagcaggu

SEQ ID NO: 3843132 - RNA, 18 nt, Shigella flexneri 2a str. 2457T
caggaauaaucagcaacg

SEQ ID NO: 3843133 - RNA, 19 nt, Shigella flexneri 2a str. 2457T
caggaauaaucagcaacga

SEQ ID NO: 3843134 - RNA, 15 nt, Shigella flexneri 2a str. 2457T
caggaauacgcccgu

SEQ ID NO: 3843135 - RNA, 21 nt, Shigella flexneri 2a str. 2457T
caggaauagcggcaagcccag

SEQ ID NO: 3843136 - RNA, 12 nt, Shigella flexneri 2a str. 2457T
caggaauauacc

SEQ ID NO: 3843137 - RNA, 15 nt, Shigella flexneri 2a str. 2457T
caggaccguucgcua

SEQ ID NO: 3843138 - RNA, 18 nt, Shigella flexneri 2a str. 2457T
caggaccguucgcuaccu

SEQ ID NO: 3843139 - RNA, 15 nt, Shigella flexneri 2a str. 2457T
caggacgaaaaauca

SEQ ID NO: 3843140 - RNA, 14 nt, Shigella flexneri 2a str. 2457T
caggacgcagucca

SEQ ID NO: 3843141 - RNA, 20 nt, Shigella flexneri 2a str. 2457T
caggacgcaguccagacucc

SEQ ID NO: 3843142 - RNA, 15 nt, Shigella flexneri 2a str. 2457T
caggacuuugaaagc

SEQ ID NO: 3843143 - RNA, 22 nt, Shigella flexneri 2a str. 2457T
caggagacgcgcaaaucagauu

SEQ ID NO: 3843144 - RNA, 14 nt, Shigella flexneri 2a str. 2457T
caggagauuaacgg

SEQ ID NO: 3843145 - RNA, 16 nt, Shigella flexneri 2a str. 2457T
caggagcaacuggagu

SEQ ID NO: 3843146 - RNA, 19 nt, Shigella flexneri 2a str. 2457T
caggagcgauuaugaaaca

SEQ ID NO: 3843147 - RNA, 22 nt, Shigella flexneri 2a str. 2457T
caggagcgauuaugaaacaaga

SEQ ID NO: 3843148 - RNA, 12 nt, Shigella flexneri 2a str. 2457T
caggagcuggau

SEQ ID NO: 3843149 - RNA, 19 nt, Shigella flexneri 2a str. 2457T
caggaggcguaauuuccac

SEQ ID NO: 3843150 - RNA, 16 nt, Shigella flexneri 2a str. 2457T
caggaguagcucuggg

SEQ ID NO: 3843151 - RNA, 15 nt, Shigella flexneri 2a str. 2457T
caggagucaugucau

SEQ ID NO: 3843152 - RNA, 17 nt, Shigella flexneri 2a str. 2457T
caggauaaacuccugca

SEQ ID NO: 3843153 - RNA, 12 nt, Shigella flexneri 2a str. 2457T
caggauacgcau

SEQ ID NO: 3843154 - RNA, 18 nt, Shigella flexneri 2a str. 2457T
caggauauauuucaucaa

SEQ ID NO: 3843155 - RNA, 14 nt, Shigella flexneri 2a str. 2457T
caggaucagacaca

SEQ ID NO: 3843156 - RNA, 13 nt, Shigella flexneri 2a str. 2457T
caggaucagcucc

SEQ ID NO: 3843157 - RNA, 17 nt, Shigella flexneri 2a str. 2457T
caggaucuccagcuccc

SEQ ID NO: 3843158 - RNA, 17 nt, Shigella flexneri 2a str. 2457T
caggaucugguguuaaa

SEQ ID NO: 3843159 - RNA, 18 nt, Shigella flexneri 2a str. 2457T
caggaugauuccggcaaa

SEQ ID NO: 3843160 - RNA, 16 nt, Shigella flexneri 2a str. 2457T
caggaugggcaacgcg

SEQ ID NO: 3843161 - RNA, 17 nt, Shigella flexneri 2a str. 2457T
caggauguuccggcaaa

SEQ ID NO: 3843162 - RNA, 16 nt, Shigella flexneri 2a str. 2457T
cagggaucaacauuca

SEQ ID NO: 3843163 - RNA, 18 nt, Shigella flexneri 2a str. 2457T
cagggaucaacauucaga

SEQ ID NO: 3843164 - RNA, 18 nt, Shigella flexneri 2a str. 2457T
cagggaucauccacccgc

SEQ ID NO: 3843165 - RNA, 21 nt, Shigella flexneri 2a str. 2457T
cagggaucucuuccagugccu

SEQ ID NO: 3843166 - RNA, 15 nt, Shigella flexneri 2a str. 2457T
cagggauggcuuuua

SEQ ID NO: 3843167 - RNA, 21 nt, Shigella flexneri 2a str. 2457T
cagggcaaacucugagagauc

SEQ ID NO: 3843168 - RNA, 22 nt, Shigella flexneri 2a str. 2457T
cagggcaaugcgggugcaauca

SEQ ID NO: 3843169 - RNA, 23 nt, Shigella flexneri 2a str. 2457T
cagggcacuuuuauccugucagu

SEQ ID NO: 3843170 - RNA, 14 nt, Shigella flexneri 2a str. 2457T
cagggcaugacaca

SEQ ID NO: 3843171 - RNA, 16 nt, Shigella flexneri 2a str. 2457T
cagggcaugacacaga

SEQ ID NO: 3843172 - RNA, 17 nt, Shigella flexneri 2a str. 2457T
cagggcaugacacagaa

SEQ ID NO: 3843173 - RNA, 12 nt, Shigella flexneri 2a str. 2457T
cagggccugaag

SEQ ID NO: 3843174 - RNA, 17 nt, Shigella flexneri 2a str. 2457T
cagggccugaaggaccu

SEQ ID NO: 3843175 - RNA, 15 nt, Shigella flexneri 2a str. 2457T
cagggcgauaucuuu

SEQ ID NO: 3843176 - RNA, 19 nt, Shigella flexneri 2a str. 2457T
cagggcgcgggcaacagaa

SEQ ID NO: 3843177 - RNA, 12 nt, Shigella flexneri 2a str. 2457T
cagggcuuacaa

SEQ ID NO: 3843178 - RNA, 22 nt, Shigella flexneri 2a str. 2457T
cagggcuuuuuuauuucauguu

SEQ ID NO: 3843179 - RNA, 14 nt, Shigella flexneri 2a str. 2457T
caggggcagcacca

SEQ ID NO: 3843180 - RNA, 18 nt, Shigella flexneri 2a str. 2457T
caggggcggggaauucua

SEQ ID NO: 3843181 - RNA, 22 nt, Shigella flexneri 2a str. 2457T
caggguaauuuguaacugucgg

SEQ ID NO: 3843182 - RNA, 21 nt, Shigella flexneri 2a str. 2457T
caggguauggaucccucuuuc

SEQ ID NO: 3843183 - RNA, 24 nt, Shigella flexneri 2a str. 2457T
caggguauuaucaauaccgauggc

SEQ ID NO: 3843184 - RNA, 17 nt, Shigella flexneri 2a str. 2457T
cagggugaucaccagua

SEQ ID NO: 3843185 - RNA, 18 nt, Shigella flexneri 2a str. 2457T
cagggugaucaccaguaa

SEQ ID NO: 3843186 - RNA, 22 nt, Shigella flexneri 2a str. 2457T
caggguuagccgaucaggcuuu

SEQ ID NO: 3843187 - RNA, 17 nt, Shigella flexneri 2a str. 2457T
caggguugcagacccgc

SEQ ID NO: 3843188 - RNA, 16 nt, Shigella flexneri 2a str. 2457T
caggguuuugcccagc

SEQ ID NO: 3843189 - RNA, 19 nt, Shigella flexneri 2a str. 2457T
cagguaaacaccuucaucc

SEQ ID NO: 3843190 - RNA, 22 nt, Shigella flexneri 2a str. 2457T
cagguaaagaccauaaauaugg

SEQ ID NO: 3843191 - RNA, 22 nt, Shigella flexneri 2a str. 2457T
cagguaagagugaauucacaau

SEQ ID NO: 3843192 - RNA, 14 nt, Shigella flexneri 2a str. 2457T
cagguaaucugcca

SEQ ID NO: 3843193 - RNA, 18 nt, Shigella flexneri 2a str. 2457T
cagguaauuugaucaaau

SEQ ID NO: 3843194 - RNA, 18 nt, Shigella flexneri 2a str. 2457T
cagguagcgcauaagcca

SEQ ID NO: 3843195 - RNA, 20 nt, Shigella flexneri 2a str. 2457T
cagguagcgcauaagccacc

SEQ ID NO: 3843196 - RNA, 21 nt, Shigella flexneri 2a str. 2457T
cagguauaccgaaaucgccau

SEQ ID NO: 3843197 - RNA, 13 nt, Shigella flexneri 2a str. 2457T
cagguaucgacaa

SEQ ID NO: 3843198 - RNA, 18 nt, Shigella flexneri 2a str. 2457T
cagguauuuugucagccc

SEQ ID NO: 3843199 - RNA, 19 nt, Shigella flexneri 2a str. 2457T
caggucaaaaaaugaaacu

SEQ ID NO: 3843200 - RNA, 22 nt, Shigella flexneri 2a str. 2457T
caggucaaaaaaugaaacugga

SEQ ID NO: 3843201 - RNA, 18 nt, Shigella flexneri 2a str. 2457T
caggucagagagccagcc

SEQ ID NO: 3843202 - RNA, 22 nt, Shigella flexneri 2a str. 2457T
caggucagauuucaaucuggcc

SEQ ID NO: 3843203 - RNA, 16 nt, Shigella flexneri 2a str. 2457T
caggucagcgccuggc

SEQ ID NO: 3843204 - RNA, 14 nt, Shigella flexneri 2a str. 2457T
caggucaucaauca

SEQ ID NO: 3843205 - RNA, 15 nt, Shigella flexneri 2a str. 2457T
cagguccccgcuucg

SEQ ID NO: 3843206 - RNA, 15 nt, Shigella flexneri 2a str. 2457T
caggucggcucagcc

SEQ ID NO: 3843207 - RNA, 20 nt, Shigella flexneri 2a str. 2457T
caggucggugugaaugacua

SEQ ID NO: 3843208 - RNA, 16 nt, Shigella flexneri 2a str. 2457T
caggugaaaaauaaaa

SEQ ID NO: 3843209 - RNA, 19 nt, Shigella flexneri 2a str. 2457T
caggugacgcgggcagcag

SEQ ID NO: 3843210 - RNA, 21 nt, Shigella flexneri 2a str. 2457T
caggugaugcauagcaaccgc

SEQ ID NO: 3843211 - RNA, 11 nt, Shigella flexneri 2a str. 2457T
caggugcagcc

SEQ ID NO: 3843212 - RNA, 18 nt, Shigella flexneri 2a str. 2457T
cagguggcaaugcccggu

SEQ ID NO: 3843213 - RNA, 19 nt, Shigella flexneri 2a str. 2457T
cagguggcguuugccaccu

SEQ ID NO: 3843214 - RNA, 14 nt, Shigella flexneri 2a str. 2457T
cagguguccagcca

SEQ ID NO: 3843215 - RNA, 19 nt, Shigella flexneri 2a str. 2457T
cagguguuauagcgcugaa

SEQ ID NO: 3843216 - RNA, 13 nt, Shigella flexneri 2a str. 2457T
cagguuaacgcag

SEQ ID NO: 3843217 - RNA, 19 nt, Shigella flexneri 2a str. 2457T
cagguuaaugacccacccc

SEQ ID NO: 3843218 - RNA, 21 nt, Shigella flexneri 2a str. 2457T
cagguuaaugacccaccccag

SEQ ID NO: 3843219 - RNA, 22 nt, Shigella flexneri 2a str. 2457T
cagguuauuaaauaaccagcgc

SEQ ID NO: 3843220 - RNA, 12 nt, Shigella flexneri 2a str. 2457T
cagguucaacag

SEQ ID NO: 3843221 - RNA, 21 nt, Shigella flexneri 2a str. 2457T
cagguuccgcauaccccuuca

SEQ ID NO: 3843222 - RNA, 14 nt, Shigella flexneri 2a str. 2457T
cagguucguaagcg

SEQ ID NO: 3843223 - RNA, 21 nt, Shigella flexneri 2a str. 2457T
cagguugaucccaccgggcaa

SEQ ID NO: 3843224 - RNA, 23 nt, Shigella flexneri 2a str. 2457T
cagguuguacuuuccagccacag

SEQ ID NO: 3843225 - RNA, 23 nt, Shigella flexneri 2a str. 2457T
cagguuuaaacagagauuacuuu

SEQ ID NO: 3843226 - RNA, 16 nt, Shigella flexneri 2a str. 2457T
cagguuuaccagcagc

SEQ ID NO: 3843227 - RNA, 21 nt, Shigella flexneri 2a str. 2457T
cagguuugacauaaauuccgc

SEQ ID NO: 3843228 - RNA, 19 nt, Shigella flexneri 2a str. 2457T
caguaaaccacccaccagc

SEQ ID NO: 3843229 - RNA, 21 nt, Shigella flexneri 2a str. 2457T
caguaaaccacccaccagcgc

SEQ ID NO: 3843230 - RNA, 13 nt, Shigella flexneri 2a str. 2457T
caguaaagcagcg

SEQ ID NO: 3843231 - RNA, 14 nt, Shigella flexneri 2a str. 2457T
caguaaauccauaa

SEQ ID NO: 3843232 - RNA, 19 nt, Shigella flexneri 2a str. 2457T
caguaaauggugauaucac

SEQ ID NO: 3843233 - RNA, 18 nt, Shigella flexneri 2a str. 2457T
caguaaccaaaagcuggg

SEQ ID NO: 3843234 - RNA, 20 nt, Shigella flexneri 2a str. 2457T
caguaaccaaaagcugggau

SEQ ID NO: 3843235 - RNA, 17 nt, Shigella flexneri 2a str. 2457T
caguaaccacgcagcgu

SEQ ID NO: 3843236 - RNA, 17 nt, Shigella flexneri 2a str. 2457T
caguaaccgcuuuuuca

SEQ ID NO: 3843237 - RNA, 18 nt, Shigella flexneri 2a str. 2457T
caguaaccgcuuuuucaa

SEQ ID NO: 3843238 - RNA, 19 nt, Shigella flexneri 2a str. 2457T
caguaaccuuucagauguu

SEQ ID NO: 3843239 - RNA, 14 nt, Shigella flexneri 2a str. 2457T
caguaacguugcau

SEQ ID NO: 3843240 - RNA, 14 nt, Shigella flexneri 2a str. 2457T
caguaacucauugc

SEQ ID NO: 3843241 - RNA, 19 nt, Shigella flexneri 2a str. 2457T
caguaagcaguccagcgcc

SEQ ID NO: 3843242 - RNA, 23 nt, Shigella flexneri 2a str. 2457T
caguaagcaguccagcgccugac

SEQ ID NO: 3843243 - RNA, 14 nt, Shigella flexneri 2a str. 2457T
caguaagcgacggg

SEQ ID NO: 3843244 - RNA, 19 nt, Shigella flexneri 2a str. 2457T
caguaagggaucacgcggu

SEQ ID NO: 3843245 - RNA, 21 nt, Shigella flexneri 2a str. 2457T
caguaaggucaucaaucauuu

SEQ ID NO: 3843246 - RNA, 13 nt, Shigella flexneri 2a str. 2457T
caguaaugagcac

SEQ ID NO: 3843247 - RNA, 16 nt, Shigella flexneri 2a str. 2457T
caguaaugauuuaaaa

SEQ ID NO: 3843248 - RNA, 15 nt, Shigella flexneri 2a str. 2457T
caguacagccgccag

SEQ ID NO: 3843249 - RNA, 23 nt, Shigella flexneri 2a str. 2457T
caguacaggccgcaccaggaucu

SEQ ID NO: 3843250 - RNA, 16 nt, Shigella flexneri 2a str. 2457T
caguacaguaccgaac

SEQ ID NO: 3843251 - RNA, 19 nt, Shigella flexneri 2a str. 2457T
caguacauuguuuuccaga

SEQ ID NO: 3843252 - RNA, 22 nt, Shigella flexneri 2a str. 2457T
caguacauuguuuuccagacug

SEQ ID NO: 3843253 - RNA, 13 nt, Shigella flexneri 2a str. 2457T
caguaccaccgcg

SEQ ID NO: 3843254 - RNA, 23 nt, Shigella flexneri 2a str. 2457T
caguaccagauaaucaccugccu

SEQ ID NO: 3843255 - RNA, 15 nt, Shigella flexneri 2a str. 2457T
caguaccagcaguac

SEQ ID NO: 3843256 - RNA, 22 nt, Shigella flexneri 2a str. 2457T
caguaccgauugcccauacagg

SEQ ID NO: 3843257 - RNA, 22 nt, Shigella flexneri 2a str. 2457T
caguaccgccaccaccagacgc

SEQ ID NO: 3843258 - RNA, 21 nt, Shigella flexneri 2a str. 2457T
caguaccgccagugcagcgaa

SEQ ID NO: 3843259 - RNA, 21 nt, Shigella flexneri 2a str. 2457T
cagugccgcauccugcaccac

SEQ ID NO: 3843260 - RNA, 18 nt, Shigella flexneri 2a str. 2457T
cagugccgcccaccacuc

SEQ ID NO: 3843261 - RNA, 21 nt, Shigella flexneri 2a str. 2457T
cagugccugcauaaacgccgu

SEQ ID NO: 3843262 - RNA, 19 nt, Shigella flexneri 2a str. 2457T
cagugcggauaccaccagu

SEQ ID NO: 3843263 - RNA, 22 nt, Shigella flexneri 2a str. 2457T
cagugcgucgcugcucuucagu

SEQ ID NO: 3843264 - RNA, 16 nt, Shigella flexneri 2a str. 2457T
cagugcgugcgcugcu

SEQ ID NO: 3843265 - RNA, 15 nt, Shigella flexneri 2a str. 2457T
cagugcuucgcggac

SEQ ID NO: 3843266 - RNA, 17 nt, Shigella flexneri 2a str. 2457T
caguggacgauaagcac

SEQ ID NO: 3843267 - RNA, 21 nt, Shigella flexneri 2a str. 2457T
caguggauaauacacuaacag

SEQ ID NO: 3843268 - RNA, 21 nt, Shigella flexneri 2a str. 2457T
caguggaugcgccauaccaug

SEQ ID NO: 3843269 - RNA, 20 nt, Shigella flexneri 2a str. 2457T
caguggcuuaucuuccuguu

SEQ ID NO: 3843270 - RNA, 14 nt, Shigella flexneri 2a str. 2457T
cagugggauuaaaa

SEQ ID NO: 3843271 - RNA, 14 nt, Shigella flexneri 2a str. 2457T
cagugggcgcugcu

SEQ ID NO: 3843272 - RNA, 20 nt, Shigella flexneri 2a str. 2457T
cagugggcgcugcuguacuu

SEQ ID NO: 3843273 - RNA, 23 nt, Shigella flexneri 2a str. 2457T
caguggguuaugaaacuccaccg

SEQ ID NO: 3843274 - RNA, 18 nt, Shigella flexneri 2a str. 2457T
caguggugcggcugaugg

SEQ ID NO: 3843275 - RNA, 20 nt, Shigella flexneri 2a str. 2457T
cagugguuucgccagcaccg

SEQ ID NO: 3843276 - RNA, 14 nt, Shigella flexneri 2a str. 2457T
caguguaaaacagc

SEQ ID NO: 3843277 - RNA, 15 nt, Shigella flexneri 2a str. 2457T
caguguacagcggca

SEQ ID NO: 3843278 - RNA, 13 nt, Shigella flexneri 2a str. 2457T
caguguccaacca

SEQ ID NO: 3843279 - RNA, 22 nt, Shigella flexneri 2a str. 2457T
cagugucgcaguagccaugcau

SEQ ID NO: 3843280 - RNA, 19 nt, Shigella flexneri 2a str. 2457T
caguuaacgcggauccccu

SEQ ID NO: 3843281 - RNA, 21 nt, Shigella flexneri 2a str. 2457T
caguuaacgcggauccccugc

SEQ ID NO: 3843282 - RNA, 23 nt, Shigella flexneri 2a str. 2457T
caguuaagcaacugacuggcucu

SEQ ID NO: 3843283 - RNA, 15 nt, Shigella flexneri 2a str. 2457T
caguuaaguuaauuc

SEQ ID NO: 3843284 - RNA, 17 nt, Shigella flexneri 2a str. 2457T
caguuacccagcggaua

SEQ ID NO: 3843285 - RNA, 18 nt, Shigella flexneri 2a str. 2457T
caguuacugccaccaucc

SEQ ID NO: 3843286 - RNA, 12 nt, Shigella flexneri 2a str. 2457T
caguuauaaaau

SEQ ID NO: 3843287 - RNA, 17 nt, Shigella flexneri 2a str. 2457T
caguuauagcgcagacg

SEQ ID NO: 3843288 - RNA, 21 nt, Shigella flexneri 2a str. 2457T
caguucaaagcguggugauac

SEQ ID NO: 3843289 - RNA, 15 nt, Shigella flexneri 2a str. 2457T
caguucaaaguugca

SEQ ID NO: 3843290 - RNA, 17 nt, Shigella flexneri 2a str. 2457T
caguucaaaguugcauu

SEQ ID NO: 3843291 - RNA, 23 nt, Shigella flexneri 2a str. 2457T
caguucaagugcuacccacuucc

SEQ ID NO: 3843292 - RNA, 16 nt, Shigella flexneri 2a str. 2457T
caguucacaccagcca

SEQ ID NO: 3843293 - RNA, 22 nt, Shigella flexneri 2a str. 2457T
caguucacccucauucaccagu

SEQ ID NO: 3843294 - RNA, 18 nt, Shigella flexneri 2a str. 2457T
caguucaccgccgaggcg

SEQ ID NO: 3843295 - RNA, 16 nt, Shigella flexneri 2a str. 2457T
caguucacgaauauuu

SEQ ID NO: 3843296 - RNA, 22 nt, Shigella flexneri 2a str. 2457T
caguucagcgauauccagcgau

SEQ ID NO: 3843297 - RNA, 17 nt, Shigella flexneri 2a str. 2457T
caguucauuugaacugg

SEQ ID NO: 3843298 - RNA, 18 nt, Shigella flexneri 2a str. 2457T
caguucccagggcuuucg

SEQ ID NO: 3843299 - RNA, 14 nt, Shigella flexneri 2a str. 2457T
caguucccccugcc

SEQ ID NO: 3843300 - RNA, 19 nt, Shigella flexneri 2a str. 2457T
caguuccggcaucgacagu

SEQ ID NO: 3843301 - RNA, 18 nt, Shigella flexneri 2a str. 2457T
caguucgaaauccagacg

SEQ ID NO: 3843302 - RNA, 16 nt, Shigella flexneri 2a str. 2457T
caguucgauauccagu

SEQ ID NO: 3843303 - RNA, 14 nt, Shigella flexneri 2a str. 2457T
caguucgauuuccc

SEQ ID NO: 3843304 - RNA, 16 nt, Shigella flexneri 2a str. 2457T
caguucgauuucccag

SEQ ID NO: 3843305 - RNA, 24 nt, Shigella flexneri 2a str. 2457T
caguucgcccgcuucaucgugcuc

SEQ ID NO: 3843306 - RNA, 16 nt, Shigella flexneri 2a str. 2457T
caguucgccguacuga

SEQ ID NO: 3843307 - RNA, 20 nt, Shigella flexneri 2a str. 2457T
caguucgccguacugacggc

SEQ ID NO: 3843308 - RNA, 15 nt, Shigella flexneri 2a str. 2457T
caguucggaaacagu

SEQ ID NO: 3843309 - RNA, 16 nt, Shigella flexneri 2a str. 2457T
caguucgguugggauc

SEQ ID NO: 3843310 - RNA, 18 nt, Shigella flexneri 2a str. 2457T
caguucuaccaucaaugg

SEQ ID NO: 3843311 - RNA, 20 nt, Shigella flexneri 2a str. 2457T
caguucuaccaucaauggcu

SEQ ID NO: 3843312 - RNA, 13 nt, Shigella flexneri 2a str. 2457T
caguucugcagcg

SEQ ID NO: 3843313 - RNA, 18 nt, Shigella flexneri 2a str. 2457T
caguucuggaagagauga

SEQ ID NO: 3843314 - RNA, 16 nt, Shigella flexneri 2a str. 2457T
caguucuuccaguucc

SEQ ID NO: 3843315 - RNA, 17 nt, Shigella flexneri 2a str. 2457T
caguucuuccaguuccg

SEQ ID NO: 3843316 - RNA, 15 nt, Shigella flexneri 2a str. 2457T
caguucuuccuggcu

SEQ ID NO: 3843317 - RNA, 21 nt, Shigella flexneri 2a str. 2457T
caguugaccugcgaccggcgu

SEQ ID NO: 3843318 - RNA, 19 nt, Shigella flexneri 2a str. 2457T
caguugauacaggaacagc

SEQ ID NO: 3843319 - RNA, 19 nt, Shigella flexneri 2a str. 2457T
caguugaucagccaggcga

SEQ ID NO: 3843320 - RNA, 16 nt, Shigella flexneri 2a str. 2457T
caguugauucgcgcgu

SEQ ID NO: 3843321 - RNA, 19 nt, Shigella flexneri 2a str. 2457T
caguugcaacucgacugga

SEQ ID NO: 3843322 - RNA, 19 nt, Shigella flexneri 2a str. 2457T
caguugcagcaagccaucg

SEQ ID NO: 3843323 - RNA, 21 nt, Shigella flexneri 2a str. 2457T
caguugcaucgucuguuuuau

SEQ ID NO: 3843324 - RNA, 14 nt, Shigella flexneri 2a str. 2457T
caguugcugcguga

SEQ ID NO: 3843325 - RNA, 21 nt, Shigella flexneri 2a str. 2457T
caguuggcagaauuugaggaa

SEQ ID NO: 3843326 - RNA, 14 nt, Shigella flexneri 2a str. 2457T
caguuggcugacaa

SEQ ID NO: 3843327 - RNA, 15 nt, Shigella flexneri 2a str. 2457T
caguuggcugacaaa

SEQ ID NO: 3843328 - RNA, 15 nt, Shigella flexneri 2a str. 2457T
caguuggggaaaagu

SEQ ID NO: 3843329 - RNA, 13 nt, Shigella flexneri 2a str. 2457T
caguugguuaauc

SEQ ID NO: 3843330 - RNA, 20 nt, Shigella flexneri 2a str. 2457T
caguugguuagagcacauca

SEQ ID NO: 3843331 - RNA, 19 nt, Shigella flexneri 2a str. 2457T
caguugucagcccuuuuuc

SEQ ID NO: 3843332 - RNA, 20 nt, Shigella flexneri 2a str. 2457T
caguugucagcccuuuuuca

SEQ ID NO: 3843333 - RNA, 14 nt, Shigella flexneri 2a str. 2457T
caguuguugcugcc

SEQ ID NO: 3843334 - RNA, 17 nt, Shigella flexneri 2a str. 2457T
caguuguugcugccgac

SEQ ID NO: 3843335 - RNA, 13 nt, Shigella flexneri 2a str. 2457T
caguuuauacagc

SEQ ID NO: 3843336 - RNA, 14 nt, Shigella flexneri 2a str. 2457T
caguuucacagggu

SEQ ID NO: 3843337 - RNA, 16 nt, Shigella flexneri 2a str. 2457T
caguuucaccagcagu

SEQ ID NO: 3843338 - RNA, 15 nt, Shigella flexneri 2a str. 2457T
caguuucaccugcug

SEQ ID NO: 3843339 - RNA, 17 nt, Shigella flexneri 2a str. 2457T
caguuucagccccauca

SEQ ID NO: 3843340 - RNA, 15 nt, Shigella flexneri 2a str. 2457T
caguuucgaggcgau

SEQ ID NO: 3843341 - RNA, 14 nt, Shigella flexneri 2a str. 2457T
caguuucgccaggg

SEQ ID NO: 3843342 - RNA, 11 nt, Shigella flexneri 2a str. 2457T
caguuucugau

SEQ ID NO: 3843343 - RNA, 18 nt, Shigella flexneri 2a str. 2457T
caguuucugauacugcuc

SEQ ID NO: 3843344 - RNA, 14 nt, Shigella flexneri 2a str. 2457T
caguuucugcagcu

SEQ ID NO: 3843345 - RNA, 15 nt, Shigella flexneri 2a str. 2457T
caguuucugcagcuc

SEQ ID NO: 3843346 - RNA, 21 nt, Shigella flexneri 2a str. 2457T
caguuucuuaccuacuugcuc

SEQ ID NO: 3843347 - RNA, 12 nt, Shigella flexneri 2a str. 2457T
caguuugccaug

SEQ ID NO: 3843348 - RNA, 20 nt, Shigella flexneri 2a str. 2457T
caguuugcgcgugcugggau

SEQ ID NO: 3843349 - RNA, 17 nt, Shigella flexneri 2a str. 2457T
caguuugcucaaaucca

SEQ ID NO: 3843350 - RNA, 14 nt, Shigella flexneri 2a str. 2457T
caguuuguucagcu

SEQ ID NO: 3843351 - RNA, 24 nt, Shigella flexneri 2a str. 2457T
caguuuucgcaccgcguuuagcgu

SEQ ID NO: 3843352 - RNA, 14 nt, Shigella flexneri 2a str. 2457T
caguuuugucuucg

SEQ ID NO: 3843353 - RNA, 22 nt, Shigella flexneri 2a str. 2457T
caguuuugucuucggccauuga

SEQ ID NO: 3843354 - RNA, 15 nt, Shigella flexneri 2a str. 2457T
caguuuuucacccgc

SEQ ID NO: 3843355 - RNA, 16 nt, Shigella flexneri 2a str. 2457T
caguuuuucuuuuuca

SEQ ID NO: 3843356 - RNA, 14 nt, Shigella flexneri 2a str. 2457T
cauauaaauuucau

SEQ ID NO: 3843357 - RNA, 19 nt, Shigella flexneri 2a str. 2457T
cauauaaccggcaacagaa

SEQ ID NO: 3843358 - RNA, 12 nt, Shigella flexneri 2a str. 2457T
cauauaagcguu

SEQ ID NO: 3843359 - RNA, 15 nt, Shigella flexneri 2a str. 2457T
cauauaauacgcauc

SEQ ID NO: 3843360 - RNA, 16 nt, Shigella flexneri 2a str. 2457T
cauauaaugcaacauu

SEQ ID NO: 3843361 - RNA, 18 nt, Shigella flexneri 2a str. 2457T
cauauaccgucagcgucu

SEQ ID NO: 3843362 - RNA, 22 nt, Shigella flexneri 2a str. 2457T
cauauacgccaucgccagcagc

SEQ ID NO: 3843363 - RNA, 23 nt, Shigella flexneri 2a str. 2457T
cauauacgccaucgccagcagcc

SEQ ID NO: 3843364 - RNA, 18 nt, Shigella flexneri 2a str. 2457T
cauauaguggguaacaau

SEQ ID NO: 3843365 - RNA, 22 nt, Shigella flexneri 2a str. 2457T
cauauauuacaacguauuauau

SEQ ID NO: 3843366 - RNA, 19 nt, Shigella flexneri 2a str. 2457T
cauaucaauaguaaccaga

SEQ ID NO: 3843367 - RNA, 11 nt, Shigella flexneri 2a str. 2457T
cauaucagcgc

SEQ ID NO: 3843368 - RNA, 16 nt, Shigella flexneri 2a str. 2457T
cauaucgaaccagcgg

SEQ ID NO: 3843369 - RNA, 19 nt, Shigella flexneri 2a str. 2457T
cauaucgaaccagcggaca

SEQ ID NO: 3843370 - RNA, 16 nt, Shigella flexneri 2a str. 2457T
cauaucgguaaaugcu

SEQ ID NO: 3843371 - RNA, 17 nt, Shigella flexneri 2a str. 2457T
cauaucucccaguaagc

SEQ ID NO: 3843372 - RNA, 16 nt, Shigella flexneri 2a str. 2457T
cauaucuucaacgcac

SEQ ID NO: 3843373 - RNA, 18 nt, Shigella flexneri 2a str. 2457T
cauaugagcgucgaagaa

SEQ ID NO: 3843374 - RNA, 17 nt, Shigella flexneri 2a str. 2457T
cauaugauucauauugc

SEQ ID NO: 3843375 - RNA, 14 nt, Shigella flexneri 2a str. 2457T
cauaugcagcaucc

SEQ ID NO: 3843376 - RNA, 20 nt, Shigella flexneri 2a str. 2457T
cauaugcagcauccaacuga

SEQ ID NO: 3843377 - RNA, 14 nt, Shigella flexneri 2a str. 2457T
cauaugcaucagau

SEQ ID NO: 3843378 - RNA, 13 nt, Shigella flexneri 2a str. 2457T
cauaugccccugu

SEQ ID NO: 3843379 - RNA, 14 nt, Shigella flexneri 2a str. 2457T
cauaugcgccagcu

SEQ ID NO: 3843380 - RNA, 16 nt, Shigella flexneri 2a str. 2457T
cauaugcgcuggcagu

SEQ ID NO: 3843381 - RNA, 17 nt, Shigella flexneri 2a str. 2457T
cauauggaagaaacgcu

SEQ ID NO: 3843382 - RNA, 17 nt, Shigella flexneri 2a str. 2457T
cauauguguuugugccg

SEQ ID NO: 3843383 - RNA, 22 nt, Shigella flexneri 2a str. 2457T
cauauguguuugugcugugaca

SEQ ID NO: 3843384 - RNA, 15 nt, Shigella flexneri 2a str. 2457T
cauauguugaaaagc

SEQ ID NO: 3843385 - RNA, 13 nt, Shigella flexneri 2a str. 2457T
cauauguuuacgc

SEQ ID NO: 3843386 - RNA, 21 nt, Shigella flexneri 2a str. 2457T
cauauucaccacgaaaccgac

SEQ ID NO: 3843387 - RNA, 23 nt, Shigella flexneri 2a str. 2457T
cauauucaccacgaaaccgacug

SEQ ID NO: 3843388 - RNA, 13 nt, Shigella flexneri 2a str. 2457T
cauauucagcagc

SEQ ID NO: 3843389 - RNA, 17 nt, Shigella flexneri 2a str. 2457T
cauauucccgcaacuua

SEQ ID NO: 3843390 - RNA, 19 nt, Shigella flexneri 2a str. 2457T
cauauuccgcaccugccag

SEQ ID NO: 3843391 - RNA, 15 nt, Shigella flexneri 2a str. 2457T
cauauuccugaccca

SEQ ID NO: 3843392 - RNA, 15 nt, Shigella flexneri 2a str. 2457T
cauauucgccaccgc

SEQ ID NO: 3843393 - RNA, 17 nt, Shigella flexneri 2a str. 2457T
cauauucgccaccgcgc

SEQ ID NO: 3843394 - RNA, 18 nt, Shigella flexneri 2a str. 2457T
cauauucgccgcccugca

SEQ ID NO: 3843395 - RNA, 22 nt, Shigella flexneri 2a str. 2457T
cauauucgccgcccugcagcau

SEQ ID NO: 3843396 - RNA, 18 nt, Shigella flexneri 2a str. 2457T
cauauucgcuuucagcga

SEQ ID NO: 3843397 - RNA, 18 nt, Shigella flexneri 2a str. 2457T
cauauucugaucgugcuc

SEQ ID NO: 3843398 - RNA, 16 nt, Shigella flexneri 2a str. 2457T
cauauugccgugcccc

SEQ ID NO: 3843399 - RNA, 14 nt, Shigella flexneri 2a str. 2457T
cauauuuaaagaag

SEQ ID NO: 3843400 - RNA, 18 nt, Shigella flexneri 2a str. 2457T
cauauuuaaucaguucua

SEQ ID NO: 3843401 - RNA, 19 nt, Shigella flexneri 2a str. 2457T
cauauuuaaucaguucuac

SEQ ID NO: 3843402 - RNA, 20 nt, Shigella flexneri 2a str. 2457T
cauauuuauaggguaaauua

SEQ ID NO: 3843403 - RNA, 14 nt, Shigella flexneri 2a str. 2457T
cauauuucuccauu

SEQ ID NO: 3843404 - RNA, 22 nt, Shigella flexneri 2a str. 2457T
cauauuuucauuauugcgcaca

SEQ ID NO: 3843405 - RNA, 22 nt, Shigella flexneri 2a str. 2457T
cauauuuuucauauuuuacauc

SEQ ID NO: 3843406 - RNA, 15 nt, Shigella flexneri 2a str. 2457T
caucaaaaaaugaaa

SEQ ID NO: 3843407 - RNA, 15 nt, Shigella flexneri 2a str. 2457T
caucaaacgaagccu

SEQ ID NO: 3843408 - RNA, 19 nt, Shigella flexneri 2a str. 2457T
caucaaaggcuucaacgac

SEQ ID NO: 3843409 - RNA, 13 nt, Shigella flexneri 2a str. 2457T
caucaaagucucc

SEQ ID NO: 3843410 - RNA, 14 nt, Shigella flexneri 2a str. 2457T
caucaaaucacuaa

SEQ ID NO: 3843411 - RNA, 14 nt, Shigella flexneri 2a str. 2457T
caucaaauccccac

SEQ ID NO: 3843412 - RNA, 20 nt, Shigella flexneri 2a str. 2457T
caucaaauggcauccuugcu

SEQ ID NO: 3843413 - RNA, 22 nt, Shigella flexneri 2a str. 2457T
caucaaauuacccugcacguug

SEQ ID NO: 3843414 - RNA, 23 nt, Shigella flexneri 2a str. 2457T
caucaacaacaauuucacuugcu

SEQ ID NO: 3843415 - RNA, 21 nt, Shigella flexneri 2a str. 2457T
caucaaccaacaccuguucca

SEQ ID NO: 3843416 - RNA, 17 nt, Shigella flexneri 2a str. 2457T
caucaaccagcacaaag

SEQ ID NO: 3843417 - RNA, 20 nt, Shigella flexneri 2a str. 2457T
caucaacccgcccagugccg

SEQ ID NO: 3843418 - RNA, 13 nt, Shigella flexneri 2a str. 2457T
caucaacgccagc

SEQ ID NO: 3843419 - RNA, 13 nt, Shigella flexneri 2a str. 2457T
caucaacucaguu

SEQ ID NO: 3843420 - RNA, 13 nt, Shigella flexneri 2a str. 2457T
caucaacuggcaa

SEQ ID NO: 3843421 - RNA, 16 nt, Shigella flexneri 2a str. 2457T
caucaagcaaggccag

SEQ ID NO: 3843422 - RNA, 18 nt, Shigella flexneri 2a str. 2457T
caucaagcugugccugaa

SEQ ID NO: 3843423 - RNA, 18 nt, Shigella flexneri 2a str. 2457T
caucaagcuguucuuccc

SEQ ID NO: 3843424 - RNA, 15 nt, Shigella flexneri 2a str. 2457T
caucaaguaaccuuu

SEQ ID NO: 3843425 - RNA, 20 nt, Shigella flexneri 2a str. 2457T
caucaaguaaccuuuaucgc

SEQ ID NO: 3843426 - RNA, 14 nt, Shigella flexneri 2a str. 2457T
caucaaguagcagg

SEQ ID NO: 3843427 - RNA, 22 nt, Shigella flexneri 2a str. 2457T
caucaaguagcagguaaucugc

SEQ ID NO: 3843428 - RNA, 15 nt, Shigella flexneri 2a str. 2457T
caucaagucagaugc

SEQ ID NO: 3843429 - RNA, 13 nt, Shigella flexneri 2a str. 2457T
caucaauaaacaa

SEQ ID NO: 3843430 - RNA, 15 nt, Shigella flexneri 2a str. 2457T
caucaauaaacaaug

SEQ ID NO: 3843431 - RNA, 21 nt, Shigella flexneri 2a str. 2457T
caucaauaccauuaucauuga

SEQ ID NO: 3843432 - RNA, 21 nt, Shigella flexneri 2a str. 2457T
caucaauaccugguccuucau

SEQ ID NO: 3843433 - RNA, 15 nt, Shigella flexneri 2a str. 2457T
caucaauccaaacau

SEQ ID NO: 3843434 - RNA, 21 nt, Shigella flexneri 2a str. 2457T
caucaaucccuucgacuuuca

SEQ ID NO: 3843435 - RNA, 14 nt, Shigella flexneri 2a str. 2457T
caucaaugaccuga

SEQ ID NO: 3843436 - RNA, 16 nt, Shigella flexneri 2a str. 2457T
caucaaugaccuuuuu

SEQ ID NO: 3843437 - RNA, 13 nt, Shigella flexneri 2a str. 2457T
caucaaugccagc

SEQ ID NO: 3843438 - RNA, 16 nt, Shigella flexneri 2a str. 2457T
caucaaugccagcaua

SEQ ID NO: 3843439 - RNA, 17 nt, Shigella flexneri 2a str. 2457T
caucaauugcucacucc

SEQ ID NO: 3843440 - RNA, 13 nt, Shigella flexneri 2a str. 2457T
caucacaauggca

SEQ ID NO: 3843441 - RNA, 23 nt, Shigella flexneri 2a str. 2457T
caucacaauuccggugcgccaga

SEQ ID NO: 3843442 - RNA, 23 nt, Shigella flexneri 2a str. 2457T
caucacaccgcgaucuuccacgc

SEQ ID NO: 3843443 - RNA, 18 nt, Shigella flexneri 2a str. 2457T
caucacauagcgguaagc

SEQ ID NO: 3843444 - RNA, 17 nt, Shigella flexneri 2a str. 2457T
caucacaucccagcaga

SEQ ID NO: 3843445 - RNA, 19 nt, Shigella flexneri 2a str. 2457T
caucaccaaugaaagcccc

SEQ ID NO: 3843446 - RNA, 14 nt, Shigella flexneri 2a str. 2457T
caucaccacugacg

SEQ ID NO: 3843447 - RNA, 17 nt, Shigella flexneri 2a str. 2457T
caucacccaacaauaac

SEQ ID NO: 3843448 - RNA, 23 nt, Shigella flexneri 2a str. 2457T
caucaccgaugcccucaauaucu

SEQ ID NO: 3843449 - RNA, 17 nt, Shigella flexneri 2a str. 2457T
caucaccgcgaggccua

SEQ ID NO: 3843450 - RNA, 14 nt, Shigella flexneri 2a str. 2457T
caucaccggagaau

SEQ ID NO: 3843451 - RNA, 21 nt, Shigella flexneri 2a str. 2457T
caucaccugagcuggcagacc

SEQ ID NO: 3843452 - RNA, 13 nt, Shigella flexneri 2a str. 2457T
caucacgaaaucc

SEQ ID NO: 3843453 - RNA, 17 nt, Shigella flexneri 2a str. 2457T
caucacgacagcaccac

SEQ ID NO: 3843454 - RNA, 20 nt, Shigella flexneri 2a str. 2457T
cauccccaaaaaaucaacga

SEQ ID NO: 3843455 - RNA, 22 nt, Shigella flexneri 2a str. 2457T
cauccccauaucccggaaggca

SEQ ID NO: 3843456 - RNA, 17 nt, Shigella flexneri 2a str. 2457T
cauccccggcaaccaca

SEQ ID NO: 3843457 - RNA, 18 nt, Shigella flexneri 2a str. 2457T
caucccggcagagaaaau

SEQ ID NO: 3843458 - RNA, 23 nt, Shigella flexneri 2a str. 2457T
caucccgguaucaaagcgccaga

SEQ ID NO: 3843459 - RNA, 15 nt, Shigella flexneri 2a str. 2457T
caucccgguuauuaa

SEQ ID NO: 3843460 - RNA, 21 nt, Shigella flexneri 2a str. 2457T
caucccuguaaaacgcgcccu

SEQ ID NO: 3843461 - RNA, 18 nt, Shigella flexneri 2a str. 2457T
cauccgacaaggcaucag

SEQ ID NO: 3843462 - RNA, 21 nt, Shigella flexneri 2a str. 2457T
cauccgacaaggcaucagauc

SEQ ID NO: 3843463 - RNA, 13 nt, Shigella flexneri 2a str. 2457T
cauccgacacugg

SEQ ID NO: 3843464 - RNA, 17 nt, Shigella flexneri 2a str. 2457T
cauccgacauuugcaca

SEQ ID NO: 3843465 - RNA, 15 nt, Shigella flexneri 2a str. 2457T
cauccgcacaauccc

SEQ ID NO: 3843466 - RNA, 13 nt, Shigella flexneri 2a str. 2457T
cauccgcgcaaua

SEQ ID NO: 3843467 - RNA, 17 nt, Shigella flexneri 2a str. 2457T
cauccgcgcgcguaagc

SEQ ID NO: 3843468 - RNA, 21 nt, Shigella flexneri 2a str. 2457T
cauccgcgucggcaaguaccc

SEQ ID NO: 3843469 - RNA, 14 nt, Shigella flexneri 2a str. 2457T
cauccgcucccugg

SEQ ID NO: 3843470 - RNA, 13 nt, Shigella flexneri 2a str. 2457T
cauccgcugcggu

SEQ ID NO: 3843471 - RNA, 18 nt, Shigella flexneri 2a str. 2457T
cauccggauacagcccca

SEQ ID NO: 3843472 - RNA, 16 nt, Shigella flexneri 2a str. 2457T
cauccggcaaaaacaa

SEQ ID NO: 3843473 - RNA, 21 nt, Shigella flexneri 2a str. 2457T
cauccggcaacaucaaauuac

SEQ ID NO: 3843474 - RNA, 23 nt, Shigella flexneri 2a str. 2457T
cauccggcaacccuugacgcggu

SEQ ID NO: 3843475 - RNA, 15 nt, Shigella flexneri 2a str. 2457T
cauccggcaauaagc

SEQ ID NO: 3843476 - RNA, 14 nt, Shigella flexneri 2a str. 2457T
cauccggcaauauu

SEQ ID NO: 3843477 - RNA, 21 nt, Shigella flexneri 2a str. 2457T
cauccggcaaucggugcaaau

SEQ ID NO: 3843478 - RNA, 19 nt, Shigella flexneri 2a str. 2457T
cauccggcaauucucucug

SEQ ID NO: 3843479 - RNA, 19 nt, Shigella flexneri 2a str. 2457T
cauccggcaauucucugcu

SEQ ID NO: 3843480 - RNA, 19 nt, Shigella flexneri 2a str. 2457T
cauccggcacucuuucagc

SEQ ID NO: 3843481 - RNA, 22 nt, Shigella flexneri 2a str. 2457T
cauccggcagccgugcccaacu

SEQ ID NO: 3843482 - RNA, 16 nt, Shigella flexneri 2a str. 2457T
cauccggcauauuaac

SEQ ID NO: 3843483 - RNA, 22 nt, Shigella flexneri 2a str. 2457T
cauccggcaugaacaaagcgca

SEQ ID NO: 3843484 - RNA, 18 nt, Shigella flexneri 2a str. 2457T
cauccggcaugauaccga

SEQ ID NO: 3843485 - RNA, 21 nt, Shigella flexneri 2a str. 2457T
cauccggcauucagugcaaau

SEQ ID NO: 3843486 - RNA, 13 nt, Shigella flexneri 2a str. 2457T
cauccggccagua

SEQ ID NO: 3843487 - RNA, 16 nt, Shigella flexneri 2a str. 2457T
cauccgggcgaacugg

SEQ ID NO: 3843488 - RNA, 17 nt, Shigella flexneri 2a str. 2457T
cauccgggguucgaauc

SEQ ID NO: 3843489 - RNA, 22 nt, Shigella flexneri 2a str. 2457T
cauccgguuaucgucugcgcca

SEQ ID NO: 3843490 - RNA, 23 nt, Shigella flexneri 2a str. 2457T
cauccgugaauaaugcaaaaagg

SEQ ID NO: 3843491 - RNA, 14 nt, Shigella flexneri 2a str. 2457T
cauccguuucccug

SEQ ID NO: 3843492 - RNA, 22 nt, Shigella flexneri 2a str. 2457T
cauccguuucucuguucagccu

SEQ ID NO: 3843493 - RNA, 21 nt, Shigella flexneri 2a str. 2457T
cauccuaaaggcaaaaugcca

SEQ ID NO: 3843494 - RNA, 16 nt, Shigella flexneri 2a str. 2457T
cauccucuauauuuca

SEQ ID NO: 3843495 - RNA, 17 nt, Shigella flexneri 2a str. 2457T
cauccucuucugccugc

SEQ ID NO: 3843496 - RNA, 14 nt, Shigella flexneri 2a str. 2457T
cauccugcggcagc

SEQ ID NO: 3843497 - RNA, 19 nt, Shigella flexneri 2a str. 2457T
cauccugcggcagcuccag

SEQ ID NO: 3843498 - RNA, 21 nt, Shigella flexneri 2a str. 2457T
cauccugcggcagcuccagca

SEQ ID NO: 3843499 - RNA, 14 nt, Shigella flexneri 2a str. 2457T
cauccugcucaagu

SEQ ID NO: 3843500 - RNA, 21 nt, Shigella flexneri 2a str. 2457T
cauccuggggguucaucacca

SEQ ID NO: 3843501 - RNA, 21 nt, Shigella flexneri 2a str. 2457T
cauccugguaguccaggaugu

SEQ ID NO: 3843502 - RNA, 17 nt, Shigella flexneri 2a str. 2457T
cauccuucacacugccu

SEQ ID NO: 3843503 - RNA, 18 nt, Shigella flexneri 2a str. 2457T
cauccuucacacugccuc

SEQ ID NO: 3843504 - RNA, 16 nt, Shigella flexneri 2a str. 2457T
caucgaaaacgccacc

SEQ ID NO: 3843505 - RNA, 14 nt, Shigella flexneri 2a str. 2457T
caucgacagcaaau

SEQ ID NO: 3843506 - RNA, 13 nt, Shigella flexneri 2a str. 2457T
caucgacccagaa

SEQ ID NO: 3843507 - RNA, 23 nt, Shigella flexneri 2a str. 2457T
caucgacguagugaaaucgccaa

SEQ ID NO: 3843508 - RNA, 14 nt, Shigella flexneri 2a str. 2457T
caucgacucaagcg

SEQ ID NO: 3843509 - RNA, 16 nt, Shigella flexneri 2a str. 2457T
caucgauaaucaccga

SEQ ID NO: 3843510 - RNA, 17 nt, Shigella flexneri 2a str. 2457T
caucgauauuaucuuca

SEQ ID NO: 3843511 - RNA, 17 nt, Shigella flexneri 2a str. 2457T
caucgaugagaugacgc

SEQ ID NO: 3843512 - RNA, 16 nt, Shigella flexneri 2a str. 2457T
caucgauuuugcaaua

SEQ ID NO: 3843513 - RNA, 16 nt, Shigella flexneri 2a str. 2457T
caucgcaaaccagacg

SEQ ID NO: 3843514 - RNA, 17 nt, Shigella flexneri 2a str. 2457T
caucgcaaaccagacgc

SEQ ID NO: 3843515 - RNA, 21 nt, Shigella flexneri 2a str. 2457T
caucgcacgagaaaaaaugac

SEQ ID NO: 3843516 - RNA, 13 nt, Shigella flexneri 2a str. 2457T
caucgcagcaaac

SEQ ID NO: 3843517 - RNA, 20 nt, Shigella flexneri 2a str. 2457T
caucgcagggaucauccacc

SEQ ID NO: 3843518 - RNA, 19 nt, Shigella flexneri 2a str. 2457T
caucgcauaaaccacagac

SEQ ID NO: 3843519 - RNA, 16 nt, Shigella flexneri 2a str. 2457T
caucgcauacaaaaac

SEQ ID NO: 3843520 - RNA, 15 nt, Shigella flexneri 2a str. 2457T
caucgcaucaaaguu

SEQ ID NO: 3843521 - RNA, 14 nt, Shigella flexneri 2a str. 2457T
caucgccaaacagg

SEQ ID NO: 3843522 - RNA, 21 nt, Shigella flexneri 2a str. 2457T
caucgccaccguuauccugau

SEQ ID NO: 3843523 - RNA, 14 nt, Shigella flexneri 2a str. 2457T
caucgccagaaauc

SEQ ID NO: 3843524 - RNA, 18 nt, Shigella flexneri 2a str. 2457T
caucgccagagaagaaca

SEQ ID NO: 3843525 - RNA, 21 nt, Shigella flexneri 2a str. 2457T
caucgccagcgaauuccaguu

SEQ ID NO: 3843526 - RNA, 16 nt, Shigella flexneri 2a str. 2457T
caucgccagcucaagg

SEQ ID NO: 3843527 - RNA, 18 nt, Shigella flexneri 2a str. 2457T
caucgccagugccgccca

SEQ ID NO: 3843528 - RNA, 17 nt, Shigella flexneri 2a str. 2457T
caucgccaguuuugcca

SEQ ID NO: 3843529 - RNA, 20 nt, Shigella flexneri 2a str. 2457T
caucgccauaauaagcgcca

SEQ ID NO: 3843530 - RNA, 14 nt, Shigella flexneri 2a str. 2457T
caucgcccacauca

SEQ ID NO: 3843531 - RNA, 14 nt, Shigella flexneri 2a str. 2457T
caucgcccaggcga

SEQ ID NO: 3843532 - RNA, 21 nt, Shigella flexneri 2a str. 2457T
caucgcccugauggcgcgcca

SEQ ID NO: 3843533 - RNA, 19 nt, Shigella flexneri 2a str. 2457T
caucgcccuuuuuucaggu

SEQ ID NO: 3843534 - RNA, 18 nt, Shigella flexneri 2a str. 2457T
caucgccugaucgcgcag

SEQ ID NO: 3843535 - RNA, 15 nt, Shigella flexneri 2a str. 2457T
caucgccuuccagcg

SEQ ID NO: 3843536 - RNA, 14 nt, Shigella flexneri 2a str. 2457T
caucgccuucuuga

SEQ ID NO: 3843537 - RNA, 12 nt, Shigella flexneri 2a str. 2457T
caucgcgccaac

SEQ ID NO: 3843538 - RNA, 19 nt, Shigella flexneri 2a str. 2457T
caucgcgcccaaaccaccc

SEQ ID NO: 3843539 - RNA, 18 nt, Shigella flexneri 2a str. 2457T
caucgcgcccgccgccau

SEQ ID NO: 3843540 - RNA, 13 nt, Shigella flexneri 2a str. 2457T
caucgcgcuggug

SEQ ID NO: 3843541 - RNA, 23 nt, Shigella flexneri 2a str. 2457T
caucgcgcuuaucgccagcgcca

SEQ ID NO: 3843542 - RNA, 14 nt, Shigella flexneri 2a str. 2457T
caucgcuacaccaa

SEQ ID NO: 3843543 - RNA, 15 nt, Shigella flexneri 2a str. 2457T
caucgcuacaccaau

SEQ ID NO: 3843544 - RNA, 20 nt, Shigella flexneri 2a str. 2457T
caucgcuacaccaaucguca

SEQ ID NO: 3843545 - RNA, 18 nt, Shigella flexneri 2a str. 2457T
caucgcuacauaacgcag

SEQ ID NO: 3843546 - RNA, 14 nt, Shigella flexneri 2a str. 2457T
caucgcuccacgcc

SEQ ID NO: 3843547 - RNA, 21 nt, Shigella flexneri 2a str. 2457T
caucgcuccacgccauaugug

SEQ ID NO: 3843548 - RNA, 23 nt, Shigella flexneri 2a str. 2457T
caucgcugauuucaccaucuuca

SEQ ID NO: 3843549 - RNA, 15 nt, Shigella flexneri 2a str. 2457T
caucgcugugcugcu

SEQ ID NO: 3843550 - RNA, 19 nt, Shigella flexneri 2a str. 2457T
caucgcuucaugcccgcca

SEQ ID NO: 3843551 - RNA, 15 nt, Shigella flexneri 2a str. 2457T
caugacuuugaucug

SEQ ID NO: 3843552 - RNA, 19 nt, Shigella flexneri 2a str. 2457T
caugacuuuguaggccgga

SEQ ID NO: 3843553 - RNA, 15 nt, Shigella flexneri 2a str. 2457T
caugagaacaguuca

SEQ ID NO: 3843554 - RNA, 22 nt, Shigella flexneri 2a str. 2457T
caugagagaaaaucacacuacc

SEQ ID NO: 3843555 - RNA, 17 nt, Shigella flexneri 2a str. 2457T
caugagcgaauaaaaaa

SEQ ID NO: 3843556 - RNA, 19 nt, Shigella flexneri 2a str. 2457T
caugagcgaauaaaaaaag

SEQ ID NO: 3843557 - RNA, 22 nt, Shigella flexneri 2a str. 2457T
caugagcgaauaaaaaaagaaa

SEQ ID NO: 3843558 - RNA, 16 nt, Shigella flexneri 2a str. 2457T
caugaguaaaauaaca

SEQ ID NO: 3843559 - RNA, 20 nt, Shigella flexneri 2a str. 2457T
caugaguaacagucaguuau

SEQ ID NO: 3843560 - RNA, 19 nt, Shigella flexneri 2a str. 2457T
caugauaagacgcgccagc

SEQ ID NO: 3843561 - RNA, 20 nt, Shigella flexneri 2a str. 2457T
caugauaagacgcgccagcg

SEQ ID NO: 3843562 - RNA, 18 nt, Shigella flexneri 2a str. 2457T
caugauaccgauuacuca

SEQ ID NO: 3843563 - RNA, 13 nt, Shigella flexneri 2a str. 2457T
caugauaugccug

SEQ ID NO: 3843564 - RNA, 21 nt, Shigella flexneri 2a str. 2457T
caugauauuggcaucgccaga

SEQ ID NO: 3843565 - RNA, 18 nt, Shigella flexneri 2a str. 2457T
caugaucauucaccagcc

SEQ ID NO: 3843566 - RNA, 14 nt, Shigella flexneri 2a str. 2457T
caugaugacaacau

SEQ ID NO: 3843567 - RNA, 18 nt, Shigella flexneri 2a str. 2457T
caugaugacaacauagcu

SEQ ID NO: 3843568 - RNA, 18 nt, Shigella flexneri 2a str. 2457T
caugauguaagaugaaau

SEQ ID NO: 3843569 - RNA, 22 nt, Shigella flexneri 2a str. 2457T
caugauucggcgguaguuaagc

SEQ ID NO: 3843570 - RNA, 12 nt, Shigella flexneri 2a str. 2457T
caugauuucugc

SEQ ID NO: 3843571 - RNA, 20 nt, Shigella flexneri 2a str. 2457T
caugauuuuguaggccggau

SEQ ID NO: 3843572 - RNA, 10 nt, Shigella flexneri 2a str. 2457T
caugcaauaa

SEQ ID NO: 3843573 - RNA, 22 nt, Shigella flexneri 2a str. 2457T
caugcaauuaccgccaccagga

SEQ ID NO: 3843574 - RNA, 13 nt, Shigella flexneri 2a str. 2457T
caugcacccucaa

SEQ ID NO: 3843575 - RNA, 20 nt, Shigella flexneri 2a str. 2457T
caugcacgggcgcuuguuau

SEQ ID NO: 3843576 - RNA, 15 nt, Shigella flexneri 2a str. 2457T
caugcacuccgcugu

SEQ ID NO: 3843577 - RNA, 14 nt, Shigella flexneri 2a str. 2457T
caugcacugcaacg

SEQ ID NO: 3843578 - RNA, 13 nt, Shigella flexneri 2a str. 2457T
caugcagcauggu

SEQ ID NO: 3843579 - RNA, 17 nt, Shigella flexneri 2a str. 2457T
caugcagcauggucagg

SEQ ID NO: 3843580 - RNA, 13 nt, Shigella flexneri 2a str. 2457T
caugcagcuccac

SEQ ID NO: 3843581 - RNA, 14 nt, Shigella flexneri 2a str. 2457T
caugcagcuccacc

SEQ ID NO: 3843582 - RNA, 15 nt, Shigella flexneri 2a str. 2457T
caugcagcuccaccg

SEQ ID NO: 3843583 - RNA, 22 nt, Shigella flexneri 2a str. 2457T
caugcagggcaaacucugagag

SEQ ID NO: 3843584 - RNA, 23 nt, Shigella flexneri 2a str. 2457T
caugcagggcaaacucugagaga

SEQ ID NO: 3843585 - RNA, 15 nt, Shigella flexneri 2a str. 2457T
caugcauaaugcagc

SEQ ID NO: 3843586 - RNA, 16 nt, Shigella flexneri 2a str. 2457T
caugcaucgguuuugc

SEQ ID NO: 3843587 - RNA, 16 nt, Shigella flexneri 2a str. 2457T
caugcauuuaagaaaa

SEQ ID NO: 3843588 - RNA, 16 nt, Shigella flexneri 2a str. 2457T
caugccaaaagggagc

SEQ ID NO: 3843589 - RNA, 15 nt, Shigella flexneri 2a str. 2457T
caugccaaaucaaug

SEQ ID NO: 3843590 - RNA, 21 nt, Shigella flexneri 2a str. 2457T
caugccacacacgauccugca

SEQ ID NO: 3843591 - RNA, 14 nt, Shigella flexneri 2a str. 2457T
caugccauauuguu

SEQ ID NO: 3843592 - RNA, 17 nt, Shigella flexneri 2a str. 2457T
caugccauauuguuuca

SEQ ID NO: 3843593 - RNA, 15 nt, Shigella flexneri 2a str. 2457T
caugccauccgcauc

SEQ ID NO: 3843594 - RNA, 16 nt, Shigella flexneri 2a str. 2457T
caugccaucugccagc

SEQ ID NO: 3843595 - RNA, 16 nt, Shigella flexneri 2a str. 2457T
caugcccgugcugaca

SEQ ID NO: 3843596 - RNA, 17 nt, Shigella flexneri 2a str. 2457T
caugccgaucgucuggg

SEQ ID NO: 3843597 - RNA, 16 nt, Shigella flexneri 2a str. 2457T
caugccgaugccgacg

SEQ ID NO: 3843598 - RNA, 17 nt, Shigella flexneri 2a str. 2457T
caugccggccagcgcca

SEQ ID NO: 3843599 - RNA, 20 nt, Shigella flexneri 2a str. 2457T
caugccggccagcgccacca

SEQ ID NO: 3843600 - RNA, 23 nt, Shigella flexneri 2a str. 2457T
caugccgggcaaaagucaccagu

SEQ ID NO: 3843601 - RNA, 17 nt, Shigella flexneri 2a str. 2457T
caugccggugaugccgc

SEQ ID NO: 3843602 - RNA, 16 nt, Shigella flexneri 2a str. 2457T
caugccgucaaaaaac

SEQ ID NO: 3843603 - RNA, 16 nt, Shigella flexneri 2a str. 2457T
caugccgugaugcgca

SEQ ID NO: 3843604 - RNA, 20 nt, Shigella flexneri 2a str. 2457T
caugccuuguuugaucaucg

SEQ ID NO: 3843605 - RNA, 23 nt, Shigella flexneri 2a str. 2457T
caugcgaucccacgccgaaugcc

SEQ ID NO: 3843606 - RNA, 13 nt, Shigella flexneri 2a str. 2457T
caugcgauggagu

SEQ ID NO: 3843607 - RNA, 21 nt, Shigella flexneri 2a str. 2457T
caugcgauggagugagaaugc

SEQ ID NO: 3843608 - RNA, 17 nt, Shigella flexneri 2a str. 2457T
caugcgcagcauaaucg

SEQ ID NO: 3843609 - RNA, 21 nt, Shigella flexneri 2a str. 2457T
caugcgguucacgcgccagag

SEQ ID NO: 3843610 - RNA, 14 nt, Shigella flexneri 2a str. 2457T
caugcguuuguagg

SEQ ID NO: 3843611 - RNA, 16 nt, Shigella flexneri 2a str. 2457T
caugcguuuguaggcg

SEQ ID NO: 3843612 - RNA, 17 nt, Shigella flexneri 2a str. 2457T
caugcucagaugccuga

SEQ ID NO: 3843613 - RNA, 23 nt, Shigella flexneri 2a str. 2457T
caugcucagaugccugaugcggc

SEQ ID NO: 3843614 - RNA, 16 nt, Shigella flexneri 2a str. 2457T
caugcuggaaccacag

SEQ ID NO: 3843615 - RNA, 19 nt, Shigella flexneri 2a str. 2457T
caugcuggaaccacagcgc

SEQ ID NO: 3843616 - RNA, 15 nt, Shigella flexneri 2a str. 2457T
caugcuggauggcgc

SEQ ID NO: 3843617 - RNA, 22 nt, Shigella flexneri 2a str. 2457T
caugcugucggcugccagccau

SEQ ID NO: 3843618 - RNA, 12 nt, Shigella flexneri 2a str. 2457T
caugcuucugca

SEQ ID NO: 3843619 - RNA, 23 nt, Shigella flexneri 2a str. 2457T
caugcuucugcacgcuugccugu

SEQ ID NO: 3843620 - RNA, 18 nt, Shigella flexneri 2a str. 2457T
cauggaagaaaaauauaa

SEQ ID NO: 3843621 - RNA, 17 nt, Shigella flexneri 2a str. 2457T
cauggacgaaaucuacg

SEQ ID NO: 3843622 - RNA, 22 nt, Shigella flexneri 2a str. 2457T
cauggagaacgccuguguccug

SEQ ID NO: 3843623 - RNA, 16 nt, Shigella flexneri 2a str. 2457T
cauggauaaaauuauc

SEQ ID NO: 3843624 - RNA, 16 nt, Shigella flexneri 2a str. 2457T
cauggauucgaugauc

SEQ ID NO: 3843625 - RNA, 16 nt, Shigella flexneri 2a str. 2457T
cauggcaacuaacuga

SEQ ID NO: 3843626 - RNA, 22 nt, Shigella flexneri 2a str. 2457T
cauggcaacuaacugacuuccg

SEQ ID NO: 3843627 - RNA, 14 nt, Shigella flexneri 2a str. 2457T
cauggcaagaauaa

SEQ ID NO: 3843628 - RNA, 14 nt, Shigella flexneri 2a str. 2457T
cauggcagaagcau

SEQ ID NO: 3843629 - RNA, 14 nt, Shigella flexneri 2a str. 2457T
cauggccuguguua

SEQ ID NO: 3843630 - RNA, 17 nt, Shigella flexneri 2a str. 2457T
cauggcgcgacauggcg

SEQ ID NO: 3843631 - RNA, 12 nt, Shigella flexneri 2a str. 2457T
cauggcguccgu

SEQ ID NO: 3843632 - RNA, 16 nt, Shigella flexneri 2a str. 2457T
cauggcucaccagcag

SEQ ID NO: 3843633 - RNA, 21 nt, Shigella flexneri 2a str. 2457T
cauggcugacugucgcagcca

SEQ ID NO: 3843634 - RNA, 20 nt, Shigella flexneri 2a str. 2457T
caugggagaacgaugcugcu

SEQ ID NO: 3843635 - RNA, 15 nt, Shigella flexneri 2a str. 2457T
caugguaaaaccgac

SEQ ID NO: 3843636 - RNA, 20 nt, Shigella flexneri 2a str. 2457T
caugguaacgccccacaaac

SEQ ID NO: 3843637 - RNA, 18 nt, Shigella flexneri 2a str. 2457T
cauggucggcagagaguu

SEQ ID NO: 3843638 - RNA, 23 nt, Shigella flexneri 2a str. 2457T
cauggugaauaucaguuauuaca

SEQ ID NO: 3843639 - RNA, 13 nt, Shigella flexneri 2a str. 2457T
cauggugcacauu

SEQ ID NO: 3843640 - RNA, 23 nt, Shigella flexneri 2a str. 2457T
cauggugcacauugcggacuucc

SEQ ID NO: 3843641 - RNA, 23 nt, Shigella flexneri 2a str. 2457T
caugguggaaaucgaacuucccg

SEQ ID NO: 3843642 - RNA, 13 nt, Shigella flexneri 2a str. 2457T
cauggugucacca

SEQ ID NO: 3843643 - RNA, 15 nt, Shigella flexneri 2a str. 2457T
cauggugucugauga

SEQ ID NO: 3843644 - RNA, 14 nt, Shigella flexneri 2a str. 2457T
caugguguucagau

SEQ ID NO: 3843645 - RNA, 21 nt, Shigella flexneri 2a str. 2457T
caugguuggccaucguaugau

SEQ ID NO: 3843646 - RNA, 18 nt, Shigella flexneri 2a str. 2457T
caugguuugcauccacaa

SEQ ID NO: 3843647 - RNA, 22 nt, Shigella flexneri 2a str. 2457T
cauguaaaaggcgcuaaaaaua

SEQ ID NO: 3843648 - RNA, 12 nt, Shigella flexneri 2a str. 2457T
cauucuccgagg

SEQ ID NO: 3843649 - RNA, 12 nt, Shigella flexneri 2a str. 2457T
cauucugacugg

SEQ ID NO: 3843650 - RNA, 22 nt, Shigella flexneri 2a str. 2457T
cauucuuaccgggucgcacugg

SEQ ID NO: 3843651 - RNA, 16 nt, Shigella flexneri 2a str. 2457T
cauucuuccuccagcg

SEQ ID NO: 3843652 - RNA, 19 nt, Shigella flexneri 2a str. 2457T
cauucuugccaucaaucac

SEQ ID NO: 3843653 - RNA, 23 nt, Shigella flexneri 2a str. 2457T
cauucuugccaucaaucacuuug

SEQ ID NO: 3843654 - RNA, 23 nt, Shigella flexneri 2a str. 2457T
cauugaacgggugauuuccccua

SEQ ID NO: 3843655 - RNA, 20 nt, Shigella flexneri 2a str. 2457T
cauugaacuuguagcuuuca

SEQ ID NO: 3843656 - RNA, 17 nt, Shigella flexneri 2a str. 2457T
cauugaagaauuuuugc

SEQ ID NO: 3843657 - RNA, 11 nt, Shigella flexneri 2a str. 2457T
cauugaaugcg

SEQ ID NO: 3843658 - RNA, 19 nt, Shigella flexneri 2a str. 2457T
cauugacgauagcgccgcc

SEQ ID NO: 3843659 - RNA, 14 nt, Shigella flexneri 2a str. 2457T
cauugacguuccuu

SEQ ID NO: 3843660 - RNA, 21 nt, Shigella flexneri 2a str. 2457T
cauugagaaagcccuggcgca

SEQ ID NO: 3843661 - RNA, 21 nt, Shigella flexneri 2a str. 2457T
cauugagucccaucuuuuuaa

SEQ ID NO: 3843662 - RNA, 14 nt, Shigella flexneri 2a str. 2457T
cauugauaauguua

SEQ ID NO: 3843663 - RNA, 16 nt, Shigella flexneri 2a str. 2457T
cauugauauacagccc

SEQ ID NO: 3843664 - RNA, 20 nt, Shigella flexneri 2a str. 2457T
cauugaugcguuagaugaug

SEQ ID NO: 3843665 - RNA, 16 nt, Shigella flexneri 2a str. 2457T
cauugauggcgcuuuc

SEQ ID NO: 3843666 - RNA, 23 nt, Shigella flexneri 2a str. 2457T
cauugcagucauaaccaguccau

SEQ ID NO: 3843667 - RNA, 15 nt, Shigella flexneri 2a str. 2457T
cauugcaguuaucug

SEQ ID NO: 3843668 - RNA, 22 nt, Shigella flexneri 2a str. 2457T
cauugcauaaacaccugcggcg

SEQ ID NO: 3843669 - RNA, 13 nt, Shigella flexneri 2a str. 2457T
cauugcaucaucg

SEQ ID NO: 3843670 - RNA, 20 nt, Shigella flexneri 2a str. 2457T
cauugccagagugaaaaugc

SEQ ID NO: 3843671 - RNA, 21 nt, Shigella flexneri 2a str. 2457T
cauugccgggcgcaucagauc

SEQ ID NO: 3843672 - RNA, 21 nt, Shigella flexneri 2a str. 2457T
cauugccguugauaaagaguu

SEQ ID NO: 3843673 - RNA, 17 nt, Shigella flexneri 2a str. 2457T
cauugccugaugcgcua

SEQ ID NO: 3843674 - RNA, 11 nt, Shigella flexneri 2a str. 2457T
cauugccuggc

SEQ ID NO: 3843675 - RNA, 21 nt, Shigella flexneri 2a str. 2457T
cauugcgguucguugauaaua

SEQ ID NO: 3843676 - RNA, 13 nt, Shigella flexneri 2a str. 2457T
cauugcguaacca

SEQ ID NO: 3843677 - RNA, 17 nt, Shigella flexneri 2a str. 2457T
cauugcguugauaugca

SEQ ID NO: 3843678 - RNA, 21 nt, Shigella flexneri 2a str. 2457T
cauugcguuuaguuacaccac

SEQ ID NO: 3843679 - RNA, 16 nt, Shigella flexneri 2a str. 2457T
cauugcuauuuccacc

SEQ ID NO: 3843680 - RNA, 15 nt, Shigella flexneri 2a str. 2457T
cauugcucacuuccu

SEQ ID NO: 3843681 - RNA, 16 nt, Shigella flexneri 2a str. 2457T
cauugcucacuuccuu

SEQ ID NO: 3843682 - RNA, 20 nt, Shigella flexneri 2a str. 2457T
cauugcucacuuccuuuuuu

SEQ ID NO: 3843683 - RNA, 16 nt, Shigella flexneri 2a str. 2457T
cauugcucucuucucc

SEQ ID NO: 3843684 - RNA, 14 nt, Shigella flexneri 2a str. 2457T
cauugcugccagaa

SEQ ID NO: 3843685 - RNA, 15 nt, Shigella flexneri 2a str. 2457T
cauugcugccgccag

SEQ ID NO: 3843686 - RNA, 20 nt, Shigella flexneri 2a str. 2457T
cauugcuuuuuugauuacag

SEQ ID NO: 3843687 - RNA, 22 nt, Shigella flexneri 2a str. 2457T
cauuggccggaauaccacuuuc

SEQ ID NO: 3843688 - RNA, 19 nt, Shigella flexneri 2a str. 2457T
cauugggccacucaacauc

SEQ ID NO: 3843689 - RNA, 21 nt, Shigella flexneri 2a str. 2457T
cauugguugcuggaaagagaa

SEQ ID NO: 3843690 - RNA, 23 nt, Shigella flexneri 2a str. 2457T
cauugguuuuuugguaaugacuc

SEQ ID NO: 3843691 - RNA, 23 nt, Shigella flexneri 2a str. 2457T
cauugucgggccgcacgcuguau

SEQ ID NO: 3843692 - RNA, 13 nt, Shigella flexneri 2a str. 2457T
cauugucucccac

SEQ ID NO: 3843693 - RNA, 19 nt, Shigella flexneri 2a str. 2457T
cauugucucccacaugcug

SEQ ID NO: 3843694 - RNA, 23 nt, Shigella flexneri 2a str. 2457T
cauugugaccuuugacucagcgu

SEQ ID NO: 3843695 - RNA, 14 nt, Shigella flexneri 2a str. 2457T
cauugugugaaauc

SEQ ID NO: 3843696 - RNA, 13 nt, Shigella flexneri 2a str. 2457T
cauuguguuaucc

SEQ ID NO: 3843697 - RNA, 20 nt, Shigella flexneri 2a str. 2457T
cauuuaaacaauuucagaau

SEQ ID NO: 3843698 - RNA, 15 nt, Shigella flexneri 2a str. 2457T
cauuuaaaucaauaa

SEQ ID NO: 3843699 - RNA, 14 nt, Shigella flexneri 2a str. 2457T
cauuuaagaaaaaa

SEQ ID NO: 3843700 - RNA, 20 nt, Shigella flexneri 2a str. 2457T
cauuuaccgcaacucauuua

SEQ ID NO: 3843701 - RNA, 23 nt, Shigella flexneri 2a str. 2457T
cauuuaccgcaacucauuuacag

SEQ ID NO: 3843702 - RNA, 20 nt, Shigella flexneri 2a str. 2457T
cauuuagcgccggguuuuuu

SEQ ID NO: 3843703 - RNA, 17 nt, Shigella flexneri 2a str. 2457T
cauuuaugccauguuca

SEQ ID NO: 3843704 - RNA, 14 nt, Shigella flexneri 2a str. 2457T
cauuuauguucagc

SEQ ID NO: 3843705 - RNA, 23 nt, Shigella flexneri 2a str. 2457T
cauuuauguucagccgucaucca

SEQ ID NO: 3843706 - RNA, 13 nt, Shigella flexneri 2a str. 2457T
cauuuauuaccuu

SEQ ID NO: 3843707 - RNA, 16 nt, Shigella flexneri 2a str. 2457T
cauuucaaucacauca

SEQ ID NO: 3843708 - RNA, 22 nt, Shigella flexneri 2a str. 2457T
cauuucaccgucaucgacaaaa

SEQ ID NO: 3843709 - RNA, 16 nt, Shigella flexneri 2a str. 2457T
cauuucacucacgccg

SEQ ID NO: 3843710 - RNA, 19 nt, Shigella flexneri 2a str. 2457T
cauuucauauucaaaaucc

SEQ ID NO: 3843711 - RNA, 16 nt, Shigella flexneri 2a str. 2457T
cauuucaucgccagcg

SEQ ID NO: 3843712 - RNA, 15 nt, Shigella flexneri 2a str. 2457T
cauuuccaagauuaa

SEQ ID NO: 3843713 - RNA, 19 nt, Shigella flexneri 2a str. 2457T
cauuucccagcaagaacca

SEQ ID NO: 3843714 - RNA, 13 nt, Shigella flexneri 2a str. 2457T
cauuuccccaauc

SEQ ID NO: 3843715 - RNA, 18 nt, Shigella flexneri 2a str. 2457T
cauuuccccaaucuucuc

SEQ ID NO: 3843716 - RNA, 16 nt, Shigella flexneri 2a str. 2457T
cauuucccggaauaau

SEQ ID NO: 3843717 - RNA, 14 nt, Shigella flexneri 2a str. 2457T
cauuucgucuucau

SEQ ID NO: 3843718 - RNA, 23 nt, Shigella flexneri 2a str. 2457T
cauuucgugcggguaaccagcca

SEQ ID NO: 3843719 - RNA, 19 nt, Shigella flexneri 2a str. 2457T
cauuucuccagcaguucua

SEQ ID NO: 3843720 - RNA, 19 nt, Shigella flexneri 2a str. 2457T
cauuucucgguauuacaau

SEQ ID NO: 3843721 - RNA, 16 nt, Shigella flexneri 2a str. 2457T
cauuucugccauucca

SEQ ID NO: 3843722 - RNA, 19 nt, Shigella flexneri 2a str. 2457T
cauuucugcugccuacaca

SEQ ID NO: 3843723 - RNA, 23 nt, Shigella flexneri 2a str. 2457T
cauuucuggacgauugugcuggu

SEQ ID NO: 3843724 - RNA, 14 nt, Shigella flexneri 2a str. 2457T
cauuucuggcguca

SEQ ID NO: 3843725 - RNA, 18 nt, Shigella flexneri 2a str. 2457T
cauuucuggugucacagu

SEQ ID NO: 3843726 - RNA, 22 nt, Shigella flexneri 2a str. 2457T
cauuucuggugucacagugaau

SEQ ID NO: 3843727 - RNA, 14 nt, Shigella flexneri 2a str. 2457T
cauuugauucacaa

SEQ ID NO: 3843728 - RNA, 12 nt, Shigella flexneri 2a str. 2457T
cauuugcacaag

SEQ ID NO: 3843729 - RNA, 14 nt, Shigella flexneri 2a str. 2457T
cauuugcaccgauu

SEQ ID NO: 3843730 - RNA, 17 nt, Shigella flexneri 2a str. 2457T
cauuugccagcuucagc

SEQ ID NO: 3843731 - RNA, 19 nt, Shigella flexneri 2a str. 2457T
cauuugcuccagacgccag

SEQ ID NO: 3843732 - RNA, 19 nt, Shigella flexneri 2a str. 2457T
cauuuggcggggauuuuuu

SEQ ID NO: 3843733 - RNA, 15 nt, Shigella flexneri 2a str. 2457T
cauuugugacauuaa

SEQ ID NO: 3843734 - RNA, 16 nt, Shigella flexneri 2a str. 2457T
cauuuguggguucagc

SEQ ID NO: 3843735 - RNA, 13 nt, Shigella flexneri 2a str. 2457T
cauuuuaauaaug

SEQ ID NO: 3843736 - RNA, 14 nt, Shigella flexneri 2a str. 2457T
cauuuuacguugca

SEQ ID NO: 3843737 - RNA, 23 nt, Shigella flexneri 2a str. 2457T
cauuuucucgcgaaccgccuggc

SEQ ID NO: 3843738 - RNA, 21 nt, Shigella flexneri 2a str. 2457T
cauuuucucgcggacugccug

SEQ ID NO: 3843739 - RNA, 23 nt, Shigella flexneri 2a str. 2457T
cauuuucucgcggacugccuggc

SEQ ID NO: 3843740 - RNA, 17 nt, Shigella flexneri 2a str. 2457T
cauuuucugcccauuua

SEQ ID NO: 3843741 - RNA, 15 nt, Shigella flexneri 2a str. 2457T
cauuuucuucagcag

SEQ ID NO: 3843742 - RNA, 14 nt, Shigella flexneri 2a str. 2457T
cauuuugacccggu

SEQ ID NO: 3843743 - RNA, 20 nt, Shigella flexneri 2a str. 2457T
cauuuugacuuuuacagcuu

SEQ ID NO: 3843744 - RNA, 15 nt, Shigella flexneri 2a str. 2457T
cauuuugcacauucc

SEQ ID NO: 3843745 - RNA, 23 nt, Shigella flexneri 2a str. 2457T
ccaaucagacucauauaaaaacc

SEQ ID NO: 3843746 - RNA, 17 nt, Shigella flexneri 2a str. 2457T
ccaaucagcacacauaa

SEQ ID NO: 3843747 - RNA, 19 nt, Shigella flexneri 2a str. 2457T
ccaaucagcgcagcaccca

SEQ ID NO: 3843748 - RNA, 16 nt, Shigella flexneri 2a str. 2457T
ccaaucagguaagcaa

SEQ ID NO: 3843749 - RNA, 20 nt, Shigella flexneri 2a str. 2457T
ccaaucauucccauuuauuu

SEQ ID NO: 3843750 - RNA, 22 nt, Shigella flexneri 2a str. 2457T
ccaauccagaacaccauaauga

SEQ ID NO: 3843751 - RNA, 20 nt, Shigella flexneri 2a str. 2457T
ccaaucccccacuuuuaaau

SEQ ID NO: 3843752 - RNA, 14 nt, Shigella flexneri 2a str. 2457T
ccaaucccgccaua

SEQ ID NO: 3843753 - RNA, 15 nt, Shigella flexneri 2a str. 2457T
ccaaucucccagccg

SEQ ID NO: 3843754 - RNA, 15 nt, Shigella flexneri 2a str. 2457T
ccaaucugugccgcu

SEQ ID NO: 3843755 - RNA, 15 nt, Shigella flexneri 2a str. 2457T
ccaaugaccacuccg

SEQ ID NO: 3843756 - RNA, 16 nt, Shigella flexneri 2a str. 2457T
ccaaugccguucucug

SEQ ID NO: 3843757 - RNA, 17 nt, Shigella flexneri 2a str. 2457T
ccaaugccguucucugg

SEQ ID NO: 3843758 - RNA, 18 nt, Shigella flexneri 2a str. 2457T
ccaauggcuuuugccgcc

SEQ ID NO: 3843759 - RNA, 22 nt, Shigella flexneri 2a str. 2457T
ccaauguaauacgcucaucugg

SEQ ID NO: 3843760 - RNA, 22 nt, Shigella flexneri 2a str. 2457T
ccaaugucgaaagccccagccc

SEQ ID NO: 3843761 - RNA, 16 nt, Shigella flexneri 2a str. 2457T
ccaauuccgcagcgcg

SEQ ID NO: 3843762 - RNA, 13 nt, Shigella flexneri 2a str. 2457T
ccaauugaacucu

SEQ ID NO: 3843763 - RNA, 18 nt, Shigella flexneri 2a str. 2457T
ccaauugcacauauuuuu

SEQ ID NO: 3843764 - RNA, 23 nt, Shigella flexneri 2a str. 2457T
ccaauuucugugcagccaaaaau

SEQ ID NO: 3843765 - RNA, 15 nt, Shigella flexneri 2a str. 2457T
ccacaaaaaccgcug

SEQ ID NO: 3843766 - RNA, 16 nt, Shigella flexneri 2a str. 2457T
ccacaaacccgccaga

SEQ ID NO: 3843767 - RNA, 13 nt, Shigella flexneri 2a str. 2457T
ccacaaacucuuu

SEQ ID NO: 3843768 - RNA, 20 nt, Shigella flexneri 2a str. 2457T
ccacaaagcagacaacccac

SEQ ID NO: 3843769 - RNA, 18 nt, Shigella flexneri 2a str. 2457T
ccacaaagggagagggau

SEQ ID NO: 3843770 - RNA, 21 nt, Shigella flexneri 2a str. 2457T
ccacaacuggcuugguaacau

SEQ ID NO: 3843771 - RNA, 23 nt, Shigella flexneri 2a str. 2457T
ccacaauugaccaguaauauccc

SEQ ID NO: 3843772 - RNA, 16 nt, Shigella flexneri 2a str. 2457T
ccacaccaccaugcua

SEQ ID NO: 3843773 - RNA, 21 nt, Shigella flexneri 2a str. 2457T
ccacaccaccgcaaucgccag

SEQ ID NO: 3843774 - RNA, 15 nt, Shigella flexneri 2a str. 2457T
ccacaccacugcgca

SEQ ID NO: 3843775 - RNA, 15 nt, Shigella flexneri 2a str. 2457T
ccacaccagcuuucg

SEQ ID NO: 3843776 - RNA, 15 nt, Shigella flexneri 2a str. 2457T
ccacacccacaucaa

SEQ ID NO: 3843777 - RNA, 16 nt, Shigella flexneri 2a str. 2457T
ccacaccggaccagac

SEQ ID NO: 3843778 - RNA, 16 nt, Shigella flexneri 2a str. 2457T
ccacaccuggugcagc

SEQ ID NO: 3843779 - RNA, 16 nt, Shigella flexneri 2a str. 2457T
ccacacgcccaacuaa

SEQ ID NO: 3843780 - RNA, 22 nt, Shigella flexneri 2a str. 2457T
ccacagacaaaauccugccagc

SEQ ID NO: 3843781 - RNA, 19 nt, Shigella flexneri 2a str. 2457T
ccacagacaaacagcucga

SEQ ID NO: 3843782 - RNA, 17 nt, Shigella flexneri 2a str. 2457T
ccacagacaaucgccag

SEQ ID NO: 3843783 - RNA, 13 nt, Shigella flexneri 2a str. 2457T
ccacagccagcca

SEQ ID NO: 3843784 - RNA, 20 nt, Shigella flexneri 2a str. 2457T
ccacagccgagcgccaccau

SEQ ID NO: 3843785 - RNA, 17 nt, Shigella flexneri 2a str. 2457T
ccacagcucacggcccu

SEQ ID NO: 3843786 - RNA, 13 nt, Shigella flexneri 2a str. 2457T
ccacagcucugcu

SEQ ID NO: 3843787 - RNA, 15 nt, Shigella flexneri 2a str. 2457T
ccacagcucugcugu

SEQ ID NO: 3843788 - RNA, 16 nt, Shigella flexneri 2a str. 2457T
ccacagcucugcuguc

SEQ ID NO: 3843789 - RNA, 16 nt, Shigella flexneri 2a str. 2457T
ccacaggccggagcca

SEQ ID NO: 3843790 - RNA, 22 nt, Shigella flexneri 2a str. 2457T
ccacagugacccgcagccagca

SEQ ID NO: 3843791 - RNA, 23 nt, Shigella flexneri 2a str. 2457T
ccacagugacccgcagccagcac

SEQ ID NO: 3843792 - RNA, 18 nt, Shigella flexneri 2a str. 2457T
ccacaguugaucagccag

SEQ ID NO: 3843793 - RNA, 21 nt, Shigella flexneri 2a str. 2457T
ccacaguuucauaucugccag

SEQ ID NO: 3843794 - RNA, 12 nt, Shigella flexneri 2a str. 2457T
ccacaucagcgg

SEQ ID NO: 3843795 - RNA, 14 nt, Shigella flexneri 2a str. 2457T
ccacaucagcggca

SEQ ID NO: 3843796 - RNA, 13 nt, Shigella flexneri 2a str. 2457T
ccacauccagugg

SEQ ID NO: 3843797 - RNA, 12 nt, Shigella flexneri 2a str. 2457T
ccacauccggca

SEQ ID NO: 3843798 - RNA, 21 nt, Shigella flexneri 2a str. 2457T
ccacauccggcauauuaacca

SEQ ID NO: 3843799 - RNA, 13 nt, Shigella flexneri 2a str. 2457T
ccacauccggcuu

SEQ ID NO: 3843800 - RNA, 19 nt, Shigella flexneri 2a str. 2457T
ccacaucggcaucaggcca

SEQ ID NO: 3843801 - RNA, 17 nt, Shigella flexneri 2a str. 2457T
ccacaugccugcauaaa

SEQ ID NO: 3843802 - RNA, 23 nt, Shigella flexneri 2a str. 2457T
ccacauucagccguaacucaucc

SEQ ID NO: 3843803 - RNA, 16 nt, Shigella flexneri 2a str. 2457T
ccacauucgaaugccg

SEQ ID NO: 3843804 - RNA, 23 nt, Shigella flexneri 2a str. 2457T
ccacauucugcaucgcgcugaac

SEQ ID NO: 3843805 - RNA, 15 nt, Shigella flexneri 2a str. 2457T
ccaccaaacugcgcc

SEQ ID NO: 3843806 - RNA, 16 nt, Shigella flexneri 2a str. 2457T
ccaccaaacugcgccc

SEQ ID NO: 3843807 - RNA, 14 nt, Shigella flexneri 2a str. 2457T
ccaccaaagauguc

SEQ ID NO: 3843808 - RNA, 18 nt, Shigella flexneri 2a str. 2457T
ccaccaauggcuggccug

SEQ ID NO: 3843809 - RNA, 12 nt, Shigella flexneri 2a str. 2457T
ccaccacaaaag

SEQ ID NO: 3843810 - RNA, 21 nt, Shigella flexneri 2a str. 2457T
ccaccacagacaaucgccagu

SEQ ID NO: 3843811 - RNA, 23 nt, Shigella flexneri 2a str. 2457T
ccaccacagacaaucgccaguga

SEQ ID NO: 3843812 - RNA, 14 nt, Shigella flexneri 2a str. 2457T
ccaccaccaccugc

SEQ ID NO: 3843813 - RNA, 18 nt, Shigella flexneri 2a str. 2457T
ccaccaccgcaaaauagg

SEQ ID NO: 3843814 - RNA, 22 nt, Shigella flexneri 2a str. 2457T
ccaccacgcggggguaaaaccc

SEQ ID NO: 3843815 - RNA, 22 nt, Shigella flexneri 2a str. 2457T
ccaccacguccagagugaugcg

SEQ ID NO: 3843816 - RNA, 13 nt, Shigella flexneri 2a str. 2457T
ccaccacugcaau

SEQ ID NO: 3843817 - RNA, 19 nt, Shigella flexneri 2a str. 2457T
ccaccagaaucgccagcau

SEQ ID NO: 3843818 - RNA, 23 nt, Shigella flexneri 2a str. 2457T
ccaccagacaaccgcucaacaaa

SEQ ID NO: 3843819 - RNA, 13 nt, Shigella flexneri 2a str. 2457T
ccaccagauggcu

SEQ ID NO: 3843820 - RNA, 13 nt, Shigella flexneri 2a str. 2457T
ccaccagcaccag

SEQ ID NO: 3843821 - RNA, 18 nt, Shigella flexneri 2a str. 2457T
ccaccagcaccgcgacaa

SEQ ID NO: 3843822 - RNA, 23 nt, Shigella flexneri 2a str. 2457T
ccaccagccccagaauucacgca

SEQ ID NO: 3843823 - RNA, 21 nt, Shigella flexneri 2a str. 2457T
ccaccagcgccgcgccacuac

SEQ ID NO: 3843824 - RNA, 13 nt, Shigella flexneri 2a str. 2457T
ccaccaggaacgc

SEQ ID NO: 3843825 - RNA, 15 nt, Shigella flexneri 2a str. 2457T
ccaccaggccacggc

SEQ ID NO: 3843826 - RNA, 19 nt, Shigella flexneri 2a str. 2457T
ccaccaguaccucuucgcu

SEQ ID NO: 3843827 - RNA, 12 nt, Shigella flexneri 2a str. 2457T
ccaccagugcca

SEQ ID NO: 3843828 - RNA, 22 nt, Shigella flexneri 2a str. 2457T
ccaccaugcuaauagcugcgcc

SEQ ID NO: 3843829 - RNA, 18 nt, Shigella flexneri 2a str. 2457T
ccaccauguucacugccg

SEQ ID NO: 3843830 - RNA, 21 nt, Shigella flexneri 2a str. 2457T
ccaccauuuuacguccgcgca

SEQ ID NO: 3843831 - RNA, 14 nt, Shigella flexneri 2a str. 2457T
ccacccaccagcgc

SEQ ID NO: 3843832 - RNA, 16 nt, Shigella flexneri 2a str. 2457T
ccacccaccagcgccg

SEQ ID NO: 3843833 - RNA, 15 nt, Shigella flexneri 2a str. 2457T
ccacccaccgcagcc

SEQ ID NO: 3843834 - RNA, 13 nt, Shigella flexneri 2a str. 2457T
ccacccagcagcg

SEQ ID NO: 3843835 - RNA, 16 nt, Shigella flexneri 2a str. 2457T
ccacccagcgccgcca

SEQ ID NO: 3843836 - RNA, 22 nt, Shigella flexneri 2a str. 2457T
ccaccccacgauguauccggca

SEQ ID NO: 3843837 - RNA, 18 nt, Shigella flexneri 2a str. 2457T
ccacccgaucgcucauau

SEQ ID NO: 3843838 - RNA, 15 nt, Shigella flexneri 2a str. 2457T
ccacccgcagcaagc

SEQ ID NO: 3843839 - RNA, 13 nt, Shigella flexneri 2a str. 2457T
ccacccgcagcca

SEQ ID NO: 3843840 - RNA, 22 nt, Shigella flexneri 2a str. 2457T
ccacccuggcaacccgggcucc

SEQ ID NO: 3843841 - RNA, 13 nt, Shigella flexneri 2a str. 2457T
ccaccgaagcuuu

SEQ ID NO: 3843842 - RNA, 23 nt, Shigella flexneri 2a str. 2457T
ccagaacugauaacgcauuucau

SEQ ID NO: 3843843 - RNA, 13 nt, Shigella flexneri 2a str. 2457T
ccagaacugaucc

SEQ ID NO: 3843844 - RNA, 14 nt, Shigella flexneri 2a str. 2457T
ccagaagaauauca

SEQ ID NO: 3843845 - RNA, 17 nt, Shigella flexneri 2a str. 2457T
ccagaagaugcguucac

SEQ ID NO: 3843846 - RNA, 19 nt, Shigella flexneri 2a str. 2457T
ccagaagcacugccagaau

SEQ ID NO: 3843847 - RNA, 19 nt, Shigella flexneri 2a str. 2457T
ccagaagggguaaugccag

SEQ ID NO: 3843848 - RNA, 15 nt, Shigella flexneri 2a str. 2457T
ccagaauaaacaacu

SEQ ID NO: 3843849 - RNA, 19 nt, Shigella flexneri 2a str. 2457T
ccagaauaccuugcugcuc

SEQ ID NO: 3843850 - RNA, 13 nt, Shigella flexneri 2a str. 2457T
ccagaauccagga

SEQ ID NO: 3843851 - RNA, 13 nt, Shigella flexneri 2a str. 2457T
ccagaaugcccca

SEQ ID NO: 3843852 - RNA, 17 nt, Shigella flexneri 2a str. 2457T
ccagaauuaacgcugac

SEQ ID NO: 3843853 - RNA, 20 nt, Shigella flexneri 2a str. 2457T
ccagaauucacgcacuuccg

SEQ ID NO: 3843854 - RNA, 16 nt, Shigella flexneri 2a str. 2457T
ccagacaaaagcgaag

SEQ ID NO: 3843855 - RNA, 13 nt, Shigella flexneri 2a str. 2457T
ccagacaaaccac

SEQ ID NO: 3843856 - RNA, 12 nt, Shigella flexneri 2a str. 2457T
ccagacaaauga

SEQ ID NO: 3843857 - RNA, 16 nt, Shigella flexneri 2a str. 2457T
ccagacaaaugaacac

SEQ ID NO: 3843858 - RNA, 19 nt, Shigella flexneri 2a str. 2457T
ccagacaauggcccgccgc

SEQ ID NO: 3843859 - RNA, 21 nt, Shigella flexneri 2a str. 2457T
ccagacaauugccgccagcuc

SEQ ID NO: 3843860 - RNA, 22 nt, Shigella flexneri 2a str. 2457T
ccagacaauugccgccagcuca

SEQ ID NO: 3843861 - RNA, 19 nt, Shigella flexneri 2a str. 2457T
ccagacagcacauuucaga

SEQ ID NO: 3843862 - RNA, 16 nt, Shigella flexneri 2a str. 2457T
ccagacaucaccagua

SEQ ID NO: 3843863 - RNA, 15 nt, Shigella flexneri 2a str. 2457T
ccagaccaaacagca

SEQ ID NO: 3843864 - RNA, 14 nt, Shigella flexneri 2a str. 2457T
ccagaccaauagaa

SEQ ID NO: 3843865 - RNA, 20 nt, Shigella flexneri 2a str. 2457T
ccagacccaguuuugcgcgu

SEQ ID NO: 3843866 - RNA, 20 nt, Shigella flexneri 2a str. 2457T
ccagaccguggucagaaaag

SEQ ID NO: 3843867 - RNA, 20 nt, Shigella flexneri 2a str. 2457T
ccagaccugaauuugcucca

SEQ ID NO: 3843868 - RNA, 17 nt, Shigella flexneri 2a str. 2457T
ccagacgaauaaaacag

SEQ ID NO: 3843869 - RNA, 16 nt, Shigella flexneri 2a str. 2457T
ccagacgagagugacg

SEQ ID NO: 3843870 - RNA, 22 nt, Shigella flexneri 2a str. 2457T
ccagacgcaacagaaacgccau

SEQ ID NO: 3843871 - RNA, 12 nt, Shigella flexneri 2a str. 2457T
ccagacgccaga

SEQ ID NO: 3843872 - RNA, 13 nt, Shigella flexneri 2a str. 2457T
ccagacgccagcc

SEQ ID NO: 3843873 - RNA, 18 nt, Shigella flexneri 2a str. 2457T
ccagacgcgcagcuucac

SEQ ID NO: 3843874 - RNA, 19 nt, Shigella flexneri 2a str. 2457T
ccagacgcgcguccccugc

SEQ ID NO: 3843875 - RNA, 19 nt, Shigella flexneri 2a str. 2457T
ccagacgguaaccccucuu

SEQ ID NO: 3843876 - RNA, 19 nt, Shigella flexneri 2a str. 2457T
ccagacguccggcgcugca

SEQ ID NO: 3843877 - RNA, 15 nt, Shigella flexneri 2a str. 2457T
ccagacucaacaggc

SEQ ID NO: 3843878 - RNA, 16 nt, Shigella flexneri 2a str. 2457T
ccagacucaacaggcc

SEQ ID NO: 3843879 - RNA, 21 nt, Shigella flexneri 2a str. 2457T
ccagacucgccagacgcaucg

SEQ ID NO: 3843880 - RNA, 20 nt, Shigella flexneri 2a str. 2457T
ccagacugaucaucgcccag

SEQ ID NO: 3843881 - RNA, 14 nt, Shigella flexneri 2a str. 2457T
ccagacugcucagc

SEQ ID NO: 3843882 - RNA, 17 nt, Shigella flexneri 2a str. 2457T
ccagacuggagcacugc

SEQ ID NO: 3843883 - RNA, 20 nt, Shigella flexneri 2a str. 2457T
ccagagagaacugcgccaga

SEQ ID NO: 3843884 - RNA, 14 nt, Shigella flexneri 2a str. 2457T
ccagagagaagcug

SEQ ID NO: 3843885 - RNA, 16 nt, Shigella flexneri 2a str. 2457T
ccagagcaucuacugg

SEQ ID NO: 3843886 - RNA, 13 nt, Shigella flexneri 2a str. 2457T
ccagagccugaag

SEQ ID NO: 3843887 - RNA, 14 nt, Shigella flexneri 2a str. 2457T
ccagagccugaagg

SEQ ID NO: 3843888 - RNA, 19 nt, Shigella flexneri 2a str. 2457T
ccagaggagccaucaccau

SEQ ID NO: 3843889 - RNA, 14 nt, Shigella flexneri 2a str. 2457T
ccagagugaccgcc

SEQ ID NO: 3843890 - RNA, 16 nt, Shigella flexneri 2a str. 2457T
ccagagugaccgccaa

SEQ ID NO: 3843891 - RNA, 14 nt, Shigella flexneri 2a str. 2457T
ccagauaagacacu

SEQ ID NO: 3843892 - RNA, 15 nt, Shigella flexneri 2a str. 2457T
ccagauaagacacua

SEQ ID NO: 3843893 - RNA, 15 nt, Shigella flexneri 2a str. 2457T
ccagauaagacacug

SEQ ID NO: 3843894 - RNA, 12 nt, Shigella flexneri 2a str. 2457T
ccagauaagacg

SEQ ID NO: 3843895 - RNA, 18 nt, Shigella flexneri 2a str. 2457T
ccagauaaucaccugccu

SEQ ID NO: 3843896 - RNA, 18 nt, Shigella flexneri 2a str. 2457T
ccagauaaugagaaacac

SEQ ID NO: 3843897 - RNA, 18 nt, Shigella flexneri 2a str. 2457T
ccagauacaaaaaaggcc

SEQ ID NO: 3843898 - RNA, 18 nt, Shigella flexneri 2a str. 2457T
ccagauacaucagcgaca

SEQ ID NO: 3843899 - RNA, 19 nt, Shigella flexneri 2a str. 2457T
ccagauagcaacagcagcc

SEQ ID NO: 3843900 - RNA, 13 nt, Shigella flexneri 2a str. 2457T
ccagauagccagg

SEQ ID NO: 3843901 - RNA, 15 nt, Shigella flexneri 2a str. 2457T
ccagauagccagguu

SEQ ID NO: 3843902 - RNA, 15 nt, Shigella flexneri 2a str. 2457T
ccagaucagcuucac

SEQ ID NO: 3843903 - RNA, 18 nt, Shigella flexneri 2a str. 2457T
ccagauccugauccugca

SEQ ID NO: 3843904 - RNA, 17 nt, Shigella flexneri 2a str. 2457T
ccagaucgaucauauuu

SEQ ID NO: 3843905 - RNA, 15 nt, Shigella flexneri 2a str. 2457T
ccagaucgccugccg

SEQ ID NO: 3843906 - RNA, 17 nt, Shigella flexneri 2a str. 2457T
ccagaucgccugccgcc

SEQ ID NO: 3843907 - RNA, 18 nt, Shigella flexneri 2a str. 2457T
ccagaucgccugccgcca

SEQ ID NO: 3843908 - RNA, 19 nt, Shigella flexneri 2a str. 2457T
ccagaucgcgguaaucacg

SEQ ID NO: 3843909 - RNA, 20 nt, Shigella flexneri 2a str. 2457T
ccagaucgcucaucugcugc

SEQ ID NO: 3843910 - RNA, 18 nt, Shigella flexneri 2a str. 2457T
ccagaugcgacgcuggcc

SEQ ID NO: 3843911 - RNA, 18 nt, Shigella flexneri 2a str. 2457T
ccagauggacaaaagccc

SEQ ID NO: 3843912 - RNA, 21 nt, Shigella flexneri 2a str. 2457T
ccagauggcuuuccaccauca

SEQ ID NO: 3843913 - RNA, 18 nt, Shigella flexneri 2a str. 2457T
ccagauggcuuugcccuu

SEQ ID NO: 3843914 - RNA, 19 nt, Shigella flexneri 2a str. 2457T
ccagauguugucucagauu

SEQ ID NO: 3843915 - RNA, 15 nt, Shigella flexneri 2a str. 2457T
ccagauuaauuauug

SEQ ID NO: 3843916 - RNA, 17 nt, Shigella flexneri 2a str. 2457T
ccagauuaccagcgaca

SEQ ID NO: 3843917 - RNA, 18 nt, Shigella flexneri 2a str. 2457T
ccagauugccgauauaaa

SEQ ID NO: 3843918 - RNA, 17 nt, Shigella flexneri 2a str. 2457T
ccagauuuaacggcagc

SEQ ID NO: 3843919 - RNA, 22 nt, Shigella flexneri 2a str. 2457T
ccagauuuuuauccaguuguuc

SEQ ID NO: 3843920 - RNA, 14 nt, Shigella flexneri 2a str. 2457T
ccagcaaaaucacc

SEQ ID NO: 3843921 - RNA, 15 nt, Shigella flexneri 2a str. 2457T
ccagcaaaaucacca

SEQ ID NO: 3843922 - RNA, 22 nt, Shigella flexneri 2a str. 2457T
ccagcaaauccacaacggcauu

SEQ ID NO: 3843923 - RNA, 20 nt, Shigella flexneri 2a str. 2457T
ccagcaacaaauaaccgccu

SEQ ID NO: 3843924 - RNA, 13 nt, Shigella flexneri 2a str. 2457T
ccagcaacaacag

SEQ ID NO: 3843925 - RNA, 14 nt, Shigella flexneri 2a str. 2457T
ccagcaacaacagc

SEQ ID NO: 3843926 - RNA, 17 nt, Shigella flexneri 2a str. 2457T
ccagcaacaacagcgcg

SEQ ID NO: 3843927 - RNA, 23 nt, Shigella flexneri 2a str. 2457T
ccagcaacaagccaguccagaaa

SEQ ID NO: 3843928 - RNA, 17 nt, Shigella flexneri 2a str. 2457T
ccagcaaccaacgccag

SEQ ID NO: 3843929 - RNA, 19 nt, Shigella flexneri 2a str. 2457T
ccagcaaccaacgccagca

SEQ ID NO: 3843930 - RNA, 19 nt, Shigella flexneri 2a str. 2457T
ccagcaaccaaugccacca

SEQ ID NO: 3843931 - RNA, 15 nt, Shigella flexneri 2a str. 2457T
ccagcaacugauaaa

SEQ ID NO: 3843932 - RNA, 18 nt, Shigella flexneri 2a str. 2457T
ccagcaacugauggccca

SEQ ID NO: 3843933 - RNA, 13 nt, Shigella flexneri 2a str. 2457T
ccagcaagaacca

SEQ ID NO: 3843934 - RNA, 23 nt, Shigella flexneri 2a str. 2457T
ccagcaagaaccaugcaauuacc

SEQ ID NO: 3843935 - RNA, 23 nt, Shigella flexneri 2a str. 2457T
ccagcaaggcgcuaaaagcauag

SEQ ID NO: 3843936 - RNA, 21 nt, Shigella flexneri 2a str. 2457T
ccagcaaggguucaccgguga

SEQ ID NO: 3843937 - RNA, 16 nt, Shigella flexneri 2a str. 2457T
ccagcaauaaugccag

SEQ ID NO: 3843938 - RNA, 17 nt, Shigella flexneri 2a str. 2457T
ccagcaauccccagaca

SEQ ID NO: 3843939 - RNA, 19 nt, Shigella flexneri 2a str. 2457T
ccagcaauccccagacaaa

SEQ ID NO: 3843940 - RNA, 17 nt, Shigella flexneri 2a str. 2457T
ccagcggauaaagcaga

SEQ ID NO: 3843941 - RNA, 20 nt, Shigella flexneri 2a str. 2457T
ccagcggauaaagcagagca

SEQ ID NO: 3843942 - RNA, 15 nt, Shigella flexneri 2a str. 2457T
ccagcggaugaccca

SEQ ID NO: 3843943 - RNA, 14 nt, Shigella flexneri 2a str. 2457T
ccagcggcagcucg

SEQ ID NO: 3843944 - RNA, 16 nt, Shigella flexneri 2a str. 2457T
ccagcggcggcacagc

SEQ ID NO: 3843945 - RNA, 23 nt, Shigella flexneri 2a str. 2457T
ccagcggcugcugauguucgcca

SEQ ID NO: 3843946 - RNA, 13 nt, Shigella flexneri 2a str. 2457T
ccagcgggcguca

SEQ ID NO: 3843947 - RNA, 21 nt, Shigella flexneri 2a str. 2457T
ccagcgggcgucaaaaucauc

SEQ ID NO: 3843948 - RNA, 12 nt, Shigella flexneri 2a str. 2457T
ccagcguaaauc

SEQ ID NO: 3843949 - RNA, 15 nt, Shigella flexneri 2a str. 2457T
ccagcguaaauccug

SEQ ID NO: 3843950 - RNA, 23 nt, Shigella flexneri 2a str. 2457T
ccagcguaaauccugacgcuggg

SEQ ID NO: 3843951 - RNA, 15 nt, Shigella flexneri 2a str. 2457T
ccagcguacguaacu

SEQ ID NO: 3843952 - RNA, 18 nt, Shigella flexneri 2a str. 2457T
ccagcguagugaaggcaa

SEQ ID NO: 3843953 - RNA, 15 nt, Shigella flexneri 2a str. 2457T
ccagcgucagccaga

SEQ ID NO: 3843954 - RNA, 22 nt, Shigella flexneri 2a str. 2457T
ccagcgucaucauagacuuccc

SEQ ID NO: 3843955 - RNA, 23 nt, Shigella flexneri 2a str. 2457T
ccagcgucaucauagacuucccu

SEQ ID NO: 3843956 - RNA, 17 nt, Shigella flexneri 2a str. 2457T
ccagcgucgcacccggc

SEQ ID NO: 3843957 - RNA, 18 nt, Shigella flexneri 2a str. 2457T
ccagcgucgcauccgaca

SEQ ID NO: 3843958 - RNA, 17 nt, Shigella flexneri 2a str. 2457T
ccagcguggucauggca

SEQ ID NO: 3843959 - RNA, 19 nt, Shigella flexneri 2a str. 2457T
ccagcguguugaggaagcg

SEQ ID NO: 3843960 - RNA, 17 nt, Shigella flexneri 2a str. 2457T
ccagcguguugccgcuu

SEQ ID NO: 3843961 - RNA, 23 nt, Shigella flexneri 2a str. 2457T
ccagcguuagauccccgcucucc

SEQ ID NO: 3843962 - RNA, 17 nt, Shigella flexneri 2a str. 2457T
ccagcguuaucccaucc

SEQ ID NO: 3843963 - RNA, 22 nt, Shigella flexneri 2a str. 2457T
ccagcguugauguuccuccucg

SEQ ID NO: 3843964 - RNA, 21 nt, Shigella flexneri 2a str. 2457T
ccagcguuuccagcaccaguu

SEQ ID NO: 3843965 - RNA, 14 nt, Shigella flexneri 2a str. 2457T
ccagcucaaacgaa

SEQ ID NO: 3843966 - RNA, 12 nt, Shigella flexneri 2a str. 2457T
ccagcuccagcc

SEQ ID NO: 3843967 - RNA, 16 nt, Shigella flexneri 2a str. 2457T
ccagcuccauccacca

SEQ ID NO: 3843968 - RNA, 15 nt, Shigella flexneri 2a str. 2457T
ccagcuccggcaccu

SEQ ID NO: 3843969 - RNA, 18 nt, Shigella flexneri 2a str. 2457T
ccagcuccguccagccac

SEQ ID NO: 3843970 - RNA, 14 nt, Shigella flexneri 2a str. 2457T
ccagcucuucuuca

SEQ ID NO: 3843971 - RNA, 15 nt, Shigella flexneri 2a str. 2457T
ccagcucuucuucac

SEQ ID NO: 3843972 - RNA, 19 nt, Shigella flexneri 2a str. 2457T
ccagcucuucuucacucuc

SEQ ID NO: 3843973 - RNA, 18 nt, Shigella flexneri 2a str. 2457T
ccagcugcucgcgagaac

SEQ ID NO: 3843974 - RNA, 13 nt, Shigella flexneri 2a str. 2457T
ccagcuggcagaa

SEQ ID NO: 3843975 - RNA, 12 nt, Shigella flexneri 2a str. 2457T
ccagcugucaaa

SEQ ID NO: 3843976 - RNA, 22 nt, Shigella flexneri 2a str. 2457T
ccagcuguggucuuuaaugaca

SEQ ID NO: 3843977 - RNA, 21 nt, Shigella flexneri 2a str. 2457T
ccagcuucccaaagaucuccu

SEQ ID NO: 3843978 - RNA, 17 nt, Shigella flexneri 2a str. 2457T
ccagcuugcuuuccagc

SEQ ID NO: 3843979 - RNA, 19 nt, Shigella flexneri 2a str. 2457T
ccagcuugucauacggauu

SEQ ID NO: 3843980 - RNA, 21 nt, Shigella flexneri 2a str. 2457T
ccaggaaccugugacagcagc

SEQ ID NO: 3843981 - RNA, 22 nt, Shigella flexneri 2a str. 2457T
ccaggaaccugugacagcagcg

SEQ ID NO: 3843982 - RNA, 23 nt, Shigella flexneri 2a str. 2457T
ccaggaaccugugacagcagcgg

SEQ ID NO: 3843983 - RNA, 17 nt, Shigella flexneri 2a str. 2457T
ccaggaacgcgccaaga

SEQ ID NO: 3843984 - RNA, 19 nt, Shigella flexneri 2a str. 2457T
ccaggaacgggauugccag

SEQ ID NO: 3843985 - RNA, 18 nt, Shigella flexneri 2a str. 2457T
ccaggaacuccagaucca

SEQ ID NO: 3843986 - RNA, 17 nt, Shigella flexneri 2a str. 2457T
ccaggaagcgacccggu

SEQ ID NO: 3843987 - RNA, 18 nt, Shigella flexneri 2a str. 2457T
ccaggaauuugguccuga

SEQ ID NO: 3843988 - RNA, 16 nt, Shigella flexneri 2a str. 2457T
ccaggacgcaguccag

SEQ ID NO: 3843989 - RNA, 18 nt, Shigella flexneri 2a str. 2457T
ccaggagcguauucagca

SEQ ID NO: 3843990 - RNA, 16 nt, Shigella flexneri 2a str. 2457T
ccaggagcuccagguc

SEQ ID NO: 3843991 - RNA, 15 nt, Shigella flexneri 2a str. 2457T
ccaggaucagaaugc

SEQ ID NO: 3843992 - RNA, 18 nt, Shigella flexneri 2a str. 2457T
ccaggaucggugcugcca

SEQ ID NO: 3843993 - RNA, 23 nt, Shigella flexneri 2a str. 2457T
ccaggaucuggcuugccagcagg

SEQ ID NO: 3843994 - RNA, 21 nt, Shigella flexneri 2a str. 2457T
ccaggaucuuuugucaugacu

SEQ ID NO: 3843995 - RNA, 17 nt, Shigella flexneri 2a str. 2457T
ccaggauuacgcucacc

SEQ ID NO: 3843996 - RNA, 15 nt, Shigella flexneri 2a str. 2457T
ccaggcaaaccagua

SEQ ID NO: 3843997 - RNA, 19 nt, Shigella flexneri 2a str. 2457T
ccaggcaaguagcgccaua

SEQ ID NO: 3843998 - RNA, 19 nt, Shigella flexneri 2a str. 2457T
ccaggcagauuuuuuaacu

SEQ ID NO: 3843999 - RNA, 20 nt, Shigella flexneri 2a str. 2457T
ccaggcaguuuauccagcca

SEQ ID NO: 3844000 - RNA, 11 nt, Shigella flexneri 2a str. 2457T
ccaggcauccc

SEQ ID NO: 3844001 - RNA, 17 nt, Shigella flexneri 2a str. 2457T
ccaggcaucguguugau

SEQ ID NO: 3844002 - RNA, 17 nt, Shigella flexneri 2a str. 2457T
ccaggcauuaaauccug

SEQ ID NO: 3844003 - RNA, 18 nt, Shigella flexneri 2a str. 2457T
ccaggccaaauccuucca

SEQ ID NO: 3844004 - RNA, 20 nt, Shigella flexneri 2a str. 2457T
ccaggccaaauccuuccagc

SEQ ID NO: 3844005 - RNA, 13 nt, Shigella flexneri 2a str. 2457T
ccaggccagcagc

SEQ ID NO: 3844006 - RNA, 12 nt, Shigella flexneri 2a str. 2457T
ccaggccagcgc

SEQ ID NO: 3844007 - RNA, 17 nt, Shigella flexneri 2a str. 2457T
ccaggccaucagcagcg

SEQ ID NO: 3844008 - RNA, 18 nt, Shigella flexneri 2a str. 2457T
ccaggccggugaugaugc

SEQ ID NO: 3844009 - RNA, 16 nt, Shigella flexneri 2a str. 2457T
ccaggcgagaucggca

SEQ ID NO: 3844010 - RNA, 16 nt, Shigella flexneri 2a str. 2457T
ccaggcgcgaauggaa

SEQ ID NO: 3844011 - RNA, 21 nt, Shigella flexneri 2a str. 2457T
ccaggcggcguuaaauacggc

SEQ ID NO: 3844012 - RNA, 22 nt, Shigella flexneri 2a str. 2457T
ccaggcuaauccagucuucgcc

SEQ ID NO: 3844013 - RNA, 15 nt, Shigella flexneri 2a str. 2457T
ccaggcucgccgccg

SEQ ID NO: 3844014 - RNA, 13 nt, Shigella flexneri 2a str. 2457T
ccaggcuuuccgu

SEQ ID NO: 3844015 - RNA, 15 nt, Shigella flexneri 2a str. 2457T
ccagggauaaagccc

SEQ ID NO: 3844016 - RNA, 16 nt, Shigella flexneri 2a str. 2457T
ccagggccaacuggca

SEQ ID NO: 3844017 - RNA, 17 nt, Shigella flexneri 2a str. 2457T
ccagggccaacuggcaa

SEQ ID NO: 3844018 - RNA, 19 nt, Shigella flexneri 2a str. 2457T
ccagggccuccugcagcgu

SEQ ID NO: 3844019 - RNA, 16 nt, Shigella flexneri 2a str. 2457T
ccagggcuuacaaaac

SEQ ID NO: 3844020 - RNA, 16 nt, Shigella flexneri 2a str. 2457T
ccagggcuuuauucac

SEQ ID NO: 3844021 - RNA, 17 nt, Shigella flexneri 2a str. 2457T
ccaggguuuuauuauuc

SEQ ID NO: 3844022 - RNA, 23 nt, Shigella flexneri 2a str. 2457T
ccagguaaacaccuucauccagc

SEQ ID NO: 3844023 - RNA, 15 nt, Shigella flexneri 2a str. 2457T
ccagguaacgaagau

SEQ ID NO: 3844024 - RNA, 13 nt, Shigella flexneri 2a str. 2457T
ccagguaauuuga

SEQ ID NO: 3844025 - RNA, 18 nt, Shigella flexneri 2a str. 2457T
ccagguacgcaggcggcu

SEQ ID NO: 3844026 - RNA, 15 nt, Shigella flexneri 2a str. 2457T
ccaggucaccagaca

SEQ ID NO: 3844027 - RNA, 16 nt, Shigella flexneri 2a str. 2457T
ccaggugaaaaauaaa

SEQ ID NO: 3844028 - RNA, 14 nt, Shigella flexneri 2a str. 2457T
ccagguggugcagg

SEQ ID NO: 3844029 - RNA, 16 nt, Shigella flexneri 2a str. 2457T
ccagguggugcaggcu

SEQ ID NO: 3844030 - RNA, 17 nt, Shigella flexneri 2a str. 2457T
ccagguuaacgcaggcg

SEQ ID NO: 3844031 - RNA, 17 nt, Shigella flexneri 2a str. 2457T
ccagguuguucacggca

SEQ ID NO: 3844032 - RNA, 14 nt, Shigella flexneri 2a str. 2457T
ccagguuucuucca

SEQ ID NO: 3844033 - RNA, 20 nt, Shigella flexneri 2a str. 2457T
ccagguuuucuuucaccucu

SEQ ID NO: 3844034 - RNA, 23 nt, Shigella flexneri 2a str. 2457T
ccaguaaccacgcagcguuggca

SEQ ID NO: 3844035 - RNA, 17 nt, Shigella flexneri 2a str. 2457T
ccaguaaccuuucagau

SEQ ID NO: 3844036 - RNA, 19 nt, Shigella flexneri 2a str. 2457T
ccaguaaccuuucagaugu

SEQ ID NO: 3844037 - RNA, 17 nt, Shigella flexneri 2a str. 2457T
ccauagcaucccaauac

SEQ ID NO: 3844038 - RNA, 20 nt, Shigella flexneri 2a str. 2457T
ccauaguguguuccucugcu

SEQ ID NO: 3844039 - RNA, 18 nt, Shigella flexneri 2a str. 2457T
ccauaguuaucggugugu

SEQ ID NO: 3844040 - RNA, 19 nt, Shigella flexneri 2a str. 2457T
ccauauacgccaucgccag

SEQ ID NO: 3844041 - RNA, 14 nt, Shigella flexneri 2a str. 2457T
ccauaucaagcaug

SEQ ID NO: 3844042 - RNA, 14 nt, Shigella flexneri 2a str. 2457T
ccauaugaauauau

SEQ ID NO: 3844043 - RNA, 18 nt, Shigella flexneri 2a str. 2457T
ccauauggcccaucaucu

SEQ ID NO: 3844044 - RNA, 19 nt, Shigella flexneri 2a str. 2457T
ccauauggcugcauucaga

SEQ ID NO: 3844045 - RNA, 22 nt, Shigella flexneri 2a str. 2457T
ccauauuagccgccagcucuuu

SEQ ID NO: 3844046 - RNA, 15 nt, Shigella flexneri 2a str. 2457T
ccauauucagcagca

SEQ ID NO: 3844047 - RNA, 19 nt, Shigella flexneri 2a str. 2457T
ccauauucugaucgugcuc

SEQ ID NO: 3844048 - RNA, 19 nt, Shigella flexneri 2a str. 2457T
ccauauuucuccauuagca

SEQ ID NO: 3844049 - RNA, 20 nt, Shigella flexneri 2a str. 2457T
ccauauuuugaaucggcggc

SEQ ID NO: 3844050 - RNA, 21 nt, Shigella flexneri 2a str. 2457T
ccauauuuugaaucggcggcg

SEQ ID NO: 3844051 - RNA, 18 nt, Shigella flexneri 2a str. 2457T
ccaucaaagaagcucuuu

SEQ ID NO: 3844052 - RNA, 15 nt, Shigella flexneri 2a str. 2457T
ccaucaaaucacuaa

SEQ ID NO: 3844053 - RNA, 15 nt, Shigella flexneri 2a str. 2457T
ccaucaacaagcgaa

SEQ ID NO: 3844054 - RNA, 12 nt, Shigella flexneri 2a str. 2457T
ccaucaaccacu

SEQ ID NO: 3844055 - RNA, 13 nt, Shigella flexneri 2a str. 2457T
ccaucaacgccag

SEQ ID NO: 3844056 - RNA, 14 nt, Shigella flexneri 2a str. 2457T
ccaucaacuucucg

SEQ ID NO: 3844057 - RNA, 22 nt, Shigella flexneri 2a str. 2457T
ccaucaaguagcagguaaucug

SEQ ID NO: 3844058 - RNA, 23 nt, Shigella flexneri 2a str. 2457T
ccaucaaguagcagguaaucugc

SEQ ID NO: 3844059 - RNA, 23 nt, Shigella flexneri 2a str. 2457T
ccaucaaucacuuugcgcucgcu

SEQ ID NO: 3844060 - RNA, 13 nt, Shigella flexneri 2a str. 2457T
ccaucaaugccgc

SEQ ID NO: 3844061 - RNA, 22 nt, Shigella flexneri 2a str. 2457T
ccaucacaauggcacaaauggc

SEQ ID NO: 3844062 - RNA, 12 nt, Shigella flexneri 2a str. 2457T
ccaucacaccuc

SEQ ID NO: 3844063 - RNA, 17 nt, Shigella flexneri 2a str. 2457T
ccaucacauccugauag

SEQ ID NO: 3844064 - RNA, 22 nt, Shigella flexneri 2a str. 2457T
ccaucaccaacgauuuuuuccg

SEQ ID NO: 3844065 - RNA, 13 nt, Shigella flexneri 2a str. 2457T
ccaucaccucuuc

SEQ ID NO: 3844066 - RNA, 14 nt, Shigella flexneri 2a str. 2457T
ccaucaccucuuca

SEQ ID NO: 3844067 - RNA, 18 nt, Shigella flexneri 2a str. 2457T
ccaucacuaaggguaaaa

SEQ ID NO: 3844068 - RNA, 18 nt, Shigella flexneri 2a str. 2457T
ccaucacuuucaaaagcc

SEQ ID NO: 3844069 - RNA, 19 nt, Shigella flexneri 2a str. 2457T
ccaucacuuucaaaagccc

SEQ ID NO: 3844070 - RNA, 20 nt, Shigella flexneri 2a str. 2457T
ccaucacuuucaaaagcccc

SEQ ID NO: 3844071 - RNA, 18 nt, Shigella flexneri 2a str. 2457T
ccaucagacuuugcgcca

SEQ ID NO: 3844072 - RNA, 15 nt, Shigella flexneri 2a str. 2457T
ccaucagcagcaaca

SEQ ID NO: 3844073 - RNA, 12 nt, Shigella flexneri 2a str. 2457T
ccaucagcagcg

SEQ ID NO: 3844074 - RNA, 18 nt, Shigella flexneri 2a str. 2457T
ccaucagcgccugaugga

SEQ ID NO: 3844075 - RNA, 15 nt, Shigella flexneri 2a str. 2457T
ccaucaggcagucug

SEQ ID NO: 3844076 - RNA, 19 nt, Shigella flexneri 2a str. 2457T
ccaucaggcagucugcgcc

SEQ ID NO: 3844077 - RNA, 21 nt, Shigella flexneri 2a str. 2457T
ccaucaggcagucugcgcccu

SEQ ID NO: 3844078 - RNA, 15 nt, Shigella flexneri 2a str. 2457T
ccaucaggcguuugu

SEQ ID NO: 3844079 - RNA, 23 nt, Shigella flexneri 2a str. 2457T
ccaucagguaauaggcaggcauc

SEQ ID NO: 3844080 - RNA, 19 nt, Shigella flexneri 2a str. 2457T
ccaucauaugcgccagcgg

SEQ ID NO: 3844081 - RNA, 20 nt, Shigella flexneri 2a str. 2457T
ccaucauauuuuccaucauu

SEQ ID NO: 3844082 - RNA, 21 nt, Shigella flexneri 2a str. 2457T
ccaucaucaucgguaccgcca

SEQ ID NO: 3844083 - RNA, 16 nt, Shigella flexneri 2a str. 2457T
ccaucaucgcuuucag

SEQ ID NO: 3844084 - RNA, 16 nt, Shigella flexneri 2a str. 2457T
ccaucaucggcaaaca

SEQ ID NO: 3844085 - RNA, 23 nt, Shigella flexneri 2a str. 2457T
ccaucauucagugacagguugcu

SEQ ID NO: 3844086 - RNA, 18 nt, Shigella flexneri 2a str. 2457T
ccauccagcaacaacagc

SEQ ID NO: 3844087 - RNA, 14 nt, Shigella flexneri 2a str. 2457T
ccauccagugaaac

SEQ ID NO: 3844088 - RNA, 16 nt, Shigella flexneri 2a str. 2457T
ccauccaucaacgcca

SEQ ID NO: 3844089 - RNA, 18 nt, Shigella flexneri 2a str. 2457T
ccauccaucaacgccagc

SEQ ID NO: 3844090 - RNA, 21 nt, Shigella flexneri 2a str. 2457T
ccauccaucaacgccagcggg

SEQ ID NO: 3844091 - RNA, 15 nt, Shigella flexneri 2a str. 2457T
ccauccauuuuucac

SEQ ID NO: 3844092 - RNA, 18 nt, Shigella flexneri 2a str. 2457T
ccauccauuuuucacgca

SEQ ID NO: 3844093 - RNA, 21 nt, Shigella flexneri 2a str. 2457T
ccauccccaaaaaaucaacga

SEQ ID NO: 3844094 - RNA, 17 nt, Shigella flexneri 2a str. 2457T
ccaucccgcucuguaag

SEQ ID NO: 3844095 - RNA, 16 nt, Shigella flexneri 2a str. 2457T
ccaucccuaccgcccg

SEQ ID NO: 3844096 - RNA, 15 nt, Shigella flexneri 2a str. 2457T
ccaucccuaugcaua

SEQ ID NO: 3844097 - RNA, 13 nt, Shigella flexneri 2a str. 2457T
ccaucccuucacc

SEQ ID NO: 3844098 - RNA, 14 nt, Shigella flexneri 2a str. 2457T
ccauccgcccacac

SEQ ID NO: 3844099 - RNA, 15 nt, Shigella flexneri 2a str. 2457T
ccauccgucauccau

SEQ ID NO: 3844100 - RNA, 17 nt, Shigella flexneri 2a str. 2457T
ccauccgucauccauac

SEQ ID NO: 3844101 - RNA, 18 nt, Shigella flexneri 2a str. 2457T
ccaucgaaccaucggcuu

SEQ ID NO: 3844102 - RNA, 17 nt, Shigella flexneri 2a str. 2457T
ccaucgagaaucagcga

SEQ ID NO: 3844103 - RNA, 21 nt, Shigella flexneri 2a str. 2457T
ccaucgauuuugcaauaaugg

SEQ ID NO: 3844104 - RNA, 23 nt, Shigella flexneri 2a str. 2457T
ccaucgcaaacaguacaucuucc

SEQ ID NO: 3844105 - RNA, 16 nt, Shigella flexneri 2a str. 2457T
ccaucgcaucuucgcc

SEQ ID NO: 3844106 - RNA, 14 nt, Shigella flexneri 2a str. 2457T
ccaucgccagcagc

SEQ ID NO: 3844107 - RNA, 15 nt, Shigella flexneri 2a str. 2457T
ccaucgccagcagcc

SEQ ID NO: 3844108 - RNA, 20 nt, Shigella flexneri 2a str. 2457T
ccaucgccagcagccauucc

SEQ ID NO: 3844109 - RNA, 14 nt, Shigella flexneri 2a str. 2457T
ccaucgccagugcc

SEQ ID NO: 3844110 - RNA, 15 nt, Shigella flexneri 2a str. 2457T
ccaucgccagugccg

SEQ ID NO: 3844111 - RNA, 18 nt, Shigella flexneri 2a str. 2457T
ccaucgccauuuaacgca

SEQ ID NO: 3844112 - RNA, 18 nt, Shigella flexneri 2a str. 2457T
ccaucgccuggugaccgc

SEQ ID NO: 3844113 - RNA, 18 nt, Shigella flexneri 2a str. 2457T
ccaucgcuacauaacgca

SEQ ID NO: 3844114 - RNA, 17 nt, Shigella flexneri 2a str. 2457T
ccaucggcaccaccaaa

SEQ ID NO: 3844115 - RNA, 15 nt, Shigella flexneri 2a str. 2457T
ccaucggcuuuggca

SEQ ID NO: 3844116 - RNA, 14 nt, Shigella flexneri 2a str. 2457T
ccaucgggcuauuu

SEQ ID NO: 3844117 - RNA, 18 nt, Shigella flexneri 2a str. 2457T
ccaucgucggguaguuaa

SEQ ID NO: 3844118 - RNA, 15 nt, Shigella flexneri 2a str. 2457T
ccaucuccagcugcu

SEQ ID NO: 3844119 - RNA, 18 nt, Shigella flexneri 2a str. 2457T
ccaucuccgcauguuucg

SEQ ID NO: 3844120 - RNA, 20 nt, Shigella flexneri 2a str. 2457T
ccaucuccgcauguuucgac

SEQ ID NO: 3844121 - RNA, 19 nt, Shigella flexneri 2a str. 2457T
ccaucuccuuacugccccc

SEQ ID NO: 3844122 - RNA, 13 nt, Shigella flexneri 2a str. 2457T
ccaucuucuucac

SEQ ID NO: 3844123 - RNA, 19 nt, Shigella flexneri 2a str. 2457T
ccaucuucuucacuucuuc

SEQ ID NO: 3844124 - RNA, 18 nt, Shigella flexneri 2a str. 2457T
ccaucuucuugcagcuua

SEQ ID NO: 3844125 - RNA, 21 nt, Shigella flexneri 2a str. 2457T
ccaucuucuugcagcuuaauc

SEQ ID NO: 3844126 - RNA, 16 nt, Shigella flexneri 2a str. 2457T
ccaugacaaauaacgg

SEQ ID NO: 3844127 - RNA, 12 nt, Shigella flexneri 2a str. 2457T
ccaugaccgccg

SEQ ID NO: 3844128 - RNA, 18 nt, Shigella flexneri 2a str. 2457T
ccaugaccgcuccgccau

SEQ ID NO: 3844129 - RNA, 23 nt, Shigella flexneri 2a str. 2457T
ccaugaccugcaaauucaauaaa

SEQ ID NO: 3844130 - RNA, 18 nt, Shigella flexneri 2a str. 2457T
ccaugacgaggagcugca

SEQ ID NO: 3844131 - RNA, 17 nt, Shigella flexneri 2a str. 2457T
ccaugacguucaguuca

SEQ ID NO: 3844132 - RNA, 23 nt, Shigella flexneri 2a str. 2457T
ccaugacuuucuggcacgaccug

SEQ ID NO: 3844133 - RNA, 17 nt, Shigella flexneri 2a str. 2457T
ccaugagaagcugaaau

SEQ ID NO: 3844134 - RNA, 13 nt, Shigella flexneri 2a str. 2457T
cccagaacaaaua

SEQ ID NO: 3844135 - RNA, 17 nt, Shigella flexneri 2a str. 2457T
cccagaacaacccggcg

SEQ ID NO: 3844136 - RNA, 21 nt, Shigella flexneri 2a str. 2457T
cccagaagcuuuccaucggag

SEQ ID NO: 3844137 - RNA, 20 nt, Shigella flexneri 2a str. 2457T
cccagaagguuucgccgcug

SEQ ID NO: 3844138 - RNA, 18 nt, Shigella flexneri 2a str. 2457T
cccagaauguuaacgcca

SEQ ID NO: 3844139 - RNA, 17 nt, Shigella flexneri 2a str. 2457T
cccagaauucacgcacu

SEQ ID NO: 3844140 - RNA, 16 nt, Shigella flexneri 2a str. 2457T
cccagacacaguucuu

SEQ ID NO: 3844141 - RNA, 14 nt, Shigella flexneri 2a str. 2457T
cccagacgagagug

SEQ ID NO: 3844142 - RNA, 18 nt, Shigella flexneri 2a str. 2457T
cccagagaacuggcggca

SEQ ID NO: 3844143 - RNA, 15 nt, Shigella flexneri 2a str. 2457T
cccagauagcaacag

SEQ ID NO: 3844144 - RNA, 19 nt, Shigella flexneri 2a str. 2457T
cccagauagcaacagcagc

SEQ ID NO: 3844145 - RNA, 13 nt, Shigella flexneri 2a str. 2457T
cccagcaccagua

SEQ ID NO: 3844146 - RNA, 14 nt, Shigella flexneri 2a str. 2457T
cccagcaccaguac

SEQ ID NO: 3844147 - RNA, 13 nt, Shigella flexneri 2a str. 2457T
cccagcacuucgc

SEQ ID NO: 3844148 - RNA, 16 nt, Shigella flexneri 2a str. 2457T
cccagcacuucgcugg

SEQ ID NO: 3844149 - RNA, 19 nt, Shigella flexneri 2a str. 2457T
cccagcagacguaaaaaua

SEQ ID NO: 3844150 - RNA, 12 nt, Shigella flexneri 2a str. 2457T
cccagcagagau

SEQ ID NO: 3844151 - RNA, 15 nt, Shigella flexneri 2a str. 2457T
cccagcagagaucuu

SEQ ID NO: 3844152 - RNA, 13 nt, Shigella flexneri 2a str. 2457T
cccagcagcgccg

SEQ ID NO: 3844153 - RNA, 15 nt, Shigella flexneri 2a str. 2457T
cccagcaucacgccc

SEQ ID NO: 3844154 - RNA, 22 nt, Shigella flexneri 2a str. 2457T
cccagcaucacgcccgcuuuuu

SEQ ID NO: 3844155 - RNA, 16 nt, Shigella flexneri 2a str. 2457T
cccagccaaugcaggc

SEQ ID NO: 3844156 - RNA, 16 nt, Shigella flexneri 2a str. 2457T
cccagccagacgccag

SEQ ID NO: 3844157 - RNA, 23 nt, Shigella flexneri 2a str. 2457T
cccagccagccgagguagaaccc

SEQ ID NO: 3844158 - RNA, 16 nt, Shigella flexneri 2a str. 2457T
cccagcccagcggaaa

SEQ ID NO: 3844159 - RNA, 12 nt, Shigella flexneri 2a str. 2457T
cccagccgcccu

SEQ ID NO: 3844160 - RNA, 17 nt, Shigella flexneri 2a str. 2457T
cccagccuuuccggcaa

SEQ ID NO: 3844161 - RNA, 17 nt, Shigella flexneri 2a str. 2457T
cccagcgaagcaaacca

SEQ ID NO: 3844162 - RNA, 19 nt, Shigella flexneri 2a str. 2457T
cccagcgaauccagcaugc

SEQ ID NO: 3844163 - RNA, 13 nt, Shigella flexneri 2a str. 2457T
cccagcgcaucag

SEQ ID NO: 3844164 - RNA, 15 nt, Shigella flexneri 2a str. 2457T
cccagcgcgaucgca

SEQ ID NO: 3844165 - RNA, 21 nt, Shigella flexneri 2a str. 2457T
cccagcgcgaucgcaccacca

SEQ ID NO: 3844166 - RNA, 14 nt, Shigella flexneri 2a str. 2457T
cccagcgucagcau

SEQ ID NO: 3844167 - RNA, 23 nt, Shigella flexneri 2a str. 2457T
cccagcgucagcaucauaccucc

SEQ ID NO: 3844168 - RNA, 21 nt, Shigella flexneri 2a str. 2457T
cccagcgugcguuuuuuguac

SEQ ID NO: 3844169 - RNA, 19 nt, Shigella flexneri 2a str. 2457T
cccaggcaaguagcgccau

SEQ ID NO: 3844170 - RNA, 16 nt, Shigella flexneri 2a str. 2457T
cccaggcugugcgcca

SEQ ID NO: 3844171 - RNA, 23 nt, Shigella flexneri 2a str. 2457T
cccagguaucguugaugcucuug

SEQ ID NO: 3844172 - RNA, 20 nt, Shigella flexneri 2a str. 2457T
cccagguuucaaugccgccg

SEQ ID NO: 3844173 - RNA, 13 nt, Shigella flexneri 2a str. 2457T
cccaguaauucag

SEQ ID NO: 3844174 - RNA, 14 nt, Shigella flexneri 2a str. 2457T
cccagucauccggc

SEQ ID NO: 3844175 - RNA, 15 nt, Shigella flexneri 2a str. 2457T
cccagucauccggcu

SEQ ID NO: 3844176 - RNA, 15 nt, Shigella flexneri 2a str. 2457T
cccagucgucauccc

SEQ ID NO: 3844177 - RNA, 22 nt, Shigella flexneri 2a str. 2457T
cccagugagucgggaccagcau

SEQ ID NO: 3844178 - RNA, 22 nt, Shigella flexneri 2a str. 2457T
cccagugagucggggccagcau

SEQ ID NO: 3844179 - RNA, 16 nt, Shigella flexneri 2a str. 2457T
cccagugccagcacca

SEQ ID NO: 3844180 - RNA, 20 nt, Shigella flexneri 2a str. 2457T
cccagugguuucgccagcac

SEQ ID NO: 3844181 - RNA, 14 nt, Shigella flexneri 2a str. 2457T
cccaguucagcggc

SEQ ID NO: 3844182 - RNA, 23 nt, Shigella flexneri 2a str. 2457T
cccaguuucggcaucagcagaau

SEQ ID NO: 3844183 - RNA, 22 nt, Shigella flexneri 2a str. 2457T
cccauaauuaaacgcgcgcugg

SEQ ID NO: 3844184 - RNA, 19 nt, Shigella flexneri 2a str. 2457T
cccauacuugcaagaucgc

SEQ ID NO: 3844185 - RNA, 12 nt, Shigella flexneri 2a str. 2457T
cccauagacagg

SEQ ID NO: 3844186 - RNA, 22 nt, Shigella flexneri 2a str. 2457T
cccauagauaccuucuugacau

SEQ ID NO: 3844187 - RNA, 14 nt, Shigella flexneri 2a str. 2457T
cccaucaacgccau

SEQ ID NO: 3844188 - RNA, 23 nt, Shigella flexneri 2a str. 2457T
cccaucacaauggcacaaauggc

SEQ ID NO: 3844189 - RNA, 19 nt, Shigella flexneri 2a str. 2457T
cccaucaucgcauccagug

SEQ ID NO: 3844190 - RNA, 23 nt, Shigella flexneri 2a str. 2457T
cccaucaucuggcugugauccau

SEQ ID NO: 3844191 - RNA, 11 nt, Shigella flexneri 2a str. 2457T
cccauccacgc

SEQ ID NO: 3844192 - RNA, 15 nt, Shigella flexneri 2a str. 2457T
cccaucucaauauua

SEQ ID NO: 3844193 - RNA, 14 nt, Shigella flexneri 2a str. 2457T
cccaugacuuugau

SEQ ID NO: 3844194 - RNA, 19 nt, Shigella flexneri 2a str. 2457T
cccaugagguuugguagca

SEQ ID NO: 3844195 - RNA, 19 nt, Shigella flexneri 2a str. 2457T
cccaugaugcgcggcucca

SEQ ID NO: 3844196 - RNA, 17 nt, Shigella flexneri 2a str. 2457T
cccauugccccauguug

SEQ ID NO: 3844197 - RNA, 13 nt, Shigella flexneri 2a str. 2457T
cccauuugccacu

SEQ ID NO: 3844198 - RNA, 14 nt, Shigella flexneri 2a str. 2457T
cccauuuuauuuuc

SEQ ID NO: 3844199 - RNA, 23 nt, Shigella flexneri 2a str. 2457T
ccccaaaaagauuaaaaaaacac

SEQ ID NO: 3844200 - RNA, 20 nt, Shigella flexneri 2a str. 2457T
ccccaaggaucgucgcccga

SEQ ID NO: 3844201 - RNA, 22 nt, Shigella flexneri 2a str. 2457T
ccccaaggcgaggggaccgccc

SEQ ID NO: 3844202 - RNA, 18 nt, Shigella flexneri 2a str. 2457T
ccccaauccacgcggguu

SEQ ID NO: 3844203 - RNA, 11 nt, Shigella flexneri 2a str. 2457T
ccccaaugacc

SEQ ID NO: 3844204 - RNA, 15 nt, Shigella flexneri 2a str. 2457T
ccccaauguagccgc

SEQ ID NO: 3844205 - RNA, 17 nt, Shigella flexneri 2a str. 2457T
ccccacaaacccgccag

SEQ ID NO: 3844206 - RNA, 21 nt, Shigella flexneri 2a str. 2457T
ccccacaaacccgccagacca

SEQ ID NO: 3844207 - RNA, 14 nt, Shigella flexneri 2a str. 2457T
ccccacaccaccau

SEQ ID NO: 3844208 - RNA, 21 nt, Shigella flexneri 2a str. 2457T
ccccacacuaccaucggcgcu

SEQ ID NO: 3844209 - RNA, 13 nt, Shigella flexneri 2a str. 2457T
ccccacagaccca

SEQ ID NO: 3844210 - RNA, 19 nt, Shigella flexneri 2a str. 2457T
ccccacagacccagguaga

SEQ ID NO: 3844211 - RNA, 12 nt, Shigella flexneri 2a str. 2457T
ccccacagcucu

SEQ ID NO: 3844212 - RNA, 21 nt, Shigella flexneri 2a str. 2457T
ccccacagugcugauuuugca

SEQ ID NO: 3844213 - RNA, 13 nt, Shigella flexneri 2a str. 2457T
ccccaccagcaaa

SEQ ID NO: 3844214 - RNA, 21 nt, Shigella flexneri 2a str. 2457T
ccccaccccggcccucucccu

SEQ ID NO: 3844215 - RNA, 22 nt, Shigella flexneri 2a str. 2457T
ccccacucgccccgagaaaaau

SEQ ID NO: 3844216 - RNA, 22 nt, Shigella flexneri 2a str. 2457T
ccccagaugacggcugccauca

SEQ ID NO: 3844217 - RNA, 16 nt, Shigella flexneri 2a str. 2457T
ccccagauugccgaua

SEQ ID NO: 3844218 - RNA, 21 nt, Shigella flexneri 2a str. 2457T
ccccagcaucacgcccgcuuu

SEQ ID NO: 3844219 - RNA, 12 nt, Shigella flexneri 2a str. 2457T
ccccagcgcaag

SEQ ID NO: 3844220 - RNA, 16 nt, Shigella flexneri 2a str. 2457T
ccccagcggaaaauau

SEQ ID NO: 3844221 - RNA, 15 nt, Shigella flexneri 2a str. 2457T
ccccagcgucagcau

SEQ ID NO: 3844222 - RNA, 12 nt, Shigella flexneri 2a str. 2457T
ccccagcuuuug

SEQ ID NO: 3844223 - RNA, 20 nt, Shigella flexneri 2a str. 2457T
ccccaggcugugcgccagcu

SEQ ID NO: 3844224 - RNA, 14 nt, Shigella flexneri 2a str. 2457T
ccccagguuccccc

SEQ ID NO: 3844225 - RNA, 22 nt, Shigella flexneri 2a str. 2457T
ccccaguaaucgggcaacugcu

SEQ ID NO: 3844226 - RNA, 12 nt, Shigella flexneri 2a str. 2457T
ccccaguaauuc

SEQ ID NO: 3844227 - RNA, 17 nt, Shigella flexneri 2a str. 2457T
ccccagucuuccugcgg

SEQ ID NO: 3844228 - RNA, 17 nt, Shigella flexneri 2a str. 2457T
ccccagugguuucgcca

SEQ ID NO: 3844229 - RNA, 21 nt, Shigella flexneri 2a str. 2457T
ccccagugguuucgccagcac

SEQ ID NO: 3844230 - RNA, 13 nt, Shigella flexneri 2a str. 2457T
ccccauccacgca

SEQ ID NO: 3844231 - RNA, 12 nt, Shigella flexneri 2a str. 2457T
ccccauuugcca

SEQ ID NO: 3844232 - RNA, 19 nt, Shigella flexneri 2a str. 2457T
cccggcuuuuuuacgccug

SEQ ID NO: 3844233 - RNA, 20 nt, Shigella flexneri 2a str. 2457T
cccgggccuccccggauuca

SEQ ID NO: 3844234 - RNA, 19 nt, Shigella flexneri 2a str. 2457T
cccggggugauaacgccug

SEQ ID NO: 3844235 - RNA, 15 nt, Shigella flexneri 2a str. 2457T
cccgguaccuuugaa

SEQ ID NO: 3844236 - RNA, 21 nt, Shigella flexneri 2a str. 2457T
cccgguaccuuugaacugcug

SEQ ID NO: 3844237 - RNA, 22 nt, Shigella flexneri 2a str. 2457T
cccgguauccaucagacuuugc

SEQ ID NO: 3844238 - RNA, 13 nt, Shigella flexneri 2a str. 2457T
cccggucccuuca

SEQ ID NO: 3844239 - RNA, 12 nt, Shigella flexneri 2a str. 2457T
cccgguccuggc

SEQ ID NO: 3844240 - RNA, 19 nt, Shigella flexneri 2a str. 2457T
cccgguguucccgcgccag

SEQ ID NO: 3844241 - RNA, 14 nt, Shigella flexneri 2a str. 2457T
cccgguugacugcu

SEQ ID NO: 3844242 - RNA, 21 nt, Shigella flexneri 2a str. 2457T
cccgguugcuuuucacaaccg

SEQ ID NO: 3844243 - RNA, 15 nt, Shigella flexneri 2a str. 2457T
cccgguuucucuucu

SEQ ID NO: 3844244 - RNA, 16 nt, Shigella flexneri 2a str. 2457T
cccgguuuuacuuugc

SEQ ID NO: 3844245 - RNA, 21 nt, Shigella flexneri 2a str. 2457T
cccguaccgucaaucuucacg

SEQ ID NO: 3844246 - RNA, 14 nt, Shigella flexneri 2a str. 2457T
cccguacgcugugg

SEQ ID NO: 3844247 - RNA, 16 nt, Shigella flexneri 2a str. 2457T
cccguacuucugacca

SEQ ID NO: 3844248 - RNA, 12 nt, Shigella flexneri 2a str. 2457T
cccguagugugg

SEQ ID NO: 3844249 - RNA, 22 nt, Shigella flexneri 2a str. 2457T
cccgucaauuaccacuggccca

SEQ ID NO: 3844250 - RNA, 14 nt, Shigella flexneri 2a str. 2457T
cccgucagcaaaau

SEQ ID NO: 3844251 - RNA, 23 nt, Shigella flexneri 2a str. 2457T
cccgucagcaaaauacugaacag

SEQ ID NO: 3844252 - RNA, 16 nt, Shigella flexneri 2a str. 2457T
cccguccguuccgcca

SEQ ID NO: 3844253 - RNA, 17 nt, Shigella flexneri 2a str. 2457T
cccgucgaagacucuua

SEQ ID NO: 3844254 - RNA, 16 nt, Shigella flexneri 2a str. 2457T
cccgucguugcaauca

SEQ ID NO: 3844255 - RNA, 17 nt, Shigella flexneri 2a str. 2457T
cccgugagucuccuuua

SEQ ID NO: 3844256 - RNA, 16 nt, Shigella flexneri 2a str. 2457T
cccgugggcaggccug

SEQ ID NO: 3844257 - RNA, 17 nt, Shigella flexneri 2a str. 2457T
cccgugggcaggccugg

SEQ ID NO: 3844258 - RNA, 16 nt, Shigella flexneri 2a str. 2457T
cccguuaaccacuuca

SEQ ID NO: 3844259 - RNA, 13 nt, Shigella flexneri 2a str. 2457T
cccguuucccugu

SEQ ID NO: 3844260 - RNA, 15 nt, Shigella flexneri 2a str. 2457T
cccguuugcggaucg

SEQ ID NO: 3844261 - RNA, 13 nt, Shigella flexneri 2a str. 2457T
cccguuuucucca

SEQ ID NO: 3844262 - RNA, 19 nt, Shigella flexneri 2a str. 2457T
cccguuuucuccagcgccg

SEQ ID NO: 3844263 - RNA, 21 nt, Shigella flexneri 2a str. 2457T
cccguuuucuccagcgccgcc

SEQ ID NO: 3844264 - RNA, 14 nt, Shigella flexneri 2a str. 2457T
cccuaacaucaucc

SEQ ID NO: 3844265 - RNA, 14 nt, Shigella flexneri 2a str. 2457T
cccuaacucuuuca

SEQ ID NO: 3844266 - RNA, 20 nt, Shigella flexneri 2a str. 2457T
cccuaacugacgggcggcuu

SEQ ID NO: 3844267 - RNA, 11 nt, Shigella flexneri 2a str. 2457T
cccuauucgca

SEQ ID NO: 3844268 - RNA, 15 nt, Shigella flexneri 2a str. 2457T
cccucaaacaacaca

SEQ ID NO: 3844269 - RNA, 19 nt, Shigella flexneri 2a str. 2457T
cccucacccuaacccucuc

SEQ ID NO: 3844270 - RNA, 20 nt, Shigella flexneri 2a str. 2457T
cccucacccuaacccucucc

SEQ ID NO: 3844271 - RNA, 23 nt, Shigella flexneri 2a str. 2457T
cccucccccagcaucuauacuua

SEQ ID NO: 3844272 - RNA, 17 nt, Shigella flexneri 2a str. 2457T
cccuccugauaacacag

SEQ ID NO: 3844273 - RNA, 16 nt, Shigella flexneri 2a str. 2457T
cccucgaccaucuccu

SEQ ID NO: 3844274 - RNA, 19 nt, Shigella flexneri 2a str. 2457T
cccucgaucggcucuuccg

SEQ ID NO: 3844275 - RNA, 14 nt, Shigella flexneri 2a str. 2457T
cccucgcccccuug

SEQ ID NO: 3844276 - RNA, 22 nt, Shigella flexneri 2a str. 2457T
cccugaauaacaccagccagaa

SEQ ID NO: 3844277 - RNA, 14 nt, Shigella flexneri 2a str. 2457T
cccugacauugcgu

SEQ ID NO: 3844278 - RNA, 17 nt, Shigella flexneri 2a str. 2457T
cccugagacaguuauua

SEQ ID NO: 3844279 - RNA, 17 nt, Shigella flexneri 2a str. 2457T
cccugagcguuacccgc

SEQ ID NO: 3844280 - RNA, 10 nt, Shigella flexneri 2a str. 2457T
cccugaguga

SEQ ID NO: 3844281 - RNA, 15 nt, Shigella flexneri 2a str. 2457T
cccugauaaccgcau

SEQ ID NO: 3844282 - RNA, 16 nt, Shigella flexneri 2a str. 2457T
cccugaucggccauga

SEQ ID NO: 3844283 - RNA, 16 nt, Shigella flexneri 2a str. 2457T
cccugcaauccagggg

SEQ ID NO: 3844284 - RNA, 14 nt, Shigella flexneri 2a str. 2457T
cccugcaauuauua

SEQ ID NO: 3844285 - RNA, 18 nt, Shigella flexneri 2a str. 2457T
cccugcaauuauuaaccu

SEQ ID NO: 3844286 - RNA, 19 nt, Shigella flexneri 2a str. 2457T
cccugcaccggugcaucca

SEQ ID NO: 3844287 - RNA, 21 nt, Shigella flexneri 2a str. 2457T
cccugcacuuaacaggaucug

SEQ ID NO: 3844288 - RNA, 22 nt, Shigella flexneri 2a str. 2457T
cccugcacuuaacaggaucugg

SEQ ID NO: 3844289 - RNA, 18 nt, Shigella flexneri 2a str. 2457T
cccugcagucaccugccc

SEQ ID NO: 3844290 - RNA, 23 nt, Shigella flexneri 2a str. 2457T
cccugcauauaaucgauccccaa

SEQ ID NO: 3844291 - RNA, 23 nt, Shigella flexneri 2a str. 2457T
cccugccaggucaucauugcagu

SEQ ID NO: 3844292 - RNA, 13 nt, Shigella flexneri 2a str. 2457T
cccugcccgcgau

SEQ ID NO: 3844293 - RNA, 18 nt, Shigella flexneri 2a str. 2457T
cccugcccguugccagga

SEQ ID NO: 3844294 - RNA, 15 nt, Shigella flexneri 2a str. 2457T
cccugcgauugugac

SEQ ID NO: 3844295 - RNA, 15 nt, Shigella flexneri 2a str. 2457T
cccugcgccagcggc

SEQ ID NO: 3844296 - RNA, 22 nt, Shigella flexneri 2a str. 2457T
cccugcgcuaaacaggaucugg

SEQ ID NO: 3844297 - RNA, 19 nt, Shigella flexneri 2a str. 2457T
cccugcggcgaugaccgcc

SEQ ID NO: 3844298 - RNA, 21 nt, Shigella flexneri 2a str. 2457T
cccugcucuuucagcaccgcg

SEQ ID NO: 3844299 - RNA, 22 nt, Shigella flexneri 2a str. 2457T
cccugcuggugauggacaacgc

SEQ ID NO: 3844300 - RNA, 15 nt, Shigella flexneri 2a str. 2457T
cccuggaugcaguca

SEQ ID NO: 3844301 - RNA, 14 nt, Shigella flexneri 2a str. 2457T
cccugggcaccgac

SEQ ID NO: 3844302 - RNA, 15 nt, Shigella flexneri 2a str. 2457T
cccugggcuucaucc

SEQ ID NO: 3844303 - RNA, 21 nt, Shigella flexneri 2a str. 2457T
cccugggcuucauccagcagu

SEQ ID NO: 3844304 - RNA, 23 nt, Shigella flexneri 2a str. 2457T
cccuggggagugaccuuaccacc

SEQ ID NO: 3844305 - RNA, 17 nt, Shigella flexneri 2a str. 2457T
cccugguaaaaaaugau

SEQ ID NO: 3844306 - RNA, 17 nt, Shigella flexneri 2a str. 2457T
cccuggucaguuucagc

SEQ ID NO: 3844307 - RNA, 22 nt, Shigella flexneri 2a str. 2457T
cccugguggcauugguugcugg

SEQ ID NO: 3844308 - RNA, 15 nt, Shigella flexneri 2a str. 2457T
cccuguaauugccug

SEQ ID NO: 3844309 - RNA, 16 nt, Shigella flexneri 2a str. 2457T
cccuguccgccauggc

SEQ ID NO: 3844310 - RNA, 15 nt, Shigella flexneri 2a str. 2457T
cccugugcgccaccg

SEQ ID NO: 3844311 - RNA, 19 nt, Shigella flexneri 2a str. 2457T
cccugugcgccaccgcgga

SEQ ID NO: 3844312 - RNA, 18 nt, Shigella flexneri 2a str. 2457T
cccugugcgcccuguucu

SEQ ID NO: 3844313 - RNA, 19 nt, Shigella flexneri 2a str. 2457T
cccugugcgcccuguucug

SEQ ID NO: 3844314 - RNA, 22 nt, Shigella flexneri 2a str. 2457T
cccuguuugguugccagccaca

SEQ ID NO: 3844315 - RNA, 22 nt, Shigella flexneri 2a str. 2457T
cccuguuuuauuucccgcccgc

SEQ ID NO: 3844316 - RNA, 14 nt, Shigella flexneri 2a str. 2457T
cccuuacccuuacu

SEQ ID NO: 3844317 - RNA, 22 nt, Shigella flexneri 2a str. 2457T
cccuuacgcguucauacuuuuc

SEQ ID NO: 3844318 - RNA, 12 nt, Shigella flexneri 2a str. 2457T
cccuuaguaacg

SEQ ID NO: 3844319 - RNA, 14 nt, Shigella flexneri 2a str. 2457T
cccuucaucacgca

SEQ ID NO: 3844320 - RNA, 20 nt, Shigella flexneri 2a str. 2457T
cccuucaucacgcagcguca

SEQ ID NO: 3844321 - RNA, 13 nt, Shigella flexneri 2a str. 2457T
cccuucaucgcuc

SEQ ID NO: 3844322 - RNA, 15 nt, Shigella flexneri 2a str. 2457T
cccuucauucaggug

SEQ ID NO: 3844323 - RNA, 18 nt, Shigella flexneri 2a str. 2457T
cccuuccccguucugcca

SEQ ID NO: 3844324 - RNA, 18 nt, Shigella flexneri 2a str. 2457T
cccuucgguagcagcuuu

SEQ ID NO: 3844325 - RNA, 24 nt, Shigella flexneri 2a str. 2457T
cccuucucaaucccuuucucuuca

SEQ ID NO: 3844326 - RNA, 16 nt, Shigella flexneri 2a str. 2457T
cccuucucgcucuugu

SEQ ID NO: 3844327 - RNA, 19 nt, Shigella flexneri 2a str. 2457T
cccuucugagaucaaugcg

SEQ ID NO: 3844328 - RNA, 12 nt, Shigella flexneri 2a str. 2457T
cccuucuucaau

SEQ ID NO: 3844329 - RNA, 19 nt, Shigella flexneri 2a str. 2457T
ccgauucccgggcacacuu

SEQ ID NO: 3844330 - RNA, 15 nt, Shigella flexneri 2a str. 2457T
ccgauugauucccaa

SEQ ID NO: 3844331 - RNA, 12 nt, Shigella flexneri 2a str. 2457T
ccgauuuaaccc

SEQ ID NO: 3844332 - RNA, 20 nt, Shigella flexneri 2a str. 2457T
ccgauuucaugaagcugaca

SEQ ID NO: 3844333 - RNA, 15 nt, Shigella flexneri 2a str. 2457T
ccgauuugaucucuu

SEQ ID NO: 3844334 - RNA, 18 nt, Shigella flexneri 2a str. 2457T
ccgauuuugccuucauac

SEQ ID NO: 3844335 - RNA, 18 nt, Shigella flexneri 2a str. 2457T
ccgauuuuguaaaagaag

SEQ ID NO: 3844336 - RNA, 15 nt, Shigella flexneri 2a str. 2457T
ccgcaaaaccaacgc

SEQ ID NO: 3844337 - RNA, 20 nt, Shigella flexneri 2a str. 2457T
ccgcaaaaggcgaaacgccu

SEQ ID NO: 3844338 - RNA, 17 nt, Shigella flexneri 2a str. 2457T
ccgcaaacauaaucccc

SEQ ID NO: 3844339 - RNA, 11 nt, Shigella flexneri 2a str. 2457T
ccgcaaagccc

SEQ ID NO: 3844340 - RNA, 14 nt, Shigella flexneri 2a str. 2457T
ccgcaaagcccauc

SEQ ID NO: 3844341 - RNA, 14 nt, Shigella flexneri 2a str. 2457T
ccgcaacaaugccg

SEQ ID NO: 3844342 - RNA, 15 nt, Shigella flexneri 2a str. 2457T
ccgcaacagcaauac

SEQ ID NO: 3844343 - RNA, 21 nt, Shigella flexneri 2a str. 2457T
ccgcaacagcaauacguuuca

SEQ ID NO: 3844344 - RNA, 20 nt, Shigella flexneri 2a str. 2457T
ccgcaacagugaaauacagu

SEQ ID NO: 3844345 - RNA, 23 nt, Shigella flexneri 2a str. 2457T
ccgcaacauacugcccgagcgcc

SEQ ID NO: 3844346 - RNA, 23 nt, Shigella flexneri 2a str. 2457T
ccgcaaccggccguaagaaaguc

SEQ ID NO: 3844347 - RNA, 14 nt, Shigella flexneri 2a str. 2457T
ccgcaacuaccagc

SEQ ID NO: 3844348 - RNA, 20 nt, Shigella flexneri 2a str. 2457T
ccgcaauaaccaucagcucu

SEQ ID NO: 3844349 - RNA, 15 nt, Shigella flexneri 2a str. 2457T
ccgcaaucgccagua

SEQ ID NO: 3844350 - RNA, 20 nt, Shigella flexneri 2a str. 2457T
ccgcaauggccguuccggca

SEQ ID NO: 3844351 - RNA, 13 nt, Shigella flexneri 2a str. 2457T
ccgcaaugugcuc

SEQ ID NO: 3844352 - RNA, 18 nt, Shigella flexneri 2a str. 2457T
ccgcacaauacauagaaa

SEQ ID NO: 3844353 - RNA, 20 nt, Shigella flexneri 2a str. 2457T
ccgcacauuucccggccacg

SEQ ID NO: 3844354 - RNA, 14 nt, Shigella flexneri 2a str. 2457T
ccgcaccaccagca

SEQ ID NO: 3844355 - RNA, 12 nt, Shigella flexneri 2a str. 2457T
ccgcaccagcgg

SEQ ID NO: 3844356 - RNA, 15 nt, Shigella flexneri 2a str. 2457T
ccgcaccagucgaug

SEQ ID NO: 3844357 - RNA, 21 nt, Shigella flexneri 2a str. 2457T
ccgcaccccugauaaccgcau

SEQ ID NO: 3844358 - RNA, 15 nt, Shigella flexneri 2a str. 2457T
ccgcaccugccagcg

SEQ ID NO: 3844359 - RNA, 16 nt, Shigella flexneri 2a str. 2457T
ccgcaccugccagcgc

SEQ ID NO: 3844360 - RNA, 22 nt, Shigella flexneri 2a str. 2457T
ccgcacgcagaaucucugcgcu

SEQ ID NO: 3844361 - RNA, 21 nt, Shigella flexneri 2a str. 2457T
ccgcacgcguagagaauccag

SEQ ID NO: 3844362 - RNA, 21 nt, Shigella flexneri 2a str. 2457T
ccgcacguuagaaacaaaaaa

SEQ ID NO: 3844363 - RNA, 17 nt, Shigella flexneri 2a str. 2457T
ccgcacucaucuuauug

SEQ ID NO: 3844364 - RNA, 22 nt, Shigella flexneri 2a str. 2457T
ccgcacucguaucaccccgccc

SEQ ID NO: 3844365 - RNA, 17 nt, Shigella flexneri 2a str. 2457T
ccgcacucuacuucuuc

SEQ ID NO: 3844366 - RNA, 21 nt, Shigella flexneri 2a str. 2457T
ccgcagaucagaccaauccag

SEQ ID NO: 3844367 - RNA, 22 nt, Shigella flexneri 2a str. 2457T
ccgcagcacggcgacgcauacg

SEQ ID NO: 3844368 - RNA, 13 nt, Shigella flexneri 2a str. 2457T
ccgcagccaucac

SEQ ID NO: 3844369 - RNA, 21 nt, Shigella flexneri 2a str. 2457T
ccgcagccaucacugacugcg

SEQ ID NO: 3844370 - RNA, 14 nt, Shigella flexneri 2a str. 2457T
ccgcagccaucagc

SEQ ID NO: 3844371 - RNA, 13 nt, Shigella flexneri 2a str. 2457T
ccgcagccccaga

SEQ ID NO: 3844372 - RNA, 13 nt, Shigella flexneri 2a str. 2457T
ccgcagccgccac

SEQ ID NO: 3844373 - RNA, 15 nt, Shigella flexneri 2a str. 2457T
ccgcagccgccagaa

SEQ ID NO: 3844374 - RNA, 20 nt, Shigella flexneri 2a str. 2457T
ccgcagccgccagaaauggc

SEQ ID NO: 3844375 - RNA, 13 nt, Shigella flexneri 2a str. 2457T
ccgcagcuccagc

SEQ ID NO: 3844376 - RNA, 14 nt, Shigella flexneri 2a str. 2457T
ccgcagcuccagcc

SEQ ID NO: 3844377 - RNA, 16 nt, Shigella flexneri 2a str. 2457T
ccgcaggcgcaauggc

SEQ ID NO: 3844378 - RNA, 18 nt, Shigella flexneri 2a str. 2457T
ccgcaggcgcaauggcgc

SEQ ID NO: 3844379 - RNA, 17 nt, Shigella flexneri 2a str. 2457T
ccgcaguaaagcgcagg

SEQ ID NO: 3844380 - RNA, 19 nt, Shigella flexneri 2a str. 2457T
ccgcagucauggcucuucc

SEQ ID NO: 3844381 - RNA, 16 nt, Shigella flexneri 2a str. 2457T
ccgcaguguaguucug

SEQ ID NO: 3844382 - RNA, 22 nt, Shigella flexneri 2a str. 2457T
ccgcaguuaaagcaauuccagc

SEQ ID NO: 3844383 - RNA, 20 nt, Shigella flexneri 2a str. 2457T
ccgcaucaacagugccaauc

SEQ ID NO: 3844384 - RNA, 14 nt, Shigella flexneri 2a str. 2457T
ccgcaucacgacag

SEQ ID NO: 3844385 - RNA, 11 nt, Shigella flexneri 2a str. 2457T
ccgcauccaga

SEQ ID NO: 3844386 - RNA, 12 nt, Shigella flexneri 2a str. 2457T
ccgcauccggca

SEQ ID NO: 3844387 - RNA, 15 nt, Shigella flexneri 2a str. 2457T
ccgcauccggcaauu

SEQ ID NO: 3844388 - RNA, 20 nt, Shigella flexneri 2a str. 2457T
ccgcauccggcaauugugau

SEQ ID NO: 3844389 - RNA, 19 nt, Shigella flexneri 2a str. 2457T
ccgcauccggcauaaacaa

SEQ ID NO: 3844390 - RNA, 19 nt, Shigella flexneri 2a str. 2457T
ccgcauccggcaucaacaa

SEQ ID NO: 3844391 - RNA, 15 nt, Shigella flexneri 2a str. 2457T
ccgcauccggcauga

SEQ ID NO: 3844392 - RNA, 19 nt, Shigella flexneri 2a str. 2457T
ccgccaaaacgguccggca

SEQ ID NO: 3844393 - RNA, 14 nt, Shigella flexneri 2a str. 2457T
ccgccaaccagcgc

SEQ ID NO: 3844394 - RNA, 19 nt, Shigella flexneri 2a str. 2457T
ccgccaauaaucgcgcuaa

SEQ ID NO: 3844395 - RNA, 19 nt, Shigella flexneri 2a str. 2457T
ccgccaauucguaaguaca

SEQ ID NO: 3844396 - RNA, 16 nt, Shigella flexneri 2a str. 2457T
ccgccaccaccagacg

SEQ ID NO: 3844397 - RNA, 11 nt, Shigella flexneri 2a str. 2457T
ccgccaccagg

SEQ ID NO: 3844398 - RNA, 22 nt, Shigella flexneri 2a str. 2457T
ccgccaccaggaacgcgccaag

SEQ ID NO: 3844399 - RNA, 17 nt, Shigella flexneri 2a str. 2457T
ccgccacgaccugcaga

SEQ ID NO: 3844400 - RNA, 22 nt, Shigella flexneri 2a str. 2457T
ccgccacgguaucaagcccgcc

SEQ ID NO: 3844401 - RNA, 19 nt, Shigella flexneri 2a str. 2457T
ccgccacuugagccuccag

SEQ ID NO: 3844402 - RNA, 23 nt, Shigella flexneri 2a str. 2457T
ccgccacuugagccuccagcgga

SEQ ID NO: 3844403 - RNA, 19 nt, Shigella flexneri 2a str. 2457T
ccgccacuuuacaggugcu

SEQ ID NO: 3844404 - RNA, 22 nt, Shigella flexneri 2a str. 2457T
ccgccagaaauggagacgguuu

SEQ ID NO: 3844405 - RNA, 19 nt, Shigella flexneri 2a str. 2457T
ccgccagaacgacgacugc

SEQ ID NO: 3844406 - RNA, 11 nt, Shigella flexneri 2a str. 2457T
ccgccagacca

SEQ ID NO: 3844407 - RNA, 15 nt, Shigella flexneri 2a str. 2457T
ccgccagaccacugc

SEQ ID NO: 3844408 - RNA, 13 nt, Shigella flexneri 2a str. 2457T
ccgccagauaguu

SEQ ID NO: 3844409 - RNA, 13 nt, Shigella flexneri 2a str. 2457T
ccgccagcaggaa

SEQ ID NO: 3844410 - RNA, 16 nt, Shigella flexneri 2a str. 2457T
ccgccagcaggaacga

SEQ ID NO: 3844411 - RNA, 15 nt, Shigella flexneri 2a str. 2457T
ccgccagcgccaucu

SEQ ID NO: 3844412 - RNA, 11 nt, Shigella flexneri 2a str. 2457T
ccgccagcgcg

SEQ ID NO: 3844413 - RNA, 22 nt, Shigella flexneri 2a str. 2457T
ccgccagcucacgggcggcagg

SEQ ID NO: 3844414 - RNA, 12 nt, Shigella flexneri 2a str. 2457T
ccgccaggcuuc

SEQ ID NO: 3844415 - RNA, 17 nt, Shigella flexneri 2a str. 2457T
ccgccaguaaucuggcc

SEQ ID NO: 3844416 - RNA, 18 nt, Shigella flexneri 2a str. 2457T
ccgccagugccaaagcca

SEQ ID NO: 3844417 - RNA, 12 nt, Shigella flexneri 2a str. 2457T
ccgccaguucuu

SEQ ID NO: 3844418 - RNA, 15 nt, Shigella flexneri 2a str. 2457T
ccgccaguucuucca

SEQ ID NO: 3844419 - RNA, 21 nt, Shigella flexneri 2a str. 2457T
ccgccaguucuuccaguuccg

SEQ ID NO: 3844420 - RNA, 21 nt, Shigella flexneri 2a str. 2457T
ccgccaguuuacugucugcuu

SEQ ID NO: 3844421 - RNA, 18 nt, Shigella flexneri 2a str. 2457T
ccgccaguuuguagccaa

SEQ ID NO: 3844422 - RNA, 20 nt, Shigella flexneri 2a str. 2457T
ccgccaguuugucuggcaau

SEQ ID NO: 3844423 - RNA, 11 nt, Shigella flexneri 2a str. 2457T
ccgccaucauc

SEQ ID NO: 3844424 - RNA, 13 nt, Shigella flexneri 2a str. 2457T
ccgccaucucuuc

SEQ ID NO: 3844425 - RNA, 13 nt, Shigella flexneri 2a str. 2457T
ccgccaucuucuu

SEQ ID NO: 3844426 - RNA, 18 nt, Shigella flexneri 2a str. 2457T
ccgccauuaaacgcagua

SEQ ID NO: 3844427 - RNA, 21 nt, Shigella flexneri 2a str. 2457T
ccgcuguccagucgcaaaccu

SEQ ID NO: 3844428 - RNA, 16 nt, Shigella flexneri 2a str. 2457T
ccgcugugauuucagc

SEQ ID NO: 3844429 - RNA, 21 nt, Shigella flexneri 2a str. 2457T
ccgcuuacaucaacucucuuu

SEQ ID NO: 3844430 - RNA, 19 nt, Shigella flexneri 2a str. 2457T
ccgcuucaaucuucgauuu

SEQ ID NO: 3844431 - RNA, 14 nt, Shigella flexneri 2a str. 2457T
ccgcuucaccaauc

SEQ ID NO: 3844432 - RNA, 15 nt, Shigella flexneri 2a str. 2457T
ccgcuucaccaccgc

SEQ ID NO: 3844433 - RNA, 14 nt, Shigella flexneri 2a str. 2457T
ccgcuucacucccu

SEQ ID NO: 3844434 - RNA, 16 nt, Shigella flexneri 2a str. 2457T
ccgcuucagcccgcga

SEQ ID NO: 3844435 - RNA, 17 nt, Shigella flexneri 2a str. 2457T
ccgcuuccagcauuucu

SEQ ID NO: 3844436 - RNA, 18 nt, Shigella flexneri 2a str. 2457T
ccgcuuccagcauuucug

SEQ ID NO: 3844437 - RNA, 17 nt, Shigella flexneri 2a str. 2457T
ccgcuuccagcgcaucu

SEQ ID NO: 3844438 - RNA, 14 nt, Shigella flexneri 2a str. 2457T
ccgcuuccagcucc

SEQ ID NO: 3844439 - RNA, 10 nt, Shigella flexneri 2a str. 2457T
ccgcuucccu

SEQ ID NO: 3844440 - RNA, 13 nt, Shigella flexneri 2a str. 2457T
ccgcuucgcccgc

SEQ ID NO: 3844441 - RNA, 13 nt, Shigella flexneri 2a str. 2457T
ccgcuucgcucac

SEQ ID NO: 3844442 - RNA, 13 nt, Shigella flexneri 2a str. 2457T
ccgcuucugcuuu

SEQ ID NO: 3844443 - RNA, 14 nt, Shigella flexneri 2a str. 2457T
ccgcuucugcuuug

SEQ ID NO: 3844444 - RNA, 12 nt, Shigella flexneri 2a str. 2457T
ccgcuuuccagg

SEQ ID NO: 3844445 - RNA, 18 nt, Shigella flexneri 2a str. 2457T
ccgcuuuccaggcugugu

SEQ ID NO: 3844446 - RNA, 20 nt, Shigella flexneri 2a str. 2457T
ccgcuuucucugcaagaacu

SEQ ID NO: 3844447 - RNA, 14 nt, Shigella flexneri 2a str. 2457T
ccgcuuuggcgucu

SEQ ID NO: 3844448 - RNA, 22 nt, Shigella flexneri 2a str. 2457T
ccgcuuuguguaaguuuaaccu

SEQ ID NO: 3844449 - RNA, 15 nt, Shigella flexneri 2a str. 2457T
ccgcuuuuccagcau

SEQ ID NO: 3844450 - RNA, 14 nt, Shigella flexneri 2a str. 2457T
ccgcuuuugcgcgu

SEQ ID NO: 3844451 - RNA, 12 nt, Shigella flexneri 2a str. 2457T
ccgcuuuuucaa

SEQ ID NO: 3844452 - RNA, 21 nt, Shigella flexneri 2a str. 2457T
ccgcuuuuuucagcgccagcu

SEQ ID NO: 3844453 - RNA, 22 nt, Shigella flexneri 2a str. 2457T
ccggaaaaacagaggcccgccc

SEQ ID NO: 3844454 - RNA, 22 nt, Shigella flexneri 2a str. 2457T
ccggaaaagguguucacgccgc

SEQ ID NO: 3844455 - RNA, 23 nt, Shigella flexneri 2a str. 2457T
ccggaacaggcagggccaccagc

SEQ ID NO: 3844456 - RNA, 14 nt, Shigella flexneri 2a str. 2457T
ccggaacccaccgc

SEQ ID NO: 3844457 - RNA, 21 nt, Shigella flexneri 2a str. 2457T
ccggaaccggauuuucaccau

SEQ ID NO: 3844458 - RNA, 14 nt, Shigella flexneri 2a str. 2457T
ccggaacgugcaua

SEQ ID NO: 3844459 - RNA, 19 nt, Shigella flexneri 2a str. 2457T
ccggaacuugccgggcgca

SEQ ID NO: 3844460 - RNA, 20 nt, Shigella flexneri 2a str. 2457T
ccggaacuugccgggcgcag

SEQ ID NO: 3844461 - RNA, 17 nt, Shigella flexneri 2a str. 2457T
ccggaagagagcagccg

SEQ ID NO: 3844462 - RNA, 17 nt, Shigella flexneri 2a str. 2457T
ccggaagccaccacgcc

SEQ ID NO: 3844463 - RNA, 12 nt, Shigella flexneri 2a str. 2457T
ccggaaggcaua

SEQ ID NO: 3844464 - RNA, 22 nt, Shigella flexneri 2a str. 2457T
ccggaauaacucccuauaaugc

SEQ ID NO: 3844465 - RNA, 13 nt, Shigella flexneri 2a str. 2457T
ccggaauaaugau

SEQ ID NO: 3844466 - RNA, 23 nt, Shigella flexneri 2a str. 2457T
ccggacacugcuuacaggcuggu

SEQ ID NO: 3844467 - RNA, 21 nt, Shigella flexneri 2a str. 2457T
ccggaccaucuuccaguugca

SEQ ID NO: 3844468 - RNA, 13 nt, Shigella flexneri 2a str. 2457T
ccggacccacacc

SEQ ID NO: 3844469 - RNA, 18 nt, Shigella flexneri 2a str. 2457T
ccggacccuggucaguuu

SEQ ID NO: 3844470 - RNA, 22 nt, Shigella flexneri 2a str. 2457T
ccggacccuggucaguuucagc

SEQ ID NO: 3844471 - RNA, 19 nt, Shigella flexneri 2a str. 2457T
ccggaccugucggggccag

SEQ ID NO: 3844472 - RNA, 20 nt, Shigella flexneri 2a str. 2457T
ccggacgacggcaucgccau

SEQ ID NO: 3844473 - RNA, 19 nt, Shigella flexneri 2a str. 2457T
ccggacggacuuccagcgg

SEQ ID NO: 3844474 - RNA, 14 nt, Shigella flexneri 2a str. 2457T
ccggacgucaggcc

SEQ ID NO: 3844475 - RNA, 18 nt, Shigella flexneri 2a str. 2457T
ccggacguguuuucaccg

SEQ ID NO: 3844476 - RNA, 15 nt, Shigella flexneri 2a str. 2457T
ccggacuccgcaccg

SEQ ID NO: 3844477 - RNA, 13 nt, Shigella flexneri 2a str. 2457T
ccggacuggagca

SEQ ID NO: 3844478 - RNA, 15 nt, Shigella flexneri 2a str. 2457T
ccggagaagcguagg

SEQ ID NO: 3844479 - RNA, 23 nt, Shigella flexneri 2a str. 2457T
ccggagaguauuaucugcaauua

SEQ ID NO: 3844480 - RNA, 21 nt, Shigella flexneri 2a str. 2457T
ccggaggucaguaaugagcac

SEQ ID NO: 3844481 - RNA, 15 nt, Shigella flexneri 2a str. 2457T
ccggauaaacaaugu

SEQ ID NO: 3844482 - RNA, 22 nt, Shigella flexneri 2a str. 2457T
ccggauaaagcguucacgccgc

SEQ ID NO: 3844483 - RNA, 20 nt, Shigella flexneri 2a str. 2457T
ccggauaagaugcgccagca

SEQ ID NO: 3844484 - RNA, 22 nt, Shigella flexneri 2a str. 2457T
ccggauaagaugcgccagcauc

SEQ ID NO: 3844485 - RNA, 21 nt, Shigella flexneri 2a str. 2457T
ccggauaagguguuuacaccg

SEQ ID NO: 3844486 - RNA, 16 nt, Shigella flexneri 2a str. 2457T
ccggaugacagacucc

SEQ ID NO: 3844487 - RNA, 19 nt, Shigella flexneri 2a str. 2457T
ccggaugauucacaucauc

SEQ ID NO: 3844488 - RNA, 15 nt, Shigella flexneri 2a str. 2457T
ccggaugccucuccu

SEQ ID NO: 3844489 - RNA, 15 nt, Shigella flexneri 2a str. 2457T
ccggaugcgccagca

SEQ ID NO: 3844490 - RNA, 17 nt, Shigella flexneri 2a str. 2457T
ccggaugcgccagcauc

SEQ ID NO: 3844491 - RNA, 16 nt, Shigella flexneri 2a str. 2457T
ccggaugcggcguaaa

SEQ ID NO: 3844492 - RNA, 22 nt, Shigella flexneri 2a str. 2457T
ccggaugcggcgugaacgccuu

SEQ ID NO: 3844493 - RNA, 15 nt, Shigella flexneri 2a str. 2457T
ccggauguuuccauc

SEQ ID NO: 3844494 - RNA, 14 nt, Shigella flexneri 2a str. 2457T
ccggauucagauug

SEQ ID NO: 3844495 - RNA, 15 nt, Shigella flexneri 2a str. 2457T
ccggauuuuuuuucc

SEQ ID NO: 3844496 - RNA, 16 nt, Shigella flexneri 2a str. 2457T
ccggauuuuuuuuccg

SEQ ID NO: 3844497 - RNA, 23 nt, Shigella flexneri 2a str. 2457T
ccggcaaagugaauacagaacag

SEQ ID NO: 3844498 - RNA, 14 nt, Shigella flexneri 2a str. 2457T
ccggcaaauaacag

SEQ ID NO: 3844499 - RNA, 11 nt, Shigella flexneri 2a str. 2457T
ccggcaaaugu

SEQ ID NO: 3844500 - RNA, 22 nt, Shigella flexneri 2a str. 2457T
ccggcaacaaugccacgccaca

SEQ ID NO: 3844501 - RNA, 14 nt, Shigella flexneri 2a str. 2457T
ccggcaaccacacc

SEQ ID NO: 3844502 - RNA, 18 nt, Shigella flexneri 2a str. 2457T
ccggcaacgacugcgagc

SEQ ID NO: 3844503 - RNA, 18 nt, Shigella flexneri 2a str. 2457T
ccggcaacgucaguccca

SEQ ID NO: 3844504 - RNA, 13 nt, Shigella flexneri 2a str. 2457T
ccggcaauaaaac

SEQ ID NO: 3844505 - RNA, 15 nt, Shigella flexneri 2a str. 2457T
ccggcaauaaaacag

SEQ ID NO: 3844506 - RNA, 19 nt, Shigella flexneri 2a str. 2457T
ccggcaauaaaacagggcg

SEQ ID NO: 3844507 - RNA, 21 nt, Shigella flexneri 2a str. 2457T
ccggcaaucaccgccagcggc

SEQ ID NO: 3844508 - RNA, 19 nt, Shigella flexneri 2a str. 2457T
ccggcaaucggugcaaaug

SEQ ID NO: 3844509 - RNA, 22 nt, Shigella flexneri 2a str. 2457T
ccggcaccaaucaccgccagca

SEQ ID NO: 3844510 - RNA, 11 nt, Shigella flexneri 2a str. 2457T
ccggcaccuuu

SEQ ID NO: 3844511 - RNA, 11 nt, Shigella flexneri 2a str. 2457T
ccggcagagaa

SEQ ID NO: 3844512 - RNA, 13 nt, Shigella flexneri 2a str. 2457T
ccggcagagaaaa

SEQ ID NO: 3844513 - RNA, 15 nt, Shigella flexneri 2a str. 2457T
ccggcagcaugugua

SEQ ID NO: 3844514 - RNA, 24 nt, Shigella flexneri 2a str. 2457T
ccggcagucaguguuaucaaauca

SEQ ID NO: 3844515 - RNA, 22 nt, Shigella flexneri 2a str. 2457T
ccggcauaaccggaucgccaau

SEQ ID NO: 3844516 - RNA, 15 nt, Shigella flexneri 2a str. 2457T
ccggcauacuuugau

SEQ ID NO: 3844517 - RNA, 14 nt, Shigella flexneri 2a str. 2457T
ccggcauauaccuc

SEQ ID NO: 3844518 - RNA, 13 nt, Shigella flexneri 2a str. 2457T
ccggcaucaacca

SEQ ID NO: 3844519 - RNA, 13 nt, Shigella flexneri 2a str. 2457T
ccggcaucgacag

SEQ ID NO: 3844520 - RNA, 21 nt, Shigella flexneri 2a str. 2457T
ccggcaucgcaaaccagacgc

SEQ ID NO: 3844521 - RNA, 14 nt, Shigella flexneri 2a str. 2457T
ccggcaugaacaaa

SEQ ID NO: 3844522 - RNA, 17 nt, Shigella flexneri 2a str. 2457T
ccggcauggcauuuuua

SEQ ID NO: 3844523 - RNA, 19 nt, Shigella flexneri 2a str. 2457T
ccggcauuaucacaucagc

SEQ ID NO: 3844524 - RNA, 22 nt, Shigella flexneri 2a str. 2457T
ccggcauuaucacaucagcgca

SEQ ID NO: 3844525 - RNA, 16 nt, Shigella flexneri 2a str. 2457T
ccguaagcgccccgag

SEQ ID NO: 3844526 - RNA, 21 nt, Shigella flexneri 2a str. 2457T
ccguaaguaagauaaaagcaa

SEQ ID NO: 3844527 - RNA, 16 nt, Shigella flexneri 2a str. 2457T
ccguaauuuuuacucc

SEQ ID NO: 3844528 - RNA, 23 nt, Shigella flexneri 2a str. 2457T
ccguaauuuuuacuccacuuccu

SEQ ID NO: 3844529 - RNA, 19 nt, Shigella flexneri 2a str. 2457T
ccguacaaagugccgccag

SEQ ID NO: 3844530 - RNA, 19 nt, Shigella flexneri 2a str. 2457T
ccguacaggcagcuuagaa

SEQ ID NO: 3844531 - RNA, 18 nt, Shigella flexneri 2a str. 2457T
ccguacauagcgucaaga

SEQ ID NO: 3844532 - RNA, 15 nt, Shigella flexneri 2a str. 2457T
ccguaccagccuugc

SEQ ID NO: 3844533 - RNA, 22 nt, Shigella flexneri 2a str. 2457T
ccguaccaucguaagcgccagg

SEQ ID NO: 3844534 - RNA, 13 nt, Shigella flexneri 2a str. 2457T
ccguacccagcaa

SEQ ID NO: 3844535 - RNA, 16 nt, Shigella flexneri 2a str. 2457T
ccguacgcaucaccag

SEQ ID NO: 3844536 - RNA, 18 nt, Shigella flexneri 2a str. 2457T
ccguacgcaucaccagac

SEQ ID NO: 3844537 - RNA, 17 nt, Shigella flexneri 2a str. 2457T
ccguacguuacguacuu

SEQ ID NO: 3844538 - RNA, 23 nt, Shigella flexneri 2a str. 2457T
ccguacugaaugaucacuuguuc

SEQ ID NO: 3844539 - RNA, 21 nt, Shigella flexneri 2a str. 2457T
ccguacugacggcguucuuua

SEQ ID NO: 3844540 - RNA, 14 nt, Shigella flexneri 2a str. 2457T
ccguacugcauaau

SEQ ID NO: 3844541 - RNA, 18 nt, Shigella flexneri 2a str. 2457T
ccguagcuucaccgcauc

SEQ ID NO: 3844542 - RNA, 14 nt, Shigella flexneri 2a str. 2457T
ccguaguuccacau

SEQ ID NO: 3844543 - RNA, 16 nt, Shigella flexneri 2a str. 2457T
ccguauaauaucuuuu

SEQ ID NO: 3844544 - RNA, 15 nt, Shigella flexneri 2a str. 2457T
ccguaugaccggaaa

SEQ ID NO: 3844545 - RNA, 19 nt, Shigella flexneri 2a str. 2457T
ccguaugaugugcgcuaac

SEQ ID NO: 3844546 - RNA, 20 nt, Shigella flexneri 2a str. 2457T
ccguauguucccaccagcca

SEQ ID NO: 3844547 - RNA, 15 nt, Shigella flexneri 2a str. 2457T
ccgucaaagcgccag

SEQ ID NO: 3844548 - RNA, 21 nt, Shigella flexneri 2a str. 2457T
ccgucaaucuucacgcgcaga

SEQ ID NO: 3844549 - RNA, 19 nt, Shigella flexneri 2a str. 2457T
ccgucacaggcacaccgcc

SEQ ID NO: 3844550 - RNA, 21 nt, Shigella flexneri 2a str. 2457T
ccgucacaggcacaccgccgc

SEQ ID NO: 3844551 - RNA, 14 nt, Shigella flexneri 2a str. 2457T
ccgucaccacuuca

SEQ ID NO: 3844552 - RNA, 18 nt, Shigella flexneri 2a str. 2457T
ccgucaccggaauaauga

SEQ ID NO: 3844553 - RNA, 12 nt, Shigella flexneri 2a str. 2457T
ccgucaccggca

SEQ ID NO: 3844554 - RNA, 17 nt, Shigella flexneri 2a str. 2457T
ccgucaccggcacaaag

SEQ ID NO: 3844555 - RNA, 19 nt, Shigella flexneri 2a str. 2457T
ccgucaccggcacaaagcu

SEQ ID NO: 3844556 - RNA, 14 nt, Shigella flexneri 2a str. 2457T
ccgucacuucuucg

SEQ ID NO: 3844557 - RNA, 20 nt, Shigella flexneri 2a str. 2457T
ccgucacuucuucgcgaucg

SEQ ID NO: 3844558 - RNA, 15 nt, Shigella flexneri 2a str. 2457T
ccgucagauccgcca

SEQ ID NO: 3844559 - RNA, 16 nt, Shigella flexneri 2a str. 2457T
ccgucagauccgccag

SEQ ID NO: 3844560 - RNA, 21 nt, Shigella flexneri 2a str. 2457T
ccgucagcaaaauacugaaca

SEQ ID NO: 3844561 - RNA, 11 nt, Shigella flexneri 2a str. 2457T
ccgucagccgc

SEQ ID NO: 3844562 - RNA, 15 nt, Shigella flexneri 2a str. 2457T
ccgucagccgcccgc

SEQ ID NO: 3844563 - RNA, 12 nt, Shigella flexneri 2a str. 2457T
ccgucagcgagu

SEQ ID NO: 3844564 - RNA, 16 nt, Shigella flexneri 2a str. 2457T
ccgucagcgcaugauu

SEQ ID NO: 3844565 - RNA, 19 nt, Shigella flexneri 2a str. 2457T
ccgucagcggcaauucuuu

SEQ ID NO: 3844566 - RNA, 21 nt, Shigella flexneri 2a str. 2457T
ccgucaguuuuucacccgcaa

SEQ ID NO: 3844567 - RNA, 17 nt, Shigella flexneri 2a str. 2457T
ccgucaucacgcaggcu

SEQ ID NO: 3844568 - RNA, 13 nt, Shigella flexneri 2a str. 2457T
ccgucaucgacaa

SEQ ID NO: 3844569 - RNA, 23 nt, Shigella flexneri 2a str. 2457T
ccgucaucgacaaaaacccugcc

SEQ ID NO: 3844570 - RNA, 20 nt, Shigella flexneri 2a str. 2457T
ccguccaggcggucaccgaa

SEQ ID NO: 3844571 - RNA, 23 nt, Shigella flexneri 2a str. 2457T
ccguccguuauaucgcgcugacg

SEQ ID NO: 3844572 - RNA, 12 nt, Shigella flexneri 2a str. 2457T
ccguccuccgua

SEQ ID NO: 3844573 - RNA, 16 nt, Shigella flexneri 2a str. 2457T
ccgucgagcagagaaa

SEQ ID NO: 3844574 - RNA, 19 nt, Shigella flexneri 2a str. 2457T
ccgucgaggaacaucugag

SEQ ID NO: 3844575 - RNA, 21 nt, Shigella flexneri 2a str. 2457T
ccgucgcaauacccugaccca

SEQ ID NO: 3844576 - RNA, 10 nt, Shigella flexneri 2a str. 2457T
ccgucgcaug

SEQ ID NO: 3844577 - RNA, 12 nt, Shigella flexneri 2a str. 2457T
ccgucgcauggg

SEQ ID NO: 3844578 - RNA, 17 nt, Shigella flexneri 2a str. 2457T
ccgucgccuucaacgua

SEQ ID NO: 3844579 - RNA, 17 nt, Shigella flexneri 2a str. 2457T
ccgucgcgcccuccugc

SEQ ID NO: 3844580 - RNA, 18 nt, Shigella flexneri 2a str. 2457T
ccgucgcgcccuccugca

SEQ ID NO: 3844581 - RNA, 16 nt, Shigella flexneri 2a str. 2457T
ccgucgggucagcucc

SEQ ID NO: 3844582 - RNA, 17 nt, Shigella flexneri 2a str. 2457T
ccgucguagccaccauc

SEQ ID NO: 3844583 - RNA, 14 nt, Shigella flexneri 2a str. 2457T
ccgucgucccuucc

SEQ ID NO: 3844584 - RNA, 16 nt, Shigella flexneri 2a str. 2457T
ccgucguggucgugau

SEQ ID NO: 3844585 - RNA, 16 nt, Shigella flexneri 2a str. 2457T
ccgucuucccgcagcc

SEQ ID NO: 3844586 - RNA, 20 nt, Shigella flexneri 2a str. 2457T
ccgugaaaacagcaaccucc

SEQ ID NO: 3844587 - RNA, 18 nt, Shigella flexneri 2a str. 2457T
ccgugaacguggccauga

SEQ ID NO: 3844588 - RNA, 17 nt, Shigella flexneri 2a str. 2457T
ccgugcaacugcggcgc

SEQ ID NO: 3844589 - RNA, 13 nt, Shigella flexneri 2a str. 2457T
ccgugcacaccga

SEQ ID NO: 3844590 - RNA, 13 nt, Shigella flexneri 2a str. 2457T
ccgugccagagca

SEQ ID NO: 3844591 - RNA, 16 nt, Shigella flexneri 2a str. 2457T
ccgugccccauauggc

SEQ ID NO: 3844592 - RNA, 13 nt, Shigella flexneri 2a str. 2457T
ccgugcgcuuuuu

SEQ ID NO: 3844593 - RNA, 23 nt, Shigella flexneri 2a str. 2457T
ccgugcgggcaucaucuuccggu

SEQ ID NO: 3844594 - RNA, 15 nt, Shigella flexneri 2a str. 2457T
ccgugcuguacagca

SEQ ID NO: 3844595 - RNA, 18 nt, Shigella flexneri 2a str. 2457T
ccgugcugugugccgcga

SEQ ID NO: 3844596 - RNA, 15 nt, Shigella flexneri 2a str. 2457T
ccguggaugcgaugu

SEQ ID NO: 3844597 - RNA, 14 nt, Shigella flexneri 2a str. 2457T
ccguggauuuaaug

SEQ ID NO: 3844598 - RNA, 23 nt, Shigella flexneri 2a str. 2457T
ccguggucuguuuaaccgcuuca

SEQ ID NO: 3844599 - RNA, 23 nt, Shigella flexneri 2a str. 2457T
ccguggugaguuguggcgcgucg

SEQ ID NO: 3844600 - RNA, 19 nt, Shigella flexneri 2a str. 2457T
ccgugguggcagccagcca

SEQ ID NO: 3844601 - RNA, 16 nt, Shigella flexneri 2a str. 2457T
ccgugugccgacaucg

SEQ ID NO: 3844602 - RNA, 15 nt, Shigella flexneri 2a str. 2457T
ccguuaaccacuuca

SEQ ID NO: 3844603 - RNA, 20 nt, Shigella flexneri 2a str. 2457T
ccguuaacccgucugguuug

SEQ ID NO: 3844604 - RNA, 15 nt, Shigella flexneri 2a str. 2457T
ccguuaaccguggga

SEQ ID NO: 3844605 - RNA, 17 nt, Shigella flexneri 2a str. 2457T
ccguuaaguuuaacugc

SEQ ID NO: 3844606 - RNA, 22 nt, Shigella flexneri 2a str. 2457T
ccguuaccguaccaaccgcaau

SEQ ID NO: 3844607 - RNA, 21 nt, Shigella flexneri 2a str. 2457T
ccguuauacaucgcuuuccag

SEQ ID NO: 3844608 - RNA, 13 nt, Shigella flexneri 2a str. 2457T
ccguucaguuccg

SEQ ID NO: 3844609 - RNA, 13 nt, Shigella flexneri 2a str. 2457T
ccguucauccgcu

SEQ ID NO: 3844610 - RNA, 17 nt, Shigella flexneri 2a str. 2457T
ccguuccacccagcuca

SEQ ID NO: 3844611 - RNA, 17 nt, Shigella flexneri 2a str. 2457T
ccguucgcuaccuuuca

SEQ ID NO: 3844612 - RNA, 19 nt, Shigella flexneri 2a str. 2457T
ccguucuuaagauauaaag

SEQ ID NO: 3844613 - RNA, 12 nt, Shigella flexneri 2a str. 2457T
ccguucuucccg

SEQ ID NO: 3844614 - RNA, 18 nt, Shigella flexneri 2a str. 2457T
ccguugauuuuauuggca

SEQ ID NO: 3844615 - RNA, 14 nt, Shigella flexneri 2a str. 2457T
ccguugccgcagcg

SEQ ID NO: 3844616 - RNA, 18 nt, Shigella flexneri 2a str. 2457T
ccguugcgcccaucauca

SEQ ID NO: 3844617 - RNA, 23 nt, Shigella flexneri 2a str. 2457T
ccguugguuaauuuuucaaacuc

SEQ ID NO: 3844618 - RNA, 20 nt, Shigella flexneri 2a str. 2457T
ccguugugcgauccacgcca

SEQ ID NO: 3844619 - RNA, 15 nt, Shigella flexneri 2a str. 2457T
ccguuuacggcuaaa

SEQ ID NO: 3844620 - RNA, 18 nt, Shigella flexneri 2a str. 2457T
ccguuucccugucucuca

SEQ ID NO: 3844621 - RNA, 21 nt, Shigella flexneri 2a str. 2457T
ccguuucccuguucagccuga

SEQ ID NO: 3844622 - RNA, 17 nt, Shigella flexneri 2a str. 2457T
ccguuuccucaagcgga

SEQ ID NO: 3844623 - RNA, 12 nt, Shigella flexneri 2a str. 2457T
ccucucuucgcu

SEQ ID NO: 3844624 - RNA, 17 nt, Shigella flexneri 2a str. 2457T
ccucugcgcccagcaac

SEQ ID NO: 3844625 - RNA, 18 nt, Shigella flexneri 2a str. 2457T
ccucuuaaugcaggcagc

SEQ ID NO: 3844626 - RNA, 22 nt, Shigella flexneri 2a str. 2457T
ccucuuacgcgaauaguuuccg

SEQ ID NO: 3844627 - RNA, 14 nt, Shigella flexneri 2a str. 2457T
ccucuucagcgucc

SEQ ID NO: 3844628 - RNA, 13 nt, Shigella flexneri 2a str. 2457T
ccucuucauuaaa

SEQ ID NO: 3844629 - RNA, 16 nt, Shigella flexneri 2a str. 2457T
ccucuuccacauuuuc

SEQ ID NO: 3844630 - RNA, 15 nt, Shigella flexneri 2a str. 2457T
ccucuuccauaaucg

SEQ ID NO: 3844631 - RNA, 16 nt, Shigella flexneri 2a str. 2457T
ccucuuccauuucauc

SEQ ID NO: 3844632 - RNA, 17 nt, Shigella flexneri 2a str. 2457T
ccucuucuaccacauga

SEQ ID NO: 3844633 - RNA, 14 nt, Shigella flexneri 2a str. 2457T
ccucuucugccugc

SEQ ID NO: 3844634 - RNA, 11 nt, Shigella flexneri 2a str. 2457T
ccucuucuuuu

SEQ ID NO: 3844635 - RNA, 15 nt, Shigella flexneri 2a str. 2457T
ccucuuucauccgau

SEQ ID NO: 3844636 - RNA, 15 nt, Shigella flexneri 2a str. 2457T
ccucuuuuuucaaca

SEQ ID NO: 3844637 - RNA, 13 nt, Shigella flexneri 2a str. 2457T
ccugaaaccauag

SEQ ID NO: 3844638 - RNA, 21 nt, Shigella flexneri 2a str. 2457T
ccugaaacgcggcguaaccgc

SEQ ID NO: 3844639 - RNA, 22 nt, Shigella flexneri 2a str. 2457T
ccugaaacggaaucgcccgcug

SEQ ID NO: 3844640 - RNA, 12 nt, Shigella flexneri 2a str. 2457T
ccugaaaguauu

SEQ ID NO: 3844641 - RNA, 17 nt, Shigella flexneri 2a str. 2457T
ccugaaaguauuugacu

SEQ ID NO: 3844642 - RNA, 19 nt, Shigella flexneri 2a str. 2457T
ccugaaaguauuugacugu

SEQ ID NO: 3844643 - RNA, 20 nt, Shigella flexneri 2a str. 2457T
ccugaaauguuugcaauaaa

SEQ ID NO: 3844644 - RNA, 13 nt, Shigella flexneri 2a str. 2457T
ccugaacaagcaa

SEQ ID NO: 3844645 - RNA, 15 nt, Shigella flexneri 2a str. 2457T
ccugaacaggucacc

SEQ ID NO: 3844646 - RNA, 18 nt, Shigella flexneri 2a str. 2457T
ccugaaccgaacuuuuug

SEQ ID NO: 3844647 - RNA, 21 nt, Shigella flexneri 2a str. 2457T
ccugaacucgccgcacaggcg

SEQ ID NO: 3844648 - RNA, 22 nt, Shigella flexneri 2a str. 2457T
ccugaagcaguuucaccagcag

SEQ ID NO: 3844649 - RNA, 13 nt, Shigella flexneri 2a str. 2457T
ccugaaggaccuu

SEQ ID NO: 3844650 - RNA, 17 nt, Shigella flexneri 2a str. 2457T
ccugaagguguuugacu

SEQ ID NO: 3844651 - RNA, 12 nt, Shigella flexneri 2a str. 2457T
ccugaauaaacg

SEQ ID NO: 3844652 - RNA, 13 nt, Shigella flexneri 2a str. 2457T
ccugaauaaacgc

SEQ ID NO: 3844653 - RNA, 16 nt, Shigella flexneri 2a str. 2457T
ccugaauaaacgccau

SEQ ID NO: 3844654 - RNA, 12 nt, Shigella flexneri 2a str. 2457T
ccugaauaacac

SEQ ID NO: 3844655 - RNA, 15 nt, Shigella flexneri 2a str. 2457T
ccugaauaacaccag

SEQ ID NO: 3844656 - RNA, 19 nt, Shigella flexneri 2a str. 2457T
ccugaauaacaccagccag

SEQ ID NO: 3844657 - RNA, 11 nt, Shigella flexneri 2a str. 2457T
ccugaauaauc

SEQ ID NO: 3844658 - RNA, 17 nt, Shigella flexneri 2a str. 2457T
ccugaauauacgccaga

SEQ ID NO: 3844659 - RNA, 17 nt, Shigella flexneri 2a str. 2457T
ccugaauggugaccugc

SEQ ID NO: 3844660 - RNA, 18 nt, Shigella flexneri 2a str. 2457T
ccugaaugucuccauacu

SEQ ID NO: 3844661 - RNA, 15 nt, Shigella flexneri 2a str. 2457T
ccugacaacaaaacg

SEQ ID NO: 3844662 - RNA, 21 nt, Shigella flexneri 2a str. 2457T
ccugacaacaaaacgggggcu

SEQ ID NO: 3844663 - RNA, 21 nt, Shigella flexneri 2a str. 2457T
ccugacaagguacgaaaaaaa

SEQ ID NO: 3844664 - RNA, 18 nt, Shigella flexneri 2a str. 2457T
ccugacacaacuggcgca

SEQ ID NO: 3844665 - RNA, 22 nt, Shigella flexneri 2a str. 2457T
ccugacaggcgggaagaacggc

SEQ ID NO: 3844666 - RNA, 19 nt, Shigella flexneri 2a str. 2457T
ccugaccauuaucaaacag

SEQ ID NO: 3844667 - RNA, 16 nt, Shigella flexneri 2a str. 2457T
ccugacccagcaccag

SEQ ID NO: 3844668 - RNA, 17 nt, Shigella flexneri 2a str. 2457T
ccugaccugcgaccagu

SEQ ID NO: 3844669 - RNA, 16 nt, Shigella flexneri 2a str. 2457T
ccugaccuuuuuucag

SEQ ID NO: 3844670 - RNA, 16 nt, Shigella flexneri 2a str. 2457T
ccugacgcaauaacac

SEQ ID NO: 3844671 - RNA, 24 nt, Shigella flexneri 2a str. 2457T
ccugacgcccguuaccaauaccaa

SEQ ID NO: 3844672 - RNA, 21 nt, Shigella flexneri 2a str. 2457T
ccugacggaaaucauccagca

SEQ ID NO: 3844673 - RNA, 15 nt, Shigella flexneri 2a str. 2457T
ccugacgguuuaccu

SEQ ID NO: 3844674 - RNA, 16 nt, Shigella flexneri 2a str. 2457T
ccugacgguuuaccug

SEQ ID NO: 3844675 - RNA, 19 nt, Shigella flexneri 2a str. 2457T
ccugacguaacgaccacca

SEQ ID NO: 3844676 - RNA, 22 nt, Shigella flexneri 2a str. 2457T
ccugagaauuccggcagagaaa

SEQ ID NO: 3844677 - RNA, 19 nt, Shigella flexneri 2a str. 2457T
ccugagacagacagccuca

SEQ ID NO: 3844678 - RNA, 15 nt, Shigella flexneri 2a str. 2457T
ccugagccggaguug

SEQ ID NO: 3844679 - RNA, 23 nt, Shigella flexneri 2a str. 2457T
ccugagcgguuaacacggcagca

SEQ ID NO: 3844680 - RNA, 12 nt, Shigella flexneri 2a str. 2457T
ccugaguaauua

SEQ ID NO: 3844681 - RNA, 22 nt, Shigella flexneri 2a str. 2457T
ccugagugaauauuuaaccuga

SEQ ID NO: 3844682 - RNA, 19 nt, Shigella flexneri 2a str. 2457T
ccugaguuaccgcuauuug

SEQ ID NO: 3844683 - RNA, 21 nt, Shigella flexneri 2a str. 2457T
ccugauaaaaaccauucaggc

SEQ ID NO: 3844684 - RNA, 17 nt, Shigella flexneri 2a str. 2457T
ccugauagcacgucacg

SEQ ID NO: 3844685 - RNA, 22 nt, Shigella flexneri 2a str. 2457T
ccugauagcccgcacaaagcac

SEQ ID NO: 3844686 - RNA, 13 nt, Shigella flexneri 2a str. 2457T
ccugauccauacu

SEQ ID NO: 3844687 - RNA, 15 nt, Shigella flexneri 2a str. 2457T
ccugauccugcaaca

SEQ ID NO: 3844688 - RNA, 15 nt, Shigella flexneri 2a str. 2457T
ccugaucgacgcgcu

SEQ ID NO: 3844689 - RNA, 19 nt, Shigella flexneri 2a str. 2457T
ccugaucgccauauuucuc

SEQ ID NO: 3844690 - RNA, 21 nt, Shigella flexneri 2a str. 2457T
ccugaucggcgagauaaugcg

SEQ ID NO: 3844691 - RNA, 21 nt, Shigella flexneri 2a str. 2457T
ccugaugacaugcaaugauuc

SEQ ID NO: 3844692 - RNA, 21 nt, Shigella flexneri 2a str. 2457T
ccugaugcagcguaaaccccu

SEQ ID NO: 3844693 - RNA, 19 nt, Shigella flexneri 2a str. 2457T
ccugaugcgacgcuugacg

SEQ ID NO: 3844694 - RNA, 19 nt, Shigella flexneri 2a str. 2457T
ccugaugcgaugcuugacg

SEQ ID NO: 3844695 - RNA, 18 nt, Shigella flexneri 2a str. 2457T
ccugaugcgcugcgcuua

SEQ ID NO: 3844696 - RNA, 12 nt, Shigella flexneri 2a str. 2457T
ccugaugcguug

SEQ ID NO: 3844697 - RNA, 20 nt, Shigella flexneri 2a str. 2457T
ccugaugugaaagauaaaac

SEQ ID NO: 3844698 - RNA, 19 nt, Shigella flexneri 2a str. 2457T
ccugauuaacgacacucuc

SEQ ID NO: 3844699 - RNA, 18 nt, Shigella flexneri 2a str. 2457T
ccugauuuuauuucggaa

SEQ ID NO: 3844700 - RNA, 22 nt, Shigella flexneri 2a str. 2457T
ccugcaacgagugcaucuggua

SEQ ID NO: 3844701 - RNA, 22 nt, Shigella flexneri 2a str. 2457T
ccugcaacgguugauggcaguc

SEQ ID NO: 3844702 - RNA, 18 nt, Shigella flexneri 2a str. 2457T
ccugcaauaccgccguua

SEQ ID NO: 3844703 - RNA, 13 nt, Shigella flexneri 2a str. 2457T
ccugcaauuccug

SEQ ID NO: 3844704 - RNA, 23 nt, Shigella flexneri 2a str. 2457T
ccugcaauuuauugauuuugcaa

SEQ ID NO: 3844705 - RNA, 19 nt, Shigella flexneri 2a str. 2457T
ccugcacaaauagccagca

SEQ ID NO: 3844706 - RNA, 19 nt, Shigella flexneri 2a str. 2457T
ccugcaccggugcauccac

SEQ ID NO: 3844707 - RNA, 16 nt, Shigella flexneri 2a str. 2457T
ccugcacgaccggguu

SEQ ID NO: 3844708 - RNA, 22 nt, Shigella flexneri 2a str. 2457T
ccugcacggagauauccagcgc

SEQ ID NO: 3844709 - RNA, 17 nt, Shigella flexneri 2a str. 2457T
ccugcacuuaacaggau

SEQ ID NO: 3844710 - RNA, 14 nt, Shigella flexneri 2a str. 2457T
ccugcacuuucagc

SEQ ID NO: 3844711 - RNA, 12 nt, Shigella flexneri 2a str. 2457T
ccugcagcuuca

SEQ ID NO: 3844712 - RNA, 15 nt, Shigella flexneri 2a str. 2457T
ccugcagggcuuuca

SEQ ID NO: 3844713 - RNA, 14 nt, Shigella flexneri 2a str. 2457T
ccugcagucaccug

SEQ ID NO: 3844714 - RNA, 17 nt, Shigella flexneri 2a str. 2457T
ccugcagugaaauuaaa

SEQ ID NO: 3844715 - RNA, 16 nt, Shigella flexneri 2a str. 2457T
ccugcauaaacgccgu

SEQ ID NO: 3844716 - RNA, 22 nt, Shigella flexneri 2a str. 2457T
ccugcauaaaggaguaacagau

SEQ ID NO: 3844717 - RNA, 18 nt, Shigella flexneri 2a str. 2457T
ccugcauacgacgugccg

SEQ ID NO: 3844718 - RNA, 21 nt, Shigella flexneri 2a str. 2457T
ccugcauacgacgugccgcag

SEQ ID NO: 3844719 - RNA, 11 nt, Shigella flexneri 2a str. 2457T
ccugcauaucg

SEQ ID NO: 3844720 - RNA, 23 nt, Shigella flexneri 2a str. 2457T
ccugcauaucgguaaaugcuuua

SEQ ID NO: 3844721 - RNA, 21 nt, Shigella flexneri 2a str. 2457T
ccugucugcaaaaaugccuuu

SEQ ID NO: 3844722 - RNA, 14 nt, Shigella flexneri 2a str. 2457T
ccugucuucccugc

SEQ ID NO: 3844723 - RNA, 15 nt, Shigella flexneri 2a str. 2457T
ccugugacagcagcg

SEQ ID NO: 3844724 - RNA, 13 nt, Shigella flexneri 2a str. 2457T
ccugugccagcca

SEQ ID NO: 3844725 - RNA, 14 nt, Shigella flexneri 2a str. 2457T
ccugugccagccau

SEQ ID NO: 3844726 - RNA, 18 nt, Shigella flexneri 2a str. 2457T
ccugugccugagccggag

SEQ ID NO: 3844727 - RNA, 16 nt, Shigella flexneri 2a str. 2457T
ccugugcgccaggaua

SEQ ID NO: 3844728 - RNA, 18 nt, Shigella flexneri 2a str. 2457T
ccugugcgcccuguucug

SEQ ID NO: 3844729 - RNA, 18 nt, Shigella flexneri 2a str. 2457T
ccuguggacgcagcucau

SEQ ID NO: 3844730 - RNA, 18 nt, Shigella flexneri 2a str. 2457T
ccugugggccgauggcua

SEQ ID NO: 3844731 - RNA, 22 nt, Shigella flexneri 2a str. 2457T
ccuguuaagaagggcuggccaa

SEQ ID NO: 3844732 - RNA, 20 nt, Shigella flexneri 2a str. 2457T
ccuguuacauaugcgcuggc

SEQ ID NO: 3844733 - RNA, 13 nt, Shigella flexneri 2a str. 2457T
ccuguuaugccuc

SEQ ID NO: 3844734 - RNA, 17 nt, Shigella flexneri 2a str. 2457T
ccuguuccagacgcugc

SEQ ID NO: 3844735 - RNA, 14 nt, Shigella flexneri 2a str. 2457T
ccuguucgccgccg

SEQ ID NO: 3844736 - RNA, 16 nt, Shigella flexneri 2a str. 2457T
ccuguugaugccagua

SEQ ID NO: 3844737 - RNA, 16 nt, Shigella flexneri 2a str. 2457T
ccuguugccauuucug

SEQ ID NO: 3844738 - RNA, 13 nt, Shigella flexneri 2a str. 2457T
ccuguugcccuuu

SEQ ID NO: 3844739 - RNA, 18 nt, Shigella flexneri 2a str. 2457T
ccuguugcgucgccgccu

SEQ ID NO: 3844740 - RNA, 16 nt, Shigella flexneri 2a str. 2457T
ccuguugucuuuccag

SEQ ID NO: 3844741 - RNA, 17 nt, Shigella flexneri 2a str. 2457T
ccuguuuagccgcuucu

SEQ ID NO: 3844742 - RNA, 20 nt, Shigella flexneri 2a str. 2457T
ccuguuuagccgcuucugca

SEQ ID NO: 3844743 - RNA, 21 nt, Shigella flexneri 2a str. 2457T
ccuguuugguugccagccaca

SEQ ID NO: 3844744 - RNA, 23 nt, Shigella flexneri 2a str. 2457T
ccuguuuugucuuuuuaaugacu

SEQ ID NO: 3844745 - RNA, 16 nt, Shigella flexneri 2a str. 2457T
ccuuaacgcaaaaucu

SEQ ID NO: 3844746 - RNA, 18 nt, Shigella flexneri 2a str. 2457T
ccuuaacgguaucuuucc

SEQ ID NO: 3844747 - RNA, 19 nt, Shigella flexneri 2a str. 2457T
ccuuaacuucaucagcaaa

SEQ ID NO: 3844748 - RNA, 15 nt, Shigella flexneri 2a str. 2457T
ccuuaaucagaauuu

SEQ ID NO: 3844749 - RNA, 18 nt, Shigella flexneri 2a str. 2457T
ccuuaccccugacgcuua

SEQ ID NO: 3844750 - RNA, 17 nt, Shigella flexneri 2a str. 2457T
ccuuacucauaaauacu

SEQ ID NO: 3844751 - RNA, 18 nt, Shigella flexneri 2a str. 2457T
ccuuacugcccccggcgu

SEQ ID NO: 3844752 - RNA, 19 nt, Shigella flexneri 2a str. 2457T
ccuuacuuacacaucaaga

SEQ ID NO: 3844753 - RNA, 20 nt, Shigella flexneri 2a str. 2457T
ccuuacuuacacaucaagau

SEQ ID NO: 3844754 - RNA, 16 nt, Shigella flexneri 2a str. 2457T
ccuuagcaacaggcca

SEQ ID NO: 3844755 - RNA, 17 nt, Shigella flexneri 2a str. 2457T
ccuuagcuaauuuuugu

SEQ ID NO: 3844756 - RNA, 12 nt, Shigella flexneri 2a str. 2457T
ccuuagguauuc

SEQ ID NO: 3844757 - RNA, 17 nt, Shigella flexneri 2a str. 2457T
ccuuaguaacgccagcg

SEQ ID NO: 3844758 - RNA, 20 nt, Shigella flexneri 2a str. 2457T
ccuuauccggcuuaccgcuc

SEQ ID NO: 3844759 - RNA, 20 nt, Shigella flexneri 2a str. 2457T
ccuucaacacuggcaaaauc

SEQ ID NO: 3844760 - RNA, 15 nt, Shigella flexneri 2a str. 2457T
ccuucaacccaucaa

SEQ ID NO: 3844761 - RNA, 13 nt, Shigella flexneri 2a str. 2457T
ccuucaacgcggc

SEQ ID NO: 3844762 - RNA, 13 nt, Shigella flexneri 2a str. 2457T
ccuucaauaucau

SEQ ID NO: 3844763 - RNA, 22 nt, Shigella flexneri 2a str. 2457T
ccuucacauuucccggaauaau

SEQ ID NO: 3844764 - RNA, 18 nt, Shigella flexneri 2a str. 2457T
ccuucacgacauaaacau

SEQ ID NO: 3844765 - RNA, 16 nt, Shigella flexneri 2a str. 2457T
ccuucacgcgcuccag

SEQ ID NO: 3844766 - RNA, 13 nt, Shigella flexneri 2a str. 2457T
ccuucacuuuugc

SEQ ID NO: 3844767 - RNA, 17 nt, Shigella flexneri 2a str. 2457T
ccuucagcaacuuguuc

SEQ ID NO: 3844768 - RNA, 14 nt, Shigella flexneri 2a str. 2457T
ccuucagccaccag

SEQ ID NO: 3844769 - RNA, 19 nt, Shigella flexneri 2a str. 2457T
ccuucaggugguuagcugc

SEQ ID NO: 3844770 - RNA, 16 nt, Shigella flexneri 2a str. 2457T
ccuucagguuuuucag

SEQ ID NO: 3844771 - RNA, 22 nt, Shigella flexneri 2a str. 2457T
ccuucauauuccugacccagca

SEQ ID NO: 3844772 - RNA, 18 nt, Shigella flexneri 2a str. 2457T
ccuucauccagcaucaua

SEQ ID NO: 3844773 - RNA, 19 nt, Shigella flexneri 2a str. 2457T
ccuucaucguuucugcugg

SEQ ID NO: 3844774 - RNA, 14 nt, Shigella flexneri 2a str. 2457T
ccuucaucuucaac

SEQ ID NO: 3844775 - RNA, 19 nt, Shigella flexneri 2a str. 2457T
ccuucaucuucauccggcu

SEQ ID NO: 3844776 - RNA, 20 nt, Shigella flexneri 2a str. 2457T
ccuucauuugccagcuucag

SEQ ID NO: 3844777 - RNA, 14 nt, Shigella flexneri 2a str. 2457T
ccuuccagcuccag

SEQ ID NO: 3844778 - RNA, 20 nt, Shigella flexneri 2a str. 2457T
ccuuccgcaauacagccagc

SEQ ID NO: 3844779 - RNA, 19 nt, Shigella flexneri 2a str. 2457T
ccuuccugaacggucgagg

SEQ ID NO: 3844780 - RNA, 18 nt, Shigella flexneri 2a str. 2457T
ccuuccuuagcaaaauag

SEQ ID NO: 3844781 - RNA, 15 nt, Shigella flexneri 2a str. 2457T
ccuucgaaucccgca

SEQ ID NO: 3844782 - RNA, 13 nt, Shigella flexneri 2a str. 2457T
ccuucgccaccgu

SEQ ID NO: 3844783 - RNA, 12 nt, Shigella flexneri 2a str. 2457T
ccuucgcggcac

SEQ ID NO: 3844784 - RNA, 14 nt, Shigella flexneri 2a str. 2457T
ccuucggccccauc

SEQ ID NO: 3844785 - RNA, 23 nt, Shigella flexneri 2a str. 2457T
ccuucggggcggcuaucccaaag

SEQ ID NO: 3844786 - RNA, 19 nt, Shigella flexneri 2a str. 2457T
ccuucggggcuaaugccag

SEQ ID NO: 3844787 - RNA, 22 nt, Shigella flexneri 2a str. 2457T
ccuucgguagcagcuuucagca

SEQ ID NO: 3844788 - RNA, 23 nt, Shigella flexneri 2a str. 2457T
ccuucguuauccucugcaagaua

SEQ ID NO: 3844789 - RNA, 13 nt, Shigella flexneri 2a str. 2457T
ccuucuaaagcaa

SEQ ID NO: 3844790 - RNA, 13 nt, Shigella flexneri 2a str. 2457T
ccuucucagcggu

SEQ ID NO: 3844791 - RNA, 12 nt, Shigella flexneri 2a str. 2457T
ccuucuccacac

SEQ ID NO: 3844792 - RNA, 15 nt, Shigella flexneri 2a str. 2457T
ccuucuccacaccgu

SEQ ID NO: 3844793 - RNA, 14 nt, Shigella flexneri 2a str. 2457T
ccuucugagaucaa

SEQ ID NO: 3844794 - RNA, 19 nt, Shigella flexneri 2a str. 2457T
ccuucugagaucaaugcgc

SEQ ID NO: 3844795 - RNA, 11 nt, Shigella flexneri 2a str. 2457T
ccuucuucauc

SEQ ID NO: 3844796 - RNA, 16 nt, Shigella flexneri 2a str. 2457T
ccuucuugaacccuuu

SEQ ID NO: 3844797 - RNA, 16 nt, Shigella flexneri 2a str. 2457T
ccuucuuuaugucgca

SEQ ID NO: 3844798 - RNA, 19 nt, Shigella flexneri 2a str. 2457T
ccuugaguaccauuugcau

SEQ ID NO: 3844799 - RNA, 17 nt, Shigella flexneri 2a str. 2457T
ccuugaguuuuucaucc

SEQ ID NO: 3844800 - RNA, 16 nt, Shigella flexneri 2a str. 2457T
ccuugauauaaauccc

SEQ ID NO: 3844801 - RNA, 14 nt, Shigella flexneri 2a str. 2457T
ccuugaugaaaaaa

SEQ ID NO: 3844802 - RNA, 18 nt, Shigella flexneri 2a str. 2457T
ccuugauuauuucccucg

SEQ ID NO: 3844803 - RNA, 13 nt, Shigella flexneri 2a str. 2457T
ccuugcaacuccg

SEQ ID NO: 3844804 - RNA, 16 nt, Shigella flexneri 2a str. 2457T
ccuugcaguugaucua

SEQ ID NO: 3844805 - RNA, 23 nt, Shigella flexneri 2a str. 2457T
ccuugccggaugcggcguaaaug

SEQ ID NO: 3844806 - RNA, 16 nt, Shigella flexneri 2a str. 2457T
ccuugcggaaauucca

SEQ ID NO: 3844807 - RNA, 17 nt, Shigella flexneri 2a str. 2457T
ccuugcggaaauuccag

SEQ ID NO: 3844808 - RNA, 13 nt, Shigella flexneri 2a str. 2457T
ccuugcuucgcca

SEQ ID NO: 3844809 - RNA, 18 nt, Shigella flexneri 2a str. 2457T
ccuugcuucgccaguucg

SEQ ID NO: 3844810 - RNA, 22 nt, Shigella flexneri 2a str. 2457T
ccuugucaucgucggccuuaau

SEQ ID NO: 3844811 - RNA, 13 nt, Shigella flexneri 2a str. 2457T
ccuugucaugcag

SEQ ID NO: 3844812 - RNA, 19 nt, Shigella flexneri 2a str. 2457T
ccuugugggccugaaagcu

SEQ ID NO: 3844813 - RNA, 15 nt, Shigella flexneri 2a str. 2457T
ccuuguuuaaggaaa

SEQ ID NO: 3844814 - RNA, 19 nt, Shigella flexneri 2a str. 2457T
ccuuguuucuucaacgaag

SEQ ID NO: 3844815 - RNA, 11 nt, Shigella flexneri 2a str. 2457T
ccuuuaccaga

SEQ ID NO: 3844816 - RNA, 20 nt, Shigella flexneri 2a str. 2457T
ccuuuaccgccacagcagcc

SEQ ID NO: 3844817 - RNA, 18 nt, Shigella flexneri 2a str. 2457T
ccuuuaucgcgcagcaga

SEQ ID NO: 3844818 - RNA, 21 nt, Shigella flexneri 2a str. 2457T
ccuuucagauguuccgccauu

SEQ ID NO: 3844819 - RNA, 13 nt, Shigella flexneri 2a str. 2457T
cgaauaaaaaaag

SEQ ID NO: 3844820 - RNA, 14 nt, Shigella flexneri 2a str. 2457T
cgaauacacccuga

SEQ ID NO: 3844821 - RNA, 17 nt, Shigella flexneri 2a str. 2457T
cgaauaccguaacgacu

SEQ ID NO: 3844822 - RNA, 13 nt, Shigella flexneri 2a str. 2457T
cgaauaccuucuu

SEQ ID NO: 3844823 - RNA, 19 nt, Shigella flexneri 2a str. 2457T
cgaauaccuucuuccugcg

SEQ ID NO: 3844824 - RNA, 22 nt, Shigella flexneri 2a str. 2457T
cgaauacuccccuuucuuauuu

SEQ ID NO: 3844825 - RNA, 12 nt, Shigella flexneri 2a str. 2457T
cgaauagaaagc

SEQ ID NO: 3844826 - RNA, 11 nt, Shigella flexneri 2a str. 2457T
cgaauauaaau

SEQ ID NO: 3844827 - RNA, 16 nt, Shigella flexneri 2a str. 2457T
cgaauauguuuuugca

SEQ ID NO: 3844828 - RNA, 14 nt, Shigella flexneri 2a str. 2457T
cgaaucaacuccag

SEQ ID NO: 3844829 - RNA, 18 nt, Shigella flexneri 2a str. 2457T
cgaaucacguugccguau

SEQ ID NO: 3844830 - RNA, 16 nt, Shigella flexneri 2a str. 2457T
cgaauccagcaugcuc

SEQ ID NO: 3844831 - RNA, 13 nt, Shigella flexneri 2a str. 2457T
cgaauccuucccc

SEQ ID NO: 3844832 - RNA, 16 nt, Shigella flexneri 2a str. 2457T
cgaaucugauuagccu

SEQ ID NO: 3844833 - RNA, 13 nt, Shigella flexneri 2a str. 2457T
cgaaucuguuuuu

SEQ ID NO: 3844834 - RNA, 17 nt, Shigella flexneri 2a str. 2457T
cgaaugacaugcccggu

SEQ ID NO: 3844835 - RNA, 20 nt, Shigella flexneri 2a str. 2457T
cgaaugacguuuacuucgcu

SEQ ID NO: 3844836 - RNA, 16 nt, Shigella flexneri 2a str. 2457T
cgaaugcgaaaauccu

SEQ ID NO: 3844837 - RNA, 22 nt, Shigella flexneri 2a str. 2457T
cgaauggcaucuacgcucucuu

SEQ ID NO: 3844838 - RNA, 17 nt, Shigella flexneri 2a str. 2457T
cgaauggguucgauuuc

SEQ ID NO: 3844839 - RNA, 17 nt, Shigella flexneri 2a str. 2457T
cgaauguuccaucacca

SEQ ID NO: 3844840 - RNA, 11 nt, Shigella flexneri 2a str. 2457T
cgaauguuggc

SEQ ID NO: 3844841 - RNA, 16 nt, Shigella flexneri 2a str. 2457T
cgaauucuaucaugca

SEQ ID NO: 3844842 - RNA, 22 nt, Shigella flexneri 2a str. 2457T
cgaauugaagccaaaucaucca

SEQ ID NO: 3844843 - RNA, 24 nt, Shigella flexneri 2a str. 2457T
cgaauuucauccuguacgacaaaa

SEQ ID NO: 3844844 - RNA, 22 nt, Shigella flexneri 2a str. 2457T
cgaauuuuccaugaccugccag

SEQ ID NO: 3844845 - RNA, 20 nt, Shigella flexneri 2a str. 2457T
cgacaaaaauaccaccaaug

SEQ ID NO: 3844846 - RNA, 21 nt, Shigella flexneri 2a str. 2457T
cgacaaaaucggaaacaaaua

SEQ ID NO: 3844847 - RNA, 22 nt, Shigella flexneri 2a str. 2457T
cgacaaaaucggaaacaaauac

SEQ ID NO: 3844848 - RNA, 15 nt, Shigella flexneri 2a str. 2457T
cgacaaacaccgaac

SEQ ID NO: 3844849 - RNA, 17 nt, Shigella flexneri 2a str. 2457T
cgacaaaugcgccgcca

SEQ ID NO: 3844850 - RNA, 22 nt, Shigella flexneri 2a str. 2457T
cgacaaauuucaucgcuacacc

SEQ ID NO: 3844851 - RNA, 19 nt, Shigella flexneri 2a str. 2457T
cgacaaccugaccuuuuuu

SEQ ID NO: 3844852 - RNA, 23 nt, Shigella flexneri 2a str. 2457T
cgacaaccugaccuuuuuucagc

SEQ ID NO: 3844853 - RNA, 18 nt, Shigella flexneri 2a str. 2457T
cgacaauaaucaccacac

SEQ ID NO: 3844854 - RNA, 17 nt, Shigella flexneri 2a str. 2457T
cgacaauaugcucucca

SEQ ID NO: 3844855 - RNA, 14 nt, Shigella flexneri 2a str. 2457T
cgacaauauugaug

SEQ ID NO: 3844856 - RNA, 17 nt, Shigella flexneri 2a str. 2457T
cgacaaucaaccagcac

SEQ ID NO: 3844857 - RNA, 16 nt, Shigella flexneri 2a str. 2457T
cgacacaaccaccguu

SEQ ID NO: 3844858 - RNA, 17 nt, Shigella flexneri 2a str. 2457T
cgacacagguaucgaca

SEQ ID NO: 3844859 - RNA, 14 nt, Shigella flexneri 2a str. 2457T
cgacagacgccagc

SEQ ID NO: 3844860 - RNA, 16 nt, Shigella flexneri 2a str. 2457T
cgacagacgccagcgc

SEQ ID NO: 3844861 - RNA, 14 nt, Shigella flexneri 2a str. 2457T
cgacagaugcucgc

SEQ ID NO: 3844862 - RNA, 17 nt, Shigella flexneri 2a str. 2457T
cgacagcgccuuuucuu

SEQ ID NO: 3844863 - RNA, 21 nt, Shigella flexneri 2a str. 2457T
cgacagcguguuaaugcccau

SEQ ID NO: 3844864 - RNA, 19 nt, Shigella flexneri 2a str. 2457T
cgacagcguuucgccaccc

SEQ ID NO: 3844865 - RNA, 13 nt, Shigella flexneri 2a str. 2457T
cgacaggaacgcc

SEQ ID NO: 3844866 - RNA, 17 nt, Shigella flexneri 2a str. 2457T
cgacagggaucucuucc

SEQ ID NO: 3844867 - RNA, 18 nt, Shigella flexneri 2a str. 2457T
cgacagggaucucuucca

SEQ ID NO: 3844868 - RNA, 19 nt, Shigella flexneri 2a str. 2457T
cgacagggaucucuuccag

SEQ ID NO: 3844869 - RNA, 22 nt, Shigella flexneri 2a str. 2457T
cgacagggaucucuuccagugc

SEQ ID NO: 3844870 - RNA, 15 nt, Shigella flexneri 2a str. 2457T
cgacaguaccagcag

SEQ ID NO: 3844871 - RNA, 17 nt, Shigella flexneri 2a str. 2457T
cgacaguaccagcagua

SEQ ID NO: 3844872 - RNA, 13 nt, Shigella flexneri 2a str. 2457T
cgacauaaaauaa

SEQ ID NO: 3844873 - RNA, 21 nt, Shigella flexneri 2a str. 2457T
cgacauacaccgcagccgcca

SEQ ID NO: 3844874 - RNA, 23 nt, Shigella flexneri 2a str. 2457T
cgacauacucagcgccugcugca

SEQ ID NO: 3844875 - RNA, 15 nt, Shigella flexneri 2a str. 2457T
cgacauauucaccau

SEQ ID NO: 3844876 - RNA, 22 nt, Shigella flexneri 2a str. 2457T
cgacauccgugcagaacuaaaa

SEQ ID NO: 3844877 - RNA, 20 nt, Shigella flexneri 2a str. 2457T
cgacaucgacguagugaaau

SEQ ID NO: 3844878 - RNA, 12 nt, Shigella flexneri 2a str. 2457T
cgacaucgccac

SEQ ID NO: 3844879 - RNA, 15 nt, Shigella flexneri 2a str. 2457T
cgacaucugucagug

SEQ ID NO: 3844880 - RNA, 15 nt, Shigella flexneri 2a str. 2457T
cgacaugcaucacgc

SEQ ID NO: 3844881 - RNA, 14 nt, Shigella flexneri 2a str. 2457T
cgacaugcuuacca

SEQ ID NO: 3844882 - RNA, 19 nt, Shigella flexneri 2a str. 2457T
cgacauggcaauagcuucu

SEQ ID NO: 3844883 - RNA, 18 nt, Shigella flexneri 2a str. 2457T
cgacauugauguuuucag

SEQ ID NO: 3844884 - RNA, 16 nt, Shigella flexneri 2a str. 2457T
cgacauuucugcugcc

SEQ ID NO: 3844885 - RNA, 21 nt, Shigella flexneri 2a str. 2457T
cgacauuuucucuacccgcuc

SEQ ID NO: 3844886 - RNA, 12 nt, Shigella flexneri 2a str. 2457T
cgaccaccaccg

SEQ ID NO: 3844887 - RNA, 12 nt, Shigella flexneri 2a str. 2457T
cgaccacuucau

SEQ ID NO: 3844888 - RNA, 14 nt, Shigella flexneri 2a str. 2457T
cgaccagaaaugca

SEQ ID NO: 3844889 - RNA, 19 nt, Shigella flexneri 2a str. 2457T
cgaccaggccaucagcagc

SEQ ID NO: 3844890 - RNA, 15 nt, Shigella flexneri 2a str. 2457T
cgaccauacagcagc

SEQ ID NO: 3844891 - RNA, 18 nt, Shigella flexneri 2a str. 2457T
cgaccauacagcagcaac

SEQ ID NO: 3844892 - RNA, 14 nt, Shigella flexneri 2a str. 2457T
cgaccaucagcugc

SEQ ID NO: 3844893 - RNA, 19 nt, Shigella flexneri 2a str. 2457T
cgaccaucggcaccaccaa

SEQ ID NO: 3844894 - RNA, 21 nt, Shigella flexneri 2a str. 2457T
cgaccaucuccuuacugcccc

SEQ ID NO: 3844895 - RNA, 18 nt, Shigella flexneri 2a str. 2457T
cgaccaugacacuucagc

SEQ ID NO: 3844896 - RNA, 16 nt, Shigella flexneri 2a str. 2457T
cgacccagaaacaggc

SEQ ID NO: 3844897 - RNA, 19 nt, Shigella flexneri 2a str. 2457T
cgacccagccagacgccag

SEQ ID NO: 3844898 - RNA, 21 nt, Shigella flexneri 2a str. 2457T
cgacccgacagaugcucgcca

SEQ ID NO: 3844899 - RNA, 23 nt, Shigella flexneri 2a str. 2457T
cgacccgccuugauauaaauccc

SEQ ID NO: 3844900 - RNA, 15 nt, Shigella flexneri 2a str. 2457T
cgaccgaacagauca

SEQ ID NO: 3844901 - RNA, 17 nt, Shigella flexneri 2a str. 2457T
cgaccgaacagaucacg

SEQ ID NO: 3844902 - RNA, 19 nt, Shigella flexneri 2a str. 2457T
cgaccgaagccuuuaccgc

SEQ ID NO: 3844903 - RNA, 19 nt, Shigella flexneri 2a str. 2457T
cgaccggcguaacggccac

SEQ ID NO: 3844904 - RNA, 17 nt, Shigella flexneri 2a str. 2457T
cgaccggguuagucugg

SEQ ID NO: 3844905 - RNA, 15 nt, Shigella flexneri 2a str. 2457T
cgaccguuccauuca

SEQ ID NO: 3844906 - RNA, 18 nt, Shigella flexneri 2a str. 2457T
cgaccuacgcgcccgcgc

SEQ ID NO: 3844907 - RNA, 12 nt, Shigella flexneri 2a str. 2457T
cgaccugauuuu

SEQ ID NO: 3844908 - RNA, 16 nt, Shigella flexneri 2a str. 2457T
cgaccugauuuugcaa

SEQ ID NO: 3844909 - RNA, 18 nt, Shigella flexneri 2a str. 2457T
cgaccugcgccugcacca

SEQ ID NO: 3844910 - RNA, 19 nt, Shigella flexneri 2a str. 2457T
cgaccuguaccuucagcgg

SEQ ID NO: 3844911 - RNA, 20 nt, Shigella flexneri 2a str. 2457T
cgaccuucgcggucagcgcc

SEQ ID NO: 3844912 - RNA, 15 nt, Shigella flexneri 2a str. 2457T
cgacgaacaccaacc

SEQ ID NO: 3844913 - RNA, 15 nt, Shigella flexneri 2a str. 2457T
cgacgaacagcucag

SEQ ID NO: 3844914 - RNA, 14 nt, Shigella flexneri 2a str. 2457T
cgacgacgcgcgcg

SEQ ID NO: 3844915 - RNA, 20 nt, Shigella flexneri 2a str. 2457T
cgacgacugccgcucaccug

SEQ ID NO: 3844916 - RNA, 21 nt, Shigella flexneri 2a str. 2457T
cgacgacugccgcucaccuga

SEQ ID NO: 3844917 - RNA, 16 nt, Shigella flexneri 2a str. 2457T
cgaggcuuauccggca

SEQ ID NO: 3844918 - RNA, 19 nt, Shigella flexneri 2a str. 2457T
cgagggagaaaacccggcc

SEQ ID NO: 3844919 - RNA, 17 nt, Shigella flexneri 2a str. 2457T
cgagggcgauauccuga

SEQ ID NO: 3844920 - RNA, 17 nt, Shigella flexneri 2a str. 2457T
cgaggggaccgccccug

SEQ ID NO: 3844921 - RNA, 19 nt, Shigella flexneri 2a str. 2457T
cgaggggacuguccgggca

SEQ ID NO: 3844922 - RNA, 19 nt, Shigella flexneri 2a str. 2457T
cgagguacgcuccagcagg

SEQ ID NO: 3844923 - RNA, 15 nt, Shigella flexneri 2a str. 2457T
cgagguccagcuccg

SEQ ID NO: 3844924 - RNA, 16 nt, Shigella flexneri 2a str. 2457T
cgaggugcucuccacg

SEQ ID NO: 3844925 - RNA, 21 nt, Shigella flexneri 2a str. 2457T
cgagguuaaacgcuauuugcc

SEQ ID NO: 3844926 - RNA, 18 nt, Shigella flexneri 2a str. 2457T
cgagguuauccgccagcg

SEQ ID NO: 3844927 - RNA, 16 nt, Shigella flexneri 2a str. 2457T
cgagguuggcucauca

SEQ ID NO: 3844928 - RNA, 13 nt, Shigella flexneri 2a str. 2457T
cgagguuuuccuu

SEQ ID NO: 3844929 - RNA, 16 nt, Shigella flexneri 2a str. 2457T
cgagguuuucuucgcc

SEQ ID NO: 3844930 - RNA, 12 nt, Shigella flexneri 2a str. 2457T
cgaguaaaaaaa

SEQ ID NO: 3844931 - RNA, 15 nt, Shigella flexneri 2a str. 2457T
cgaguaaaaaaacau

SEQ ID NO: 3844932 - RNA, 14 nt, Shigella flexneri 2a str. 2457T
cgaguagaucaaca

SEQ ID NO: 3844933 - RNA, 22 nt, Shigella flexneri 2a str. 2457T
cgaguauugucuccgcugagac

SEQ ID NO: 3844934 - RNA, 16 nt, Shigella flexneri 2a str. 2457T
cgaguccuuccagguc

SEQ ID NO: 3844935 - RNA, 19 nt, Shigella flexneri 2a str. 2457T
cgagucgcguuaaggcguc

SEQ ID NO: 3844936 - RNA, 17 nt, Shigella flexneri 2a str. 2457T
cgagucgcugagcgugc

SEQ ID NO: 3844937 - RNA, 20 nt, Shigella flexneri 2a str. 2457T
cgagucgcugagcgugcccc

SEQ ID NO: 3844938 - RNA, 16 nt, Shigella flexneri 2a str. 2457T
cgagucgucaguucca

SEQ ID NO: 3844939 - RNA, 13 nt, Shigella flexneri 2a str. 2457T
cgaguugaucacg

SEQ ID NO: 3844940 - RNA, 15 nt, Shigella flexneri 2a str. 2457T
cgaguuggugcgccg

SEQ ID NO: 3844941 - RNA, 12 nt, Shigella flexneri 2a str. 2457T
cgauaaaaccuu

SEQ ID NO: 3844942 - RNA, 15 nt, Shigella flexneri 2a str. 2457T
cgauaaacgccggau

SEQ ID NO: 3844943 - RNA, 13 nt, Shigella flexneri 2a str. 2457T
cgauaaacucaau

SEQ ID NO: 3844944 - RNA, 18 nt, Shigella flexneri 2a str. 2457T
cgauaaacucaaucaggc

SEQ ID NO: 3844945 - RNA, 14 nt, Shigella flexneri 2a str. 2457T
cgauaaagcugggu

SEQ ID NO: 3844946 - RNA, 21 nt, Shigella flexneri 2a str. 2457T
cgauaaaggucgacagcagcc

SEQ ID NO: 3844947 - RNA, 20 nt, Shigella flexneri 2a str. 2457T
cgauaaauggcgcauccagc

SEQ ID NO: 3844948 - RNA, 14 nt, Shigella flexneri 2a str. 2457T
cgauaaccacgcuc

SEQ ID NO: 3844949 - RNA, 17 nt, Shigella flexneri 2a str. 2457T
cgauaaccuucuucauu

SEQ ID NO: 3844950 - RNA, 19 nt, Shigella flexneri 2a str. 2457T
cgauaacgccccaauccac

SEQ ID NO: 3844951 - RNA, 15 nt, Shigella flexneri 2a str. 2457T
cgauaacucgcuuug

SEQ ID NO: 3844952 - RNA, 21 nt, Shigella flexneri 2a str. 2457T
cgauaacucgcuuugcccaga

SEQ ID NO: 3844953 - RNA, 17 nt, Shigella flexneri 2a str. 2457T
cgauaagcaacgcggcg

SEQ ID NO: 3844954 - RNA, 22 nt, Shigella flexneri 2a str. 2457T
cgauaagguaucgcgaaaaaaa

SEQ ID NO: 3844955 - RNA, 19 nt, Shigella flexneri 2a str. 2457T
cgauaauauugaugcacac

SEQ ID NO: 3844956 - RNA, 13 nt, Shigella flexneri 2a str. 2457T
cgauaaugcccag

SEQ ID NO: 3844957 - RNA, 20 nt, Shigella flexneri 2a str. 2457T
cgauaauuuaugccugauac

SEQ ID NO: 3844958 - RNA, 14 nt, Shigella flexneri 2a str. 2457T
cgauacaacgcuuu

SEQ ID NO: 3844959 - RNA, 22 nt, Shigella flexneri 2a str. 2457T
cgauaccaauaucaacguaaug

SEQ ID NO: 3844960 - RNA, 12 nt, Shigella flexneri 2a str. 2457T
cgauacccauuu

SEQ ID NO: 3844961 - RNA, 18 nt, Shigella flexneri 2a str. 2457T
cgauacccccaguaaaug

SEQ ID NO: 3844962 - RNA, 12 nt, Shigella flexneri 2a str. 2457T
cgauaccguuca

SEQ ID NO: 3844963 - RNA, 22 nt, Shigella flexneri 2a str. 2457T
cgauacgacacgccuccuggcu

SEQ ID NO: 3844964 - RNA, 14 nt, Shigella flexneri 2a str. 2457T
cgauacgcugcaca

SEQ ID NO: 3844965 - RNA, 22 nt, Shigella flexneri 2a str. 2457T
cgauacgcugcacaauugccag

SEQ ID NO: 3844966 - RNA, 16 nt, Shigella flexneri 2a str. 2457T
cgauacuuauaagcuc

SEQ ID NO: 3844967 - RNA, 14 nt, Shigella flexneri 2a str. 2457T
cgauacuuuuucaa

SEQ ID NO: 3844968 - RNA, 16 nt, Shigella flexneri 2a str. 2457T
cgauagaauauuucua

SEQ ID NO: 3844969 - RNA, 15 nt, Shigella flexneri 2a str. 2457T
cgauagagcaaccac

SEQ ID NO: 3844970 - RNA, 20 nt, Shigella flexneri 2a str. 2457T
cgauagagcaaccaccugca

SEQ ID NO: 3844971 - RNA, 13 nt, Shigella flexneri 2a str. 2457T
cgauagcaacgag

SEQ ID NO: 3844972 - RNA, 23 nt, Shigella flexneri 2a str. 2457T
cgauagcgcacgcgcuucacaug

SEQ ID NO: 3844973 - RNA, 21 nt, Shigella flexneri 2a str. 2457T
cgauagcgcccgaacggaaac

SEQ ID NO: 3844974 - RNA, 14 nt, Shigella flexneri 2a str. 2457T
cgauagcgccgcca

SEQ ID NO: 3844975 - RNA, 18 nt, Shigella flexneri 2a str. 2457T
cgauaggcuuccgccauc

SEQ ID NO: 3844976 - RNA, 17 nt, Shigella flexneri 2a str. 2457T
cgauauaaauuccacgc

SEQ ID NO: 3844977 - RNA, 12 nt, Shigella flexneri 2a str. 2457T
cgauauaauaaa

SEQ ID NO: 3844978 - RNA, 14 nt, Shigella flexneri 2a str. 2457T
cgauaucaauauga

SEQ ID NO: 3844979 - RNA, 17 nt, Shigella flexneri 2a str. 2457T
cgauaucgacgaccuga

SEQ ID NO: 3844980 - RNA, 22 nt, Shigella flexneri 2a str. 2457T
cgauaucgccauuaaacaaccc

SEQ ID NO: 3844981 - RNA, 17 nt, Shigella flexneri 2a str. 2457T
cgauaucggaggccugu

SEQ ID NO: 3844982 - RNA, 19 nt, Shigella flexneri 2a str. 2457T
cgauaucuggaucaacgac

SEQ ID NO: 3844983 - RNA, 15 nt, Shigella flexneri 2a str. 2457T
cgauaugccggcauc

SEQ ID NO: 3844984 - RNA, 16 nt, Shigella flexneri 2a str. 2457T
cgauauucauuuugcu

SEQ ID NO: 3844985 - RNA, 20 nt, Shigella flexneri 2a str. 2457T
cgaucaagauugauccccgc

SEQ ID NO: 3844986 - RNA, 12 nt, Shigella flexneri 2a str. 2457T
cgaucacagcag

SEQ ID NO: 3844987 - RNA, 13 nt, Shigella flexneri 2a str. 2457T
cgaucagcggacg

SEQ ID NO: 3844988 - RNA, 18 nt, Shigella flexneri 2a str. 2457T
cgaucagcggacgcugcu

SEQ ID NO: 3844989 - RNA, 23 nt, Shigella flexneri 2a str. 2457T
cgaucaucacguuggucuggucg

SEQ ID NO: 3844990 - RNA, 15 nt, Shigella flexneri 2a str. 2457T
cgaucaucauccagc

SEQ ID NO: 3844991 - RNA, 13 nt, Shigella flexneri 2a str. 2457T
cgaucaucgacag

SEQ ID NO: 3844992 - RNA, 22 nt, Shigella flexneri 2a str. 2457T
cgaucauguaccguugcugcca

SEQ ID NO: 3844993 - RNA, 18 nt, Shigella flexneri 2a str. 2457T
cgaucauuaacaccacgc

SEQ ID NO: 3844994 - RNA, 13 nt, Shigella flexneri 2a str. 2457T
cgauccaccaccg

SEQ ID NO: 3844995 - RNA, 17 nt, Shigella flexneri 2a str. 2457T
cgauccaccaccgcaaa

SEQ ID NO: 3844996 - RNA, 11 nt, Shigella flexneri 2a str. 2457T
cgauccacgcc

SEQ ID NO: 3844997 - RNA, 16 nt, Shigella flexneri 2a str. 2457T
cgauccagugauucca

SEQ ID NO: 3844998 - RNA, 19 nt, Shigella flexneri 2a str. 2457T
cgauccccaaagagagcac

SEQ ID NO: 3844999 - RNA, 17 nt, Shigella flexneri 2a str. 2457T
cgauccggcgguguucu

SEQ ID NO: 3845000 - RNA, 14 nt, Shigella flexneri 2a str. 2457T
cgaucgagugcaau

SEQ ID NO: 3845001 - RNA, 16 nt, Shigella flexneri 2a str. 2457T
cgaucgccagcagggc

SEQ ID NO: 3845002 - RNA, 22 nt, Shigella flexneri 2a str. 2457T
cgaucgccugguaccagcaccg

SEQ ID NO: 3845003 - RNA, 22 nt, Shigella flexneri 2a str. 2457T
cgaucggcgagucgcuccugcc

SEQ ID NO: 3845004 - RNA, 21 nt, Shigella flexneri 2a str. 2457T
cgaucuaggaucgggcauuuu

SEQ ID NO: 3845005 - RNA, 19 nt, Shigella flexneri 2a str. 2457T
cgaucugcgcgucauuuuc

SEQ ID NO: 3845006 - RNA, 14 nt, Shigella flexneri 2a str. 2457T
cgaugacagucugg

SEQ ID NO: 3845007 - RNA, 16 nt, Shigella flexneri 2a str. 2457T
cgaugacaucgcagca

SEQ ID NO: 3845008 - RNA, 13 nt, Shigella flexneri 2a str. 2457T
cgaugaccgccac

SEQ ID NO: 3845009 - RNA, 22 nt, Shigella flexneri 2a str. 2457T
cgaugaccuugucaugcagcuc

SEQ ID NO: 3845010 - RNA, 16 nt, Shigella flexneri 2a str. 2457T
cgaugacuggccggaa

SEQ ID NO: 3845011 - RNA, 17 nt, Shigella flexneri 2a str. 2457T
cgaugacuguacagauc

SEQ ID NO: 3845012 - RNA, 16 nt, Shigella flexneri 2a str. 2457T
cgaugaucaacagcau

SEQ ID NO: 3845013 - RNA, 20 nt, Shigella flexneri 2a str. 2457T
cgaugaugcagccagugauu

SEQ ID NO: 3845014 - RNA, 17 nt, Shigella flexneri 2a str. 2457T
cgaugccccaguaccug

SEQ ID NO: 3845015 - RNA, 18 nt, Shigella flexneri 2a str. 2457T
cgcaauggccguuccggc

SEQ ID NO: 3845016 - RNA, 21 nt, Shigella flexneri 2a str. 2457T
cgcaauggccguuccggcaac

SEQ ID NO: 3845017 - RNA, 18 nt, Shigella flexneri 2a str. 2457T
cgcaauggucccuugcug

SEQ ID NO: 3845018 - RNA, 16 nt, Shigella flexneri 2a str. 2457T
cgcaaugguguacuca

SEQ ID NO: 3845019 - RNA, 12 nt, Shigella flexneri 2a str. 2457T
cgcaaugugcuc

SEQ ID NO: 3845020 - RNA, 12 nt, Shigella flexneri 2a str. 2457T
cgcaauguugcg

SEQ ID NO: 3845021 - RNA, 22 nt, Shigella flexneri 2a str. 2457T
cgcaauucgcgucggcgucagc

SEQ ID NO: 3845022 - RNA, 22 nt, Shigella flexneri 2a str. 2457T
cgcaauugccggaugcgaguuu

SEQ ID NO: 3845023 - RNA, 18 nt, Shigella flexneri 2a str. 2457T
cgcaauuuugacaauaau

SEQ ID NO: 3845024 - RNA, 20 nt, Shigella flexneri 2a str. 2457T
cgcacaaugcuguaaccagc

SEQ ID NO: 3845025 - RNA, 15 nt, Shigella flexneri 2a str. 2457T
cgcacacgccgugca

SEQ ID NO: 3845026 - RNA, 17 nt, Shigella flexneri 2a str. 2457T
cgcacaggcaauccagc

SEQ ID NO: 3845027 - RNA, 20 nt, Shigella flexneri 2a str. 2457T
cgcacaggcaauccagcucg

SEQ ID NO: 3845028 - RNA, 18 nt, Shigella flexneri 2a str. 2457T
cgcacaggugcaaaaaaa

SEQ ID NO: 3845029 - RNA, 19 nt, Shigella flexneri 2a str. 2457T
cgcacaggugcaaaaaaac

SEQ ID NO: 3845030 - RNA, 17 nt, Shigella flexneri 2a str. 2457T
cgcacaguaaugcgcca

SEQ ID NO: 3845031 - RNA, 16 nt, Shigella flexneri 2a str. 2457T
cgcacauuucaaucau

SEQ ID NO: 3845032 - RNA, 13 nt, Shigella flexneri 2a str. 2457T
cgcaccaacucca

SEQ ID NO: 3845033 - RNA, 20 nt, Shigella flexneri 2a str. 2457T
cgcaccaacuccacuucacc

SEQ ID NO: 3845034 - RNA, 11 nt, Shigella flexneri 2a str. 2457T
cgcaccaccag

SEQ ID NO: 3845035 - RNA, 15 nt, Shigella flexneri 2a str. 2457T
cgcaccaccagcagc

SEQ ID NO: 3845036 - RNA, 16 nt, Shigella flexneri 2a str. 2457T
cgcaccaccagcagcu

SEQ ID NO: 3845037 - RNA, 12 nt, Shigella flexneri 2a str. 2457T
cgcaccagcagg

SEQ ID NO: 3845038 - RNA, 14 nt, Shigella flexneri 2a str. 2457T
cgcacccguaacau

SEQ ID NO: 3845039 - RNA, 17 nt, Shigella flexneri 2a str. 2457T
cgcaccggaacaaccca

SEQ ID NO: 3845040 - RNA, 18 nt, Shigella flexneri 2a str. 2457T
cgcaccgggcuuccggca

SEQ ID NO: 3845041 - RNA, 20 nt, Shigella flexneri 2a str. 2457T
cgcaccgggcuuccggcaau

SEQ ID NO: 3845042 - RNA, 16 nt, Shigella flexneri 2a str. 2457T
cgcaccugaguaauua

SEQ ID NO: 3845043 - RNA, 13 nt, Shigella flexneri 2a str. 2457T
cgcaccugccagc

SEQ ID NO: 3845044 - RNA, 12 nt, Shigella flexneri 2a str. 2457T
cgcaccuuuacc

SEQ ID NO: 3845045 - RNA, 22 nt, Shigella flexneri 2a str. 2457T
cgcacgcagggaguuaccgugu

SEQ ID NO: 3845046 - RNA, 13 nt, Shigella flexneri 2a str. 2457T
cgcacgcuggaga

SEQ ID NO: 3845047 - RNA, 14 nt, Shigella flexneri 2a str. 2457T
cgcacgcugguaac

SEQ ID NO: 3845048 - RNA, 17 nt, Shigella flexneri 2a str. 2457T
cgcacggccgcaagcag

SEQ ID NO: 3845049 - RNA, 18 nt, Shigella flexneri 2a str. 2457T
cgcacggccgcaagcaga

SEQ ID NO: 3845050 - RNA, 19 nt, Shigella flexneri 2a str. 2457T
cgcacgucagccucgcugg

SEQ ID NO: 3845051 - RNA, 17 nt, Shigella flexneri 2a str. 2457T
cgcacguugucagcaac

SEQ ID NO: 3845052 - RNA, 19 nt, Shigella flexneri 2a str. 2457T
cgcacguugucagcaacug

SEQ ID NO: 3845053 - RNA, 16 nt, Shigella flexneri 2a str. 2457T
cgcacuauacaaccag

SEQ ID NO: 3845054 - RNA, 17 nt, Shigella flexneri 2a str. 2457T
cgcacuauacaaccaga

SEQ ID NO: 3845055 - RNA, 23 nt, Shigella flexneri 2a str. 2457T
cgcacucguaucaccccgcccga

SEQ ID NO: 3845056 - RNA, 12 nt, Shigella flexneri 2a str. 2457T
cgcacugcugau

SEQ ID NO: 3845057 - RNA, 20 nt, Shigella flexneri 2a str. 2457T
cgcacuggcgagcgccagca

SEQ ID NO: 3845058 - RNA, 22 nt, Shigella flexneri 2a str. 2457T
cgcacuggggggcuauccgcgc

SEQ ID NO: 3845059 - RNA, 12 nt, Shigella flexneri 2a str. 2457T
cgcacuuaauau

SEQ ID NO: 3845060 - RNA, 15 nt, Shigella flexneri 2a str. 2457T
cgcacuuacagcaac

SEQ ID NO: 3845061 - RNA, 16 nt, Shigella flexneri 2a str. 2457T
cgcacuucuuccgggc

SEQ ID NO: 3845062 - RNA, 12 nt, Shigella flexneri 2a str. 2457T
cgcacuugccag

SEQ ID NO: 3845063 - RNA, 18 nt, Shigella flexneri 2a str. 2457T
cgcacuuuuuaaacgaau

SEQ ID NO: 3845064 - RNA, 15 nt, Shigella flexneri 2a str. 2457T
cgcagaaccagaagc

SEQ ID NO: 3845065 - RNA, 22 nt, Shigella flexneri 2a str. 2457T
cgcagacacuuucccuggcgcu

SEQ ID NO: 3845066 - RNA, 17 nt, Shigella flexneri 2a str. 2457T
cgcagagacaucaccaa

SEQ ID NO: 3845067 - RNA, 19 nt, Shigella flexneri 2a str. 2457T
cgcagauaaauaucaaucc

SEQ ID NO: 3845068 - RNA, 21 nt, Shigella flexneri 2a str. 2457T
cgcagauagagcgccugcaga

SEQ ID NO: 3845069 - RNA, 18 nt, Shigella flexneri 2a str. 2457T
cgcagaugaagcuggcaa

SEQ ID NO: 3845070 - RNA, 15 nt, Shigella flexneri 2a str. 2457T
cgcagauuucuucug

SEQ ID NO: 3845071 - RNA, 20 nt, Shigella flexneri 2a str. 2457T
cgcagcacccugaguuuuca

SEQ ID NO: 3845072 - RNA, 12 nt, Shigella flexneri 2a str. 2457T
cgcagcacggcg

SEQ ID NO: 3845073 - RNA, 13 nt, Shigella flexneri 2a str. 2457T
cgcagcagcgcgc

SEQ ID NO: 3845074 - RNA, 12 nt, Shigella flexneri 2a str. 2457T
cgcagcauugcu

SEQ ID NO: 3845075 - RNA, 21 nt, Shigella flexneri 2a str. 2457T
cgcagccacgucaccugcccg

SEQ ID NO: 3845076 - RNA, 22 nt, Shigella flexneri 2a str. 2457T
cgcagccacuccuuauucagcg

SEQ ID NO: 3845077 - RNA, 12 nt, Shigella flexneri 2a str. 2457T
cgcagccagcac

SEQ ID NO: 3845078 - RNA, 15 nt, Shigella flexneri 2a str. 2457T
cgcagccagcacugc

SEQ ID NO: 3845079 - RNA, 21 nt, Shigella flexneri 2a str. 2457T
cgcagccagcacugccgcauc

SEQ ID NO: 3845080 - RNA, 14 nt, Shigella flexneri 2a str. 2457T
cgcagccagcgcgc

SEQ ID NO: 3845081 - RNA, 15 nt, Shigella flexneri 2a str. 2457T
cgcagccaguuaacc

SEQ ID NO: 3845082 - RNA, 11 nt, Shigella flexneri 2a str. 2457T
cgcagccauca

SEQ ID NO: 3845083 - RNA, 14 nt, Shigella flexneri 2a str. 2457T
cgcagccaucagcg

SEQ ID NO: 3845084 - RNA, 14 nt, Shigella flexneri 2a str. 2457T
cgcagccauuacca

SEQ ID NO: 3845085 - RNA, 13 nt, Shigella flexneri 2a str. 2457T
cgcagccccagag

SEQ ID NO: 3845086 - RNA, 14 nt, Shigella flexneri 2a str. 2457T
cgcagccgaguaga

SEQ ID NO: 3845087 - RNA, 18 nt, Shigella flexneri 2a str. 2457T
cgcagcgguuucacagga

SEQ ID NO: 3845088 - RNA, 13 nt, Shigella flexneri 2a str. 2457T
cgcagcgucagca

SEQ ID NO: 3845089 - RNA, 15 nt, Shigella flexneri 2a str. 2457T
cgcagcgucagcacc

SEQ ID NO: 3845090 - RNA, 20 nt, Shigella flexneri 2a str. 2457T
cgcagcgucagcaccagaga

SEQ ID NO: 3845091 - RNA, 17 nt, Shigella flexneri 2a str. 2457T
cgcagcucaucaacacg

SEQ ID NO: 3845092 - RNA, 12 nt, Shigella flexneri 2a str. 2457T
cgcagcuccagc

SEQ ID NO: 3845093 - RNA, 22 nt, Shigella flexneri 2a str. 2457T
cgcagcuccgggcucaugcugu

SEQ ID NO: 3845094 - RNA, 21 nt, Shigella flexneri 2a str. 2457T
cgcagcugagaaaaagcgaag

SEQ ID NO: 3845095 - RNA, 12 nt, Shigella flexneri 2a str. 2457T
cgcagcuucucg

SEQ ID NO: 3845096 - RNA, 20 nt, Shigella flexneri 2a str. 2457T
cgcaggagcgccgaauggau

SEQ ID NO: 3845097 - RNA, 16 nt, Shigella flexneri 2a str. 2457T
cgcaggauaucguggc

SEQ ID NO: 3845098 - RNA, 19 nt, Shigella flexneri 2a str. 2457T
cgcaggauaucguggcacg

SEQ ID NO: 3845099 - RNA, 14 nt, Shigella flexneri 2a str. 2457T
cgcaggccaacagu

SEQ ID NO: 3845100 - RNA, 13 nt, Shigella flexneri 2a str. 2457T
cgcaggccacgaa

SEQ ID NO: 3845101 - RNA, 19 nt, Shigella flexneri 2a str. 2457T
cgcaggcgcaauggcgcaa

SEQ ID NO: 3845102 - RNA, 14 nt, Shigella flexneri 2a str. 2457T
cgcaggcgcugaaa

SEQ ID NO: 3845103 - RNA, 15 nt, Shigella flexneri 2a str. 2457T
cgcaggcgguggaag

SEQ ID NO: 3845104 - RNA, 20 nt, Shigella flexneri 2a str. 2457T
cgcaggcugagaaaugccag

SEQ ID NO: 3845105 - RNA, 17 nt, Shigella flexneri 2a str. 2457T
cgcaggcuguuaccccu

SEQ ID NO: 3845106 - RNA, 23 nt, Shigella flexneri 2a str. 2457T
cgcaggcuguuaccccugcggcc

SEQ ID NO: 3845107 - RNA, 22 nt, Shigella flexneri 2a str. 2457T
cgcagggacacucgcugacuga

SEQ ID NO: 3845108 - RNA, 20 nt, Shigella flexneri 2a str. 2457T
cgcaggguuugcaucgccau

SEQ ID NO: 3845109 - RNA, 19 nt, Shigella flexneri 2a str. 2457T
cgcaggucauccggcacgc

SEQ ID NO: 3845110 - RNA, 20 nt, Shigella flexneri 2a str. 2457T
cgcaggucauccggcacgcu

SEQ ID NO: 3845111 - RNA, 21 nt, Shigella flexneri 2a str. 2457T
cgcaggucgucuuuuacagcg

SEQ ID NO: 3845112 - RNA, 21 nt, Shigella flexneri 2a str. 2457T
cgcaggugacgcgggcagcag

SEQ ID NO: 3845113 - RNA, 15 nt, Shigella flexneri 2a str. 2457T
cgccauccagccggg

SEQ ID NO: 3845114 - RNA, 14 nt, Shigella flexneri 2a str. 2457T
cgccauccuuacgc

SEQ ID NO: 3845115 - RNA, 14 nt, Shigella flexneri 2a str. 2457T
cgccaucgccagca

SEQ ID NO: 3845116 - RNA, 14 nt, Shigella flexneri 2a str. 2457T
cgccaucgccagga

SEQ ID NO: 3845117 - RNA, 18 nt, Shigella flexneri 2a str. 2457T
cgccaucggcagcaucgc

SEQ ID NO: 3845118 - RNA, 23 nt, Shigella flexneri 2a str. 2457T
cgccaugaacgcgaaggccagaa

SEQ ID NO: 3845119 - RNA, 19 nt, Shigella flexneri 2a str. 2457T
cgccaugaagacauacccu

SEQ ID NO: 3845120 - RNA, 18 nt, Shigella flexneri 2a str. 2457T
cgccaugagcggacugaa

SEQ ID NO: 3845121 - RNA, 19 nt, Shigella flexneri 2a str. 2457T
cgccaugcuugaagggcug

SEQ ID NO: 3845122 - RNA, 18 nt, Shigella flexneri 2a str. 2457T
cgccauggcuucucgcca

SEQ ID NO: 3845123 - RNA, 14 nt, Shigella flexneri 2a str. 2457T
cgccauuucuccuc

SEQ ID NO: 3845124 - RNA, 21 nt, Shigella flexneri 2a str. 2457T
cgccauuucuucuccggcauc

SEQ ID NO: 3845125 - RNA, 17 nt, Shigella flexneri 2a str. 2457T
cgccauuuucugccgca

SEQ ID NO: 3845126 - RNA, 16 nt, Shigella flexneri 2a str. 2457T
cgccauuuugcgcggc

SEQ ID NO: 3845127 - RNA, 18 nt, Shigella flexneri 2a str. 2457T
cgccauuuugcgcggcau

SEQ ID NO: 3845128 - RNA, 13 nt, Shigella flexneri 2a str. 2457T
cgcccaacacuuc

SEQ ID NO: 3845129 - RNA, 23 nt, Shigella flexneri 2a str. 2457T
cgcccaacuaaaugcugcagcca

SEQ ID NO: 3845130 - RNA, 14 nt, Shigella flexneri 2a str. 2457T
cgcccaauccggcc

SEQ ID NO: 3845131 - RNA, 22 nt, Shigella flexneri 2a str. 2457T
cgcccaaucgaugggauauaac

SEQ ID NO: 3845132 - RNA, 15 nt, Shigella flexneri 2a str. 2457T
cgcccaccaccagcg

SEQ ID NO: 3845133 - RNA, 19 nt, Shigella flexneri 2a str. 2457T
cgcccacgccagccugcuu

SEQ ID NO: 3845134 - RNA, 24 nt, Shigella flexneri 2a str. 2457T
cgcccacgcgcauucccagcgcgu

SEQ ID NO: 3845135 - RNA, 16 nt, Shigella flexneri 2a str. 2457T
cgcccagaccagaaug

SEQ ID NO: 3845136 - RNA, 13 nt, Shigella flexneri 2a str. 2457T
cgcccagcgcagg

SEQ ID NO: 3845137 - RNA, 21 nt, Shigella flexneri 2a str. 2457T
cgcccagcguacguaacuucu

SEQ ID NO: 3845138 - RNA, 22 nt, Shigella flexneri 2a str. 2457T
cgcccagcgucagcauaaaaau

SEQ ID NO: 3845139 - RNA, 18 nt, Shigella flexneri 2a str. 2457T
cgcccagcuaaucgagcc

SEQ ID NO: 3845140 - RNA, 22 nt, Shigella flexneri 2a str. 2457T
cgcccaggcaaguagcgccaua

SEQ ID NO: 3845141 - RNA, 20 nt, Shigella flexneri 2a str. 2457T
cgcccagugcggugccgcga

SEQ ID NO: 3845142 - RNA, 17 nt, Shigella flexneri 2a str. 2457T
cgcccaguggaugcgcc

SEQ ID NO: 3845143 - RNA, 18 nt, Shigella flexneri 2a str. 2457T
cgcccaguggaugcgcca

SEQ ID NO: 3845144 - RNA, 18 nt, Shigella flexneri 2a str. 2457T
cgcccaguugaucaccag

SEQ ID NO: 3845145 - RNA, 17 nt, Shigella flexneri 2a str. 2457T
cgcccauaaugcgugca

SEQ ID NO: 3845146 - RNA, 11 nt, Shigella flexneri 2a str. 2457T
cgcccaucauu

SEQ ID NO: 3845147 - RNA, 19 nt, Shigella flexneri 2a str. 2457T
cgcccaucgcgcccgccgc

SEQ ID NO: 3845148 - RNA, 13 nt, Shigella flexneri 2a str. 2457T
cgccccaacacaa

SEQ ID NO: 3845149 - RNA, 15 nt, Shigella flexneri 2a str. 2457T
cgccccacaccacca

SEQ ID NO: 3845150 - RNA, 15 nt, Shigella flexneri 2a str. 2457T
cgccccacagaccca

SEQ ID NO: 3845151 - RNA, 21 nt, Shigella flexneri 2a str. 2457T
cgccccagaccugaauuugcu

SEQ ID NO: 3845152 - RNA, 13 nt, Shigella flexneri 2a str. 2457T
cgccccgcucgcu

SEQ ID NO: 3845153 - RNA, 14 nt, Shigella flexneri 2a str. 2457T
cgccccggccuugc

SEQ ID NO: 3845154 - RNA, 17 nt, Shigella flexneri 2a str. 2457T
cgccccggccuugccug

SEQ ID NO: 3845155 - RNA, 22 nt, Shigella flexneri 2a str. 2457T
cgccccugcgcuaaacaggauc

SEQ ID NO: 3845156 - RNA, 22 nt, Shigella flexneri 2a str. 2457T
cgcccgaaugcgaaaauccuca

SEQ ID NO: 3845157 - RNA, 11 nt, Shigella flexneri 2a str. 2457T
cgcccgccaga

SEQ ID NO: 3845158 - RNA, 14 nt, Shigella flexneri 2a str. 2457T
cgcccgccgccauu

SEQ ID NO: 3845159 - RNA, 18 nt, Shigella flexneri 2a str. 2457T
cgcccgccguccggcgcu

SEQ ID NO: 3845160 - RNA, 18 nt, Shigella flexneri 2a str. 2457T
cgcccgcuguaagccaag

SEQ ID NO: 3845161 - RNA, 22 nt, Shigella flexneri 2a str. 2457T
cgcccggauauccacccgcagc

SEQ ID NO: 3845162 - RNA, 14 nt, Shigella flexneri 2a str. 2457T
cgcccggauuacag

SEQ ID NO: 3845163 - RNA, 14 nt, Shigella flexneri 2a str. 2457T
cgcccgguuuccgu

SEQ ID NO: 3845164 - RNA, 18 nt, Shigella flexneri 2a str. 2457T
cgcccgguuuucgcgcgc

SEQ ID NO: 3845165 - RNA, 16 nt, Shigella flexneri 2a str. 2457T
cgcccguuaaccgcuc

SEQ ID NO: 3845166 - RNA, 15 nt, Shigella flexneri 2a str. 2457T
cgcccguuuucucca

SEQ ID NO: 3845167 - RNA, 21 nt, Shigella flexneri 2a str. 2457T
cgcccguuuucuccagcgccg

SEQ ID NO: 3845168 - RNA, 11 nt, Shigella flexneri 2a str. 2457T
cgcccuacucc

SEQ ID NO: 3845169 - RNA, 14 nt, Shigella flexneri 2a str. 2457T
cgcccucacccgua

SEQ ID NO: 3845170 - RNA, 12 nt, Shigella flexneri 2a str. 2457T
cgcccuccugca

SEQ ID NO: 3845171 - RNA, 16 nt, Shigella flexneri 2a str. 2457T
cgcccucgaucggcuc

SEQ ID NO: 3845172 - RNA, 20 nt, Shigella flexneri 2a str. 2457T
cgcccugaaaacgcaguucc

SEQ ID NO: 3845173 - RNA, 15 nt, Shigella flexneri 2a str. 2457T
cgcccugaaccgacg

SEQ ID NO: 3845174 - RNA, 22 nt, Shigella flexneri 2a str. 2457T
cgcccugaaccgacgacagauu

SEQ ID NO: 3845175 - RNA, 22 nt, Shigella flexneri 2a str. 2457T
cgcccugauaaaucaccugcgc

SEQ ID NO: 3845176 - RNA, 15 nt, Shigella flexneri 2a str. 2457T
cgcccugcagcauca

SEQ ID NO: 3845177 - RNA, 19 nt, Shigella flexneri 2a str. 2457T
cgcccugcagcaucaccgg

SEQ ID NO: 3845178 - RNA, 12 nt, Shigella flexneri 2a str. 2457T
cgcccugccuuu

SEQ ID NO: 3845179 - RNA, 18 nt, Shigella flexneri 2a str. 2457T
cgcccugcgcuggugaaa

SEQ ID NO: 3845180 - RNA, 20 nt, Shigella flexneri 2a str. 2457T
cgcccugcgucgcacucuca

SEQ ID NO: 3845181 - RNA, 15 nt, Shigella flexneri 2a str. 2457T
cgcccugcuccagca

SEQ ID NO: 3845182 - RNA, 21 nt, Shigella flexneri 2a str. 2457T
cgcccugggcuucauccagca

SEQ ID NO: 3845183 - RNA, 18 nt, Shigella flexneri 2a str. 2457T
cgcccuguucugcaaggc

SEQ ID NO: 3845184 - RNA, 18 nt, Shigella flexneri 2a str. 2457T
cgcccuucggcaucacga

SEQ ID NO: 3845185 - RNA, 19 nt, Shigella flexneri 2a str. 2457T
cgccgaagugcgcgcagcu

SEQ ID NO: 3845186 - RNA, 17 nt, Shigella flexneri 2a str. 2457T
cgccgaauaacgcgcag

SEQ ID NO: 3845187 - RNA, 16 nt, Shigella flexneri 2a str. 2457T
cgccgacaaagaugca

SEQ ID NO: 3845188 - RNA, 15 nt, Shigella flexneri 2a str. 2457T
cgccgacggcgcuac

SEQ ID NO: 3845189 - RNA, 13 nt, Shigella flexneri 2a str. 2457T
cgccgacugucaa

SEQ ID NO: 3845190 - RNA, 16 nt, Shigella flexneri 2a str. 2457T
cgccgagcaaaccaca

SEQ ID NO: 3845191 - RNA, 18 nt, Shigella flexneri 2a str. 2457T
cgccgaggauacagccga

SEQ ID NO: 3845192 - RNA, 23 nt, Shigella flexneri 2a str. 2457T
cgccgauaaucaacgcgccgcca

SEQ ID NO: 3845193 - RNA, 20 nt, Shigella flexneri 2a str. 2457T
cgccgcaaccguaguggcca

SEQ ID NO: 3845194 - RNA, 20 nt, Shigella flexneri 2a str. 2457T
cgccgcacaauacauagaaa

SEQ ID NO: 3845195 - RNA, 12 nt, Shigella flexneri 2a str. 2457T
cgccgcacacgc

SEQ ID NO: 3845196 - RNA, 19 nt, Shigella flexneri 2a str. 2457T
cgccgcacuuucuccuccc

SEQ ID NO: 3845197 - RNA, 15 nt, Shigella flexneri 2a str. 2457T
cgccgcauccaacau

SEQ ID NO: 3845198 - RNA, 19 nt, Shigella flexneri 2a str. 2457T
cgccgcauccgacacuggc

SEQ ID NO: 3845199 - RNA, 15 nt, Shigella flexneri 2a str. 2457T
cgccgcauccggcau

SEQ ID NO: 3845200 - RNA, 14 nt, Shigella flexneri 2a str. 2457T
cgccgcaucuuccc

SEQ ID NO: 3845201 - RNA, 14 nt, Shigella flexneri 2a str. 2457T
cgccgccacugcca

SEQ ID NO: 3845202 - RNA, 13 nt, Shigella flexneri 2a str. 2457T
cgccgcccagaga

SEQ ID NO: 3845203 - RNA, 15 nt, Shigella flexneri 2a str. 2457T
cgccgcccagccagc

SEQ ID NO: 3845204 - RNA, 17 nt, Shigella flexneri 2a str. 2457T
cgccgcccugcagcauc

SEQ ID NO: 3845205 - RNA, 17 nt, Shigella flexneri 2a str. 2457T
cgccgccgagcaccacg

SEQ ID NO: 3845206 - RNA, 16 nt, Shigella flexneri 2a str. 2457T
cgccgccgcuggcgug

SEQ ID NO: 3845207 - RNA, 22 nt, Shigella flexneri 2a str. 2457T
cgccgccguuagcuucagccgg

SEQ ID NO: 3845208 - RNA, 19 nt, Shigella flexneri 2a str. 2457T
cgccgccucugcgcuuugu

SEQ ID NO: 3845209 - RNA, 19 nt, Shigella flexneri 2a str. 2457T
cgccgccuuuuacgcauuc

SEQ ID NO: 3845210 - RNA, 15 nt, Shigella flexneri 2a str. 2457T
cgccgcggacaauaa

SEQ ID NO: 3845211 - RNA, 15 nt, Shigella flexneri 2a str. 2457T
cgcgauauugcugca

SEQ ID NO: 3845212 - RNA, 14 nt, Shigella flexneri 2a str. 2457T
cgcgauccggcggu

SEQ ID NO: 3845213 - RNA, 13 nt, Shigella flexneri 2a str. 2457T
cgcgaucuuccac

SEQ ID NO: 3845214 - RNA, 14 nt, Shigella flexneri 2a str. 2457T
cgcgaugaccaaaa

SEQ ID NO: 3845215 - RNA, 22 nt, Shigella flexneri 2a str. 2457T
cgcgauugugcgcgauccggcg

SEQ ID NO: 3845216 - RNA, 15 nt, Shigella flexneri 2a str. 2457T
cgcgauuucucauca

SEQ ID NO: 3845217 - RNA, 18 nt, Shigella flexneri 2a str. 2457T
cgcgcaauauccugcgcu

SEQ ID NO: 3845218 - RNA, 16 nt, Shigella flexneri 2a str. 2457T
cgcgcacaucaggacg

SEQ ID NO: 3845219 - RNA, 20 nt, Shigella flexneri 2a str. 2457T
cgcgcaccggaacaacccag

SEQ ID NO: 3845220 - RNA, 15 nt, Shigella flexneri 2a str. 2457T
cgcgcaccuacagcc

SEQ ID NO: 3845221 - RNA, 19 nt, Shigella flexneri 2a str. 2457T
cgcgcacgcccaucagcgg

SEQ ID NO: 3845222 - RNA, 20 nt, Shigella flexneri 2a str. 2457T
cgcgcacgcugguaacggcg

SEQ ID NO: 3845223 - RNA, 18 nt, Shigella flexneri 2a str. 2457T
cgcgcacgucagccucgc

SEQ ID NO: 3845224 - RNA, 20 nt, Shigella flexneri 2a str. 2457T
cgcgcacucgcccugaccug

SEQ ID NO: 3845225 - RNA, 17 nt, Shigella flexneri 2a str. 2457T
cgcgcagcgucgcauca

SEQ ID NO: 3845226 - RNA, 12 nt, Shigella flexneri 2a str. 2457T
cgcgcagcuuca

SEQ ID NO: 3845227 - RNA, 22 nt, Shigella flexneri 2a str. 2457T
cgcgcagggugcagaaucaauc

SEQ ID NO: 3845228 - RNA, 17 nt, Shigella flexneri 2a str. 2457T
cgcgcaguaaauccgcc

SEQ ID NO: 3845229 - RNA, 22 nt, Shigella flexneri 2a str. 2457T
cgcgcagugccgguggaagggc

SEQ ID NO: 3845230 - RNA, 20 nt, Shigella flexneri 2a str. 2457T
cgcgcaguuaaacgccuugc

SEQ ID NO: 3845231 - RNA, 18 nt, Shigella flexneri 2a str. 2457T
cgcgcaguucgucgcguu

SEQ ID NO: 3845232 - RNA, 16 nt, Shigella flexneri 2a str. 2457T
cgcgcaucagcaguuc

SEQ ID NO: 3845233 - RNA, 15 nt, Shigella flexneri 2a str. 2457T
cgcgcaucagcuccg

SEQ ID NO: 3845234 - RNA, 18 nt, Shigella flexneri 2a str. 2457T
cgcgccaagauagaacca

SEQ ID NO: 3845235 - RNA, 14 nt, Shigella flexneri 2a str. 2457T
cgcgccaaucagcg

SEQ ID NO: 3845236 - RNA, 17 nt, Shigella flexneri 2a str. 2457T
cgcgccaaucagcgcag

SEQ ID NO: 3845237 - RNA, 18 nt, Shigella flexneri 2a str. 2457T
cgcgccaaucagcgcagc

SEQ ID NO: 3845238 - RNA, 21 nt, Shigella flexneri 2a str. 2457T
cgcgccaaucagcgcagcacc

SEQ ID NO: 3845239 - RNA, 22 nt, Shigella flexneri 2a str. 2457T
cgcgccaaucagcgcagcaccc

SEQ ID NO: 3845240 - RNA, 16 nt, Shigella flexneri 2a str. 2457T
cgcgccaaugccugau

SEQ ID NO: 3845241 - RNA, 14 nt, Shigella flexneri 2a str. 2457T
cgcgccaccgacca

SEQ ID NO: 3845242 - RNA, 22 nt, Shigella flexneri 2a str. 2457T
cgcgccagaacacgcucccagc

SEQ ID NO: 3845243 - RNA, 13 nt, Shigella flexneri 2a str. 2457T
cgcgccagcuuag

SEQ ID NO: 3845244 - RNA, 21 nt, Shigella flexneri 2a str. 2457T
cgcgccauuucggcgugcugu

SEQ ID NO: 3845245 - RNA, 22 nt, Shigella flexneri 2a str. 2457T
cgcgccauuucggcgugcuguc

SEQ ID NO: 3845246 - RNA, 13 nt, Shigella flexneri 2a str. 2457T
cgcgcccgcgcag

SEQ ID NO: 3845247 - RNA, 14 nt, Shigella flexneri 2a str. 2457T
cgcgcccgcgcagc

SEQ ID NO: 3845248 - RNA, 13 nt, Shigella flexneri 2a str. 2457T
cgcgcccuccugc

SEQ ID NO: 3845249 - RNA, 18 nt, Shigella flexneri 2a str. 2457T
cgcgccgacugcgccaau

SEQ ID NO: 3845250 - RNA, 13 nt, Shigella flexneri 2a str. 2457T
cgcgccgcauccg

SEQ ID NO: 3845251 - RNA, 15 nt, Shigella flexneri 2a str. 2457T
cgcgccgccaacccc

SEQ ID NO: 3845252 - RNA, 16 nt, Shigella flexneri 2a str. 2457T
cgcgccgccucccuuc

SEQ ID NO: 3845253 - RNA, 21 nt, Shigella flexneri 2a str. 2457T
cgcgccgcgcugcuguagcag

SEQ ID NO: 3845254 - RNA, 16 nt, Shigella flexneri 2a str. 2457T
cgcgccgggcagaguc

SEQ ID NO: 3845255 - RNA, 18 nt, Shigella flexneri 2a str. 2457T
cgcgccucuuacgcgaau

SEQ ID NO: 3845256 - RNA, 16 nt, Shigella flexneri 2a str. 2457T
cgcgccuucgugcggc

SEQ ID NO: 3845257 - RNA, 20 nt, Shigella flexneri 2a str. 2457T
cgcgcgaauauggcggcggc

SEQ ID NO: 3845258 - RNA, 13 nt, Shigella flexneri 2a str. 2457T
cgcgcgcaccuga

SEQ ID NO: 3845259 - RNA, 13 nt, Shigella flexneri 2a str. 2457T
cgcgcgccaccau

SEQ ID NO: 3845260 - RNA, 16 nt, Shigella flexneri 2a str. 2457T
cgcgcgguaucaccac

SEQ ID NO: 3845261 - RNA, 19 nt, Shigella flexneri 2a str. 2457T
cgcgcgugaaguggcacag

SEQ ID NO: 3845262 - RNA, 16 nt, Shigella flexneri 2a str. 2457T
cgcgcguguugcgcca

SEQ ID NO: 3845263 - RNA, 15 nt, Shigella flexneri 2a str. 2457T
cgcgcguucgcagag

SEQ ID NO: 3845264 - RNA, 15 nt, Shigella flexneri 2a str. 2457T
cgcgcuacggccgcc

SEQ ID NO: 3845265 - RNA, 14 nt, Shigella flexneri 2a str. 2457T
cgcgcuaucggcag

SEQ ID NO: 3845266 - RNA, 14 nt, Shigella flexneri 2a str. 2457T
cgcgcuauuuuccu

SEQ ID NO: 3845267 - RNA, 18 nt, Shigella flexneri 2a str. 2457T
cgcgcucgucagcuuauu

SEQ ID NO: 3845268 - RNA, 16 nt, Shigella flexneri 2a str. 2457T
cgcgcucuuuaaaggc

SEQ ID NO: 3845269 - RNA, 18 nt, Shigella flexneri 2a str. 2457T
cgcgcugagguccggcca

SEQ ID NO: 3845270 - RNA, 19 nt, Shigella flexneri 2a str. 2457T
cgcgcuuaucgccagcgcc

SEQ ID NO: 3845271 - RNA, 20 nt, Shigella flexneri 2a str. 2457T
cgcgcuuaucgccagcgcca

SEQ ID NO: 3845272 - RNA, 22 nt, Shigella flexneri 2a str. 2457T
cgcgcuucgguguuaaaacgca

SEQ ID NO: 3845273 - RNA, 14 nt, Shigella flexneri 2a str. 2457T
cgcgcuugccgccg

SEQ ID NO: 3845274 - RNA, 19 nt, Shigella flexneri 2a str. 2457T
cgcggaagacccggcggcg

SEQ ID NO: 3845275 - RNA, 13 nt, Shigella flexneri 2a str. 2457T
cgcggacagacuu

SEQ ID NO: 3845276 - RNA, 15 nt, Shigella flexneri 2a str. 2457T
cgcggaccaacaaaa

SEQ ID NO: 3845277 - RNA, 17 nt, Shigella flexneri 2a str. 2457T
cgcggacuccgcuguua

SEQ ID NO: 3845278 - RNA, 13 nt, Shigella flexneri 2a str. 2457T
cgcggagcgccug

SEQ ID NO: 3845279 - RNA, 20 nt, Shigella flexneri 2a str. 2457T
cgcggaucacgcgaccaucg

SEQ ID NO: 3845280 - RNA, 19 nt, Shigella flexneri 2a str. 2457T
cgcggauuuuauucagcag

SEQ ID NO: 3845281 - RNA, 20 nt, Shigella flexneri 2a str. 2457T
cgcggcaauuuuuaccgguc

SEQ ID NO: 3845282 - RNA, 12 nt, Shigella flexneri 2a str. 2457T
cgcggcagcagg

SEQ ID NO: 3845283 - RNA, 13 nt, Shigella flexneri 2a str. 2457T
cgcggcaggcauc

SEQ ID NO: 3845284 - RNA, 19 nt, Shigella flexneri 2a str. 2457T
cgcggcagugacugcccca

SEQ ID NO: 3845285 - RNA, 20 nt, Shigella flexneri 2a str. 2457T
cgcggcauuaccggcaaugu

SEQ ID NO: 3845286 - RNA, 20 nt, Shigella flexneri 2a str. 2457T
cgcggcauuuuuacugcgcg

SEQ ID NO: 3845287 - RNA, 16 nt, Shigella flexneri 2a str. 2457T
cgcggcccaccuggcu

SEQ ID NO: 3845288 - RNA, 16 nt, Shigella flexneri 2a str. 2457T
cgcggcccaggcggcg

SEQ ID NO: 3845289 - RNA, 23 nt, Shigella flexneri 2a str. 2457T
cgcggcgauaaugcccagcaacg

SEQ ID NO: 3845290 - RNA, 16 nt, Shigella flexneri 2a str. 2457T
cgcggcgauauccagc

SEQ ID NO: 3845291 - RNA, 19 nt, Shigella flexneri 2a str. 2457T
cgcggcgauauccagcgcg

SEQ ID NO: 3845292 - RNA, 19 nt, Shigella flexneri 2a str. 2457T
cgcggcuuugucauaacca

SEQ ID NO: 3845293 - RNA, 20 nt, Shigella flexneri 2a str. 2457T
cgcggcuuugucauaaccaa

SEQ ID NO: 3845294 - RNA, 18 nt, Shigella flexneri 2a str. 2457T
cgcgggccauccaccagu

SEQ ID NO: 3845295 - RNA, 18 nt, Shigella flexneri 2a str. 2457T
cgcggggaucacuggcag

SEQ ID NO: 3845296 - RNA, 19 nt, Shigella flexneri 2a str. 2457T
cgcggggaucacuggcaga

SEQ ID NO: 3845297 - RNA, 14 nt, Shigella flexneri 2a str. 2457T
cgcgggucaccgcg

SEQ ID NO: 3845298 - RNA, 15 nt, Shigella flexneri 2a str. 2457T
cgcgggucaguauuc

SEQ ID NO: 3845299 - RNA, 15 nt, Shigella flexneri 2a str. 2457T
cgcgggucguugauc

SEQ ID NO: 3845300 - RNA, 15 nt, Shigella flexneri 2a str. 2457T
cgcgguaaaagccca

SEQ ID NO: 3845301 - RNA, 17 nt, Shigella flexneri 2a str. 2457T
cgcgguaaacugcauga

SEQ ID NO: 3845302 - RNA, 17 nt, Shigella flexneri 2a str. 2457T
cgcgguaaagcgcggca

SEQ ID NO: 3845303 - RNA, 23 nt, Shigella flexneri 2a str. 2457T
cgcgguaagaguaaagcccgcca

SEQ ID NO: 3845304 - RNA, 17 nt, Shigella flexneri 2a str. 2457T
cgcgguagcacgucauc

SEQ ID NO: 3845305 - RNA, 14 nt, Shigella flexneri 2a str. 2457T
cgcgguaucaccac

SEQ ID NO: 3845306 - RNA, 19 nt, Shigella flexneri 2a str. 2457T
cgcgguaucaccacccagc

SEQ ID NO: 3845307 - RNA, 17 nt, Shigella flexneri 2a str. 2457T
cgcggucagcugcuguu

SEQ ID NO: 3845308 - RNA, 21 nt, Shigella flexneri 2a str. 2457T
cgcggucgccgucaggcaagc

SEQ ID NO: 3845309 - RNA, 16 nt, Shigella flexneri 2a str. 2457T
cgcugaacgggccauc

SEQ ID NO: 3845310 - RNA, 17 nt, Shigella flexneri 2a str. 2457T
cgcugaagaaaauggcc

SEQ ID NO: 3845311 - RNA, 24 nt, Shigella flexneri 2a str. 2457T
cgcugaagaaaauggccagccagc

SEQ ID NO: 3845312 - RNA, 20 nt, Shigella flexneri 2a str. 2457T
cgcugaaguuucuuuaccgg

SEQ ID NO: 3845313 - RNA, 18 nt, Shigella flexneri 2a str. 2457T
cgcugaauaauggugaau

SEQ ID NO: 3845314 - RNA, 22 nt, Shigella flexneri 2a str. 2457T
cgcugaaucaacaggcgguaac

SEQ ID NO: 3845315 - RNA, 15 nt, Shigella flexneri 2a str. 2457T
cgcugaauggcgauu

SEQ ID NO: 3845316 - RNA, 20 nt, Shigella flexneri 2a str. 2457T
cgcugacaguacccagauuc

SEQ ID NO: 3845317 - RNA, 21 nt, Shigella flexneri 2a str. 2457T
cgcugacaguacccagauuca

SEQ ID NO: 3845318 - RNA, 24 nt, Shigella flexneri 2a str. 2457T
cgcugacgauuguagaaaaucuca

SEQ ID NO: 3845319 - RNA, 20 nt, Shigella flexneri 2a str. 2457T
cgcugacgcgucuuaucugg

SEQ ID NO: 3845320 - RNA, 14 nt, Shigella flexneri 2a str. 2457T
cgcugacggcagcg

SEQ ID NO: 3845321 - RNA, 15 nt, Shigella flexneri 2a str. 2457T
cgcugacucuacuga

SEQ ID NO: 3845322 - RNA, 13 nt, Shigella flexneri 2a str. 2457T
cgcugagacgcgc

SEQ ID NO: 3845323 - RNA, 15 nt, Shigella flexneri 2a str. 2457T
cgcugagagaagcac

SEQ ID NO: 3845324 - RNA, 16 nt, Shigella flexneri 2a str. 2457T
cgcugagagaagcacg

SEQ ID NO: 3845325 - RNA, 21 nt, Shigella flexneri 2a str. 2457T
cgcugagauacucaagcagcc

SEQ ID NO: 3845326 - RNA, 16 nt, Shigella flexneri 2a str. 2457T
cgcugagguccggcca

SEQ ID NO: 3845327 - RNA, 18 nt, Shigella flexneri 2a str. 2457T
cgcugagguuaugcaaac

SEQ ID NO: 3845328 - RNA, 13 nt, Shigella flexneri 2a str. 2457T
cgcugaugccagg

SEQ ID NO: 3845329 - RNA, 20 nt, Shigella flexneri 2a str. 2457T
cgcugaugucagcacuucca

SEQ ID NO: 3845330 - RNA, 21 nt, Shigella flexneri 2a str. 2457T
cgcugauucaaaaccgguucu

SEQ ID NO: 3845331 - RNA, 20 nt, Shigella flexneri 2a str. 2457T
cgcugauuggccccauugcc

SEQ ID NO: 3845332 - RNA, 19 nt, Shigella flexneri 2a str. 2457T
cgcugauugggaaaucaga

SEQ ID NO: 3845333 - RNA, 21 nt, Shigella flexneri 2a str. 2457T
cgcugcacaauugccagcccu

SEQ ID NO: 3845334 - RNA, 22 nt, Shigella flexneri 2a str. 2457T
cgcugcacuuucucgacaucca

SEQ ID NO: 3845335 - RNA, 17 nt, Shigella flexneri 2a str. 2457T
cgcugcaucgccaaucu

SEQ ID NO: 3845336 - RNA, 13 nt, Shigella flexneri 2a str. 2457T
cgcugccgcuucu

SEQ ID NO: 3845337 - RNA, 16 nt, Shigella flexneri 2a str. 2457T
cgcugccguugcuuga

SEQ ID NO: 3845338 - RNA, 19 nt, Shigella flexneri 2a str. 2457T
cgcugcgcaaagaugcgau

SEQ ID NO: 3845339 - RNA, 19 nt, Shigella flexneri 2a str. 2457T
cgcugcgcuuauccggccc

SEQ ID NO: 3845340 - RNA, 13 nt, Shigella flexneri 2a str. 2457T
cgcugcuaauuua

SEQ ID NO: 3845341 - RNA, 22 nt, Shigella flexneri 2a str. 2457T
cgcugcuaauuuaucggcguua

SEQ ID NO: 3845342 - RNA, 14 nt, Shigella flexneri 2a str. 2457T
cgcugcucuucagu

SEQ ID NO: 3845343 - RNA, 15 nt, Shigella flexneri 2a str. 2457T
cgcugcugcacauac

SEQ ID NO: 3845344 - RNA, 19 nt, Shigella flexneri 2a str. 2457T
cgcugcuguagcaguucca

SEQ ID NO: 3845345 - RNA, 19 nt, Shigella flexneri 2a str. 2457T
cgcugcuuguuccacuuca

SEQ ID NO: 3845346 - RNA, 16 nt, Shigella flexneri 2a str. 2457T
cgcugcuuuccugcug

SEQ ID NO: 3845347 - RNA, 22 nt, Shigella flexneri 2a str. 2457T
cgcuggagaacaaggcuuuaau

SEQ ID NO: 3845348 - RNA, 18 nt, Shigella flexneri 2a str. 2457T
cgcuggaugucuggcaga

SEQ ID NO: 3845349 - RNA, 15 nt, Shigella flexneri 2a str. 2457T
cgcuggcaacacaga

SEQ ID NO: 3845350 - RNA, 13 nt, Shigella flexneri 2a str. 2457T
cgcuggcgcaugu

SEQ ID NO: 3845351 - RNA, 15 nt, Shigella flexneri 2a str. 2457T
cgcuggcgcgccgcc

SEQ ID NO: 3845352 - RNA, 13 nt, Shigella flexneri 2a str. 2457T
cgcuggcggcugg

SEQ ID NO: 3845353 - RNA, 22 nt, Shigella flexneri 2a str. 2457T
cgcuggcgguauagaucagacg

SEQ ID NO: 3845354 - RNA, 13 nt, Shigella flexneri 2a str. 2457T
cgcuggucaguga

SEQ ID NO: 3845355 - RNA, 19 nt, Shigella flexneri 2a str. 2457T
cgcuggugauugcaccgac

SEQ ID NO: 3845356 - RNA, 17 nt, Shigella flexneri 2a str. 2457T
cgcugguuaccaccugc

SEQ ID NO: 3845357 - RNA, 16 nt, Shigella flexneri 2a str. 2457T
cgcuguccggcgcacu

SEQ ID NO: 3845358 - RNA, 12 nt, Shigella flexneri 2a str. 2457T
cgcugucgguac

SEQ ID NO: 3845359 - RNA, 15 nt, Shigella flexneri 2a str. 2457T
cgcugucuuccuggu

SEQ ID NO: 3845360 - RNA, 16 nt, Shigella flexneri 2a str. 2457T
cgcugugagcaggcgu

SEQ ID NO: 3845361 - RNA, 15 nt, Shigella flexneri 2a str. 2457T
cgcuguguaaaccca

SEQ ID NO: 3845362 - RNA, 20 nt, Shigella flexneri 2a str. 2457T
cgcuguugaggcacaucuua

SEQ ID NO: 3845363 - RNA, 17 nt, Shigella flexneri 2a str. 2457T
cgcuguugcguaacuga

SEQ ID NO: 3845364 - RNA, 15 nt, Shigella flexneri 2a str. 2457T
cgcuguugucugaau

SEQ ID NO: 3845365 - RNA, 21 nt, Shigella flexneri 2a str. 2457T
cgcuguuuguucaagcgcaau

SEQ ID NO: 3845366 - RNA, 22 nt, Shigella flexneri 2a str. 2457T
cgcuuaaucaauugcaggaagg

SEQ ID NO: 3845367 - RNA, 17 nt, Shigella flexneri 2a str. 2457T
cgcuuacgccugccagc

SEQ ID NO: 3845368 - RNA, 14 nt, Shigella flexneri 2a str. 2457T
cgcuuaucaggccu

SEQ ID NO: 3845369 - RNA, 19 nt, Shigella flexneri 2a str. 2457T
cgcuuaucaggccuacgcg

SEQ ID NO: 3845370 - RNA, 13 nt, Shigella flexneri 2a str. 2457T
cgcuuauccggcc

SEQ ID NO: 3845371 - RNA, 14 nt, Shigella flexneri 2a str. 2457T
cgcuuauccggccc

SEQ ID NO: 3845372 - RNA, 23 nt, Shigella flexneri 2a str. 2457T
cgcuuauuguugucaauauucug

SEQ ID NO: 3845373 - RNA, 14 nt, Shigella flexneri 2a str. 2457T
cgcuucaacagcgg

SEQ ID NO: 3845374 - RNA, 14 nt, Shigella flexneri 2a str. 2457T
cgcuucaaccaccu

SEQ ID NO: 3845375 - RNA, 20 nt, Shigella flexneri 2a str. 2457T
cgcuucaauacgcucgaaca

SEQ ID NO: 3845376 - RNA, 13 nt, Shigella flexneri 2a str. 2457T
cgcuucaaucuga

SEQ ID NO: 3845377 - RNA, 14 nt, Shigella flexneri 2a str. 2457T
cgcuucaccaauca

SEQ ID NO: 3845378 - RNA, 13 nt, Shigella flexneri 2a str. 2457T
cgcuucaccaccg

SEQ ID NO: 3845379 - RNA, 14 nt, Shigella flexneri 2a str. 2457T
cgcuucaggaauaa

SEQ ID NO: 3845380 - RNA, 13 nt, Shigella flexneri 2a str. 2457T
cgcuuccagcaga

SEQ ID NO: 3845381 - RNA, 14 nt, Shigella flexneri 2a str. 2457T
cgcuuccagcauuu

SEQ ID NO: 3845382 - RNA, 15 nt, Shigella flexneri 2a str. 2457T
cgcuuccagcgcauc

SEQ ID NO: 3845383 - RNA, 16 nt, Shigella flexneri 2a str. 2457T
cgcuucgcccaaaucc

SEQ ID NO: 3845384 - RNA, 14 nt, Shigella flexneri 2a str. 2457T
cgcuucggcgcaua

SEQ ID NO: 3845385 - RNA, 20 nt, Shigella flexneri 2a str. 2457T
cgcuucggcuccagcgcguc

SEQ ID NO: 3845386 - RNA, 21 nt, Shigella flexneri 2a str. 2457T
cgcuucggcuccagcgcgucu

SEQ ID NO: 3845387 - RNA, 21 nt, Shigella flexneri 2a str. 2457T
cgcuucgguuuucgcgccagc

SEQ ID NO: 3845388 - RNA, 14 nt, Shigella flexneri 2a str. 2457T
cgcuucguuuucag

SEQ ID NO: 3845389 - RNA, 11 nt, Shigella flexneri 2a str. 2457T
cgcuucugcca

SEQ ID NO: 3845390 - RNA, 14 nt, Shigella flexneri 2a str. 2457T
cgcuucuucagccu

SEQ ID NO: 3845391 - RNA, 19 nt, Shigella flexneri 2a str. 2457T
cgcuugauucuguucagua

SEQ ID NO: 3845392 - RNA, 22 nt, Shigella flexneri 2a str. 2457T
cgcuugcuaacgcccgccguga

SEQ ID NO: 3845393 - RNA, 20 nt, Shigella flexneri 2a str. 2457T
cgcuugcugauaacgugcag

SEQ ID NO: 3845394 - RNA, 23 nt, Shigella flexneri 2a str. 2457T
cgcuugcugauaacgugcagcuu

SEQ ID NO: 3845395 - RNA, 15 nt, Shigella flexneri 2a str. 2457T
cgcuugcuggcgcuu

SEQ ID NO: 3845396 - RNA, 13 nt, Shigella flexneri 2a str. 2457T
cgcuugggcagaa

SEQ ID NO: 3845397 - RNA, 21 nt, Shigella flexneri 2a str. 2457T
cgcuugugguacuaucagcgu

SEQ ID NO: 3845398 - RNA, 14 nt, Shigella flexneri 2a str. 2457T
cgcuuuacguuccu

SEQ ID NO: 3845399 - RNA, 16 nt, Shigella flexneri 2a str. 2457T
cgcuuuaucgccgcug

SEQ ID NO: 3845400 - RNA, 19 nt, Shigella flexneri 2a str. 2457T
cgcuuucacuauuucuuug

SEQ ID NO: 3845401 - RNA, 17 nt, Shigella flexneri 2a str. 2457T
cgcuuucacucaguguu

SEQ ID NO: 3845402 - RNA, 14 nt, Shigella flexneri 2a str. 2457T
cgcuuucaggucag

SEQ ID NO: 3845403 - RNA, 15 nt, Shigella flexneri 2a str. 2457T
cgcuuucagugucug

SEQ ID NO: 3845404 - RNA, 23 nt, Shigella flexneri 2a str. 2457T
cgcuuucauguuaaauuccggcu

SEQ ID NO: 3845405 - RNA, 15 nt, Shigella flexneri 2a str. 2457T
cgcuuuuauaaaggg

SEQ ID NO: 3845406 - RNA, 22 nt, Shigella flexneri 2a str. 2457T
cgcuuuuucaauuuccaguuug

SEQ ID NO: 3845407 - RNA, 20 nt, Shigella flexneri 2a str. 2457T
cggaucgauaccguucagac

SEQ ID NO: 3845408 - RNA, 15 nt, Shigella flexneri 2a str. 2457T
cggaucggaggcagc

SEQ ID NO: 3845409 - RNA, 15 nt, Shigella flexneri 2a str. 2457T
cggaucucagcucau

SEQ ID NO: 3845410 - RNA, 11 nt, Shigella flexneri 2a str. 2457T
cggaugacaga

SEQ ID NO: 3845411 - RNA, 21 nt, Shigella flexneri 2a str. 2457T
cggaugacagacuccgcuucg

SEQ ID NO: 3845412 - RNA, 22 nt, Shigella flexneri 2a str. 2457T
cggaugaggcguuaacagcgca

SEQ ID NO: 3845413 - RNA, 15 nt, Shigella flexneri 2a str. 2457T
cggaugaguacagcg

SEQ ID NO: 3845414 - RNA, 17 nt, Shigella flexneri 2a str. 2457T
cggaugcgaugcuggcg

SEQ ID NO: 3845415 - RNA, 18 nt, Shigella flexneri 2a str. 2457T
cggaugcggcgugaaugc

SEQ ID NO: 3845416 - RNA, 16 nt, Shigella flexneri 2a str. 2457T
cggaugcuuaaccgcc

SEQ ID NO: 3845417 - RNA, 22 nt, Shigella flexneri 2a str. 2457T
cggaugugaugcauccggcaca

SEQ ID NO: 3845418 - RNA, 22 nt, Shigella flexneri 2a str. 2457T
cggauguuucaccggaugccgg

SEQ ID NO: 3845419 - RNA, 18 nt, Shigella flexneri 2a str. 2457T
cggauguuucuucaacac

SEQ ID NO: 3845420 - RNA, 22 nt, Shigella flexneri 2a str. 2457T
cggauuaacaguccgccguucu

SEQ ID NO: 3845421 - RNA, 18 nt, Shigella flexneri 2a str. 2457T
cggauucagauugcagac

SEQ ID NO: 3845422 - RNA, 17 nt, Shigella flexneri 2a str. 2457T
cggauucaguaaaucca

SEQ ID NO: 3845423 - RNA, 16 nt, Shigella flexneri 2a str. 2457T
cggauugcuccugcuc

SEQ ID NO: 3845424 - RNA, 17 nt, Shigella flexneri 2a str. 2457T
cggauuucauauccggc

SEQ ID NO: 3845425 - RNA, 22 nt, Shigella flexneri 2a str. 2457T
cggauuuggcaaaugcaucagu

SEQ ID NO: 3845426 - RNA, 16 nt, Shigella flexneri 2a str. 2457T
cggauuuggcugaaua

SEQ ID NO: 3845427 - RNA, 13 nt, Shigella flexneri 2a str. 2457T
cggcaaaaccguu

SEQ ID NO: 3845428 - RNA, 23 nt, Shigella flexneri 2a str. 2457T
cggcaaaaccguucgaacuggau

SEQ ID NO: 3845429 - RNA, 13 nt, Shigella flexneri 2a str. 2457T
cggcaaacacgcc

SEQ ID NO: 3845430 - RNA, 19 nt, Shigella flexneri 2a str. 2457T
cggcaaacaguuucugcag

SEQ ID NO: 3845431 - RNA, 14 nt, Shigella flexneri 2a str. 2457T
cggcaaacgcaacc

SEQ ID NO: 3845432 - RNA, 23 nt, Shigella flexneri 2a str. 2457T
cggcaaacguaagcgucugcucc

SEQ ID NO: 3845433 - RNA, 13 nt, Shigella flexneri 2a str. 2457T
cggcaaacgucgc

SEQ ID NO: 3845434 - RNA, 14 nt, Shigella flexneri 2a str. 2457T
cggcaaacugcuga

SEQ ID NO: 3845435 - RNA, 14 nt, Shigella flexneri 2a str. 2457T
cggcaaagcgcuga

SEQ ID NO: 3845436 - RNA, 23 nt, Shigella flexneri 2a str. 2457T
cggcaaagugaauacagaacagu

SEQ ID NO: 3845437 - RNA, 17 nt, Shigella flexneri 2a str. 2457T
cggcaaaugacgaugca

SEQ ID NO: 3845438 - RNA, 23 nt, Shigella flexneri 2a str. 2457T
cggcaaauucauuaccaaccuga

SEQ ID NO: 3845439 - RNA, 19 nt, Shigella flexneri 2a str. 2457T
cggcaaccacacccacauc

SEQ ID NO: 3845440 - RNA, 15 nt, Shigella flexneri 2a str. 2457T
cggcaaccagcaccg

SEQ ID NO: 3845441 - RNA, 17 nt, Shigella flexneri 2a str. 2457T
cggcaaccgcauccaga

SEQ ID NO: 3845442 - RNA, 22 nt, Shigella flexneri 2a str. 2457T
cggcaacuuuggguugccgcca

SEQ ID NO: 3845443 - RNA, 18 nt, Shigella flexneri 2a str. 2457T
cggcaagauacugcauaa

SEQ ID NO: 3845444 - RNA, 17 nt, Shigella flexneri 2a str. 2457T
cggcaagaucaccguuu

SEQ ID NO: 3845445 - RNA, 16 nt, Shigella flexneri 2a str. 2457T
cggcaagaucagcauc

SEQ ID NO: 3845446 - RNA, 20 nt, Shigella flexneri 2a str. 2457T
cggcaagauggauuacaccu

SEQ ID NO: 3845447 - RNA, 15 nt, Shigella flexneri 2a str. 2457T
cggcaagcaaaugaa

SEQ ID NO: 3845448 - RNA, 15 nt, Shigella flexneri 2a str. 2457T
cggcaauaagcaacg

SEQ ID NO: 3845449 - RNA, 16 nt, Shigella flexneri 2a str. 2457T
cggcaauaauccccgc

SEQ ID NO: 3845450 - RNA, 14 nt, Shigella flexneri 2a str. 2457T
cggcaauaccugac

SEQ ID NO: 3845451 - RNA, 21 nt, Shigella flexneri 2a str. 2457T
cggcaauacuuugcagaucgc

SEQ ID NO: 3845452 - RNA, 14 nt, Shigella flexneri 2a str. 2457T
cggcaaucacauca

SEQ ID NO: 3845453 - RNA, 17 nt, Shigella flexneri 2a str. 2457T
cggcaaucacaucacca

SEQ ID NO: 3845454 - RNA, 14 nt, Shigella flexneri 2a str. 2457T
cggcaaucacgccc

SEQ ID NO: 3845455 - RNA, 12 nt, Shigella flexneri 2a str. 2457T
cggcaaucgcca

SEQ ID NO: 3845456 - RNA, 13 nt, Shigella flexneri 2a str. 2457T
cggcaaucgccag

SEQ ID NO: 3845457 - RNA, 22 nt, Shigella flexneri 2a str. 2457T
cggcaaucgccagaucagcuuc

SEQ ID NO: 3845458 - RNA, 23 nt, Shigella flexneri 2a str. 2457T
cggcaaucgccagaucagcuuca

SEQ ID NO: 3845459 - RNA, 17 nt, Shigella flexneri 2a str. 2457T
cggcaaucgcugcuaau

SEQ ID NO: 3845460 - RNA, 15 nt, Shigella flexneri 2a str. 2457T
cggcaaucggugcaa

SEQ ID NO: 3845461 - RNA, 14 nt, Shigella flexneri 2a str. 2457T
cggcaaugcgcccc

SEQ ID NO: 3845462 - RNA, 18 nt, Shigella flexneri 2a str. 2457T
cggcaaugcguuccagca

SEQ ID NO: 3845463 - RNA, 13 nt, Shigella flexneri 2a str. 2457T
cggcaauggugaa

SEQ ID NO: 3845464 - RNA, 21 nt, Shigella flexneri 2a str. 2457T
cggcaauuaaaaaagcggcua

SEQ ID NO: 3845465 - RNA, 16 nt, Shigella flexneri 2a str. 2457T
cggcaauuagcggcug

SEQ ID NO: 3845466 - RNA, 17 nt, Shigella flexneri 2a str. 2457T
cggcaauuagcggcugg

SEQ ID NO: 3845467 - RNA, 17 nt, Shigella flexneri 2a str. 2457T
cggcaauucucugcucc

SEQ ID NO: 3845468 - RNA, 19 nt, Shigella flexneri 2a str. 2457T
cggcaauucucugcuccug

SEQ ID NO: 3845469 - RNA, 21 nt, Shigella flexneri 2a str. 2457T
cggcaauucucugcuccugau

SEQ ID NO: 3845470 - RNA, 13 nt, Shigella flexneri 2a str. 2457T
cggcaauuuuuac

SEQ ID NO: 3845471 - RNA, 20 nt, Shigella flexneri 2a str. 2457T
cggcaauuuuuaccggucag

SEQ ID NO: 3845472 - RNA, 22 nt, Shigella flexneri 2a str. 2457T
cggcacacagcacggcagcaac

SEQ ID NO: 3845473 - RNA, 16 nt, Shigella flexneri 2a str. 2457T
cggcacagaaacgcca

SEQ ID NO: 3845474 - RNA, 13 nt, Shigella flexneri 2a str. 2457T
cggcaccacaaac

SEQ ID NO: 3845475 - RNA, 13 nt, Shigella flexneri 2a str. 2457T
cggcaccacauuc

SEQ ID NO: 3845476 - RNA, 12 nt, Shigella flexneri 2a str. 2457T
cggcaccaccaa

SEQ ID NO: 3845477 - RNA, 15 nt, Shigella flexneri 2a str. 2457T
cggcaccaccaaaaa

SEQ ID NO: 3845478 - RNA, 23 nt, Shigella flexneri 2a str. 2457T
cggcacccaauccaguacaugaa

SEQ ID NO: 3845479 - RNA, 22 nt, Shigella flexneri 2a str. 2457T
cggcaccuaauaacucuccucc

SEQ ID NO: 3845480 - RNA, 17 nt, Shigella flexneri 2a str. 2457T
cggcaccuuuucaucag

SEQ ID NO: 3845481 - RNA, 19 nt, Shigella flexneri 2a str. 2457T
cggcacgcguugcgcauga

SEQ ID NO: 3845482 - RNA, 21 nt, Shigella flexneri 2a str. 2457T
cggcacgcguugcgcaugacc

SEQ ID NO: 3845483 - RNA, 18 nt, Shigella flexneri 2a str. 2457T
cggcacggaaagcagcau

SEQ ID NO: 3845484 - RNA, 15 nt, Shigella flexneri 2a str. 2457T
cggcacguuccugca

SEQ ID NO: 3845485 - RNA, 22 nt, Shigella flexneri 2a str. 2457T
cggcacguucgaugcggcucag

SEQ ID NO: 3845486 - RNA, 14 nt, Shigella flexneri 2a str. 2457T
cggcacuccucuuc

SEQ ID NO: 3845487 - RNA, 14 nt, Shigella flexneri 2a str. 2457T
cggcacugaccacu

SEQ ID NO: 3845488 - RNA, 17 nt, Shigella flexneri 2a str. 2457T
cggcacuguuucgccag

SEQ ID NO: 3845489 - RNA, 13 nt, Shigella flexneri 2a str. 2457T
cggcagaacggug

SEQ ID NO: 3845490 - RNA, 14 nt, Shigella flexneri 2a str. 2457T
cggcagaagcaauc

SEQ ID NO: 3845491 - RNA, 15 nt, Shigella flexneri 2a str. 2457T
cggcagaaugguaac

SEQ ID NO: 3845492 - RNA, 22 nt, Shigella flexneri 2a str. 2457T
cggcagacgcucgccauuuuuc

SEQ ID NO: 3845493 - RNA, 14 nt, Shigella flexneri 2a str. 2457T
cggcagacgggcaa

SEQ ID NO: 3845494 - RNA, 20 nt, Shigella flexneri 2a str. 2457T
cggcagagaaaccacaucaa

SEQ ID NO: 3845495 - RNA, 21 nt, Shigella flexneri 2a str. 2457T
cggcagaucaaauucaaugac

SEQ ID NO: 3845496 - RNA, 13 nt, Shigella flexneri 2a str. 2457T
cggcagcaaccgc

SEQ ID NO: 3845497 - RNA, 15 nt, Shigella flexneri 2a str. 2457T
cggcagcaaccgcuu

SEQ ID NO: 3845498 - RNA, 17 nt, Shigella flexneri 2a str. 2457T
cggcagcaauugucgca

SEQ ID NO: 3845499 - RNA, 19 nt, Shigella flexneri 2a str. 2457T
cggcagcaggugcgccagc

SEQ ID NO: 3845500 - RNA, 13 nt, Shigella flexneri 2a str. 2457T
cggcagccuccug

SEQ ID NO: 3845501 - RNA, 20 nt, Shigella flexneri 2a str. 2457T
cggcagccugggucgccauc

SEQ ID NO: 3845502 - RNA, 18 nt, Shigella flexneri 2a str. 2457T
cggcagcgucggaagcga

SEQ ID NO: 3845503 - RNA, 14 nt, Shigella flexneri 2a str. 2457T
cggcagcugcucgc

SEQ ID NO: 3845504 - RNA, 18 nt, Shigella flexneri 2a str. 2457T
cggcaggaaaaaagcgcu

SEQ ID NO: 3845505 - RNA, 18 nt, Shigella flexneri 2a str. 2457T
cggcgugaccucuucggc

SEQ ID NO: 3845506 - RNA, 18 nt, Shigella flexneri 2a str. 2457T
cggcgugcgcgcccauac

SEQ ID NO: 3845507 - RNA, 13 nt, Shigella flexneri 2a str. 2457T
cggcgugggcgcu

SEQ ID NO: 3845508 - RNA, 17 nt, Shigella flexneri 2a str. 2457T
cggcguuaugccuguaa

SEQ ID NO: 3845509 - RNA, 16 nt, Shigella flexneri 2a str. 2457T
cggcguuucacuucug

SEQ ID NO: 3845510 - RNA, 15 nt, Shigella flexneri 2a str. 2457T
cggcguuuccagcuc

SEQ ID NO: 3845511 - RNA, 14 nt, Shigella flexneri 2a str. 2457T
cggcguuuucaggu

SEQ ID NO: 3845512 - RNA, 20 nt, Shigella flexneri 2a str. 2457T
cggcguuuucucaucgcugc

SEQ ID NO: 3845513 - RNA, 14 nt, Shigella flexneri 2a str. 2457T
cggcucaccugcac

SEQ ID NO: 3845514 - RNA, 16 nt, Shigella flexneri 2a str. 2457T
cggcucaggcgcacgc

SEQ ID NO: 3845515 - RNA, 14 nt, Shigella flexneri 2a str. 2457T
cggcuccagcaaug

SEQ ID NO: 3845516 - RNA, 13 nt, Shigella flexneri 2a str. 2457T
cggcucccgcagc

SEQ ID NO: 3845517 - RNA, 18 nt, Shigella flexneri 2a str. 2457T
cggcucccgcagccacuc

SEQ ID NO: 3845518 - RNA, 13 nt, Shigella flexneri 2a str. 2457T
cggcuccgcccca

SEQ ID NO: 3845519 - RNA, 18 nt, Shigella flexneri 2a str. 2457T
cggcuccgccccaaugcg

SEQ ID NO: 3845520 - RNA, 19 nt, Shigella flexneri 2a str. 2457T
cggcuccgcugacgccugc

SEQ ID NO: 3845521 - RNA, 23 nt, Shigella flexneri 2a str. 2457T
cggcuccgguuaacgccgcgccc

SEQ ID NO: 3845522 - RNA, 24 nt, Shigella flexneri 2a str. 2457T
cggcuccgguuaacgccgcgcccg

SEQ ID NO: 3845523 - RNA, 15 nt, Shigella flexneri 2a str. 2457T
cggcuccguuccgcu

SEQ ID NO: 3845524 - RNA, 17 nt, Shigella flexneri 2a str. 2457T
cggcucggcuccgggcg

SEQ ID NO: 3845525 - RNA, 16 nt, Shigella flexneri 2a str. 2457T
cggcucucaccuugua

SEQ ID NO: 3845526 - RNA, 14 nt, Shigella flexneri 2a str. 2457T
cggcugccagccag

SEQ ID NO: 3845527 - RNA, 13 nt, Shigella flexneri 2a str. 2457T
cggcugcccauca

SEQ ID NO: 3845528 - RNA, 12 nt, Shigella flexneri 2a str. 2457T
cggcugccggau

SEQ ID NO: 3845529 - RNA, 20 nt, Shigella flexneri 2a str. 2457T
cggcugcugauguucgccag

SEQ ID NO: 3845530 - RNA, 21 nt, Shigella flexneri 2a str. 2457T
cggcugcuucggucagcacgc

SEQ ID NO: 3845531 - RNA, 15 nt, Shigella flexneri 2a str. 2457T
cggcuggcugaccug

SEQ ID NO: 3845532 - RNA, 20 nt, Shigella flexneri 2a str. 2457T
cggcuggugauuucguccag

SEQ ID NO: 3845533 - RNA, 22 nt, Shigella flexneri 2a str. 2457T
cggcuguaguccuaacagagca

SEQ ID NO: 3845534 - RNA, 18 nt, Shigella flexneri 2a str. 2457T
cggcuguccggcaccauc

SEQ ID NO: 3845535 - RNA, 22 nt, Shigella flexneri 2a str. 2457T
cggcuguugauguccaguuccc

SEQ ID NO: 3845536 - RNA, 17 nt, Shigella flexneri 2a str. 2457T
cggcuuauaauccccgg

SEQ ID NO: 3845537 - RNA, 20 nt, Shigella flexneri 2a str. 2457T
cggcuucgcaucccgguauc

SEQ ID NO: 3845538 - RNA, 15 nt, Shigella flexneri 2a str. 2457T
cggcuucgccuccug

SEQ ID NO: 3845539 - RNA, 16 nt, Shigella flexneri 2a str. 2457T
cggcuucgccuccugu

SEQ ID NO: 3845540 - RNA, 20 nt, Shigella flexneri 2a str. 2457T
cggcuucgccuccuguucug

SEQ ID NO: 3845541 - RNA, 16 nt, Shigella flexneri 2a str. 2457T
cggcuugaaccagcca

SEQ ID NO: 3845542 - RNA, 22 nt, Shigella flexneri 2a str. 2457T
cggcuugcgcgcaaucagcacc

SEQ ID NO: 3845543 - RNA, 15 nt, Shigella flexneri 2a str. 2457T
cggcuuguggugaaa

SEQ ID NO: 3845544 - RNA, 13 nt, Shigella flexneri 2a str. 2457T
cggcuuucaaggc

SEQ ID NO: 3845545 - RNA, 23 nt, Shigella flexneri 2a str. 2457T
cggcuuuggcaaauggcgcuaac

SEQ ID NO: 3845546 - RNA, 23 nt, Shigella flexneri 2a str. 2457T
cggcuuugucauuaaagccgcca

SEQ ID NO: 3845547 - RNA, 18 nt, Shigella flexneri 2a str. 2457T
cggcuuuuuacuucucag

SEQ ID NO: 3845548 - RNA, 24 nt, Shigella flexneri 2a str. 2457T
cggcuuuuuacuucucagcgucag

SEQ ID NO: 3845549 - RNA, 15 nt, Shigella flexneri 2a str. 2457T
cggcuuuuuccugcc

SEQ ID NO: 3845550 - RNA, 18 nt, Shigella flexneri 2a str. 2457T
cggcuuuuuuacgccugu

SEQ ID NO: 3845551 - RNA, 16 nt, Shigella flexneri 2a str. 2457T
cggcuuuuuugucucc

SEQ ID NO: 3845552 - RNA, 14 nt, Shigella flexneri 2a str. 2457T
cgggaaaucaaguu

SEQ ID NO: 3845553 - RNA, 20 nt, Shigella flexneri 2a str. 2457T
cgggaacuggcaacaauggc

SEQ ID NO: 3845554 - RNA, 15 nt, Shigella flexneri 2a str. 2457T
cgggaagauccaggu

SEQ ID NO: 3845555 - RNA, 20 nt, Shigella flexneri 2a str. 2457T
cgggaagcucucuuccaguu

SEQ ID NO: 3845556 - RNA, 15 nt, Shigella flexneri 2a str. 2457T
cgggaauaaaagcca

SEQ ID NO: 3845557 - RNA, 18 nt, Shigella flexneri 2a str. 2457T
cgggaauaaaagccagga

SEQ ID NO: 3845558 - RNA, 17 nt, Shigella flexneri 2a str. 2457T
cgggaauauuaacgaca

SEQ ID NO: 3845559 - RNA, 16 nt, Shigella flexneri 2a str. 2457T
cgggacagcauggggc

SEQ ID NO: 3845560 - RNA, 16 nt, Shigella flexneri 2a str. 2457T
cgggagagauaagaua

SEQ ID NO: 3845561 - RNA, 18 nt, Shigella flexneri 2a str. 2457T
cgggagagauaagauaaa

SEQ ID NO: 3845562 - RNA, 19 nt, Shigella flexneri 2a str. 2457T
cgggaggcgaaggugccuc

SEQ ID NO: 3845563 - RNA, 11 nt, Shigella flexneri 2a str. 2457T
cgggauaaacg

SEQ ID NO: 3845564 - RNA, 19 nt, Shigella flexneri 2a str. 2457T
cgggaucaucgcccagccg

SEQ ID NO: 3845565 - RNA, 13 nt, Shigella flexneri 2a str. 2457T
cgggaucugaugg

SEQ ID NO: 3845566 - RNA, 22 nt, Shigella flexneri 2a str. 2457T
cgggaucugauucugauccugc

SEQ ID NO: 3845567 - RNA, 15 nt, Shigella flexneri 2a str. 2457T
cgggaugccuucagu

SEQ ID NO: 3845568 - RNA, 21 nt, Shigella flexneri 2a str. 2457T
cgggauguguaaguaaugaca

SEQ ID NO: 3845569 - RNA, 17 nt, Shigella flexneri 2a str. 2457T
cgggauugccagaugcg

SEQ ID NO: 3845570 - RNA, 13 nt, Shigella flexneri 2a str. 2457T
cgggcaacugcug

SEQ ID NO: 3845571 - RNA, 13 nt, Shigella flexneri 2a str. 2457T
cgggcaacuucaa

SEQ ID NO: 3845572 - RNA, 16 nt, Shigella flexneri 2a str. 2457T
cgggcaagcaccaggg

SEQ ID NO: 3845573 - RNA, 17 nt, Shigella flexneri 2a str. 2457T
cgggcacagauuuccaa

SEQ ID NO: 3845574 - RNA, 16 nt, Shigella flexneri 2a str. 2457T
cgggcaggcuucaaca

SEQ ID NO: 3845575 - RNA, 20 nt, Shigella flexneri 2a str. 2457T
cgggcaggcuucaacacagg

SEQ ID NO: 3845576 - RNA, 14 nt, Shigella flexneri 2a str. 2457T
cgggcauauuuccg

SEQ ID NO: 3845577 - RNA, 16 nt, Shigella flexneri 2a str. 2457T
cgggcaucaucuuccg

SEQ ID NO: 3845578 - RNA, 21 nt, Shigella flexneri 2a str. 2457T
cgggcaugucgguuguacaaa

SEQ ID NO: 3845579 - RNA, 18 nt, Shigella flexneri 2a str. 2457T
cgggccaguuucauagug

SEQ ID NO: 3845580 - RNA, 18 nt, Shigella flexneri 2a str. 2457T
cgggccaucagagcugga

SEQ ID NO: 3845581 - RNA, 15 nt, Shigella flexneri 2a str. 2457T
cgggccgcaaaccag

SEQ ID NO: 3845582 - RNA, 15 nt, Shigella flexneri 2a str. 2457T
cgggccuccccggau

SEQ ID NO: 3845583 - RNA, 21 nt, Shigella flexneri 2a str. 2457T
cgggccuccccggauucaucc

SEQ ID NO: 3845584 - RNA, 15 nt, Shigella flexneri 2a str. 2457T
cgggcggccucuuca

SEQ ID NO: 3845585 - RNA, 23 nt, Shigella flexneri 2a str. 2457T
cgggcgguguuggggcaagauau

SEQ ID NO: 3845586 - RNA, 20 nt, Shigella flexneri 2a str. 2457T
cgggcguagugcccgcagua

SEQ ID NO: 3845587 - RNA, 16 nt, Shigella flexneri 2a str. 2457T
cgggcguauaacacgc

SEQ ID NO: 3845588 - RNA, 15 nt, Shigella flexneri 2a str. 2457T
cgggcuaaucgucau

SEQ ID NO: 3845589 - RNA, 19 nt, Shigella flexneri 2a str. 2457T
cgggcuggcguacccauca

SEQ ID NO: 3845590 - RNA, 21 nt, Shigella flexneri 2a str. 2457T
cgggcuuugccauacucccgc

SEQ ID NO: 3845591 - RNA, 23 nt, Shigella flexneri 2a str. 2457T
cgggcuuuuuaauuccugccgcg

SEQ ID NO: 3845592 - RNA, 18 nt, Shigella flexneri 2a str. 2457T
cggggaacaucaggcauu

SEQ ID NO: 3845593 - RNA, 18 nt, Shigella flexneri 2a str. 2457T
cggggagagucauuaugc

SEQ ID NO: 3845594 - RNA, 24 nt, Shigella flexneri 2a str. 2457T
cggggauaagaauaucgaccgcgu

SEQ ID NO: 3845595 - RNA, 20 nt, Shigella flexneri 2a str. 2457T
cggggauuacuccccgcaca

SEQ ID NO: 3845596 - RNA, 12 nt, Shigella flexneri 2a str. 2457T
cggggccagcau

SEQ ID NO: 3845597 - RNA, 14 nt, Shigella flexneri 2a str. 2457T
cggggccagcauuc

SEQ ID NO: 3845598 - RNA, 18 nt, Shigella flexneri 2a str. 2457T
cggggcggcuaucccaaa

SEQ ID NO: 3845599 - RNA, 18 nt, Shigella flexneri 2a str. 2457T
cggggcuaccgccagacc

SEQ ID NO: 3845600 - RNA, 21 nt, Shigella flexneri 2a str. 2457T
cggggcuguuuuccagcacca

SEQ ID NO: 3845601 - RNA, 13 nt, Shigella flexneri 2a str. 2457T
cgggggaagcuga

SEQ ID NO: 3845602 - RNA, 15 nt, Shigella flexneri 2a str. 2457T
cgguguccacuuccg

SEQ ID NO: 3845603 - RNA, 19 nt, Shigella flexneri 2a str. 2457T
cgguguccacuuccgcguc

SEQ ID NO: 3845604 - RNA, 23 nt, Shigella flexneri 2a str. 2457T
cggugucgauacgacaacggcag

SEQ ID NO: 3845605 - RNA, 20 nt, Shigella flexneri 2a str. 2457T
cggugugcgggaacauauca

SEQ ID NO: 3845606 - RNA, 18 nt, Shigella flexneri 2a str. 2457T
cgguguucaagccaaaac

SEQ ID NO: 3845607 - RNA, 19 nt, Shigella flexneri 2a str. 2457T
cgguguucaagccaaaacg

SEQ ID NO: 3845608 - RNA, 18 nt, Shigella flexneri 2a str. 2457T
cgguguugccgaagcagc

SEQ ID NO: 3845609 - RNA, 21 nt, Shigella flexneri 2a str. 2457T
cgguguuucgacgacaacgcg

SEQ ID NO: 3845610 - RNA, 14 nt, Shigella flexneri 2a str. 2457T
cgguuaaaaauaau

SEQ ID NO: 3845611 - RNA, 23 nt, Shigella flexneri 2a str. 2457T
cgguuaaaucgacguucugccaa

SEQ ID NO: 3845612 - RNA, 14 nt, Shigella flexneri 2a str. 2457T
cgguuaauaaugau

SEQ ID NO: 3845613 - RNA, 19 nt, Shigella flexneri 2a str. 2457T
cgguucaagucccaacauc

SEQ ID NO: 3845614 - RNA, 23 nt, Shigella flexneri 2a str. 2457T
cgguucaauaucuuccuggcgcu

SEQ ID NO: 3845615 - RNA, 16 nt, Shigella flexneri 2a str. 2457T
cgguucaauuuccagu

SEQ ID NO: 3845616 - RNA, 14 nt, Shigella flexneri 2a str. 2457T
cgguucaucacgaa

SEQ ID NO: 3845617 - RNA, 18 nt, Shigella flexneri 2a str. 2457T
cgguucgacggcuggaca

SEQ ID NO: 3845618 - RNA, 17 nt, Shigella flexneri 2a str. 2457T
cgguucguaggccagau

SEQ ID NO: 3845619 - RNA, 13 nt, Shigella flexneri 2a str. 2457T
cgguugccagaua

SEQ ID NO: 3845620 - RNA, 12 nt, Shigella flexneri 2a str. 2457T
cgguugccauaa

SEQ ID NO: 3845621 - RNA, 15 nt, Shigella flexneri 2a str. 2457T
cgguugcugaacagc

SEQ ID NO: 3845622 - RNA, 22 nt, Shigella flexneri 2a str. 2457T
cgguugcugaacagcuuuuucc

SEQ ID NO: 3845623 - RNA, 18 nt, Shigella flexneri 2a str. 2457T
cgguugcuuuucacaacc

SEQ ID NO: 3845624 - RNA, 22 nt, Shigella flexneri 2a str. 2457T
cgguuggcaucagaggaaugau

SEQ ID NO: 3845625 - RNA, 17 nt, Shigella flexneri 2a str. 2457T
cgguuggccugccggau

SEQ ID NO: 3845626 - RNA, 14 nt, Shigella flexneri 2a str. 2457T
cgguugggccaccg

SEQ ID NO: 3845627 - RNA, 15 nt, Shigella flexneri 2a str. 2457T
cgguugggccaccga

SEQ ID NO: 3845628 - RNA, 18 nt, Shigella flexneri 2a str. 2457T
cgguuguagcucggcgca

SEQ ID NO: 3845629 - RNA, 23 nt, Shigella flexneri 2a str. 2457T
cgguuguucaaccaccggcacca

SEQ ID NO: 3845630 - RNA, 11 nt, Shigella flexneri 2a str. 2457T
cgguuuaaccg

SEQ ID NO: 3845631 - RNA, 14 nt, Shigella flexneri 2a str. 2457T
cgguuuacccugcu

SEQ ID NO: 3845632 - RNA, 14 nt, Shigella flexneri 2a str. 2457T
cgguuuauccccaa

SEQ ID NO: 3845633 - RNA, 20 nt, Shigella flexneri 2a str. 2457T
cgguuucaaauuacgaucca

SEQ ID NO: 3845634 - RNA, 16 nt, Shigella flexneri 2a str. 2457T
cgguuucaauccaggu

SEQ ID NO: 3845635 - RNA, 16 nt, Shigella flexneri 2a str. 2457T
cgguuucacuauuacc

SEQ ID NO: 3845636 - RNA, 18 nt, Shigella flexneri 2a str. 2457T
cgguuucaguggggcagg

SEQ ID NO: 3845637 - RNA, 13 nt, Shigella flexneri 2a str. 2457T
cgguuucaucaca

SEQ ID NO: 3845638 - RNA, 13 nt, Shigella flexneri 2a str. 2457T
cgguuugccauuu

SEQ ID NO: 3845639 - RNA, 16 nt, Shigella flexneri 2a str. 2457T
cgguuugccauuuucu

SEQ ID NO: 3845640 - RNA, 20 nt, Shigella flexneri 2a str. 2457T
cgguuuucgcgccagccagu

SEQ ID NO: 3845641 - RNA, 23 nt, Shigella flexneri 2a str. 2457T
cgguuuugcaggaaaaacugccc

SEQ ID NO: 3845642 - RNA, 19 nt, Shigella flexneri 2a str. 2457T
cgguuuuguugccgcccgu

SEQ ID NO: 3845643 - RNA, 23 nt, Shigella flexneri 2a str. 2457T
cgguuuuuaaggguauuuuucua

SEQ ID NO: 3845644 - RNA, 17 nt, Shigella flexneri 2a str. 2457T
cguaaaaacccgcuucg

SEQ ID NO: 3845645 - RNA, 18 nt, Shigella flexneri 2a str. 2457T
cguaaaaacggauuucau

SEQ ID NO: 3845646 - RNA, 16 nt, Shigella flexneri 2a str. 2457T
cguaaaacugccugau

SEQ ID NO: 3845647 - RNA, 16 nt, Shigella flexneri 2a str. 2457T
cguaaaagccuggacc

SEQ ID NO: 3845648 - RNA, 20 nt, Shigella flexneri 2a str. 2457T
cguaaaagccuggaccauau

SEQ ID NO: 3845649 - RNA, 14 nt, Shigella flexneri 2a str. 2457T
cguaaacaacuggc

SEQ ID NO: 3845650 - RNA, 15 nt, Shigella flexneri 2a str. 2457T
cguaaacaacuggcg

SEQ ID NO: 3845651 - RNA, 18 nt, Shigella flexneri 2a str. 2457T
cguaaaccacugacacag

SEQ ID NO: 3845652 - RNA, 21 nt, Shigella flexneri 2a str. 2457T
cguaaacgccuuauccggccu

SEQ ID NO: 3845653 - RNA, 18 nt, Shigella flexneri 2a str. 2457T
cguaaagcgucgcaucag

SEQ ID NO: 3845654 - RNA, 20 nt, Shigella flexneri 2a str. 2457T
cguaaaggcggcagaacaga

SEQ ID NO: 3845655 - RNA, 14 nt, Shigella flexneri 2a str. 2457T
cguaaaucccgcca

SEQ ID NO: 3845656 - RNA, 18 nt, Shigella flexneri 2a str. 2457T
cguaaaucgucaguagcg

SEQ ID NO: 3845657 - RNA, 15 nt, Shigella flexneri 2a str. 2457T
cguaaaucuuuacca

SEQ ID NO: 3845658 - RNA, 13 nt, Shigella flexneri 2a str. 2457T
cguaacaaaacuc

SEQ ID NO: 3845659 - RNA, 17 nt, Shigella flexneri 2a str. 2457T
cguaacacauaacgcca

SEQ ID NO: 3845660 - RNA, 11 nt, Shigella flexneri 2a str. 2457T
cguaacauauu

SEQ ID NO: 3845661 - RNA, 13 nt, Shigella flexneri 2a str. 2457T
cguaaccaaucac

SEQ ID NO: 3845662 - RNA, 17 nt, Shigella flexneri 2a str. 2457T
cguaaccagacggcgua

SEQ ID NO: 3845663 - RNA, 19 nt, Shigella flexneri 2a str. 2457T
cguaaccagacggcguaau

SEQ ID NO: 3845664 - RNA, 15 nt, Shigella flexneri 2a str. 2457T
cguaacgaccaccac

SEQ ID NO: 3845665 - RNA, 17 nt, Shigella flexneri 2a str. 2457T
cguaacgaccaccaccg

SEQ ID NO: 3845666 - RNA, 13 nt, Shigella flexneri 2a str. 2457T
cguaacgacugac

SEQ ID NO: 3845667 - RNA, 23 nt, Shigella flexneri 2a str. 2457T
cguaacgcaccaggcgaaaacgc

SEQ ID NO: 3845668 - RNA, 22 nt, Shigella flexneri 2a str. 2457T
cguaacgccacgauagagagca

SEQ ID NO: 3845669 - RNA, 23 nt, Shigella flexneri 2a str. 2457T
cguaacgccacgauagagagcag

SEQ ID NO: 3845670 - RNA, 16 nt, Shigella flexneri 2a str. 2457T
cguaacucauccaacu

SEQ ID NO: 3845671 - RNA, 21 nt, Shigella flexneri 2a str. 2457T
cguaagcaaaaguagcaaagu

SEQ ID NO: 3845672 - RNA, 22 nt, Shigella flexneri 2a str. 2457T
cguaagcgcauccggcaccagc

SEQ ID NO: 3845673 - RNA, 18 nt, Shigella flexneri 2a str. 2457T
cguaaggcuucaaucaau

SEQ ID NO: 3845674 - RNA, 16 nt, Shigella flexneri 2a str. 2457T
cguaauaaaaucuauu

SEQ ID NO: 3845675 - RNA, 17 nt, Shigella flexneri 2a str. 2457T
cguaauacccuugcaga

SEQ ID NO: 3845676 - RNA, 13 nt, Shigella flexneri 2a str. 2457T
cguaauauccagg

SEQ ID NO: 3845677 - RNA, 15 nt, Shigella flexneri 2a str. 2457T
cguaauauccaggcc

SEQ ID NO: 3845678 - RNA, 16 nt, Shigella flexneri 2a str. 2457T
cguaaucagcaucuca

SEQ ID NO: 3845679 - RNA, 16 nt, Shigella flexneri 2a str. 2457T
cguaauccguaaagcc

SEQ ID NO: 3845680 - RNA, 17 nt, Shigella flexneri 2a str. 2457T
cguaaucgcccgcuucc

SEQ ID NO: 3845681 - RNA, 18 nt, Shigella flexneri 2a str. 2457T
cguaaucuuuucauauua

SEQ ID NO: 3845682 - RNA, 20 nt, Shigella flexneri 2a str. 2457T
cguaaugcuucuaccgucug

SEQ ID NO: 3845683 - RNA, 20 nt, Shigella flexneri 2a str. 2457T
cguaauggcagcauucaggu

SEQ ID NO: 3845684 - RNA, 15 nt, Shigella flexneri 2a str. 2457T
cguaaugucggugaa

SEQ ID NO: 3845685 - RNA, 16 nt, Shigella flexneri 2a str. 2457T
cguaauuggccugaca

SEQ ID NO: 3845686 - RNA, 14 nt, Shigella flexneri 2a str. 2457T
cguaauuugccguu

SEQ ID NO: 3845687 - RNA, 20 nt, Shigella flexneri 2a str. 2457T
cguacaccaacaucacgcaa

SEQ ID NO: 3845688 - RNA, 13 nt, Shigella flexneri 2a str. 2457T
cguacacgccgca

SEQ ID NO: 3845689 - RNA, 22 nt, Shigella flexneri 2a str. 2457T
cguacaugcagggcaaacucug

SEQ ID NO: 3845690 - RNA, 20 nt, Shigella flexneri 2a str. 2457T
cguacauugccgacauggca

SEQ ID NO: 3845691 - RNA, 22 nt, Shigella flexneri 2a str. 2457T
cguaccaaccgcaauugcugua

SEQ ID NO: 3845692 - RNA, 18 nt, Shigella flexneri 2a str. 2457T
cguaccacgcacagcccg

SEQ ID NO: 3845693 - RNA, 19 nt, Shigella flexneri 2a str. 2457T
cguaccacgcacagcccgc

SEQ ID NO: 3845694 - RNA, 16 nt, Shigella flexneri 2a str. 2457T
cguaccacggcauuuc

SEQ ID NO: 3845695 - RNA, 16 nt, Shigella flexneri 2a str. 2457T
cguaccagccuugcca

SEQ ID NO: 3845696 - RNA, 16 nt, Shigella flexneri 2a str. 2457T
cguaccaugcgcauca

SEQ ID NO: 3845697 - RNA, 20 nt, Shigella flexneri 2a str. 2457T
cguaccauuaucaccaaacu

SEQ ID NO: 3845698 - RNA, 16 nt, Shigella flexneri 2a str. 2457T
cguacccagcagcgcc

SEQ ID NO: 3845699 - RNA, 14 nt, Shigella flexneri 2a str. 2457T
cgucaguucacgcg

SEQ ID NO: 3845700 - RNA, 15 nt, Shigella flexneri 2a str. 2457T
cgucauacuccaguc

SEQ ID NO: 3845701 - RNA, 14 nt, Shigella flexneri 2a str. 2457T
cgucauacugcuca

SEQ ID NO: 3845702 - RNA, 17 nt, Shigella flexneri 2a str. 2457T
cgucauacugcucagac

SEQ ID NO: 3845703 - RNA, 22 nt, Shigella flexneri 2a str. 2457T
cgucauauagccgcgcaguuuc

SEQ ID NO: 3845704 - RNA, 16 nt, Shigella flexneri 2a str. 2457T
cgucauauuacugcaa

SEQ ID NO: 3845705 - RNA, 18 nt, Shigella flexneri 2a str. 2457T
cgucauauuacugcaacu

SEQ ID NO: 3845706 - RNA, 16 nt, Shigella flexneri 2a str. 2457T
cgucaucagcgccaac

SEQ ID NO: 3845707 - RNA, 22 nt, Shigella flexneri 2a str. 2457T
cgucaucauucaucgccuucuu

SEQ ID NO: 3845708 - RNA, 18 nt, Shigella flexneri 2a str. 2457T
cgucauccagcacuugca

SEQ ID NO: 3845709 - RNA, 19 nt, Shigella flexneri 2a str. 2457T
cgucaucccagucuucauc

SEQ ID NO: 3845710 - RNA, 18 nt, Shigella flexneri 2a str. 2457T
cgucauccggaaagcaca

SEQ ID NO: 3845711 - RNA, 17 nt, Shigella flexneri 2a str. 2457T
cgucauccguggcgaca

SEQ ID NO: 3845712 - RNA, 19 nt, Shigella flexneri 2a str. 2457T
cgucaucggcguugcccau

SEQ ID NO: 3845713 - RNA, 23 nt, Shigella flexneri 2a str. 2457T
cgucauuguuaacgccgcgccgu

SEQ ID NO: 3845714 - RNA, 21 nt, Shigella flexneri 2a str. 2457T
cgucauuuucaucgcuuucuu

SEQ ID NO: 3845715 - RNA, 13 nt, Shigella flexneri 2a str. 2457T
cguccacacggca

SEQ ID NO: 3845716 - RNA, 19 nt, Shigella flexneri 2a str. 2457T
cguccacagccaacacauu

SEQ ID NO: 3845717 - RNA, 12 nt, Shigella flexneri 2a str. 2457T
cguccagaugcg

SEQ ID NO: 3845718 - RNA, 19 nt, Shigella flexneri 2a str. 2457T
cguccagaugcgagauguc

SEQ ID NO: 3845719 - RNA, 15 nt, Shigella flexneri 2a str. 2457T
cguccagcagcaaug

SEQ ID NO: 3845720 - RNA, 17 nt, Shigella flexneri 2a str. 2457T
cguccagcuugaagggu

SEQ ID NO: 3845721 - RNA, 20 nt, Shigella flexneri 2a str. 2457T
cguccaggcccaggcauccc

SEQ ID NO: 3845722 - RNA, 22 nt, Shigella flexneri 2a str. 2457T
cguccaguuugccuucacaggc

SEQ ID NO: 3845723 - RNA, 18 nt, Shigella flexneri 2a str. 2457T
cguccauuucagcgcaga

SEQ ID NO: 3845724 - RNA, 15 nt, Shigella flexneri 2a str. 2457T
cguccccaucaggaa

SEQ ID NO: 3845725 - RNA, 19 nt, Shigella flexneri 2a str. 2457T
cguccgauuaaaaacccug

SEQ ID NO: 3845726 - RNA, 13 nt, Shigella flexneri 2a str. 2457T
cguccgcacgcug

SEQ ID NO: 3845727 - RNA, 20 nt, Shigella flexneri 2a str. 2457T
cguccgcucggucacugaca

SEQ ID NO: 3845728 - RNA, 20 nt, Shigella flexneri 2a str. 2457T
cguccggcaucgcaaaccag

SEQ ID NO: 3845729 - RNA, 15 nt, Shigella flexneri 2a str. 2457T
cguccggcugccagc

SEQ ID NO: 3845730 - RNA, 16 nt, Shigella flexneri 2a str. 2457T
cguccgguuuacuucc

SEQ ID NO: 3845731 - RNA, 15 nt, Shigella flexneri 2a str. 2457T
cguccucuucccaga

SEQ ID NO: 3845732 - RNA, 15 nt, Shigella flexneri 2a str. 2457T
cguccugcuugccag

SEQ ID NO: 3845733 - RNA, 15 nt, Shigella flexneri 2a str. 2457T
cgucgaaauuauuca

SEQ ID NO: 3845734 - RNA, 13 nt, Shigella flexneri 2a str. 2457T
cgucgaucaacgc

SEQ ID NO: 3845735 - RNA, 18 nt, Shigella flexneri 2a str. 2457T
cgucgauugcucaacgcc

SEQ ID NO: 3845736 - RNA, 23 nt, Shigella flexneri 2a str. 2457T
cgucgauuguuauaccaguccac

SEQ ID NO: 3845737 - RNA, 20 nt, Shigella flexneri 2a str. 2457T
cgucgcaauacccugaccca

SEQ ID NO: 3845738 - RNA, 15 nt, Shigella flexneri 2a str. 2457T
cgucgcauccggcaa

SEQ ID NO: 3845739 - RNA, 18 nt, Shigella flexneri 2a str. 2457T
cgucgccagacgcagcaa

SEQ ID NO: 3845740 - RNA, 16 nt, Shigella flexneri 2a str. 2457T
cgucgccagcgcgcag

SEQ ID NO: 3845741 - RNA, 18 nt, Shigella flexneri 2a str. 2457T
cgucgccaguaccagcag

SEQ ID NO: 3845742 - RNA, 14 nt, Shigella flexneri 2a str. 2457T
cgucgcccgcgcga

SEQ ID NO: 3845743 - RNA, 13 nt, Shigella flexneri 2a str. 2457T
cgucgccuucaac

SEQ ID NO: 3845744 - RNA, 17 nt, Shigella flexneri 2a str. 2457T
cgucgcgcacgcccauc

SEQ ID NO: 3845745 - RNA, 16 nt, Shigella flexneri 2a str. 2457T
cgucgcgcccuccugc

SEQ ID NO: 3845746 - RNA, 23 nt, Shigella flexneri 2a str. 2457T
cgucgcgguugcugucggcggcg

SEQ ID NO: 3845747 - RNA, 19 nt, Shigella flexneri 2a str. 2457T
cgucgcuaacggugcacgc

SEQ ID NO: 3845748 - RNA, 21 nt, Shigella flexneri 2a str. 2457T
cgucgcuuaauugaccugccg

SEQ ID NO: 3845749 - RNA, 17 nt, Shigella flexneri 2a str. 2457T
cgucgcuucucaagcuc

SEQ ID NO: 3845750 - RNA, 12 nt, Shigella flexneri 2a str. 2457T
cgucgcuuuaua

SEQ ID NO: 3845751 - RNA, 21 nt, Shigella flexneri 2a str. 2457T
cgucggcaucgggcagcaucg

SEQ ID NO: 3845752 - RNA, 19 nt, Shigella flexneri 2a str. 2457T
cgucggcgucaucgacauc

SEQ ID NO: 3845753 - RNA, 13 nt, Shigella flexneri 2a str. 2457T
cgucgggaagacc

SEQ ID NO: 3845754 - RNA, 20 nt, Shigella flexneri 2a str. 2457T
cgucgucagcaguucacgca

SEQ ID NO: 3845755 - RNA, 21 nt, Shigella flexneri 2a str. 2457T
cgucgucagcaguucacgcag

SEQ ID NO: 3845756 - RNA, 15 nt, Shigella flexneri 2a str. 2457T
cgucgucccuuccgc

SEQ ID NO: 3845757 - RNA, 19 nt, Shigella flexneri 2a str. 2457T
cgucguggcaaaaugcauc

SEQ ID NO: 3845758 - RNA, 19 nt, Shigella flexneri 2a str. 2457T
cgucguuacugucgcgcag

SEQ ID NO: 3845759 - RNA, 17 nt, Shigella flexneri 2a str. 2457T
cgucuacaggcgcgacc

SEQ ID NO: 3845760 - RNA, 14 nt, Shigella flexneri 2a str. 2457T
cgucuacuaacgcu

SEQ ID NO: 3845761 - RNA, 23 nt, Shigella flexneri 2a str. 2457T
cgucucagcgccgcuuuccaggc

SEQ ID NO: 3845762 - RNA, 12 nt, Shigella flexneri 2a str. 2457T
cgucuccaucaa

SEQ ID NO: 3845763 - RNA, 15 nt, Shigella flexneri 2a str. 2457T
cgucuccaucaauac

SEQ ID NO: 3845764 - RNA, 19 nt, Shigella flexneri 2a str. 2457T
cgucucccgaugccagcac

SEQ ID NO: 3845765 - RNA, 16 nt, Shigella flexneri 2a str. 2457T
cgucuccugccgagcg

SEQ ID NO: 3845766 - RNA, 20 nt, Shigella flexneri 2a str. 2457T
cgucucugguuuuacaacgu

SEQ ID NO: 3845767 - RNA, 18 nt, Shigella flexneri 2a str. 2457T
cgucugcgccaccacaac

SEQ ID NO: 3845768 - RNA, 11 nt, Shigella flexneri 2a str. 2457T
cgucugcugga

SEQ ID NO: 3845769 - RNA, 21 nt, Shigella flexneri 2a str. 2457T
cgucugggcaaaaucaucacu

SEQ ID NO: 3845770 - RNA, 19 nt, Shigella flexneri 2a str. 2457T
cgucuuaucaggccuacaa

SEQ ID NO: 3845771 - RNA, 12 nt, Shigella flexneri 2a str. 2457T
cgucuuaucugg

SEQ ID NO: 3845772 - RNA, 20 nt, Shigella flexneri 2a str. 2457T
cgucuuaucuggccuacaga

SEQ ID NO: 3845773 - RNA, 14 nt, Shigella flexneri 2a str. 2457T
cgucuucccgcagc

SEQ ID NO: 3845774 - RNA, 15 nt, Shigella flexneri 2a str. 2457T
cgucuucccgcagcc

SEQ ID NO: 3845775 - RNA, 17 nt, Shigella flexneri 2a str. 2457T
cgucuuccgugccugac

SEQ ID NO: 3845776 - RNA, 13 nt, Shigella flexneri 2a str. 2457T
cgucuucguccca

SEQ ID NO: 3845777 - RNA, 16 nt, Shigella flexneri 2a str. 2457T
cgucuucugcagucac

SEQ ID NO: 3845778 - RNA, 18 nt, Shigella flexneri 2a str. 2457T
cgucuucugguugcgaaa

SEQ ID NO: 3845779 - RNA, 22 nt, Shigella flexneri 2a str. 2457T
cgucuucugguugcgaaaaaau

SEQ ID NO: 3845780 - RNA, 19 nt, Shigella flexneri 2a str. 2457T
cgucuuugcguuccaucag

SEQ ID NO: 3845781 - RNA, 14 nt, Shigella flexneri 2a str. 2457T
cgucuuuuacagcg

SEQ ID NO: 3845782 - RNA, 13 nt, Shigella flexneri 2a str. 2457T
cgucuuuuuucac

SEQ ID NO: 3845783 - RNA, 16 nt, Shigella flexneri 2a str. 2457T
cgugaacgugcaaaau

SEQ ID NO: 3845784 - RNA, 18 nt, Shigella flexneri 2a str. 2457T
cgugaacgugggucuguc

SEQ ID NO: 3845785 - RNA, 21 nt, Shigella flexneri 2a str. 2457T
cgugaacugggccugcauauc

SEQ ID NO: 3845786 - RNA, 23 nt, Shigella flexneri 2a str. 2457T
cgugaagagauggaucaacuugg

SEQ ID NO: 3845787 - RNA, 18 nt, Shigella flexneri 2a str. 2457T
cgugaagcuggcagaagu

SEQ ID NO: 3845788 - RNA, 17 nt, Shigella flexneri 2a str. 2457T
cgugaauauggaacgga

SEQ ID NO: 3845789 - RNA, 21 nt, Shigella flexneri 2a str. 2457T
cgugaaugccguaggcccagc

SEQ ID NO: 3845790 - RNA, 14 nt, Shigella flexneri 2a str. 2457T
cgugaaugccugau

SEQ ID NO: 3845791 - RNA, 16 nt, Shigella flexneri 2a str. 2457T
cgugaauuacugcugc

SEQ ID NO: 3845792 - RNA, 20 nt, Shigella flexneri 2a str. 2457T
cgugacaauaauacccagca

SEQ ID NO: 3845793 - RNA, 21 nt, Shigella flexneri 2a str. 2457T
cgugaccaguaccaccgcgaa

SEQ ID NO: 3845794 - RNA, 17 nt, Shigella flexneri 2a str. 2457T
cgugaccgccagaacac

SEQ ID NO: 3845795 - RNA, 19 nt, Shigella flexneri 2a str. 2457T
cgugaccugugccagccau

SEQ ID NO: 3845796 - RNA, 20 nt, Shigella flexneri 2a str. 2457T
cguucaauaccgucugcgcc

SEQ ID NO: 3845797 - RNA, 19 nt, Shigella flexneri 2a str. 2457T
cguucacgcagcucacgca

SEQ ID NO: 3845798 - RNA, 16 nt, Shigella flexneri 2a str. 2457T
cguucacgccgcaucc

SEQ ID NO: 3845799 - RNA, 21 nt, Shigella flexneri 2a str. 2457T
cguucacgccgcauccggcau

SEQ ID NO: 3845800 - RNA, 13 nt, Shigella flexneri 2a str. 2457T
cguucacugccac

SEQ ID NO: 3845801 - RNA, 17 nt, Shigella flexneri 2a str. 2457T
cguucagccauacguug

SEQ ID NO: 3845802 - RNA, 15 nt, Shigella flexneri 2a str. 2457T
cguucagucgccggg

SEQ ID NO: 3845803 - RNA, 16 nt, Shigella flexneri 2a str. 2457T
cguucauuaacgcccc

SEQ ID NO: 3845804 - RNA, 21 nt, Shigella flexneri 2a str. 2457T
cguuccacccacggcguuaac

SEQ ID NO: 3845805 - RNA, 20 nt, Shigella flexneri 2a str. 2457T
cguuccacggggacuccaca

SEQ ID NO: 3845806 - RNA, 13 nt, Shigella flexneri 2a str. 2457T
cguuccaggcgau

SEQ ID NO: 3845807 - RNA, 15 nt, Shigella flexneri 2a str. 2457T
cguuccauggcagga

SEQ ID NO: 3845808 - RNA, 17 nt, Shigella flexneri 2a str. 2457T
cguuccuggcuugccag

SEQ ID NO: 3845809 - RNA, 19 nt, Shigella flexneri 2a str. 2457T
cguuccuucaggacccuua

SEQ ID NO: 3845810 - RNA, 21 nt, Shigella flexneri 2a str. 2457T
cguuccuuuacggugaacuca

SEQ ID NO: 3845811 - RNA, 12 nt, Shigella flexneri 2a str. 2457T
cguuccuuucuu

SEQ ID NO: 3845812 - RNA, 21 nt, Shigella flexneri 2a str. 2457T
cguuccuuucuugcgcaaacc

SEQ ID NO: 3845813 - RNA, 15 nt, Shigella flexneri 2a str. 2457T
cguucgaacuggaua

SEQ ID NO: 3845814 - RNA, 14 nt, Shigella flexneri 2a str. 2457T
cguucggcgagcag

SEQ ID NO: 3845815 - RNA, 20 nt, Shigella flexneri 2a str. 2457T
cguucugaucuuucuucagc

SEQ ID NO: 3845816 - RNA, 18 nt, Shigella flexneri 2a str. 2457T
cguucuggguggugauuu

SEQ ID NO: 3845817 - RNA, 15 nt, Shigella flexneri 2a str. 2457T
cguucuucggcacug

SEQ ID NO: 3845818 - RNA, 23 nt, Shigella flexneri 2a str. 2457T
cguugaaaaaucaaaaaacugga

SEQ ID NO: 3845819 - RNA, 14 nt, Shigella flexneri 2a str. 2457T
cguugaaagauaau

SEQ ID NO: 3845820 - RNA, 15 nt, Shigella flexneri 2a str. 2457T
cguugaauuucaggu

SEQ ID NO: 3845821 - RNA, 14 nt, Shigella flexneri 2a str. 2457T
cguugaccaccaua

SEQ ID NO: 3845822 - RNA, 14 nt, Shigella flexneri 2a str. 2457T
cguugaccagcauc

SEQ ID NO: 3845823 - RNA, 16 nt, Shigella flexneri 2a str. 2457T
cguugaccagcauccc

SEQ ID NO: 3845824 - RNA, 14 nt, Shigella flexneri 2a str. 2457T
cguugaccaucuga

SEQ ID NO: 3845825 - RNA, 22 nt, Shigella flexneri 2a str. 2457T
cguugagaaaacuuccggcaga

SEQ ID NO: 3845826 - RNA, 19 nt, Shigella flexneri 2a str. 2457T
cguugagagguaaaaccug

SEQ ID NO: 3845827 - RNA, 22 nt, Shigella flexneri 2a str. 2457T
cguugaggauggcgucgauaau

SEQ ID NO: 3845828 - RNA, 16 nt, Shigella flexneri 2a str. 2457T
cguugagggcgcaauu

SEQ ID NO: 3845829 - RNA, 21 nt, Shigella flexneri 2a str. 2457T
cguugaucacccacaucagcg

SEQ ID NO: 3845830 - RNA, 13 nt, Shigella flexneri 2a str. 2457T
cguugaucgcuuu

SEQ ID NO: 3845831 - RNA, 17 nt, Shigella flexneri 2a str. 2457T
cguugaucggcuggcga

SEQ ID NO: 3845832 - RNA, 12 nt, Shigella flexneri 2a str. 2457T
cguugaugcagg

SEQ ID NO: 3845833 - RNA, 19 nt, Shigella flexneri 2a str. 2457T
cguugauucacuuucugaa

SEQ ID NO: 3845834 - RNA, 21 nt, Shigella flexneri 2a str. 2457T
cguugauuuugucauggcgca

SEQ ID NO: 3845835 - RNA, 16 nt, Shigella flexneri 2a str. 2457T
cguugcccaucgccac

SEQ ID NO: 3845836 - RNA, 17 nt, Shigella flexneri 2a str. 2457T
cguugcccggagcagca

SEQ ID NO: 3845837 - RNA, 14 nt, Shigella flexneri 2a str. 2457T
cguugccugcggca

SEQ ID NO: 3845838 - RNA, 14 nt, Shigella flexneri 2a str. 2457T
cguugcgaucgacc

SEQ ID NO: 3845839 - RNA, 16 nt, Shigella flexneri 2a str. 2457T
cguugcgaucgaccug

SEQ ID NO: 3845840 - RNA, 16 nt, Shigella flexneri 2a str. 2457T
cguugcgcccaucauc

SEQ ID NO: 3845841 - RNA, 20 nt, Shigella flexneri 2a str. 2457T
cguugcggcugcccaucauc

SEQ ID NO: 3845842 - RNA, 12 nt, Shigella flexneri 2a str. 2457T
cguugcucagaa

SEQ ID NO: 3845843 - RNA, 13 nt, Shigella flexneri 2a str. 2457T
cguugcucuucuc

SEQ ID NO: 3845844 - RNA, 19 nt, Shigella flexneri 2a str. 2457T
cguugcuuuuugcgcaucc

SEQ ID NO: 3845845 - RNA, 21 nt, Shigella flexneri 2a str. 2457T
cguugcuuuuugcgcauccag

SEQ ID NO: 3845846 - RNA, 19 nt, Shigella flexneri 2a str. 2457T
cguugggugcuugaggcug

SEQ ID NO: 3845847 - RNA, 14 nt, Shigella flexneri 2a str. 2457T
cguuggucaucacu

SEQ ID NO: 3845848 - RNA, 18 nt, Shigella flexneri 2a str. 2457T
cguuggucucaagcaagu

SEQ ID NO: 3845849 - RNA, 17 nt, Shigella flexneri 2a str. 2457T
cguuggugauaaaacgc

SEQ ID NO: 3845850 - RNA, 14 nt, Shigella flexneri 2a str. 2457T
cguugugauuaaac

SEQ ID NO: 3845851 - RNA, 17 nt, Shigella flexneri 2a str. 2457T
cguugugcgauccacgc

SEQ ID NO: 3845852 - RNA, 17 nt, Shigella flexneri 2a str. 2457T
cguugugcgcgacauac

SEQ ID NO: 3845853 - RNA, 14 nt, Shigella flexneri 2a str. 2457T
cguugugucgccag

SEQ ID NO: 3845854 - RNA, 16 nt, Shigella flexneri 2a str. 2457T
cguuguuaaggguaaa

SEQ ID NO: 3845855 - RNA, 19 nt, Shigella flexneri 2a str. 2457T
cguuguuccuuccagcugg

SEQ ID NO: 3845856 - RNA, 15 nt, Shigella flexneri 2a str. 2457T
cguuguucuacgugc

SEQ ID NO: 3845857 - RNA, 18 nt, Shigella flexneri 2a str. 2457T
cguuuaaaccaggcgaga

SEQ ID NO: 3845858 - RNA, 14 nt, Shigella flexneri 2a str. 2457T
cguuuaccgccauc

SEQ ID NO: 3845859 - RNA, 15 nt, Shigella flexneri 2a str. 2457T
cguuuacgccgcauc

SEQ ID NO: 3845860 - RNA, 22 nt, Shigella flexneri 2a str. 2457T
cguuuacgccgcauccggcaau

SEQ ID NO: 3845861 - RNA, 21 nt, Shigella flexneri 2a str. 2457T
cguuuacgccgcauccggcau

SEQ ID NO: 3845862 - RNA, 16 nt, Shigella flexneri 2a str. 2457T
cguuuagccgccguua

SEQ ID NO: 3845863 - RNA, 18 nt, Shigella flexneri 2a str. 2457T
cguuuaugaucaucaagg

SEQ ID NO: 3845864 - RNA, 16 nt, Shigella flexneri 2a str. 2457T
cguuuaugcagguucu

SEQ ID NO: 3845865 - RNA, 19 nt, Shigella flexneri 2a str. 2457T
cguuuauugucguuaucgc

SEQ ID NO: 3845866 - RNA, 22 nt, Shigella flexneri 2a str. 2457T
cguuuauuuccccgcucuaccu

SEQ ID NO: 3845867 - RNA, 14 nt, Shigella flexneri 2a str. 2457T
cguuucaaaaacaa

SEQ ID NO: 3845868 - RNA, 15 nt, Shigella flexneri 2a str. 2457T
cguuucaaaaacaaa

SEQ ID NO: 3845869 - RNA, 17 nt, Shigella flexneri 2a str. 2457T
cguuucaccgcacgacg

SEQ ID NO: 3845870 - RNA, 16 nt, Shigella flexneri 2a str. 2457T
cguuucacugccggac

SEQ ID NO: 3845871 - RNA, 20 nt, Shigella flexneri 2a str. 2457T
cguuucagauuguugacaaa

SEQ ID NO: 3845872 - RNA, 18 nt, Shigella flexneri 2a str. 2457T
cguuucagcgguuugaaa

SEQ ID NO: 3845873 - RNA, 16 nt, Shigella flexneri 2a str. 2457T
cguuucagguuaaugc

SEQ ID NO: 3845874 - RNA, 17 nt, Shigella flexneri 2a str. 2457T
cguuuccagcaguucca

SEQ ID NO: 3845875 - RNA, 17 nt, Shigella flexneri 2a str. 2457T
cguuuccauucgcugcu

SEQ ID NO: 3845876 - RNA, 21 nt, Shigella flexneri 2a str. 2457T
cguuucgcagguuccgcauac

SEQ ID NO: 3845877 - RNA, 20 nt, Shigella flexneri 2a str. 2457T
cguuucuacaagcagagaga

SEQ ID NO: 3845878 - RNA, 13 nt, Shigella flexneri 2a str. 2457T
cguuucugcuggu

SEQ ID NO: 3845879 - RNA, 22 nt, Shigella flexneri 2a str. 2457T
cguuugauuaacgccagauuac

SEQ ID NO: 3845880 - RNA, 17 nt, Shigella flexneri 2a str. 2457T
cguuugccaccugugca

SEQ ID NO: 3845881 - RNA, 17 nt, Shigella flexneri 2a str. 2457T
cguuugccagugccguu

SEQ ID NO: 3845882 - RNA, 18 nt, Shigella flexneri 2a str. 2457T
cguuugccuuucggcgca

SEQ ID NO: 3845883 - RNA, 23 nt, Shigella flexneri 2a str. 2457T
cguuuggggcauauuaucagcaa

SEQ ID NO: 3845884 - RNA, 19 nt, Shigella flexneri 2a str. 2457T
cguuuguaacccaccaugc

SEQ ID NO: 3845885 - RNA, 16 nt, Shigella flexneri 2a str. 2457T
cguuuguugcgcuaag

SEQ ID NO: 3845886 - RNA, 22 nt, Shigella flexneri 2a str. 2457T
cguuuuaaugcgauccugagcc

SEQ ID NO: 3845887 - RNA, 15 nt, Shigella flexneri 2a str. 2457T
cguuuuaguaacaac

SEQ ID NO: 3845888 - RNA, 22 nt, Shigella flexneri 2a str. 2457T
cguuuucagguuacgcccuuca

SEQ ID NO: 3845889 - RNA, 21 nt, Shigella flexneri 2a str. 2457T
cguuuucaguugcucugcagc

SEQ ID NO: 3845890 - RNA, 21 nt, Shigella flexneri 2a str. 2457T
cguuuucgccacaucagguaa

SEQ ID NO: 3845891 - RNA, 11 nt, Shigella flexneri 2a str. 2457T
cguuuuuaaaa

SEQ ID NO: 3845892 - RNA, 21 nt, Shigella flexneri 2a str. 2457T
cguuuuuaucuucacacacau

SEQ ID NO: 3845893 - RNA, 17 nt, Shigella flexneri 2a str. 2457T
cguuuuuuaugccggau

SEQ ID NO: 3845894 - RNA, 18 nt, Shigella flexneri 2a str. 2457T
cuacagcgcccgccagca

SEQ ID NO: 3845895 - RNA, 23 nt, Shigella flexneri 2a str. 2457T
cuacagcgcccgccagcaccgga

SEQ ID NO: 3845896 - RNA, 15 nt, Shigella flexneri 2a str. 2457T
cuacaucguuccugc

SEQ ID NO: 3845897 - RNA, 17 nt, Shigella flexneri 2a str. 2457T
cuaccacgccgauaauc

SEQ ID NO: 3845898 - RNA, 16 nt, Shigella flexneri 2a str. 2457T
cuaccacguaacgacu

SEQ ID NO: 3845899 - RNA, 17 nt, Shigella flexneri 2a str. 2457T
cuaccacugccugaguu

SEQ ID NO: 3845900 - RNA, 20 nt, Shigella flexneri 2a str. 2457T
cuaccagguuucgcaauaac

SEQ ID NO: 3845901 - RNA, 23 nt, Shigella flexneri 2a str. 2457T
cuaccaucagguaauaggcaggc

SEQ ID NO: 3845902 - RNA, 23 nt, Shigella flexneri 2a str. 2457T
cuaccaugaccugcaaauucaau

SEQ ID NO: 3845903 - RNA, 16 nt, Shigella flexneri 2a str. 2457T
cuacccauauuuaauc

SEQ ID NO: 3845904 - RNA, 12 nt, Shigella flexneri 2a str. 2457T
cuacccggcaag

SEQ ID NO: 3845905 - RNA, 16 nt, Shigella flexneri 2a str. 2457T
cuaccgcgcaggguaa

SEQ ID NO: 3845906 - RNA, 14 nt, Shigella flexneri 2a str. 2457T
cuaccguguucagc

SEQ ID NO: 3845907 - RNA, 16 nt, Shigella flexneri 2a str. 2457T
cuaccguguucagcgu

SEQ ID NO: 3845908 - RNA, 17 nt, Shigella flexneri 2a str. 2457T
cuaccuaaggaauccag

SEQ ID NO: 3845909 - RNA, 22 nt, Shigella flexneri 2a str. 2457T
cuaccuuaacgguaucuuucca

SEQ ID NO: 3845910 - RNA, 16 nt, Shigella flexneri 2a str. 2457T
cuacgcgcccgcgcag

SEQ ID NO: 3845911 - RNA, 13 nt, Shigella flexneri 2a str. 2457T
cuacgcuuaucag

SEQ ID NO: 3845912 - RNA, 15 nt, Shigella flexneri 2a str. 2457T
cuacggucacgccac

SEQ ID NO: 3845913 - RNA, 15 nt, Shigella flexneri 2a str. 2457T
cuacgucucaauuca

SEQ ID NO: 3845914 - RNA, 19 nt, Shigella flexneri 2a str. 2457T
cuacgucucaauucaucuu

SEQ ID NO: 3845915 - RNA, 18 nt, Shigella flexneri 2a str. 2457T
cuacgugaggcaucagac

SEQ ID NO: 3845916 - RNA, 16 nt, Shigella flexneri 2a str. 2457T
cuacgugcgcuaugug

SEQ ID NO: 3845917 - RNA, 19 nt, Shigella flexneri 2a str. 2457T
cuacgugcgcuauguguua

SEQ ID NO: 3845918 - RNA, 23 nt, Shigella flexneri 2a str. 2457T
cuacguggaucgaucaauuuauu

SEQ ID NO: 3845919 - RNA, 16 nt, Shigella flexneri 2a str. 2457T
cuacuauggaacgcuc

SEQ ID NO: 3845920 - RNA, 14 nt, Shigella flexneri 2a str. 2457T
cuacucguuuauua

SEQ ID NO: 3845921 - RNA, 21 nt, Shigella flexneri 2a str. 2457T
cuacucuauacaggauaauua

SEQ ID NO: 3845922 - RNA, 16 nt, Shigella flexneri 2a str. 2457T
cuacucugacccagua

SEQ ID NO: 3845923 - RNA, 21 nt, Shigella flexneri 2a str. 2457T
cuacugauggcuacguucugc

SEQ ID NO: 3845924 - RNA, 20 nt, Shigella flexneri 2a str. 2457T
cuacuucuucuucgcugcag

SEQ ID NO: 3845925 - RNA, 23 nt, Shigella flexneri 2a str. 2457T
cuacuuuguaaacgaagcgccau

SEQ ID NO: 3845926 - RNA, 21 nt, Shigella flexneri 2a str. 2457T
cuacuuuuccagguuauuuua

SEQ ID NO: 3845927 - RNA, 21 nt, Shigella flexneri 2a str. 2457T
cuacuuuuuaauucaggaaau

SEQ ID NO: 3845928 - RNA, 18 nt, Shigella flexneri 2a str. 2457T
cuacuuuuuucacccaca

SEQ ID NO: 3845929 - RNA, 21 nt, Shigella flexneri 2a str. 2457T
cuacuuuuuucacccacacuu

SEQ ID NO: 3845930 - RNA, 19 nt, Shigella flexneri 2a str. 2457T
cuagacagcgacucucuga

SEQ ID NO: 3845931 - RNA, 14 nt, Shigella flexneri 2a str. 2457T
cuagacgaugaaaa

SEQ ID NO: 3845932 - RNA, 24 nt, Shigella flexneri 2a str. 2457T
cuagagcaucaugaauauauaauu

SEQ ID NO: 3845933 - RNA, 22 nt, Shigella flexneri 2a str. 2457T
cuagaugugcaguuccugcaac

SEQ ID NO: 3845934 - RNA, 22 nt, Shigella flexneri 2a str. 2457T
cuaggacgcacaucgcugugcu

SEQ ID NO: 3845935 - RNA, 18 nt, Shigella flexneri 2a str. 2457T
cuaggcgccaagggcggc

SEQ ID NO: 3845936 - RNA, 14 nt, Shigella flexneri 2a str. 2457T
cuaguguacccuuc

SEQ ID NO: 3845937 - RNA, 18 nt, Shigella flexneri 2a str. 2457T
cuaguuuugccgacuggc

SEQ ID NO: 3845938 - RNA, 20 nt, Shigella flexneri 2a str. 2457T
cuauaaccggcuguuuauua

SEQ ID NO: 3845939 - RNA, 14 nt, Shigella flexneri 2a str. 2457T
cuauaaccguaaua

SEQ ID NO: 3845940 - RNA, 21 nt, Shigella flexneri 2a str. 2457T
cuauaaguguaaaauucuaca

SEQ ID NO: 3845941 - RNA, 15 nt, Shigella flexneri 2a str. 2457T
cuauaaugagauauu

SEQ ID NO: 3845942 - RNA, 19 nt, Shigella flexneri 2a str. 2457T
cuauaaugagauauuuaau

SEQ ID NO: 3845943 - RNA, 20 nt, Shigella flexneri 2a str. 2457T
cuauaaugagauauuuaaug

SEQ ID NO: 3845944 - RNA, 23 nt, Shigella flexneri 2a str. 2457T
cuauaauugcuuuuuuccauaag

SEQ ID NO: 3845945 - RNA, 19 nt, Shigella flexneri 2a str. 2457T
cuauaccagauaaacaucg

SEQ ID NO: 3845946 - RNA, 14 nt, Shigella flexneri 2a str. 2457T
cuauaccccacccc

SEQ ID NO: 3845947 - RNA, 16 nt, Shigella flexneri 2a str. 2457T
cuauagauuauuugcg

SEQ ID NO: 3845948 - RNA, 14 nt, Shigella flexneri 2a str. 2457T
cuauagucuuuucg

SEQ ID NO: 3845949 - RNA, 18 nt, Shigella flexneri 2a str. 2457T
cuauagugaggcuauucc

SEQ ID NO: 3845950 - RNA, 18 nt, Shigella flexneri 2a str. 2457T
cuauaucgcucuugcucu

SEQ ID NO: 3845951 - RNA, 22 nt, Shigella flexneri 2a str. 2457T
cuauauuacgagucacaaacau

SEQ ID NO: 3845952 - RNA, 15 nt, Shigella flexneri 2a str. 2457T
cuaucaaacugaccu

SEQ ID NO: 3845953 - RNA, 20 nt, Shigella flexneri 2a str. 2457T
cuaucagaccuacaaaaccu

SEQ ID NO: 3845954 - RNA, 22 nt, Shigella flexneri 2a str. 2457T
cuaucagcgccaccacaaaagc

SEQ ID NO: 3845955 - RNA, 12 nt, Shigella flexneri 2a str. 2457T
cuaucaggcaaa

SEQ ID NO: 3845956 - RNA, 16 nt, Shigella flexneri 2a str. 2457T
cuaucaggcaaaaaaa

SEQ ID NO: 3845957 - RNA, 14 nt, Shigella flexneri 2a str. 2457T
cuaucauacucauu

SEQ ID NO: 3845958 - RNA, 17 nt, Shigella flexneri 2a str. 2457T
cuaucccagccuauaac

SEQ ID NO: 3845959 - RNA, 14 nt, Shigella flexneri 2a str. 2457T
cuauccggcauaca

SEQ ID NO: 3845960 - RNA, 20 nt, Shigella flexneri 2a str. 2457T
cuauccugguuauuucacuu

SEQ ID NO: 3845961 - RNA, 18 nt, Shigella flexneri 2a str. 2457T
cuaucgaaaguuuaccag

SEQ ID NO: 3845962 - RNA, 22 nt, Shigella flexneri 2a str. 2457T
cuaucgcugagauacucaagca

SEQ ID NO: 3845963 - RNA, 21 nt, Shigella flexneri 2a str. 2457T
cuaucggcagaguugagcagu

SEQ ID NO: 3845964 - RNA, 18 nt, Shigella flexneri 2a str. 2457T
cuaucucccugauccaac

SEQ ID NO: 3845965 - RNA, 18 nt, Shigella flexneri 2a str. 2457T
cuaucugcugcuugcggu

SEQ ID NO: 3845966 - RNA, 14 nt, Shigella flexneri 2a str. 2457T
cuaucuguuugcca

SEQ ID NO: 3845967 - RNA, 15 nt, Shigella flexneri 2a str. 2457T
cuaucuuucaacagu

SEQ ID NO: 3845968 - RNA, 21 nt, Shigella flexneri 2a str. 2457T
cuaucuuucagaccuuuuacu

SEQ ID NO: 3845969 - RNA, 22 nt, Shigella flexneri 2a str. 2457T
cuaugaacacgaucucacgcug

SEQ ID NO: 3845970 - RNA, 16 nt, Shigella flexneri 2a str. 2457T
cuaugaagaacuggaa

SEQ ID NO: 3845971 - RNA, 17 nt, Shigella flexneri 2a str. 2457T
cuaugagaaaauuucau

SEQ ID NO: 3845972 - RNA, 11 nt, Shigella flexneri 2a str. 2457T
cuaugagcaga

SEQ ID NO: 3845973 - RNA, 14 nt, Shigella flexneri 2a str. 2457T
cuaugauuuuccug

SEQ ID NO: 3845974 - RNA, 17 nt, Shigella flexneri 2a str. 2457T
cuaugauuuuccugagg

SEQ ID NO: 3845975 - RNA, 22 nt, Shigella flexneri 2a str. 2457T
cuaugcaacaacugaaaaaaaa

SEQ ID NO: 3845976 - RNA, 18 nt, Shigella flexneri 2a str. 2457T
cuaugcauaauccugccg

SEQ ID NO: 3845977 - RNA, 11 nt, Shigella flexneri 2a str. 2457T
cuauggggaaa

SEQ ID NO: 3845978 - RNA, 13 nt, Shigella flexneri 2a str. 2457T
cuauggucuugua

SEQ ID NO: 3845979 - RNA, 15 nt, Shigella flexneri 2a str. 2457T
cuaugguuuugaaga

SEQ ID NO: 3845980 - RNA, 16 nt, Shigella flexneri 2a str. 2457T
cuaugguuuugaagaa

SEQ ID NO: 3845981 - RNA, 17 nt, Shigella flexneri 2a str. 2457T
cuaugucgcauccggca

SEQ ID NO: 3845982 - RNA, 22 nt, Shigella flexneri 2a str. 2457T
cuaugugaucuuuaucacacag

SEQ ID NO: 3845983 - RNA, 20 nt, Shigella flexneri 2a str. 2457T
cuauuaaaaagcuucucaga

SEQ ID NO: 3845984 - RNA, 22 nt, Shigella flexneri 2a str. 2457T
cuauuaaagaaaguaaucuaua

SEQ ID NO: 3845985 - RNA, 19 nt, Shigella flexneri 2a str. 2457T
cuauuaauuaugauggggc

SEQ ID NO: 3845986 - RNA, 21 nt, Shigella flexneri 2a str. 2457T
cuauuacuuuaagccuuccgc

SEQ ID NO: 3845987 - RNA, 17 nt, Shigella flexneri 2a str. 2457T
cuauuauuauuuuugug

SEQ ID NO: 3845988 - RNA, 21 nt, Shigella flexneri 2a str. 2457T
cuauuauuuuucauauggaua

SEQ ID NO: 3845989 - RNA, 22 nt, Shigella flexneri 2a str. 2457T
cuauucaccgcaucaauauuaa

SEQ ID NO: 3845990 - RNA, 16 nt, Shigella flexneri 2a str. 2457T
cuauucacgaaucuau

SEQ ID NO: 3845991 - RNA, 14 nt, Shigella flexneri 2a str. 2457T
cucagcgccacauc

SEQ ID NO: 3845992 - RNA, 24 nt, Shigella flexneri 2a str. 2457T
cucagcgccgcuuuccaggcugug

SEQ ID NO: 3845993 - RNA, 20 nt, Shigella flexneri 2a str. 2457T
cucagcgucagccugcucag

SEQ ID NO: 3845994 - RNA, 16 nt, Shigella flexneri 2a str. 2457T
cucagcucauuaaaaa

SEQ ID NO: 3845995 - RNA, 13 nt, Shigella flexneri 2a str. 2457T
cucagcuccucuu

SEQ ID NO: 3845996 - RNA, 16 nt, Shigella flexneri 2a str. 2457T
cucagcuccucuuuca

SEQ ID NO: 3845997 - RNA, 14 nt, Shigella flexneri 2a str. 2457T
cucaggaacuguuu

SEQ ID NO: 3845998 - RNA, 19 nt, Shigella flexneri 2a str. 2457T
cucaggccgauuucaugaa

SEQ ID NO: 3845999 - RNA, 23 nt, Shigella flexneri 2a str. 2457T
cucaggccgauuucaugaagcug

SEQ ID NO: 3846000 - RNA, 22 nt, Shigella flexneri 2a str. 2457T
cucaggcgcacgccgacaaaga

SEQ ID NO: 3846001 - RNA, 23 nt, Shigella flexneri 2a str. 2457T
cucaggcgcacgccgacaaagau

SEQ ID NO: 3846002 - RNA, 20 nt, Shigella flexneri 2a str. 2457T
cucaggugucuggcagcgug

SEQ ID NO: 3846003 - RNA, 17 nt, Shigella flexneri 2a str. 2457T
cucaguaaaguuaccuu

SEQ ID NO: 3846004 - RNA, 19 nt, Shigella flexneri 2a str. 2457T
cucaguaaaguuaccuucg

SEQ ID NO: 3846005 - RNA, 14 nt, Shigella flexneri 2a str. 2457T
cucaguacaggccg

SEQ ID NO: 3846006 - RNA, 16 nt, Shigella flexneri 2a str. 2457T
cucagugguugucgca

SEQ ID NO: 3846007 - RNA, 20 nt, Shigella flexneri 2a str. 2457T
cucaguuccgggaucaccag

SEQ ID NO: 3846008 - RNA, 16 nt, Shigella flexneri 2a str. 2457T
cucauaauacaggcua

SEQ ID NO: 3846009 - RNA, 18 nt, Shigella flexneri 2a str. 2457T
cucauacaccagcggcac

SEQ ID NO: 3846010 - RNA, 19 nt, Shigella flexneri 2a str. 2457T
cucauaccuuccacuuuca

SEQ ID NO: 3846011 - RNA, 14 nt, Shigella flexneri 2a str. 2457T
cucauagaccauug

SEQ ID NO: 3846012 - RNA, 22 nt, Shigella flexneri 2a str. 2457T
cucauagggugugacgacacca

SEQ ID NO: 3846013 - RNA, 19 nt, Shigella flexneri 2a str. 2457T
cucauauuccugcauugcu

SEQ ID NO: 3846014 - RNA, 20 nt, Shigella flexneri 2a str. 2457T
cucaucaacguuuuuuugcu

SEQ ID NO: 3846015 - RNA, 18 nt, Shigella flexneri 2a str. 2457T
cucaucaagcuguucuuc

SEQ ID NO: 3846016 - RNA, 9 nt, Shigella flexneri 2a str. 2457T
cucaucaau

SEQ ID NO: 3846017 - RNA, 23 nt, Shigella flexneri 2a str. 2457T
cucaucaauaccugguccuucau

SEQ ID NO: 3846018 - RNA, 13 nt, Shigella flexneri 2a str. 2457T
cucaucagcgucg

SEQ ID NO: 3846019 - RNA, 12 nt, Shigella flexneri 2a str. 2457T
cucaucaggccu

SEQ ID NO: 3846020 - RNA, 18 nt, Shigella flexneri 2a str. 2457T
cucaucaggccuacaaaa

SEQ ID NO: 3846021 - RNA, 12 nt, Shigella flexneri 2a str. 2457T
cucauccaucaa

SEQ ID NO: 3846022 - RNA, 21 nt, Shigella flexneri 2a str. 2457T
cucaucgacggcuacgcucau

SEQ ID NO: 3846023 - RNA, 14 nt, Shigella flexneri 2a str. 2457T
cucaucgccgccaa

SEQ ID NO: 3846024 - RNA, 14 nt, Shigella flexneri 2a str. 2457T
cucaucggcauaca

SEQ ID NO: 3846025 - RNA, 15 nt, Shigella flexneri 2a str. 2457T
cucaucggguaacgg

SEQ ID NO: 3846026 - RNA, 15 nt, Shigella flexneri 2a str. 2457T
cucaucuuccaccac

SEQ ID NO: 3846027 - RNA, 18 nt, Shigella flexneri 2a str. 2457T
cucaucuuccaccacguc

SEQ ID NO: 3846028 - RNA, 18 nt, Shigella flexneri 2a str. 2457T
cucaugggaccgcuacca

SEQ ID NO: 3846029 - RNA, 21 nt, Shigella flexneri 2a str. 2457T
cucauguagccgcuuuuucug

SEQ ID NO: 3846030 - RNA, 13 nt, Shigella flexneri 2a str. 2457T
cucauuauuugcc

SEQ ID NO: 3846031 - RNA, 12 nt, Shigella flexneri 2a str. 2457T
cucauugccagu

SEQ ID NO: 3846032 - RNA, 20 nt, Shigella flexneri 2a str. 2457T
cucauugguccaucuuuuug

SEQ ID NO: 3846033 - RNA, 13 nt, Shigella flexneri 2a str. 2457T
cucauuuaauauu

SEQ ID NO: 3846034 - RNA, 17 nt, Shigella flexneri 2a str. 2457T
cucauuucugccauucc

SEQ ID NO: 3846035 - RNA, 21 nt, Shigella flexneri 2a str. 2457T
cucauuuuccgggauugagau

SEQ ID NO: 3846036 - RNA, 20 nt, Shigella flexneri 2a str. 2457T
cuccacaagaaugccugcca

SEQ ID NO: 3846037 - RNA, 14 nt, Shigella flexneri 2a str. 2457T
cuccacaagcuccg

SEQ ID NO: 3846038 - RNA, 13 nt, Shigella flexneri 2a str. 2457T
cuccacaccggca

SEQ ID NO: 3846039 - RNA, 21 nt, Shigella flexneri 2a str. 2457T
cuccacaccggcaccauggcu

SEQ ID NO: 3846040 - RNA, 20 nt, Shigella flexneri 2a str. 2457T
cuccaccucauuaagaugca

SEQ ID NO: 3846041 - RNA, 16 nt, Shigella flexneri 2a str. 2457T
cuccacgauguucuga

SEQ ID NO: 3846042 - RNA, 18 nt, Shigella flexneri 2a str. 2457T
cuccacgauguucugagc

SEQ ID NO: 3846043 - RNA, 17 nt, Shigella flexneri 2a str. 2457T
cuccacgcccagcgcag

SEQ ID NO: 3846044 - RNA, 20 nt, Shigella flexneri 2a str. 2457T
cuccacgcccagcgcaggaa

SEQ ID NO: 3846045 - RNA, 21 nt, Shigella flexneri 2a str. 2457T
cuccacgcuauacagcagcca

SEQ ID NO: 3846046 - RNA, 12 nt, Shigella flexneri 2a str. 2457T
cuccacgcugca

SEQ ID NO: 3846047 - RNA, 15 nt, Shigella flexneri 2a str. 2457T
cuccacgcugcaucg

SEQ ID NO: 3846048 - RNA, 17 nt, Shigella flexneri 2a str. 2457T
cuccacgcugcaucgcc

SEQ ID NO: 3846049 - RNA, 20 nt, Shigella flexneri 2a str. 2457T
cuccacgcugcaucgccaau

SEQ ID NO: 3846050 - RNA, 18 nt, Shigella flexneri 2a str. 2457T
cuccacgcuuaacaaccc

SEQ ID NO: 3846051 - RNA, 21 nt, Shigella flexneri 2a str. 2457T
cuccacgcuuaacaacccguu

SEQ ID NO: 3846052 - RNA, 13 nt, Shigella flexneri 2a str. 2457T
cuccacugcucac

SEQ ID NO: 3846053 - RNA, 17 nt, Shigella flexneri 2a str. 2457T
cuccacuucaccgcgaa

SEQ ID NO: 3846054 - RNA, 17 nt, Shigella flexneri 2a str. 2457T
cuccacuuccugccagu

SEQ ID NO: 3846055 - RNA, 22 nt, Shigella flexneri 2a str. 2457T
cuccacuuuuacaugcgcgaca

SEQ ID NO: 3846056 - RNA, 19 nt, Shigella flexneri 2a str. 2457T
cuccagacaccgcugcuuc

SEQ ID NO: 3846057 - RNA, 15 nt, Shigella flexneri 2a str. 2457T
cuccagacgccagau

SEQ ID NO: 3846058 - RNA, 22 nt, Shigella flexneri 2a str. 2457T
cuccagauccauaagguccucc

SEQ ID NO: 3846059 - RNA, 15 nt, Shigella flexneri 2a str. 2457T
cuccagcaacucaau

SEQ ID NO: 3846060 - RNA, 13 nt, Shigella flexneri 2a str. 2457T
cuccagcagacca

SEQ ID NO: 3846061 - RNA, 14 nt, Shigella flexneri 2a str. 2457T
cuccagcagaccag

SEQ ID NO: 3846062 - RNA, 15 nt, Shigella flexneri 2a str. 2457T
cuccagcagugccgc

SEQ ID NO: 3846063 - RNA, 13 nt, Shigella flexneri 2a str. 2457T
cuccagccagagc

SEQ ID NO: 3846064 - RNA, 11 nt, Shigella flexneri 2a str. 2457T
cuccagcgcca

SEQ ID NO: 3846065 - RNA, 17 nt, Shigella flexneri 2a str. 2457T
cuccagcgccagcgcgc

SEQ ID NO: 3846066 - RNA, 19 nt, Shigella flexneri 2a str. 2457T
cuccagcgggcgaaucaac

SEQ ID NO: 3846067 - RNA, 23 nt, Shigella flexneri 2a str. 2457T
cuccagcgggcgaaucaacucca

SEQ ID NO: 3846068 - RNA, 18 nt, Shigella flexneri 2a str. 2457T
cuccaggagcguauucag

SEQ ID NO: 3846069 - RNA, 22 nt, Shigella flexneri 2a str. 2457T
cuccaggagcguauucagcaau

SEQ ID NO: 3846070 - RNA, 23 nt, Shigella flexneri 2a str. 2457T
cuccaggcguuuugcagauucag

SEQ ID NO: 3846071 - RNA, 16 nt, Shigella flexneri 2a str. 2457T
cuccagguccuccugu

SEQ ID NO: 3846072 - RNA, 22 nt, Shigella flexneri 2a str. 2457T
cuccagguccuccuguaccuuc

SEQ ID NO: 3846073 - RNA, 16 nt, Shigella flexneri 2a str. 2457T
cuccagguuaacggag

SEQ ID NO: 3846074 - RNA, 16 nt, Shigella flexneri 2a str. 2457T
cuccaguaccugcaaa

SEQ ID NO: 3846075 - RNA, 15 nt, Shigella flexneri 2a str. 2457T
cuccagucgcgugug

SEQ ID NO: 3846076 - RNA, 15 nt, Shigella flexneri 2a str. 2457T
cuccagugcauccag

SEQ ID NO: 3846077 - RNA, 19 nt, Shigella flexneri 2a str. 2457T
cuccaguuuguucagcugc

SEQ ID NO: 3846078 - RNA, 21 nt, Shigella flexneri 2a str. 2457T
cuccauacaucuucaucaucc

SEQ ID NO: 3846079 - RNA, 18 nt, Shigella flexneri 2a str. 2457T
cuccauccagcaacaaca

SEQ ID NO: 3846080 - RNA, 19 nt, Shigella flexneri 2a str. 2457T
cuccauccagcaacaacag

SEQ ID NO: 3846081 - RNA, 22 nt, Shigella flexneri 2a str. 2457T
cuccaugagaagcugaaaucau

SEQ ID NO: 3846082 - RNA, 20 nt, Shigella flexneri 2a str. 2457T
cuccaugggagaacgaugcu

SEQ ID NO: 3846083 - RNA, 18 nt, Shigella flexneri 2a str. 2457T
cuccauguccagcuugau

SEQ ID NO: 3846084 - RNA, 16 nt, Shigella flexneri 2a str. 2457T
cuccauuccaucgccu

SEQ ID NO: 3846085 - RNA, 15 nt, Shigella flexneri 2a str. 2457T
cuccauugaauuuua

SEQ ID NO: 3846086 - RNA, 19 nt, Shigella flexneri 2a str. 2457T
cuccauugcccgcccgaca

SEQ ID NO: 3846087 - RNA, 24 nt, Shigella flexneri 2a str. 2457T
cuccauuuuuuugcauuacugcua

SEQ ID NO: 3846088 - RNA, 22 nt, Shigella flexneri 2a str. 2457T
cucccaguugugggugcccaca

SEQ ID NO: 3846089 - RNA, 18 nt, Shigella flexneri 2a str. 2457T
cuccccagaauccaggaa

SEQ ID NO: 3846090 - RNA, 16 nt, Shigella flexneri 2a str. 2457T
cucccccagcaucuau

SEQ ID NO: 3846091 - RNA, 23 nt, Shigella flexneri 2a str. 2457T
cuccccgcauuuacucucaucaa

SEQ ID NO: 3846092 - RNA, 17 nt, Shigella flexneri 2a str. 2457T
cuccccgccguugcucu

SEQ ID NO: 3846093 - RNA, 14 nt, Shigella flexneri 2a str. 2457T
cuccccugcaaucc

SEQ ID NO: 3846094 - RNA, 18 nt, Shigella flexneri 2a str. 2457T
cuccccuuucuuauuuuu

SEQ ID NO: 3846095 - RNA, 19 nt, Shigella flexneri 2a str. 2457T
cuccccuuucuuauuuuuc

SEQ ID NO: 3846096 - RNA, 23 nt, Shigella flexneri 2a str. 2457T
cuccccuuucuuauuuuucugca

SEQ ID NO: 3846097 - RNA, 19 nt, Shigella flexneri 2a str. 2457T
cucccgaaugaccgccccu

SEQ ID NO: 3846098 - RNA, 20 nt, Shigella flexneri 2a str. 2457T
cucccgaaugaccgccccug

SEQ ID NO: 3846099 - RNA, 16 nt, Shigella flexneri 2a str. 2457T
cucccgcagccacucc

SEQ ID NO: 3846100 - RNA, 19 nt, Shigella flexneri 2a str. 2457T
cucccggcgguaaaucgcc

SEQ ID NO: 3846101 - RNA, 14 nt, Shigella flexneri 2a str. 2457T
cucccgguagguga

SEQ ID NO: 3846102 - RNA, 15 nt, Shigella flexneri 2a str. 2457T
cucccgucgcccaca

SEQ ID NO: 3846103 - RNA, 15 nt, Shigella flexneri 2a str. 2457T
cucccgugccagagc

SEQ ID NO: 3846104 - RNA, 22 nt, Shigella flexneri 2a str. 2457T
cucccguuccugguuuuccaga

SEQ ID NO: 3846105 - RNA, 23 nt, Shigella flexneri 2a str. 2457T
cucccucgucggugguggucccu

SEQ ID NO: 3846106 - RNA, 14 nt, Shigella flexneri 2a str. 2457T
cucccugccuccau

SEQ ID NO: 3846107 - RNA, 19 nt, Shigella flexneri 2a str. 2457T
cucccuggcccaucgccag

SEQ ID NO: 3846108 - RNA, 16 nt, Shigella flexneri 2a str. 2457T
cucccuguaucccagu

SEQ ID NO: 3846109 - RNA, 15 nt, Shigella flexneri 2a str. 2457T
cuccgaccagaagcg

SEQ ID NO: 3846110 - RNA, 14 nt, Shigella flexneri 2a str. 2457T
cuccgcaauaugcg

SEQ ID NO: 3846111 - RNA, 12 nt, Shigella flexneri 2a str. 2457T
cuccgccagcaa

SEQ ID NO: 3846112 - RNA, 14 nt, Shigella flexneri 2a str. 2457T
cuccgccccggcaa

SEQ ID NO: 3846113 - RNA, 23 nt, Shigella flexneri 2a str. 2457T
cuccgccccggcaauaaaacagg

SEQ ID NO: 3846114 - RNA, 16 nt, Shigella flexneri 2a str. 2457T
cuccgccgcaucuucc

SEQ ID NO: 3846115 - RNA, 20 nt, Shigella flexneri 2a str. 2457T
cuccgccggaaucaacggca

SEQ ID NO: 3846116 - RNA, 13 nt, Shigella flexneri 2a str. 2457T
cuccgcgccgccg

SEQ ID NO: 3846117 - RNA, 19 nt, Shigella flexneri 2a str. 2457T
cuccgcgccgcgguacagc

SEQ ID NO: 3846118 - RNA, 21 nt, Shigella flexneri 2a str. 2457T
cuccgcguucaauacgcaguu

SEQ ID NO: 3846119 - RNA, 15 nt, Shigella flexneri 2a str. 2457T
cuccgcugagacgcg

SEQ ID NO: 3846120 - RNA, 21 nt, Shigella flexneri 2a str. 2457T
cuccgcuucgguaagcaaagc

SEQ ID NO: 3846121 - RNA, 14 nt, Shigella flexneri 2a str. 2457T
cuccggacuccgca

SEQ ID NO: 3846122 - RNA, 15 nt, Shigella flexneri 2a str. 2457T
cuccggcagcugcuc

SEQ ID NO: 3846123 - RNA, 16 nt, Shigella flexneri 2a str. 2457T
cuccggcaggaaaugg

SEQ ID NO: 3846124 - RNA, 13 nt, Shigella flexneri 2a str. 2457T
cuccggccagagc

SEQ ID NO: 3846125 - RNA, 17 nt, Shigella flexneri 2a str. 2457T
cuccggccugcacugca

SEQ ID NO: 3846126 - RNA, 23 nt, Shigella flexneri 2a str. 2457T
cuccggccuuuuuuaucucuuac

SEQ ID NO: 3846127 - RNA, 17 nt, Shigella flexneri 2a str. 2457T
cuccggcgcauccauga

SEQ ID NO: 3846128 - RNA, 24 nt, Shigella flexneri 2a str. 2457T
cuccggcgcguugaugccgugcag

SEQ ID NO: 3846129 - RNA, 14 nt, Shigella flexneri 2a str. 2457T
cuccggcugggcgu

SEQ ID NO: 3846130 - RNA, 21 nt, Shigella flexneri 2a str. 2457T
cuccggcuuuuuacuucucag

SEQ ID NO: 3846131 - RNA, 22 nt, Shigella flexneri 2a str. 2457T
cuccgggaaaacgcuggcagca

SEQ ID NO: 3846132 - RNA, 14 nt, Shigella flexneri 2a str. 2457T
cuccguaaaccccg

SEQ ID NO: 3846133 - RNA, 13 nt, Shigella flexneri 2a str. 2457T
cuccguuccccuc

SEQ ID NO: 3846134 - RNA, 18 nt, Shigella flexneri 2a str. 2457T
cuccguuucacuucucau

SEQ ID NO: 3846135 - RNA, 20 nt, Shigella flexneri 2a str. 2457T
cuccuauuaucggcaccauu

SEQ ID NO: 3846136 - RNA, 20 nt, Shigella flexneri 2a str. 2457T
cuccuauuguugauaaggaa

SEQ ID NO: 3846137 - RNA, 16 nt, Shigella flexneri 2a str. 2457T
cuccucaacaaucguc

SEQ ID NO: 3846138 - RNA, 17 nt, Shigella flexneri 2a str. 2457T
cuccucaacaaucguca

SEQ ID NO: 3846139 - RNA, 21 nt, Shigella flexneri 2a str. 2457T
cuccucaguuucgacgccuuc

SEQ ID NO: 3846140 - RNA, 17 nt, Shigella flexneri 2a str. 2457T
cuccucgaguccuucca

SEQ ID NO: 3846141 - RNA, 18 nt, Shigella flexneri 2a str. 2457T
cuccucgaguccuuccag

SEQ ID NO: 3846142 - RNA, 20 nt, Shigella flexneri 2a str. 2457T
cuccucgaguccuuccaggu

SEQ ID NO: 3846143 - RNA, 18 nt, Shigella flexneri 2a str. 2457T
cuccucugacuggacucg

SEQ ID NO: 3846144 - RNA, 19 nt, Shigella flexneri 2a str. 2457T
cuccucuucacguuuuucg

SEQ ID NO: 3846145 - RNA, 18 nt, Shigella flexneri 2a str. 2457T
cuccucuuucaucucccg

SEQ ID NO: 3846146 - RNA, 22 nt, Shigella flexneri 2a str. 2457T
cuccugacgaucauauuguucc

SEQ ID NO: 3846147 - RNA, 19 nt, Shigella flexneri 2a str. 2457T
cuccugcaacagguugcgc

SEQ ID NO: 3846148 - RNA, 20 nt, Shigella flexneri 2a str. 2457T
cuccugccaauacaaaauuu

SEQ ID NO: 3846149 - RNA, 14 nt, Shigella flexneri 2a str. 2457T
cuccugcggcugca

SEQ ID NO: 3846150 - RNA, 19 nt, Shigella flexneri 2a str. 2457T
cuccugcuaugcuuaagaa

SEQ ID NO: 3846151 - RNA, 22 nt, Shigella flexneri 2a str. 2457T
cuccugcuaugcuuaagaaauu

SEQ ID NO: 3846152 - RNA, 15 nt, Shigella flexneri 2a str. 2457T
cuccuggaucacaau

SEQ ID NO: 3846153 - RNA, 22 nt, Shigella flexneri 2a str. 2457T
cuccuggcgguuaauaaugauu

SEQ ID NO: 3846154 - RNA, 23 nt, Shigella flexneri 2a str. 2457T
cuccuggcgguuaauaaugauuu

SEQ ID NO: 3846155 - RNA, 19 nt, Shigella flexneri 2a str. 2457T
cuccugucaguauaacuac

SEQ ID NO: 3846156 - RNA, 16 nt, Shigella flexneri 2a str. 2457T
cuccugucuucccugc

SEQ ID NO: 3846157 - RNA, 18 nt, Shigella flexneri 2a str. 2457T
cuccugucuucccugcug

SEQ ID NO: 3846158 - RNA, 14 nt, Shigella flexneri 2a str. 2457T
cuccuguucugugc

SEQ ID NO: 3846159 - RNA, 14 nt, Shigella flexneri 2a str. 2457T
cuccuuccugaaau

SEQ ID NO: 3846160 - RNA, 14 nt, Shigella flexneri 2a str. 2457T
cuccuuucuuucug

SEQ ID NO: 3846161 - RNA, 17 nt, Shigella flexneri 2a str. 2457T
cucgaaaaccacuccug

SEQ ID NO: 3846162 - RNA, 15 nt, Shigella flexneri 2a str. 2457T
cucgaacauccccac

SEQ ID NO: 3846163 - RNA, 17 nt, Shigella flexneri 2a str. 2457T
cucgacaccaaacagac

SEQ ID NO: 3846164 - RNA, 17 nt, Shigella flexneri 2a str. 2457T
cucgacgcccagcuuca

SEQ ID NO: 3846165 - RNA, 20 nt, Shigella flexneri 2a str. 2457T
cucgacgcccagcuucauca

SEQ ID NO: 3846166 - RNA, 15 nt, Shigella flexneri 2a str. 2457T
cucgacuggagccgc

SEQ ID NO: 3846167 - RNA, 23 nt, Shigella flexneri 2a str. 2457T
cucgacuguggcgcgaccaaugu

SEQ ID NO: 3846168 - RNA, 22 nt, Shigella flexneri 2a str. 2457T
cucgagaacacgguaaugacuc

SEQ ID NO: 3846169 - RNA, 17 nt, Shigella flexneri 2a str. 2457T
cucgagagagaaaauaa

SEQ ID NO: 3846170 - RNA, 13 nt, Shigella flexneri 2a str. 2457T
cucgaguccuucc

SEQ ID NO: 3846171 - RNA, 18 nt, Shigella flexneri 2a str. 2457T
cucgaguccuuccagguc

SEQ ID NO: 3846172 - RNA, 22 nt, Shigella flexneri 2a str. 2457T
cucgauaccagauuaauuauug

SEQ ID NO: 3846173 - RNA, 13 nt, Shigella flexneri 2a str. 2457T
cucgaugccgccc

SEQ ID NO: 3846174 - RNA, 24 nt, Shigella flexneri 2a str. 2457T
cucgcaagccgaauaacggcucaa

SEQ ID NO: 3846175 - RNA, 23 nt, Shigella flexneri 2a str. 2457T
cucgcaggcugagaaaugccaga

SEQ ID NO: 3846176 - RNA, 18 nt, Shigella flexneri 2a str. 2457T
cucgcauaucuucaacgc

SEQ ID NO: 3846177 - RNA, 14 nt, Shigella flexneri 2a str. 2457T
cucgccaacaagcc

SEQ ID NO: 3846178 - RNA, 18 nt, Shigella flexneri 2a str. 2457T
cucgccacgucacucuuu

SEQ ID NO: 3846179 - RNA, 18 nt, Shigella flexneri 2a str. 2457T
cucgccagagagcggagc

SEQ ID NO: 3846180 - RNA, 19 nt, Shigella flexneri 2a str. 2457T
cucgccagcgauucccguu

SEQ ID NO: 3846181 - RNA, 19 nt, Shigella flexneri 2a str. 2457T
cucgccaucaaauagcccc

SEQ ID NO: 3846182 - RNA, 17 nt, Shigella flexneri 2a str. 2457T
cucgcccagaucaccaa

SEQ ID NO: 3846183 - RNA, 21 nt, Shigella flexneri 2a str. 2457T
cucgcccauuuuucaugaucu

SEQ ID NO: 3846184 - RNA, 13 nt, Shigella flexneri 2a str. 2457T
cucgcccccuugg

SEQ ID NO: 3846185 - RNA, 21 nt, Shigella flexneri 2a str. 2457T
cugacagggugagcagggcac

SEQ ID NO: 3846186 - RNA, 18 nt, Shigella flexneri 2a str. 2457T
cugacauuuuuacuccuu

SEQ ID NO: 3846187 - RNA, 17 nt, Shigella flexneri 2a str. 2457T
cugaccaaauacacgca

SEQ ID NO: 3846188 - RNA, 13 nt, Shigella flexneri 2a str. 2457T
cugaccaccacca

SEQ ID NO: 3846189 - RNA, 17 nt, Shigella flexneri 2a str. 2457T
cugaccacggccacagc

SEQ ID NO: 3846190 - RNA, 15 nt, Shigella flexneri 2a str. 2457T
cugaccacuucggua

SEQ ID NO: 3846191 - RNA, 23 nt, Shigella flexneri 2a str. 2457T
cugaccacuucgguacccagacg

SEQ ID NO: 3846192 - RNA, 16 nt, Shigella flexneri 2a str. 2457T
cugaccaucagcagcg

SEQ ID NO: 3846193 - RNA, 14 nt, Shigella flexneri 2a str. 2457T
cugacccagaccga

SEQ ID NO: 3846194 - RNA, 13 nt, Shigella flexneri 2a str. 2457T
cugacccagcacc

SEQ ID NO: 3846195 - RNA, 14 nt, Shigella flexneri 2a str. 2457T
cugaccggccagca

SEQ ID NO: 3846196 - RNA, 19 nt, Shigella flexneri 2a str. 2457T
cugaccucuucuaccacau

SEQ ID NO: 3846197 - RNA, 20 nt, Shigella flexneri 2a str. 2457T
cugaccugaauuaaugccuc

SEQ ID NO: 3846198 - RNA, 13 nt, Shigella flexneri 2a str. 2457T
cugaccuucuuca

SEQ ID NO: 3846199 - RNA, 14 nt, Shigella flexneri 2a str. 2457T
cugaccuucuucag

SEQ ID NO: 3846200 - RNA, 17 nt, Shigella flexneri 2a str. 2457T
cugaccuugcuuugcaa

SEQ ID NO: 3846201 - RNA, 13 nt, Shigella flexneri 2a str. 2457T
cugaccuuuuuuc

SEQ ID NO: 3846202 - RNA, 15 nt, Shigella flexneri 2a str. 2457T
cugaccuuuuuucag

SEQ ID NO: 3846203 - RNA, 13 nt, Shigella flexneri 2a str. 2457T
cugacgacauaau

SEQ ID NO: 3846204 - RNA, 12 nt, Shigella flexneri 2a str. 2457T
cugacgccaugc

SEQ ID NO: 3846205 - RNA, 16 nt, Shigella flexneri 2a str. 2457T
cugacgccugcgggca

SEQ ID NO: 3846206 - RNA, 16 nt, Shigella flexneri 2a str. 2457T
cugacgcgucuuaucu

SEQ ID NO: 3846207 - RNA, 20 nt, Shigella flexneri 2a str. 2457T
cugacgcgucuuaucuggcc

SEQ ID NO: 3846208 - RNA, 22 nt, Shigella flexneri 2a str. 2457T
cugacgcgucuuaucuggccua

SEQ ID NO: 3846209 - RNA, 21 nt, Shigella flexneri 2a str. 2457T
cugacgcucucuacgcccugu

SEQ ID NO: 3846210 - RNA, 15 nt, Shigella flexneri 2a str. 2457T
cugacggauagccuu

SEQ ID NO: 3846211 - RNA, 13 nt, Shigella flexneri 2a str. 2457T
cugacggccuucg

SEQ ID NO: 3846212 - RNA, 21 nt, Shigella flexneri 2a str. 2457T
cugacggccuucggugcgaca

SEQ ID NO: 3846213 - RNA, 14 nt, Shigella flexneri 2a str. 2457T
cugacggucuggug

SEQ ID NO: 3846214 - RNA, 19 nt, Shigella flexneri 2a str. 2457T
cugacggugauacagcaaa

SEQ ID NO: 3846215 - RNA, 14 nt, Shigella flexneri 2a str. 2457T
cugacguaacgacc

SEQ ID NO: 3846216 - RNA, 22 nt, Shigella flexneri 2a str. 2457T
cugacguaacgaccaccaccgc

SEQ ID NO: 3846217 - RNA, 17 nt, Shigella flexneri 2a str. 2457T
cugacgucuggccucuc

SEQ ID NO: 3846218 - RNA, 14 nt, Shigella flexneri 2a str. 2457T
cugacgugauuuag

SEQ ID NO: 3846219 - RNA, 23 nt, Shigella flexneri 2a str. 2457T
cugacguuaagaaaacggaagcu

SEQ ID NO: 3846220 - RNA, 22 nt, Shigella flexneri 2a str. 2457T
cugacguuauugaucgccagcg

SEQ ID NO: 3846221 - RNA, 19 nt, Shigella flexneri 2a str. 2457T
cugacguuuucucguccag

SEQ ID NO: 3846222 - RNA, 20 nt, Shigella flexneri 2a str. 2457T
cugacuagaugugcaguucc

SEQ ID NO: 3846223 - RNA, 22 nt, Shigella flexneri 2a str. 2457T
cugacuagaugugcaguuccug

SEQ ID NO: 3846224 - RNA, 20 nt, Shigella flexneri 2a str. 2457T
cugacuaugguguaacgauu

SEQ ID NO: 3846225 - RNA, 22 nt, Shigella flexneri 2a str. 2457T
cugacugacuucaacaggaaaa

SEQ ID NO: 3846226 - RNA, 14 nt, Shigella flexneri 2a str. 2457T
cugacugcgccacu

SEQ ID NO: 3846227 - RNA, 17 nt, Shigella flexneri 2a str. 2457T
cugacugcgccacuucc

SEQ ID NO: 3846228 - RNA, 15 nt, Shigella flexneri 2a str. 2457T
cugacugcgggcgaa

SEQ ID NO: 3846229 - RNA, 16 nt, Shigella flexneri 2a str. 2457T
cugacugucgcagcca

SEQ ID NO: 3846230 - RNA, 17 nt, Shigella flexneri 2a str. 2457T
cugacuguuccagcacg

SEQ ID NO: 3846231 - RNA, 13 nt, Shigella flexneri 2a str. 2457T
cugacuugcccgu

SEQ ID NO: 3846232 - RNA, 14 nt, Shigella flexneri 2a str. 2457T
cugacuuugcccca

SEQ ID NO: 3846233 - RNA, 15 nt, Shigella flexneri 2a str. 2457T
cugagaaaaagcgaa

SEQ ID NO: 3846234 - RNA, 19 nt, Shigella flexneri 2a str. 2457T
cugagaaacucaguugauu

SEQ ID NO: 3846235 - RNA, 11 nt, Shigella flexneri 2a str. 2457T
cugagaacgca

SEQ ID NO: 3846236 - RNA, 15 nt, Shigella flexneri 2a str. 2457T
cugagaagcuggaag

SEQ ID NO: 3846237 - RNA, 17 nt, Shigella flexneri 2a str. 2457T
cugagaauuccggcaga

SEQ ID NO: 3846238 - RNA, 14 nt, Shigella flexneri 2a str. 2457T
cugagacgcgcuug

SEQ ID NO: 3846239 - RNA, 23 nt, Shigella flexneri 2a str. 2457T
cugagacgcgcuugcauuacuac

SEQ ID NO: 3846240 - RNA, 18 nt, Shigella flexneri 2a str. 2457T
cugagaggaaaaaaauua

SEQ ID NO: 3846241 - RNA, 17 nt, Shigella flexneri 2a str. 2457T
cugagaucaaacucuuu

SEQ ID NO: 3846242 - RNA, 19 nt, Shigella flexneri 2a str. 2457T
cugagaucaaugcgccaac

SEQ ID NO: 3846243 - RNA, 13 nt, Shigella flexneri 2a str. 2457T
cugagcaaacagu

SEQ ID NO: 3846244 - RNA, 14 nt, Shigella flexneri 2a str. 2457T
cugagcaucacaua

SEQ ID NO: 3846245 - RNA, 22 nt, Shigella flexneri 2a str. 2457T
cugagcaucacauaaucgaaaa

SEQ ID NO: 3846246 - RNA, 18 nt, Shigella flexneri 2a str. 2457T
cugagcaugaugccugau

SEQ ID NO: 3846247 - RNA, 21 nt, Shigella flexneri 2a str. 2457T
cugagcaugaugccugaugcg

SEQ ID NO: 3846248 - RNA, 17 nt, Shigella flexneri 2a str. 2457T
cugagccaguuuuucuu

SEQ ID NO: 3846249 - RNA, 18 nt, Shigella flexneri 2a str. 2457T
cugagccaguuuuucuuu

SEQ ID NO: 3846250 - RNA, 13 nt, Shigella flexneri 2a str. 2457T
cugagccugccau

SEQ ID NO: 3846251 - RNA, 18 nt, Shigella flexneri 2a str. 2457T
cugagccugccauuggca

SEQ ID NO: 3846252 - RNA, 23 nt, Shigella flexneri 2a str. 2457T
cugagcgaagauuucguuuucua

SEQ ID NO: 3846253 - RNA, 17 nt, Shigella flexneri 2a str. 2457T
cugagcggcgggcuuua

SEQ ID NO: 3846254 - RNA, 19 nt, Shigella flexneri 2a str. 2457T
cugagcggcgggcuuuaau

SEQ ID NO: 3846255 - RNA, 18 nt, Shigella flexneri 2a str. 2457T
cugagcgguuaacacggc

SEQ ID NO: 3846256 - RNA, 20 nt, Shigella flexneri 2a str. 2457T
cugagcgugccccugaauaa

SEQ ID NO: 3846257 - RNA, 22 nt, Shigella flexneri 2a str. 2457T
cugagcuauaccaugccguucu

SEQ ID NO: 3846258 - RNA, 18 nt, Shigella flexneri 2a str. 2457T
cugagcuccugcauugac

SEQ ID NO: 3846259 - RNA, 18 nt, Shigella flexneri 2a str. 2457T
cugagcuggcagaccugc

SEQ ID NO: 3846260 - RNA, 22 nt, Shigella flexneri 2a str. 2457T
cugagcuucuucaaaaaaguca

SEQ ID NO: 3846261 - RNA, 22 nt, Shigella flexneri 2a str. 2457T
cugagcuugauccuacacauac

SEQ ID NO: 3846262 - RNA, 23 nt, Shigella flexneri 2a str. 2457T
cugaggccggaugucgcugcuag

SEQ ID NO: 3846263 - RNA, 13 nt, Shigella flexneri 2a str. 2457T
cugaggcugucau

SEQ ID NO: 3846264 - RNA, 23 nt, Shigella flexneri 2a str. 2457T
cugagguuuauaacggugcugca

SEQ ID NO: 3846265 - RNA, 15 nt, Shigella flexneri 2a str. 2457T
cugaguaauaacuuc

SEQ ID NO: 3846266 - RNA, 21 nt, Shigella flexneri 2a str. 2457T
cugaguaauuaauacgccaga

SEQ ID NO: 3846267 - RNA, 18 nt, Shigella flexneri 2a str. 2457T
cugagucaucaacucagu

SEQ ID NO: 3846268 - RNA, 22 nt, Shigella flexneri 2a str. 2457T
cugagucgggugcagcgacagg

SEQ ID NO: 3846269 - RNA, 23 nt, Shigella flexneri 2a str. 2457T
cugagugauacguaaaccacuga

SEQ ID NO: 3846270 - RNA, 16 nt, Shigella flexneri 2a str. 2457T
cugaguugcagcaacu

SEQ ID NO: 3846271 - RNA, 17 nt, Shigella flexneri 2a str. 2457T
cugaguugccaucauca

SEQ ID NO: 3846272 - RNA, 22 nt, Shigella flexneri 2a str. 2457T
cugaguugccaucaucaccaga

SEQ ID NO: 3846273 - RNA, 18 nt, Shigella flexneri 2a str. 2457T
cugaguuuaacggacacu

SEQ ID NO: 3846274 - RNA, 16 nt, Shigella flexneri 2a str. 2457T
cugaguuucagaccaa

SEQ ID NO: 3846275 - RNA, 17 nt, Shigella flexneri 2a str. 2457T
cugaguuuuuuaaguga

SEQ ID NO: 3846276 - RNA, 14 nt, Shigella flexneri 2a str. 2457T
cugauaaaaaaccc

SEQ ID NO: 3846277 - RNA, 23 nt, Shigella flexneri 2a str. 2457T
cugauaaaaaacccgcuuuuuga

SEQ ID NO: 3846278 - RNA, 17 nt, Shigella flexneri 2a str. 2457T
cugauaaaaaccauuca

SEQ ID NO: 3846279 - RNA, 22 nt, Shigella flexneri 2a str. 2457T
cugauaaacaagcguacaaaau

SEQ ID NO: 3846280 - RNA, 18 nt, Shigella flexneri 2a str. 2457T
cugauaaaucaccugcgc

SEQ ID NO: 3846281 - RNA, 18 nt, Shigella flexneri 2a str. 2457T
cugauaacacagaggcag

SEQ ID NO: 3846282 - RNA, 19 nt, Shigella flexneri 2a str. 2457T
cugcacaaauagccagcag

SEQ ID NO: 3846283 - RNA, 19 nt, Shigella flexneri 2a str. 2457T
cugcacaccaaccgcuucc

SEQ ID NO: 3846284 - RNA, 13 nt, Shigella flexneri 2a str. 2457T
cugcaccauugcu

SEQ ID NO: 3846285 - RNA, 19 nt, Shigella flexneri 2a str. 2457T
cugcaccauugcugccgcc

SEQ ID NO: 3846286 - RNA, 13 nt, Shigella flexneri 2a str. 2457T
cugcacgaaacca

SEQ ID NO: 3846287 - RNA, 23 nt, Shigella flexneri 2a str. 2457T
cugcacgaccggguuuucaauga

SEQ ID NO: 3846288 - RNA, 13 nt, Shigella flexneri 2a str. 2457T
cugcacgcccuga

SEQ ID NO: 3846289 - RNA, 19 nt, Shigella flexneri 2a str. 2457T
cugcacggcuucccacguc

SEQ ID NO: 3846290 - RNA, 20 nt, Shigella flexneri 2a str. 2457T
cugcacggucacaucgcuga

SEQ ID NO: 3846291 - RNA, 19 nt, Shigella flexneri 2a str. 2457T
cugcacggugugcggcagg

SEQ ID NO: 3846292 - RNA, 21 nt, Shigella flexneri 2a str. 2457T
cugcacgguuuuuccagcucu

SEQ ID NO: 3846293 - RNA, 19 nt, Shigella flexneri 2a str. 2457T
cugcacguuggcgcauaac

SEQ ID NO: 3846294 - RNA, 16 nt, Shigella flexneri 2a str. 2457T
cugcacuggcuuccag

SEQ ID NO: 3846295 - RNA, 23 nt, Shigella flexneri 2a str. 2457T
cugcacuuugugucagcgccaga

SEQ ID NO: 3846296 - RNA, 18 nt, Shigella flexneri 2a str. 2457T
cugcagauuaugccugau

SEQ ID NO: 3846297 - RNA, 14 nt, Shigella flexneri 2a str. 2457T
cugcagcaucaccg

SEQ ID NO: 3846298 - RNA, 15 nt, Shigella flexneri 2a str. 2457T
cugcagcaucaccgg

SEQ ID NO: 3846299 - RNA, 16 nt, Shigella flexneri 2a str. 2457T
cugcagcccgaacggu

SEQ ID NO: 3846300 - RNA, 23 nt, Shigella flexneri 2a str. 2457T
cugcagcgcggcgagagcuuucg

SEQ ID NO: 3846301 - RNA, 21 nt, Shigella flexneri 2a str. 2457T
cugcagcggucacauguucca

SEQ ID NO: 3846302 - RNA, 17 nt, Shigella flexneri 2a str. 2457T
cugcagcgucacucgcu

SEQ ID NO: 3846303 - RNA, 22 nt, Shigella flexneri 2a str. 2457T
cugcagcuccaguuucuuuugc

SEQ ID NO: 3846304 - RNA, 15 nt, Shigella flexneri 2a str. 2457T
cugcagguauugcuu

SEQ ID NO: 3846305 - RNA, 16 nt, Shigella flexneri 2a str. 2457T
cugcagucaccugccc

SEQ ID NO: 3846306 - RNA, 21 nt, Shigella flexneri 2a str. 2457T
cugcauaaacgccgucaucac

SEQ ID NO: 3846307 - RNA, 22 nt, Shigella flexneri 2a str. 2457T
cugcauaaacgccgucaucaca

SEQ ID NO: 3846308 - RNA, 18 nt, Shigella flexneri 2a str. 2457T
cugcauaaucgcaacgcc

SEQ ID NO: 3846309 - RNA, 18 nt, Shigella flexneri 2a str. 2457T
cugcauaaugccgguggu

SEQ ID NO: 3846310 - RNA, 13 nt, Shigella flexneri 2a str. 2457T
cugcauacaaaua

SEQ ID NO: 3846311 - RNA, 22 nt, Shigella flexneri 2a str. 2457T
cugcauacguuucaccagcacu

SEQ ID NO: 3846312 - RNA, 16 nt, Shigella flexneri 2a str. 2457T
cugcaucaaccaacac

SEQ ID NO: 3846313 - RNA, 13 nt, Shigella flexneri 2a str. 2457T
cugcaucaccauc

SEQ ID NO: 3846314 - RNA, 19 nt, Shigella flexneri 2a str. 2457T
cugcauccgccauccacca

SEQ ID NO: 3846315 - RNA, 16 nt, Shigella flexneri 2a str. 2457T
cugcauccgcgcuuuc

SEQ ID NO: 3846316 - RNA, 14 nt, Shigella flexneri 2a str. 2457T
cugcaucuccggcg

SEQ ID NO: 3846317 - RNA, 22 nt, Shigella flexneri 2a str. 2457T
cugcaucuuccguggaacaaaa

SEQ ID NO: 3846318 - RNA, 19 nt, Shigella flexneri 2a str. 2457T
cugcaugacggcugaaaug

SEQ ID NO: 3846319 - RNA, 19 nt, Shigella flexneri 2a str. 2457T
cugcauuauccagcgaacc

SEQ ID NO: 3846320 - RNA, 13 nt, Shigella flexneri 2a str. 2457T
cugcauucaccag

SEQ ID NO: 3846321 - RNA, 14 nt, Shigella flexneri 2a str. 2457T
cugcauucaccagu

SEQ ID NO: 3846322 - RNA, 23 nt, Shigella flexneri 2a str. 2457T
cugcauucccaucgcaucgucac

SEQ ID NO: 3846323 - RNA, 14 nt, Shigella flexneri 2a str. 2457T
cugcauuugaaacg

SEQ ID NO: 3846324 - RNA, 20 nt, Shigella flexneri 2a str. 2457T
cugccaaacgcucccugcca

SEQ ID NO: 3846325 - RNA, 23 nt, Shigella flexneri 2a str. 2457T
cugccacgguaugacccagcgcg

SEQ ID NO: 3846326 - RNA, 14 nt, Shigella flexneri 2a str. 2457T
cugccacuucugcu

SEQ ID NO: 3846327 - RNA, 23 nt, Shigella flexneri 2a str. 2457T
cugccacuuucucacucaccgca

SEQ ID NO: 3846328 - RNA, 19 nt, Shigella flexneri 2a str. 2457T
cugccagaaaucggccuuc

SEQ ID NO: 3846329 - RNA, 21 nt, Shigella flexneri 2a str. 2457T
cugccagaaaucggccuucca

SEQ ID NO: 3846330 - RNA, 13 nt, Shigella flexneri 2a str. 2457T
cugccagaaccgc

SEQ ID NO: 3846331 - RNA, 15 nt, Shigella flexneri 2a str. 2457T
cugccagaaccgcuu

SEQ ID NO: 3846332 - RNA, 14 nt, Shigella flexneri 2a str. 2457T
cugccagaaggauu

SEQ ID NO: 3846333 - RNA, 23 nt, Shigella flexneri 2a str. 2457T
cugccagaaggauugaucaauuc

SEQ ID NO: 3846334 - RNA, 20 nt, Shigella flexneri 2a str. 2457T
cugccagacccauaaucaga

SEQ ID NO: 3846335 - RNA, 17 nt, Shigella flexneri 2a str. 2457T
cugccagacuccaggcg

SEQ ID NO: 3846336 - RNA, 18 nt, Shigella flexneri 2a str. 2457T
cugccagaggagccauca

SEQ ID NO: 3846337 - RNA, 22 nt, Shigella flexneri 2a str. 2457T
cugccagaggagccaucaccau

SEQ ID NO: 3846338 - RNA, 23 nt, Shigella flexneri 2a str. 2457T
cugccagaggagccaucaccauc

SEQ ID NO: 3846339 - RNA, 24 nt, Shigella flexneri 2a str. 2457T
cugccagaucaucguuuccgaugg

SEQ ID NO: 3846340 - RNA, 12 nt, Shigella flexneri 2a str. 2457T
cugccagaugca

SEQ ID NO: 3846341 - RNA, 23 nt, Shigella flexneri 2a str. 2457T
cugccagaugcagcgguaauucc

SEQ ID NO: 3846342 - RNA, 12 nt, Shigella flexneri 2a str. 2457T
cugccagccagg

SEQ ID NO: 3846343 - RNA, 14 nt, Shigella flexneri 2a str. 2457T
cugccagccauaaa

SEQ ID NO: 3846344 - RNA, 15 nt, Shigella flexneri 2a str. 2457T
cugccagccauaaau

SEQ ID NO: 3846345 - RNA, 13 nt, Shigella flexneri 2a str. 2457T
cugccagcccgcc

SEQ ID NO: 3846346 - RNA, 17 nt, Shigella flexneri 2a str. 2457T
cugccagcgccgacagc

SEQ ID NO: 3846347 - RNA, 17 nt, Shigella flexneri 2a str. 2457T
cugccagcguaaauccu

SEQ ID NO: 3846348 - RNA, 19 nt, Shigella flexneri 2a str. 2457T
cugccagcguaccaugauc

SEQ ID NO: 3846349 - RNA, 12 nt, Shigella flexneri 2a str. 2457T
cugccagcucuc

SEQ ID NO: 3846350 - RNA, 15 nt, Shigella flexneri 2a str. 2457T
cugccagcucucaga

SEQ ID NO: 3846351 - RNA, 16 nt, Shigella flexneri 2a str. 2457T
cugccagggagcgaaa

SEQ ID NO: 3846352 - RNA, 20 nt, Shigella flexneri 2a str. 2457T
cugccaggucgugccagaaa

SEQ ID NO: 3846353 - RNA, 18 nt, Shigella flexneri 2a str. 2457T
cugccaguaaagcagcga

SEQ ID NO: 3846354 - RNA, 17 nt, Shigella flexneri 2a str. 2457T
cugccaguccugcucaa

SEQ ID NO: 3846355 - RNA, 15 nt, Shigella flexneri 2a str. 2457T
cugccagugcugcuu

SEQ ID NO: 3846356 - RNA, 19 nt, Shigella flexneri 2a str. 2457T
cugccaguuauagcgcaga

SEQ ID NO: 3846357 - RNA, 20 nt, Shigella flexneri 2a str. 2457T
cugccaguuauagcgcagac

SEQ ID NO: 3846358 - RNA, 17 nt, Shigella flexneri 2a str. 2457T
cugccauaaacgguuuc

SEQ ID NO: 3846359 - RNA, 23 nt, Shigella flexneri 2a str. 2457T
cugccauaaacgguuucagcagc

SEQ ID NO: 3846360 - RNA, 21 nt, Shigella flexneri 2a str. 2457T
cugccauccguaauuuuuacu

SEQ ID NO: 3846361 - RNA, 19 nt, Shigella flexneri 2a str. 2457T
cugccauuggcaggcucug

SEQ ID NO: 3846362 - RNA, 15 nt, Shigella flexneri 2a str. 2457T
cugccauuguuguug

SEQ ID NO: 3846363 - RNA, 20 nt, Shigella flexneri 2a str. 2457T
cugccauuguuguuggaucc

SEQ ID NO: 3846364 - RNA, 14 nt, Shigella flexneri 2a str. 2457T
cugcccacgcgcac

SEQ ID NO: 3846365 - RNA, 17 nt, Shigella flexneri 2a str. 2457T
cugcccacgcgcacgcu

SEQ ID NO: 3846366 - RNA, 20 nt, Shigella flexneri 2a str. 2457T
cugcccacgcgguauccaua

SEQ ID NO: 3846367 - RNA, 13 nt, Shigella flexneri 2a str. 2457T
cugccccaguucc

SEQ ID NO: 3846368 - RNA, 17 nt, Shigella flexneri 2a str. 2457T
cugcccccgcucuucca

SEQ ID NO: 3846369 - RNA, 13 nt, Shigella flexneri 2a str. 2457T
cugcccgcaccca

SEQ ID NO: 3846370 - RNA, 16 nt, Shigella flexneri 2a str. 2457T
cugcccgcguggcgca

SEQ ID NO: 3846371 - RNA, 20 nt, Shigella flexneri 2a str. 2457T
cugcccucuuuagcauucag

SEQ ID NO: 3846372 - RNA, 18 nt, Shigella flexneri 2a str. 2457T
cugccgagcgugcgggca

SEQ ID NO: 3846373 - RNA, 15 nt, Shigella flexneri 2a str. 2457T
cugccgaucaacugc

SEQ ID NO: 3846374 - RNA, 22 nt, Shigella flexneri 2a str. 2457T
cugccgcaauggccguuccggc

SEQ ID NO: 3846375 - RNA, 14 nt, Shigella flexneri 2a str. 2457T
cugccgcaggaaag

SEQ ID NO: 3846376 - RNA, 16 nt, Shigella flexneri 2a str. 2457T
cugccgcaguuucuga

SEQ ID NO: 3846377 - RNA, 12 nt, Shigella flexneri 2a str. 2457T
cugccgccagca

SEQ ID NO: 3846378 - RNA, 13 nt, Shigella flexneri 2a str. 2457T
cugccgcgccuga

SEQ ID NO: 3846379 - RNA, 19 nt, Shigella flexneri 2a str. 2457T
cugcguacugagucgggug

SEQ ID NO: 3846380 - RNA, 21 nt, Shigella flexneri 2a str. 2457T
cugcguaugguugccgggcug

SEQ ID NO: 3846381 - RNA, 14 nt, Shigella flexneri 2a str. 2457T
cugcguauuuccug

SEQ ID NO: 3846382 - RNA, 16 nt, Shigella flexneri 2a str. 2457T
cugcguauuuccugcc

SEQ ID NO: 3846383 - RNA, 20 nt, Shigella flexneri 2a str. 2457T
cugcgucaccacauccagcu

SEQ ID NO: 3846384 - RNA, 18 nt, Shigella flexneri 2a str. 2457T
cugcgucgcgcguaacau

SEQ ID NO: 3846385 - RNA, 14 nt, Shigella flexneri 2a str. 2457T
cugcgucgcuuucc

SEQ ID NO: 3846386 - RNA, 17 nt, Shigella flexneri 2a str. 2457T
cugcgugccuaauuccg

SEQ ID NO: 3846387 - RNA, 17 nt, Shigella flexneri 2a str. 2457T
cugcguggcgcgcguca

SEQ ID NO: 3846388 - RNA, 20 nt, Shigella flexneri 2a str. 2457T
cugcguggucauuaugaccg

SEQ ID NO: 3846389 - RNA, 19 nt, Shigella flexneri 2a str. 2457T
cugcguuccggcaugauuc

SEQ ID NO: 3846390 - RNA, 14 nt, Shigella flexneri 2a str. 2457T
cugcguuccugggg

SEQ ID NO: 3846391 - RNA, 21 nt, Shigella flexneri 2a str. 2457T
cugcguuguaccaguucgcuu

SEQ ID NO: 3846392 - RNA, 21 nt, Shigella flexneri 2a str. 2457T
cugcguuuucgagaaggcgcu

SEQ ID NO: 3846393 - RNA, 14 nt, Shigella flexneri 2a str. 2457T
cugcuaaauuugca

SEQ ID NO: 3846394 - RNA, 15 nt, Shigella flexneri 2a str. 2457T
cugcuaauauuuucg

SEQ ID NO: 3846395 - RNA, 21 nt, Shigella flexneri 2a str. 2457T
cugcuacggcaauucccagaa

SEQ ID NO: 3846396 - RNA, 19 nt, Shigella flexneri 2a str. 2457T
cugcuauucaccagcaaau

SEQ ID NO: 3846397 - RNA, 16 nt, Shigella flexneri 2a str. 2457T
cugcucaaguaauaaa

SEQ ID NO: 3846398 - RNA, 12 nt, Shigella flexneri 2a str. 2457T
cugcucaaugga

SEQ ID NO: 3846399 - RNA, 15 nt, Shigella flexneri 2a str. 2457T
cugcucaaugucugu

SEQ ID NO: 3846400 - RNA, 20 nt, Shigella flexneri 2a str. 2457T
cugcucagacggugaccaga

SEQ ID NO: 3846401 - RNA, 15 nt, Shigella flexneri 2a str. 2457T
cugcucagcuccucu

SEQ ID NO: 3846402 - RNA, 16 nt, Shigella flexneri 2a str. 2457T
cugcucagcuccucuu

SEQ ID NO: 3846403 - RNA, 15 nt, Shigella flexneri 2a str. 2457T
cugcucaucagcggu

SEQ ID NO: 3846404 - RNA, 21 nt, Shigella flexneri 2a str. 2457T
cugcucauugguccaucuuuu

SEQ ID NO: 3846405 - RNA, 16 nt, Shigella flexneri 2a str. 2457T
cugcuccagaaaauaa

SEQ ID NO: 3846406 - RNA, 17 nt, Shigella flexneri 2a str. 2457T
cugcuccuccuucucac

SEQ ID NO: 3846407 - RNA, 16 nt, Shigella flexneri 2a str. 2457T
cugcuccugcggcugc

SEQ ID NO: 3846408 - RNA, 17 nt, Shigella flexneri 2a str. 2457T
cugcuccuguugaugug

SEQ ID NO: 3846409 - RNA, 13 nt, Shigella flexneri 2a str. 2457T
cugcucgcaggcu

SEQ ID NO: 3846410 - RNA, 23 nt, Shigella flexneri 2a str. 2457T
cugcucgcgguuaaguuccguga

SEQ ID NO: 3846411 - RNA, 16 nt, Shigella flexneri 2a str. 2457T
cugcucggaaauauuc

SEQ ID NO: 3846412 - RNA, 15 nt, Shigella flexneri 2a str. 2457T
cugcucgguucgcug

SEQ ID NO: 3846413 - RNA, 16 nt, Shigella flexneri 2a str. 2457T
cugcucguucagcacu

SEQ ID NO: 3846414 - RNA, 13 nt, Shigella flexneri 2a str. 2457T
cugcucuucagua

SEQ ID NO: 3846415 - RNA, 14 nt, Shigella flexneri 2a str. 2457T
cugcugaacgugau

SEQ ID NO: 3846416 - RNA, 19 nt, Shigella flexneri 2a str. 2457T
cugcugacgcagauccuga

SEQ ID NO: 3846417 - RNA, 19 nt, Shigella flexneri 2a str. 2457T
cugcugacggcacuaccau

SEQ ID NO: 3846418 - RNA, 20 nt, Shigella flexneri 2a str. 2457T
cugcugacuuugauccagcc

SEQ ID NO: 3846419 - RNA, 16 nt, Shigella flexneri 2a str. 2457T
cugcugauccagcuuc

SEQ ID NO: 3846420 - RNA, 18 nt, Shigella flexneri 2a str. 2457T
cugcugauccagcuucca

SEQ ID NO: 3846421 - RNA, 23 nt, Shigella flexneri 2a str. 2457T
cugcugaugcgccgcuaacgucu

SEQ ID NO: 3846422 - RNA, 18 nt, Shigella flexneri 2a str. 2457T
cugcugcauccgcgcuuu

SEQ ID NO: 3846423 - RNA, 20 nt, Shigella flexneri 2a str. 2457T
cugcugccacauuccucugu

SEQ ID NO: 3846424 - RNA, 11 nt, Shigella flexneri 2a str. 2457T
cugcugccgcu

SEQ ID NO: 3846425 - RNA, 18 nt, Shigella flexneri 2a str. 2457T
cugcugcguuccggcaug

SEQ ID NO: 3846426 - RNA, 20 nt, Shigella flexneri 2a str. 2457T
cugcugcuguagccgaugcc

SEQ ID NO: 3846427 - RNA, 18 nt, Shigella flexneri 2a str. 2457T
cugcuggaacaaacugcc

SEQ ID NO: 3846428 - RNA, 13 nt, Shigella flexneri 2a str. 2457T
cugcuggaagcug

SEQ ID NO: 3846429 - RNA, 16 nt, Shigella flexneri 2a str. 2457T
cugcuggaucugcggg

SEQ ID NO: 3846430 - RNA, 14 nt, Shigella flexneri 2a str. 2457T
cugcuggugaugga

SEQ ID NO: 3846431 - RNA, 18 nt, Shigella flexneri 2a str. 2457T
cugcugguuagcggccug

SEQ ID NO: 3846432 - RNA, 22 nt, Shigella flexneri 2a str. 2457T
cugcugguucggcaucgccgcu

SEQ ID NO: 3846433 - RNA, 14 nt, Shigella flexneri 2a str. 2457T
cugcugguucugcg

SEQ ID NO: 3846434 - RNA, 18 nt, Shigella flexneri 2a str. 2457T
cugcuguuaauucaggau

SEQ ID NO: 3846435 - RNA, 17 nt, Shigella flexneri 2a str. 2457T
cugcuuaacugcgcuuu

SEQ ID NO: 3846436 - RNA, 17 nt, Shigella flexneri 2a str. 2457T
cugcuuaauaucccuuc

SEQ ID NO: 3846437 - RNA, 23 nt, Shigella flexneri 2a str. 2457T
cugcuuaauaucccuuccucccu

SEQ ID NO: 3846438 - RNA, 12 nt, Shigella flexneri 2a str. 2457T
cugcuuaauauu

SEQ ID NO: 3846439 - RNA, 15 nt, Shigella flexneri 2a str. 2457T
cugcuuacaggcugg

SEQ ID NO: 3846440 - RNA, 16 nt, Shigella flexneri 2a str. 2457T
cugcuuacaggcuggu

SEQ ID NO: 3846441 - RNA, 15 nt, Shigella flexneri 2a str. 2457T
cugcuuauagcgcau

SEQ ID NO: 3846442 - RNA, 17 nt, Shigella flexneri 2a str. 2457T
cugcuuaucaucacgca

SEQ ID NO: 3846443 - RNA, 23 nt, Shigella flexneri 2a str. 2457T
cugcuucagccgcacuuuuuaaa

SEQ ID NO: 3846444 - RNA, 24 nt, Shigella flexneri 2a str. 2457T
cugcuuccuuaaucccuggauuug

SEQ ID NO: 3846445 - RNA, 14 nt, Shigella flexneri 2a str. 2457T
cugcuucugccugg

SEQ ID NO: 3846446 - RNA, 18 nt, Shigella flexneri 2a str. 2457T
cugcuugaacgcaccgcc

SEQ ID NO: 3846447 - RNA, 21 nt, Shigella flexneri 2a str. 2457T
cugcuugaacgcaccgccacc

SEQ ID NO: 3846448 - RNA, 16 nt, Shigella flexneri 2a str. 2457T
cugcuugccagauacg

SEQ ID NO: 3846449 - RNA, 16 nt, Shigella flexneri 2a str. 2457T
cugcuuguuccacuuc

SEQ ID NO: 3846450 - RNA, 17 nt, Shigella flexneri 2a str. 2457T
cugcuuguuccacuuca

SEQ ID NO: 3846451 - RNA, 18 nt, Shigella flexneri 2a str. 2457T
cugcuuguuccacuucau

SEQ ID NO: 3846452 - RNA, 18 nt, Shigella flexneri 2a str. 2457T
cugcuuuacgccagguug

SEQ ID NO: 3846453 - RNA, 21 nt, Shigella flexneri 2a str. 2457T
cugcuuuaucagaucacgcau

SEQ ID NO: 3846454 - RNA, 17 nt, Shigella flexneri 2a str. 2457T
cugcuuuccgcuggcgu

SEQ ID NO: 3846455 - RNA, 22 nt, Shigella flexneri 2a str. 2457T
cugcuuuucccuccacuccggu

SEQ ID NO: 3846456 - RNA, 19 nt, Shigella flexneri 2a str. 2457T
cugcuuuuccggucagcaa

SEQ ID NO: 3846457 - RNA, 14 nt, Shigella flexneri 2a str. 2457T
cuggaaaaagugcc

SEQ ID NO: 3846458 - RNA, 21 nt, Shigella flexneri 2a str. 2457T
cuggaaaaucuacguuaaaaa

SEQ ID NO: 3846459 - RNA, 17 nt, Shigella flexneri 2a str. 2457T
cuggaaagagaaaaccc

SEQ ID NO: 3846460 - RNA, 16 nt, Shigella flexneri 2a str. 2457T
cuggaaagucugaaug

SEQ ID NO: 3846461 - RNA, 14 nt, Shigella flexneri 2a str. 2457T
cuggaaaucaaaaa

SEQ ID NO: 3846462 - RNA, 15 nt, Shigella flexneri 2a str. 2457T
cuggaaaucaauggu

SEQ ID NO: 3846463 - RNA, 17 nt, Shigella flexneri 2a str. 2457T
cuggaaccacagcgccg

SEQ ID NO: 3846464 - RNA, 18 nt, Shigella flexneri 2a str. 2457T
cuggaacuggcugccagc

SEQ ID NO: 3846465 - RNA, 15 nt, Shigella flexneri 2a str. 2457T
cuggaacugguggau

SEQ ID NO: 3846466 - RNA, 21 nt, Shigella flexneri 2a str. 2457T
cuggaagaguuuguugagaug

SEQ ID NO: 3846467 - RNA, 23 nt, Shigella flexneri 2a str. 2457T
cuggaagaguuuguugagauggu

SEQ ID NO: 3846468 - RNA, 14 nt, Shigella flexneri 2a str. 2457T
cuggaagauucccc

SEQ ID NO: 3846469 - RNA, 17 nt, Shigella flexneri 2a str. 2457T
cuggaagccagucacau

SEQ ID NO: 3846470 - RNA, 23 nt, Shigella flexneri 2a str. 2457T
cuggaagcuggauuaacgcuggg

SEQ ID NO: 3846471 - RNA, 13 nt, Shigella flexneri 2a str. 2457T
cuggaagcuggca

SEQ ID NO: 3846472 - RNA, 19 nt, Shigella flexneri 2a str. 2457T
cuggaaggacucgaggagc

SEQ ID NO: 3846473 - RNA, 14 nt, Shigella flexneri 2a str. 2457T
cuggaaggugaaau

SEQ ID NO: 3846474 - RNA, 23 nt, Shigella flexneri 2a str. 2457T
cuggaaggugaaauugucggcgu

SEQ ID NO: 3846475 - RNA, 13 nt, Shigella flexneri 2a str. 2457T
cuggaauaaucgu

SEQ ID NO: 3846476 - RNA, 16 nt, Shigella flexneri 2a str. 2457T
cuggcuucccggcaau

SEQ ID NO: 3846477 - RNA, 19 nt, Shigella flexneri 2a str. 2457T
cuggcuucccggcaaucgc

SEQ ID NO: 3846478 - RNA, 14 nt, Shigella flexneri 2a str. 2457T
cuggcuucgcuguu

SEQ ID NO: 3846479 - RNA, 22 nt, Shigella flexneri 2a str. 2457T
cuggcuugguaacaugcucuuu

SEQ ID NO: 3846480 - RNA, 16 nt, Shigella flexneri 2a str. 2457T
cugggaaaucaccacc

SEQ ID NO: 3846481 - RNA, 18 nt, Shigella flexneri 2a str. 2457T
cugggaaaucaccaccag

SEQ ID NO: 3846482 - RNA, 19 nt, Shigella flexneri 2a str. 2457T
cugggaagaauggaaaaaa

SEQ ID NO: 3846483 - RNA, 20 nt, Shigella flexneri 2a str. 2457T
cugggagaacggacccgcga

SEQ ID NO: 3846484 - RNA, 17 nt, Shigella flexneri 2a str. 2457T
cugggaugaaagugaug

SEQ ID NO: 3846485 - RNA, 19 nt, Shigella flexneri 2a str. 2457T
cugggaugaucaccugcau

SEQ ID NO: 3846486 - RNA, 21 nt, Shigella flexneri 2a str. 2457T
cugggcaaugcugucgguggu

SEQ ID NO: 3846487 - RNA, 16 nt, Shigella flexneri 2a str. 2457T
cugggcaauggugaac

SEQ ID NO: 3846488 - RNA, 18 nt, Shigella flexneri 2a str. 2457T
cugggcauugaaggcagc

SEQ ID NO: 3846489 - RNA, 19 nt, Shigella flexneri 2a str. 2457T
cugggcauugaaggcagca

SEQ ID NO: 3846490 - RNA, 16 nt, Shigella flexneri 2a str. 2457T
cugggccgccauccgg

SEQ ID NO: 3846491 - RNA, 18 nt, Shigella flexneri 2a str. 2457T
cugggccgccauccggca

SEQ ID NO: 3846492 - RNA, 15 nt, Shigella flexneri 2a str. 2457T
cugggcgaaacagag

SEQ ID NO: 3846493 - RNA, 15 nt, Shigella flexneri 2a str. 2457T
cugggcgaugcuggc

SEQ ID NO: 3846494 - RNA, 23 nt, Shigella flexneri 2a str. 2457T
cugggcgauuuccuucagcagca

SEQ ID NO: 3846495 - RNA, 18 nt, Shigella flexneri 2a str. 2457T
cugggcgauuuucuacuu

SEQ ID NO: 3846496 - RNA, 15 nt, Shigella flexneri 2a str. 2457T
cugggcugccugagc

SEQ ID NO: 3846497 - RNA, 23 nt, Shigella flexneri 2a str. 2457T
cugggcuucauccagcagugacu

SEQ ID NO: 3846498 - RNA, 22 nt, Shigella flexneri 2a str. 2457T
cuggggauagaaacagucugga

SEQ ID NO: 3846499 - RNA, 23 nt, Shigella flexneri 2a str. 2457T
cuggggcuuugaugucgcuucca

SEQ ID NO: 3846500 - RNA, 20 nt, Shigella flexneri 2a str. 2457T
cuggguaaaaauagggugcg

SEQ ID NO: 3846501 - RNA, 16 nt, Shigella flexneri 2a str. 2457T
cuggguaaugacucca

SEQ ID NO: 3846502 - RNA, 19 nt, Shigella flexneri 2a str. 2457T
cuggguagaguuugaacuc

SEQ ID NO: 3846503 - RNA, 15 nt, Shigella flexneri 2a str. 2457T
cuggguaguccauga

SEQ ID NO: 3846504 - RNA, 15 nt, Shigella flexneri 2a str. 2457T
cuggguuucgccugc

SEQ ID NO: 3846505 - RNA, 19 nt, Shigella flexneri 2a str. 2457T
cuggguuucgccugccaga

SEQ ID NO: 3846506 - RNA, 20 nt, Shigella flexneri 2a str. 2457T
cugguaaaaaaugauuuccu

SEQ ID NO: 3846507 - RNA, 18 nt, Shigella flexneri 2a str. 2457T
cugguaacuggugccagg

SEQ ID NO: 3846508 - RNA, 14 nt, Shigella flexneri 2a str. 2457T
cugguaaucaccac

SEQ ID NO: 3846509 - RNA, 15 nt, Shigella flexneri 2a str. 2457T
cugguaccagcaccg

SEQ ID NO: 3846510 - RNA, 16 nt, Shigella flexneri 2a str. 2457T
cugguaccagcaccgu

SEQ ID NO: 3846511 - RNA, 21 nt, Shigella flexneri 2a str. 2457T
cugguacgauucgcccgcagc

SEQ ID NO: 3846512 - RNA, 18 nt, Shigella flexneri 2a str. 2457T
cugguacucaaccgccac

SEQ ID NO: 3846513 - RNA, 18 nt, Shigella flexneri 2a str. 2457T
cugguacucgacuguggc

SEQ ID NO: 3846514 - RNA, 14 nt, Shigella flexneri 2a str. 2457T
cugguagauaagca

SEQ ID NO: 3846515 - RNA, 12 nt, Shigella flexneri 2a str. 2457T
cugguagcaucu

SEQ ID NO: 3846516 - RNA, 19 nt, Shigella flexneri 2a str. 2457T
cugguagcgggugaagaga

SEQ ID NO: 3846517 - RNA, 17 nt, Shigella flexneri 2a str. 2457T
cugguagcuguagguaa

SEQ ID NO: 3846518 - RNA, 14 nt, Shigella flexneri 2a str. 2457T
cugguaguccagga

SEQ ID NO: 3846519 - RNA, 21 nt, Shigella flexneri 2a str. 2457T
cugguaguccaggaugugcgu

SEQ ID NO: 3846520 - RNA, 14 nt, Shigella flexneri 2a str. 2457T
cugguauuuccagu

SEQ ID NO: 3846521 - RNA, 18 nt, Shigella flexneri 2a str. 2457T
cugguauuuccaguccag

SEQ ID NO: 3846522 - RNA, 16 nt, Shigella flexneri 2a str. 2457T
cuggucacucucgacc

SEQ ID NO: 3846523 - RNA, 20 nt, Shigella flexneri 2a str. 2457T
cuggucaguuucagccagga

SEQ ID NO: 3846524 - RNA, 20 nt, Shigella flexneri 2a str. 2457T
cuggucauaggccgcugaug

SEQ ID NO: 3846525 - RNA, 15 nt, Shigella flexneri 2a str. 2457T
cuggucauugccagg

SEQ ID NO: 3846526 - RNA, 18 nt, Shigella flexneri 2a str. 2457T
cugguccuucaucuucaa

SEQ ID NO: 3846527 - RNA, 13 nt, Shigella flexneri 2a str. 2457T
cuggucgagaucg

SEQ ID NO: 3846528 - RNA, 22 nt, Shigella flexneri 2a str. 2457T
cuggucugacgcugaauacgca

SEQ ID NO: 3846529 - RNA, 14 nt, Shigella flexneri 2a str. 2457T
cuggugaccuggga

SEQ ID NO: 3846530 - RNA, 19 nt, Shigella flexneri 2a str. 2457T
cuggugacuuuugcccggc

SEQ ID NO: 3846531 - RNA, 21 nt, Shigella flexneri 2a str. 2457T
cuggugauugcaccgacuggc

SEQ ID NO: 3846532 - RNA, 20 nt, Shigella flexneri 2a str. 2457T
cuggugauugccggaauggu

SEQ ID NO: 3846533 - RNA, 22 nt, Shigella flexneri 2a str. 2457T
cuggugcaauuucagcguccug

SEQ ID NO: 3846534 - RNA, 22 nt, Shigella flexneri 2a str. 2457T
cuggugcggcaaaaacccuucu

SEQ ID NO: 3846535 - RNA, 23 nt, Shigella flexneri 2a str. 2457T
cuggugcuaacagcaaucccaaa

SEQ ID NO: 3846536 - RNA, 21 nt, Shigella flexneri 2a str. 2457T
cuggugggugcuuuaaaaaag

SEQ ID NO: 3846537 - RNA, 20 nt, Shigella flexneri 2a str. 2457T
cugguggugcgugcggcaaa

SEQ ID NO: 3846538 - RNA, 22 nt, Shigella flexneri 2a str. 2457T
cugguguaagucggucacaguc

SEQ ID NO: 3846539 - RNA, 22 nt, Shigella flexneri 2a str. 2457T
cuggugucagcgugacuggcag

SEQ ID NO: 3846540 - RNA, 22 nt, Shigella flexneri 2a str. 2457T
cugguguucgauaaccaucccu

SEQ ID NO: 3846541 - RNA, 21 nt, Shigella flexneri 2a str. 2457T
cugguuacucaccagccgcga

SEQ ID NO: 3846542 - RNA, 22 nt, Shigella flexneri 2a str. 2457T
cugguuaguuuuagcgcgggga

SEQ ID NO: 3846543 - RNA, 15 nt, Shigella flexneri 2a str. 2457T
cugguuauauuuccc

SEQ ID NO: 3846544 - RNA, 23 nt, Shigella flexneri 2a str. 2457T
cugguuauauuuccccuguugca

SEQ ID NO: 3846545 - RNA, 16 nt, Shigella flexneri 2a str. 2457T
cugguucaagagagaa

SEQ ID NO: 3846546 - RNA, 16 nt, Shigella flexneri 2a str. 2457T
cugguucccaacaaca

SEQ ID NO: 3846547 - RNA, 17 nt, Shigella flexneri 2a str. 2457T
cugguucccaacaacag

SEQ ID NO: 3846548 - RNA, 16 nt, Shigella flexneri 2a str. 2457T
cugguuccugacuccu

SEQ ID NO: 3846549 - RNA, 15 nt, Shigella flexneri 2a str. 2457T
cugguucugcggguu

SEQ ID NO: 3846550 - RNA, 18 nt, Shigella flexneri 2a str. 2457T
cugguugauucauggcau

SEQ ID NO: 3846551 - RNA, 16 nt, Shigella flexneri 2a str. 2457T
cugguuuccgcuguug

SEQ ID NO: 3846552 - RNA, 20 nt, Shigella flexneri 2a str. 2457T
cugguuuucagcgaaacagc

SEQ ID NO: 3846553 - RNA, 15 nt, Shigella flexneri 2a str. 2457T
cugguuuuucgauuu

SEQ ID NO: 3846554 - RNA, 21 nt, Shigella flexneri 2a str. 2457T
cugguuuuucgauuuaaauga

SEQ ID NO: 3846555 - RNA, 21 nt, Shigella flexneri 2a str. 2457T
cuguaaaacgcgcccucagcc

SEQ ID NO: 3846556 - RNA, 22 nt, Shigella flexneri 2a str. 2457T
cuguaaaacgcgcccucagccc

SEQ ID NO: 3846557 - RNA, 17 nt, Shigella flexneri 2a str. 2457T
cuguaaaaggcgccauu

SEQ ID NO: 3846558 - RNA, 22 nt, Shigella flexneri 2a str. 2457T
cuguaaagagugugaauauuca

SEQ ID NO: 3846559 - RNA, 19 nt, Shigella flexneri 2a str. 2457T
cuguaaaugcugcuccagc

SEQ ID NO: 3846560 - RNA, 22 nt, Shigella flexneri 2a str. 2457T
cuguaaauucucaauaucauca

SEQ ID NO: 3846561 - RNA, 19 nt, Shigella flexneri 2a str. 2457T
cuguaaauugaugugaaaa

SEQ ID NO: 3846562 - RNA, 23 nt, Shigella flexneri 2a str. 2457T
cuguaaauugaugugaaaacucu

SEQ ID NO: 3846563 - RNA, 21 nt, Shigella flexneri 2a str. 2457T
cuguaacggugucguauucuc

SEQ ID NO: 3846564 - RNA, 19 nt, Shigella flexneri 2a str. 2457T
cuguaauuaccagcgccgg

SEQ ID NO: 3846565 - RNA, 12 nt, Shigella flexneri 2a str. 2457T
cuguaauugccg

SEQ ID NO: 3846566 - RNA, 19 nt, Shigella flexneri 2a str. 2457T
cuguacaaagccgguuuca

SEQ ID NO: 3846567 - RNA, 18 nt, Shigella flexneri 2a str. 2457T
cuguacagauccgccauu

SEQ ID NO: 3846568 - RNA, 17 nt, Shigella flexneri 2a str. 2457T
cuguacaggcuccugua

SEQ ID NO: 3846569 - RNA, 14 nt, Shigella flexneri 2a str. 2457T
cuguaccacaaccu

SEQ ID NO: 3846570 - RNA, 12 nt, Shigella flexneri 2a str. 2457T
cuguaccaccag

SEQ ID NO: 3846571 - RNA, 14 nt, Shigella flexneri 2a str. 2457T
cuguaccaccagaa

SEQ ID NO: 3846572 - RNA, 15 nt, Shigella flexneri 2a str. 2457T
cuguuccggcuuugu

SEQ ID NO: 3846573 - RNA, 20 nt, Shigella flexneri 2a str. 2457T
cuguucgcaaccuaaccaaa

SEQ ID NO: 3846574 - RNA, 14 nt, Shigella flexneri 2a str. 2457T
cuguucgccgccgc

SEQ ID NO: 3846575 - RNA, 19 nt, Shigella flexneri 2a str. 2457T
cuguucgguuuugcccaca

SEQ ID NO: 3846576 - RNA, 15 nt, Shigella flexneri 2a str. 2457T
cuguucugccucuga

SEQ ID NO: 3846577 - RNA, 23 nt, Shigella flexneri 2a str. 2457T
cuguugaagccgccgguagucac

SEQ ID NO: 3846578 - RNA, 18 nt, Shigella flexneri 2a str. 2457T
cuguugauguccaguucc

SEQ ID NO: 3846579 - RNA, 18 nt, Shigella flexneri 2a str. 2457T
cuguugguaacuuacuga

SEQ ID NO: 3846580 - RNA, 19 nt, Shigella flexneri 2a str. 2457T
cuguuggugccagauagcc

SEQ ID NO: 3846581 - RNA, 15 nt, Shigella flexneri 2a str. 2457T
cuguugguucagugg

SEQ ID NO: 3846582 - RNA, 13 nt, Shigella flexneri 2a str. 2457T
cuguugugaugca

SEQ ID NO: 3846583 - RNA, 16 nt, Shigella flexneri 2a str. 2457T
cuguuuaaccgcuuca

SEQ ID NO: 3846584 - RNA, 18 nt, Shigella flexneri 2a str. 2457T
cuguuuaauaugcaauuc

SEQ ID NO: 3846585 - RNA, 18 nt, Shigella flexneri 2a str. 2457T
cuguuuacgcagcucacu

SEQ ID NO: 3846586 - RNA, 16 nt, Shigella flexneri 2a str. 2457T
cuguuuagccgcuucu

SEQ ID NO: 3846587 - RNA, 19 nt, Shigella flexneri 2a str. 2457T
cuguuuagccgcuucugca

SEQ ID NO: 3846588 - RNA, 23 nt, Shigella flexneri 2a str. 2457T
cuguuuagccgcuucugcagcuu

SEQ ID NO: 3846589 - RNA, 20 nt, Shigella flexneri 2a str. 2457T
cuguuuagcgacucgauggc

SEQ ID NO: 3846590 - RNA, 15 nt, Shigella flexneri 2a str. 2457T
cuguuuaucuuccca

SEQ ID NO: 3846591 - RNA, 16 nt, Shigella flexneri 2a str. 2457T
cuguuuaucuucccag

SEQ ID NO: 3846592 - RNA, 19 nt, Shigella flexneri 2a str. 2457T
cuguuuaucuucccagcgc

SEQ ID NO: 3846593 - RNA, 20 nt, Shigella flexneri 2a str. 2457T
cuguuucaucucuucacgcu

SEQ ID NO: 3846594 - RNA, 19 nt, Shigella flexneri 2a str. 2457T
cuguuugcaggugaccagc

SEQ ID NO: 3846595 - RNA, 12 nt, Shigella flexneri 2a str. 2457T
cuguuugccagu

SEQ ID NO: 3846596 - RNA, 22 nt, Shigella flexneri 2a str. 2457T
cuguuugucgaucaucaggccc

SEQ ID NO: 3846597 - RNA, 19 nt, Shigella flexneri 2a str. 2457T
cuguuuuccagcaccacuu

SEQ ID NO: 3846598 - RNA, 14 nt, Shigella flexneri 2a str. 2457T
cuguuuuuuauacu

SEQ ID NO: 3846599 - RNA, 21 nt, Shigella flexneri 2a str. 2457T
cuguuuuuugguguuacugcu

SEQ ID NO: 3846600 - RNA, 22 nt, Shigella flexneri 2a str. 2457T
cuuaaacaguacgagagaagag

SEQ ID NO: 3846601 - RNA, 17 nt, Shigella flexneri 2a str. 2457T
cuuaaaggggugaaaaa

SEQ ID NO: 3846602 - RNA, 21 nt, Shigella flexneri 2a str. 2457T
cuuaaaggggugaaaaaaacu

SEQ ID NO: 3846603 - RNA, 15 nt, Shigella flexneri 2a str. 2457T
cuuaaagucuuugua

SEQ ID NO: 3846604 - RNA, 17 nt, Shigella flexneri 2a str. 2457T
cuuaaagucuuuguauu

SEQ ID NO: 3846605 - RNA, 13 nt, Shigella flexneri 2a str. 2457T
cuuaaauaaugcu

SEQ ID NO: 3846606 - RNA, 21 nt, Shigella flexneri 2a str. 2457T
cuuaaaugcacccgccagaga

SEQ ID NO: 3846607 - RNA, 15 nt, Shigella flexneri 2a str. 2457T
cuuaaauuaagaagu

SEQ ID NO: 3846608 - RNA, 22 nt, Shigella flexneri 2a str. 2457T
cuuaaauuucuuaccacugccg

SEQ ID NO: 3846609 - RNA, 15 nt, Shigella flexneri 2a str. 2457T
cuuaacgcaccaugc

SEQ ID NO: 3846610 - RNA, 14 nt, Shigella flexneri 2a str. 2457T
cuuaacuguaaauc

SEQ ID NO: 3846611 - RNA, 18 nt, Shigella flexneri 2a str. 2457T
cuuaacuguaaaucgcca

SEQ ID NO: 3846612 - RNA, 19 nt, Shigella flexneri 2a str. 2457T
cuuaacuguaaaucgccau

SEQ ID NO: 3846613 - RNA, 20 nt, Shigella flexneri 2a str. 2457T
cuuaacuucgcagcuuauuu

SEQ ID NO: 3846614 - RNA, 18 nt, Shigella flexneri 2a str. 2457T
cuuaagaaauuauucaug

SEQ ID NO: 3846615 - RNA, 22 nt, Shigella flexneri 2a str. 2457T
cuuaagccgcuguguguaggcc

SEQ ID NO: 3846616 - RNA, 20 nt, Shigella flexneri 2a str. 2457T
cuuaaggcuguucccacgca

SEQ ID NO: 3846617 - RNA, 14 nt, Shigella flexneri 2a str. 2457T
cuuaaggucacaga

SEQ ID NO: 3846618 - RNA, 14 nt, Shigella flexneri 2a str. 2457T
cuuaauaaaaauuu

SEQ ID NO: 3846619 - RNA, 14 nt, Shigella flexneri 2a str. 2457T
cuuaaucaacucac

SEQ ID NO: 3846620 - RNA, 13 nt, Shigella flexneri 2a str. 2457T
cuuaaucaccagc

SEQ ID NO: 3846621 - RNA, 20 nt, Shigella flexneri 2a str. 2457T
cuuaaucagaauuuuucgcu

SEQ ID NO: 3846622 - RNA, 17 nt, Shigella flexneri 2a str. 2457T
cuuaaucaucaaugcca

SEQ ID NO: 3846623 - RNA, 18 nt, Shigella flexneri 2a str. 2457T
cuuaaucaucaaugccag

SEQ ID NO: 3846624 - RNA, 22 nt, Shigella flexneri 2a str. 2457T
cuuaaucaucaaugccagcaua

SEQ ID NO: 3846625 - RNA, 19 nt, Shigella flexneri 2a str. 2457T
cuuaaucugccagaaggau

SEQ ID NO: 3846626 - RNA, 20 nt, Shigella flexneri 2a str. 2457T
cuuaaugcaggcagcacugc

SEQ ID NO: 3846627 - RNA, 21 nt, Shigella flexneri 2a str. 2457T
cuuaaugcccaucucuucuuc

SEQ ID NO: 3846628 - RNA, 18 nt, Shigella flexneri 2a str. 2457T
cuuaauggaaaacuguuu

SEQ ID NO: 3846629 - RNA, 19 nt, Shigella flexneri 2a str. 2457T
cuuaauggucugaaaggua

SEQ ID NO: 3846630 - RNA, 20 nt, Shigella flexneri 2a str. 2457T
cuuaauggucugaaagguau

SEQ ID NO: 3846631 - RNA, 19 nt, Shigella flexneri 2a str. 2457T
cuuaauugcccgaagccaa

SEQ ID NO: 3846632 - RNA, 24 nt, Shigella flexneri 2a str. 2457T
cuuacagaaaugguaaagaaggca

SEQ ID NO: 3846633 - RNA, 16 nt, Shigella flexneri 2a str. 2457T
cuuacauuccgucuca

SEQ ID NO: 3846634 - RNA, 17 nt, Shigella flexneri 2a str. 2457T
cuuaccaaauaaacgaa

SEQ ID NO: 3846635 - RNA, 15 nt, Shigella flexneri 2a str. 2457T
cuuacccuaaauccg

SEQ ID NO: 3846636 - RNA, 16 nt, Shigella flexneri 2a str. 2457T
cuuacccuaaauccgc

SEQ ID NO: 3846637 - RNA, 18 nt, Shigella flexneri 2a str. 2457T
cuuaccguccucuuccca

SEQ ID NO: 3846638 - RNA, 15 nt, Shigella flexneri 2a str. 2457T
cuuaccuacuugcuc

SEQ ID NO: 3846639 - RNA, 20 nt, Shigella flexneri 2a str. 2457T
cuuacgagugcgcucuucaa

SEQ ID NO: 3846640 - RNA, 16 nt, Shigella flexneri 2a str. 2457T
cuuacgccugccagcu

SEQ ID NO: 3846641 - RNA, 13 nt, Shigella flexneri 2a str. 2457T
cuuacgcgucaga

SEQ ID NO: 3846642 - RNA, 18 nt, Shigella flexneri 2a str. 2457T
cuuacggauaauuauuua

SEQ ID NO: 3846643 - RNA, 19 nt, Shigella flexneri 2a str. 2457T
cuuacggcacuccucuuca

SEQ ID NO: 3846644 - RNA, 16 nt, Shigella flexneri 2a str. 2457T
cuuacggcuuuuaauc

SEQ ID NO: 3846645 - RNA, 17 nt, Shigella flexneri 2a str. 2457T
cuuacguaauuuauaau

SEQ ID NO: 3846646 - RNA, 22 nt, Shigella flexneri 2a str. 2457T
cuuacucauaaauacuccauaa

SEQ ID NO: 3846647 - RNA, 16 nt, Shigella flexneri 2a str. 2457T
cuuacucaugauguca

SEQ ID NO: 3846648 - RNA, 22 nt, Shigella flexneri 2a str. 2457T
cuuacucauuaaugcacuucca

SEQ ID NO: 3846649 - RNA, 16 nt, Shigella flexneri 2a str. 2457T
cuuacugauaguguuu

SEQ ID NO: 3846650 - RNA, 18 nt, Shigella flexneri 2a str. 2457T
cuuacugaugcacacacg

SEQ ID NO: 3846651 - RNA, 19 nt, Shigella flexneri 2a str. 2457T
cuuacuggggaaguggcga

SEQ ID NO: 3846652 - RNA, 12 nt, Shigella flexneri 2a str. 2457T
cuuacuguguug

SEQ ID NO: 3846653 - RNA, 13 nt, Shigella flexneri 2a str. 2457T
cuuacuucaacac

SEQ ID NO: 3846654 - RNA, 20 nt, Shigella flexneri 2a str. 2457T
cuuacuucagcaagcgauaa

SEQ ID NO: 3846655 - RNA, 14 nt, Shigella flexneri 2a str. 2457T
cuuagccuguguca

SEQ ID NO: 3846656 - RNA, 22 nt, Shigella flexneri 2a str. 2457T
cuuagcguucugcguuaagacu

SEQ ID NO: 3846657 - RNA, 17 nt, Shigella flexneri 2a str. 2457T
cuuagguaaugacucca

SEQ ID NO: 3846658 - RNA, 13 nt, Shigella flexneri 2a str. 2457T
cuuaguagaagag

SEQ ID NO: 3846659 - RNA, 16 nt, Shigella flexneri 2a str. 2457T
cuuauaaagaaaaucu

SEQ ID NO: 3846660 - RNA, 18 nt, Shigella flexneri 2a str. 2457T
cuuauaaagaaaaucuga

SEQ ID NO: 3846661 - RNA, 18 nt, Shigella flexneri 2a str. 2457T
cuuauaaggaaccuccau

SEQ ID NO: 3846662 - RNA, 13 nt, Shigella flexneri 2a str. 2457T
cuuauaagucuca

SEQ ID NO: 3846663 - RNA, 17 nt, Shigella flexneri 2a str. 2457T
cuuauaauccccggccu

SEQ ID NO: 3846664 - RNA, 13 nt, Shigella flexneri 2a str. 2457T
cuuauagaaagca

SEQ ID NO: 3846665 - RNA, 14 nt, Shigella flexneri 2a str. 2457T
cuuauagacuaaau

SEQ ID NO: 3846666 - RNA, 13 nt, Shigella flexneri 2a str. 2457T
cuuaucaaucuca

SEQ ID NO: 3846667 - RNA, 17 nt, Shigella flexneri 2a str. 2457T
cuuaucaaucucagcaa

SEQ ID NO: 3846668 - RNA, 11 nt, Shigella flexneri 2a str. 2457T
cuuaucaggcc

SEQ ID NO: 3846669 - RNA, 14 nt, Shigella flexneri 2a str. 2457T
cuucaucauccucu

SEQ ID NO: 3846670 - RNA, 22 nt, Shigella flexneri 2a str. 2457T
cuucaucauccuuugggcauuu

SEQ ID NO: 3846671 - RNA, 19 nt, Shigella flexneri 2a str. 2457T
cuucaucaucgcagauuuc

SEQ ID NO: 3846672 - RNA, 22 nt, Shigella flexneri 2a str. 2457T
cuucauccacauucgaaugccg

SEQ ID NO: 3846673 - RNA, 15 nt, Shigella flexneri 2a str. 2457T
cuucauccaccgauu

SEQ ID NO: 3846674 - RNA, 14 nt, Shigella flexneri 2a str. 2457T
cuucauccagcagu

SEQ ID NO: 3846675 - RNA, 15 nt, Shigella flexneri 2a str. 2457T
cuucauccagcagug

SEQ ID NO: 3846676 - RNA, 14 nt, Shigella flexneri 2a str. 2457T
cuucaucccugaaa

SEQ ID NO: 3846677 - RNA, 23 nt, Shigella flexneri 2a str. 2457T
cuucaucccuuucgcuucaagua

SEQ ID NO: 3846678 - RNA, 17 nt, Shigella flexneri 2a str. 2457T
cuucaucgauacugcuc

SEQ ID NO: 3846679 - RNA, 13 nt, Shigella flexneri 2a str. 2457T
cuucaucgcccac

SEQ ID NO: 3846680 - RNA, 21 nt, Shigella flexneri 2a str. 2457T
cuucaucgugcucgcuuucca

SEQ ID NO: 3846681 - RNA, 15 nt, Shigella flexneri 2a str. 2457T
cuucaucucagugag

SEQ ID NO: 3846682 - RNA, 17 nt, Shigella flexneri 2a str. 2457T
cuucaucucagugagau

SEQ ID NO: 3846683 - RNA, 18 nt, Shigella flexneri 2a str. 2457T
cuucaugcgcagcauaau

SEQ ID NO: 3846684 - RNA, 17 nt, Shigella flexneri 2a str. 2457T
cuucauggggaugcuga

SEQ ID NO: 3846685 - RNA, 20 nt, Shigella flexneri 2a str. 2457T
cuucauucgcgccagauggc

SEQ ID NO: 3846686 - RNA, 20 nt, Shigella flexneri 2a str. 2457T
cuucauugaacgggugauuu

SEQ ID NO: 3846687 - RNA, 15 nt, Shigella flexneri 2a str. 2457T
cuucauugacgccaa

SEQ ID NO: 3846688 - RNA, 13 nt, Shigella flexneri 2a str. 2457T
cuucauugcucuc

SEQ ID NO: 3846689 - RNA, 17 nt, Shigella flexneri 2a str. 2457T
cuucauuugccagcuuc

SEQ ID NO: 3846690 - RNA, 16 nt, Shigella flexneri 2a str. 2457T
cuuccacaauggcaua

SEQ ID NO: 3846691 - RNA, 19 nt, Shigella flexneri 2a str. 2457T
cuuccaccguuucuuuuuc

SEQ ID NO: 3846692 - RNA, 16 nt, Shigella flexneri 2a str. 2457T
cuuccagaauaaacaa

SEQ ID NO: 3846693 - RNA, 21 nt, Shigella flexneri 2a str. 2457T
cuuccagacucugaaacucga

SEQ ID NO: 3846694 - RNA, 23 nt, Shigella flexneri 2a str. 2457T
cuuccagaucaccgcagaagcga

SEQ ID NO: 3846695 - RNA, 15 nt, Shigella flexneri 2a str. 2457T
cuuccagauucaguu

SEQ ID NO: 3846696 - RNA, 15 nt, Shigella flexneri 2a str. 2457T
cuuccagcaaaucca

SEQ ID NO: 3846697 - RNA, 17 nt, Shigella flexneri 2a str. 2457T
cuuccagcaaauccauc

SEQ ID NO: 3846698 - RNA, 22 nt, Shigella flexneri 2a str. 2457T
cuuccagcagaccagcaauaac

SEQ ID NO: 3846699 - RNA, 20 nt, Shigella flexneri 2a str. 2457T
cuuccagcagaccuucugcc

SEQ ID NO: 3846700 - RNA, 18 nt, Shigella flexneri 2a str. 2457T
cuuccagcaguucgcccg

SEQ ID NO: 3846701 - RNA, 14 nt, Shigella flexneri 2a str. 2457T
cuuccagcgauaau

SEQ ID NO: 3846702 - RNA, 18 nt, Shigella flexneri 2a str. 2457T
cuuccagcguucgccaaa

SEQ ID NO: 3846703 - RNA, 19 nt, Shigella flexneri 2a str. 2457T
cuuccagcguucgccaaac

SEQ ID NO: 3846704 - RNA, 20 nt, Shigella flexneri 2a str. 2457T
cuuccagcguucgccaaacc

SEQ ID NO: 3846705 - RNA, 13 nt, Shigella flexneri 2a str. 2457T
cuuccagcuccag

SEQ ID NO: 3846706 - RNA, 18 nt, Shigella flexneri 2a str. 2457T
cuuccaggucaaccuagc

SEQ ID NO: 3846707 - RNA, 19 nt, Shigella flexneri 2a str. 2457T
cuuccaguuccggcaucga

SEQ ID NO: 3846708 - RNA, 17 nt, Shigella flexneri 2a str. 2457T
cuuccaguugcacgcca

SEQ ID NO: 3846709 - RNA, 14 nt, Shigella flexneri 2a str. 2457T
cuuccauacagcuc

SEQ ID NO: 3846710 - RNA, 19 nt, Shigella flexneri 2a str. 2457T
cuuccauguguuuaucuau

SEQ ID NO: 3846711 - RNA, 14 nt, Shigella flexneri 2a str. 2457T
cuuccauugccgcu

SEQ ID NO: 3846712 - RNA, 22 nt, Shigella flexneri 2a str. 2457T
cuuccauugccgcuuuccaggc

SEQ ID NO: 3846713 - RNA, 22 nt, Shigella flexneri 2a str. 2457T
cuucccaaagaucuccucacca

SEQ ID NO: 3846714 - RNA, 13 nt, Shigella flexneri 2a str. 2457T
cuucccagcccag

SEQ ID NO: 3846715 - RNA, 13 nt, Shigella flexneri 2a str. 2457T
cuucccagcgcag

SEQ ID NO: 3846716 - RNA, 19 nt, Shigella flexneri 2a str. 2457T
cuucccagguuucaaugcc

SEQ ID NO: 3846717 - RNA, 16 nt, Shigella flexneri 2a str. 2457T
cuuccccgcuucagcc

SEQ ID NO: 3846718 - RNA, 17 nt, Shigella flexneri 2a str. 2457T
cuuccccgcuucagccc

SEQ ID NO: 3846719 - RNA, 18 nt, Shigella flexneri 2a str. 2457T
cuuccccguucugccagu

SEQ ID NO: 3846720 - RNA, 14 nt, Shigella flexneri 2a str. 2457T
cuuccccuucucgu

SEQ ID NO: 3846721 - RNA, 17 nt, Shigella flexneri 2a str. 2457T
cuucccgcauccagaaa

SEQ ID NO: 3846722 - RNA, 13 nt, Shigella flexneri 2a str. 2457T
cuucccgccuguc

SEQ ID NO: 3846723 - RNA, 15 nt, Shigella flexneri 2a str. 2457T
cuucccggcaaucgc

SEQ ID NO: 3846724 - RNA, 21 nt, Shigella flexneri 2a str. 2457T
cuucccgggucgcgacugcca

SEQ ID NO: 3846725 - RNA, 12 nt, Shigella flexneri 2a str. 2457T
cuucccugcggu

SEQ ID NO: 3846726 - RNA, 21 nt, Shigella flexneri 2a str. 2457T
cuucccugcugaauccccuuc

SEQ ID NO: 3846727 - RNA, 18 nt, Shigella flexneri 2a str. 2457T
cuuccgcaauacagccag

SEQ ID NO: 3846728 - RNA, 22 nt, Shigella flexneri 2a str. 2457T
cuuccgcaauacagccagccag

SEQ ID NO: 3846729 - RNA, 12 nt, Shigella flexneri 2a str. 2457T
cuuccgccagcg

SEQ ID NO: 3846730 - RNA, 20 nt, Shigella flexneri 2a str. 2457T
cuuccgcuaguguacccuuc

SEQ ID NO: 3846731 - RNA, 17 nt, Shigella flexneri 2a str. 2457T
cuuccgcugacagcgcg

SEQ ID NO: 3846732 - RNA, 19 nt, Shigella flexneri 2a str. 2457T
cuuccggacguucagccau

SEQ ID NO: 3846733 - RNA, 13 nt, Shigella flexneri 2a str. 2457T
cuuccggcagacc

SEQ ID NO: 3846734 - RNA, 20 nt, Shigella flexneri 2a str. 2457T
cuuccgggauuucccggcac

SEQ ID NO: 3846735 - RNA, 17 nt, Shigella flexneri 2a str. 2457T
cuuccgguuacgccacc

SEQ ID NO: 3846736 - RNA, 20 nt, Shigella flexneri 2a str. 2457T
cuuccgguuacgccaccagc

SEQ ID NO: 3846737 - RNA, 15 nt, Shigella flexneri 2a str. 2457T
cuuccguagcggcuc

SEQ ID NO: 3846738 - RNA, 14 nt, Shigella flexneri 2a str. 2457T
cuuccgucacaggc

SEQ ID NO: 3846739 - RNA, 17 nt, Shigella flexneri 2a str. 2457T
cuuccguuuaaagagca

SEQ ID NO: 3846740 - RNA, 16 nt, Shigella flexneri 2a str. 2457T
cuuccucaaccacuuu

SEQ ID NO: 3846741 - RNA, 13 nt, Shigella flexneri 2a str. 2457T
cuuccuccagcgg

SEQ ID NO: 3846742 - RNA, 17 nt, Shigella flexneri 2a str. 2457T
cuuccuccagcgguuua

SEQ ID NO: 3846743 - RNA, 21 nt, Shigella flexneri 2a str. 2457T
cuuccuccagcgguuuaucaa

SEQ ID NO: 3846744 - RNA, 22 nt, Shigella flexneri 2a str. 2457T
cuuccuccagcgguuuaucaau

SEQ ID NO: 3846745 - RNA, 12 nt, Shigella flexneri 2a str. 2457T
cuuccucgccag

SEQ ID NO: 3846746 - RNA, 15 nt, Shigella flexneri 2a str. 2457T
cuuccucgucccaaa

SEQ ID NO: 3846747 - RNA, 20 nt, Shigella flexneri 2a str. 2457T
cuuccugcaacgagugcauc

SEQ ID NO: 3846748 - RNA, 21 nt, Shigella flexneri 2a str. 2457T
cuuccugcaacgagugcaucu

SEQ ID NO: 3846749 - RNA, 23 nt, Shigella flexneri 2a str. 2457T
cuuccugcaacgagugcaucugg

SEQ ID NO: 3846750 - RNA, 12 nt, Shigella flexneri 2a str. 2457T
cuuccugcagcu

SEQ ID NO: 3846751 - RNA, 15 nt, Shigella flexneri 2a str. 2457T
cuuccugcagcuuca

SEQ ID NO: 3846752 - RNA, 19 nt, Shigella flexneri 2a str. 2457T
cuuccugccagauccagug

SEQ ID NO: 3846753 - RNA, 19 nt, Shigella flexneri 2a str. 2457T
cuuccugcggcagacgcuc

SEQ ID NO: 3846754 - RNA, 16 nt, Shigella flexneri 2a str. 2457T
cuuccuggcgcuggcg

SEQ ID NO: 3846755 - RNA, 21 nt, Shigella flexneri 2a str. 2457T
cuuccugggauaugagcgauu

SEQ ID NO: 3846756 - RNA, 18 nt, Shigella flexneri 2a str. 2457T
cuuccuguucaucgacag

SEQ ID NO: 3846757 - RNA, 17 nt, Shigella flexneri 2a str. 2457T
cuuccuuaaucccugga

SEQ ID NO: 3846758 - RNA, 20 nt, Shigella flexneri 2a str. 2457T
cuuccuuaugcuaagccgug

SEQ ID NO: 3846759 - RNA, 12 nt, Shigella flexneri 2a str. 2457T
cuuccuucagcu

SEQ ID NO: 3846760 - RNA, 18 nt, Shigella flexneri 2a str. 2457T
cuuccuucagcucccgcu

SEQ ID NO: 3846761 - RNA, 18 nt, Shigella flexneri 2a str. 2457T
cuuccuugcguacaccaa

SEQ ID NO: 3846762 - RNA, 18 nt, Shigella flexneri 2a str. 2457T
cuuccuugcuaagcccuc

SEQ ID NO: 3846763 - RNA, 16 nt, Shigella flexneri 2a str. 2457T
cuuccuuuuuuauuua

SEQ ID NO: 3846764 - RNA, 17 nt, Shigella flexneri 2a str. 2457T
cuucgaaucuuugaguu

SEQ ID NO: 3846765 - RNA, 15 nt, Shigella flexneri 2a str. 2457T
cuucgaaugccgcag

SEQ ID NO: 3846766 - RNA, 22 nt, Shigella flexneri 2a str. 2457T
cuucgacuuucaguggcuuauc

SEQ ID NO: 3846767 - RNA, 16 nt, Shigella flexneri 2a str. 2457T
cuugccaggcuuacgc

SEQ ID NO: 3846768 - RNA, 20 nt, Shigella flexneri 2a str. 2457T
cuugccauuccacaaaaacc

SEQ ID NO: 3846769 - RNA, 15 nt, Shigella flexneri 2a str. 2457T
cuugcccaggugugu

SEQ ID NO: 3846770 - RNA, 13 nt, Shigella flexneri 2a str. 2457T
cuugccccuuccc

SEQ ID NO: 3846771 - RNA, 15 nt, Shigella flexneri 2a str. 2457T
cuugccgcgucuuau

SEQ ID NO: 3846772 - RNA, 17 nt, Shigella flexneri 2a str. 2457T
cuugccgcgucuuauca

SEQ ID NO: 3846773 - RNA, 22 nt, Shigella flexneri 2a str. 2457T
cuugccggacaugcugccucca

SEQ ID NO: 3846774 - RNA, 13 nt, Shigella flexneri 2a str. 2457T
cuugccuuuccuc

SEQ ID NO: 3846775 - RNA, 20 nt, Shigella flexneri 2a str. 2457T
cuugcgauauucuucaguau

SEQ ID NO: 3846776 - RNA, 16 nt, Shigella flexneri 2a str. 2457T
cuugcgauccugcaga

SEQ ID NO: 3846777 - RNA, 14 nt, Shigella flexneri 2a str. 2457T
cuugcggaaacugu

SEQ ID NO: 3846778 - RNA, 19 nt, Shigella flexneri 2a str. 2457T
cuugcggaagcgucaaggu

SEQ ID NO: 3846779 - RNA, 15 nt, Shigella flexneri 2a str. 2457T
cuugcggacccggcg

SEQ ID NO: 3846780 - RNA, 21 nt, Shigella flexneri 2a str. 2457T
cuugcggcaacgugcgguuuc

SEQ ID NO: 3846781 - RNA, 23 nt, Shigella flexneri 2a str. 2457T
cuugcguacaccaacaucacgca

SEQ ID NO: 3846782 - RNA, 18 nt, Shigella flexneri 2a str. 2457T
cuugcguaucgacggcgu

SEQ ID NO: 3846783 - RNA, 12 nt, Shigella flexneri 2a str. 2457T
cuugcgucacau

SEQ ID NO: 3846784 - RNA, 20 nt, Shigella flexneri 2a str. 2457T
cuugcgucauccagcacuug

SEQ ID NO: 3846785 - RNA, 16 nt, Shigella flexneri 2a str. 2457T
cuugcgucgccaguuu

SEQ ID NO: 3846786 - RNA, 20 nt, Shigella flexneri 2a str. 2457T
cuugcucaaugaguucgcgc

SEQ ID NO: 3846787 - RNA, 14 nt, Shigella flexneri 2a str. 2457T
cuugcucauccgga

SEQ ID NO: 3846788 - RNA, 14 nt, Shigella flexneri 2a str. 2457T
cuugcuccacguuc

SEQ ID NO: 3846789 - RNA, 19 nt, Shigella flexneri 2a str. 2457T
cuugcuccacguucagaga

SEQ ID NO: 3846790 - RNA, 16 nt, Shigella flexneri 2a str. 2457T
cuugcucgcgcagaua

SEQ ID NO: 3846791 - RNA, 12 nt, Shigella flexneri 2a str. 2457T
cuugcugauaac

SEQ ID NO: 3846792 - RNA, 16 nt, Shigella flexneri 2a str. 2457T
cuugcugaugcacgca

SEQ ID NO: 3846793 - RNA, 15 nt, Shigella flexneri 2a str. 2457T
cuugcugcuccagcg

SEQ ID NO: 3846794 - RNA, 21 nt, Shigella flexneri 2a str. 2457T
cuugcugcuccagcgggcgaa

SEQ ID NO: 3846795 - RNA, 17 nt, Shigella flexneri 2a str. 2457T
cuugcuguuucgccagu

SEQ ID NO: 3846796 - RNA, 14 nt, Shigella flexneri 2a str. 2457T
cuugcuuaaaaaau

SEQ ID NO: 3846797 - RNA, 20 nt, Shigella flexneri 2a str. 2457T
cuugcuuuccagcuucaaau

SEQ ID NO: 3846798 - RNA, 13 nt, Shigella flexneri 2a str. 2457T
cuugcuuugcaac

SEQ ID NO: 3846799 - RNA, 13 nt, Shigella flexneri 2a str. 2457T
cuuggcaccauua

SEQ ID NO: 3846800 - RNA, 22 nt, Shigella flexneri 2a str. 2457T
cuuggcaccauuaccgccgcua

SEQ ID NO: 3846801 - RNA, 19 nt, Shigella flexneri 2a str. 2457T
cuuggcauuaaacagccaa

SEQ ID NO: 3846802 - RNA, 22 nt, Shigella flexneri 2a str. 2457T
cuuggcgggcaacguuccagca

SEQ ID NO: 3846803 - RNA, 13 nt, Shigella flexneri 2a str. 2457T
cuuggcugggaua

SEQ ID NO: 3846804 - RNA, 12 nt, Shigella flexneri 2a str. 2457T
cuuggcuuccau

SEQ ID NO: 3846805 - RNA, 19 nt, Shigella flexneri 2a str. 2457T
cuuguacggcuccgcccca

SEQ ID NO: 3846806 - RNA, 18 nt, Shigella flexneri 2a str. 2457T
cuuguacucuacaaccag

SEQ ID NO: 3846807 - RNA, 15 nt, Shigella flexneri 2a str. 2457T
cuuguaggccugaua

SEQ ID NO: 3846808 - RNA, 16 nt, Shigella flexneri 2a str. 2457T
cuuguaggccugauaa

SEQ ID NO: 3846809 - RNA, 16 nt, Shigella flexneri 2a str. 2457T
cuugucacgucucauc

SEQ ID NO: 3846810 - RNA, 17 nt, Shigella flexneri 2a str. 2457T
cuugucaugcagcucca

SEQ ID NO: 3846811 - RNA, 13 nt, Shigella flexneri 2a str. 2457T
cuugucuacgccu

SEQ ID NO: 3846812 - RNA, 15 nt, Shigella flexneri 2a str. 2457T
cuugucugagccgaa

SEQ ID NO: 3846813 - RNA, 16 nt, Shigella flexneri 2a str. 2457T
cuugucugagccgaaa

SEQ ID NO: 3846814 - RNA, 22 nt, Shigella flexneri 2a str. 2457T
cuugucugagccgaaaaagaga

SEQ ID NO: 3846815 - RNA, 15 nt, Shigella flexneri 2a str. 2457T
cuugugcucaauuga

SEQ ID NO: 3846816 - RNA, 18 nt, Shigella flexneri 2a str. 2457T
cuuguuaccugaugcagc

SEQ ID NO: 3846817 - RNA, 12 nt, Shigella flexneri 2a str. 2457T
cuuguuaugaga

SEQ ID NO: 3846818 - RNA, 13 nt, Shigella flexneri 2a str. 2457T
cuuguuaugagau

SEQ ID NO: 3846819 - RNA, 22 nt, Shigella flexneri 2a str. 2457T
cuuguucacgccaucaucggca

SEQ ID NO: 3846820 - RNA, 16 nt, Shigella flexneri 2a str. 2457T
cuuguuccacuucauc

SEQ ID NO: 3846821 - RNA, 15 nt, Shigella flexneri 2a str. 2457T
cuuguugcaacaaaa

SEQ ID NO: 3846822 - RNA, 16 nt, Shigella flexneri 2a str. 2457T
cuuuaaaaaaagcauu

SEQ ID NO: 3846823 - RNA, 15 nt, Shigella flexneri 2a str. 2457T
cuuuaaaaaagaaua

SEQ ID NO: 3846824 - RNA, 21 nt, Shigella flexneri 2a str. 2457T
cuuuaaaaagaaaccuccgca

SEQ ID NO: 3846825 - RNA, 20 nt, Shigella flexneri 2a str. 2457T
cuuuaaacacgcgaccaaag

SEQ ID NO: 3846826 - RNA, 11 nt, Shigella flexneri 2a str. 2457T
cuuuaaacaga

SEQ ID NO: 3846827 - RNA, 22 nt, Shigella flexneri 2a str. 2457T
cuuuaaacgauuccacuuuuuc

SEQ ID NO: 3846828 - RNA, 13 nt, Shigella flexneri 2a str. 2457T
cuuuaaaggccag

SEQ ID NO: 3846829 - RNA, 20 nt, Shigella flexneri 2a str. 2457T
cuuuaaaugcugcuuuauau

SEQ ID NO: 3846830 - RNA, 23 nt, Shigella flexneri 2a str. 2457T
cuuuaaguucagccaguugaucu

SEQ ID NO: 3846831 - RNA, 15 nt, Shigella flexneri 2a str. 2457T
cuuuaauaccugccu

SEQ ID NO: 3846832 - RNA, 20 nt, Shigella flexneri 2a str. 2457T
cuuuaauauuaacgccagcc

SEQ ID NO: 3846833 - RNA, 23 nt, Shigella flexneri 2a str. 2457T
cuuuaaugccacauuagauaaaa

SEQ ID NO: 3846834 - RNA, 22 nt, Shigella flexneri 2a str. 2457T
cuuuaauuggaauacauauauu

SEQ ID NO: 3846835 - RNA, 14 nt, Shigella flexneri 2a str. 2457T
cuuuacccagcgga

SEQ ID NO: 3846836 - RNA, 17 nt, Shigella flexneri 2a str. 2457T
cuuuacccagcggaugu

SEQ ID NO: 3846837 - RNA, 17 nt, Shigella flexneri 2a str. 2457T
cuuuaccgccuuacgcu

SEQ ID NO: 3846838 - RNA, 23 nt, Shigella flexneri 2a str. 2457T
cuuuaccgccuuacgcugcauuu

SEQ ID NO: 3846839 - RNA, 11 nt, Shigella flexneri 2a str. 2457T
cuuuaccuuca

SEQ ID NO: 3846840 - RNA, 14 nt, Shigella flexneri 2a str. 2457T
cuuuaccuucaucc

SEQ ID NO: 3846841 - RNA, 20 nt, Shigella flexneri 2a str. 2457T
cuuuacgaucaucacguugg

SEQ ID NO: 3846842 - RNA, 13 nt, Shigella flexneri 2a str. 2457T
cuuuacgcaaaau

SEQ ID NO: 3846843 - RNA, 19 nt, Shigella flexneri 2a str. 2457T
cuuuauaaucccuccagca

SEQ ID NO: 3846844 - RNA, 18 nt, Shigella flexneri 2a str. 2457T
cuuuauagguggcaaaga

SEQ ID NO: 3846845 - RNA, 19 nt, Shigella flexneri 2a str. 2457T
cuuuauagugugcaaucac

SEQ ID NO: 3846846 - RNA, 20 nt, Shigella flexneri 2a str. 2457T
cuuuauagugugcaaucacu

SEQ ID NO: 3846847 - RNA, 13 nt, Shigella flexneri 2a str. 2457T
cuuuauccugacu

SEQ ID NO: 3846848 - RNA, 20 nt, Shigella flexneri 2a str. 2457T
cuuuaucgauaaauggcgca

SEQ ID NO: 3846849 - RNA, 18 nt, Shigella flexneri 2a str. 2457T
cuuuaucgccgcuggaaa

SEQ ID NO: 3846850 - RNA, 19 nt, Shigella flexneri 2a str. 2457T
cuuuaucgccgcuggaaau

SEQ ID NO: 3846851 - RNA, 20 nt, Shigella flexneri 2a str. 2457T
cuuuaucuaucaggacgaaa

SEQ ID NO: 3846852 - RNA, 17 nt, Shigella flexneri 2a str. 2457T
cuuuaugacgaucgcag

SEQ ID NO: 3846853 - RNA, 17 nt, Shigella flexneri 2a str. 2457T
cuuuauuauuuucaaua

SEQ ID NO: 3846854 - RNA, 20 nt, Shigella flexneri 2a str. 2457T
cuuuauucaccaguaaggca

SEQ ID NO: 3846855 - RNA, 23 nt, Shigella flexneri 2a str. 2457T
cuuuauucugacgccaccauuca

SEQ ID NO: 3846856 - RNA, 22 nt, Shigella flexneri 2a str. 2457T
cuuucaacagguuaacuccccc

SEQ ID NO: 3846857 - RNA, 19 nt, Shigella flexneri 2a str. 2457T
cuuucaacguagccugcca

SEQ ID NO: 3846858 - RNA, 18 nt, Shigella flexneri 2a str. 2457T
cuuucaauaccgccugca

SEQ ID NO: 3846859 - RNA, 12 nt, Shigella flexneri 2a str. 2457T
cuuucacaaggc

SEQ ID NO: 3846860 - RNA, 20 nt, Shigella flexneri 2a str. 2457T
cuuucacccggcgcuaauuc

SEQ ID NO: 3846861 - RNA, 14 nt, Shigella flexneri 2a str. 2457T
cuuucaccucuuca

SEQ ID NO: 3846862 - RNA, 17 nt, Shigella flexneri 2a str. 2457T
cuuucaccucuucauua

SEQ ID NO: 3846863 - RNA, 18 nt, Shigella flexneri 2a str. 2457T
cuuucacgaacacagugg

SEQ ID NO: 3846864 - RNA, 20 nt, Shigella flexneri 2a str. 2457T
cuuucacgcccaguccgcuc

SEQ ID NO: 3846865 - RNA, 15 nt, Shigella flexneri 2a str. 2457T
cuuuuacaagcaacu

SEQ ID NO: 3846866 - RNA, 13 nt, Shigella flexneri 2a str. 2457T
cuuuuacaucauu

SEQ ID NO: 3846867 - RNA, 14 nt, Shigella flexneri 2a str. 2457T
cuuuuacauuaucc

SEQ ID NO: 3846868 - RNA, 16 nt, Shigella flexneri 2a str. 2457T
cuuuuagcaucuuauc

SEQ ID NO: 3846869 - RNA, 22 nt, Shigella flexneri 2a str. 2457T
cuuuucaccaugggcaauccac

SEQ ID NO: 3846870 - RNA, 20 nt, Shigella flexneri 2a str. 2457T
cuuuucaguuggcugacaaa

SEQ ID NO: 3846871 - RNA, 16 nt, Shigella flexneri 2a str. 2457T
cuuuucauauuauuug

SEQ ID NO: 3846872 - RNA, 17 nt, Shigella flexneri 2a str. 2457T
cuuuucaucgcaucgau

SEQ ID NO: 3846873 - RNA, 15 nt, Shigella flexneri 2a str. 2457T
cuuuuccagcauaau

SEQ ID NO: 3846874 - RNA, 18 nt, Shigella flexneri 2a str. 2457T
cuuuuccauaucaagcau

SEQ ID NO: 3846875 - RNA, 14 nt, Shigella flexneri 2a str. 2457T
cuuuucccuccacu

SEQ ID NO: 3846876 - RNA, 18 nt, Shigella flexneri 2a str. 2457T
cuuuuccucucaugagca

SEQ ID NO: 3846877 - RNA, 23 nt, Shigella flexneri 2a str. 2457T
cuuuucgccaccggcaaucugcu

SEQ ID NO: 3846878 - RNA, 20 nt, Shigella flexneri 2a str. 2457T
cuuuucgcccuggacaacau

SEQ ID NO: 3846879 - RNA, 16 nt, Shigella flexneri 2a str. 2457T
cuuuucgucaggauua

SEQ ID NO: 3846880 - RNA, 20 nt, Shigella flexneri 2a str. 2457T
cuuuucguuuugguccuggu

SEQ ID NO: 3846881 - RNA, 21 nt, Shigella flexneri 2a str. 2457T
cuuuucguuuugguccugguc

SEQ ID NO: 3846882 - RNA, 21 nt, Shigella flexneri 2a str. 2457T
cuuuucuaccaccaaaaccac

SEQ ID NO: 3846883 - RNA, 21 nt, Shigella flexneri 2a str. 2457T
cuuuucugaaguacacauaaa

SEQ ID NO: 3846884 - RNA, 19 nt, Shigella flexneri 2a str. 2457T
cuuuugaacuuuaagcuga

SEQ ID NO: 3846885 - RNA, 22 nt, Shigella flexneri 2a str. 2457T
cuuuugaggauuaugcccgcag

SEQ ID NO: 3846886 - RNA, 20 nt, Shigella flexneri 2a str. 2457T
cuuuugauacucugucugau

SEQ ID NO: 3846887 - RNA, 12 nt, Shigella flexneri 2a str. 2457T
cuuuugccagaa

SEQ ID NO: 3846888 - RNA, 21 nt, Shigella flexneri 2a str. 2457T
cuuuugcgccacuaacgcauu

SEQ ID NO: 3846889 - RNA, 22 nt, Shigella flexneri 2a str. 2457T
cuuuuggcgcguuccccuguug

SEQ ID NO: 3846890 - RNA, 18 nt, Shigella flexneri 2a str. 2457T
cuuuuggugcuuuugcug

SEQ ID NO: 3846891 - RNA, 20 nt, Shigella flexneri 2a str. 2457T
cuuuuuacccauggucaucu

SEQ ID NO: 3846892 - RNA, 17 nt, Shigella flexneri 2a str. 2457T
cuuuuuaccuucauuug

SEQ ID NO: 3846893 - RNA, 23 nt, Shigella flexneri 2a str. 2457T
cuuuuuagggccgcaucugcgau

SEQ ID NO: 3846894 - RNA, 19 nt, Shigella flexneri 2a str. 2457T
cuuuuucaauuccauuucc

SEQ ID NO: 3846895 - RNA, 20 nt, Shigella flexneri 2a str. 2457T
cuuuuuccacuuccaccagc

SEQ ID NO: 3846896 - RNA, 20 nt, Shigella flexneri 2a str. 2457T
cuuuuuccaguccacguuca

SEQ ID NO: 3846897 - RNA, 20 nt, Shigella flexneri 2a str. 2457T
cuuuuucccugguaaaaaau

SEQ ID NO: 3846898 - RNA, 17 nt, Shigella flexneri 2a str. 2457T
cuuuuucgaucacuuuu

SEQ ID NO: 3846899 - RNA, 20 nt, Shigella flexneri 2a str. 2457T
cuuuuugaacggguugcggu

SEQ ID NO: 3846900 - RNA, 17 nt, Shigella flexneri 2a str. 2457T
cuuuuugcauuuccgcu

SEQ ID NO: 3846901 - RNA, 12 nt, Shigella flexneri 2a str. 2457T
cuuuuugcucuc

SEQ ID NO: 3846902 - RNA, 20 nt, Shigella flexneri 2a str. 2457T
cuuuuugguaggcguccugc

SEQ ID NO: 3846903 - RNA, 15 nt, Shigella flexneri 2a str. 2457T
cuuuuugguucaucg

SEQ ID NO: 3846904 - RNA, 20 nt, Shigella flexneri 2a str. 2457T
cuuuuugugcuuaucgcgau

SEQ ID NO: 3846905 - RNA, 12 nt, Shigella flexneri 2a str. 2457T
cuuuuuuaaaca

SEQ ID NO: 3846906 - RNA, 16 nt, Shigella flexneri 2a str. 2457T
cuuuuuuacaucauca

SEQ ID NO: 3846907 - RNA, 14 nt, Shigella flexneri 2a str. 2457T
cuuuuuuauggaau

SEQ ID NO: 3846908 - RNA, 15 nt, Shigella flexneri 2a str. 2457T
cuuuuuuauuuuuua

SEQ ID NO: 3846909 - RNA, 20 nt, Shigella flexneri 2a str. 2457T
cuuuuuucaauucucuaauc

SEQ ID NO: 3846910 - RNA, 21 nt, Shigella flexneri 2a str. 2457T
cuuuuuucauggguaccagau

SEQ ID NO: 3846911 - RNA, 15 nt, Shigella flexneri 2a str. 2457T
cuuuuuucgcugucg

SEQ ID NO: 3846912 - RNA, 22 nt, Shigella flexneri 2a str. 2457T
cuuuuuugagcagcauuaccug

SEQ ID NO: 3846913 - RNA, 16 nt, Shigella flexneri 2a str. 2457T
cuuuuuuugccccaga

SEQ ID NO: 3846914 - RNA, 22 nt, Shigella flexneri 2a str. 2457T
cuuuuuuuugccaaauaucuua

SEQ ID NO: 3846915 - RNA, 21 nt, Shigella flexneri 2a str. 2457T
gaaaaaaaauuacaaaaagug

SEQ ID NO: 3846916 - RNA, 15 nt, Shigella flexneri 2a str. 2457T
gaaaaaacagcaggg

SEQ ID NO: 3846917 - RNA, 13 nt, Shigella flexneri 2a str. 2457T
gaaaaaaccagaa

SEQ ID NO: 3846918 - RNA, 14 nt, Shigella flexneri 2a str. 2457T
gaaaaaaucccacu

SEQ ID NO: 3846919 - RNA, 14 nt, Shigella flexneri 2a str. 2457T
gaaaaaaugaugau

SEQ ID NO: 3846920 - RNA, 18 nt, Shigella flexneri 2a str. 2457T
gaaaaacacaaaguaaac

SEQ ID NO: 3846921 - RNA, 18 nt, Shigella flexneri 2a str. 2457T
gaaaaaccaaucucccag

SEQ ID NO: 3846922 - RNA, 16 nt, Shigella flexneri 2a str. 2457T
gaaaaaccagacagca

SEQ ID NO: 3846923 - RNA, 15 nt, Shigella flexneri 2a str. 2457T
gaaaaaccugacguu

SEQ ID NO: 3846924 - RNA, 17 nt, Shigella flexneri 2a str. 2457T
gaaaaacucuccucguu

SEQ ID NO: 3846925 - RNA, 12 nt, Shigella flexneri 2a str. 2457T
gaaaaacugccc

SEQ ID NO: 3846926 - RNA, 15 nt, Shigella flexneri 2a str. 2457T
gaaaaacuuaauccu

SEQ ID NO: 3846927 - RNA, 18 nt, Shigella flexneri 2a str. 2457T
gaaaaagagcagcugauu

SEQ ID NO: 3846928 - RNA, 16 nt, Shigella flexneri 2a str. 2457T
gaaaaagcgaagcggc

SEQ ID NO: 3846929 - RNA, 19 nt, Shigella flexneri 2a str. 2457T
gaaaaaguucgacuuaaau

SEQ ID NO: 3846930 - RNA, 13 nt, Shigella flexneri 2a str. 2457T
gaaaaauagcauu

SEQ ID NO: 3846931 - RNA, 22 nt, Shigella flexneri 2a str. 2457T
gaaaaaucaauauuuucaaucu

SEQ ID NO: 3846932 - RNA, 19 nt, Shigella flexneri 2a str. 2457T
gaaaaaucacauaaauucu

SEQ ID NO: 3846933 - RNA, 23 nt, Shigella flexneri 2a str. 2457T
gaaaaaugaauaccaagucucaa

SEQ ID NO: 3846934 - RNA, 20 nt, Shigella flexneri 2a str. 2457T
gaaaacaauuacgccgagcg

SEQ ID NO: 3846935 - RNA, 22 nt, Shigella flexneri 2a str. 2457T
gaaaacagcgcaccagaaacaa

SEQ ID NO: 3846936 - RNA, 23 nt, Shigella flexneri 2a str. 2457T
gaaaacagcgcaccagaaacaau

SEQ ID NO: 3846937 - RNA, 16 nt, Shigella flexneri 2a str. 2457T
gaaaacaucaugguuu

SEQ ID NO: 3846938 - RNA, 14 nt, Shigella flexneri 2a str. 2457T
gaaaacccggccug

SEQ ID NO: 3846939 - RNA, 20 nt, Shigella flexneri 2a str. 2457T
gaaaacccucgaccaucucc

SEQ ID NO: 3846940 - RNA, 15 nt, Shigella flexneri 2a str. 2457T
gaaaaccgaugcagu

SEQ ID NO: 3846941 - RNA, 14 nt, Shigella flexneri 2a str. 2457T
gaaaacgaaagcgc

SEQ ID NO: 3846942 - RNA, 15 nt, Shigella flexneri 2a str. 2457T
gaaaacgaaagcgcc

SEQ ID NO: 3846943 - RNA, 15 nt, Shigella flexneri 2a str. 2457T
gaaaacgaaggccgg

SEQ ID NO: 3846944 - RNA, 15 nt, Shigella flexneri 2a str. 2457T
gaaaacgcauaccag

SEQ ID NO: 3846945 - RNA, 14 nt, Shigella flexneri 2a str. 2457T
gaaaacgcccggca

SEQ ID NO: 3846946 - RNA, 22 nt, Shigella flexneri 2a str. 2457T
gaaaacgccggagugaaaauuc

SEQ ID NO: 3846947 - RNA, 23 nt, Shigella flexneri 2a str. 2457T
gaaaacgccggagugaaaauucu

SEQ ID NO: 3846948 - RNA, 21 nt, Shigella flexneri 2a str. 2457T
gaaaacguuucaaacaggcug

SEQ ID NO: 3846949 - RNA, 19 nt, Shigella flexneri 2a str. 2457T
gaaaacguuucaaccugca

SEQ ID NO: 3846950 - RNA, 13 nt, Shigella flexneri 2a str. 2457T
gaaaacucuuagc

SEQ ID NO: 3846951 - RNA, 19 nt, Shigella flexneri 2a str. 2457T
gaaaagcgagaguuacagc

SEQ ID NO: 3846952 - RNA, 16 nt, Shigella flexneri 2a str. 2457T
gaaaagcuucuuccuc

SEQ ID NO: 3846953 - RNA, 13 nt, Shigella flexneri 2a str. 2457T
gaaaaggcggcgc

SEQ ID NO: 3846954 - RNA, 17 nt, Shigella flexneri 2a str. 2457T
gaaaagguacuccuccc

SEQ ID NO: 3846955 - RNA, 17 nt, Shigella flexneri 2a str. 2457T
gaaaagguagaauaagg

SEQ ID NO: 3846956 - RNA, 16 nt, Shigella flexneri 2a str. 2457T
gaaaauaaaaaacauu

SEQ ID NO: 3846957 - RNA, 17 nt, Shigella flexneri 2a str. 2457T
gaaaauaaaauguacau

SEQ ID NO: 3846958 - RNA, 13 nt, Shigella flexneri 2a str. 2457T
gaaaauacagcaa

SEQ ID NO: 3846959 - RNA, 12 nt, Shigella flexneri 2a str. 2457T
gaaaauaucggu

SEQ ID NO: 3846960 - RNA, 13 nt, Shigella flexneri 2a str. 2457T
gaaaaucaccauu

SEQ ID NO: 3846961 - RNA, 12 nt, Shigella flexneri 2a str. 2457T
gaaaaucaucuu

SEQ ID NO: 3846962 - RNA, 16 nt, Shigella flexneri 2a str. 2457T
gaaaaucgacaauaug

SEQ ID NO: 3846963 - RNA, 21 nt, Shigella flexneri 2a str. 2457T
gaaaaucucaauguauucccg

SEQ ID NO: 3846964 - RNA, 17 nt, Shigella flexneri 2a str. 2457T
gaaaaucucauaucccc

SEQ ID NO: 3846965 - RNA, 20 nt, Shigella flexneri 2a str. 2457T
gaaaaucugaauuguuuuuc

SEQ ID NO: 3846966 - RNA, 14 nt, Shigella flexneri 2a str. 2457T
gaaaaucuucucuc

SEQ ID NO: 3846967 - RNA, 23 nt, Shigella flexneri 2a str. 2457T
gaaaaugcccauggcaagaauaa

SEQ ID NO: 3846968 - RNA, 15 nt, Shigella flexneri 2a str. 2457T
gaaaauggccagcca

SEQ ID NO: 3846969 - RNA, 18 nt, Shigella flexneri 2a str. 2457T
gaaaauggccagccagca

SEQ ID NO: 3846970 - RNA, 19 nt, Shigella flexneri 2a str. 2457T
gaaaaugggagcugggagu

SEQ ID NO: 3846971 - RNA, 16 nt, Shigella flexneri 2a str. 2457T
gaaaaugggcaucagu

SEQ ID NO: 3846972 - RNA, 22 nt, Shigella flexneri 2a str. 2457T
gaaaaugggcaucaguaugaau

SEQ ID NO: 3846973 - RNA, 13 nt, Shigella flexneri 2a str. 2457T
gaaaauuauaucu

SEQ ID NO: 3846974 - RNA, 19 nt, Shigella flexneri 2a str. 2457T
gaaaauuauuuuaaauuuc

SEQ ID NO: 3846975 - RNA, 18 nt, Shigella flexneri 2a str. 2457T
gaaaauucuccggcguuu

SEQ ID NO: 3846976 - RNA, 14 nt, Shigella flexneri 2a str. 2457T
gaaacaaacgcaaa

SEQ ID NO: 3846977 - RNA, 16 nt, Shigella flexneri 2a str. 2457T
gaaacagaaaauuacg

SEQ ID NO: 3846978 - RNA, 22 nt, Shigella flexneri 2a str. 2457T
gaaacaggcgacgcguccgguu

SEQ ID NO: 3846979 - RNA, 23 nt, Shigella flexneri 2a str. 2457T
gaaacagguggcguuugccaccu

SEQ ID NO: 3846980 - RNA, 19 nt, Shigella flexneri 2a str. 2457T
gaaacagugauuucuucau

SEQ ID NO: 3846981 - RNA, 16 nt, Shigella flexneri 2a str. 2457T
gaaaccaaacuuaugc

SEQ ID NO: 3846982 - RNA, 21 nt, Shigella flexneri 2a str. 2457T
gaaaccaaacuuaugcagcug

SEQ ID NO: 3846983 - RNA, 20 nt, Shigella flexneri 2a str. 2457T
gaaaccaacuccagcggcgc

SEQ ID NO: 3846984 - RNA, 22 nt, Shigella flexneri 2a str. 2457T
gaaaccauguccauuuccggau

SEQ ID NO: 3846985 - RNA, 13 nt, Shigella flexneri 2a str. 2457T
gaaacccaacgca

SEQ ID NO: 3846986 - RNA, 13 nt, Shigella flexneri 2a str. 2457T
gaaaccgaaguug

SEQ ID NO: 3846987 - RNA, 12 nt, Shigella flexneri 2a str. 2457T
gaaaccuccgca

SEQ ID NO: 3846988 - RNA, 14 nt, Shigella flexneri 2a str. 2457T
gaaaccuccgcauu

SEQ ID NO: 3846989 - RNA, 14 nt, Shigella flexneri 2a str. 2457T
gaaaccuggauauu

SEQ ID NO: 3846990 - RNA, 14 nt, Shigella flexneri 2a str. 2457T
gaaacgauacccac

SEQ ID NO: 3846991 - RNA, 16 nt, Shigella flexneri 2a str. 2457T
gaaacgauuaauuaca

SEQ ID NO: 3846992 - RNA, 22 nt, Shigella flexneri 2a str. 2457T
gaaacgccaccauuuuacgucc

SEQ ID NO: 3846993 - RNA, 18 nt, Shigella flexneri 2a str. 2457T
gaaacgcucauaaauugc

SEQ ID NO: 3846994 - RNA, 17 nt, Shigella flexneri 2a str. 2457T
gaaacggaaaucgccga

SEQ ID NO: 3846995 - RNA, 19 nt, Shigella flexneri 2a str. 2457T
gaaacgggcugauuucacc

SEQ ID NO: 3846996 - RNA, 15 nt, Shigella flexneri 2a str. 2457T
gaaacgucaaauaau

SEQ ID NO: 3846997 - RNA, 13 nt, Shigella flexneri 2a str. 2457T
gaaacucacgcag

SEQ ID NO: 3846998 - RNA, 15 nt, Shigella flexneri 2a str. 2457T
gaaacucacgccagc

SEQ ID NO: 3846999 - RNA, 15 nt, Shigella flexneri 2a str. 2457T
gaaacucauaugcag

SEQ ID NO: 3847000 - RNA, 13 nt, Shigella flexneri 2a str. 2457T
gaaacucgcguaa

SEQ ID NO: 3847001 - RNA, 18 nt, Shigella flexneri 2a str. 2457T
gaaacucgcguaaaucca

SEQ ID NO: 3847002 - RNA, 16 nt, Shigella flexneri 2a str. 2457T
gaaacucgcugccagc

SEQ ID NO: 3847003 - RNA, 18 nt, Shigella flexneri 2a str. 2457T
gaaacucgcugccagcac

SEQ ID NO: 3847004 - RNA, 18 nt, Shigella flexneri 2a str. 2457T
gaaacugacuguuucacc

SEQ ID NO: 3847005 - RNA, 14 nt, Shigella flexneri 2a str. 2457T
gaaacugauaauuu

SEQ ID NO: 3847006 - RNA, 12 nt, Shigella flexneri 2a str. 2457T
gaaacuuauuca

SEQ ID NO: 3847007 - RNA, 18 nt, Shigella flexneri 2a str. 2457T
gaaacuucacaucaccau

SEQ ID NO: 3847008 - RNA, 24 nt, Shigella flexneri 2a str. 2457T
gaaagaaaaucaauccaguguaaa

SEQ ID NO: 3847009 - RNA, 22 nt, Shigella flexneri 2a str. 2457T
gaaagacgguuaaugcguuuug

SEQ ID NO: 3847010 - RNA, 18 nt, Shigella flexneri 2a str. 2457T
gaaagagcaacccacugg

SEQ ID NO: 3847011 - RNA, 14 nt, Shigella flexneri 2a str. 2457T
gaaagaggcggaua

SEQ ID NO: 3847012 - RNA, 21 nt, Shigella flexneri 2a str. 2457T
gaaagagggcauucuuaccgg

SEQ ID NO: 3847013 - RNA, 13 nt, Shigella flexneri 2a str. 2457T
gaaagaucgccac

SEQ ID NO: 3847014 - RNA, 21 nt, Shigella flexneri 2a str. 2457T
gaaagauggcgcgcagaaaga

SEQ ID NO: 3847015 - RNA, 19 nt, Shigella flexneri 2a str. 2457T
gaaagcaauuaacagugac

SEQ ID NO: 3847016 - RNA, 20 nt, Shigella flexneri 2a str. 2457T
gaaagcaauuaacagugaca

SEQ ID NO: 3847017 - RNA, 17 nt, Shigella flexneri 2a str. 2457T
gaaagcaccugcgcagg

SEQ ID NO: 3847018 - RNA, 20 nt, Shigella flexneri 2a str. 2457T
gaaagcaccugcgcaggcau

SEQ ID NO: 3847019 - RNA, 18 nt, Shigella flexneri 2a str. 2457T
gaaagcagcauguagaug

SEQ ID NO: 3847020 - RNA, 17 nt, Shigella flexneri 2a str. 2457T
gaaagcagcgaugcuuu

SEQ ID NO: 3847021 - RNA, 19 nt, Shigella flexneri 2a str. 2457T
gaaagcauaguuuuuacaa

SEQ ID NO: 3847022 - RNA, 15 nt, Shigella flexneri 2a str. 2457T
gaaagcccaucaucc

SEQ ID NO: 3847023 - RNA, 20 nt, Shigella flexneri 2a str. 2457T
gaaagcgacuuugccuggcg

SEQ ID NO: 3847024 - RNA, 19 nt, Shigella flexneri 2a str. 2457T
gaaagcgccagcaagagca

SEQ ID NO: 3847025 - RNA, 23 nt, Shigella flexneri 2a str. 2457T
gaaagcggaucaguuccagcagc

SEQ ID NO: 3847026 - RNA, 15 nt, Shigella flexneri 2a str. 2457T
gaaagcggcguuuug

SEQ ID NO: 3847027 - RNA, 20 nt, Shigella flexneri 2a str. 2457T
gaaagcguauccaucacuaa

SEQ ID NO: 3847028 - RNA, 19 nt, Shigella flexneri 2a str. 2457T
gaaagcgucagcuuucaga

SEQ ID NO: 3847029 - RNA, 20 nt, Shigella flexneri 2a str. 2457T
gaaagcgucagcuuucagag

SEQ ID NO: 3847030 - RNA, 14 nt, Shigella flexneri 2a str. 2457T
gaaagcucauaacg

SEQ ID NO: 3847031 - RNA, 22 nt, Shigella flexneri 2a str. 2457T
gaaagcugcugaccaccagcac

SEQ ID NO: 3847032 - RNA, 16 nt, Shigella flexneri 2a str. 2457T
gaaagcuucaggcacc

SEQ ID NO: 3847033 - RNA, 17 nt, Shigella flexneri 2a str. 2457T
gaaaggaucacaauaau

SEQ ID NO: 3847034 - RNA, 20 nt, Shigella flexneri 2a str. 2457T
gaaaggcguuguccuuacca

SEQ ID NO: 3847035 - RNA, 12 nt, Shigella flexneri 2a str. 2457T
gaaagggaagaa

SEQ ID NO: 3847036 - RNA, 15 nt, Shigella flexneri 2a str. 2457T
gaaagggcaaauaau

SEQ ID NO: 3847037 - RNA, 14 nt, Shigella flexneri 2a str. 2457T
gaaaguaaaaaaga

SEQ ID NO: 3847038 - RNA, 20 nt, Shigella flexneri 2a str. 2457T
gaaaguaaaaaagaaggaaa

SEQ ID NO: 3847039 - RNA, 22 nt, Shigella flexneri 2a str. 2457T
gaaaguacuucacaaucagcgc

SEQ ID NO: 3847040 - RNA, 15 nt, Shigella flexneri 2a str. 2457T
gaaaguauuugacug

SEQ ID NO: 3847041 - RNA, 15 nt, Shigella flexneri 2a str. 2457T
gaaagucauaucagc

SEQ ID NO: 3847042 - RNA, 17 nt, Shigella flexneri 2a str. 2457T
gaaagucguaggccuga

SEQ ID NO: 3847043 - RNA, 16 nt, Shigella flexneri 2a str. 2457T
gaaagugacagcccgg

SEQ ID NO: 3847044 - RNA, 18 nt, Shigella flexneri 2a str. 2457T
gaaagugacagcccggca

SEQ ID NO: 3847045 - RNA, 15 nt, Shigella flexneri 2a str. 2457T
gaaagugaguuuugc

SEQ ID NO: 3847046 - RNA, 22 nt, Shigella flexneri 2a str. 2457T
gaaagugccggauguuugcauc

SEQ ID NO: 3847047 - RNA, 17 nt, Shigella flexneri 2a str. 2457T
gaaaguguaaagcaggu

SEQ ID NO: 3847048 - RNA, 20 nt, Shigella flexneri 2a str. 2457T
gaaaguguaaagcaggugcc

SEQ ID NO: 3847049 - RNA, 15 nt, Shigella flexneri 2a str. 2457T
gaaaguuguuuuuug

SEQ ID NO: 3847050 - RNA, 23 nt, Shigella flexneri 2a str. 2457T
gaaaguuuuucaacaccaugaca

SEQ ID NO: 3847051 - RNA, 14 nt, Shigella flexneri 2a str. 2457T
gaaauaaaccgcgc

SEQ ID NO: 3847052 - RNA, 22 nt, Shigella flexneri 2a str. 2457T
gaaauaacugcuauucaccagc

SEQ ID NO: 3847053 - RNA, 18 nt, Shigella flexneri 2a str. 2457T
gaaauacagguccccgcu

SEQ ID NO: 3847054 - RNA, 15 nt, Shigella flexneri 2a str. 2457T
gaaauaccagguugc

SEQ ID NO: 3847055 - RNA, 17 nt, Shigella flexneri 2a str. 2457T
gaaauacguaggccuga

SEQ ID NO: 3847056 - RNA, 18 nt, Shigella flexneri 2a str. 2457T
gaaauagaacaguuacgc

SEQ ID NO: 3847057 - RNA, 14 nt, Shigella flexneri 2a str. 2457T
gaaauauauucccc

SEQ ID NO: 3847058 - RNA, 22 nt, Shigella flexneri 2a str. 2457T
gaaauauccagcggaucaagaa

SEQ ID NO: 3847059 - RNA, 15 nt, Shigella flexneri 2a str. 2457T
gaaccguaaacagau

SEQ ID NO: 3847060 - RNA, 14 nt, Shigella flexneri 2a str. 2457T
gaaccguacagcau

SEQ ID NO: 3847061 - RNA, 15 nt, Shigella flexneri 2a str. 2457T
gaaccgugucgccau

SEQ ID NO: 3847062 - RNA, 19 nt, Shigella flexneri 2a str. 2457T
gaaccuccauguccagcuu

SEQ ID NO: 3847063 - RNA, 17 nt, Shigella flexneri 2a str. 2457T
gaaccucgcggcugccc

SEQ ID NO: 3847064 - RNA, 17 nt, Shigella flexneri 2a str. 2457T
gaaccugugacagcagc

SEQ ID NO: 3847065 - RNA, 18 nt, Shigella flexneri 2a str. 2457T
gaaccugugacagcagcg

SEQ ID NO: 3847066 - RNA, 22 nt, Shigella flexneri 2a str. 2457T
gaacgagaaaagccaaccugcg

SEQ ID NO: 3847067 - RNA, 16 nt, Shigella flexneri 2a str. 2457T
gaacgagaaaaugacg

SEQ ID NO: 3847068 - RNA, 20 nt, Shigella flexneri 2a str. 2457T
gaacgagaaaaugacgauga

SEQ ID NO: 3847069 - RNA, 19 nt, Shigella flexneri 2a str. 2457T
gaacgcaaucaaauaccac

SEQ ID NO: 3847070 - RNA, 16 nt, Shigella flexneri 2a str. 2457T
gaacgcaccgaccauc

SEQ ID NO: 3847071 - RNA, 15 nt, Shigella flexneri 2a str. 2457T
gaacgcagcgucuca

SEQ ID NO: 3847072 - RNA, 17 nt, Shigella flexneri 2a str. 2457T
gaacgccaaauucuuua

SEQ ID NO: 3847073 - RNA, 15 nt, Shigella flexneri 2a str. 2457T
gaacgccuaauccag

SEQ ID NO: 3847074 - RNA, 16 nt, Shigella flexneri 2a str. 2457T
gaacgccuuauccggc

SEQ ID NO: 3847075 - RNA, 17 nt, Shigella flexneri 2a str. 2457T
gaacgccuuauccggcc

SEQ ID NO: 3847076 - RNA, 16 nt, Shigella flexneri 2a str. 2457T
gaacgccuucgccauc

SEQ ID NO: 3847077 - RNA, 15 nt, Shigella flexneri 2a str. 2457T
gaacgcggcccaggc

SEQ ID NO: 3847078 - RNA, 20 nt, Shigella flexneri 2a str. 2457T
gaacgcggcccaggcggcgu

SEQ ID NO: 3847079 - RNA, 17 nt, Shigella flexneri 2a str. 2457T
gaacgcguucacugccg

SEQ ID NO: 3847080 - RNA, 19 nt, Shigella flexneri 2a str. 2457T
gaacgcguucacugccgua

SEQ ID NO: 3847081 - RNA, 16 nt, Shigella flexneri 2a str. 2457T
gaacgcuggcggcagg

SEQ ID NO: 3847082 - RNA, 19 nt, Shigella flexneri 2a str. 2457T
gaacgcuuuugcaucggca

SEQ ID NO: 3847083 - RNA, 19 nt, Shigella flexneri 2a str. 2457T
gaacggauagagcgcggcg

SEQ ID NO: 3847084 - RNA, 21 nt, Shigella flexneri 2a str. 2457T
gaacggauagagcgcggcgca

SEQ ID NO: 3847085 - RNA, 18 nt, Shigella flexneri 2a str. 2457T
gaacggauaucgagaauc

SEQ ID NO: 3847086 - RNA, 20 nt, Shigella flexneri 2a str. 2457T
gaacggauaucgagaaucac

SEQ ID NO: 3847087 - RNA, 15 nt, Shigella flexneri 2a str. 2457T
gaacggauucaguga

SEQ ID NO: 3847088 - RNA, 21 nt, Shigella flexneri 2a str. 2457T
gaacggcaauaccugaccguu

SEQ ID NO: 3847089 - RNA, 15 nt, Shigella flexneri 2a str. 2457T
gaacggcagagaaac

SEQ ID NO: 3847090 - RNA, 23 nt, Shigella flexneri 2a str. 2457T
gaacggcagauccaaaccgacug

SEQ ID NO: 3847091 - RNA, 13 nt, Shigella flexneri 2a str. 2457T
gaacggcggcggc

SEQ ID NO: 3847092 - RNA, 20 nt, Shigella flexneri 2a str. 2457T
gaacggcuucgccuccuguu

SEQ ID NO: 3847093 - RNA, 18 nt, Shigella flexneri 2a str. 2457T
gaacgggagaaacccggc

SEQ ID NO: 3847094 - RNA, 18 nt, Shigella flexneri 2a str. 2457T
gaacgggauugccagcau

SEQ ID NO: 3847095 - RNA, 22 nt, Shigella flexneri 2a str. 2457T
gaacgggucacgacucaggaac

SEQ ID NO: 3847096 - RNA, 20 nt, Shigella flexneri 2a str. 2457T
gaacgggugauuaaagaaaa

SEQ ID NO: 3847097 - RNA, 21 nt, Shigella flexneri 2a str. 2457T
gaacgggugauuaaagaaaau

SEQ ID NO: 3847098 - RNA, 15 nt, Shigella flexneri 2a str. 2457T
gaacgggugauuucc

SEQ ID NO: 3847099 - RNA, 20 nt, Shigella flexneri 2a str. 2457T
gaacgguucuugaaaaucaa

SEQ ID NO: 3847100 - RNA, 19 nt, Shigella flexneri 2a str. 2457T
gaacguaacaguacaauau

SEQ ID NO: 3847101 - RNA, 14 nt, Shigella flexneri 2a str. 2457T
gaacguaggcugga

SEQ ID NO: 3847102 - RNA, 13 nt, Shigella flexneri 2a str. 2457T
gaacgugcauauu

SEQ ID NO: 3847103 - RNA, 19 nt, Shigella flexneri 2a str. 2457T
gaacgugccaggguggcuc

SEQ ID NO: 3847104 - RNA, 20 nt, Shigella flexneri 2a str. 2457T
gaacguuacaaucugcgcug

SEQ ID NO: 3847105 - RNA, 22 nt, Shigella flexneri 2a str. 2457T
gaacguuacaaucugcgcugga

SEQ ID NO: 3847106 - RNA, 18 nt, Shigella flexneri 2a str. 2457T
gaacguugccugauuuua

SEQ ID NO: 3847107 - RNA, 19 nt, Shigella flexneri 2a str. 2457T
gaacuacguuccauggcag

SEQ ID NO: 3847108 - RNA, 12 nt, Shigella flexneri 2a str. 2457T
gaacuauauccc

SEQ ID NO: 3847109 - RNA, 19 nt, Shigella flexneri 2a str. 2457T
gaacuauauucucaaaaua

SEQ ID NO: 3847110 - RNA, 18 nt, Shigella flexneri 2a str. 2457T
gaacuauuggucuggaac

SEQ ID NO: 3847111 - RNA, 14 nt, Shigella flexneri 2a str. 2457T
gaacucaaaccauu

SEQ ID NO: 3847112 - RNA, 15 nt, Shigella flexneri 2a str. 2457T
gaacucacagggcug

SEQ ID NO: 3847113 - RNA, 18 nt, Shigella flexneri 2a str. 2457T
gaacucacagggcugcug

SEQ ID NO: 3847114 - RNA, 20 nt, Shigella flexneri 2a str. 2457T
gaacucaggcugccagauca

SEQ ID NO: 3847115 - RNA, 22 nt, Shigella flexneri 2a str. 2457T
gaacucaggcugccagaucauc

SEQ ID NO: 3847116 - RNA, 15 nt, Shigella flexneri 2a str. 2457T
gaacucgaggauaaa

SEQ ID NO: 3847117 - RNA, 20 nt, Shigella flexneri 2a str. 2457T
gaacucgaggauaaauuuuc

SEQ ID NO: 3847118 - RNA, 22 nt, Shigella flexneri 2a str. 2457T
gaacucguucagcgcauuccag

SEQ ID NO: 3847119 - RNA, 14 nt, Shigella flexneri 2a str. 2457T
gaacucuuccggca

SEQ ID NO: 3847120 - RNA, 17 nt, Shigella flexneri 2a str. 2457T
gaacucuucuuccggca

SEQ ID NO: 3847121 - RNA, 13 nt, Shigella flexneri 2a str. 2457T
gaacugaagcuga

SEQ ID NO: 3847122 - RNA, 11 nt, Shigella flexneri 2a str. 2457T
gaacugacagc

SEQ ID NO: 3847123 - RNA, 19 nt, Shigella flexneri 2a str. 2457T
gaacugacuuccacuuccu

SEQ ID NO: 3847124 - RNA, 21 nt, Shigella flexneri 2a str. 2457T
gaacugauaacgcauuucaug

SEQ ID NO: 3847125 - RNA, 14 nt, Shigella flexneri 2a str. 2457T
gaacugcaacucac

SEQ ID NO: 3847126 - RNA, 17 nt, Shigella flexneri 2a str. 2457T
gaacugcaacucaccuu

SEQ ID NO: 3847127 - RNA, 19 nt, Shigella flexneri 2a str. 2457T
gaacugcgguaauccgggu

SEQ ID NO: 3847128 - RNA, 15 nt, Shigella flexneri 2a str. 2457T
gaacuggcaggaaac

SEQ ID NO: 3847129 - RNA, 15 nt, Shigella flexneri 2a str. 2457T
gaacuggcuuucaca

SEQ ID NO: 3847130 - RNA, 20 nt, Shigella flexneri 2a str. 2457T
gaacugggaaggaaugacga

SEQ ID NO: 3847131 - RNA, 15 nt, Shigella flexneri 2a str. 2457T
gaacugggcgcggcc

SEQ ID NO: 3847132 - RNA, 15 nt, Shigella flexneri 2a str. 2457T
gaacuguagacaaaa

SEQ ID NO: 3847133 - RNA, 23 nt, Shigella flexneri 2a str. 2457T
gaacuguuaucgcagggagccac

SEQ ID NO: 3847134 - RNA, 19 nt, Shigella flexneri 2a str. 2457T
gaacuucauaugcgccaga

SEQ ID NO: 3847135 - RNA, 14 nt, Shigella flexneri 2a str. 2457T
gaacuuccgggauc

SEQ ID NO: 3847136 - RNA, 16 nt, Shigella flexneri 2a str. 2457T
gaacuucgcagccgug

SEQ ID NO: 3847137 - RNA, 17 nt, Shigella flexneri 2a str. 2457T
gaacuugcucauccgga

SEQ ID NO: 3847138 - RNA, 17 nt, Shigella flexneri 2a str. 2457T
gaacuuucucccgaaaa

SEQ ID NO: 3847139 - RNA, 19 nt, Shigella flexneri 2a str. 2457T
gaacuuuuugauagccacu

SEQ ID NO: 3847140 - RNA, 18 nt, Shigella flexneri 2a str. 2457T
gaagaaaaauauaaaccg

SEQ ID NO: 3847141 - RNA, 14 nt, Shigella flexneri 2a str. 2457T
gaagaaaccgauga

SEQ ID NO: 3847142 - RNA, 13 nt, Shigella flexneri 2a str. 2457T
gaagaaaccgcua

SEQ ID NO: 3847143 - RNA, 12 nt, Shigella flexneri 2a str. 2457T
gaagaaagcaau

SEQ ID NO: 3847144 - RNA, 12 nt, Shigella flexneri 2a str. 2457T
gaagaaaucagu

SEQ ID NO: 3847145 - RNA, 20 nt, Shigella flexneri 2a str. 2457T
gaagaaaucccccagcauca

SEQ ID NO: 3847146 - RNA, 13 nt, Shigella flexneri 2a str. 2457T
gaagaaccacaga

SEQ ID NO: 3847147 - RNA, 17 nt, Shigella flexneri 2a str. 2457T
gaagaacugcuggaagc

SEQ ID NO: 3847148 - RNA, 13 nt, Shigella flexneri 2a str. 2457T
gaagaagaaguuu

SEQ ID NO: 3847149 - RNA, 13 nt, Shigella flexneri 2a str. 2457T
gaagaaguaaaac

SEQ ID NO: 3847150 - RNA, 23 nt, Shigella flexneri 2a str. 2457T
gaagaagucgaaugcgcaaccgu

SEQ ID NO: 3847151 - RNA, 15 nt, Shigella flexneri 2a str. 2457T
gaagaauggaaaaaa

SEQ ID NO: 3847152 - RNA, 14 nt, Shigella flexneri 2a str. 2457T
gaagaauuugcccu

SEQ ID NO: 3847153 - RNA, 19 nt, Shigella flexneri 2a str. 2457T
gaagaauuuguaggccgga

SEQ ID NO: 3847154 - RNA, 22 nt, Shigella flexneri 2a str. 2457T
gaagacaaccaaaaucaggccg

SEQ ID NO: 3847155 - RNA, 14 nt, Shigella flexneri 2a str. 2457T
gaagacacauugcg

SEQ ID NO: 3847156 - RNA, 22 nt, Shigella flexneri 2a str. 2457T
gaagaccugggcgaugcuggca

SEQ ID NO: 3847157 - RNA, 18 nt, Shigella flexneri 2a str. 2457T
gaauaccguauucaacga

SEQ ID NO: 3847158 - RNA, 17 nt, Shigella flexneri 2a str. 2457T
gaauaccuugcugcucc

SEQ ID NO: 3847159 - RNA, 23 nt, Shigella flexneri 2a str. 2457T
gaauacgcucacgcgcugccucu

SEQ ID NO: 3847160 - RNA, 21 nt, Shigella flexneri 2a str. 2457T
gaauacgcuggcgcgccgccu

SEQ ID NO: 3847161 - RNA, 23 nt, Shigella flexneri 2a str. 2457T
gaauagucccuucgguagcagcu

SEQ ID NO: 3847162 - RNA, 15 nt, Shigella flexneri 2a str. 2457T
gaauaguuucagccu

SEQ ID NO: 3847163 - RNA, 23 nt, Shigella flexneri 2a str. 2457T
gaauaguuucagccucugccgcg

SEQ ID NO: 3847164 - RNA, 19 nt, Shigella flexneri 2a str. 2457T
gaauaguuuccgcuucugc

SEQ ID NO: 3847165 - RNA, 22 nt, Shigella flexneri 2a str. 2457T
gaauaguuuccgcuucugcuuu

SEQ ID NO: 3847166 - RNA, 22 nt, Shigella flexneri 2a str. 2457T
gaauauaccauggaagaaaaau

SEQ ID NO: 3847167 - RNA, 14 nt, Shigella flexneri 2a str. 2457T
gaauauacgccaga

SEQ ID NO: 3847168 - RNA, 17 nt, Shigella flexneri 2a str. 2457T
gaauauauaauuaaaaa

SEQ ID NO: 3847169 - RNA, 19 nt, Shigella flexneri 2a str. 2457T
gaauauauaauuaaaaaua

SEQ ID NO: 3847170 - RNA, 14 nt, Shigella flexneri 2a str. 2457T
gaauauaucagccu

SEQ ID NO: 3847171 - RNA, 20 nt, Shigella flexneri 2a str. 2457T
gaauauauccgaaaaaggau

SEQ ID NO: 3847172 - RNA, 16 nt, Shigella flexneri 2a str. 2457T
gaauaucaauacauca

SEQ ID NO: 3847173 - RNA, 21 nt, Shigella flexneri 2a str. 2457T
gaauaucauugccgguuggcg

SEQ ID NO: 3847174 - RNA, 20 nt, Shigella flexneri 2a str. 2457T
gaauaucgcuggccuccagu

SEQ ID NO: 3847175 - RNA, 20 nt, Shigella flexneri 2a str. 2457T
gaauaucguucaagagacug

SEQ ID NO: 3847176 - RNA, 21 nt, Shigella flexneri 2a str. 2457T
gaauaucuucaaccgucacca

SEQ ID NO: 3847177 - RNA, 19 nt, Shigella flexneri 2a str. 2457T
gaauaucuuucucgcggca

SEQ ID NO: 3847178 - RNA, 23 nt, Shigella flexneri 2a str. 2457T
gaauaugaacaugaaaaaacugg

SEQ ID NO: 3847179 - RNA, 13 nt, Shigella flexneri 2a str. 2457T
gaauauggcggcg

SEQ ID NO: 3847180 - RNA, 19 nt, Shigella flexneri 2a str. 2457T
gaauauucugaagcaaacu

SEQ ID NO: 3847181 - RNA, 17 nt, Shigella flexneri 2a str. 2457T
gaauauuucuauauccu

SEQ ID NO: 3847182 - RNA, 19 nt, Shigella flexneri 2a str. 2457T
gaaucaaauaaaaauaccc

SEQ ID NO: 3847183 - RNA, 20 nt, Shigella flexneri 2a str. 2457T
gaaucaccgccacgcccucc

SEQ ID NO: 3847184 - RNA, 14 nt, Shigella flexneri 2a str. 2457T
gaaucaccucuuuu

SEQ ID NO: 3847185 - RNA, 18 nt, Shigella flexneri 2a str. 2457T
gaaucacgccaacaaaca

SEQ ID NO: 3847186 - RNA, 16 nt, Shigella flexneri 2a str. 2457T
gaaucacguaggccug

SEQ ID NO: 3847187 - RNA, 17 nt, Shigella flexneri 2a str. 2457T
gaaucacucaucaugca

SEQ ID NO: 3847188 - RNA, 21 nt, Shigella flexneri 2a str. 2457T
gaaucacuccauccccagcuc

SEQ ID NO: 3847189 - RNA, 17 nt, Shigella flexneri 2a str. 2457T
gaaucagauucaaauua

SEQ ID NO: 3847190 - RNA, 23 nt, Shigella flexneri 2a str. 2457T
gaaucaggaaccacaaccacuuu

SEQ ID NO: 3847191 - RNA, 19 nt, Shigella flexneri 2a str. 2457T
gaaucaguaggugcaagca

SEQ ID NO: 3847192 - RNA, 19 nt, Shigella flexneri 2a str. 2457T
gaaucauaaauacaaggcc

SEQ ID NO: 3847193 - RNA, 21 nt, Shigella flexneri 2a str. 2457T
gaaucauaaauacaaggccaa

SEQ ID NO: 3847194 - RNA, 19 nt, Shigella flexneri 2a str. 2457T
gaaucaucguucauauauu

SEQ ID NO: 3847195 - RNA, 21 nt, Shigella flexneri 2a str. 2457T
gaaucaucguucauauauucc

SEQ ID NO: 3847196 - RNA, 18 nt, Shigella flexneri 2a str. 2457T
gaaucaugccgaucgucu

SEQ ID NO: 3847197 - RNA, 23 nt, Shigella flexneri 2a str. 2457T
gaaucaugccgaucgucugggca

SEQ ID NO: 3847198 - RNA, 21 nt, Shigella flexneri 2a str. 2457T
gaaucaugguuuauuucccag

SEQ ID NO: 3847199 - RNA, 22 nt, Shigella flexneri 2a str. 2457T
gaaucaugguuuauuucccaga

SEQ ID NO: 3847200 - RNA, 15 nt, Shigella flexneri 2a str. 2457T
gaaucccgcugcaau

SEQ ID NO: 3847201 - RNA, 21 nt, Shigella flexneri 2a str. 2457T
gaauccgcaccaacuccacuu

SEQ ID NO: 3847202 - RNA, 15 nt, Shigella flexneri 2a str. 2457T
gaauccuucccccac

SEQ ID NO: 3847203 - RNA, 23 nt, Shigella flexneri 2a str. 2457T
gaaucgccagcaucggcagcgcc

SEQ ID NO: 3847204 - RNA, 13 nt, Shigella flexneri 2a str. 2457T
gaaucgcuguuga

SEQ ID NO: 3847205 - RNA, 15 nt, Shigella flexneri 2a str. 2457T
gaaucgcuucauuua

SEQ ID NO: 3847206 - RNA, 13 nt, Shigella flexneri 2a str. 2457T
gaaucggcggcgg

SEQ ID NO: 3847207 - RNA, 17 nt, Shigella flexneri 2a str. 2457T
gaaucgggcgugauucc

SEQ ID NO: 3847208 - RNA, 21 nt, Shigella flexneri 2a str. 2457T
gaaucgguccaccacguacca

SEQ ID NO: 3847209 - RNA, 20 nt, Shigella flexneri 2a str. 2457T
gaaucguucauaccacgcca

SEQ ID NO: 3847210 - RNA, 14 nt, Shigella flexneri 2a str. 2457T
gaaucuaagauccc

SEQ ID NO: 3847211 - RNA, 15 nt, Shigella flexneri 2a str. 2457T
gaaucugaaggaugu

SEQ ID NO: 3847212 - RNA, 15 nt, Shigella flexneri 2a str. 2457T
gaaucugcguaaaua

SEQ ID NO: 3847213 - RNA, 16 nt, Shigella flexneri 2a str. 2457T
gaaugacauaaugcaa

SEQ ID NO: 3847214 - RNA, 18 nt, Shigella flexneri 2a str. 2457T
gaaugacgacuaaaucug

SEQ ID NO: 3847215 - RNA, 12 nt, Shigella flexneri 2a str. 2457T
gaaugacgccau

SEQ ID NO: 3847216 - RNA, 15 nt, Shigella flexneri 2a str. 2457T
gaaugagcaucuacu

SEQ ID NO: 3847217 - RNA, 16 nt, Shigella flexneri 2a str. 2457T
gaaugaugcggcgcuu

SEQ ID NO: 3847218 - RNA, 16 nt, Shigella flexneri 2a str. 2457T
gaaugccaauuucccg

SEQ ID NO: 3847219 - RNA, 21 nt, Shigella flexneri 2a str. 2457T
gaaugccgcagcacccugagu

SEQ ID NO: 3847220 - RNA, 16 nt, Shigella flexneri 2a str. 2457T
gaaugccggaugcggc

SEQ ID NO: 3847221 - RNA, 17 nt, Shigella flexneri 2a str. 2457T
gaaugccggguaauuuc

SEQ ID NO: 3847222 - RNA, 16 nt, Shigella flexneri 2a str. 2457T
gaaugcgaaaauccuc

SEQ ID NO: 3847223 - RNA, 15 nt, Shigella flexneri 2a str. 2457T
gaaugcgauggcaaa

SEQ ID NO: 3847224 - RNA, 18 nt, Shigella flexneri 2a str. 2457T
gaaugcgcaacgccguaa

SEQ ID NO: 3847225 - RNA, 19 nt, Shigella flexneri 2a str. 2457T
gaaugcucgcuggcaggcc

SEQ ID NO: 3847226 - RNA, 20 nt, Shigella flexneri 2a str. 2457T
gaauggaaacagcaccaucc

SEQ ID NO: 3847227 - RNA, 23 nt, Shigella flexneri 2a str. 2457T
gaauggcaucagaaggagcuaau

SEQ ID NO: 3847228 - RNA, 19 nt, Shigella flexneri 2a str. 2457T
gaauggcaucuacgcucuc

SEQ ID NO: 3847229 - RNA, 13 nt, Shigella flexneri 2a str. 2457T
gaauggcaucuga

SEQ ID NO: 3847230 - RNA, 20 nt, Shigella flexneri 2a str. 2457T
gaauggcaucugauaagccc

SEQ ID NO: 3847231 - RNA, 18 nt, Shigella flexneri 2a str. 2457T
gaauggguucgauuucau

SEQ ID NO: 3847232 - RNA, 22 nt, Shigella flexneri 2a str. 2457T
gaauggucaaugguggcaaucu

SEQ ID NO: 3847233 - RNA, 14 nt, Shigella flexneri 2a str. 2457T
gaauggugaccugc

SEQ ID NO: 3847234 - RNA, 20 nt, Shigella flexneri 2a str. 2457T
gaaugguggcgaugauuucc

SEQ ID NO: 3847235 - RNA, 16 nt, Shigella flexneri 2a str. 2457T
gaaugucgauaaaguu

SEQ ID NO: 3847236 - RNA, 15 nt, Shigella flexneri 2a str. 2457T
gaaugucguuuccau

SEQ ID NO: 3847237 - RNA, 13 nt, Shigella flexneri 2a str. 2457T
gaaugugacccgg

SEQ ID NO: 3847238 - RNA, 21 nt, Shigella flexneri 2a str. 2457T
gaauguggcaaugagugguga

SEQ ID NO: 3847239 - RNA, 11 nt, Shigella flexneri 2a str. 2457T
gaauguuccau

SEQ ID NO: 3847240 - RNA, 12 nt, Shigella flexneri 2a str. 2457T
gaauuaaaauau

SEQ ID NO: 3847241 - RNA, 14 nt, Shigella flexneri 2a str. 2457T
gaauuaaugccucu

SEQ ID NO: 3847242 - RNA, 14 nt, Shigella flexneri 2a str. 2457T
gaauuaugauaguc

SEQ ID NO: 3847243 - RNA, 13 nt, Shigella flexneri 2a str. 2457T
gaauuaugcagcc

SEQ ID NO: 3847244 - RNA, 18 nt, Shigella flexneri 2a str. 2457T
gaauucaaauccuucaga

SEQ ID NO: 3847245 - RNA, 18 nt, Shigella flexneri 2a str. 2457T
gaauucacucuauaccgc

SEQ ID NO: 3847246 - RNA, 13 nt, Shigella flexneri 2a str. 2457T
gaauucagaaaaa

SEQ ID NO: 3847247 - RNA, 18 nt, Shigella flexneri 2a str. 2457T
gaauuccggcagagaaag

SEQ ID NO: 3847248 - RNA, 15 nt, Shigella flexneri 2a str. 2457T
gaauucgacuuucuc

SEQ ID NO: 3847249 - RNA, 17 nt, Shigella flexneri 2a str. 2457T
gaauucgacuuucucug

SEQ ID NO: 3847250 - RNA, 21 nt, Shigella flexneri 2a str. 2457T
gaauucgcugaauaccgauuc

SEQ ID NO: 3847251 - RNA, 16 nt, Shigella flexneri 2a str. 2457T
gaauucuaucaugcaa

SEQ ID NO: 3847252 - RNA, 17 nt, Shigella flexneri 2a str. 2457T
gaauucuaucaugcaaa

SEQ ID NO: 3847253 - RNA, 18 nt, Shigella flexneri 2a str. 2457T
gaauugcagauaccacau

SEQ ID NO: 3847254 - RNA, 17 nt, Shigella flexneri 2a str. 2457T
gacaguguuauucccaa

SEQ ID NO: 3847255 - RNA, 16 nt, Shigella flexneri 2a str. 2457T
gacaguuauuaucuga

SEQ ID NO: 3847256 - RNA, 22 nt, Shigella flexneri 2a str. 2457T
gacaguugcugcgugaccgcca

SEQ ID NO: 3847257 - RNA, 17 nt, Shigella flexneri 2a str. 2457T
gacaguuucaccugcug

SEQ ID NO: 3847258 - RNA, 22 nt, Shigella flexneri 2a str. 2457T
gacaguuucaccugcugauuau

SEQ ID NO: 3847259 - RNA, 22 nt, Shigella flexneri 2a str. 2457T
gacauaaaauaaccaaauaaaa

SEQ ID NO: 3847260 - RNA, 17 nt, Shigella flexneri 2a str. 2457T
gacauaaacaccagcaa

SEQ ID NO: 3847261 - RNA, 18 nt, Shigella flexneri 2a str. 2457T
gacauaaacauuccacuu

SEQ ID NO: 3847262 - RNA, 14 nt, Shigella flexneri 2a str. 2457T
gacauacagaucgu

SEQ ID NO: 3847263 - RNA, 15 nt, Shigella flexneri 2a str. 2457T
gacauaguagccagc

SEQ ID NO: 3847264 - RNA, 16 nt, Shigella flexneri 2a str. 2457T
gacauaguagccagcc

SEQ ID NO: 3847265 - RNA, 17 nt, Shigella flexneri 2a str. 2457T
gacauaguagccagcca

SEQ ID NO: 3847266 - RNA, 14 nt, Shigella flexneri 2a str. 2457T
gacauauaaccggc

SEQ ID NO: 3847267 - RNA, 12 nt, Shigella flexneri 2a str. 2457T
gacauauuuuug

SEQ ID NO: 3847268 - RNA, 13 nt, Shigella flexneri 2a str. 2457T
gacaucaagaaau

SEQ ID NO: 3847269 - RNA, 22 nt, Shigella flexneri 2a str. 2457T
gacaucaauaaacaaugagaua

SEQ ID NO: 3847270 - RNA, 18 nt, Shigella flexneri 2a str. 2457T
gacaucagcauccgcacg

SEQ ID NO: 3847271 - RNA, 15 nt, Shigella flexneri 2a str. 2457T
gacaucccagugcaa

SEQ ID NO: 3847272 - RNA, 16 nt, Shigella flexneri 2a str. 2457T
gacaucccggcagaga

SEQ ID NO: 3847273 - RNA, 15 nt, Shigella flexneri 2a str. 2457T
gacauccugcguuaa

SEQ ID NO: 3847274 - RNA, 15 nt, Shigella flexneri 2a str. 2457T
gacaucgccacggca

SEQ ID NO: 3847275 - RNA, 23 nt, Shigella flexneri 2a str. 2457T
gacaucgccacggcaugaaagcg

SEQ ID NO: 3847276 - RNA, 14 nt, Shigella flexneri 2a str. 2457T
gacaucgugcuggu

SEQ ID NO: 3847277 - RNA, 13 nt, Shigella flexneri 2a str. 2457T
gacaugacccggc

SEQ ID NO: 3847278 - RNA, 12 nt, Shigella flexneri 2a str. 2457T
gacaugauucau

SEQ ID NO: 3847279 - RNA, 13 nt, Shigella flexneri 2a str. 2457T
gacaugcaucacg

SEQ ID NO: 3847280 - RNA, 20 nt, Shigella flexneri 2a str. 2457T
gacaugcgguucacgcgcca

SEQ ID NO: 3847281 - RNA, 20 nt, Shigella flexneri 2a str. 2457T
gacauggugcgauuaagaua

SEQ ID NO: 3847282 - RNA, 15 nt, Shigella flexneri 2a str. 2457T
gacauguacuuaugc

SEQ ID NO: 3847283 - RNA, 14 nt, Shigella flexneri 2a str. 2457T
gacauguggauuaa

SEQ ID NO: 3847284 - RNA, 21 nt, Shigella flexneri 2a str. 2457T
gacauguggauuaaauugcgc

SEQ ID NO: 3847285 - RNA, 17 nt, Shigella flexneri 2a str. 2457T
gacauuacggauuaaau

SEQ ID NO: 3847286 - RNA, 18 nt, Shigella flexneri 2a str. 2457T
gacauuacggauuaaaua

SEQ ID NO: 3847287 - RNA, 21 nt, Shigella flexneri 2a str. 2457T
gacauuauaaauucuggccac

SEQ ID NO: 3847288 - RNA, 15 nt, Shigella flexneri 2a str. 2457T
gacauuaucuggauc

SEQ ID NO: 3847289 - RNA, 16 nt, Shigella flexneri 2a str. 2457T
gacauucaccucacga

SEQ ID NO: 3847290 - RNA, 19 nt, Shigella flexneri 2a str. 2457T
gacauucgcgcacggugca

SEQ ID NO: 3847291 - RNA, 20 nt, Shigella flexneri 2a str. 2457T
gacauugcguuuaguuacac

SEQ ID NO: 3847292 - RNA, 16 nt, Shigella flexneri 2a str. 2457T
gacauuguuuccauau

SEQ ID NO: 3847293 - RNA, 14 nt, Shigella flexneri 2a str. 2457T
gacauuuuggacaa

SEQ ID NO: 3847294 - RNA, 20 nt, Shigella flexneri 2a str. 2457T
gaccaaaggcgaugcuguau

SEQ ID NO: 3847295 - RNA, 15 nt, Shigella flexneri 2a str. 2457T
gaccaacaaaaaucu

SEQ ID NO: 3847296 - RNA, 17 nt, Shigella flexneri 2a str. 2457T
gaccaauaaacgccagg

SEQ ID NO: 3847297 - RNA, 18 nt, Shigella flexneri 2a str. 2457T
gaccaaucacacaaccau

SEQ ID NO: 3847298 - RNA, 20 nt, Shigella flexneri 2a str. 2457T
gaccaaucacacaaccaugc

SEQ ID NO: 3847299 - RNA, 22 nt, Shigella flexneri 2a str. 2457T
gaccaaucacacaaccaugcag

SEQ ID NO: 3847300 - RNA, 14 nt, Shigella flexneri 2a str. 2457T
gaccaaucaccacu

SEQ ID NO: 3847301 - RNA, 13 nt, Shigella flexneri 2a str. 2457T
gaccaauccagcc

SEQ ID NO: 3847302 - RNA, 16 nt, Shigella flexneri 2a str. 2457T
gaccaaucccgccaua

SEQ ID NO: 3847303 - RNA, 13 nt, Shigella flexneri 2a str. 2457T
gaccaauccgcca

SEQ ID NO: 3847304 - RNA, 22 nt, Shigella flexneri 2a str. 2457T
gaccacacggucuaucaucagc

SEQ ID NO: 3847305 - RNA, 23 nt, Shigella flexneri 2a str. 2457T
gaccacacggucuaucaucagca

SEQ ID NO: 3847306 - RNA, 13 nt, Shigella flexneri 2a str. 2457T
gaccaccagcacg

SEQ ID NO: 3847307 - RNA, 19 nt, Shigella flexneri 2a str. 2457T
gaccaccauauucgccacc

SEQ ID NO: 3847308 - RNA, 16 nt, Shigella flexneri 2a str. 2457T
gaccacggccacagcc

SEQ ID NO: 3847309 - RNA, 18 nt, Shigella flexneri 2a str. 2457T
gaccacggccacagccag

SEQ ID NO: 3847310 - RNA, 22 nt, Shigella flexneri 2a str. 2457T
gaccacuucgguacccagacgc

SEQ ID NO: 3847311 - RNA, 23 nt, Shigella flexneri 2a str. 2457T
gaccacuuuccucaucagaaaga

SEQ ID NO: 3847312 - RNA, 19 nt, Shigella flexneri 2a str. 2457T
gaccagaaacgccaccauu

SEQ ID NO: 3847313 - RNA, 17 nt, Shigella flexneri 2a str. 2457T
gaccagagcugauacgg

SEQ ID NO: 3847314 - RNA, 17 nt, Shigella flexneri 2a str. 2457T
gaccagcaacaaauaac

SEQ ID NO: 3847315 - RNA, 13 nt, Shigella flexneri 2a str. 2457T
gaccagcagcauu

SEQ ID NO: 3847316 - RNA, 18 nt, Shigella flexneri 2a str. 2457T
gaccagcaucccggcagc

SEQ ID NO: 3847317 - RNA, 16 nt, Shigella flexneri 2a str. 2457T
gaccagccaggccgcc

SEQ ID NO: 3847318 - RNA, 17 nt, Shigella flexneri 2a str. 2457T
gaccagccgcuaccagc

SEQ ID NO: 3847319 - RNA, 22 nt, Shigella flexneri 2a str. 2457T
gaccagcgccgcaacuaccagc

SEQ ID NO: 3847320 - RNA, 19 nt, Shigella flexneri 2a str. 2457T
gaccagcggguugcugaga

SEQ ID NO: 3847321 - RNA, 20 nt, Shigella flexneri 2a str. 2457T
gaccagcgucgcaucaggca

SEQ ID NO: 3847322 - RNA, 21 nt, Shigella flexneri 2a str. 2457T
gaccagcgucgcaucaggcau

SEQ ID NO: 3847323 - RNA, 13 nt, Shigella flexneri 2a str. 2457T
gaccagcuaccac

SEQ ID NO: 3847324 - RNA, 19 nt, Shigella flexneri 2a str. 2457T
gaccagcugccgacgccag

SEQ ID NO: 3847325 - RNA, 23 nt, Shigella flexneri 2a str. 2457T
gaccagcugccgacgccaguucu

SEQ ID NO: 3847326 - RNA, 16 nt, Shigella flexneri 2a str. 2457T
gaccaggaaacccaac

SEQ ID NO: 3847327 - RNA, 15 nt, Shigella flexneri 2a str. 2457T
gaccaggccaucagc

SEQ ID NO: 3847328 - RNA, 16 nt, Shigella flexneri 2a str. 2457T
gaccaggccaucagca

SEQ ID NO: 3847329 - RNA, 20 nt, Shigella flexneri 2a str. 2457T
gaccagggcgucaccuugcc

SEQ ID NO: 3847330 - RNA, 13 nt, Shigella flexneri 2a str. 2457T
gaccaguaccacc

SEQ ID NO: 3847331 - RNA, 18 nt, Shigella flexneri 2a str. 2457T
gaccaguucacaccagcc

SEQ ID NO: 3847332 - RNA, 14 nt, Shigella flexneri 2a str. 2457T
gaccaguugcucca

SEQ ID NO: 3847333 - RNA, 19 nt, Shigella flexneri 2a str. 2457T
gaccauaaauauggugaaa

SEQ ID NO: 3847334 - RNA, 19 nt, Shigella flexneri 2a str. 2457T
gaccauacagcagcaacga

SEQ ID NO: 3847335 - RNA, 16 nt, Shigella flexneri 2a str. 2457T
gaccauauuagccgcc

SEQ ID NO: 3847336 - RNA, 17 nt, Shigella flexneri 2a str. 2457T
gaccauauuagccgcca

SEQ ID NO: 3847337 - RNA, 13 nt, Shigella flexneri 2a str. 2457T
gaccaucagcagc

SEQ ID NO: 3847338 - RNA, 17 nt, Shigella flexneri 2a str. 2457T
gaccaucagcaugacaa

SEQ ID NO: 3847339 - RNA, 12 nt, Shigella flexneri 2a str. 2457T
gaccaucgccag

SEQ ID NO: 3847340 - RNA, 15 nt, Shigella flexneri 2a str. 2457T
gaccauuaucauuac

SEQ ID NO: 3847341 - RNA, 23 nt, Shigella flexneri 2a str. 2457T
gaccauugaugcucuccgccauc

SEQ ID NO: 3847342 - RNA, 16 nt, Shigella flexneri 2a str. 2457T
gacccaccccagcagc

SEQ ID NO: 3847343 - RNA, 18 nt, Shigella flexneri 2a str. 2457T
gacccagcaccaguacca

SEQ ID NO: 3847344 - RNA, 16 nt, Shigella flexneri 2a str. 2457T
gacccagccagacgcc

SEQ ID NO: 3847345 - RNA, 19 nt, Shigella flexneri 2a str. 2457T
gacccagccagacgccagc

SEQ ID NO: 3847346 - RNA, 17 nt, Shigella flexneri 2a str. 2457T
gacccaucugccagcgc

SEQ ID NO: 3847347 - RNA, 15 nt, Shigella flexneri 2a str. 2457T
gacccgcagccagca

SEQ ID NO: 3847348 - RNA, 15 nt, Shigella flexneri 2a str. 2457T
gacccggaauaaaug

SEQ ID NO: 3847349 - RNA, 19 nt, Shigella flexneri 2a str. 2457T
gacccguuuacggcuaaaa

SEQ ID NO: 3847350 - RNA, 16 nt, Shigella flexneri 2a str. 2457T
gacccugcucuuucag

SEQ ID NO: 3847351 - RNA, 14 nt, Shigella flexneri 2a str. 2457T
gaccgaaugcaguc

SEQ ID NO: 3847352 - RNA, 16 nt, Shigella flexneri 2a str. 2457T
gacggaauaaacccac

SEQ ID NO: 3847353 - RNA, 23 nt, Shigella flexneri 2a str. 2457T
gacggauaaggcguuuacgccgc

SEQ ID NO: 3847354 - RNA, 14 nt, Shigella flexneri 2a str. 2457T
gacggcugauaugc

SEQ ID NO: 3847355 - RNA, 20 nt, Shigella flexneri 2a str. 2457T
gacggcugauaugccagacu

SEQ ID NO: 3847356 - RNA, 15 nt, Shigella flexneri 2a str. 2457T
gacggcuuagcgcau

SEQ ID NO: 3847357 - RNA, 23 nt, Shigella flexneri 2a str. 2457T
gacgggcauuucgucuugcagga

SEQ ID NO: 3847358 - RNA, 19 nt, Shigella flexneri 2a str. 2457T
gacgggcuaaucgucauca

SEQ ID NO: 3847359 - RNA, 21 nt, Shigella flexneri 2a str. 2457T
gacgggcuaaucgucaucagc

SEQ ID NO: 3847360 - RNA, 22 nt, Shigella flexneri 2a str. 2457T
gacggugacacuuugcgccauc

SEQ ID NO: 3847361 - RNA, 19 nt, Shigella flexneri 2a str. 2457T
gacgguggagcaacaggga

SEQ ID NO: 3847362 - RNA, 19 nt, Shigella flexneri 2a str. 2457T
gacguaacgaccaccaccg

SEQ ID NO: 3847363 - RNA, 21 nt, Shigella flexneri 2a str. 2457T
gacguaaugauguaaaaauac

SEQ ID NO: 3847364 - RNA, 21 nt, Shigella flexneri 2a str. 2457T
gacguagcucgacuccugacu

SEQ ID NO: 3847365 - RNA, 18 nt, Shigella flexneri 2a str. 2457T
gacgucacaggccaucac

SEQ ID NO: 3847366 - RNA, 14 nt, Shigella flexneri 2a str. 2457T
gacgucauagcagu

SEQ ID NO: 3847367 - RNA, 18 nt, Shigella flexneri 2a str. 2457T
gacgucucaaucaccacc

SEQ ID NO: 3847368 - RNA, 21 nt, Shigella flexneri 2a str. 2457T
gacgugcgcaaacuucuucag

SEQ ID NO: 3847369 - RNA, 21 nt, Shigella flexneri 2a str. 2457T
gacgugcgggcgcaagggugc

SEQ ID NO: 3847370 - RNA, 23 nt, Shigella flexneri 2a str. 2457T
gacgugcguaccauuaucaccaa

SEQ ID NO: 3847371 - RNA, 18 nt, Shigella flexneri 2a str. 2457T
gacgugcucgaacauccc

SEQ ID NO: 3847372 - RNA, 17 nt, Shigella flexneri 2a str. 2457T
gacguguugucagcuca

SEQ ID NO: 3847373 - RNA, 18 nt, Shigella flexneri 2a str. 2457T
gacguuaacuacaaucac

SEQ ID NO: 3847374 - RNA, 15 nt, Shigella flexneri 2a str. 2457T
gacguuaagaaaacg

SEQ ID NO: 3847375 - RNA, 14 nt, Shigella flexneri 2a str. 2457T
gacguucagccaua

SEQ ID NO: 3847376 - RNA, 14 nt, Shigella flexneri 2a str. 2457T
gacguucaguuccg

SEQ ID NO: 3847377 - RNA, 16 nt, Shigella flexneri 2a str. 2457T
gacguucgcguacugc

SEQ ID NO: 3847378 - RNA, 13 nt, Shigella flexneri 2a str. 2457T
gacguucugccaa

SEQ ID NO: 3847379 - RNA, 17 nt, Shigella flexneri 2a str. 2457T
gacguucugccaaacgc

SEQ ID NO: 3847380 - RNA, 17 nt, Shigella flexneri 2a str. 2457T
gacguucuuccugugga

SEQ ID NO: 3847381 - RNA, 14 nt, Shigella flexneri 2a str. 2457T
gacguuguucaggu

SEQ ID NO: 3847382 - RNA, 20 nt, Shigella flexneri 2a str. 2457T
gacguuuuacagcaacgggc

SEQ ID NO: 3847383 - RNA, 11 nt, Shigella flexneri 2a str. 2457T
gacuaaaaccc

SEQ ID NO: 3847384 - RNA, 16 nt, Shigella flexneri 2a str. 2457T
gacuaaauacauuagu

SEQ ID NO: 3847385 - RNA, 23 nt, Shigella flexneri 2a str. 2457T
gacuaacggaauugccaacggca

SEQ ID NO: 3847386 - RNA, 19 nt, Shigella flexneri 2a str. 2457T
gacuaauugagcgugaagu

SEQ ID NO: 3847387 - RNA, 17 nt, Shigella flexneri 2a str. 2457T
gacuaccacguaacgac

SEQ ID NO: 3847388 - RNA, 15 nt, Shigella flexneri 2a str. 2457T
gacuaccauccgagu

SEQ ID NO: 3847389 - RNA, 15 nt, Shigella flexneri 2a str. 2457T
gacuacgccaacaga

SEQ ID NO: 3847390 - RNA, 18 nt, Shigella flexneri 2a str. 2457T
gacuacgccaacagaagu

SEQ ID NO: 3847391 - RNA, 16 nt, Shigella flexneri 2a str. 2457T
gacuauuaaacaggau

SEQ ID NO: 3847392 - RNA, 13 nt, Shigella flexneri 2a str. 2457T
gacuauuucuuca

SEQ ID NO: 3847393 - RNA, 22 nt, Shigella flexneri 2a str. 2457T
gacucagucgcccaguaucuga

SEQ ID NO: 3847394 - RNA, 14 nt, Shigella flexneri 2a str. 2457T
gacuccaacuuacu

SEQ ID NO: 3847395 - RNA, 15 nt, Shigella flexneri 2a str. 2457T
gacuccagcgccagc

SEQ ID NO: 3847396 - RNA, 19 nt, Shigella flexneri 2a str. 2457T
gacuccaggcguuuugcag

SEQ ID NO: 3847397 - RNA, 18 nt, Shigella flexneri 2a str. 2457T
gacucccgcgccgcagcc

SEQ ID NO: 3847398 - RNA, 18 nt, Shigella flexneri 2a str. 2457T
gacucgaggagcuggagg

SEQ ID NO: 3847399 - RNA, 17 nt, Shigella flexneri 2a str. 2457T
gacucucagccgcacac

SEQ ID NO: 3847400 - RNA, 17 nt, Shigella flexneri 2a str. 2457T
gacucuuacucuuucaa

SEQ ID NO: 3847401 - RNA, 20 nt, Shigella flexneri 2a str. 2457T
gacucuuacucuuucaauuu

SEQ ID NO: 3847402 - RNA, 15 nt, Shigella flexneri 2a str. 2457T
gacugaauacgcugg

SEQ ID NO: 3847403 - RNA, 17 nt, Shigella flexneri 2a str. 2457T
gacugaauacgcuggcg

SEQ ID NO: 3847404 - RNA, 18 nt, Shigella flexneri 2a str. 2457T
gacugaccgaaaccguaa

SEQ ID NO: 3847405 - RNA, 13 nt, Shigella flexneri 2a str. 2457T
gacugauaacgcg

SEQ ID NO: 3847406 - RNA, 19 nt, Shigella flexneri 2a str. 2457T
gacugauaacgcggcagca

SEQ ID NO: 3847407 - RNA, 17 nt, Shigella flexneri 2a str. 2457T
gacugaugacaaacaca

SEQ ID NO: 3847408 - RNA, 22 nt, Shigella flexneri 2a str. 2457T
gacugauguguaggucgcauag

SEQ ID NO: 3847409 - RNA, 14 nt, Shigella flexneri 2a str. 2457T
gacugccgcucacc

SEQ ID NO: 3847410 - RNA, 22 nt, Shigella flexneri 2a str. 2457T
gacugcgagaaguucugcagcc

SEQ ID NO: 3847411 - RNA, 18 nt, Shigella flexneri 2a str. 2457T
gacugcgccacuucccag

SEQ ID NO: 3847412 - RNA, 22 nt, Shigella flexneri 2a str. 2457T
gacugcgccacuucccagccuu

SEQ ID NO: 3847413 - RNA, 14 nt, Shigella flexneri 2a str. 2457T
gacugcgcccugaa

SEQ ID NO: 3847414 - RNA, 15 nt, Shigella flexneri 2a str. 2457T
gacugcgccugcagg

SEQ ID NO: 3847415 - RNA, 16 nt, Shigella flexneri 2a str. 2457T
gacugcggccugaguu

SEQ ID NO: 3847416 - RNA, 17 nt, Shigella flexneri 2a str. 2457T
gacugcucagcuccucu

SEQ ID NO: 3847417 - RNA, 21 nt, Shigella flexneri 2a str. 2457T
gacugcuuuuacaaaaucuuc

SEQ ID NO: 3847418 - RNA, 13 nt, Shigella flexneri 2a str. 2457T
gacuggaaaucaa

SEQ ID NO: 3847419 - RNA, 17 nt, Shigella flexneri 2a str. 2457T
gacuggaauaagccaaa

SEQ ID NO: 3847420 - RNA, 23 nt, Shigella flexneri 2a str. 2457T
gacuggaauaagccaaauccagc

SEQ ID NO: 3847421 - RNA, 21 nt, Shigella flexneri 2a str. 2457T
gacugggucaguauggaucaa

SEQ ID NO: 3847422 - RNA, 21 nt, Shigella flexneri 2a str. 2457T
gacugggugccgcgcagcgug

SEQ ID NO: 3847423 - RNA, 16 nt, Shigella flexneri 2a str. 2457T
gacuguacagauccgc

SEQ ID NO: 3847424 - RNA, 20 nt, Shigella flexneri 2a str. 2457T
gacuguacagauccgccauu

SEQ ID NO: 3847425 - RNA, 16 nt, Shigella flexneri 2a str. 2457T
gacugucgcagccagc

SEQ ID NO: 3847426 - RNA, 21 nt, Shigella flexneri 2a str. 2457T
gacuguuauugcgcaggcgcg

SEQ ID NO: 3847427 - RNA, 12 nt, Shigella flexneri 2a str. 2457T
gacuguuccagc

SEQ ID NO: 3847428 - RNA, 20 nt, Shigella flexneri 2a str. 2457T
gacuuaaaaggaaaaucaca

SEQ ID NO: 3847429 - RNA, 13 nt, Shigella flexneri 2a str. 2457T
gacuuauucuuca

SEQ ID NO: 3847430 - RNA, 14 nt, Shigella flexneri 2a str. 2457T
gacuuauucuucaa

SEQ ID NO: 3847431 - RNA, 22 nt, Shigella flexneri 2a str. 2457T
gacuucaaaaauaaguugccac

SEQ ID NO: 3847432 - RNA, 13 nt, Shigella flexneri 2a str. 2457T
gacuuccagcgua

SEQ ID NO: 3847433 - RNA, 15 nt, Shigella flexneri 2a str. 2457T
gacuucugcuuucau

SEQ ID NO: 3847434 - RNA, 17 nt, Shigella flexneri 2a str. 2457T
gacuucuucauucaucc

SEQ ID NO: 3847435 - RNA, 21 nt, Shigella flexneri 2a str. 2457T
gacuucuucauucauccgccg

SEQ ID NO: 3847436 - RNA, 23 nt, Shigella flexneri 2a str. 2457T
gacuuuaaucaccugccagggag

SEQ ID NO: 3847437 - RNA, 22 nt, Shigella flexneri 2a str. 2457T
gacuuugauccagccauugcca

SEQ ID NO: 3847438 - RNA, 20 nt, Shigella flexneri 2a str. 2457T
gacuuuguuuuuaguuaaau

SEQ ID NO: 3847439 - RNA, 15 nt, Shigella flexneri 2a str. 2457T
gacuuuugcccggca

SEQ ID NO: 3847440 - RNA, 15 nt, Shigella flexneri 2a str. 2457T
gacuuuuuccugcuc

SEQ ID NO: 3847441 - RNA, 22 nt, Shigella flexneri 2a str. 2457T
gacuuuuuccugcucaaugucu

SEQ ID NO: 3847442 - RNA, 11 nt, Shigella flexneri 2a str. 2457T
gagaaaaaccu

SEQ ID NO: 3847443 - RNA, 14 nt, Shigella flexneri 2a str. 2457T
gagaaaaauagcau

SEQ ID NO: 3847444 - RNA, 21 nt, Shigella flexneri 2a str. 2457T
gagaaaaauaucguaggccug

SEQ ID NO: 3847445 - RNA, 14 nt, Shigella flexneri 2a str. 2457T
gagaaaaccggugu

SEQ ID NO: 3847446 - RNA, 19 nt, Shigella flexneri 2a str. 2457T
gagaaaaugccgcacauca

SEQ ID NO: 3847447 - RNA, 23 nt, Shigella flexneri 2a str. 2457T
gagaaaauuucauuaauaucagg

SEQ ID NO: 3847448 - RNA, 16 nt, Shigella flexneri 2a str. 2457T
gagaaagaaacgccau

SEQ ID NO: 3847449 - RNA, 17 nt, Shigella flexneri 2a str. 2457T
gagcgacaucuuccuua

SEQ ID NO: 3847450 - RNA, 18 nt, Shigella flexneri 2a str. 2457T
gagcgauaacccagcgca

SEQ ID NO: 3847451 - RNA, 15 nt, Shigella flexneri 2a str. 2457T
gagcgccccagaccu

SEQ ID NO: 3847452 - RNA, 20 nt, Shigella flexneri 2a str. 2457T
gagcgcuggugacaucgcca

SEQ ID NO: 3847453 - RNA, 15 nt, Shigella flexneri 2a str. 2457T
gagcggacugaacgc

SEQ ID NO: 3847454 - RNA, 13 nt, Shigella flexneri 2a str. 2457T
gagcggccagggc

SEQ ID NO: 3847455 - RNA, 19 nt, Shigella flexneri 2a str. 2457T
gagcgggacaacaaacgca

SEQ ID NO: 3847456 - RNA, 22 nt, Shigella flexneri 2a str. 2457T
gagcgguuuuuuuaauuacugc

SEQ ID NO: 3847457 - RNA, 23 nt, Shigella flexneri 2a str. 2457T
gagcguauccagcauaccuucca

SEQ ID NO: 3847458 - RNA, 14 nt, Shigella flexneri 2a str. 2457T
gagcguuucaaaaa

SEQ ID NO: 3847459 - RNA, 22 nt, Shigella flexneri 2a str. 2457T
gagcguuucaaaaacaaagaac

SEQ ID NO: 3847460 - RNA, 18 nt, Shigella flexneri 2a str. 2457T
gagcguuuuuugauaguu

SEQ ID NO: 3847461 - RNA, 15 nt, Shigella flexneri 2a str. 2457T
gagcuaccggcagga

SEQ ID NO: 3847462 - RNA, 13 nt, Shigella flexneri 2a str. 2457T
gagcuaucucccu

SEQ ID NO: 3847463 - RNA, 16 nt, Shigella flexneri 2a str. 2457T
gagcucaauacaaccc

SEQ ID NO: 3847464 - RNA, 14 nt, Shigella flexneri 2a str. 2457T
gagcuccagguccu

SEQ ID NO: 3847465 - RNA, 13 nt, Shigella flexneri 2a str. 2457T
gagcugcaaggca

SEQ ID NO: 3847466 - RNA, 19 nt, Shigella flexneri 2a str. 2457T
gagcuggaaguuacucaaa

SEQ ID NO: 3847467 - RNA, 20 nt, Shigella flexneri 2a str. 2457T
gagcuggcgaacgugcagga

SEQ ID NO: 3847468 - RNA, 21 nt, Shigella flexneri 2a str. 2457T
gagcuuauuuguugagcugga

SEQ ID NO: 3847469 - RNA, 22 nt, Shigella flexneri 2a str. 2457T
gagcuuugacgaccuucuucca

SEQ ID NO: 3847470 - RNA, 14 nt, Shigella flexneri 2a str. 2457T
gaggaagacaacca

SEQ ID NO: 3847471 - RNA, 13 nt, Shigella flexneri 2a str. 2457T
gaggaagcgcagc

SEQ ID NO: 3847472 - RNA, 21 nt, Shigella flexneri 2a str. 2457T
gaggaagcgcagcagcgcgcc

SEQ ID NO: 3847473 - RNA, 22 nt, Shigella flexneri 2a str. 2457T
gaggaaggcacguacaugcagg

SEQ ID NO: 3847474 - RNA, 21 nt, Shigella flexneri 2a str. 2457T
gaggagagugcaaugaaaaac

SEQ ID NO: 3847475 - RNA, 16 nt, Shigella flexneri 2a str. 2457T
gaggagccaucaccau

SEQ ID NO: 3847476 - RNA, 20 nt, Shigella flexneri 2a str. 2457T
gaggagcugcacgaugacug

SEQ ID NO: 3847477 - RNA, 18 nt, Shigella flexneri 2a str. 2457T
gaggagcuggaggaccuu

SEQ ID NO: 3847478 - RNA, 13 nt, Shigella flexneri 2a str. 2457T
gaggaguuuaugg

SEQ ID NO: 3847479 - RNA, 17 nt, Shigella flexneri 2a str. 2457T
gaggauaauauuuuugc

SEQ ID NO: 3847480 - RNA, 12 nt, Shigella flexneri 2a str. 2457T
gaggaucaccag

SEQ ID NO: 3847481 - RNA, 15 nt, Shigella flexneri 2a str. 2457T
gaggaugcacucgca

SEQ ID NO: 3847482 - RNA, 15 nt, Shigella flexneri 2a str. 2457T
gaggccaaucagcaa

SEQ ID NO: 3847483 - RNA, 17 nt, Shigella flexneri 2a str. 2457T
gaggccaauuuggcugc

SEQ ID NO: 3847484 - RNA, 20 nt, Shigella flexneri 2a str. 2457T
gaggcggggccaauugcugu

SEQ ID NO: 3847485 - RNA, 19 nt, Shigella flexneri 2a str. 2457T
gaggcguaauuuccacgcc

SEQ ID NO: 3847486 - RNA, 20 nt, Shigella flexneri 2a str. 2457T
gaggcgucagcguuccacgu

SEQ ID NO: 3847487 - RNA, 15 nt, Shigella flexneri 2a str. 2457T
gaggcguuucaacuc

SEQ ID NO: 3847488 - RNA, 15 nt, Shigella flexneri 2a str. 2457T
gaggcuuauccggca

SEQ ID NO: 3847489 - RNA, 18 nt, Shigella flexneri 2a str. 2457T
gaggcuuuaauaccugcc

SEQ ID NO: 3847490 - RNA, 17 nt, Shigella flexneri 2a str. 2457T
gagggaaauagagaaau

SEQ ID NO: 3847491 - RNA, 19 nt, Shigella flexneri 2a str. 2457T
gagggaaccuguucaacaa

SEQ ID NO: 3847492 - RNA, 14 nt, Shigella flexneri 2a str. 2457T
gagggaauggcaga

SEQ ID NO: 3847493 - RNA, 13 nt, Shigella flexneri 2a str. 2457T
gagggagcguccu

SEQ ID NO: 3847494 - RNA, 22 nt, Shigella flexneri 2a str. 2457T
gagggauaucuucccgccguug

SEQ ID NO: 3847495 - RNA, 18 nt, Shigella flexneri 2a str. 2457T
gagggaucgacagauccc

SEQ ID NO: 3847496 - RNA, 22 nt, Shigella flexneri 2a str. 2457T
gagggcaaaggcgcggcggcga

SEQ ID NO: 3847497 - RNA, 19 nt, Shigella flexneri 2a str. 2457T
gagggcgauuauccgccag

SEQ ID NO: 3847498 - RNA, 16 nt, Shigella flexneri 2a str. 2457T
gaggggcggcucuccu

SEQ ID NO: 3847499 - RNA, 19 nt, Shigella flexneri 2a str. 2457T
gaggguaaacaacaugcua

SEQ ID NO: 3847500 - RNA, 14 nt, Shigella flexneri 2a str. 2457T
gagguaaaaccuga

SEQ ID NO: 3847501 - RNA, 14 nt, Shigella flexneri 2a str. 2457T
gaggucaaaaucca

SEQ ID NO: 3847502 - RNA, 12 nt, Shigella flexneri 2a str. 2457T
gaggucacgucc

SEQ ID NO: 3847503 - RNA, 21 nt, Shigella flexneri 2a str. 2457T
gaggucaguaaugagcacaga

SEQ ID NO: 3847504 - RNA, 20 nt, Shigella flexneri 2a str. 2457T
gaggucaucagcgcgguacg

SEQ ID NO: 3847505 - RNA, 19 nt, Shigella flexneri 2a str. 2457T
gagguuaauauuuucgcca

SEQ ID NO: 3847506 - RNA, 14 nt, Shigella flexneri 2a str. 2457T
gagguuaaugaucg

SEQ ID NO: 3847507 - RNA, 22 nt, Shigella flexneri 2a str. 2457T
gagguuagcaaugccuucugga

SEQ ID NO: 3847508 - RNA, 22 nt, Shigella flexneri 2a str. 2457T
gagguuggcucaucaagcacaa

SEQ ID NO: 3847509 - RNA, 16 nt, Shigella flexneri 2a str. 2457T
gaguaaaaaaacauca

SEQ ID NO: 3847510 - RNA, 13 nt, Shigella flexneri 2a str. 2457T
gaguaaagcccgc

SEQ ID NO: 3847511 - RNA, 16 nt, Shigella flexneri 2a str. 2457T
gaguaaauugcaaacc

SEQ ID NO: 3847512 - RNA, 14 nt, Shigella flexneri 2a str. 2457T
gaguaacagauugu

SEQ ID NO: 3847513 - RNA, 20 nt, Shigella flexneri 2a str. 2457T
gaguaacgggcacguaaauc

SEQ ID NO: 3847514 - RNA, 12 nt, Shigella flexneri 2a str. 2457T
gaguaaucaggc

SEQ ID NO: 3847515 - RNA, 14 nt, Shigella flexneri 2a str. 2457T
gaguaaucgccagc

SEQ ID NO: 3847516 - RNA, 15 nt, Shigella flexneri 2a str. 2457T
gaguaaugccaguca

SEQ ID NO: 3847517 - RNA, 12 nt, Shigella flexneri 2a str. 2457T
gaguacauccac

SEQ ID NO: 3847518 - RNA, 16 nt, Shigella flexneri 2a str. 2457T
gaguauuuccagcuca

SEQ ID NO: 3847519 - RNA, 17 nt, Shigella flexneri 2a str. 2457T
gagucaagggugucggc

SEQ ID NO: 3847520 - RNA, 21 nt, Shigella flexneri 2a str. 2457T
gagucaagggugucggcacac

SEQ ID NO: 3847521 - RNA, 14 nt, Shigella flexneri 2a str. 2457T
gagucacaaacauc

SEQ ID NO: 3847522 - RNA, 19 nt, Shigella flexneri 2a str. 2457T
gagucacaaacaucaugcc

SEQ ID NO: 3847523 - RNA, 18 nt, Shigella flexneri 2a str. 2457T
gagucacucgacagcacc

SEQ ID NO: 3847524 - RNA, 16 nt, Shigella flexneri 2a str. 2457T
gagucagcccaacaaa

SEQ ID NO: 3847525 - RNA, 17 nt, Shigella flexneri 2a str. 2457T
gagucagcccaacaaag

SEQ ID NO: 3847526 - RNA, 19 nt, Shigella flexneri 2a str. 2457T
gagucauucuccagaucuu

SEQ ID NO: 3847527 - RNA, 15 nt, Shigella flexneri 2a str. 2457T
gaguccuuccagguc

SEQ ID NO: 3847528 - RNA, 14 nt, Shigella flexneri 2a str. 2457T
gagucgggaccagc

SEQ ID NO: 3847529 - RNA, 19 nt, Shigella flexneri 2a str. 2457T
gagucgggaccagcauucc

SEQ ID NO: 3847530 - RNA, 14 nt, Shigella flexneri 2a str. 2457T
gagucggggccagc

SEQ ID NO: 3847531 - RNA, 16 nt, Shigella flexneri 2a str. 2457T
gagucggggccagcau

SEQ ID NO: 3847532 - RNA, 19 nt, Shigella flexneri 2a str. 2457T
gagucggggccagcauucc

SEQ ID NO: 3847533 - RNA, 20 nt, Shigella flexneri 2a str. 2457T
gagucggggccagcauucca

SEQ ID NO: 3847534 - RNA, 23 nt, Shigella flexneri 2a str. 2457T
gagucugaccgucgaugaaagcg

SEQ ID NO: 3847535 - RNA, 19 nt, Shigella flexneri 2a str. 2457T
gagugaaaaugccucagag

SEQ ID NO: 3847536 - RNA, 17 nt, Shigella flexneri 2a str. 2457T
gagugaagucgcgcuca

SEQ ID NO: 3847537 - RNA, 21 nt, Shigella flexneri 2a str. 2457T
gagugacuucgccgugaaagu

SEQ ID NO: 3847538 - RNA, 18 nt, Shigella flexneri 2a str. 2457T
gagugauacguaaaccac

SEQ ID NO: 3847539 - RNA, 17 nt, Shigella flexneri 2a str. 2457T
gagugcagcaugcaccc

SEQ ID NO: 3847540 - RNA, 17 nt, Shigella flexneri 2a str. 2457T
gagugccgaagaacaua

SEQ ID NO: 3847541 - RNA, 16 nt, Shigella flexneri 2a str. 2457T
gagugcggaugacgau

SEQ ID NO: 3847542 - RNA, 21 nt, Shigella flexneri 2a str. 2457T
gagugcguuccccgaagacgu

SEQ ID NO: 3847543 - RNA, 18 nt, Shigella flexneri 2a str. 2457T
gaguggauuaucuucacc

SEQ ID NO: 3847544 - RNA, 15 nt, Shigella flexneri 2a str. 2457T
gaguggcccagguua

SEQ ID NO: 3847545 - RNA, 17 nt, Shigella flexneri 2a str. 2457T
gaguggcgaaauuggua

SEQ ID NO: 3847546 - RNA, 14 nt, Shigella flexneri 2a str. 2457T
gaguguggcguggc

SEQ ID NO: 3847547 - RNA, 20 nt, Shigella flexneri 2a str. 2457T
gauacugaugaacgcgcagg

SEQ ID NO: 3847548 - RNA, 21 nt, Shigella flexneri 2a str. 2457T
gauacugaugaacgcgcaggu

SEQ ID NO: 3847549 - RNA, 21 nt, Shigella flexneri 2a str. 2457T
gauacugcccaccgacgcagu

SEQ ID NO: 3847550 - RNA, 20 nt, Shigella flexneri 2a str. 2457T
gauagaacaucucuucccau

SEQ ID NO: 3847551 - RNA, 19 nt, Shigella flexneri 2a str. 2457T
gauagaaccacgcaaaggc

SEQ ID NO: 3847552 - RNA, 15 nt, Shigella flexneri 2a str. 2457T
gauagaauauuucua

SEQ ID NO: 3847553 - RNA, 22 nt, Shigella flexneri 2a str. 2457T
gauagaauauuucuauauccuc

SEQ ID NO: 3847554 - RNA, 18 nt, Shigella flexneri 2a str. 2457T
gauagaaugccaaguaau

SEQ ID NO: 3847555 - RNA, 17 nt, Shigella flexneri 2a str. 2457T
gauagagagcagucagg

SEQ ID NO: 3847556 - RNA, 20 nt, Shigella flexneri 2a str. 2457T
gauagagagcagucagguuc

SEQ ID NO: 3847557 - RNA, 16 nt, Shigella flexneri 2a str. 2457T
gauagagcaaccaccu

SEQ ID NO: 3847558 - RNA, 16 nt, Shigella flexneri 2a str. 2457T
gauagauauucuccag

SEQ ID NO: 3847559 - RNA, 20 nt, Shigella flexneri 2a str. 2457T
gauagcaagcgcugagacgc

SEQ ID NO: 3847560 - RNA, 22 nt, Shigella flexneri 2a str. 2457T
gauagcaagcgcugagacgcgc

SEQ ID NO: 3847561 - RNA, 19 nt, Shigella flexneri 2a str. 2457T
gauagcacgacguuucuuu

SEQ ID NO: 3847562 - RNA, 18 nt, Shigella flexneri 2a str. 2457T
gauagcacgucacggacu

SEQ ID NO: 3847563 - RNA, 12 nt, Shigella flexneri 2a str. 2457T
gauagccaggcg

SEQ ID NO: 3847564 - RNA, 16 nt, Shigella flexneri 2a str. 2457T
gauagcgcacgcgcuu

SEQ ID NO: 3847565 - RNA, 19 nt, Shigella flexneri 2a str. 2457T
gauagcgcacgcgcuucac

SEQ ID NO: 3847566 - RNA, 22 nt, Shigella flexneri 2a str. 2457T
gauagcgucauuucuacgggua

SEQ ID NO: 3847567 - RNA, 14 nt, Shigella flexneri 2a str. 2457T
gauaggcaccgcca

SEQ ID NO: 3847568 - RNA, 19 nt, Shigella flexneri 2a str. 2457T
gauaguaagauuauauaau

SEQ ID NO: 3847569 - RNA, 12 nt, Shigella flexneri 2a str. 2457T
gauagucaugau

SEQ ID NO: 3847570 - RNA, 20 nt, Shigella flexneri 2a str. 2457T
gauagugcugccaucuucuu

SEQ ID NO: 3847571 - RNA, 21 nt, Shigella flexneri 2a str. 2457T
gauaguguuuuauguucagau

SEQ ID NO: 3847572 - RNA, 20 nt, Shigella flexneri 2a str. 2457T
gauaguucgcgaucgcgcca

SEQ ID NO: 3847573 - RNA, 17 nt, Shigella flexneri 2a str. 2457T
gauauaccgugcugacu

SEQ ID NO: 3847574 - RNA, 14 nt, Shigella flexneri 2a str. 2457T
gauaucaccaccaa

SEQ ID NO: 3847575 - RNA, 14 nt, Shigella flexneri 2a str. 2457T
gauaucagccugca

SEQ ID NO: 3847576 - RNA, 21 nt, Shigella flexneri 2a str. 2457T
gauaucauuaaaguuaucgcc

SEQ ID NO: 3847577 - RNA, 19 nt, Shigella flexneri 2a str. 2457T
gauauccacccgcagccau

SEQ ID NO: 3847578 - RNA, 21 nt, Shigella flexneri 2a str. 2457T
gauauccagauccagcaccuu

SEQ ID NO: 3847579 - RNA, 13 nt, Shigella flexneri 2a str. 2457T
gauauccagcgcc

SEQ ID NO: 3847580 - RNA, 16 nt, Shigella flexneri 2a str. 2457T
gauaucccgccagcac

SEQ ID NO: 3847581 - RNA, 14 nt, Shigella flexneri 2a str. 2457T
gauauccgccaaua

SEQ ID NO: 3847582 - RNA, 13 nt, Shigella flexneri 2a str. 2457T
gauaucgccgguu

SEQ ID NO: 3847583 - RNA, 16 nt, Shigella flexneri 2a str. 2457T
gauaucggaggccugu

SEQ ID NO: 3847584 - RNA, 16 nt, Shigella flexneri 2a str. 2457T
gauaucuacaaaacca

SEQ ID NO: 3847585 - RNA, 15 nt, Shigella flexneri 2a str. 2457T
gauaucugcccgcac

SEQ ID NO: 3847586 - RNA, 14 nt, Shigella flexneri 2a str. 2457T
gauaugcagcagcc

SEQ ID NO: 3847587 - RNA, 13 nt, Shigella flexneri 2a str. 2457T
gauaugcaucaug

SEQ ID NO: 3847588 - RNA, 17 nt, Shigella flexneri 2a str. 2457T
gauaugcaucaugaaaa

SEQ ID NO: 3847589 - RNA, 16 nt, Shigella flexneri 2a str. 2457T
gauaugcgagcaccug

SEQ ID NO: 3847590 - RNA, 14 nt, Shigella flexneri 2a str. 2457T
gauaugcgucagau

SEQ ID NO: 3847591 - RNA, 19 nt, Shigella flexneri 2a str. 2457T
gauauggucaaugauuucu

SEQ ID NO: 3847592 - RNA, 20 nt, Shigella flexneri 2a str. 2457T
gauauguucagaaagcgcca

SEQ ID NO: 3847593 - RNA, 23 nt, Shigella flexneri 2a str. 2457T
gauauguucaggauauuuauauu

SEQ ID NO: 3847594 - RNA, 21 nt, Shigella flexneri 2a str. 2457T
gauauuauccccugcgauggu

SEQ ID NO: 3847595 - RNA, 20 nt, Shigella flexneri 2a str. 2457T
gauauucaggcguugaaaaa

SEQ ID NO: 3847596 - RNA, 18 nt, Shigella flexneri 2a str. 2457T
gauauucaucuccagcac

SEQ ID NO: 3847597 - RNA, 20 nt, Shigella flexneri 2a str. 2457T
gauauucaucuccagcacgu

SEQ ID NO: 3847598 - RNA, 16 nt, Shigella flexneri 2a str. 2457T
gauauuccccagacga

SEQ ID NO: 3847599 - RNA, 23 nt, Shigella flexneri 2a str. 2457T
gauauuccccagacgagagugac

SEQ ID NO: 3847600 - RNA, 16 nt, Shigella flexneri 2a str. 2457T
gauauucuccagcuuc

SEQ ID NO: 3847601 - RNA, 12 nt, Shigella flexneri 2a str. 2457T
gauauugacgau

SEQ ID NO: 3847602 - RNA, 20 nt, Shigella flexneri 2a str. 2457T
gauauugauucaucucuucu

SEQ ID NO: 3847603 - RNA, 21 nt, Shigella flexneri 2a str. 2457T
gauauugauucaucucuucuu

SEQ ID NO: 3847604 - RNA, 21 nt, Shigella flexneri 2a str. 2457T
gauauugccgcgauagcaagc

SEQ ID NO: 3847605 - RNA, 13 nt, Shigella flexneri 2a str. 2457T
gaucaaacgaagc

SEQ ID NO: 3847606 - RNA, 14 nt, Shigella flexneri 2a str. 2457T
gaucaaacgccgau

SEQ ID NO: 3847607 - RNA, 14 nt, Shigella flexneri 2a str. 2457T
gaucaaauaaccgg

SEQ ID NO: 3847608 - RNA, 16 nt, Shigella flexneri 2a str. 2457T
gaucaaauacuucaau

SEQ ID NO: 3847609 - RNA, 14 nt, Shigella flexneri 2a str. 2457T
gaucaaaucucgcc

SEQ ID NO: 3847610 - RNA, 14 nt, Shigella flexneri 2a str. 2457T
gaucaacacaucca

SEQ ID NO: 3847611 - RNA, 22 nt, Shigella flexneri 2a str. 2457T
gaucaaccgcuacauacuuaaa

SEQ ID NO: 3847612 - RNA, 14 nt, Shigella flexneri 2a str. 2457T
gaucaacgcuggca

SEQ ID NO: 3847613 - RNA, 19 nt, Shigella flexneri 2a str. 2457T
gaucaagcacaugcugaca

SEQ ID NO: 3847614 - RNA, 17 nt, Shigella flexneri 2a str. 2457T
gaucaagccccagcagg

SEQ ID NO: 3847615 - RNA, 13 nt, Shigella flexneri 2a str. 2457T
gaucaauuucaca

SEQ ID NO: 3847616 - RNA, 18 nt, Shigella flexneri 2a str. 2457T
gaucacagcaguccagcg

SEQ ID NO: 3847617 - RNA, 20 nt, Shigella flexneri 2a str. 2457T
gaucacagcaguccagcgcg

SEQ ID NO: 3847618 - RNA, 21 nt, Shigella flexneri 2a str. 2457T
gaucacauccaguacgccuuc

SEQ ID NO: 3847619 - RNA, 13 nt, Shigella flexneri 2a str. 2457T
gaucacaucgccg

SEQ ID NO: 3847620 - RNA, 19 nt, Shigella flexneri 2a str. 2457T
gaucaccaguccaucggca

SEQ ID NO: 3847621 - RNA, 23 nt, Shigella flexneri 2a str. 2457T
gaucaccaguccaucggcauuaa

SEQ ID NO: 3847622 - RNA, 17 nt, Shigella flexneri 2a str. 2457T
gaucaccgcagaagcga

SEQ ID NO: 3847623 - RNA, 15 nt, Shigella flexneri 2a str. 2457T
gaucaccugcacaug

SEQ ID NO: 3847624 - RNA, 15 nt, Shigella flexneri 2a str. 2457T
gaucacucacccgcu

SEQ ID NO: 3847625 - RNA, 14 nt, Shigella flexneri 2a str. 2457T
gaucacuuccagca

SEQ ID NO: 3847626 - RNA, 16 nt, Shigella flexneri 2a str. 2457T
gaucacuuccagcagu

SEQ ID NO: 3847627 - RNA, 20 nt, Shigella flexneri 2a str. 2457T
gaucacuucgcgcaaccagu

SEQ ID NO: 3847628 - RNA, 20 nt, Shigella flexneri 2a str. 2457T
gaucagaagcguaaccgagc

SEQ ID NO: 3847629 - RNA, 16 nt, Shigella flexneri 2a str. 2457T
gaucagacacaauaau

SEQ ID NO: 3847630 - RNA, 23 nt, Shigella flexneri 2a str. 2457T
gaucagacgacaaucaaccagca

SEQ ID NO: 3847631 - RNA, 17 nt, Shigella flexneri 2a str. 2457T
gaucagaguugaaaaac

SEQ ID NO: 3847632 - RNA, 23 nt, Shigella flexneri 2a str. 2457T
gaucagauugccgugaaccugcg

SEQ ID NO: 3847633 - RNA, 19 nt, Shigella flexneri 2a str. 2457T
gaucagcaaauccaucgcc

SEQ ID NO: 3847634 - RNA, 20 nt, Shigella flexneri 2a str. 2457T
gaucagcaaauccaucgccu

SEQ ID NO: 3847635 - RNA, 11 nt, Shigella flexneri 2a str. 2457T
gaucagcaucc

SEQ ID NO: 3847636 - RNA, 12 nt, Shigella flexneri 2a str. 2457T
gaucagcauuuc

SEQ ID NO: 3847637 - RNA, 13 nt, Shigella flexneri 2a str. 2457T
gaucagcauuucg

SEQ ID NO: 3847638 - RNA, 21 nt, Shigella flexneri 2a str. 2457T
gaucagcgaagcgugauuguu

SEQ ID NO: 3847639 - RNA, 16 nt, Shigella flexneri 2a str. 2457T
gaucagcggacgcugc

SEQ ID NO: 3847640 - RNA, 13 nt, Shigella flexneri 2a str. 2457T
gaucagcgguggu

SEQ ID NO: 3847641 - RNA, 15 nt, Shigella flexneri 2a str. 2457T
gaucagcggugguga

SEQ ID NO: 3847642 - RNA, 13 nt, Shigella flexneri 2a str. 2457T
gaucagcgguuuu

SEQ ID NO: 3847643 - RNA, 11 nt, Shigella flexneri 2a str. 2457T
gaucaguaaac

SEQ ID NO: 3847644 - RNA, 13 nt, Shigella flexneri 2a str. 2457T
gaucauccgcaca

SEQ ID NO: 3847645 - RNA, 21 nt, Shigella flexneri 2a str. 2457T
gaugccggaaucaaccauggu

SEQ ID NO: 3847646 - RNA, 18 nt, Shigella flexneri 2a str. 2457T
gaugccggaugcggcgug

SEQ ID NO: 3847647 - RNA, 21 nt, Shigella flexneri 2a str. 2457T
gaugccgggacgaucggcgag

SEQ ID NO: 3847648 - RNA, 18 nt, Shigella flexneri 2a str. 2457T
gaugccgguuaauacgcc

SEQ ID NO: 3847649 - RNA, 21 nt, Shigella flexneri 2a str. 2457T
gaugccgucuuugucggugga

SEQ ID NO: 3847650 - RNA, 15 nt, Shigella flexneri 2a str. 2457T
gaugccgugcagcac

SEQ ID NO: 3847651 - RNA, 21 nt, Shigella flexneri 2a str. 2457T
gaugccguuccacccagcuca

SEQ ID NO: 3847652 - RNA, 18 nt, Shigella flexneri 2a str. 2457T
gaugccugaugcgacgcu

SEQ ID NO: 3847653 - RNA, 19 nt, Shigella flexneri 2a str. 2457T
gaugccugauguacaacca

SEQ ID NO: 3847654 - RNA, 18 nt, Shigella flexneri 2a str. 2457T
gaugccugaugugacgcu

SEQ ID NO: 3847655 - RNA, 19 nt, Shigella flexneri 2a str. 2457T
gaugccugcuuccgccacc

SEQ ID NO: 3847656 - RNA, 17 nt, Shigella flexneri 2a str. 2457T
gaugccuugugggccug

SEQ ID NO: 3847657 - RNA, 13 nt, Shigella flexneri 2a str. 2457T
gaugcgacgcuua

SEQ ID NO: 3847658 - RNA, 19 nt, Shigella flexneri 2a str. 2457T
gaugcgacggcaccacauu

SEQ ID NO: 3847659 - RNA, 18 nt, Shigella flexneri 2a str. 2457T
gaugcgacuugucaucau

SEQ ID NO: 3847660 - RNA, 21 nt, Shigella flexneri 2a str. 2457T
gaugcgaugcauccggcaguc

SEQ ID NO: 3847661 - RNA, 19 nt, Shigella flexneri 2a str. 2457T
gaugcgaugcuggcgcauc

SEQ ID NO: 3847662 - RNA, 19 nt, Shigella flexneri 2a str. 2457T
gaugcgcgaacuggaugaa

SEQ ID NO: 3847663 - RNA, 17 nt, Shigella flexneri 2a str. 2457T
gaugcgcuacgcucauc

SEQ ID NO: 3847664 - RNA, 15 nt, Shigella flexneri 2a str. 2457T
gaugcgcuacgcuua

SEQ ID NO: 3847665 - RNA, 17 nt, Shigella flexneri 2a str. 2457T
gaugcgcuacgcuuauc

SEQ ID NO: 3847666 - RNA, 15 nt, Shigella flexneri 2a str. 2457T
gaugcggcguaaacg

SEQ ID NO: 3847667 - RNA, 20 nt, Shigella flexneri 2a str. 2457T
gaugcggcguaaacgccuua

SEQ ID NO: 3847668 - RNA, 21 nt, Shigella flexneri 2a str. 2457T
gaugcggcguaaacgccuuau

SEQ ID NO: 3847669 - RNA, 20 nt, Shigella flexneri 2a str. 2457T
gaugcggcguaaaugccuua

SEQ ID NO: 3847670 - RNA, 20 nt, Shigella flexneri 2a str. 2457T
gaugcggcguuaacgccuua

SEQ ID NO: 3847671 - RNA, 18 nt, Shigella flexneri 2a str. 2457T
gaugcgggucaggccagg

SEQ ID NO: 3847672 - RNA, 20 nt, Shigella flexneri 2a str. 2457T
gaugcggucgcugacgccau

SEQ ID NO: 3847673 - RNA, 20 nt, Shigella flexneri 2a str. 2457T
gaugcguaccucacguucca

SEQ ID NO: 3847674 - RNA, 13 nt, Shigella flexneri 2a str. 2457T
gaugcguucaccu

SEQ ID NO: 3847675 - RNA, 17 nt, Shigella flexneri 2a str. 2457T
gaugcucuuuucugaag

SEQ ID NO: 3847676 - RNA, 22 nt, Shigella flexneri 2a str. 2457T
gaugcugcggcggcggaaaaag

SEQ ID NO: 3847677 - RNA, 21 nt, Shigella flexneri 2a str. 2457T
gaugcuggcggcgcgauaaaa

SEQ ID NO: 3847678 - RNA, 11 nt, Shigella flexneri 2a str. 2457T
gaugcuugaug

SEQ ID NO: 3847679 - RNA, 13 nt, Shigella flexneri 2a str. 2457T
gaugcuuucccac

SEQ ID NO: 3847680 - RNA, 19 nt, Shigella flexneri 2a str. 2457T
gauggaaaaagagcagcug

SEQ ID NO: 3847681 - RNA, 22 nt, Shigella flexneri 2a str. 2457T
gauggaacaaaauuuucagcgu

SEQ ID NO: 3847682 - RNA, 18 nt, Shigella flexneri 2a str. 2457T
gauggaagaaaccagcgu

SEQ ID NO: 3847683 - RNA, 15 nt, Shigella flexneri 2a str. 2457T
gauggaucaacuugg

SEQ ID NO: 3847684 - RNA, 13 nt, Shigella flexneri 2a str. 2457T
gauggauugcuga

SEQ ID NO: 3847685 - RNA, 17 nt, Shigella flexneri 2a str. 2457T
gauggcaaaugcagcau

SEQ ID NO: 3847686 - RNA, 17 nt, Shigella flexneri 2a str. 2457T
gauggcaagcggugcga

SEQ ID NO: 3847687 - RNA, 19 nt, Shigella flexneri 2a str. 2457T
gauggcaauauguggcuug

SEQ ID NO: 3847688 - RNA, 17 nt, Shigella flexneri 2a str. 2457T
gauggcaauuuucacug

SEQ ID NO: 3847689 - RNA, 16 nt, Shigella flexneri 2a str. 2457T
gauggcagucuggaca

SEQ ID NO: 3847690 - RNA, 19 nt, Shigella flexneri 2a str. 2457T
gauggcauaccauccggca

SEQ ID NO: 3847691 - RNA, 13 nt, Shigella flexneri 2a str. 2457T
gauggcauuaccg

SEQ ID NO: 3847692 - RNA, 13 nt, Shigella flexneri 2a str. 2457T
gauggcccggcgg

SEQ ID NO: 3847693 - RNA, 19 nt, Shigella flexneri 2a str. 2457T
gauggccugaugugacgcu

SEQ ID NO: 3847694 - RNA, 16 nt, Shigella flexneri 2a str. 2457T
gauggcgauaaucuuu

SEQ ID NO: 3847695 - RNA, 16 nt, Shigella flexneri 2a str. 2457T
gauggcgggacagcau

SEQ ID NO: 3847696 - RNA, 17 nt, Shigella flexneri 2a str. 2457T
gauggcguuacauuucc

SEQ ID NO: 3847697 - RNA, 18 nt, Shigella flexneri 2a str. 2457T
gauggcguuuaaucgccu

SEQ ID NO: 3847698 - RNA, 21 nt, Shigella flexneri 2a str. 2457T
gauggcuauuacuuuaagccu

SEQ ID NO: 3847699 - RNA, 20 nt, Shigella flexneri 2a str. 2457T
gauggcuguuuucagcacca

SEQ ID NO: 3847700 - RNA, 19 nt, Shigella flexneri 2a str. 2457T
gauggcuugcgucauccag

SEQ ID NO: 3847701 - RNA, 16 nt, Shigella flexneri 2a str. 2457T
gaugggauaaagaucu

SEQ ID NO: 3847702 - RNA, 23 nt, Shigella flexneri 2a str. 2457T
gaugggcgaagagaaagaacgag

SEQ ID NO: 3847703 - RNA, 21 nt, Shigella flexneri 2a str. 2457T
gaugggcgccauuuuucacug

SEQ ID NO: 3847704 - RNA, 23 nt, Shigella flexneri 2a str. 2457T
gaugggcguuuucuaccagguuu

SEQ ID NO: 3847705 - RNA, 18 nt, Shigella flexneri 2a str. 2457T
gaugguacuucaaucgcc

SEQ ID NO: 3847706 - RNA, 23 nt, Shigella flexneri 2a str. 2457T
gaugguacuucaaucgccaccac

SEQ ID NO: 3847707 - RNA, 15 nt, Shigella flexneri 2a str. 2457T
gaugguauucaucgc

SEQ ID NO: 3847708 - RNA, 16 nt, Shigella flexneri 2a str. 2457T
gaugguauucaucgcg

SEQ ID NO: 3847709 - RNA, 23 nt, Shigella flexneri 2a str. 2457T
gauggucacggacaggugaugca

SEQ ID NO: 3847710 - RNA, 19 nt, Shigella flexneri 2a str. 2457T
gauggucgcuuuguggcgg

SEQ ID NO: 3847711 - RNA, 22 nt, Shigella flexneri 2a str. 2457T
gauggugcaaauugcaccaucc

SEQ ID NO: 3847712 - RNA, 16 nt, Shigella flexneri 2a str. 2457T
gaugguuuugcuuuau

SEQ ID NO: 3847713 - RNA, 13 nt, Shigella flexneri 2a str. 2457T
gauguaaugagaa

SEQ ID NO: 3847714 - RNA, 17 nt, Shigella flexneri 2a str. 2457T
gauguaauuaagcgcaa

SEQ ID NO: 3847715 - RNA, 21 nt, Shigella flexneri 2a str. 2457T
gauguacuucaacauaacgca

SEQ ID NO: 3847716 - RNA, 20 nt, Shigella flexneri 2a str. 2457T
gaugucauaaaucagcguga

SEQ ID NO: 3847717 - RNA, 16 nt, Shigella flexneri 2a str. 2457T
gaugucgcuuccauug

SEQ ID NO: 3847718 - RNA, 18 nt, Shigella flexneri 2a str. 2457T
gaugucggcauaaagcug

SEQ ID NO: 3847719 - RNA, 14 nt, Shigella flexneri 2a str. 2457T
gaugugauccauca

SEQ ID NO: 3847720 - RNA, 21 nt, Shigella flexneri 2a str. 2457T
gaugugaugcccggucgcucc

SEQ ID NO: 3847721 - RNA, 17 nt, Shigella flexneri 2a str. 2457T
gaugugauggccgcgca

SEQ ID NO: 3847722 - RNA, 18 nt, Shigella flexneri 2a str. 2457T
gaugugcaguuccugcaa

SEQ ID NO: 3847723 - RNA, 20 nt, Shigella flexneri 2a str. 2457T
gaugugcgguggcuucgccu

SEQ ID NO: 3847724 - RNA, 19 nt, Shigella flexneri 2a str. 2457T
gauguggugcaaggaaaua

SEQ ID NO: 3847725 - RNA, 13 nt, Shigella flexneri 2a str. 2457T
gauguuccgccau

SEQ ID NO: 3847726 - RNA, 21 nt, Shigella flexneri 2a str. 2457T
gauguugguaaccaaaucucc

SEQ ID NO: 3847727 - RNA, 18 nt, Shigella flexneri 2a str. 2457T
gauguuguacaugcugcu

SEQ ID NO: 3847728 - RNA, 18 nt, Shigella flexneri 2a str. 2457T
gauguuguuuuuaaccaa

SEQ ID NO: 3847729 - RNA, 14 nt, Shigella flexneri 2a str. 2457T
gauguuugagcuaa

SEQ ID NO: 3847730 - RNA, 18 nt, Shigella flexneri 2a str. 2457T
gauguuuucugccucugc

SEQ ID NO: 3847731 - RNA, 18 nt, Shigella flexneri 2a str. 2457T
gauuaaaaacccugcaga

SEQ ID NO: 3847732 - RNA, 20 nt, Shigella flexneri 2a str. 2457T
gauuaaaggaaggucaucca

SEQ ID NO: 3847733 - RNA, 18 nt, Shigella flexneri 2a str. 2457T
gauuaacgcgccggaaau

SEQ ID NO: 3847734 - RNA, 13 nt, Shigella flexneri 2a str. 2457T
gauuaauuacaca

SEQ ID NO: 3847735 - RNA, 13 nt, Shigella flexneri 2a str. 2457T
gauuacaaauaaa

SEQ ID NO: 3847736 - RNA, 17 nt, Shigella flexneri 2a str. 2457T
gauuacaucgcgaagaa

SEQ ID NO: 3847737 - RNA, 12 nt, Shigella flexneri 2a str. 2457T
gauuacgcaccg

SEQ ID NO: 3847738 - RNA, 18 nt, Shigella flexneri 2a str. 2457T
gauuacgcgcucaccgcu

SEQ ID NO: 3847739 - RNA, 21 nt, Shigella flexneri 2a str. 2457T
gauuacugcaaacucaucgcc

SEQ ID NO: 3847740 - RNA, 19 nt, Shigella flexneri 2a str. 2457T
gauuacuguacagauccgc

SEQ ID NO: 3847741 - RNA, 17 nt, Shigella flexneri 2a str. 2457T
gauuacuuuauuuauau

SEQ ID NO: 3847742 - RNA, 13 nt, Shigella flexneri 2a str. 2457T
gcaaaaucaccau

SEQ ID NO: 3847743 - RNA, 15 nt, Shigella flexneri 2a str. 2457T
gcaaaaucaccauca

SEQ ID NO: 3847744 - RNA, 19 nt, Shigella flexneri 2a str. 2457T
gcaaaaucaucacucccuu

SEQ ID NO: 3847745 - RNA, 22 nt, Shigella flexneri 2a str. 2457T
gcaaaaugcaucggcauaauca

SEQ ID NO: 3847746 - RNA, 14 nt, Shigella flexneri 2a str. 2457T
gcaaaauuagcucg

SEQ ID NO: 3847747 - RNA, 14 nt, Shigella flexneri 2a str. 2457T
gcaaacaccagcga

SEQ ID NO: 3847748 - RNA, 14 nt, Shigella flexneri 2a str. 2457T
gcaaacaggaacac

SEQ ID NO: 3847749 - RNA, 19 nt, Shigella flexneri 2a str. 2457T
gcaaacaggaacaccagca

SEQ ID NO: 3847750 - RNA, 17 nt, Shigella flexneri 2a str. 2457T
gcaaacaggugcuccag

SEQ ID NO: 3847751 - RNA, 13 nt, Shigella flexneri 2a str. 2457T
gcaaacaguuucu

SEQ ID NO: 3847752 - RNA, 22 nt, Shigella flexneri 2a str. 2457T
gcaaacaguuucugcagcucca

SEQ ID NO: 3847753 - RNA, 17 nt, Shigella flexneri 2a str. 2457T
gcaaacaucggcuuauu

SEQ ID NO: 3847754 - RNA, 15 nt, Shigella flexneri 2a str. 2457T
gcaaaccaggccggu

SEQ ID NO: 3847755 - RNA, 18 nt, Shigella flexneri 2a str. 2457T
gcaaaccaggccgguaac

SEQ ID NO: 3847756 - RNA, 14 nt, Shigella flexneri 2a str. 2457T
gcaaaccucaccgc

SEQ ID NO: 3847757 - RNA, 14 nt, Shigella flexneri 2a str. 2457T
gcaaaccuggcaac

SEQ ID NO: 3847758 - RNA, 14 nt, Shigella flexneri 2a str. 2457T
gcaaacgaaagcag

SEQ ID NO: 3847759 - RNA, 15 nt, Shigella flexneri 2a str. 2457T
gcaaacgccaccugu

SEQ ID NO: 3847760 - RNA, 17 nt, Shigella flexneri 2a str. 2457T
gcaaacggcgcgacuuu

SEQ ID NO: 3847761 - RNA, 23 nt, Shigella flexneri 2a str. 2457T
gcaaacgguuguagcucggcgca

SEQ ID NO: 3847762 - RNA, 16 nt, Shigella flexneri 2a str. 2457T
gcaaacguaaaacugc

SEQ ID NO: 3847763 - RNA, 19 nt, Shigella flexneri 2a str. 2457T
gcaaacucugagagaucuu

SEQ ID NO: 3847764 - RNA, 11 nt, Shigella flexneri 2a str. 2457T
gcaaacugagu

SEQ ID NO: 3847765 - RNA, 16 nt, Shigella flexneri 2a str. 2457T
gcaaacugaguggagu

SEQ ID NO: 3847766 - RNA, 23 nt, Shigella flexneri 2a str. 2457T
gcaaacugcugauguuguuucuc

SEQ ID NO: 3847767 - RNA, 20 nt, Shigella flexneri 2a str. 2457T
gcaaacugucuaauggugaa

SEQ ID NO: 3847768 - RNA, 14 nt, Shigella flexneri 2a str. 2457T
gcaaagacgacuuu

SEQ ID NO: 3847769 - RNA, 21 nt, Shigella flexneri 2a str. 2457T
gcaaagcaaauuuugugggca

SEQ ID NO: 3847770 - RNA, 19 nt, Shigella flexneri 2a str. 2457T
gcaaagcauuuuuucacau

SEQ ID NO: 3847771 - RNA, 18 nt, Shigella flexneri 2a str. 2457T
gcaaagccgauaccuucc

SEQ ID NO: 3847772 - RNA, 16 nt, Shigella flexneri 2a str. 2457T
gcaaagcggucuucug

SEQ ID NO: 3847773 - RNA, 21 nt, Shigella flexneri 2a str. 2457T
gcaaagcgugcaaauauacau

SEQ ID NO: 3847774 - RNA, 16 nt, Shigella flexneri 2a str. 2457T
gcaaaggccagcaauc

SEQ ID NO: 3847775 - RNA, 14 nt, Shigella flexneri 2a str. 2457T
gcaaaggccagcca

SEQ ID NO: 3847776 - RNA, 22 nt, Shigella flexneri 2a str. 2457T
gcaaaggcguuauacugcggca

SEQ ID NO: 3847777 - RNA, 14 nt, Shigella flexneri 2a str. 2457T
gcaaagguuuuacc

SEQ ID NO: 3847778 - RNA, 19 nt, Shigella flexneri 2a str. 2457T
gcaaaguaauaaugaucag

SEQ ID NO: 3847779 - RNA, 18 nt, Shigella flexneri 2a str. 2457T
gcaaaguagcggccugac

SEQ ID NO: 3847780 - RNA, 16 nt, Shigella flexneri 2a str. 2457T
gcaaagugaauacaga

SEQ ID NO: 3847781 - RNA, 20 nt, Shigella flexneri 2a str. 2457T
gcaaagugaauacagaacag

SEQ ID NO: 3847782 - RNA, 21 nt, Shigella flexneri 2a str. 2457T
gcaaagugaauacagaacagu

SEQ ID NO: 3847783 - RNA, 13 nt, Shigella flexneri 2a str. 2457T
gcaaagugccccc

SEQ ID NO: 3847784 - RNA, 15 nt, Shigella flexneri 2a str. 2457T
gcaaagugcccccaa

SEQ ID NO: 3847785 - RNA, 22 nt, Shigella flexneri 2a str. 2457T
gcaaaguggcgcagagccugaa

SEQ ID NO: 3847786 - RNA, 17 nt, Shigella flexneri 2a str. 2457T
gcaaaguuugugaucuu

SEQ ID NO: 3847787 - RNA, 15 nt, Shigella flexneri 2a str. 2457T
gcaaauaacguaaaa

SEQ ID NO: 3847788 - RNA, 17 nt, Shigella flexneri 2a str. 2457T
gcaaauacccaaaaaau

SEQ ID NO: 3847789 - RNA, 21 nt, Shigella flexneri 2a str. 2457T
gcaaauaccggacacacuuca

SEQ ID NO: 3847790 - RNA, 19 nt, Shigella flexneri 2a str. 2457T
gcaaauacugacuggcaag

SEQ ID NO: 3847791 - RNA, 14 nt, Shigella flexneri 2a str. 2457T
gcaaauauuaauaa

SEQ ID NO: 3847792 - RNA, 16 nt, Shigella flexneri 2a str. 2457T
gcaaauauuaauaaua

SEQ ID NO: 3847793 - RNA, 21 nt, Shigella flexneri 2a str. 2457T
gcaaaucaauagugaacugac

SEQ ID NO: 3847794 - RNA, 16 nt, Shigella flexneri 2a str. 2457T
gcaaauccaucgccug

SEQ ID NO: 3847795 - RNA, 15 nt, Shigella flexneri 2a str. 2457T
gcaaaucccaucggu

SEQ ID NO: 3847796 - RNA, 22 nt, Shigella flexneri 2a str. 2457T
gcaaaucgacgccacaaucuga

SEQ ID NO: 3847797 - RNA, 23 nt, Shigella flexneri 2a str. 2457T
gcaaaucgacgccacaaucugau

SEQ ID NO: 3847798 - RNA, 18 nt, Shigella flexneri 2a str. 2457T
gcaaaucgcugaauaucu

SEQ ID NO: 3847799 - RNA, 23 nt, Shigella flexneri 2a str. 2457T
gcaaaucguauccggcauuauca

SEQ ID NO: 3847800 - RNA, 15 nt, Shigella flexneri 2a str. 2457T
gcaaaugcagcauug

SEQ ID NO: 3847801 - RNA, 18 nt, Shigella flexneri 2a str. 2457T
gcaaaugcagcauugccu

SEQ ID NO: 3847802 - RNA, 11 nt, Shigella flexneri 2a str. 2457T
gcaaaugccag

SEQ ID NO: 3847803 - RNA, 19 nt, Shigella flexneri 2a str. 2457T
gcaaauucaauaaauugca

SEQ ID NO: 3847804 - RNA, 16 nt, Shigella flexneri 2a str. 2457T
gcaaauucauuaccaa

SEQ ID NO: 3847805 - RNA, 20 nt, Shigella flexneri 2a str. 2457T
gcaaauucggcggcgugccu

SEQ ID NO: 3847806 - RNA, 16 nt, Shigella flexneri 2a str. 2457T
gcaaauugcauacugc

SEQ ID NO: 3847807 - RNA, 15 nt, Shigella flexneri 2a str. 2457T
gcaaauuuauuaucu

SEQ ID NO: 3847808 - RNA, 21 nt, Shigella flexneri 2a str. 2457T
gcaacaaaauccgccguaaau

SEQ ID NO: 3847809 - RNA, 12 nt, Shigella flexneri 2a str. 2457T
gcaacaacagcg

SEQ ID NO: 3847810 - RNA, 13 nt, Shigella flexneri 2a str. 2457T
gcaacaacagcgc

SEQ ID NO: 3847811 - RNA, 12 nt, Shigella flexneri 2a str. 2457T
gcaacaacugaa

SEQ ID NO: 3847812 - RNA, 13 nt, Shigella flexneri 2a str. 2457T
gcaacaacugaaa

SEQ ID NO: 3847813 - RNA, 16 nt, Shigella flexneri 2a str. 2457T
gcaacaacugaaaaaa

SEQ ID NO: 3847814 - RNA, 17 nt, Shigella flexneri 2a str. 2457T
gcaacaaucgggaaaau

SEQ ID NO: 3847815 - RNA, 20 nt, Shigella flexneri 2a str. 2457T
gcaacaaugccacgccacag

SEQ ID NO: 3847816 - RNA, 22 nt, Shigella flexneri 2a str. 2457T
gcaacaaugcucucuucgccaa

SEQ ID NO: 3847817 - RNA, 19 nt, Shigella flexneri 2a str. 2457T
gcaacaauggcauuuaucu

SEQ ID NO: 3847818 - RNA, 15 nt, Shigella flexneri 2a str. 2457T
gcaacacgccagcgu

SEQ ID NO: 3847819 - RNA, 14 nt, Shigella flexneri 2a str. 2457T
gcaacagaacgcgc

SEQ ID NO: 3847820 - RNA, 17 nt, Shigella flexneri 2a str. 2457T
gcaacagaacgcgccuu

SEQ ID NO: 3847821 - RNA, 16 nt, Shigella flexneri 2a str. 2457T
gcaacagaauuacugg

SEQ ID NO: 3847822 - RNA, 18 nt, Shigella flexneri 2a str. 2457T
gcaacagaauuacuggca

SEQ ID NO: 3847823 - RNA, 13 nt, Shigella flexneri 2a str. 2457T
gcaacagcaauac

SEQ ID NO: 3847824 - RNA, 17 nt, Shigella flexneri 2a str. 2457T
gcaacagcaauacguuu

SEQ ID NO: 3847825 - RNA, 12 nt, Shigella flexneri 2a str. 2457T
gcaacaggcugu

SEQ ID NO: 3847826 - RNA, 15 nt, Shigella flexneri 2a str. 2457T
gcaacauacugcccg

SEQ ID NO: 3847827 - RNA, 15 nt, Shigella flexneri 2a str. 2457T
gcaacauaggcugcu

SEQ ID NO: 3847828 - RNA, 23 nt, Shigella flexneri 2a str. 2457T
gcaacaucaaauuacagcaccuu

SEQ ID NO: 3847829 - RNA, 19 nt, Shigella flexneri 2a str. 2457T
gcaacaugucagcaaucac

SEQ ID NO: 3847830 - RNA, 15 nt, Shigella flexneri 2a str. 2457T
gcaacauguugaauc

SEQ ID NO: 3847831 - RNA, 18 nt, Shigella flexneri 2a str. 2457T
gcaacauguugaaucuuc

SEQ ID NO: 3847832 - RNA, 22 nt, Shigella flexneri 2a str. 2457T
gcaacauugcgccucaccggau

SEQ ID NO: 3847833 - RNA, 17 nt, Shigella flexneri 2a str. 2457T
gcaaccaacgccagcag

SEQ ID NO: 3847834 - RNA, 19 nt, Shigella flexneri 2a str. 2457T
gcaaccaacgccagcagca

SEQ ID NO: 3847835 - RNA, 22 nt, Shigella flexneri 2a str. 2457T
gcaaccaacgccagcagcagcg

SEQ ID NO: 3847836 - RNA, 13 nt, Shigella flexneri 2a str. 2457T
gcaaccaacggcc

SEQ ID NO: 3847837 - RNA, 18 nt, Shigella flexneri 2a str. 2457T
gcaaccacaaaacacucu

SEQ ID NO: 3847838 - RNA, 14 nt, Shigella flexneri 2a str. 2457T
gcaaccacacccac

SEQ ID NO: 3847839 - RNA, 13 nt, Shigella flexneri 2a str. 2457T
gcaaccagcaccg

SEQ ID NO: 3847840 - RNA, 23 nt, Shigella flexneri 2a str. 2457T
gcaaucacugccagaauagccgc

SEQ ID NO: 3847841 - RNA, 18 nt, Shigella flexneri 2a str. 2457T
gcaaucagauaaaauaca

SEQ ID NO: 3847842 - RNA, 22 nt, Shigella flexneri 2a str. 2457T
gcaaucagauaaaauacacuuu

SEQ ID NO: 3847843 - RNA, 23 nt, Shigella flexneri 2a str. 2457T
gcaaucagugguguagggcaggc

SEQ ID NO: 3847844 - RNA, 17 nt, Shigella flexneri 2a str. 2457T
gcaaucauauucaccac

SEQ ID NO: 3847845 - RNA, 18 nt, Shigella flexneri 2a str. 2457T
gcaaucauauucaccacg

SEQ ID NO: 3847846 - RNA, 13 nt, Shigella flexneri 2a str. 2457T
gcaaucaucccag

SEQ ID NO: 3847847 - RNA, 16 nt, Shigella flexneri 2a str. 2457T
gcaaucaucguacugu

SEQ ID NO: 3847848 - RNA, 14 nt, Shigella flexneri 2a str. 2457T
gcaaucaucuugua

SEQ ID NO: 3847849 - RNA, 22 nt, Shigella flexneri 2a str. 2457T
gcaaucaucuuguaggccugau

SEQ ID NO: 3847850 - RNA, 14 nt, Shigella flexneri 2a str. 2457T
gcaauccagcucuu

SEQ ID NO: 3847851 - RNA, 14 nt, Shigella flexneri 2a str. 2457T
gcaauccaguccac

SEQ ID NO: 3847852 - RNA, 23 nt, Shigella flexneri 2a str. 2457T
gcaauccaguccaccugaccugc

SEQ ID NO: 3847853 - RNA, 19 nt, Shigella flexneri 2a str. 2457T
gcaauccccucuucagccg

SEQ ID NO: 3847854 - RNA, 15 nt, Shigella flexneri 2a str. 2457T
gcaauccggaaacca

SEQ ID NO: 3847855 - RNA, 14 nt, Shigella flexneri 2a str. 2457T
gcaaucgaccaggc

SEQ ID NO: 3847856 - RNA, 18 nt, Shigella flexneri 2a str. 2457T
gcaaucgaccaggccauc

SEQ ID NO: 3847857 - RNA, 20 nt, Shigella flexneri 2a str. 2457T
gcaaucgagcccagaugccg

SEQ ID NO: 3847858 - RNA, 14 nt, Shigella flexneri 2a str. 2457T
gcaaucgccagcgg

SEQ ID NO: 3847859 - RNA, 14 nt, Shigella flexneri 2a str. 2457T
gcaaucgcccagcg

SEQ ID NO: 3847860 - RNA, 22 nt, Shigella flexneri 2a str. 2457T
gcaaucgcccagcgcguaaaua

SEQ ID NO: 3847861 - RNA, 18 nt, Shigella flexneri 2a str. 2457T
gcaaucguagcccagcuc

SEQ ID NO: 3847862 - RNA, 20 nt, Shigella flexneri 2a str. 2457T
gcaaucuccguguaggccug

SEQ ID NO: 3847863 - RNA, 19 nt, Shigella flexneri 2a str. 2457T
gcaaucucuucaagcugcu

SEQ ID NO: 3847864 - RNA, 22 nt, Shigella flexneri 2a str. 2457T
gcaaucuguuuauuugacagcc

SEQ ID NO: 3847865 - RNA, 21 nt, Shigella flexneri 2a str. 2457T
gcaaucuuuagcauaaaaacu

SEQ ID NO: 3847866 - RNA, 22 nt, Shigella flexneri 2a str. 2457T
gcaaugagagggcgauaaaucu

SEQ ID NO: 3847867 - RNA, 23 nt, Shigella flexneri 2a str. 2457T
gcaaugagagggcgauaaaucuc

SEQ ID NO: 3847868 - RNA, 16 nt, Shigella flexneri 2a str. 2457T
gcaaugccauccagcu

SEQ ID NO: 3847869 - RNA, 21 nt, Shigella flexneri 2a str. 2457T
gcaaugcccgguguucccgcg

SEQ ID NO: 3847870 - RNA, 12 nt, Shigella flexneri 2a str. 2457T
gcaaugcgcaca

SEQ ID NO: 3847871 - RNA, 18 nt, Shigella flexneri 2a str. 2457T
gcaaugcggagguuucuu

SEQ ID NO: 3847872 - RNA, 18 nt, Shigella flexneri 2a str. 2457T
gcaaugcguagcugagca

SEQ ID NO: 3847873 - RNA, 16 nt, Shigella flexneri 2a str. 2457T
gcaaugcguuccagca

SEQ ID NO: 3847874 - RNA, 14 nt, Shigella flexneri 2a str. 2457T
gcaaugcuuccugc

SEQ ID NO: 3847875 - RNA, 15 nt, Shigella flexneri 2a str. 2457T
gcaauggaaaaaguu

SEQ ID NO: 3847876 - RNA, 18 nt, Shigella flexneri 2a str. 2457T
gcaauggaaaaaguuuua

SEQ ID NO: 3847877 - RNA, 14 nt, Shigella flexneri 2a str. 2457T
gcaauggcugcggc

SEQ ID NO: 3847878 - RNA, 17 nt, Shigella flexneri 2a str. 2457T
gcaauggcuggccccgu

SEQ ID NO: 3847879 - RNA, 17 nt, Shigella flexneri 2a str. 2457T
gcaauggcuucauccac

SEQ ID NO: 3847880 - RNA, 18 nt, Shigella flexneri 2a str. 2457T
gcaauggguaacggcaga

SEQ ID NO: 3847881 - RNA, 20 nt, Shigella flexneri 2a str. 2457T
gcaauggucgcaucauuuaa

SEQ ID NO: 3847882 - RNA, 21 nt, Shigella flexneri 2a str. 2457T
gcaauguugcguuugucauca

SEQ ID NO: 3847883 - RNA, 14 nt, Shigella flexneri 2a str. 2457T
gcaauuaaauaaag

SEQ ID NO: 3847884 - RNA, 12 nt, Shigella flexneri 2a str. 2457T
gcaauuaacgcc

SEQ ID NO: 3847885 - RNA, 20 nt, Shigella flexneri 2a str. 2457T
gcaauuaccgccaccaggaa

SEQ ID NO: 3847886 - RNA, 16 nt, Shigella flexneri 2a str. 2457T
gcaauuagcggcuggc

SEQ ID NO: 3847887 - RNA, 14 nt, Shigella flexneri 2a str. 2457T
gcaauucccagaau

SEQ ID NO: 3847888 - RNA, 13 nt, Shigella flexneri 2a str. 2457T
gcaauucuuucuc

SEQ ID NO: 3847889 - RNA, 18 nt, Shigella flexneri 2a str. 2457T
gcaauucuuucucgcuca

SEQ ID NO: 3847890 - RNA, 22 nt, Shigella flexneri 2a str. 2457T
gcaauuggugcacgaugccuga

SEQ ID NO: 3847891 - RNA, 14 nt, Shigella flexneri 2a str. 2457T
gcaauuuaaacccu

SEQ ID NO: 3847892 - RNA, 13 nt, Shigella flexneri 2a str. 2457T
gcaauuuccauug

SEQ ID NO: 3847893 - RNA, 18 nt, Shigella flexneri 2a str. 2457T
gcaauuuucgccaucuca

SEQ ID NO: 3847894 - RNA, 14 nt, Shigella flexneri 2a str. 2457T
gcaauuuuuaccgc

SEQ ID NO: 3847895 - RNA, 20 nt, Shigella flexneri 2a str. 2457T
gcacaaaaaaucgugcugca

SEQ ID NO: 3847896 - RNA, 14 nt, Shigella flexneri 2a str. 2457T
gcacaaaaucacgu

SEQ ID NO: 3847897 - RNA, 23 nt, Shigella flexneri 2a str. 2457T
gcacaaacccagggccaacuggc

SEQ ID NO: 3847898 - RNA, 15 nt, Shigella flexneri 2a str. 2457T
gcacaaauagccagc

SEQ ID NO: 3847899 - RNA, 18 nt, Shigella flexneri 2a str. 2457T
gcacaaauagccagcaga

SEQ ID NO: 3847900 - RNA, 22 nt, Shigella flexneri 2a str. 2457T
gcacaaauagccagcagagcaa

SEQ ID NO: 3847901 - RNA, 17 nt, Shigella flexneri 2a str. 2457T
gcacaaauggcaaugac

SEQ ID NO: 3847902 - RNA, 12 nt, Shigella flexneri 2a str. 2457T
gcacaacaggcu

SEQ ID NO: 3847903 - RNA, 16 nt, Shigella flexneri 2a str. 2457T
gcacaacgucgcgcga

SEQ ID NO: 3847904 - RNA, 22 nt, Shigella flexneri 2a str. 2457T
gcacaacguuccuucguucaca

SEQ ID NO: 3847905 - RNA, 16 nt, Shigella flexneri 2a str. 2457T
gcacaacucggcggcu

SEQ ID NO: 3847906 - RNA, 16 nt, Shigella flexneri 2a str. 2457T
gcacaagcuaccagcc

SEQ ID NO: 3847907 - RNA, 16 nt, Shigella flexneri 2a str. 2457T
gcacaaguuguuuaca

SEQ ID NO: 3847908 - RNA, 23 nt, Shigella flexneri 2a str. 2457T
gcacaaguuuuuaggcaugauaa

SEQ ID NO: 3847909 - RNA, 17 nt, Shigella flexneri 2a str. 2457T
gcacaauacauagaaac

SEQ ID NO: 3847910 - RNA, 12 nt, Shigella flexneri 2a str. 2457T
gcacaaucacgu

SEQ ID NO: 3847911 - RNA, 18 nt, Shigella flexneri 2a str. 2457T
gcacacaagcguaagaga

SEQ ID NO: 3847912 - RNA, 13 nt, Shigella flexneri 2a str. 2457T
gcacacacaucac

SEQ ID NO: 3847913 - RNA, 11 nt, Shigella flexneri 2a str. 2457T
gcacacacugc

SEQ ID NO: 3847914 - RNA, 24 nt, Shigella flexneri 2a str. 2457T
gcacacacugcuuaacugcgcuuu

SEQ ID NO: 3847915 - RNA, 23 nt, Shigella flexneri 2a str. 2457T
gcacacagggcgcuagccaacuu

SEQ ID NO: 3847916 - RNA, 18 nt, Shigella flexneri 2a str. 2457T
gcacacauuacgccagua

SEQ ID NO: 3847917 - RNA, 15 nt, Shigella flexneri 2a str. 2457T
gcacaccaaccgcuu

SEQ ID NO: 3847918 - RNA, 17 nt, Shigella flexneri 2a str. 2457T
gcacaccaaccgcuucc

SEQ ID NO: 3847919 - RNA, 23 nt, Shigella flexneri 2a str. 2457T
gcacaccaggcucuuuaaacagu

SEQ ID NO: 3847920 - RNA, 20 nt, Shigella flexneri 2a str. 2457T
gcacaccccgcgcagcugag

SEQ ID NO: 3847921 - RNA, 23 nt, Shigella flexneri 2a str. 2457T
gcacacgacauccgugcagaacu

SEQ ID NO: 3847922 - RNA, 16 nt, Shigella flexneri 2a str. 2457T
gcacacggauauugcu

SEQ ID NO: 3847923 - RNA, 16 nt, Shigella flexneri 2a str. 2457T
gcacacguaggccaac

SEQ ID NO: 3847924 - RNA, 12 nt, Shigella flexneri 2a str. 2457T
gcacacguuuca

SEQ ID NO: 3847925 - RNA, 21 nt, Shigella flexneri 2a str. 2457T
gcacacuguucauuaaagccg

SEQ ID NO: 3847926 - RNA, 12 nt, Shigella flexneri 2a str. 2457T
gcacacuuagcc

SEQ ID NO: 3847927 - RNA, 19 nt, Shigella flexneri 2a str. 2457T
gcacacuuagccuguguca

SEQ ID NO: 3847928 - RNA, 21 nt, Shigella flexneri 2a str. 2457T
gcacagaacaaaauguuuaug

SEQ ID NO: 3847929 - RNA, 12 nt, Shigella flexneri 2a str. 2457T
gcacagaccauc

SEQ ID NO: 3847930 - RNA, 21 nt, Shigella flexneri 2a str. 2457T
gcacagacuuaauauugccgu

SEQ ID NO: 3847931 - RNA, 14 nt, Shigella flexneri 2a str. 2457T
gcacagaucgcacu

SEQ ID NO: 3847932 - RNA, 16 nt, Shigella flexneri 2a str. 2457T
gcacagcaaaucaccc

SEQ ID NO: 3847933 - RNA, 23 nt, Shigella flexneri 2a str. 2457T
gcacagcaucaggcuaaucgcca

SEQ ID NO: 3847934 - RNA, 23 nt, Shigella flexneri 2a str. 2457T
gcacagcggaguaaucgccagca

SEQ ID NO: 3847935 - RNA, 16 nt, Shigella flexneri 2a str. 2457T
gcacaggugcaaaaaa

SEQ ID NO: 3847936 - RNA, 16 nt, Shigella flexneri 2a str. 2457T
gcacaguaaugcgcca

SEQ ID NO: 3847937 - RNA, 21 nt, Shigella flexneri 2a str. 2457T
gcacguuagaaacaaaaaaac

SEQ ID NO: 3847938 - RNA, 14 nt, Shigella flexneri 2a str. 2457T
gcacguucauccca

SEQ ID NO: 3847939 - RNA, 16 nt, Shigella flexneri 2a str. 2457T
gcacguucaucccacu

SEQ ID NO: 3847940 - RNA, 13 nt, Shigella flexneri 2a str. 2457T
gcacguuccugca

SEQ ID NO: 3847941 - RNA, 18 nt, Shigella flexneri 2a str. 2457T
gcacguucgaugcggcuc

SEQ ID NO: 3847942 - RNA, 18 nt, Shigella flexneri 2a str. 2457T
gcacguugggcgcuggcg

SEQ ID NO: 3847943 - RNA, 14 nt, Shigella flexneri 2a str. 2457T
gcacguugucagca

SEQ ID NO: 3847944 - RNA, 16 nt, Shigella flexneri 2a str. 2457T
gcacguuuagcuuugg

SEQ ID NO: 3847945 - RNA, 13 nt, Shigella flexneri 2a str. 2457T
gcacuaugugcca

SEQ ID NO: 3847946 - RNA, 17 nt, Shigella flexneri 2a str. 2457T
gcacucaacaaccagaa

SEQ ID NO: 3847947 - RNA, 19 nt, Shigella flexneri 2a str. 2457T
gcacuccgccacgucauca

SEQ ID NO: 3847948 - RNA, 22 nt, Shigella flexneri 2a str. 2457T
gcacuccuguuaugccucaacc

SEQ ID NO: 3847949 - RNA, 14 nt, Shigella flexneri 2a str. 2457T
gcacucgcccugac

SEQ ID NO: 3847950 - RNA, 13 nt, Shigella flexneri 2a str. 2457T
gcacucugacgga

SEQ ID NO: 3847951 - RNA, 18 nt, Shigella flexneri 2a str. 2457T
gcacugaaagccgcaggc

SEQ ID NO: 3847952 - RNA, 16 nt, Shigella flexneri 2a str. 2457T
gcacugaccaccacca

SEQ ID NO: 3847953 - RNA, 21 nt, Shigella flexneri 2a str. 2457T
gcacugccagaaucaagguga

SEQ ID NO: 3847954 - RNA, 16 nt, Shigella flexneri 2a str. 2457T
gcacugcgcccgccag

SEQ ID NO: 3847955 - RNA, 19 nt, Shigella flexneri 2a str. 2457T
gcacugcgcccgccagcau

SEQ ID NO: 3847956 - RNA, 17 nt, Shigella flexneri 2a str. 2457T
gcacuggcggcagcagg

SEQ ID NO: 3847957 - RNA, 18 nt, Shigella flexneri 2a str. 2457T
gcacuggcggcagcaggu

SEQ ID NO: 3847958 - RNA, 19 nt, Shigella flexneri 2a str. 2457T
gcacuguuacugucggcaa

SEQ ID NO: 3847959 - RNA, 15 nt, Shigella flexneri 2a str. 2457T
gcacuguuucgccag

SEQ ID NO: 3847960 - RNA, 18 nt, Shigella flexneri 2a str. 2457T
gcacuucacccaucgcca

SEQ ID NO: 3847961 - RNA, 19 nt, Shigella flexneri 2a str. 2457T
gcacuucacccaucgccag

SEQ ID NO: 3847962 - RNA, 20 nt, Shigella flexneri 2a str. 2457T
gcacuucacccaucgccaga

SEQ ID NO: 3847963 - RNA, 14 nt, Shigella flexneri 2a str. 2457T
gcacuuccagcggc

SEQ ID NO: 3847964 - RNA, 19 nt, Shigella flexneri 2a str. 2457T
gcacuucgccaucugccag

SEQ ID NO: 3847965 - RNA, 23 nt, Shigella flexneri 2a str. 2457T
gcacuucgccaucugccagaccc

SEQ ID NO: 3847966 - RNA, 15 nt, Shigella flexneri 2a str. 2457T
gcacuucuuccgggc

SEQ ID NO: 3847967 - RNA, 12 nt, Shigella flexneri 2a str. 2457T
gcacuugcagga

SEQ ID NO: 3847968 - RNA, 19 nt, Shigella flexneri 2a str. 2457T
gcacuuucgccugcggcgc

SEQ ID NO: 3847969 - RNA, 22 nt, Shigella flexneri 2a str. 2457T
gcacuuugccagaaauccaggc

SEQ ID NO: 3847970 - RNA, 14 nt, Shigella flexneri 2a str. 2457T
gcacuuuguccgcu

SEQ ID NO: 3847971 - RNA, 14 nt, Shigella flexneri 2a str. 2457T
gcacuuuucugggu

SEQ ID NO: 3847972 - RNA, 15 nt, Shigella flexneri 2a str. 2457T
gcagaaagcgacuuu

SEQ ID NO: 3847973 - RNA, 17 nt, Shigella flexneri 2a str. 2457T
gcagaaauugaccccag

SEQ ID NO: 3847974 - RNA, 23 nt, Shigella flexneri 2a str. 2457T
gcagaaauugaccccagccaguu

SEQ ID NO: 3847975 - RNA, 13 nt, Shigella flexneri 2a str. 2457T
gcagaacagaaca

SEQ ID NO: 3847976 - RNA, 14 nt, Shigella flexneri 2a str. 2457T
gcagaacaucagcu

SEQ ID NO: 3847977 - RNA, 12 nt, Shigella flexneri 2a str. 2457T
gcagaacaucca

SEQ ID NO: 3847978 - RNA, 16 nt, Shigella flexneri 2a str. 2457T
gcagaacgcuuucgca

SEQ ID NO: 3847979 - RNA, 13 nt, Shigella flexneri 2a str. 2457T
gcagaagcaauca

SEQ ID NO: 3847980 - RNA, 20 nt, Shigella flexneri 2a str. 2457T
gcagaagcaaucaucccagu

SEQ ID NO: 3847981 - RNA, 23 nt, Shigella flexneri 2a str. 2457T
gcagaagcaaucaucccagugga

SEQ ID NO: 3847982 - RNA, 17 nt, Shigella flexneri 2a str. 2457T
gcagaagcccagcgacu

SEQ ID NO: 3847983 - RNA, 23 nt, Shigella flexneri 2a str. 2457T
gcagaagcgauaaccuucaccgu

SEQ ID NO: 3847984 - RNA, 23 nt, Shigella flexneri 2a str. 2457T
gcagaaguuguccaugugcugga

SEQ ID NO: 3847985 - RNA, 18 nt, Shigella flexneri 2a str. 2457T
gcagaaucgcaaccagcg

SEQ ID NO: 3847986 - RNA, 15 nt, Shigella flexneri 2a str. 2457T
gcagacaaagugagc

SEQ ID NO: 3847987 - RNA, 14 nt, Shigella flexneri 2a str. 2457T
gcagacacugcuga

SEQ ID NO: 3847988 - RNA, 14 nt, Shigella flexneri 2a str. 2457T
gcagacacuuuccc

SEQ ID NO: 3847989 - RNA, 16 nt, Shigella flexneri 2a str. 2457T
gcagacagccuaccag

SEQ ID NO: 3847990 - RNA, 17 nt, Shigella flexneri 2a str. 2457T
gcagacagccuaccaga

SEQ ID NO: 3847991 - RNA, 23 nt, Shigella flexneri 2a str. 2457T
gcagaccaaacucuucgacaauc

SEQ ID NO: 3847992 - RNA, 22 nt, Shigella flexneri 2a str. 2457T
gcagaccaaggugcuuuaacga

SEQ ID NO: 3847993 - RNA, 13 nt, Shigella flexneri 2a str. 2457T
gcagaccugcuuu

SEQ ID NO: 3847994 - RNA, 21 nt, Shigella flexneri 2a str. 2457T
gcagaccugcuuuguucagcc

SEQ ID NO: 3847995 - RNA, 22 nt, Shigella flexneri 2a str. 2457T
gcagacgcaaaguagcggccug

SEQ ID NO: 3847996 - RNA, 19 nt, Shigella flexneri 2a str. 2457T
gcagacgccacaaucucac

SEQ ID NO: 3847997 - RNA, 16 nt, Shigella flexneri 2a str. 2457T
gcagacgcucguuaaa

SEQ ID NO: 3847998 - RNA, 19 nt, Shigella flexneri 2a str. 2457T
gcagacggcucaucacccc

SEQ ID NO: 3847999 - RNA, 15 nt, Shigella flexneri 2a str. 2457T
gcagacggcucaucu

SEQ ID NO: 3848000 - RNA, 13 nt, Shigella flexneri 2a str. 2457T
gcagacggcuguc

SEQ ID NO: 3848001 - RNA, 21 nt, Shigella flexneri 2a str. 2457T
gcagacguuuuuucugcccca

SEQ ID NO: 3848002 - RNA, 23 nt, Shigella flexneri 2a str. 2457T
gcagacguuuuuucugccccagu

SEQ ID NO: 3848003 - RNA, 17 nt, Shigella flexneri 2a str. 2457T
gcagacuuuuugcggca

SEQ ID NO: 3848004 - RNA, 23 nt, Shigella flexneri 2a str. 2457T
gcagagaaaaugccgcacaucac

SEQ ID NO: 3848005 - RNA, 18 nt, Shigella flexneri 2a str. 2457T
gcagagaaaccacaucaa

SEQ ID NO: 3848006 - RNA, 19 nt, Shigella flexneri 2a str. 2457T
gcagagaaacgccagcagc

SEQ ID NO: 3848007 - RNA, 23 nt, Shigella flexneri 2a str. 2457T
gcagagaucauacagaugcugcu

SEQ ID NO: 3848008 - RNA, 22 nt, Shigella flexneri 2a str. 2457T
gcagagcaaaaaucgacagcag

SEQ ID NO: 3848009 - RNA, 16 nt, Shigella flexneri 2a str. 2457T
gcagagcaaucaccag

SEQ ID NO: 3848010 - RNA, 20 nt, Shigella flexneri 2a str. 2457T
gcagagcauccuuguacucu

SEQ ID NO: 3848011 - RNA, 22 nt, Shigella flexneri 2a str. 2457T
gcagagccugaauaaacgccau

SEQ ID NO: 3848012 - RNA, 14 nt, Shigella flexneri 2a str. 2457T
gcagagccuguuac

SEQ ID NO: 3848013 - RNA, 12 nt, Shigella flexneri 2a str. 2457T
gcagagcuucac

SEQ ID NO: 3848014 - RNA, 17 nt, Shigella flexneri 2a str. 2457T
gcagagucucuggcuuc

SEQ ID NO: 3848015 - RNA, 19 nt, Shigella flexneri 2a str. 2457T
gcagagugaagguuucugc

SEQ ID NO: 3848016 - RNA, 15 nt, Shigella flexneri 2a str. 2457T
gcagaguugccaccc

SEQ ID NO: 3848017 - RNA, 16 nt, Shigella flexneri 2a str. 2457T
gcagauaaauaucaau

SEQ ID NO: 3848018 - RNA, 23 nt, Shigella flexneri 2a str. 2457T
gcagauaaucguauucuggcuuc

SEQ ID NO: 3848019 - RNA, 17 nt, Shigella flexneri 2a str. 2457T
gcagauacauugccacc

SEQ ID NO: 3848020 - RNA, 14 nt, Shigella flexneri 2a str. 2457T
gcagauagcccgga

SEQ ID NO: 3848021 - RNA, 19 nt, Shigella flexneri 2a str. 2457T
gcagauaucccgccagcac

SEQ ID NO: 3848022 - RNA, 19 nt, Shigella flexneri 2a str. 2457T
gcagauauucguucagaua

SEQ ID NO: 3848023 - RNA, 14 nt, Shigella flexneri 2a str. 2457T
gcagauauugcacc

SEQ ID NO: 3848024 - RNA, 15 nt, Shigella flexneri 2a str. 2457T
gcagauccagugcuc

SEQ ID NO: 3848025 - RNA, 15 nt, Shigella flexneri 2a str. 2457T
gcagauccugauuua

SEQ ID NO: 3848026 - RNA, 16 nt, Shigella flexneri 2a str. 2457T
gcagaucgaacacggu

SEQ ID NO: 3848027 - RNA, 12 nt, Shigella flexneri 2a str. 2457T
gcagaucgccaa

SEQ ID NO: 3848028 - RNA, 23 nt, Shigella flexneri 2a str. 2457T
gcagaucgcggcccaccuggcug

SEQ ID NO: 3848029 - RNA, 16 nt, Shigella flexneri 2a str. 2457T
gcagaucguuuuccug

SEQ ID NO: 3848030 - RNA, 23 nt, Shigella flexneri 2a str. 2457T
gcagaugcgucuucugcagucac

SEQ ID NO: 3848031 - RNA, 15 nt, Shigella flexneri 2a str. 2457T
gcagauuaugccuga

SEQ ID NO: 3848032 - RNA, 21 nt, Shigella flexneri 2a str. 2457T
gcagauucagccacauuugcg

SEQ ID NO: 3848033 - RNA, 13 nt, Shigella flexneri 2a str. 2457T
gcagauuugccag

SEQ ID NO: 3848034 - RNA, 17 nt, Shigella flexneri 2a str. 2457T
gcaggccuggguaaaaa

SEQ ID NO: 3848035 - RNA, 16 nt, Shigella flexneri 2a str. 2457T
gcaggcgauuuacugg

SEQ ID NO: 3848036 - RNA, 18 nt, Shigella flexneri 2a str. 2457T
gcaggcgauuuacuggca

SEQ ID NO: 3848037 - RNA, 14 nt, Shigella flexneri 2a str. 2457T
gcaggcgcugaaaa

SEQ ID NO: 3848038 - RNA, 18 nt, Shigella flexneri 2a str. 2457T
gcaggcgcuuggcuucca

SEQ ID NO: 3848039 - RNA, 18 nt, Shigella flexneri 2a str. 2457T
gcaggcggauugcuucug

SEQ ID NO: 3848040 - RNA, 16 nt, Shigella flexneri 2a str. 2457T
gcaggcggcuggcauc

SEQ ID NO: 3848041 - RNA, 19 nt, Shigella flexneri 2a str. 2457T
gcaggcgguggaagcaccu

SEQ ID NO: 3848042 - RNA, 16 nt, Shigella flexneri 2a str. 2457T
gcaggcgucgggaaga

SEQ ID NO: 3848043 - RNA, 18 nt, Shigella flexneri 2a str. 2457T
gcaggcguuaaaacaggu

SEQ ID NO: 3848044 - RNA, 15 nt, Shigella flexneri 2a str. 2457T
gcaggcuauuucugg

SEQ ID NO: 3848045 - RNA, 18 nt, Shigella flexneri 2a str. 2457T
gcaggcucagaagacgcu

SEQ ID NO: 3848046 - RNA, 15 nt, Shigella flexneri 2a str. 2457T
gcaggcuggugguga

SEQ ID NO: 3848047 - RNA, 14 nt, Shigella flexneri 2a str. 2457T
gcaggcuucaauuu

SEQ ID NO: 3848048 - RNA, 16 nt, Shigella flexneri 2a str. 2457T
gcaggcuuuuuuggua

SEQ ID NO: 3848049 - RNA, 18 nt, Shigella flexneri 2a str. 2457T
gcagggauauuucaccgc

SEQ ID NO: 3848050 - RNA, 12 nt, Shigella flexneri 2a str. 2457T
gcagggcaaugc

SEQ ID NO: 3848051 - RNA, 20 nt, Shigella flexneri 2a str. 2457T
gcagggccguuuucguuacu

SEQ ID NO: 3848052 - RNA, 17 nt, Shigella flexneri 2a str. 2457T
gcagggcggcaggcagc

SEQ ID NO: 3848053 - RNA, 20 nt, Shigella flexneri 2a str. 2457T
gcagggcggcaggcagcgcc

SEQ ID NO: 3848054 - RNA, 17 nt, Shigella flexneri 2a str. 2457T
gcagggcuguuuaucgu

SEQ ID NO: 3848055 - RNA, 15 nt, Shigella flexneri 2a str. 2457T
gcaggggaauuucaa

SEQ ID NO: 3848056 - RNA, 13 nt, Shigella flexneri 2a str. 2457T
gcaggggcgggga

SEQ ID NO: 3848057 - RNA, 19 nt, Shigella flexneri 2a str. 2457T
gcaggguacugcgcgccgc

SEQ ID NO: 3848058 - RNA, 14 nt, Shigella flexneri 2a str. 2457T
gcagguaaucugcc

SEQ ID NO: 3848059 - RNA, 15 nt, Shigella flexneri 2a str. 2457T
gcagguacgguacug

SEQ ID NO: 3848060 - RNA, 18 nt, Shigella flexneri 2a str. 2457T
gcagguacgguacugaaa

SEQ ID NO: 3848061 - RNA, 19 nt, Shigella flexneri 2a str. 2457T
gcaggucauccggcacgcu

SEQ ID NO: 3848062 - RNA, 18 nt, Shigella flexneri 2a str. 2457T
gcaggucgucuuuuacag

SEQ ID NO: 3848063 - RNA, 13 nt, Shigella flexneri 2a str. 2457T
gcaggugccuuac

SEQ ID NO: 3848064 - RNA, 15 nt, Shigella flexneri 2a str. 2457T
gcagguugcgugcac

SEQ ID NO: 3848065 - RNA, 22 nt, Shigella flexneri 2a str. 2457T
gcagguuuuugcagugaaaagg

SEQ ID NO: 3848066 - RNA, 12 nt, Shigella flexneri 2a str. 2457T
gcaguaaaccac

SEQ ID NO: 3848067 - RNA, 20 nt, Shigella flexneri 2a str. 2457T
gcaguaaaccacccaccagc

SEQ ID NO: 3848068 - RNA, 21 nt, Shigella flexneri 2a str. 2457T
gcaguaaaccacccaccagcg

SEQ ID NO: 3848069 - RNA, 23 nt, Shigella flexneri 2a str. 2457T
gcaguaaaccacccaccagcgcc

SEQ ID NO: 3848070 - RNA, 13 nt, Shigella flexneri 2a str. 2457T
gcaguaaaccgcu

SEQ ID NO: 3848071 - RNA, 12 nt, Shigella flexneri 2a str. 2457T
gcaguaaaucgu

SEQ ID NO: 3848072 - RNA, 19 nt, Shigella flexneri 2a str. 2457T
gcaguaaccaaaagcuggg

SEQ ID NO: 3848073 - RNA, 20 nt, Shigella flexneri 2a str. 2457T
gcaguaaccaaaagcuggga

SEQ ID NO: 3848074 - RNA, 16 nt, Shigella flexneri 2a str. 2457T
gcaguaagcgccaggg

SEQ ID NO: 3848075 - RNA, 18 nt, Shigella flexneri 2a str. 2457T
gcaguaaggaaauguucc

SEQ ID NO: 3848076 - RNA, 22 nt, Shigella flexneri 2a str. 2457T
gcaguaccacgguacgccagag

SEQ ID NO: 3848077 - RNA, 22 nt, Shigella flexneri 2a str. 2457T
gcaguaccagauaaucaccugc

SEQ ID NO: 3848078 - RNA, 19 nt, Shigella flexneri 2a str. 2457T
gcaguaccuccuucacagu

SEQ ID NO: 3848079 - RNA, 15 nt, Shigella flexneri 2a str. 2457T
gcaguacgcggcggu

SEQ ID NO: 3848080 - RNA, 12 nt, Shigella flexneri 2a str. 2457T
gcaguagcugca

SEQ ID NO: 3848081 - RNA, 16 nt, Shigella flexneri 2a str. 2457T
gcaguaucagagauaa

SEQ ID NO: 3848082 - RNA, 16 nt, Shigella flexneri 2a str. 2457T
gcagucaaaucuuaua

SEQ ID NO: 3848083 - RNA, 17 nt, Shigella flexneri 2a str. 2457T
gcagucacaccagcgau

SEQ ID NO: 3848084 - RNA, 15 nt, Shigella flexneri 2a str. 2457T
gcagucaccagcauc

SEQ ID NO: 3848085 - RNA, 17 nt, Shigella flexneri 2a str. 2457T
gcagucaccugcccucc

SEQ ID NO: 3848086 - RNA, 14 nt, Shigella flexneri 2a str. 2457T
gcagucaggcgcgc

SEQ ID NO: 3848087 - RNA, 19 nt, Shigella flexneri 2a str. 2457T
gcagucauagguucuuuua

SEQ ID NO: 3848088 - RNA, 19 nt, Shigella flexneri 2a str. 2457T
gcaguccagcgccugacgc

SEQ ID NO: 3848089 - RNA, 23 nt, Shigella flexneri 2a str. 2457T
gcagucuggacaaagagcuuuca

SEQ ID NO: 3848090 - RNA, 14 nt, Shigella flexneri 2a str. 2457T
gcagugacucacga

SEQ ID NO: 3848091 - RNA, 14 nt, Shigella flexneri 2a str. 2457T
gcagugacugcccc

SEQ ID NO: 3848092 - RNA, 23 nt, Shigella flexneri 2a str. 2457T
gcagugcacgaaccagagacaga

SEQ ID NO: 3848093 - RNA, 14 nt, Shigella flexneri 2a str. 2457T
gcagugcauccagc

SEQ ID NO: 3848094 - RNA, 16 nt, Shigella flexneri 2a str. 2457T
gcagugccaguucuuc

SEQ ID NO: 3848095 - RNA, 16 nt, Shigella flexneri 2a str. 2457T
gcagugcuuucauuuc

SEQ ID NO: 3848096 - RNA, 15 nt, Shigella flexneri 2a str. 2457T
gcaguggauaauaca

SEQ ID NO: 3848097 - RNA, 21 nt, Shigella flexneri 2a str. 2457T
gcaguggauaauacacuaaca

SEQ ID NO: 3848098 - RNA, 22 nt, Shigella flexneri 2a str. 2457T
gcaguggcaaacugaguggagu

SEQ ID NO: 3848099 - RNA, 14 nt, Shigella flexneri 2a str. 2457T
gcaguggcaaccag

SEQ ID NO: 3848100 - RNA, 22 nt, Shigella flexneri 2a str. 2457T
gcaguggcuaagcaggcuggcu

SEQ ID NO: 3848101 - RNA, 17 nt, Shigella flexneri 2a str. 2457T
gcagugggccagaaaaa

SEQ ID NO: 3848102 - RNA, 23 nt, Shigella flexneri 2a str. 2457T
gcaguggguaagccagaccaccc

SEQ ID NO: 3848103 - RNA, 19 nt, Shigella flexneri 2a str. 2457T
gcaguggguaaugcuguga

SEQ ID NO: 3848104 - RNA, 14 nt, Shigella flexneri 2a str. 2457T
gcaguguuuccggc

SEQ ID NO: 3848105 - RNA, 18 nt, Shigella flexneri 2a str. 2457T
gcaguuaaacgccuugcg

SEQ ID NO: 3848106 - RNA, 12 nt, Shigella flexneri 2a str. 2457T
gcaguuaacgcg

SEQ ID NO: 3848107 - RNA, 23 nt, Shigella flexneri 2a str. 2457T
gcaguuaucugccgaacaggcug

SEQ ID NO: 3848108 - RNA, 18 nt, Shigella flexneri 2a str. 2457T
gcaguucacagcgcagau

SEQ ID NO: 3848109 - RNA, 13 nt, Shigella flexneri 2a str. 2457T
gcaguucacgcag

SEQ ID NO: 3848110 - RNA, 14 nt, Shigella flexneri 2a str. 2457T
gcaguucgacaaaa

SEQ ID NO: 3848111 - RNA, 18 nt, Shigella flexneri 2a str. 2457T
gcaguucuggcaccggac

SEQ ID NO: 3848112 - RNA, 16 nt, Shigella flexneri 2a str. 2457T
gcaguugacagccaca

SEQ ID NO: 3848113 - RNA, 23 nt, Shigella flexneri 2a str. 2457T
gcaguugcaacucgacuggagcc

SEQ ID NO: 3848114 - RNA, 17 nt, Shigella flexneri 2a str. 2457T
gcaguugcaguaccagu

SEQ ID NO: 3848115 - RNA, 17 nt, Shigella flexneri 2a str. 2457T
gcaguugcccgguuucg

SEQ ID NO: 3848116 - RNA, 16 nt, Shigella flexneri 2a str. 2457T
gcaguugcuucaucuc

SEQ ID NO: 3848117 - RNA, 12 nt, Shigella flexneri 2a str. 2457T
gcaguuuaccgu

SEQ ID NO: 3848118 - RNA, 12 nt, Shigella flexneri 2a str. 2457T
gcaguuuauaaa

SEQ ID NO: 3848119 - RNA, 21 nt, Shigella flexneri 2a str. 2457T
gcaguuuauccagccacggcu

SEQ ID NO: 3848120 - RNA, 18 nt, Shigella flexneri 2a str. 2457T
gcaguuucauccuucauu

SEQ ID NO: 3848121 - RNA, 15 nt, Shigella flexneri 2a str. 2457T
gcaguuucgcgaccu

SEQ ID NO: 3848122 - RNA, 16 nt, Shigella flexneri 2a str. 2457T
gcauaaacaaagcgca

SEQ ID NO: 3848123 - RNA, 13 nt, Shigella flexneri 2a str. 2457T
gcauaaaccacag

SEQ ID NO: 3848124 - RNA, 22 nt, Shigella flexneri 2a str. 2457T
gcauaaaccgggcguggaucug

SEQ ID NO: 3848125 - RNA, 18 nt, Shigella flexneri 2a str. 2457T
gcauaaccggaucgccaa

SEQ ID NO: 3848126 - RNA, 19 nt, Shigella flexneri 2a str. 2457T
gcauaacguugcagcguuu

SEQ ID NO: 3848127 - RNA, 13 nt, Shigella flexneri 2a str. 2457T
gcauaaucaccag

SEQ ID NO: 3848128 - RNA, 18 nt, Shigella flexneri 2a str. 2457T
gcauaauccacuuucuua

SEQ ID NO: 3848129 - RNA, 14 nt, Shigella flexneri 2a str. 2457T
gcauaaugcagcca

SEQ ID NO: 3848130 - RNA, 14 nt, Shigella flexneri 2a str. 2457T
gcauacaaauaagu

SEQ ID NO: 3848131 - RNA, 22 nt, Shigella flexneri 2a str. 2457T
gcauacagccagacaaucgaaa

SEQ ID NO: 3848132 - RNA, 21 nt, Shigella flexneri 2a str. 2457T
gcauuucuccgcguucaauac

SEQ ID NO: 3848133 - RNA, 22 nt, Shigella flexneri 2a str. 2457T
gcauuugcacugaaugccggau

SEQ ID NO: 3848134 - RNA, 14 nt, Shigella flexneri 2a str. 2457T
gcauuuuacauccu

SEQ ID NO: 3848135 - RNA, 15 nt, Shigella flexneri 2a str. 2457T
gcauuuucugcgcau

SEQ ID NO: 3848136 - RNA, 11 nt, Shigella flexneri 2a str. 2457T
gcauuuugcag

SEQ ID NO: 3848137 - RNA, 16 nt, Shigella flexneri 2a str. 2457T
gcauuuugcaguaaca

SEQ ID NO: 3848138 - RNA, 15 nt, Shigella flexneri 2a str. 2457T
gcauuuuuaucacgu

SEQ ID NO: 3848139 - RNA, 19 nt, Shigella flexneri 2a str. 2457T
gcauuuuuuucaccaacgc

SEQ ID NO: 3848140 - RNA, 23 nt, Shigella flexneri 2a str. 2457T
gccaaaaagaaccugaacgccgg

SEQ ID NO: 3848141 - RNA, 16 nt, Shigella flexneri 2a str. 2457T
gccaaaaaucgcaaau

SEQ ID NO: 3848142 - RNA, 22 nt, Shigella flexneri 2a str. 2457T
gccaaaaaucgcaaauugacua

SEQ ID NO: 3848143 - RNA, 20 nt, Shigella flexneri 2a str. 2457T
gccaaaauaacuuaauguca

SEQ ID NO: 3848144 - RNA, 12 nt, Shigella flexneri 2a str. 2457T
gccaaaaucucu

SEQ ID NO: 3848145 - RNA, 22 nt, Shigella flexneri 2a str. 2457T
gccaaaauugguuucagccgga

SEQ ID NO: 3848146 - RNA, 17 nt, Shigella flexneri 2a str. 2457T
gccaaacagaccaaugg

SEQ ID NO: 3848147 - RNA, 15 nt, Shigella flexneri 2a str. 2457T
gccaaacgcucccug

SEQ ID NO: 3848148 - RNA, 22 nt, Shigella flexneri 2a str. 2457T
gccaaacuggaacugaaaggcg

SEQ ID NO: 3848149 - RNA, 19 nt, Shigella flexneri 2a str. 2457T
gccaaagcaccacuccuca

SEQ ID NO: 3848150 - RNA, 20 nt, Shigella flexneri 2a str. 2457T
gccaaagcaccacuccucaa

SEQ ID NO: 3848151 - RNA, 13 nt, Shigella flexneri 2a str. 2457T
gccaaagccgccg

SEQ ID NO: 3848152 - RNA, 16 nt, Shigella flexneri 2a str. 2457T
gccaaagccgccgagc

SEQ ID NO: 3848153 - RNA, 17 nt, Shigella flexneri 2a str. 2457T
gccaaagccgccgagca

SEQ ID NO: 3848154 - RNA, 13 nt, Shigella flexneri 2a str. 2457T
gccaaagcguuca

SEQ ID NO: 3848155 - RNA, 12 nt, Shigella flexneri 2a str. 2457T
gccaaagggagc

SEQ ID NO: 3848156 - RNA, 20 nt, Shigella flexneri 2a str. 2457T
gccaaaguacggacgcggca

SEQ ID NO: 3848157 - RNA, 23 nt, Shigella flexneri 2a str. 2457T
gccaaagugacacaaucaaaucc

SEQ ID NO: 3848158 - RNA, 19 nt, Shigella flexneri 2a str. 2457T
gccaaaguuaucgagcugc

SEQ ID NO: 3848159 - RNA, 23 nt, Shigella flexneri 2a str. 2457T
gccaaauacauugauauacagcc

SEQ ID NO: 3848160 - RNA, 21 nt, Shigella flexneri 2a str. 2457T
gccaaauauuucuuuaucacc

SEQ ID NO: 3848161 - RNA, 15 nt, Shigella flexneri 2a str. 2457T
gccaaaucauccaga

SEQ ID NO: 3848162 - RNA, 20 nt, Shigella flexneri 2a str. 2457T
gccaaaucauccagacugcu

SEQ ID NO: 3848163 - RNA, 15 nt, Shigella flexneri 2a str. 2457T
gccaaauccagcgca

SEQ ID NO: 3848164 - RNA, 19 nt, Shigella flexneri 2a str. 2457T
gccaaaugucaccagccga

SEQ ID NO: 3848165 - RNA, 14 nt, Shigella flexneri 2a str. 2457T
gccaacaaaaucuu

SEQ ID NO: 3848166 - RNA, 15 nt, Shigella flexneri 2a str. 2457T
gccaacaaucucuuc

SEQ ID NO: 3848167 - RNA, 20 nt, Shigella flexneri 2a str. 2457T
gccaacagcgacaucaaauu

SEQ ID NO: 3848168 - RNA, 16 nt, Shigella flexneri 2a str. 2457T
gccaaccaugccgccc

SEQ ID NO: 3848169 - RNA, 22 nt, Shigella flexneri 2a str. 2457T
gccaacccgcucuggauaauca

SEQ ID NO: 3848170 - RNA, 15 nt, Shigella flexneri 2a str. 2457T
gccaacgauaauuca

SEQ ID NO: 3848171 - RNA, 18 nt, Shigella flexneri 2a str. 2457T
gccaacgcccauaaugcg

SEQ ID NO: 3848172 - RNA, 18 nt, Shigella flexneri 2a str. 2457T
gccaacguccauaaugcg

SEQ ID NO: 3848173 - RNA, 14 nt, Shigella flexneri 2a str. 2457T
gccaacguuucugg

SEQ ID NO: 3848174 - RNA, 13 nt, Shigella flexneri 2a str. 2457T
gccaacuggcaaa

SEQ ID NO: 3848175 - RNA, 15 nt, Shigella flexneri 2a str. 2457T
gccaacuugcccagg

SEQ ID NO: 3848176 - RNA, 16 nt, Shigella flexneri 2a str. 2457T
gccaacuuugccguga

SEQ ID NO: 3848177 - RNA, 15 nt, Shigella flexneri 2a str. 2457T
gccaagaaacaccag

SEQ ID NO: 3848178 - RNA, 20 nt, Shigella flexneri 2a str. 2457T
gccaagcgccgccucagcca

SEQ ID NO: 3848179 - RNA, 17 nt, Shigella flexneri 2a str. 2457T
gccaauaaaugccacca

SEQ ID NO: 3848180 - RNA, 19 nt, Shigella flexneri 2a str. 2457T
gccaauaucaaucuucucu

SEQ ID NO: 3848181 - RNA, 18 nt, Shigella flexneri 2a str. 2457T
gccaaucacucaccugcu

SEQ ID NO: 3848182 - RNA, 16 nt, Shigella flexneri 2a str. 2457T
gccaaucagcaauaaa

SEQ ID NO: 3848183 - RNA, 21 nt, Shigella flexneri 2a str. 2457T
gccaauccagaacaccauaau

SEQ ID NO: 3848184 - RNA, 18 nt, Shigella flexneri 2a str. 2457T
gccaaucccggaagccac

SEQ ID NO: 3848185 - RNA, 18 nt, Shigella flexneri 2a str. 2457T
gccaaugcaggcaucggu

SEQ ID NO: 3848186 - RNA, 11 nt, Shigella flexneri 2a str. 2457T
gccaauuccca

SEQ ID NO: 3848187 - RNA, 14 nt, Shigella flexneri 2a str. 2457T
gccacaaacgccgu

SEQ ID NO: 3848188 - RNA, 14 nt, Shigella flexneri 2a str. 2457T
gccacaacuucaac

SEQ ID NO: 3848189 - RNA, 22 nt, Shigella flexneri 2a str. 2457T
gccacaagaguaaaaaacguag

SEQ ID NO: 3848190 - RNA, 14 nt, Shigella flexneri 2a str. 2457T
gccacaagggcaua

SEQ ID NO: 3848191 - RNA, 20 nt, Shigella flexneri 2a str. 2457T
gccacaauaaagcgauaaau

SEQ ID NO: 3848192 - RNA, 19 nt, Shigella flexneri 2a str. 2457T
gccacaauacugaucauca

SEQ ID NO: 3848193 - RNA, 22 nt, Shigella flexneri 2a str. 2457T
gccacaaucgcagcgcaagcug

SEQ ID NO: 3848194 - RNA, 17 nt, Shigella flexneri 2a str. 2457T
gccacaaucucacccgc

SEQ ID NO: 3848195 - RNA, 18 nt, Shigella flexneri 2a str. 2457T
gccacaaucucacccgcu

SEQ ID NO: 3848196 - RNA, 14 nt, Shigella flexneri 2a str. 2457T
gccacaaucugaua

SEQ ID NO: 3848197 - RNA, 22 nt, Shigella flexneri 2a str. 2457T
gccacacacgauccugcacggu

SEQ ID NO: 3848198 - RNA, 16 nt, Shigella flexneri 2a str. 2457T
gccacaccacugcgca

SEQ ID NO: 3848199 - RNA, 21 nt, Shigella flexneri 2a str. 2457T
gccacagcaauuuugcccagc

SEQ ID NO: 3848200 - RNA, 14 nt, Shigella flexneri 2a str. 2457T
gccacagccgagcg

SEQ ID NO: 3848201 - RNA, 19 nt, Shigella flexneri 2a str. 2457T
gccacagccgagcgccacc

SEQ ID NO: 3848202 - RNA, 16 nt, Shigella flexneri 2a str. 2457T
gccacagcgccagaca

SEQ ID NO: 3848203 - RNA, 17 nt, Shigella flexneri 2a str. 2457T
gccacaggcuuuccuga

SEQ ID NO: 3848204 - RNA, 15 nt, Shigella flexneri 2a str. 2457T
gccacaggucagcag

SEQ ID NO: 3848205 - RNA, 17 nt, Shigella flexneri 2a str. 2457T
gccacaggucagcagga

SEQ ID NO: 3848206 - RNA, 19 nt, Shigella flexneri 2a str. 2457T
gccacaggucagcaggagc

SEQ ID NO: 3848207 - RNA, 22 nt, Shigella flexneri 2a str. 2457T
gccacaguucgaggaucgcggg

SEQ ID NO: 3848208 - RNA, 19 nt, Shigella flexneri 2a str. 2457T
gccacaguugaucagccag

SEQ ID NO: 3848209 - RNA, 18 nt, Shigella flexneri 2a str. 2457T
gccacauaugaucggaag

SEQ ID NO: 3848210 - RNA, 19 nt, Shigella flexneri 2a str. 2457T
gccacauccgcgguaucgc

SEQ ID NO: 3848211 - RNA, 12 nt, Shigella flexneri 2a str. 2457T
gccacauccggc

SEQ ID NO: 3848212 - RNA, 13 nt, Shigella flexneri 2a str. 2457T
gccacauccggcu

SEQ ID NO: 3848213 - RNA, 15 nt, Shigella flexneri 2a str. 2457T
gccacauccggcuuu

SEQ ID NO: 3848214 - RNA, 13 nt, Shigella flexneri 2a str. 2457T
gccaccacaccgg

SEQ ID NO: 3848215 - RNA, 22 nt, Shigella flexneri 2a str. 2457T
gccaccacaccggaccagacga

SEQ ID NO: 3848216 - RNA, 14 nt, Shigella flexneri 2a str. 2457T
gccaccaccagcac

SEQ ID NO: 3848217 - RNA, 15 nt, Shigella flexneri 2a str. 2457T
gccaccaccagcaca

SEQ ID NO: 3848218 - RNA, 13 nt, Shigella flexneri 2a str. 2457T
gccaccaccagcg

SEQ ID NO: 3848219 - RNA, 17 nt, Shigella flexneri 2a str. 2457T
gccaccacgccaagaaa

SEQ ID NO: 3848220 - RNA, 15 nt, Shigella flexneri 2a str. 2457T
gccaccacuugcagc

SEQ ID NO: 3848221 - RNA, 16 nt, Shigella flexneri 2a str. 2457T
gccaccagggauaaag

SEQ ID NO: 3848222 - RNA, 17 nt, Shigella flexneri 2a str. 2457T
gccaccagugcaggcac

SEQ ID NO: 3848223 - RNA, 23 nt, Shigella flexneri 2a str. 2457T
gccaccauuuuacguccgcgcac

SEQ ID NO: 3848224 - RNA, 18 nt, Shigella flexneri 2a str. 2457T
gccaccgaccaggcaaac

SEQ ID NO: 3848225 - RNA, 12 nt, Shigella flexneri 2a str. 2457T
gccaccgcgcca

SEQ ID NO: 3848226 - RNA, 16 nt, Shigella flexneri 2a str. 2457T
gccaccgcgccgggca

SEQ ID NO: 3848227 - RNA, 14 nt, Shigella flexneri 2a str. 2457T
gccaccgcgcguuu

SEQ ID NO: 3848228 - RNA, 23 nt, Shigella flexneri 2a str. 2457T
gccaccgcgcguuugaucgacag

SEQ ID NO: 3848229 - RNA, 18 nt, Shigella flexneri 2a str. 2457T
gccaccggcaaucugcug

SEQ ID NO: 3848230 - RNA, 14 nt, Shigella flexneri 2a str. 2457T
gccagcagcagcgu

SEQ ID NO: 3848231 - RNA, 23 nt, Shigella flexneri 2a str. 2457T
gccagcagcgaaucagcccagcc

SEQ ID NO: 3848232 - RNA, 17 nt, Shigella flexneri 2a str. 2457T
gccagcagggcaaacag

SEQ ID NO: 3848233 - RNA, 20 nt, Shigella flexneri 2a str. 2457T
gccagcagggcaaacagcac

SEQ ID NO: 3848234 - RNA, 15 nt, Shigella flexneri 2a str. 2457T
gccagcauacagcuu

SEQ ID NO: 3848235 - RNA, 14 nt, Shigella flexneri 2a str. 2457T
gccagcauccggca

SEQ ID NO: 3848236 - RNA, 21 nt, Shigella flexneri 2a str. 2457T
gccagcauucccgccagcggc

SEQ ID NO: 3848237 - RNA, 21 nt, Shigella flexneri 2a str. 2457T
gccagccaagcaugucauaca

SEQ ID NO: 3848238 - RNA, 21 nt, Shigella flexneri 2a str. 2457T
gccagccaccacaauugacca

SEQ ID NO: 3848239 - RNA, 11 nt, Shigella flexneri 2a str. 2457T
gccagccagaa

SEQ ID NO: 3848240 - RNA, 12 nt, Shigella flexneri 2a str. 2457T
gccagccagcca

SEQ ID NO: 3848241 - RNA, 22 nt, Shigella flexneri 2a str. 2457T
gccagcccgaucggcuggcauu

SEQ ID NO: 3848242 - RNA, 14 nt, Shigella flexneri 2a str. 2457T
gccagccucaucca

SEQ ID NO: 3848243 - RNA, 15 nt, Shigella flexneri 2a str. 2457T
gccagccucauccau

SEQ ID NO: 3848244 - RNA, 11 nt, Shigella flexneri 2a str. 2457T
gccagccuccc

SEQ ID NO: 3848245 - RNA, 15 nt, Shigella flexneri 2a str. 2457T
gccagccucccagcc

SEQ ID NO: 3848246 - RNA, 15 nt, Shigella flexneri 2a str. 2457T
gccagcgaagccagc

SEQ ID NO: 3848247 - RNA, 16 nt, Shigella flexneri 2a str. 2457T
gccagcgaagccagcu

SEQ ID NO: 3848248 - RNA, 16 nt, Shigella flexneri 2a str. 2457T
gccagcgauaucgcga

SEQ ID NO: 3848249 - RNA, 19 nt, Shigella flexneri 2a str. 2457T
gccagcgccgacagcagcc

SEQ ID NO: 3848250 - RNA, 18 nt, Shigella flexneri 2a str. 2457T
gccagcgcgaugcaggcc

SEQ ID NO: 3848251 - RNA, 15 nt, Shigella flexneri 2a str. 2457T
gccagcgcgccuuca

SEQ ID NO: 3848252 - RNA, 23 nt, Shigella flexneri 2a str. 2457T
gccagcgcgccuucauucaggcc

SEQ ID NO: 3848253 - RNA, 13 nt, Shigella flexneri 2a str. 2457T
gccagcggcagcu

SEQ ID NO: 3848254 - RNA, 10 nt, Shigella flexneri 2a str. 2457T
gccagcggcg

SEQ ID NO: 3848255 - RNA, 12 nt, Shigella flexneri 2a str. 2457T
gccagcggcggc

SEQ ID NO: 3848256 - RNA, 19 nt, Shigella flexneri 2a str. 2457T
gccagcggcuccccgcuau

SEQ ID NO: 3848257 - RNA, 16 nt, Shigella flexneri 2a str. 2457T
gccagcggguucccgg

SEQ ID NO: 3848258 - RNA, 15 nt, Shigella flexneri 2a str. 2457T
gccagcguaaauccu

SEQ ID NO: 3848259 - RNA, 18 nt, Shigella flexneri 2a str. 2457T
gccagcguaaauccugac

SEQ ID NO: 3848260 - RNA, 21 nt, Shigella flexneri 2a str. 2457T
gccagcguaaauccugacgcu

SEQ ID NO: 3848261 - RNA, 22 nt, Shigella flexneri 2a str. 2457T
gccagcguaccaugauccugca

SEQ ID NO: 3848262 - RNA, 17 nt, Shigella flexneri 2a str. 2457T
gccagcgucaucauaga

SEQ ID NO: 3848263 - RNA, 15 nt, Shigella flexneri 2a str. 2457T
gccagcgucugagca

SEQ ID NO: 3848264 - RNA, 16 nt, Shigella flexneri 2a str. 2457T
gccagcucaaacgaau

SEQ ID NO: 3848265 - RNA, 17 nt, Shigella flexneri 2a str. 2457T
gccagcucuuuaaacac

SEQ ID NO: 3848266 - RNA, 15 nt, Shigella flexneri 2a str. 2457T
gccagcugcugugga

SEQ ID NO: 3848267 - RNA, 13 nt, Shigella flexneri 2a str. 2457T
gccagcuggcaga

SEQ ID NO: 3848268 - RNA, 18 nt, Shigella flexneri 2a str. 2457T
gccagcuucgaggccgga

SEQ ID NO: 3848269 - RNA, 17 nt, Shigella flexneri 2a str. 2457T
gccagcuuucaccugcg

SEQ ID NO: 3848270 - RNA, 18 nt, Shigella flexneri 2a str. 2457T
gccaggaaccugugacag

SEQ ID NO: 3848271 - RNA, 22 nt, Shigella flexneri 2a str. 2457T
gccaggaaccugugacagcagc

SEQ ID NO: 3848272 - RNA, 16 nt, Shigella flexneri 2a str. 2457T
gccaggcacgccgcgc

SEQ ID NO: 3848273 - RNA, 19 nt, Shigella flexneri 2a str. 2457T
gccaggcagaacgcuuucg

SEQ ID NO: 3848274 - RNA, 16 nt, Shigella flexneri 2a str. 2457T
gccaggcgcgaaugga

SEQ ID NO: 3848275 - RNA, 23 nt, Shigella flexneri 2a str. 2457T
gccaggcgcgaauggaaagcccg

SEQ ID NO: 3848276 - RNA, 19 nt, Shigella flexneri 2a str. 2457T
gccaggcgcugauugggaa

SEQ ID NO: 3848277 - RNA, 22 nt, Shigella flexneri 2a str. 2457T
gccaggcguaccgugggcggca

SEQ ID NO: 3848278 - RNA, 13 nt, Shigella flexneri 2a str. 2457T
gccaggcuggcag

SEQ ID NO: 3848279 - RNA, 14 nt, Shigella flexneri 2a str. 2457T
gccaggcuggcgga

SEQ ID NO: 3848280 - RNA, 16 nt, Shigella flexneri 2a str. 2457T
gccaggcuuaccgcca

SEQ ID NO: 3848281 - RNA, 21 nt, Shigella flexneri 2a str. 2457T
gccaggcuuuccgucagcggc

SEQ ID NO: 3848282 - RNA, 19 nt, Shigella flexneri 2a str. 2457T
gccagggcuuacaaaaccu

SEQ ID NO: 3848283 - RNA, 14 nt, Shigella flexneri 2a str. 2457T
gccagggugcuggc

SEQ ID NO: 3848284 - RNA, 13 nt, Shigella flexneri 2a str. 2457T
gccaggguggcuc

SEQ ID NO: 3848285 - RNA, 23 nt, Shigella flexneri 2a str. 2457T
gccagguauucaugcccgcgcaa

SEQ ID NO: 3848286 - RNA, 16 nt, Shigella flexneri 2a str. 2457T
gccaggucagagagcc

SEQ ID NO: 3848287 - RNA, 17 nt, Shigella flexneri 2a str. 2457T
gccaggucgugccagaa

SEQ ID NO: 3848288 - RNA, 17 nt, Shigella flexneri 2a str. 2457T
gccagguuuaccagcag

SEQ ID NO: 3848289 - RNA, 20 nt, Shigella flexneri 2a str. 2457T
gccagguuuucuuucaccuc

SEQ ID NO: 3848290 - RNA, 14 nt, Shigella flexneri 2a str. 2457T
gccaguaaagcagc

SEQ ID NO: 3848291 - RNA, 16 nt, Shigella flexneri 2a str. 2457T
gccaguaaauuuauca

SEQ ID NO: 3848292 - RNA, 22 nt, Shigella flexneri 2a str. 2457T
gccaguaagacaccccacagcu

SEQ ID NO: 3848293 - RNA, 12 nt, Shigella flexneri 2a str. 2457T
gccaguaagcag

SEQ ID NO: 3848294 - RNA, 16 nt, Shigella flexneri 2a str. 2457T
gccaguaagcagucca

SEQ ID NO: 3848295 - RNA, 21 nt, Shigella flexneri 2a str. 2457T
gccaguaagcaguccagcgcc

SEQ ID NO: 3848296 - RNA, 20 nt, Shigella flexneri 2a str. 2457T
gccaguaaucggcugaacgu

SEQ ID NO: 3848297 - RNA, 20 nt, Shigella flexneri 2a str. 2457T
gccaguaaucuggccaaugc

SEQ ID NO: 3848298 - RNA, 14 nt, Shigella flexneri 2a str. 2457T
gccaguaccagcag

SEQ ID NO: 3848299 - RNA, 15 nt, Shigella flexneri 2a str. 2457T
gccaguaccagcagc

SEQ ID NO: 3848300 - RNA, 14 nt, Shigella flexneri 2a str. 2457T
gccaguacgcgccc

SEQ ID NO: 3848301 - RNA, 16 nt, Shigella flexneri 2a str. 2457T
gccaguacgcgcccgu

SEQ ID NO: 3848302 - RNA, 21 nt, Shigella flexneri 2a str. 2457T
gccagucagcucucagccagc

SEQ ID NO: 3848303 - RNA, 13 nt, Shigella flexneri 2a str. 2457T
gccagucaguuaa

SEQ ID NO: 3848304 - RNA, 17 nt, Shigella flexneri 2a str. 2457T
gccagucaguuaagcaa

SEQ ID NO: 3848305 - RNA, 13 nt, Shigella flexneri 2a str. 2457T
gccaguccagguu

SEQ ID NO: 3848306 - RNA, 16 nt, Shigella flexneri 2a str. 2457T
gccagucuuccgccgg

SEQ ID NO: 3848307 - RNA, 21 nt, Shigella flexneri 2a str. 2457T
gccagugauugcuugccccuu

SEQ ID NO: 3848308 - RNA, 16 nt, Shigella flexneri 2a str. 2457T
gccagugccaaagcca

SEQ ID NO: 3848309 - RNA, 17 nt, Shigella flexneri 2a str. 2457T
gccagugccacacgcuc

SEQ ID NO: 3848310 - RNA, 17 nt, Shigella flexneri 2a str. 2457T
gccagugccgcccacca

SEQ ID NO: 3848311 - RNA, 15 nt, Shigella flexneri 2a str. 2457T
gccagugcugaaggu

SEQ ID NO: 3848312 - RNA, 16 nt, Shigella flexneri 2a str. 2457T
gccaguguuaaccaga

SEQ ID NO: 3848313 - RNA, 22 nt, Shigella flexneri 2a str. 2457T
gccaguguuggcgucagaccgg

SEQ ID NO: 3848314 - RNA, 12 nt, Shigella flexneri 2a str. 2457T
gccaguuauugg

SEQ ID NO: 3848315 - RNA, 13 nt, Shigella flexneri 2a str. 2457T
gccaguucaaagu

SEQ ID NO: 3848316 - RNA, 14 nt, Shigella flexneri 2a str. 2457T
gccaguucccccug

SEQ ID NO: 3848317 - RNA, 14 nt, Shigella flexneri 2a str. 2457T
gccaguuccgccgg

SEQ ID NO: 3848318 - RNA, 13 nt, Shigella flexneri 2a str. 2457T
gccaguucuucca

SEQ ID NO: 3848319 - RNA, 22 nt, Shigella flexneri 2a str. 2457T
gccaguuuacugucugcuucug

SEQ ID NO: 3848320 - RNA, 19 nt, Shigella flexneri 2a str. 2457T
gccaguuucggacgcggca

SEQ ID NO: 3848321 - RNA, 17 nt, Shigella flexneri 2a str. 2457T
gccaguuugcgcgugcu

SEQ ID NO: 3848322 - RNA, 22 nt, Shigella flexneri 2a str. 2457T
gccaguuuggucuggcaaaaau

SEQ ID NO: 3848323 - RNA, 22 nt, Shigella flexneri 2a str. 2457T
gccaguuuugugcccgcgugga

SEQ ID NO: 3848324 - RNA, 14 nt, Shigella flexneri 2a str. 2457T
gccauaaacagcag

SEQ ID NO: 3848325 - RNA, 22 nt, Shigella flexneri 2a str. 2457T
gccauaaacgguuucagcagcg

SEQ ID NO: 3848326 - RNA, 20 nt, Shigella flexneri 2a str. 2457T
gccauaaacugagccaaacg

SEQ ID NO: 3848327 - RNA, 22 nt, Shigella flexneri 2a str. 2457T
gccauaacggcuguccauacgu

SEQ ID NO: 3848328 - RNA, 21 nt, Shigella flexneri 2a str. 2457T
gcccagcgucuaaucgcuuua

SEQ ID NO: 3848329 - RNA, 22 nt, Shigella flexneri 2a str. 2457T
gcccagcguuccggcguccacc

SEQ ID NO: 3848330 - RNA, 22 nt, Shigella flexneri 2a str. 2457T
gcccagcucauucagccggguu

SEQ ID NO: 3848331 - RNA, 17 nt, Shigella flexneri 2a str. 2457T
gcccaggcaucccggca

SEQ ID NO: 3848332 - RNA, 20 nt, Shigella flexneri 2a str. 2457T
gcccaggcgaccaggccggu

SEQ ID NO: 3848333 - RNA, 21 nt, Shigella flexneri 2a str. 2457T
gcccaggugugucucaagucg

SEQ ID NO: 3848334 - RNA, 18 nt, Shigella flexneri 2a str. 2457T
gcccaguaucugacagca

SEQ ID NO: 3848335 - RNA, 15 nt, Shigella flexneri 2a str. 2457T
gcccagucacggcuu

SEQ ID NO: 3848336 - RNA, 23 nt, Shigella flexneri 2a str. 2457T
gcccaguccgcucgccgcagaga

SEQ ID NO: 3848337 - RNA, 19 nt, Shigella flexneri 2a str. 2457T
gcccagugagucggggcca

SEQ ID NO: 3848338 - RNA, 19 nt, Shigella flexneri 2a str. 2457T
gcccagugaguuggggcca

SEQ ID NO: 3848339 - RNA, 14 nt, Shigella flexneri 2a str. 2457T
gcccagugccagca

SEQ ID NO: 3848340 - RNA, 19 nt, Shigella flexneri 2a str. 2457T
gcccagugccgagaguaac

SEQ ID NO: 3848341 - RNA, 21 nt, Shigella flexneri 2a str. 2457T
gcccaguuagacgugcgaaug

SEQ ID NO: 3848342 - RNA, 17 nt, Shigella flexneri 2a str. 2457T
gcccaguugaucaccag

SEQ ID NO: 3848343 - RNA, 21 nt, Shigella flexneri 2a str. 2457T
gcccaucacaauggcacaaau

SEQ ID NO: 3848344 - RNA, 14 nt, Shigella flexneri 2a str. 2457T
gcccaucagcaucc

SEQ ID NO: 3848345 - RNA, 19 nt, Shigella flexneri 2a str. 2457T
gcccaucagcaucccaccu

SEQ ID NO: 3848346 - RNA, 14 nt, Shigella flexneri 2a str. 2457T
gcccaucaucaucg

SEQ ID NO: 3848347 - RNA, 15 nt, Shigella flexneri 2a str. 2457T
gcccaucauccgcgc

SEQ ID NO: 3848348 - RNA, 15 nt, Shigella flexneri 2a str. 2457T
gcccaucaucuggcu

SEQ ID NO: 3848349 - RNA, 17 nt, Shigella flexneri 2a str. 2457T
gcccaucaugcgccagg

SEQ ID NO: 3848350 - RNA, 18 nt, Shigella flexneri 2a str. 2457T
gcccaucaugcgccaggu

SEQ ID NO: 3848351 - RNA, 15 nt, Shigella flexneri 2a str. 2457T
gcccauccaggguuu

SEQ ID NO: 3848352 - RNA, 20 nt, Shigella flexneri 2a str. 2457T
gcccaucgcgcccgccgcca

SEQ ID NO: 3848353 - RNA, 22 nt, Shigella flexneri 2a str. 2457T
gcccaugcguugucgccaucca

SEQ ID NO: 3848354 - RNA, 13 nt, Shigella flexneri 2a str. 2457T
gcccauuuugcca

SEQ ID NO: 3848355 - RNA, 14 nt, Shigella flexneri 2a str. 2457T
gcccauuuugccac

SEQ ID NO: 3848356 - RNA, 21 nt, Shigella flexneri 2a str. 2457T
gccccaaccgaacccagcagg

SEQ ID NO: 3848357 - RNA, 23 nt, Shigella flexneri 2a str. 2457T
gccccaaugcguuccagcauguu

SEQ ID NO: 3848358 - RNA, 17 nt, Shigella flexneri 2a str. 2457T
gccccacaaacccgcca

SEQ ID NO: 3848359 - RNA, 22 nt, Shigella flexneri 2a str. 2457T
gccccacaaacccgccagacca

SEQ ID NO: 3848360 - RNA, 13 nt, Shigella flexneri 2a str. 2457T
gccccacaccgcg

SEQ ID NO: 3848361 - RNA, 15 nt, Shigella flexneri 2a str. 2457T
gccccacagacccag

SEQ ID NO: 3848362 - RNA, 16 nt, Shigella flexneri 2a str. 2457T
gccccacagacccagg

SEQ ID NO: 3848363 - RNA, 16 nt, Shigella flexneri 2a str. 2457T
gccccagaauucacgc

SEQ ID NO: 3848364 - RNA, 17 nt, Shigella flexneri 2a str. 2457T
gccccagaauucacgca

SEQ ID NO: 3848365 - RNA, 22 nt, Shigella flexneri 2a str. 2457T
gccccagcaggauguuccggca

SEQ ID NO: 3848366 - RNA, 18 nt, Shigella flexneri 2a str. 2457T
gccccagcgucagcauca

SEQ ID NO: 3848367 - RNA, 20 nt, Shigella flexneri 2a str. 2457T
gccccagcuucauaaggaaa

SEQ ID NO: 3848368 - RNA, 13 nt, Shigella flexneri 2a str. 2457T
gccccaguaccug

SEQ ID NO: 3848369 - RNA, 21 nt, Shigella flexneri 2a str. 2457T
gccccauggacauacgcaccu

SEQ ID NO: 3848370 - RNA, 19 nt, Shigella flexneri 2a str. 2457T
gcccccagcagcgccgcaa

SEQ ID NO: 3848371 - RNA, 15 nt, Shigella flexneri 2a str. 2457T
gcccccgggccuccc

SEQ ID NO: 3848372 - RNA, 22 nt, Shigella flexneri 2a str. 2457T
gcccccugaagcaguuucacca

SEQ ID NO: 3848373 - RNA, 16 nt, Shigella flexneri 2a str. 2457T
gccccgagaaaaauag

SEQ ID NO: 3848374 - RNA, 21 nt, Shigella flexneri 2a str. 2457T
gccccgagaaguacguagcgu

SEQ ID NO: 3848375 - RNA, 18 nt, Shigella flexneri 2a str. 2457T
gccccgccuaaagaagcc

SEQ ID NO: 3848376 - RNA, 20 nt, Shigella flexneri 2a str. 2457T
gccccgcgcggcgcaggcgc

SEQ ID NO: 3848377 - RNA, 17 nt, Shigella flexneri 2a str. 2457T
gccccgcucgcuggugc

SEQ ID NO: 3848378 - RNA, 18 nt, Shigella flexneri 2a str. 2457T
gccccggcaaaugacgau

SEQ ID NO: 3848379 - RNA, 20 nt, Shigella flexneri 2a str. 2457T
gccccggcgaucccagagcg

SEQ ID NO: 3848380 - RNA, 17 nt, Shigella flexneri 2a str. 2457T
gccccggcugcgcgacg

SEQ ID NO: 3848381 - RNA, 19 nt, Shigella flexneri 2a str. 2457T
gccccggcugcgcgacggc

SEQ ID NO: 3848382 - RNA, 17 nt, Shigella flexneri 2a str. 2457T
gccccggguuuccugga

SEQ ID NO: 3848383 - RNA, 16 nt, Shigella flexneri 2a str. 2457T
gccccgguuucucuuc

SEQ ID NO: 3848384 - RNA, 15 nt, Shigella flexneri 2a str. 2457T
gccccgugaugaacu

SEQ ID NO: 3848385 - RNA, 17 nt, Shigella flexneri 2a str. 2457T
gccccguugccacccau

SEQ ID NO: 3848386 - RNA, 22 nt, Shigella flexneri 2a str. 2457T
gccccugagcguuacccgcagc

SEQ ID NO: 3848387 - RNA, 21 nt, Shigella flexneri 2a str. 2457T
gccccuggaaaaagugcccca

SEQ ID NO: 3848388 - RNA, 20 nt, Shigella flexneri 2a str. 2457T
gccccuggucauaggccgcu

SEQ ID NO: 3848389 - RNA, 16 nt, Shigella flexneri 2a str. 2457T
gccccuucggggagag

SEQ ID NO: 3848390 - RNA, 15 nt, Shigella flexneri 2a str. 2457T
gcccgaagccaauuu

SEQ ID NO: 3848391 - RNA, 22 nt, Shigella flexneri 2a str. 2457T
gcccgacaagauccugauacuc

SEQ ID NO: 3848392 - RNA, 15 nt, Shigella flexneri 2a str. 2457T
gcccgacgauaccgc

SEQ ID NO: 3848393 - RNA, 18 nt, Shigella flexneri 2a str. 2457T
gcccgacgauaccgccgc

SEQ ID NO: 3848394 - RNA, 21 nt, Shigella flexneri 2a str. 2457T
gcccgacgauaccgccgcaca

SEQ ID NO: 3848395 - RNA, 12 nt, Shigella flexneri 2a str. 2457T
gcccgagcgcca

SEQ ID NO: 3848396 - RNA, 21 nt, Shigella flexneri 2a str. 2457T
gcccgauacgcuugcgcaucg

SEQ ID NO: 3848397 - RNA, 21 nt, Shigella flexneri 2a str. 2457T
gcccgaugaccuugucaugca

SEQ ID NO: 3848398 - RNA, 20 nt, Shigella flexneri 2a str. 2457T
gcccgauggcaucaccaucg

SEQ ID NO: 3848399 - RNA, 18 nt, Shigella flexneri 2a str. 2457T
gcccgauggugaugccau

SEQ ID NO: 3848400 - RNA, 23 nt, Shigella flexneri 2a str. 2457T
gcccgauggugaugccaucgggc

SEQ ID NO: 3848401 - RNA, 16 nt, Shigella flexneri 2a str. 2457T
gcccgcauagagaaaa

SEQ ID NO: 3848402 - RNA, 14 nt, Shigella flexneri 2a str. 2457T
gcccgccagcaccg

SEQ ID NO: 3848403 - RNA, 18 nt, Shigella flexneri 2a str. 2457T
gcccgccagcaccggagg

SEQ ID NO: 3848404 - RNA, 13 nt, Shigella flexneri 2a str. 2457T
gcccgccagcauc

SEQ ID NO: 3848405 - RNA, 14 nt, Shigella flexneri 2a str. 2457T
gcccgcccccgggc

SEQ ID NO: 3848406 - RNA, 15 nt, Shigella flexneri 2a str. 2457T
gcccgcccccgggcc

SEQ ID NO: 3848407 - RNA, 13 nt, Shigella flexneri 2a str. 2457T
gcccgccgccauc

SEQ ID NO: 3848408 - RNA, 23 nt, Shigella flexneri 2a str. 2457T
gcccgcgauaaaaauccuguucc

SEQ ID NO: 3848409 - RNA, 13 nt, Shigella flexneri 2a str. 2457T
gcccgcgcguuaa

SEQ ID NO: 3848410 - RNA, 16 nt, Shigella flexneri 2a str. 2457T
gcccgcugaaaagcgg

SEQ ID NO: 3848411 - RNA, 15 nt, Shigella flexneri 2a str. 2457T
gcccgcugccgcaga

SEQ ID NO: 3848412 - RNA, 17 nt, Shigella flexneri 2a str. 2457T
gcccgcuucaucgugcu

SEQ ID NO: 3848413 - RNA, 14 nt, Shigella flexneri 2a str. 2457T
gcccgcuuccagcg

SEQ ID NO: 3848414 - RNA, 21 nt, Shigella flexneri 2a str. 2457T
gcccgcuuucaccaucgcgau

SEQ ID NO: 3848415 - RNA, 16 nt, Shigella flexneri 2a str. 2457T
gcccggagcagcaguc

SEQ ID NO: 3848416 - RNA, 21 nt, Shigella flexneri 2a str. 2457T
gcccggauauccacccgcagc

SEQ ID NO: 3848417 - RNA, 20 nt, Shigella flexneri 2a str. 2457T
gcccggaucguucacaugag

SEQ ID NO: 3848418 - RNA, 19 nt, Shigella flexneri 2a str. 2457T
gcccggcaacguugcccgu

SEQ ID NO: 3848419 - RNA, 16 nt, Shigella flexneri 2a str. 2457T
gcccggcaauggguaa

SEQ ID NO: 3848420 - RNA, 19 nt, Shigella flexneri 2a str. 2457T
gcccggcaugacgccgggc

SEQ ID NO: 3848421 - RNA, 24 nt, Shigella flexneri 2a str. 2457T
gcccggcauucaccucugcggcaa

SEQ ID NO: 3848422 - RNA, 18 nt, Shigella flexneri 2a str. 2457T
gcccgguaaacguggugc

SEQ ID NO: 3848423 - RNA, 18 nt, Shigella flexneri 2a str. 2457T
gcccggucgggugcucau

SEQ ID NO: 3848424 - RNA, 16 nt, Shigella flexneri 2a str. 2457T
gcccgguuguaugugc

SEQ ID NO: 3848425 - RNA, 17 nt, Shigella flexneri 2a str. 2457T
gccgcaguaaagcgcag

SEQ ID NO: 3848426 - RNA, 12 nt, Shigella flexneri 2a str. 2457T
gccgcaguuucu

SEQ ID NO: 3848427 - RNA, 23 nt, Shigella flexneri 2a str. 2457T
gccgcaguuuuugcacgcuuucu

SEQ ID NO: 3848428 - RNA, 13 nt, Shigella flexneri 2a str. 2457T
gccgcauccggca

SEQ ID NO: 3848429 - RNA, 19 nt, Shigella flexneri 2a str. 2457T
gccgcauccggcaauggug

SEQ ID NO: 3848430 - RNA, 20 nt, Shigella flexneri 2a str. 2457T
gccgcauccggcaaugguga

SEQ ID NO: 3848431 - RNA, 15 nt, Shigella flexneri 2a str. 2457T
gccgcauccugcacc

SEQ ID NO: 3848432 - RNA, 16 nt, Shigella flexneri 2a str. 2457T
gccgcauccugcacca

SEQ ID NO: 3848433 - RNA, 20 nt, Shigella flexneri 2a str. 2457T
gccgcaucgggggaagcuga

SEQ ID NO: 3848434 - RNA, 13 nt, Shigella flexneri 2a str. 2457T
gccgcaucuggca

SEQ ID NO: 3848435 - RNA, 20 nt, Shigella flexneri 2a str. 2457T
gccgcauggaaccaguucac

SEQ ID NO: 3848436 - RNA, 18 nt, Shigella flexneri 2a str. 2457T
gccgcauugguaaagccg

SEQ ID NO: 3848437 - RNA, 23 nt, Shigella flexneri 2a str. 2457T
gccgcauuuucagcaaccggagg

SEQ ID NO: 3848438 - RNA, 21 nt, Shigella flexneri 2a str. 2457T
gccgccacgcgugagcggaca

SEQ ID NO: 3848439 - RNA, 13 nt, Shigella flexneri 2a str. 2457T
gccgccagaaaug

SEQ ID NO: 3848440 - RNA, 21 nt, Shigella flexneri 2a str. 2457T
gccgccagacaauugccgcca

SEQ ID NO: 3848441 - RNA, 24 nt, Shigella flexneri 2a str. 2457T
gccgccagacguccggcgcugcaa

SEQ ID NO: 3848442 - RNA, 18 nt, Shigella flexneri 2a str. 2457T
gccgccagacugcgagaa

SEQ ID NO: 3848443 - RNA, 13 nt, Shigella flexneri 2a str. 2457T
gccgccagcaucu

SEQ ID NO: 3848444 - RNA, 15 nt, Shigella flexneri 2a str. 2457T
gccgccagcaucuca

SEQ ID NO: 3848445 - RNA, 19 nt, Shigella flexneri 2a str. 2457T
gccgccagcucuuuaaaca

SEQ ID NO: 3848446 - RNA, 18 nt, Shigella flexneri 2a str. 2457T
gccgccaguacgcgcccg

SEQ ID NO: 3848447 - RNA, 15 nt, Shigella flexneri 2a str. 2457T
gccgccauaaacagc

SEQ ID NO: 3848448 - RNA, 13 nt, Shigella flexneri 2a str. 2457T
gccgccaucaucg

SEQ ID NO: 3848449 - RNA, 21 nt, Shigella flexneri 2a str. 2457T
gccgccauccugaaucaccug

SEQ ID NO: 3848450 - RNA, 16 nt, Shigella flexneri 2a str. 2457T
gccgccaucucuucca

SEQ ID NO: 3848451 - RNA, 19 nt, Shigella flexneri 2a str. 2457T
gccgccauugaaucguuau

SEQ ID NO: 3848452 - RNA, 16 nt, Shigella flexneri 2a str. 2457T
gccgccccaggccagc

SEQ ID NO: 3848453 - RNA, 18 nt, Shigella flexneri 2a str. 2457T
gccgcccccgacuccagc

SEQ ID NO: 3848454 - RNA, 19 nt, Shigella flexneri 2a str. 2457T
gccgcccccgacuccagca

SEQ ID NO: 3848455 - RNA, 19 nt, Shigella flexneri 2a str. 2457T
gccgcccuguuugguugcc

SEQ ID NO: 3848456 - RNA, 22 nt, Shigella flexneri 2a str. 2457T
gccgccgagcaaaccacaggcc

SEQ ID NO: 3848457 - RNA, 16 nt, Shigella flexneri 2a str. 2457T
gccgccgcgcucuuca

SEQ ID NO: 3848458 - RNA, 14 nt, Shigella flexneri 2a str. 2457T
gccgccgcggacaa

SEQ ID NO: 3848459 - RNA, 17 nt, Shigella flexneri 2a str. 2457T
gccgccgcuggcgugca

SEQ ID NO: 3848460 - RNA, 13 nt, Shigella flexneri 2a str. 2457T
gccgccgcuuucg

SEQ ID NO: 3848461 - RNA, 22 nt, Shigella flexneri 2a str. 2457T
gccgccggauagacaugcccgg

SEQ ID NO: 3848462 - RNA, 16 nt, Shigella flexneri 2a str. 2457T
gccgccguuagcuuca

SEQ ID NO: 3848463 - RNA, 13 nt, Shigella flexneri 2a str. 2457T
gccgccucccuuc

SEQ ID NO: 3848464 - RNA, 20 nt, Shigella flexneri 2a str. 2457T
gccgccucccuucgcugcug

SEQ ID NO: 3848465 - RNA, 22 nt, Shigella flexneri 2a str. 2457T
gccgccuuguuguaaugacaac

SEQ ID NO: 3848466 - RNA, 18 nt, Shigella flexneri 2a str. 2457T
gccgcgauagcaagcgcu

SEQ ID NO: 3848467 - RNA, 18 nt, Shigella flexneri 2a str. 2457T
gccgcgcaguuucuuacc

SEQ ID NO: 3848468 - RNA, 16 nt, Shigella flexneri 2a str. 2457T
gccgcgcggguggugc

SEQ ID NO: 3848469 - RNA, 15 nt, Shigella flexneri 2a str. 2457T
gccgcgcuuucuucu

SEQ ID NO: 3848470 - RNA, 20 nt, Shigella flexneri 2a str. 2457T
gccgcggcucaggcgcacgc

SEQ ID NO: 3848471 - RNA, 20 nt, Shigella flexneri 2a str. 2457T
gccgcgguaucaaacacagg

SEQ ID NO: 3848472 - RNA, 13 nt, Shigella flexneri 2a str. 2457T
gccgcggucuggg

SEQ ID NO: 3848473 - RNA, 19 nt, Shigella flexneri 2a str. 2457T
gccgcguguuuccgggccg

SEQ ID NO: 3848474 - RNA, 15 nt, Shigella flexneri 2a str. 2457T
gccgcuaaaaaaggu

SEQ ID NO: 3848475 - RNA, 14 nt, Shigella flexneri 2a str. 2457T
gccgcuaacagcag

SEQ ID NO: 3848476 - RNA, 16 nt, Shigella flexneri 2a str. 2457T
gccgcuaacagcagca

SEQ ID NO: 3848477 - RNA, 20 nt, Shigella flexneri 2a str. 2457T
gccgcuaauggugcgcgcac

SEQ ID NO: 3848478 - RNA, 15 nt, Shigella flexneri 2a str. 2457T
gccgcuaccgcccug

SEQ ID NO: 3848479 - RNA, 14 nt, Shigella flexneri 2a str. 2457T
gccgcuacggaaga

SEQ ID NO: 3848480 - RNA, 14 nt, Shigella flexneri 2a str. 2457T
gccgcuccagaauc

SEQ ID NO: 3848481 - RNA, 23 nt, Shigella flexneri 2a str. 2457T
gccgcuguguguaggccagcgau

SEQ ID NO: 3848482 - RNA, 13 nt, Shigella flexneri 2a str. 2457T
gccgcuuaaauuu

SEQ ID NO: 3848483 - RNA, 13 nt, Shigella flexneri 2a str. 2457T
gccgcuuccagca

SEQ ID NO: 3848484 - RNA, 17 nt, Shigella flexneri 2a str. 2457T
gccgcuuccagcagacc

SEQ ID NO: 3848485 - RNA, 15 nt, Shigella flexneri 2a str. 2457T
gccgcuuccagcauu

SEQ ID NO: 3848486 - RNA, 18 nt, Shigella flexneri 2a str. 2457T
gccgcuuccagcauuucu

SEQ ID NO: 3848487 - RNA, 20 nt, Shigella flexneri 2a str. 2457T
gccgcuucgcccaaauccuu

SEQ ID NO: 3848488 - RNA, 21 nt, Shigella flexneri 2a str. 2457T
gccgcuuuaugugcuucuacc

SEQ ID NO: 3848489 - RNA, 22 nt, Shigella flexneri 2a str. 2457T
gccgcuuuaugugcuucuacca

SEQ ID NO: 3848490 - RNA, 13 nt, Shigella flexneri 2a str. 2457T
gccgcuuuccagg

SEQ ID NO: 3848491 - RNA, 16 nt, Shigella flexneri 2a str. 2457T
gccgcuuuccaggcau

SEQ ID NO: 3848492 - RNA, 16 nt, Shigella flexneri 2a str. 2457T
gccggaaaacguuuca

SEQ ID NO: 3848493 - RNA, 22 nt, Shigella flexneri 2a str. 2457T
gccggaaacauaaauaguggca

SEQ ID NO: 3848494 - RNA, 18 nt, Shigella flexneri 2a str. 2457T
gccggaaauuugcagugc

SEQ ID NO: 3848495 - RNA, 13 nt, Shigella flexneri 2a str. 2457T
gccggaaccugau

SEQ ID NO: 3848496 - RNA, 16 nt, Shigella flexneri 2a str. 2457T
gccggaacgugcauau

SEQ ID NO: 3848497 - RNA, 18 nt, Shigella flexneri 2a str. 2457T
gccggaacuauuggucug

SEQ ID NO: 3848498 - RNA, 19 nt, Shigella flexneri 2a str. 2457T
gccggaaggaagacgcagc

SEQ ID NO: 3848499 - RNA, 21 nt, Shigella flexneri 2a str. 2457T
gccggaaggaagacgcagcau

SEQ ID NO: 3848500 - RNA, 16 nt, Shigella flexneri 2a str. 2457T
gccggaaguauuucaa

SEQ ID NO: 3848501 - RNA, 12 nt, Shigella flexneri 2a str. 2457T
gccggaauaauc

SEQ ID NO: 3848502 - RNA, 18 nt, Shigella flexneri 2a str. 2457T
gccggaauaccacuuuca

SEQ ID NO: 3848503 - RNA, 17 nt, Shigella flexneri 2a str. 2457T
gccggaaucaacggcaa

SEQ ID NO: 3848504 - RNA, 15 nt, Shigella flexneri 2a str. 2457T
gccggaauuauccgg

SEQ ID NO: 3848505 - RNA, 18 nt, Shigella flexneri 2a str. 2457T
gccggaauuucuuucagc

SEQ ID NO: 3848506 - RNA, 22 nt, Shigella flexneri 2a str. 2457T
gccggaccaucuuccaguugca

SEQ ID NO: 3848507 - RNA, 20 nt, Shigella flexneri 2a str. 2457T
gccggacgcugagcacguuu

SEQ ID NO: 3848508 - RNA, 17 nt, Shigella flexneri 2a str. 2457T
gccggacguguuuucac

SEQ ID NO: 3848509 - RNA, 16 nt, Shigella flexneri 2a str. 2457T
gccggacguucgccca

SEQ ID NO: 3848510 - RNA, 16 nt, Shigella flexneri 2a str. 2457T
gccggagacgacgccc

SEQ ID NO: 3848511 - RNA, 13 nt, Shigella flexneri 2a str. 2457T
gccggagccagcc

SEQ ID NO: 3848512 - RNA, 21 nt, Shigella flexneri 2a str. 2457T
gccggagggauguggcccagc

SEQ ID NO: 3848513 - RNA, 21 nt, Shigella flexneri 2a str. 2457T
gccggauaagcguaagcgcau

SEQ ID NO: 3848514 - RNA, 14 nt, Shigella flexneri 2a str. 2457T
gccggauaaggcau

SEQ ID NO: 3848515 - RNA, 22 nt, Shigella flexneri 2a str. 2457T
gccggauaaggcguucacgacg

SEQ ID NO: 3848516 - RNA, 19 nt, Shigella flexneri 2a str. 2457T
gccggauacgauuugcggc

SEQ ID NO: 3848517 - RNA, 23 nt, Shigella flexneri 2a str. 2457T
gccggauaugacguccggcauac

SEQ ID NO: 3848518 - RNA, 19 nt, Shigella flexneri 2a str. 2457T
gccggaucgguagaccgga

SEQ ID NO: 3848519 - RNA, 21 nt, Shigella flexneri 2a str. 2457T
gccggaugacacaucaccucc

SEQ ID NO: 3848520 - RNA, 14 nt, Shigella flexneri 2a str. 2457T
gccggaugacagac

SEQ ID NO: 3848521 - RNA, 17 nt, Shigella flexneri 2a str. 2457T
gccggaugacagacucc

SEQ ID NO: 3848522 - RNA, 16 nt, Shigella flexneri 2a str. 2457T
gccucugaaacgccag

SEQ ID NO: 3848523 - RNA, 16 nt, Shigella flexneri 2a str. 2457T
gccucugucagaaaug

SEQ ID NO: 3848524 - RNA, 13 nt, Shigella flexneri 2a str. 2457T
gccucuuuauaaa

SEQ ID NO: 3848525 - RNA, 17 nt, Shigella flexneri 2a str. 2457T
gccucuuuuaaccucag

SEQ ID NO: 3848526 - RNA, 23 nt, Shigella flexneri 2a str. 2457T
gccugaaaguauuugacuguucu

SEQ ID NO: 3848527 - RNA, 14 nt, Shigella flexneri 2a str. 2457T
gccugaagguguuu

SEQ ID NO: 3848528 - RNA, 16 nt, Shigella flexneri 2a str. 2457T
gccugaauauccagau

SEQ ID NO: 3848529 - RNA, 20 nt, Shigella flexneri 2a str. 2457T
gccugacagcacgccccggc

SEQ ID NO: 3848530 - RNA, 21 nt, Shigella flexneri 2a str. 2457T
gccugacagggaagggagcgc

SEQ ID NO: 3848531 - RNA, 16 nt, Shigella flexneri 2a str. 2457T
gccugaccauuaucaa

SEQ ID NO: 3848532 - RNA, 13 nt, Shigella flexneri 2a str. 2457T
gccugaccgcaca

SEQ ID NO: 3848533 - RNA, 17 nt, Shigella flexneri 2a str. 2457T
gccugaccgcacacccc

SEQ ID NO: 3848534 - RNA, 20 nt, Shigella flexneri 2a str. 2457T
gccugaccgcacaccccggc

SEQ ID NO: 3848535 - RNA, 21 nt, Shigella flexneri 2a str. 2457T
gccugacggaaaucauccagc

SEQ ID NO: 3848536 - RNA, 23 nt, Shigella flexneri 2a str. 2457T
gccugagaagcgcaacgcaucag

SEQ ID NO: 3848537 - RNA, 15 nt, Shigella flexneri 2a str. 2457T
gccugauaagcgcag

SEQ ID NO: 3848538 - RNA, 23 nt, Shigella flexneri 2a str. 2457T
gccugauaagcgcagcgcaucag

SEQ ID NO: 3848539 - RNA, 23 nt, Shigella flexneri 2a str. 2457T
gccugauaaguguagcgcaucag

SEQ ID NO: 3848540 - RNA, 21 nt, Shigella flexneri 2a str. 2457T
gccugauacaggaaggccgga

SEQ ID NO: 3848541 - RNA, 16 nt, Shigella flexneri 2a str. 2457T
gccugauagcccgcac

SEQ ID NO: 3848542 - RNA, 21 nt, Shigella flexneri 2a str. 2457T
gccugaugaugagucugaccg

SEQ ID NO: 3848543 - RNA, 19 nt, Shigella flexneri 2a str. 2457T
gccugaugcgacgcuggcg

SEQ ID NO: 3848544 - RNA, 23 nt, Shigella flexneri 2a str. 2457T
gccugaugcgacgcuugccgcgu

SEQ ID NO: 3848545 - RNA, 22 nt, Shigella flexneri 2a str. 2457T
gccugaugcgacgcuugcgcgu

SEQ ID NO: 3848546 - RNA, 12 nt, Shigella flexneri 2a str. 2457T
gccugaugcgcu

SEQ ID NO: 3848547 - RNA, 22 nt, Shigella flexneri 2a str. 2457T
gccugaugcgcuacgcuuauca

SEQ ID NO: 3848548 - RNA, 19 nt, Shigella flexneri 2a str. 2457T
gccugaugcgcuaugcuua

SEQ ID NO: 3848549 - RNA, 22 nt, Shigella flexneri 2a str. 2457T
gccugaugcgcugcgcuuauca

SEQ ID NO: 3848550 - RNA, 14 nt, Shigella flexneri 2a str. 2457T
gccugaugcguugc

SEQ ID NO: 3848551 - RNA, 16 nt, Shigella flexneri 2a str. 2457T
gccugauguacaacca

SEQ ID NO: 3848552 - RNA, 16 nt, Shigella flexneri 2a str. 2457T
gccugcaaacgcuuua

SEQ ID NO: 3848553 - RNA, 16 nt, Shigella flexneri 2a str. 2457T
gccugcaacgcuuuca

SEQ ID NO: 3848554 - RNA, 15 nt, Shigella flexneri 2a str. 2457T
gccugcaccauugcu

SEQ ID NO: 3848555 - RNA, 16 nt, Shigella flexneri 2a str. 2457T
gccugcaccauugcug

SEQ ID NO: 3848556 - RNA, 21 nt, Shigella flexneri 2a str. 2457T
gccugcacggagauauccagc

SEQ ID NO: 3848557 - RNA, 16 nt, Shigella flexneri 2a str. 2457T
gccugcauacguuuca

SEQ ID NO: 3848558 - RNA, 12 nt, Shigella flexneri 2a str. 2457T
gccugcaucacc

SEQ ID NO: 3848559 - RNA, 16 nt, Shigella flexneri 2a str. 2457T
gccugcauccgccauc

SEQ ID NO: 3848560 - RNA, 11 nt, Shigella flexneri 2a str. 2457T
gccugccagag

SEQ ID NO: 3848561 - RNA, 14 nt, Shigella flexneri 2a str. 2457T
gccugccagcucuu

SEQ ID NO: 3848562 - RNA, 15 nt, Shigella flexneri 2a str. 2457T
gccugccagucaauc

SEQ ID NO: 3848563 - RNA, 18 nt, Shigella flexneri 2a str. 2457T
gccugccagucaaucauc

SEQ ID NO: 3848564 - RNA, 22 nt, Shigella flexneri 2a str. 2457T
gccugccauuggcaggcucugg

SEQ ID NO: 3848565 - RNA, 15 nt, Shigella flexneri 2a str. 2457T
gccugccugcagcug

SEQ ID NO: 3848566 - RNA, 21 nt, Shigella flexneri 2a str. 2457T
gccugcgacagggaucucuuc

SEQ ID NO: 3848567 - RNA, 16 nt, Shigella flexneri 2a str. 2457T
gccugcgacgugggca

SEQ ID NO: 3848568 - RNA, 15 nt, Shigella flexneri 2a str. 2457T
gccugcggccagcag

SEQ ID NO: 3848569 - RNA, 16 nt, Shigella flexneri 2a str. 2457T
gccugcggcgcaugca

SEQ ID NO: 3848570 - RNA, 18 nt, Shigella flexneri 2a str. 2457T
gccugcuaaaccagcccu

SEQ ID NO: 3848571 - RNA, 16 nt, Shigella flexneri 2a str. 2457T
gccugcucaacugcca

SEQ ID NO: 3848572 - RNA, 10 nt, Shigella flexneri 2a str. 2457T
gccugcucca

SEQ ID NO: 3848573 - RNA, 16 nt, Shigella flexneri 2a str. 2457T
gccugcucccgaaccu

SEQ ID NO: 3848574 - RNA, 13 nt, Shigella flexneri 2a str. 2457T
gccugcucuuauu

SEQ ID NO: 3848575 - RNA, 22 nt, Shigella flexneri 2a str. 2457T
gccugcugauaagacgcaucca

SEQ ID NO: 3848576 - RNA, 22 nt, Shigella flexneri 2a str. 2457T
gccugcuggcuagccucccugc

SEQ ID NO: 3848577 - RNA, 19 nt, Shigella flexneri 2a str. 2457T
gccugcugggcgcaccugc

SEQ ID NO: 3848578 - RNA, 22 nt, Shigella flexneri 2a str. 2457T
gccugcuuccgguuguucaacc

SEQ ID NO: 3848579 - RNA, 14 nt, Shigella flexneri 2a str. 2457T
gccugcuuugacaa

SEQ ID NO: 3848580 - RNA, 16 nt, Shigella flexneri 2a str. 2457T
gccuggcguccggaaa

SEQ ID NO: 3848581 - RNA, 13 nt, Shigella flexneri 2a str. 2457T
gccugggcgaggu

SEQ ID NO: 3848582 - RNA, 15 nt, Shigella flexneri 2a str. 2457T
gccuggggagauguu

SEQ ID NO: 3848583 - RNA, 16 nt, Shigella flexneri 2a str. 2457T
gccugggugcaaucaa

SEQ ID NO: 3848584 - RNA, 15 nt, Shigella flexneri 2a str. 2457T
gccuggguuuucaca

SEQ ID NO: 3848585 - RNA, 17 nt, Shigella flexneri 2a str. 2457T
gccuggguuuucacaga

SEQ ID NO: 3848586 - RNA, 20 nt, Shigella flexneri 2a str. 2457T
gccuggguuuucacagaagu

SEQ ID NO: 3848587 - RNA, 12 nt, Shigella flexneri 2a str. 2457T
gccuggugaccg

SEQ ID NO: 3848588 - RNA, 22 nt, Shigella flexneri 2a str. 2457T
gccugguggucgaaaaucugcc

SEQ ID NO: 3848589 - RNA, 16 nt, Shigella flexneri 2a str. 2457T
gccuguaccagcggcu

SEQ ID NO: 3848590 - RNA, 21 nt, Shigella flexneri 2a str. 2457T
gccuguacggcagugaacgcg

SEQ ID NO: 3848591 - RNA, 13 nt, Shigella flexneri 2a str. 2457T
gccugugcaaccu

SEQ ID NO: 3848592 - RNA, 15 nt, Shigella flexneri 2a str. 2457T
gccugugcaaccuuu

SEQ ID NO: 3848593 - RNA, 14 nt, Shigella flexneri 2a str. 2457T
gccugugcagcgac

SEQ ID NO: 3848594 - RNA, 15 nt, Shigella flexneri 2a str. 2457T
gccugugcagcgacg

SEQ ID NO: 3848595 - RNA, 16 nt, Shigella flexneri 2a str. 2457T
gccugugccacggcuu

SEQ ID NO: 3848596 - RNA, 15 nt, Shigella flexneri 2a str. 2457T
gccugugccugagcc

SEQ ID NO: 3848597 - RNA, 16 nt, Shigella flexneri 2a str. 2457T
gccugugccugagccg

SEQ ID NO: 3848598 - RNA, 14 nt, Shigella flexneri 2a str. 2457T
gccugugucaggcc

SEQ ID NO: 3848599 - RNA, 21 nt, Shigella flexneri 2a str. 2457T
gccuguuacauaugcgcuggc

SEQ ID NO: 3848600 - RNA, 23 nt, Shigella flexneri 2a str. 2457T
gccuguuaucgcucgucgcgacg

SEQ ID NO: 3848601 - RNA, 16 nt, Shigella flexneri 2a str. 2457T
gccuguucgccgccgc

SEQ ID NO: 3848602 - RNA, 14 nt, Shigella flexneri 2a str. 2457T
gccuguugcgucgc

SEQ ID NO: 3848603 - RNA, 17 nt, Shigella flexneri 2a str. 2457T
gccuguugcgucgccgc

SEQ ID NO: 3848604 - RNA, 19 nt, Shigella flexneri 2a str. 2457T
gccuguuuauccaucacgc

SEQ ID NO: 3848605 - RNA, 12 nt, Shigella flexneri 2a str. 2457T
gccuuaaacuca

SEQ ID NO: 3848606 - RNA, 22 nt, Shigella flexneri 2a str. 2457T
gccuuacccggaccgucuuuuu

SEQ ID NO: 3848607 - RNA, 13 nt, Shigella flexneri 2a str. 2457T
gccuuaguagaag

SEQ ID NO: 3848608 - RNA, 15 nt, Shigella flexneri 2a str. 2457T
gccuuauccagcaga

SEQ ID NO: 3848609 - RNA, 23 nt, Shigella flexneri 2a str. 2457T
gccuuauccgacauuucugcugc

SEQ ID NO: 3848610 - RNA, 13 nt, Shigella flexneri 2a str. 2457T
gccuuauccggcc

SEQ ID NO: 3848611 - RNA, 19 nt, Shigella flexneri 2a str. 2457T
gccuuauccggccuacgau

SEQ ID NO: 3848612 - RNA, 13 nt, Shigella flexneri 2a str. 2457T
gccuuauccggcu

SEQ ID NO: 3848613 - RNA, 14 nt, Shigella flexneri 2a str. 2457T
gccuuauccggucu

SEQ ID NO: 3848614 - RNA, 19 nt, Shigella flexneri 2a str. 2457T
gccuuauccguccuacgaa

SEQ ID NO: 3848615 - RNA, 14 nt, Shigella flexneri 2a str. 2457T
gccuuaucuggccu

SEQ ID NO: 3848616 - RNA, 23 nt, Shigella flexneri 2a str. 2457T
gccuuauugccugugacuuucug

SEQ ID NO: 3848617 - RNA, 18 nt, Shigella flexneri 2a str. 2457T
gccuucacaggccgccag

SEQ ID NO: 3848618 - RNA, 18 nt, Shigella flexneri 2a str. 2457T
gccuucacggcuuuguca

SEQ ID NO: 3848619 - RNA, 15 nt, Shigella flexneri 2a str. 2457T
gccuucacuuccggc

SEQ ID NO: 3848620 - RNA, 21 nt, Shigella flexneri 2a str. 2457T
gcgacgcuguccgcgucuuau

SEQ ID NO: 3848621 - RNA, 17 nt, Shigella flexneri 2a str. 2457T
gcgacgcuuaccgcguc

SEQ ID NO: 3848622 - RNA, 21 nt, Shigella flexneri 2a str. 2457T
gcgacgcuuaccgcgucuuau

SEQ ID NO: 3848623 - RNA, 20 nt, Shigella flexneri 2a str. 2457T
gcgacgcuuacgcgucuuau

SEQ ID NO: 3848624 - RNA, 21 nt, Shigella flexneri 2a str. 2457T
gcgacgcuugcagcgucuuau

SEQ ID NO: 3848625 - RNA, 21 nt, Shigella flexneri 2a str. 2457T
gcgacgcuugccgcgucuuau

SEQ ID NO: 3848626 - RNA, 15 nt, Shigella flexneri 2a str. 2457T
gcgacgucugccggu

SEQ ID NO: 3848627 - RNA, 21 nt, Shigella flexneri 2a str. 2457T
gcgacguucguuaacaacaac

SEQ ID NO: 3848628 - RNA, 19 nt, Shigella flexneri 2a str. 2457T
gcgacucucugagccagcu

SEQ ID NO: 3848629 - RNA, 17 nt, Shigella flexneri 2a str. 2457T
gcgacugaggcugucau

SEQ ID NO: 3848630 - RNA, 15 nt, Shigella flexneri 2a str. 2457T
gcgacugcgggcgca

SEQ ID NO: 3848631 - RNA, 23 nt, Shigella flexneri 2a str. 2457T
gcgacugucuuucaggcagucgc

SEQ ID NO: 3848632 - RNA, 14 nt, Shigella flexneri 2a str. 2457T
gcgacuugucauca

SEQ ID NO: 3848633 - RNA, 22 nt, Shigella flexneri 2a str. 2457T
gcgacuuugccuggcggcagau

SEQ ID NO: 3848634 - RNA, 22 nt, Shigella flexneri 2a str. 2457T
gcgagaaacuucacaucaccau

SEQ ID NO: 3848635 - RNA, 17 nt, Shigella flexneri 2a str. 2457T
gcgagaaguucugcagc

SEQ ID NO: 3848636 - RNA, 23 nt, Shigella flexneri 2a str. 2457T
gcgagaaguucugcagcccgaac

SEQ ID NO: 3848637 - RNA, 23 nt, Shigella flexneri 2a str. 2457T
gcgagacggcggaaagggccgca

SEQ ID NO: 3848638 - RNA, 20 nt, Shigella flexneri 2a str. 2457T
gcgagcaaaaucguaagcag

SEQ ID NO: 3848639 - RNA, 14 nt, Shigella flexneri 2a str. 2457T
gcgagcagcauucc

SEQ ID NO: 3848640 - RNA, 20 nt, Shigella flexneri 2a str. 2457T
gcgagcgauaacccagcgca

SEQ ID NO: 3848641 - RNA, 23 nt, Shigella flexneri 2a str. 2457T
gcgagcuuucgaccagccaggcc

SEQ ID NO: 3848642 - RNA, 21 nt, Shigella flexneri 2a str. 2457T
gcgaggaaauugcgaauuccu

SEQ ID NO: 3848643 - RNA, 19 nt, Shigella flexneri 2a str. 2457T
gcgagggagaaaacccggc

SEQ ID NO: 3848644 - RNA, 19 nt, Shigella flexneri 2a str. 2457T
gcgagguauuuucugaaac

SEQ ID NO: 3848645 - RNA, 15 nt, Shigella flexneri 2a str. 2457T
gcgagguccagcucc

SEQ ID NO: 3848646 - RNA, 18 nt, Shigella flexneri 2a str. 2457T
gcgagguuauccgccagc

SEQ ID NO: 3848647 - RNA, 15 nt, Shigella flexneri 2a str. 2457T
gcgagucgcuccugc

SEQ ID NO: 3848648 - RNA, 15 nt, Shigella flexneri 2a str. 2457T
gcgaguggucuccug

SEQ ID NO: 3848649 - RNA, 18 nt, Shigella flexneri 2a str. 2457T
gcgaguuuuucaguccac

SEQ ID NO: 3848650 - RNA, 13 nt, Shigella flexneri 2a str. 2457T
gcgauaaccgcac

SEQ ID NO: 3848651 - RNA, 17 nt, Shigella flexneri 2a str. 2457T
gcgauaaccgcaccuuc

SEQ ID NO: 3848652 - RNA, 16 nt, Shigella flexneri 2a str. 2457T
gcgauaacgccccaau

SEQ ID NO: 3848653 - RNA, 13 nt, Shigella flexneri 2a str. 2457T
gcgauaaucgaac

SEQ ID NO: 3848654 - RNA, 16 nt, Shigella flexneri 2a str. 2457T
gcgauaaugcccagca

SEQ ID NO: 3848655 - RNA, 19 nt, Shigella flexneri 2a str. 2457T
gcgauacccccaguaaaug

SEQ ID NO: 3848656 - RNA, 12 nt, Shigella flexneri 2a str. 2457T
gcgauacgcagu

SEQ ID NO: 3848657 - RNA, 18 nt, Shigella flexneri 2a str. 2457T
gcgauagauuagcuggcc

SEQ ID NO: 3848658 - RNA, 16 nt, Shigella flexneri 2a str. 2457T
gcgauagccgcuuucu

SEQ ID NO: 3848659 - RNA, 20 nt, Shigella flexneri 2a str. 2457T
gcgauauccagcgauaccgg

SEQ ID NO: 3848660 - RNA, 20 nt, Shigella flexneri 2a str. 2457T
gcgauauccagugccagaau

SEQ ID NO: 3848661 - RNA, 13 nt, Shigella flexneri 2a str. 2457T
gcgauaugccggc

SEQ ID NO: 3848662 - RNA, 22 nt, Shigella flexneri 2a str. 2457T
gcgauauguuuaucaggccacg

SEQ ID NO: 3848663 - RNA, 13 nt, Shigella flexneri 2a str. 2457T
gcgaucauuagcc

SEQ ID NO: 3848664 - RNA, 17 nt, Shigella flexneri 2a str. 2457T
gcgauccugauacagac

SEQ ID NO: 3848665 - RNA, 20 nt, Shigella flexneri 2a str. 2457T
gcgaucgucgcuccaugaga

SEQ ID NO: 3848666 - RNA, 16 nt, Shigella flexneri 2a str. 2457T
gcgaucucgucagcau

SEQ ID NO: 3848667 - RNA, 20 nt, Shigella flexneri 2a str. 2457T
gcgaucuuccacgccugcau

SEQ ID NO: 3848668 - RNA, 20 nt, Shigella flexneri 2a str. 2457T
gcgaugaaaaucaccggaug

SEQ ID NO: 3848669 - RNA, 21 nt, Shigella flexneri 2a str. 2457T
gcgaugacagucuggaagcca

SEQ ID NO: 3848670 - RNA, 16 nt, Shigella flexneri 2a str. 2457T
gcgaugaccaaaaaca

SEQ ID NO: 3848671 - RNA, 19 nt, Shigella flexneri 2a str. 2457T
gcgaugacuguacagaucc

SEQ ID NO: 3848672 - RNA, 17 nt, Shigella flexneri 2a str. 2457T
gcgaugcccagugacca

SEQ ID NO: 3848673 - RNA, 14 nt, Shigella flexneri 2a str. 2457T
gcgaugccuggcaa

SEQ ID NO: 3848674 - RNA, 21 nt, Shigella flexneri 2a str. 2457T
gcgaugcugacgcaucuucuc

SEQ ID NO: 3848675 - RNA, 14 nt, Shigella flexneri 2a str. 2457T
gcgaugcuggcaga

SEQ ID NO: 3848676 - RNA, 17 nt, Shigella flexneri 2a str. 2457T
gcgauggacgcagacca

SEQ ID NO: 3848677 - RNA, 14 nt, Shigella flexneri 2a str. 2457T
gcgauggcccgcuu

SEQ ID NO: 3848678 - RNA, 17 nt, Shigella flexneri 2a str. 2457T
gcgaugggcguuucacu

SEQ ID NO: 3848679 - RNA, 22 nt, Shigella flexneri 2a str. 2457T
gcgaugguacuucaaucgccac

SEQ ID NO: 3848680 - RNA, 13 nt, Shigella flexneri 2a str. 2457T
gcgaugguggugg

SEQ ID NO: 3848681 - RNA, 15 nt, Shigella flexneri 2a str. 2457T
gcgauuaaacgccau

SEQ ID NO: 3848682 - RNA, 20 nt, Shigella flexneri 2a str. 2457T
gcgauuaaacgccauccggc

SEQ ID NO: 3848683 - RNA, 14 nt, Shigella flexneri 2a str. 2457T
gcgauuaagaaugc

SEQ ID NO: 3848684 - RNA, 13 nt, Shigella flexneri 2a str. 2457T
gcgauuaauaaaa

SEQ ID NO: 3848685 - RNA, 21 nt, Shigella flexneri 2a str. 2457T
gcgauuaauaaaauuauccag

SEQ ID NO: 3848686 - RNA, 23 nt, Shigella flexneri 2a str. 2457T
gcgauuaauaaaauuauccagcu

SEQ ID NO: 3848687 - RNA, 18 nt, Shigella flexneri 2a str. 2457T
gcgauucauaugcgccag

SEQ ID NO: 3848688 - RNA, 23 nt, Shigella flexneri 2a str. 2457T
gcgauugccguuggcguugcacc

SEQ ID NO: 3848689 - RNA, 19 nt, Shigella flexneri 2a str. 2457T
gcgauugucauucgccuga

SEQ ID NO: 3848690 - RNA, 17 nt, Shigella flexneri 2a str. 2457T
gcgauugugacacgcgc

SEQ ID NO: 3848691 - RNA, 20 nt, Shigella flexneri 2a str. 2457T
gcgauugugacacgcgcgca

SEQ ID NO: 3848692 - RNA, 23 nt, Shigella flexneri 2a str. 2457T
gcgauuucacaagacuguaaaua

SEQ ID NO: 3848693 - RNA, 15 nt, Shigella flexneri 2a str. 2457T
gcgcaaaauaccagc

SEQ ID NO: 3848694 - RNA, 19 nt, Shigella flexneri 2a str. 2457T
gcgcaaaauaccagcaauu

SEQ ID NO: 3848695 - RNA, 16 nt, Shigella flexneri 2a str. 2457T
gcgcaaaggccagcaa

SEQ ID NO: 3848696 - RNA, 17 nt, Shigella flexneri 2a str. 2457T
gcgcaaaggccagcaau

SEQ ID NO: 3848697 - RNA, 20 nt, Shigella flexneri 2a str. 2457T
gcgcaaaucagauugccaca

SEQ ID NO: 3848698 - RNA, 21 nt, Shigella flexneri 2a str. 2457T
gcgcaaaucagauugccacag

SEQ ID NO: 3848699 - RNA, 15 nt, Shigella flexneri 2a str. 2457T
gcgcaaauugcuggu

SEQ ID NO: 3848700 - RNA, 15 nt, Shigella flexneri 2a str. 2457T
gcgcaacaaauaaaa

SEQ ID NO: 3848701 - RNA, 20 nt, Shigella flexneri 2a str. 2457T
gcgcaacaaauaaaagcaaa

SEQ ID NO: 3848702 - RNA, 22 nt, Shigella flexneri 2a str. 2457T
gcgcaacaaauaaaagcaaaaa

SEQ ID NO: 3848703 - RNA, 22 nt, Shigella flexneri 2a str. 2457T
gcgcaacauauuccgcaccugc

SEQ ID NO: 3848704 - RNA, 18 nt, Shigella flexneri 2a str. 2457T
gcgcaacauccgcuuucg

SEQ ID NO: 3848705 - RNA, 16 nt, Shigella flexneri 2a str. 2457T
gcgcaacuugcagauc

SEQ ID NO: 3848706 - RNA, 17 nt, Shigella flexneri 2a str. 2457T
gcgcaagggccgcagcu

SEQ ID NO: 3848707 - RNA, 20 nt, Shigella flexneri 2a str. 2457T
gcgcaaggugugggcaauca

SEQ ID NO: 3848708 - RNA, 22 nt, Shigella flexneri 2a str. 2457T
gcgcaauauccugcgcuuccug

SEQ ID NO: 3848709 - RNA, 20 nt, Shigella flexneri 2a str. 2457T
gcgcaauaugcggugccauu

SEQ ID NO: 3848710 - RNA, 12 nt, Shigella flexneri 2a str. 2457T
gcgcaaucacca

SEQ ID NO: 3848711 - RNA, 13 nt, Shigella flexneri 2a str. 2457T
gcgcaaucgccag

SEQ ID NO: 3848712 - RNA, 16 nt, Shigella flexneri 2a str. 2457T
gcgcaaucgcccagcg

SEQ ID NO: 3848713 - RNA, 19 nt, Shigella flexneri 2a str. 2457T
gcgcaaugccauccagcuu

SEQ ID NO: 3848714 - RNA, 16 nt, Shigella flexneri 2a str. 2457T
gcgcaauugccagaca

SEQ ID NO: 3848715 - RNA, 17 nt, Shigella flexneri 2a str. 2457T
gcgcacaauggcgguga

SEQ ID NO: 3848716 - RNA, 21 nt, Shigella flexneri 2a str. 2457T
gcgcacaggcaauccagcucg

SEQ ID NO: 3848717 - RNA, 15 nt, Shigella flexneri 2a str. 2457T
gcgccuuuaccagac

SEQ ID NO: 3848718 - RNA, 23 nt, Shigella flexneri 2a str. 2457T
gcgccuuuuguuuguucuucucg

SEQ ID NO: 3848719 - RNA, 20 nt, Shigella flexneri 2a str. 2457T
gcgccuuuuuucgccgcagc

SEQ ID NO: 3848720 - RNA, 15 nt, Shigella flexneri 2a str. 2457T
gcgcgaacugucggu

SEQ ID NO: 3848721 - RNA, 20 nt, Shigella flexneri 2a str. 2457T
gcgcgaacugucgguuugua

SEQ ID NO: 3848722 - RNA, 14 nt, Shigella flexneri 2a str. 2457T
gcgcgaagcccuca

SEQ ID NO: 3848723 - RNA, 19 nt, Shigella flexneri 2a str. 2457T
gcgcgaagcuggcggcggc

SEQ ID NO: 3848724 - RNA, 20 nt, Shigella flexneri 2a str. 2457T
gcgcgaagcuggcggcggcg

SEQ ID NO: 3848725 - RNA, 17 nt, Shigella flexneri 2a str. 2457T
gcgcgaauauggcggcg

SEQ ID NO: 3848726 - RNA, 19 nt, Shigella flexneri 2a str. 2457T
gcgcgaauggaaagcccgc

SEQ ID NO: 3848727 - RNA, 14 nt, Shigella flexneri 2a str. 2457T
gcgcgacaauauuc

SEQ ID NO: 3848728 - RNA, 14 nt, Shigella flexneri 2a str. 2457T
gcgcgacuuuuucc

SEQ ID NO: 3848729 - RNA, 12 nt, Shigella flexneri 2a str. 2457T
gcgcgagccaua

SEQ ID NO: 3848730 - RNA, 18 nt, Shigella flexneri 2a str. 2457T
gcgcgagccauaaacuga

SEQ ID NO: 3848731 - RNA, 16 nt, Shigella flexneri 2a str. 2457T
gcgcgauaucgcggua

SEQ ID NO: 3848732 - RNA, 16 nt, Shigella flexneri 2a str. 2457T
gcgcgauccggcggug

SEQ ID NO: 3848733 - RNA, 22 nt, Shigella flexneri 2a str. 2457T
gcgcgaucggcuucgcucggcu

SEQ ID NO: 3848734 - RNA, 22 nt, Shigella flexneri 2a str. 2457T
gcgcgaucgggaaccggcuggc

SEQ ID NO: 3848735 - RNA, 15 nt, Shigella flexneri 2a str. 2457T
gcgcgaugccgccgu

SEQ ID NO: 3848736 - RNA, 15 nt, Shigella flexneri 2a str. 2457T
gcgcgcagugccggu

SEQ ID NO: 3848737 - RNA, 21 nt, Shigella flexneri 2a str. 2457T
gcgcgcauucuggagcuggac

SEQ ID NO: 3848738 - RNA, 15 nt, Shigella flexneri 2a str. 2457T
gcgcgccaagcccgu

SEQ ID NO: 3848739 - RNA, 13 nt, Shigella flexneri 2a str. 2457T
gcgcgccaggaga

SEQ ID NO: 3848740 - RNA, 14 nt, Shigella flexneri 2a str. 2457T
gcgcgccaggcgcu

SEQ ID NO: 3848741 - RNA, 12 nt, Shigella flexneri 2a str. 2457T
gcgcgcccgccg

SEQ ID NO: 3848742 - RNA, 15 nt, Shigella flexneri 2a str. 2457T
gcgcgcggcaggaag

SEQ ID NO: 3848743 - RNA, 16 nt, Shigella flexneri 2a str. 2457T
gcgcgcggcaggaagu

SEQ ID NO: 3848744 - RNA, 15 nt, Shigella flexneri 2a str. 2457T
gcgcgcucagcgcca

SEQ ID NO: 3848745 - RNA, 16 nt, Shigella flexneri 2a str. 2457T
gcgcgcugccagaacc

SEQ ID NO: 3848746 - RNA, 15 nt, Shigella flexneri 2a str. 2457T
gcgcgcuucgcccuu

SEQ ID NO: 3848747 - RNA, 18 nt, Shigella flexneri 2a str. 2457T
gcgcggauccacaccuga

SEQ ID NO: 3848748 - RNA, 21 nt, Shigella flexneri 2a str. 2457T
gcgcggcaauuagcggccagc

SEQ ID NO: 3848749 - RNA, 22 nt, Shigella flexneri 2a str. 2457T
gcgcggcaauuagcggcuggcu

SEQ ID NO: 3848750 - RNA, 16 nt, Shigella flexneri 2a str. 2457T
gcgcggcacccgcagg

SEQ ID NO: 3848751 - RNA, 14 nt, Shigella flexneri 2a str. 2457T
gcgcggcaggcauc

SEQ ID NO: 3848752 - RNA, 16 nt, Shigella flexneri 2a str. 2457T
gcgcggcgcaggcgcu

SEQ ID NO: 3848753 - RNA, 14 nt, Shigella flexneri 2a str. 2457T
gcgcggcggguaac

SEQ ID NO: 3848754 - RNA, 18 nt, Shigella flexneri 2a str. 2457T
gcgcgggcgauaaucuca

SEQ ID NO: 3848755 - RNA, 18 nt, Shigella flexneri 2a str. 2457T
gcgcgguaaagcgcggca

SEQ ID NO: 3848756 - RNA, 17 nt, Shigella flexneri 2a str. 2457T
gcgcgguagagaaguuu

SEQ ID NO: 3848757 - RNA, 23 nt, Shigella flexneri 2a str. 2457T
gcgcgguaucaccacccagcggu

SEQ ID NO: 3848758 - RNA, 21 nt, Shigella flexneri 2a str. 2457T
gcgcggucauaaaauccguaa

SEQ ID NO: 3848759 - RNA, 13 nt, Shigella flexneri 2a str. 2457T
gcgcggugcugga

SEQ ID NO: 3848760 - RNA, 16 nt, Shigella flexneri 2a str. 2457T
gcgcggugcuggauga

SEQ ID NO: 3848761 - RNA, 13 nt, Shigella flexneri 2a str. 2457T
gcgcgucaacugu

SEQ ID NO: 3848762 - RNA, 14 nt, Shigella flexneri 2a str. 2457T
gcgcguccccugcc

SEQ ID NO: 3848763 - RNA, 13 nt, Shigella flexneri 2a str. 2457T
gcgcgucccugcc

SEQ ID NO: 3848764 - RNA, 22 nt, Shigella flexneri 2a str. 2457T
gcgcguccgcagacacuuuccc

SEQ ID NO: 3848765 - RNA, 16 nt, Shigella flexneri 2a str. 2457T
gcgcgucuuguacuuc

SEQ ID NO: 3848766 - RNA, 15 nt, Shigella flexneri 2a str. 2457T
gcgcgugagcuggga

SEQ ID NO: 3848767 - RNA, 21 nt, Shigella flexneri 2a str. 2457T
gcgcguuaaagaagcggcgcg

SEQ ID NO: 3848768 - RNA, 23 nt, Shigella flexneri 2a str. 2457T
gcgcguugcuggauuuucugugc

SEQ ID NO: 3848769 - RNA, 18 nt, Shigella flexneri 2a str. 2457T
gcgcuaaaaauagcgacu

SEQ ID NO: 3848770 - RNA, 14 nt, Shigella flexneri 2a str. 2457T
gcgcuaaccgccug

SEQ ID NO: 3848771 - RNA, 13 nt, Shigella flexneri 2a str. 2457T
gcgcuaacucauc

SEQ ID NO: 3848772 - RNA, 20 nt, Shigella flexneri 2a str. 2457T
gcgcuacgcucaucaggccu

SEQ ID NO: 3848773 - RNA, 20 nt, Shigella flexneri 2a str. 2457T
gcgcuacgcuuaucaggccu

SEQ ID NO: 3848774 - RNA, 13 nt, Shigella flexneri 2a str. 2457T
gcgcuacggccgc

SEQ ID NO: 3848775 - RNA, 15 nt, Shigella flexneri 2a str. 2457T
gcgcuacggccgcca

SEQ ID NO: 3848776 - RNA, 17 nt, Shigella flexneri 2a str. 2457T
gcgcuacggcguuucac

SEQ ID NO: 3848777 - RNA, 20 nt, Shigella flexneri 2a str. 2457T
gcgcuauaucgcugauauca

SEQ ID NO: 3848778 - RNA, 23 nt, Shigella flexneri 2a str. 2457T
gcgcuaucaauacuuuccagcau

SEQ ID NO: 3848779 - RNA, 14 nt, Shigella flexneri 2a str. 2457T
gcgcuauccagcgc

SEQ ID NO: 3848780 - RNA, 14 nt, Shigella flexneri 2a str. 2457T
gcgcuauccugguu

SEQ ID NO: 3848781 - RNA, 21 nt, Shigella flexneri 2a str. 2457T
gcgcuauguuuaucaggccaa

SEQ ID NO: 3848782 - RNA, 19 nt, Shigella flexneri 2a str. 2457T
gcgcucacaccacagcagc

SEQ ID NO: 3848783 - RNA, 13 nt, Shigella flexneri 2a str. 2457T
gcgcuccaggagu

SEQ ID NO: 3848784 - RNA, 23 nt, Shigella flexneri 2a str. 2457T
gcgcucccgcaggagcgccgaau

SEQ ID NO: 3848785 - RNA, 19 nt, Shigella flexneri 2a str. 2457T
gcgcucgaagcgggcgcgc

SEQ ID NO: 3848786 - RNA, 16 nt, Shigella flexneri 2a str. 2457T
gcgcucugcccaugcu

SEQ ID NO: 3848787 - RNA, 12 nt, Shigella flexneri 2a str. 2457T
gcgcucugguag

SEQ ID NO: 3848788 - RNA, 20 nt, Shigella flexneri 2a str. 2457T
gcgcucugguagauaagcaa

SEQ ID NO: 3848789 - RNA, 22 nt, Shigella flexneri 2a str. 2457T
gcgcugaagaaaauggccagcc

SEQ ID NO: 3848790 - RNA, 23 nt, Shigella flexneri 2a str. 2457T
gcgcugaagaaaauggccagcca

SEQ ID NO: 3848791 - RNA, 15 nt, Shigella flexneri 2a str. 2457T
gcgcugacauuacgc

SEQ ID NO: 3848792 - RNA, 23 nt, Shigella flexneri 2a str. 2457T
gcgcugaguaauccuucccccac

SEQ ID NO: 3848793 - RNA, 15 nt, Shigella flexneri 2a str. 2457T
gcgcugcugcacaua

SEQ ID NO: 3848794 - RNA, 21 nt, Shigella flexneri 2a str. 2457T
gcgcuggcgcauguuggcgcg

SEQ ID NO: 3848795 - RNA, 13 nt, Shigella flexneri 2a str. 2457T
gcgcuggcggcug

SEQ ID NO: 3848796 - RNA, 15 nt, Shigella flexneri 2a str. 2457T
gcgcuggcggcuggg

SEQ ID NO: 3848797 - RNA, 18 nt, Shigella flexneri 2a str. 2457T
gcgcugguaaucaccacc

SEQ ID NO: 3848798 - RNA, 22 nt, Shigella flexneri 2a str. 2457T
gcgcuggugacaucgccagaga

SEQ ID NO: 3848799 - RNA, 21 nt, Shigella flexneri 2a str. 2457T
gcgcuuaaucaauugcaggaa

SEQ ID NO: 3848800 - RNA, 22 nt, Shigella flexneri 2a str. 2457T
gcgcuuaaucaauugcaggaag

SEQ ID NO: 3848801 - RNA, 16 nt, Shigella flexneri 2a str. 2457T
gcgcuuauagcgacca

SEQ ID NO: 3848802 - RNA, 14 nt, Shigella flexneri 2a str. 2457T
gcgcuuaucgccag

SEQ ID NO: 3848803 - RNA, 14 nt, Shigella flexneri 2a str. 2457T
gcgcuuccagcucc

SEQ ID NO: 3848804 - RNA, 16 nt, Shigella flexneri 2a str. 2457T
gcgcuuccagcuccau

SEQ ID NO: 3848805 - RNA, 12 nt, Shigella flexneri 2a str. 2457T
gcgcuuccugca

SEQ ID NO: 3848806 - RNA, 23 nt, Shigella flexneri 2a str. 2457T
gcgcuucgcuuaccaugccaacg

SEQ ID NO: 3848807 - RNA, 15 nt, Shigella flexneri 2a str. 2457T
gcgcuucucaggccu

SEQ ID NO: 3848808 - RNA, 17 nt, Shigella flexneri 2a str. 2457T
gcgcuugcucuaacggu

SEQ ID NO: 3848809 - RNA, 13 nt, Shigella flexneri 2a str. 2457T
gcgcuuggcgacg

SEQ ID NO: 3848810 - RNA, 23 nt, Shigella flexneri 2a str. 2457T
gcgcuuuauagggugcaauuuuu

SEQ ID NO: 3848811 - RNA, 20 nt, Shigella flexneri 2a str. 2457T
gcgcuuucagcacgacauaa

SEQ ID NO: 3848812 - RNA, 13 nt, Shigella flexneri 2a str. 2457T
gcgcuuucgccag

SEQ ID NO: 3848813 - RNA, 22 nt, Shigella flexneri 2a str. 2457T
gcgcuuuuggcaggaacugcuc

SEQ ID NO: 3848814 - RNA, 20 nt, Shigella flexneri 2a str. 2457T
gcggaaacgacuauuaaaca

SEQ ID NO: 3848815 - RNA, 21 nt, Shigella flexneri 2a str. 2457T
gcggggaucacuccccgccgu

SEQ ID NO: 3848816 - RNA, 18 nt, Shigella flexneri 2a str. 2457T
gcgggggagucgcugguu

SEQ ID NO: 3848817 - RNA, 20 nt, Shigella flexneri 2a str. 2457T
gcggguaauugcuccaucca

SEQ ID NO: 3848818 - RNA, 22 nt, Shigella flexneri 2a str. 2457T
gcggguaucuuuaaucgagaua

SEQ ID NO: 3848819 - RNA, 21 nt, Shigella flexneri 2a str. 2457T
gcgggucaccgcgguguauac

SEQ ID NO: 3848820 - RNA, 16 nt, Shigella flexneri 2a str. 2457T
gcgggucaggccagga

SEQ ID NO: 3848821 - RNA, 17 nt, Shigella flexneri 2a str. 2457T
gcgggucaggccaggau

SEQ ID NO: 3848822 - RNA, 15 nt, Shigella flexneri 2a str. 2457T
gcgggucaguauucc

SEQ ID NO: 3848823 - RNA, 16 nt, Shigella flexneri 2a str. 2457T
gcgggugaacgcguua

SEQ ID NO: 3848824 - RNA, 20 nt, Shigella flexneri 2a str. 2457T
gcgggugacuucccgcacgc

SEQ ID NO: 3848825 - RNA, 13 nt, Shigella flexneri 2a str. 2457T
gcggguuagucug

SEQ ID NO: 3848826 - RNA, 18 nt, Shigella flexneri 2a str. 2457T
gcggguuagucugcauuu

SEQ ID NO: 3848827 - RNA, 18 nt, Shigella flexneri 2a str. 2457T
gcgguaaaauggucagcc

SEQ ID NO: 3848828 - RNA, 16 nt, Shigella flexneri 2a str. 2457T
gcgguaaacugcauga

SEQ ID NO: 3848829 - RNA, 18 nt, Shigella flexneri 2a str. 2457T
gcgguaaaguuuggcugu

SEQ ID NO: 3848830 - RNA, 23 nt, Shigella flexneri 2a str. 2457T
gcgguaacaggauggcguucgca

SEQ ID NO: 3848831 - RNA, 18 nt, Shigella flexneri 2a str. 2457T
gcgguaaucacgcaugga

SEQ ID NO: 3848832 - RNA, 17 nt, Shigella flexneri 2a str. 2457T
gcgguacaccaaagcgg

SEQ ID NO: 3848833 - RNA, 15 nt, Shigella flexneri 2a str. 2457T
gcgguacucgcgcag

SEQ ID NO: 3848834 - RNA, 21 nt, Shigella flexneri 2a str. 2457T
gcgguacugaccaucagcagc

SEQ ID NO: 3848835 - RNA, 17 nt, Shigella flexneri 2a str. 2457T
gcgguagcacgucaucu

SEQ ID NO: 3848836 - RNA, 19 nt, Shigella flexneri 2a str. 2457T
gcgguaguuucuccccaug

SEQ ID NO: 3848837 - RNA, 15 nt, Shigella flexneri 2a str. 2457T
gcgguaucaccaccc

SEQ ID NO: 3848838 - RNA, 16 nt, Shigella flexneri 2a str. 2457T
gcgguaucaccaccca

SEQ ID NO: 3848839 - RNA, 16 nt, Shigella flexneri 2a str. 2457T
gcggucaaaagcugca

SEQ ID NO: 3848840 - RNA, 14 nt, Shigella flexneri 2a str. 2457T
gcggugaccagcag

SEQ ID NO: 3848841 - RNA, 16 nt, Shigella flexneri 2a str. 2457T
gcggugaccagcagca

SEQ ID NO: 3848842 - RNA, 21 nt, Shigella flexneri 2a str. 2457T
gcggugccauuaaaccaacaa

SEQ ID NO: 3848843 - RNA, 17 nt, Shigella flexneri 2a str. 2457T
gcggugcgaugccuggc

SEQ ID NO: 3848844 - RNA, 17 nt, Shigella flexneri 2a str. 2457T
gcgguguauaccagcuc

SEQ ID NO: 3848845 - RNA, 21 nt, Shigella flexneri 2a str. 2457T
gcggugucuaacgaugccagc

SEQ ID NO: 3848846 - RNA, 23 nt, Shigella flexneri 2a str. 2457T
gcggugucuaacgaugccagcac

SEQ ID NO: 3848847 - RNA, 17 nt, Shigella flexneri 2a str. 2457T
gcgguugacggaaagca

SEQ ID NO: 3848848 - RNA, 20 nt, Shigella flexneri 2a str. 2457T
gcgguugcugucggcggcga

SEQ ID NO: 3848849 - RNA, 23 nt, Shigella flexneri 2a str. 2457T
gcgguuggcaaucaguuuuuguu

SEQ ID NO: 3848850 - RNA, 17 nt, Shigella flexneri 2a str. 2457T
gcgguuuucucuuguuc

SEQ ID NO: 3848851 - RNA, 14 nt, Shigella flexneri 2a str. 2457T
gcguaaaucaaacc

SEQ ID NO: 3848852 - RNA, 16 nt, Shigella flexneri 2a str. 2457T
gcguaaauccagcggc

SEQ ID NO: 3848853 - RNA, 23 nt, Shigella flexneri 2a str. 2457T
gcguaauccugaaagcgugucau

SEQ ID NO: 3848854 - RNA, 21 nt, Shigella flexneri 2a str. 2457T
gcguacaauagccacauugcu

SEQ ID NO: 3848855 - RNA, 13 nt, Shigella flexneri 2a str. 2457T
gcguacaccaaca

SEQ ID NO: 3848856 - RNA, 15 nt, Shigella flexneri 2a str. 2457T
gcguacaccaacauc

SEQ ID NO: 3848857 - RNA, 13 nt, Shigella flexneri 2a str. 2457T
gcguacagcgagg

SEQ ID NO: 3848858 - RNA, 12 nt, Shigella flexneri 2a str. 2457T
gcguacagcgcg

SEQ ID NO: 3848859 - RNA, 18 nt, Shigella flexneri 2a str. 2457T
gcguaccgugggcggcau

SEQ ID NO: 3848860 - RNA, 16 nt, Shigella flexneri 2a str. 2457T
gcguacuggcaaucgc

SEQ ID NO: 3848861 - RNA, 19 nt, Shigella flexneri 2a str. 2457T
gcguacuggcaaucgccag

SEQ ID NO: 3848862 - RNA, 17 nt, Shigella flexneri 2a str. 2457T
gcguagcagcguuaaug

SEQ ID NO: 3848863 - RNA, 20 nt, Shigella flexneri 2a str. 2457T
gcguaguuaugaaaauagga

SEQ ID NO: 3848864 - RNA, 14 nt, Shigella flexneri 2a str. 2457T
gcguauaacacgcc

SEQ ID NO: 3848865 - RNA, 22 nt, Shigella flexneri 2a str. 2457T
gcguaucaauuaacgguugcgg

SEQ ID NO: 3848866 - RNA, 18 nt, Shigella flexneri 2a str. 2457T
gcguauccgaugaaucac

SEQ ID NO: 3848867 - RNA, 13 nt, Shigella flexneri 2a str. 2457T
gcguauccuccug

SEQ ID NO: 3848868 - RNA, 19 nt, Shigella flexneri 2a str. 2457T
gcguaucgacaaucaccag

SEQ ID NO: 3848869 - RNA, 17 nt, Shigella flexneri 2a str. 2457T
gcguaugcccggugcgg

SEQ ID NO: 3848870 - RNA, 22 nt, Shigella flexneri 2a str. 2457T
gcgucaacaacacucucugaag

SEQ ID NO: 3848871 - RNA, 18 nt, Shigella flexneri 2a str. 2457T
gcgucaaggucaacaguu

SEQ ID NO: 3848872 - RNA, 23 nt, Shigella flexneri 2a str. 2457T
gcgucaauuuguuccgccagcga

SEQ ID NO: 3848873 - RNA, 18 nt, Shigella flexneri 2a str. 2457T
gcgucagcauaaaaauau

SEQ ID NO: 3848874 - RNA, 13 nt, Shigella flexneri 2a str. 2457T
gcgucagcaucgc

SEQ ID NO: 3848875 - RNA, 17 nt, Shigella flexneri 2a str. 2457T
gcgucagccugcucagu

SEQ ID NO: 3848876 - RNA, 15 nt, Shigella flexneri 2a str. 2457T
gcgucagcuuucaga

SEQ ID NO: 3848877 - RNA, 14 nt, Shigella flexneri 2a str. 2457T
gcgucaggcgcgug

SEQ ID NO: 3848878 - RNA, 15 nt, Shigella flexneri 2a str. 2457T
gcgucauaauccggc

SEQ ID NO: 3848879 - RNA, 18 nt, Shigella flexneri 2a str. 2457T
gcgucauugacgcuggcu

SEQ ID NO: 3848880 - RNA, 21 nt, Shigella flexneri 2a str. 2457T
gcguccacagccaacacauuu

SEQ ID NO: 3848881 - RNA, 13 nt, Shigella flexneri 2a str. 2457T
gcgucccaucggc

SEQ ID NO: 3848882 - RNA, 15 nt, Shigella flexneri 2a str. 2457T
gcgucccaucggcaa

SEQ ID NO: 3848883 - RNA, 14 nt, Shigella flexneri 2a str. 2457T
gcguccgccgauac

SEQ ID NO: 3848884 - RNA, 18 nt, Shigella flexneri 2a str. 2457T
gcguccggcgucgcuucu

SEQ ID NO: 3848885 - RNA, 21 nt, Shigella flexneri 2a str. 2457T
gcgucgaagaaaacauggcgu

SEQ ID NO: 3848886 - RNA, 18 nt, Shigella flexneri 2a str. 2457T
gcgucgcaucaggcauca

SEQ ID NO: 3848887 - RNA, 14 nt, Shigella flexneri 2a str. 2457T
gcgucgccagcgcg

SEQ ID NO: 3848888 - RNA, 15 nt, Shigella flexneri 2a str. 2457T
gcgucgccagcgcgc

SEQ ID NO: 3848889 - RNA, 18 nt, Shigella flexneri 2a str. 2457T
gcgucgcugcucuucagu

SEQ ID NO: 3848890 - RNA, 13 nt, Shigella flexneri 2a str. 2457T
gcgucgggaucau

SEQ ID NO: 3848891 - RNA, 12 nt, Shigella flexneri 2a str. 2457T
gcgucgguuucg

SEQ ID NO: 3848892 - RNA, 20 nt, Shigella flexneri 2a str. 2457T
gcgucguucgcgccaacagc

SEQ ID NO: 3848893 - RNA, 14 nt, Shigella flexneri 2a str. 2457T
gcgucucaucuuua

SEQ ID NO: 3848894 - RNA, 19 nt, Shigella flexneri 2a str. 2457T
gcgucucuuuucguuuugg

SEQ ID NO: 3848895 - RNA, 14 nt, Shigella flexneri 2a str. 2457T
gcgucuuaucaggc

SEQ ID NO: 3848896 - RNA, 16 nt, Shigella flexneri 2a str. 2457T
gcgucuuaucaggccu

SEQ ID NO: 3848897 - RNA, 15 nt, Shigella flexneri 2a str. 2457T
gcgucuuaucuggcc

SEQ ID NO: 3848898 - RNA, 16 nt, Shigella flexneri 2a str. 2457T
gcgucuuaucuggccu

SEQ ID NO: 3848899 - RNA, 17 nt, Shigella flexneri 2a str. 2457T
gcgucuuaucuggccua

SEQ ID NO: 3848900 - RNA, 16 nt, Shigella flexneri 2a str. 2457T
gcgucuuccgugccug

SEQ ID NO: 3848901 - RNA, 17 nt, Shigella flexneri 2a str. 2457T
gcgucuuguugaacagg

SEQ ID NO: 3848902 - RNA, 15 nt, Shigella flexneri 2a str. 2457T
gcgugaaucaacacc

SEQ ID NO: 3848903 - RNA, 16 nt, Shigella flexneri 2a str. 2457T
gcgugaccaguugcuc

SEQ ID NO: 3848904 - RNA, 20 nt, Shigella flexneri 2a str. 2457T
gcgugacgaaagucugggcc

SEQ ID NO: 3848905 - RNA, 17 nt, Shigella flexneri 2a str. 2457T
gcgugagaacaccaccu

SEQ ID NO: 3848906 - RNA, 18 nt, Shigella flexneri 2a str. 2457T
gcgugagaacaccaccug

SEQ ID NO: 3848907 - RNA, 22 nt, Shigella flexneri 2a str. 2457T
gcgugagccgaaauauggcgcu

SEQ ID NO: 3848908 - RNA, 22 nt, Shigella flexneri 2a str. 2457T
gcgugaucuaaaaucgcuucag

SEQ ID NO: 3848909 - RNA, 21 nt, Shigella flexneri 2a str. 2457T
gcgugcaguggugcgaucucg

SEQ ID NO: 3848910 - RNA, 20 nt, Shigella flexneri 2a str. 2457T
gcgugcccgggucagcgcca

SEQ ID NO: 3848911 - RNA, 19 nt, Shigella flexneri 2a str. 2457T
gcgugccgugaauauggaa

SEQ ID NO: 3848912 - RNA, 14 nt, Shigella flexneri 2a str. 2457T
gcuaucuuucaaca

SEQ ID NO: 3848913 - RNA, 15 nt, Shigella flexneri 2a str. 2457T
gcuauuauaucgcuc

SEQ ID NO: 3848914 - RNA, 16 nt, Shigella flexneri 2a str. 2457T
gcuauugcgccagccu

SEQ ID NO: 3848915 - RNA, 12 nt, Shigella flexneri 2a str. 2457T
gcuauuugcgcc

SEQ ID NO: 3848916 - RNA, 16 nt, Shigella flexneri 2a str. 2457T
gcuauuuuagaaaaac

SEQ ID NO: 3848917 - RNA, 20 nt, Shigella flexneri 2a str. 2457T
gcuauuuuuugcaggccaga

SEQ ID NO: 3848918 - RNA, 23 nt, Shigella flexneri 2a str. 2457T
gcucaaaaauccagauuuauaaa

SEQ ID NO: 3848919 - RNA, 16 nt, Shigella flexneri 2a str. 2457T
gcucaaaacaaaaacc

SEQ ID NO: 3848920 - RNA, 16 nt, Shigella flexneri 2a str. 2457T
gcucaaaccagcgacg

SEQ ID NO: 3848921 - RNA, 22 nt, Shigella flexneri 2a str. 2457T
gcucaaagacgcgguaaaagcc

SEQ ID NO: 3848922 - RNA, 13 nt, Shigella flexneri 2a str. 2457T
gcucaaagauauu

SEQ ID NO: 3848923 - RNA, 15 nt, Shigella flexneri 2a str. 2457T
gcucaaagccgucga

SEQ ID NO: 3848924 - RNA, 10 nt, Shigella flexneri 2a str. 2457T
gcucaaaucc

SEQ ID NO: 3848925 - RNA, 17 nt, Shigella flexneri 2a str. 2457T
gcucaaauccaucagac

SEQ ID NO: 3848926 - RNA, 17 nt, Shigella flexneri 2a str. 2457T
gcucaacaauaaacugg

SEQ ID NO: 3848927 - RNA, 19 nt, Shigella flexneri 2a str. 2457T
gcucaacaauaaacuggcu

SEQ ID NO: 3848928 - RNA, 22 nt, Shigella flexneri 2a str. 2457T
gcucaacaauaaacuggcugug

SEQ ID NO: 3848929 - RNA, 16 nt, Shigella flexneri 2a str. 2457T
gcucaauacaacccac

SEQ ID NO: 3848930 - RNA, 12 nt, Shigella flexneri 2a str. 2457T
gcucaaucugcg

SEQ ID NO: 3848931 - RNA, 18 nt, Shigella flexneri 2a str. 2457T
gcucaaugguguuuucca

SEQ ID NO: 3848932 - RNA, 15 nt, Shigella flexneri 2a str. 2457T
gcucaaugucuguca

SEQ ID NO: 3848933 - RNA, 15 nt, Shigella flexneri 2a str. 2457T
gcucaaugugcugag

SEQ ID NO: 3848934 - RNA, 13 nt, Shigella flexneri 2a str. 2457T
gcucaccagcagc

SEQ ID NO: 3848935 - RNA, 18 nt, Shigella flexneri 2a str. 2457T
gcucaccagcagcggucg

SEQ ID NO: 3848936 - RNA, 13 nt, Shigella flexneri 2a str. 2457T
gcucaccgccagc

SEQ ID NO: 3848937 - RNA, 13 nt, Shigella flexneri 2a str. 2457T
gcucaccugcaca

SEQ ID NO: 3848938 - RNA, 15 nt, Shigella flexneri 2a str. 2457T
gcucacgcccaucag

SEQ ID NO: 3848939 - RNA, 21 nt, Shigella flexneri 2a str. 2457T
gcucacgcgcugccucucuuc

SEQ ID NO: 3848940 - RNA, 20 nt, Shigella flexneri 2a str. 2457T
gcucacuacggcucaguaau

SEQ ID NO: 3848941 - RNA, 16 nt, Shigella flexneri 2a str. 2457T
gcucacucaucacucc

SEQ ID NO: 3848942 - RNA, 16 nt, Shigella flexneri 2a str. 2457T
gcucagucacuucaaa

SEQ ID NO: 3848943 - RNA, 21 nt, Shigella flexneri 2a str. 2457T
gcucagucggcgcuuuugcau

SEQ ID NO: 3848944 - RNA, 18 nt, Shigella flexneri 2a str. 2457T
gcucauaaaaucacgcgc

SEQ ID NO: 3848945 - RNA, 20 nt, Shigella flexneri 2a str. 2457T
gcucauaaaaucacgcgccu

SEQ ID NO: 3848946 - RNA, 21 nt, Shigella flexneri 2a str. 2457T
gcucauaaaaucacgcgccug

SEQ ID NO: 3848947 - RNA, 15 nt, Shigella flexneri 2a str. 2457T
gcucauaaccgucca

SEQ ID NO: 3848948 - RNA, 15 nt, Shigella flexneri 2a str. 2457T
gcucauauuccugca

SEQ ID NO: 3848949 - RNA, 14 nt, Shigella flexneri 2a str. 2457T
gcucaucaagcaca

SEQ ID NO: 3848950 - RNA, 15 nt, Shigella flexneri 2a str. 2457T
gcucaucaagcuguu

SEQ ID NO: 3848951 - RNA, 15 nt, Shigella flexneri 2a str. 2457T
gcucaucaauacgcc

SEQ ID NO: 3848952 - RNA, 16 nt, Shigella flexneri 2a str. 2457T
gcucaucagcccggca

SEQ ID NO: 3848953 - RNA, 12 nt, Shigella flexneri 2a str. 2457T
gcucaucagcgg

SEQ ID NO: 3848954 - RNA, 19 nt, Shigella flexneri 2a str. 2457T
gcucaucaggccuacaaaa

SEQ ID NO: 3848955 - RNA, 20 nt, Shigella flexneri 2a str. 2457T
gcucaucgccuuccagcgau

SEQ ID NO: 3848956 - RNA, 16 nt, Shigella flexneri 2a str. 2457T
gcucaucggcauacag

SEQ ID NO: 3848957 - RNA, 14 nt, Shigella flexneri 2a str. 2457T
gcucaucguuacgc

SEQ ID NO: 3848958 - RNA, 16 nt, Shigella flexneri 2a str. 2457T
gcucaucuggauuguu

SEQ ID NO: 3848959 - RNA, 19 nt, Shigella flexneri 2a str. 2457T
gcucaugcaucauaaccug

SEQ ID NO: 3848960 - RNA, 14 nt, Shigella flexneri 2a str. 2457T
gcucauuaaaaaua

SEQ ID NO: 3848961 - RNA, 13 nt, Shigella flexneri 2a str. 2457T
gcucauuauuugc

SEQ ID NO: 3848962 - RNA, 14 nt, Shigella flexneri 2a str. 2457T
gcucauucuuccuc

SEQ ID NO: 3848963 - RNA, 18 nt, Shigella flexneri 2a str. 2457T
gcucauugcggcaacaau

SEQ ID NO: 3848964 - RNA, 17 nt, Shigella flexneri 2a str. 2457T
gcucauuuucucuuuca

SEQ ID NO: 3848965 - RNA, 12 nt, Shigella flexneri 2a str. 2457T
gcuccacgcugc

SEQ ID NO: 3848966 - RNA, 15 nt, Shigella flexneri 2a str. 2457T
gcuccagacgccaga

SEQ ID NO: 3848967 - RNA, 19 nt, Shigella flexneri 2a str. 2457T
gcuccagauuaccagcgac

SEQ ID NO: 3848968 - RNA, 22 nt, Shigella flexneri 2a str. 2457T
gcuccagauuacuuaaguuaua

SEQ ID NO: 3848969 - RNA, 20 nt, Shigella flexneri 2a str. 2457T
gcuccagcaaaaagcggcuc

SEQ ID NO: 3848970 - RNA, 16 nt, Shigella flexneri 2a str. 2457T
gcuccagcagguuuaa

SEQ ID NO: 3848971 - RNA, 22 nt, Shigella flexneri 2a str. 2457T
gcuccagcccgcgucguucauc

SEQ ID NO: 3848972 - RNA, 18 nt, Shigella flexneri 2a str. 2457T
gcuccagccgcucccuuc

SEQ ID NO: 3848973 - RNA, 13 nt, Shigella flexneri 2a str. 2457T
gcuccagcgggcg

SEQ ID NO: 3848974 - RNA, 16 nt, Shigella flexneri 2a str. 2457T
gcuccagcguaccugc

SEQ ID NO: 3848975 - RNA, 15 nt, Shigella flexneri 2a str. 2457T
gcuccagguccuccu

SEQ ID NO: 3848976 - RNA, 17 nt, Shigella flexneri 2a str. 2457T
gcuccagguccuccugu

SEQ ID NO: 3848977 - RNA, 16 nt, Shigella flexneri 2a str. 2457T
gcuccaguaccugcaa

SEQ ID NO: 3848978 - RNA, 16 nt, Shigella flexneri 2a str. 2457T
gcuccagugcgcuuua

SEQ ID NO: 3848979 - RNA, 19 nt, Shigella flexneri 2a str. 2457T
gcucccaggcuccgccaga

SEQ ID NO: 3848980 - RNA, 12 nt, Shigella flexneri 2a str. 2457T
gcuccccagaau

SEQ ID NO: 3848981 - RNA, 18 nt, Shigella flexneri 2a str. 2457T
gcucccgcagccacuccu

SEQ ID NO: 3848982 - RNA, 22 nt, Shigella flexneri 2a str. 2457T
gcucccugaauaacaccagcca

SEQ ID NO: 3848983 - RNA, 18 nt, Shigella flexneri 2a str. 2457T
gcucccuggcccaucgcc

SEQ ID NO: 3848984 - RNA, 17 nt, Shigella flexneri 2a str. 2457T
gcucccuucggggcggc

SEQ ID NO: 3848985 - RNA, 22 nt, Shigella flexneri 2a str. 2457T
gcuccgcaagcgaaugaggcag

SEQ ID NO: 3848986 - RNA, 19 nt, Shigella flexneri 2a str. 2457T
gcuccgccaucuucuugca

SEQ ID NO: 3848987 - RNA, 24 nt, Shigella flexneri 2a str. 2457T
gcuccggcaccucccccugagcag

SEQ ID NO: 3848988 - RNA, 21 nt, Shigella flexneri 2a str. 2457T
gcuccggcgggguuuuuugua

SEQ ID NO: 3848989 - RNA, 21 nt, Shigella flexneri 2a str. 2457T
gcuccgggaaaacgcuggcag

SEQ ID NO: 3848990 - RNA, 22 nt, Shigella flexneri 2a str. 2457T
gcuccgggugugacaacaacau

SEQ ID NO: 3848991 - RNA, 13 nt, Shigella flexneri 2a str. 2457T
gcuccguaaaccc

SEQ ID NO: 3848992 - RNA, 15 nt, Shigella flexneri 2a str. 2457T
gcuccguccagccac

SEQ ID NO: 3848993 - RNA, 18 nt, Shigella flexneri 2a str. 2457T
gcuccguccagccaccgc

SEQ ID NO: 3848994 - RNA, 17 nt, Shigella flexneri 2a str. 2457T
gcuccuccuucucaccu

SEQ ID NO: 3848995 - RNA, 19 nt, Shigella flexneri 2a str. 2457T
gcuccucgaguccuuccag

SEQ ID NO: 3848996 - RNA, 13 nt, Shigella flexneri 2a str. 2457T
gcuccucuuucau

SEQ ID NO: 3848997 - RNA, 19 nt, Shigella flexneri 2a str. 2457T
gcuccuguaugacccggua

SEQ ID NO: 3848998 - RNA, 15 nt, Shigella flexneri 2a str. 2457T
gcucgaacgccucug

SEQ ID NO: 3848999 - RNA, 17 nt, Shigella flexneri 2a str. 2457T
gcucgaagcgggcgcgc

SEQ ID NO: 3849000 - RNA, 17 nt, Shigella flexneri 2a str. 2457T
gcucgacaagauacugc

SEQ ID NO: 3849001 - RNA, 16 nt, Shigella flexneri 2a str. 2457T
gcucgacaccaaacag

SEQ ID NO: 3849002 - RNA, 13 nt, Shigella flexneri 2a str. 2457T
gcucgacagcgcu

SEQ ID NO: 3849003 - RNA, 18 nt, Shigella flexneri 2a str. 2457T
gcucgacgagaauuuccu

SEQ ID NO: 3849004 - RNA, 17 nt, Shigella flexneri 2a str. 2457T
gcucgacgauaucggag

SEQ ID NO: 3849005 - RNA, 20 nt, Shigella flexneri 2a str. 2457T
gcucgacgucacaggccauc

SEQ ID NO: 3849006 - RNA, 19 nt, Shigella flexneri 2a str. 2457T
gcucgcaggcugagaaaug

SEQ ID NO: 3849007 - RNA, 15 nt, Shigella flexneri 2a str. 2457T
gcucgccgcagagau

SEQ ID NO: 3849008 - RNA, 12 nt, Shigella flexneri 2a str. 2457T
gcucgccgccgc

SEQ ID NO: 3849009 - RNA, 19 nt, Shigella flexneri 2a str. 2457T
gcucgccgguugggccacc

SEQ ID NO: 3849010 - RNA, 15 nt, Shigella flexneri 2a str. 2457T
gcugaugucagcacu

SEQ ID NO: 3849011 - RNA, 22 nt, Shigella flexneri 2a str. 2457T
gcugauuaaaaccgaggggcug

SEQ ID NO: 3849012 - RNA, 22 nt, Shigella flexneri 2a str. 2457T
gcugauuaccuuccugccagau

SEQ ID NO: 3849013 - RNA, 19 nt, Shigella flexneri 2a str. 2457T
gcugauuaugucaucaucg

SEQ ID NO: 3849014 - RNA, 23 nt, Shigella flexneri 2a str. 2457T
gcugauuaugucaucaucgccac

SEQ ID NO: 3849015 - RNA, 20 nt, Shigella flexneri 2a str. 2457T
gcugauucucccucaucauu

SEQ ID NO: 3849016 - RNA, 14 nt, Shigella flexneri 2a str. 2457T
gcugauugcggaga

SEQ ID NO: 3849017 - RNA, 15 nt, Shigella flexneri 2a str. 2457T
gcugauugcggagaa

SEQ ID NO: 3849018 - RNA, 14 nt, Shigella flexneri 2a str. 2457T
gcugauuucaccau

SEQ ID NO: 3849019 - RNA, 21 nt, Shigella flexneri 2a str. 2457T
gcugauuucaccccacaccac

SEQ ID NO: 3849020 - RNA, 12 nt, Shigella flexneri 2a str. 2457T
gcugauuuuucu

SEQ ID NO: 3849021 - RNA, 13 nt, Shigella flexneri 2a str. 2457T
gcugauuuuucug

SEQ ID NO: 3849022 - RNA, 13 nt, Shigella flexneri 2a str. 2457T
gcugcaaaaaauu

SEQ ID NO: 3849023 - RNA, 16 nt, Shigella flexneri 2a str. 2457T
gcugcaaaaaauugcg

SEQ ID NO: 3849024 - RNA, 21 nt, Shigella flexneri 2a str. 2457T
gcugcaaacccugagcgguua

SEQ ID NO: 3849025 - RNA, 18 nt, Shigella flexneri 2a str. 2457T
gcugcaaagcauuuuuuc

SEQ ID NO: 3849026 - RNA, 21 nt, Shigella flexneri 2a str. 2457T
gcugcaaagcauuuuuucaca

SEQ ID NO: 3849027 - RNA, 17 nt, Shigella flexneri 2a str. 2457T
gcugcaaagucugggcu

SEQ ID NO: 3849028 - RNA, 18 nt, Shigella flexneri 2a str. 2457T
gcugcaaggugaaagcaa

SEQ ID NO: 3849029 - RNA, 22 nt, Shigella flexneri 2a str. 2457T
gcugcaauaaaauaucuuccac

SEQ ID NO: 3849030 - RNA, 23 nt, Shigella flexneri 2a str. 2457T
gcugcaauaaacaagauaacaga

SEQ ID NO: 3849031 - RNA, 22 nt, Shigella flexneri 2a str. 2457T
gcugcacacagggcgcuagcca

SEQ ID NO: 3849032 - RNA, 20 nt, Shigella flexneri 2a str. 2457T
gcugcacauacugcaucagc

SEQ ID NO: 3849033 - RNA, 18 nt, Shigella flexneri 2a str. 2457T
gcugcaccaacaucaugc

SEQ ID NO: 3849034 - RNA, 17 nt, Shigella flexneri 2a str. 2457T
gcugcaccucgagauca

SEQ ID NO: 3849035 - RNA, 14 nt, Shigella flexneri 2a str. 2457T
gcugcagccagggu

SEQ ID NO: 3849036 - RNA, 16 nt, Shigella flexneri 2a str. 2457T
gcugcagccaggguca

SEQ ID NO: 3849037 - RNA, 22 nt, Shigella flexneri 2a str. 2457T
gcugcagcucaucuaaugcagg

SEQ ID NO: 3849038 - RNA, 22 nt, Shigella flexneri 2a str. 2457T
gcugcaggaauaaucagcaacg

SEQ ID NO: 3849039 - RNA, 20 nt, Shigella flexneri 2a str. 2457T
gcugcauacggugaaagucc

SEQ ID NO: 3849040 - RNA, 14 nt, Shigella flexneri 2a str. 2457T
gcugcauccgcgcu

SEQ ID NO: 3849041 - RNA, 18 nt, Shigella flexneri 2a str. 2457T
gcugcauccgcgcuuucu

SEQ ID NO: 3849042 - RNA, 12 nt, Shigella flexneri 2a str. 2457T
gcugcaucgcca

SEQ ID NO: 3849043 - RNA, 12 nt, Shigella flexneri 2a str. 2457T
gcugcaucugaa

SEQ ID NO: 3849044 - RNA, 14 nt, Shigella flexneri 2a str. 2457T
gcugcaucugaaac

SEQ ID NO: 3849045 - RNA, 21 nt, Shigella flexneri 2a str. 2457T
gcugccaaugauaucggaaga

SEQ ID NO: 3849046 - RNA, 22 nt, Shigella flexneri 2a str. 2457T
gcugccacauugcguccaggcc

SEQ ID NO: 3849047 - RNA, 15 nt, Shigella flexneri 2a str. 2457T
gcugccagaaccgcu

SEQ ID NO: 3849048 - RNA, 15 nt, Shigella flexneri 2a str. 2457T
gcugccagccaggau

SEQ ID NO: 3849049 - RNA, 17 nt, Shigella flexneri 2a str. 2457T
gcugccaggucgugcca

SEQ ID NO: 3849050 - RNA, 14 nt, Shigella flexneri 2a str. 2457T
gcugcccaucaucg

SEQ ID NO: 3849051 - RNA, 14 nt, Shigella flexneri 2a str. 2457T
gcugcccaugcgcu

SEQ ID NO: 3849052 - RNA, 20 nt, Shigella flexneri 2a str. 2457T
gcugccgaaccacugaugga

SEQ ID NO: 3849053 - RNA, 15 nt, Shigella flexneri 2a str. 2457T
gcugccgccaguucu

SEQ ID NO: 3849054 - RNA, 20 nt, Shigella flexneri 2a str. 2457T
gcugccgccaguucuuccag

SEQ ID NO: 3849055 - RNA, 16 nt, Shigella flexneri 2a str. 2457T
gcugccgccaguuuac

SEQ ID NO: 3849056 - RNA, 22 nt, Shigella flexneri 2a str. 2457T
gcugccggaaggcagccuuucu

SEQ ID NO: 3849057 - RNA, 23 nt, Shigella flexneri 2a str. 2457T
gcugccggaaggcagccuuucuc

SEQ ID NO: 3849058 - RNA, 13 nt, Shigella flexneri 2a str. 2457T
gcugccggcacag

SEQ ID NO: 3849059 - RNA, 21 nt, Shigella flexneri 2a str. 2457T
gcugccggcacaggcaucacu

SEQ ID NO: 3849060 - RNA, 23 nt, Shigella flexneri 2a str. 2457T
gcugccggggagauauuccccag

SEQ ID NO: 3849061 - RNA, 19 nt, Shigella flexneri 2a str. 2457T
gcugccgggguaaagcgcg

SEQ ID NO: 3849062 - RNA, 18 nt, Shigella flexneri 2a str. 2457T
gcugccguuuucaaaggu

SEQ ID NO: 3849063 - RNA, 17 nt, Shigella flexneri 2a str. 2457T
gcugccucucuucgcug

SEQ ID NO: 3849064 - RNA, 20 nt, Shigella flexneri 2a str. 2457T
gcugccuguacggcagugaa

SEQ ID NO: 3849065 - RNA, 19 nt, Shigella flexneri 2a str. 2457T
gcugccuucggcgucucca

SEQ ID NO: 3849066 - RNA, 23 nt, Shigella flexneri 2a str. 2457T
gcugcgccaguugcuuauccagc

SEQ ID NO: 3849067 - RNA, 13 nt, Shigella flexneri 2a str. 2457T
gcugcgccccaca

SEQ ID NO: 3849068 - RNA, 11 nt, Shigella flexneri 2a str. 2457T
gcugcgcccgc

SEQ ID NO: 3849069 - RNA, 15 nt, Shigella flexneri 2a str. 2457T
gcugcgcgacggcga

SEQ ID NO: 3849070 - RNA, 13 nt, Shigella flexneri 2a str. 2457T
gcugcgcuaucag

SEQ ID NO: 3849071 - RNA, 17 nt, Shigella flexneri 2a str. 2457T
gcugcggaauugccggu

SEQ ID NO: 3849072 - RNA, 19 nt, Shigella flexneri 2a str. 2457T
gcugcggcguuccccaguu

SEQ ID NO: 3849073 - RNA, 18 nt, Shigella flexneri 2a str. 2457T
gcugcgguuuacgccagg

SEQ ID NO: 3849074 - RNA, 14 nt, Shigella flexneri 2a str. 2457T
gcugcgugccuaau

SEQ ID NO: 3849075 - RNA, 16 nt, Shigella flexneri 2a str. 2457T
gcugcguuccggcaug

SEQ ID NO: 3849076 - RNA, 18 nt, Shigella flexneri 2a str. 2457T
gcugcuacgccgucauua

SEQ ID NO: 3849077 - RNA, 22 nt, Shigella flexneri 2a str. 2457T
gcugcucaggcgaggcggacug

SEQ ID NO: 3849078 - RNA, 16 nt, Shigella flexneri 2a str. 2457T
gcugcuccugcggcug

SEQ ID NO: 3849079 - RNA, 16 nt, Shigella flexneri 2a str. 2457T
gcugcucuucaguagu

SEQ ID NO: 3849080 - RNA, 14 nt, Shigella flexneri 2a str. 2457T
gcugcugauccagc

SEQ ID NO: 3849081 - RNA, 18 nt, Shigella flexneri 2a str. 2457T
gcugcugcguuccggcau

SEQ ID NO: 3849082 - RNA, 17 nt, Shigella flexneri 2a str. 2457T
gcugcugcucaaaggca

SEQ ID NO: 3849083 - RNA, 22 nt, Shigella flexneri 2a str. 2457T
gcugcuguggauucagcaccgu

SEQ ID NO: 3849084 - RNA, 13 nt, Shigella flexneri 2a str. 2457T
gcugcuuuauauu

SEQ ID NO: 3849085 - RNA, 19 nt, Shigella flexneri 2a str. 2457T
gcugcuuuaucagaucacg

SEQ ID NO: 3849086 - RNA, 15 nt, Shigella flexneri 2a str. 2457T
gcugcuuuccugcug

SEQ ID NO: 3849087 - RNA, 19 nt, Shigella flexneri 2a str. 2457T
gcugcuuuguaaguggggg

SEQ ID NO: 3849088 - RNA, 19 nt, Shigella flexneri 2a str. 2457T
gcuggaaagcguaaacggu

SEQ ID NO: 3849089 - RNA, 23 nt, Shigella flexneri 2a str. 2457T
gcuggaaaugaccauaaaaggca

SEQ ID NO: 3849090 - RNA, 16 nt, Shigella flexneri 2a str. 2457T
gcuggaacaaacugcc

SEQ ID NO: 3849091 - RNA, 21 nt, Shigella flexneri 2a str. 2457T
gcuggaagguaaggauaaaaa

SEQ ID NO: 3849092 - RNA, 15 nt, Shigella flexneri 2a str. 2457T
gcuggaagguggcau

SEQ ID NO: 3849093 - RNA, 22 nt, Shigella flexneri 2a str. 2457T
gcuggacgcgccaacaaaugga

SEQ ID NO: 3849094 - RNA, 21 nt, Shigella flexneri 2a str. 2457T
gcuggacguugcguugcagca

SEQ ID NO: 3849095 - RNA, 23 nt, Shigella flexneri 2a str. 2457T
gcuggacucccagaacaacccgg

SEQ ID NO: 3849096 - RNA, 17 nt, Shigella flexneri 2a str. 2457T
gcuggagaacuugacuc

SEQ ID NO: 3849097 - RNA, 20 nt, Shigella flexneri 2a str. 2457T
gcuggagcggggaacaccuc

SEQ ID NO: 3849098 - RNA, 21 nt, Shigella flexneri 2a str. 2457T
gcuggaguggugaaacaggga

SEQ ID NO: 3849099 - RNA, 14 nt, Shigella flexneri 2a str. 2457T
gcuggaucguggug

SEQ ID NO: 3849100 - RNA, 14 nt, Shigella flexneri 2a str. 2457T
gcuggaucugcggg

SEQ ID NO: 3849101 - RNA, 19 nt, Shigella flexneri 2a str. 2457T
gcuggauggcgcaaugcca

SEQ ID NO: 3849102 - RNA, 21 nt, Shigella flexneri 2a str. 2457T
gcuggaugucuggcagagccu

SEQ ID NO: 3849103 - RNA, 22 nt, Shigella flexneri 2a str. 2457T
gcuggauuaacgcuggggauag

SEQ ID NO: 3849104 - RNA, 23 nt, Shigella flexneri 2a str. 2457T
gcuggauuuuagggacaaagaau

SEQ ID NO: 3849105 - RNA, 17 nt, Shigella flexneri 2a str. 2457T
gcuggauuuucugugca

SEQ ID NO: 3849106 - RNA, 12 nt, Shigella flexneri 2a str. 2457T
gcuggcaaugac

SEQ ID NO: 3849107 - RNA, 21 nt, Shigella flexneri 2a str. 2457T
gcuuacucuucguucuucuuc

SEQ ID NO: 3849108 - RNA, 22 nt, Shigella flexneri 2a str. 2457T
gcuuacuugcugcucugaaggu

SEQ ID NO: 3849109 - RNA, 14 nt, Shigella flexneri 2a str. 2457T
gcuuagcaucccca

SEQ ID NO: 3849110 - RNA, 14 nt, Shigella flexneri 2a str. 2457T
gcuuaucaggccua

SEQ ID NO: 3849111 - RNA, 19 nt, Shigella flexneri 2a str. 2457T
gcuuaucaggccuacaaaa

SEQ ID NO: 3849112 - RNA, 19 nt, Shigella flexneri 2a str. 2457T
gcuuaucaggccuacauga

SEQ ID NO: 3849113 - RNA, 19 nt, Shigella flexneri 2a str. 2457T
gcuuauccggcaugcaauc

SEQ ID NO: 3849114 - RNA, 16 nt, Shigella flexneri 2a str. 2457T
gcuuaucgccagcgcc

SEQ ID NO: 3849115 - RNA, 13 nt, Shigella flexneri 2a str. 2457T
gcuuaucgcccug

SEQ ID NO: 3849116 - RNA, 22 nt, Shigella flexneri 2a str. 2457T
gcuuaugcgccguuuuuuuucu

SEQ ID NO: 3849117 - RNA, 16 nt, Shigella flexneri 2a str. 2457T
gcuuauuagggaucau

SEQ ID NO: 3849118 - RNA, 14 nt, Shigella flexneri 2a str. 2457T
gcuuauucauuacu

SEQ ID NO: 3849119 - RNA, 13 nt, Shigella flexneri 2a str. 2457T
gcuucaaaguuug

SEQ ID NO: 3849120 - RNA, 16 nt, Shigella flexneri 2a str. 2457T
gcuucaaaguuugcac

SEQ ID NO: 3849121 - RNA, 23 nt, Shigella flexneri 2a str. 2457T
gcuucaaaucauuacaguuucgg

SEQ ID NO: 3849122 - RNA, 15 nt, Shigella flexneri 2a str. 2457T
gcuucaaauuagccg

SEQ ID NO: 3849123 - RNA, 17 nt, Shigella flexneri 2a str. 2457T
gcuucaaauuagccgca

SEQ ID NO: 3849124 - RNA, 14 nt, Shigella flexneri 2a str. 2457T
gcuucaagaugcca

SEQ ID NO: 3849125 - RNA, 23 nt, Shigella flexneri 2a str. 2457T
gcuucaauacgcucgaacagcug

SEQ ID NO: 3849126 - RNA, 21 nt, Shigella flexneri 2a str. 2457T
gcuucaaucaauaacagcgca

SEQ ID NO: 3849127 - RNA, 12 nt, Shigella flexneri 2a str. 2457T
gcuucaaucuga

SEQ ID NO: 3849128 - RNA, 14 nt, Shigella flexneri 2a str. 2457T
gcuucaaucugaua

SEQ ID NO: 3849129 - RNA, 14 nt, Shigella flexneri 2a str. 2457T
gcuucaauuuccug

SEQ ID NO: 3849130 - RNA, 14 nt, Shigella flexneri 2a str. 2457T
gcuucaauuuuuuc

SEQ ID NO: 3849131 - RNA, 15 nt, Shigella flexneri 2a str. 2457T
gcuucaauuuuuucu

SEQ ID NO: 3849132 - RNA, 20 nt, Shigella flexneri 2a str. 2457T
gcuucaauuuuuucuggcga

SEQ ID NO: 3849133 - RNA, 21 nt, Shigella flexneri 2a str. 2457T
gcuucaccaaucagaaaggcg

SEQ ID NO: 3849134 - RNA, 14 nt, Shigella flexneri 2a str. 2457T
gcuucaccagcagc

SEQ ID NO: 3849135 - RNA, 17 nt, Shigella flexneri 2a str. 2457T
gcuucacccgcagcacg

SEQ ID NO: 3849136 - RNA, 21 nt, Shigella flexneri 2a str. 2457T
gcuucacgcggguugccaccg

SEQ ID NO: 3849137 - RNA, 20 nt, Shigella flexneri 2a str. 2457T
gcuucacucccugccccauc

SEQ ID NO: 3849138 - RNA, 21 nt, Shigella flexneri 2a str. 2457T
gcuucacuucuuaccgcuuca

SEQ ID NO: 3849139 - RNA, 12 nt, Shigella flexneri 2a str. 2457T
gcuucagccgga

SEQ ID NO: 3849140 - RNA, 10 nt, Shigella flexneri 2a str. 2457T
gcuucagcga

SEQ ID NO: 3849141 - RNA, 17 nt, Shigella flexneri 2a str. 2457T
gcuucagcguaucccag

SEQ ID NO: 3849142 - RNA, 20 nt, Shigella flexneri 2a str. 2457T
gcuucaggugcccaacauac

SEQ ID NO: 3849143 - RNA, 22 nt, Shigella flexneri 2a str. 2457T
gcuucagugacuucugccagcu

SEQ ID NO: 3849144 - RNA, 14 nt, Shigella flexneri 2a str. 2457T
gcuucauaaggaaa

SEQ ID NO: 3849145 - RNA, 17 nt, Shigella flexneri 2a str. 2457T
gcuucaucagacgcuua

SEQ ID NO: 3849146 - RNA, 11 nt, Shigella flexneri 2a str. 2457T
gcuucaucgcc

SEQ ID NO: 3849147 - RNA, 12 nt, Shigella flexneri 2a str. 2457T
gcuucaucgccc

SEQ ID NO: 3849148 - RNA, 21 nt, Shigella flexneri 2a str. 2457T
gcuucaucgugcucgcuuucc

SEQ ID NO: 3849149 - RNA, 15 nt, Shigella flexneri 2a str. 2457T
gcuucaugcccgcca

SEQ ID NO: 3849150 - RNA, 16 nt, Shigella flexneri 2a str. 2457T
gcuucaugcuuaauca

SEQ ID NO: 3849151 - RNA, 19 nt, Shigella flexneri 2a str. 2457T
gcuuccaccguuucuuuuu

SEQ ID NO: 3849152 - RNA, 16 nt, Shigella flexneri 2a str. 2457T
gcuuccagcauuucug

SEQ ID NO: 3849153 - RNA, 12 nt, Shigella flexneri 2a str. 2457T
gcuucccaacgc

SEQ ID NO: 3849154 - RNA, 20 nt, Shigella flexneri 2a str. 2457T
gcuucccacagacgacgaac

SEQ ID NO: 3849155 - RNA, 16 nt, Shigella flexneri 2a str. 2457T
gcuucccacgucagac

SEQ ID NO: 3849156 - RNA, 18 nt, Shigella flexneri 2a str. 2457T
gcuucccccgcaucguga

SEQ ID NO: 3849157 - RNA, 18 nt, Shigella flexneri 2a str. 2457T
gcuucccgauaagggagc

SEQ ID NO: 3849158 - RNA, 19 nt, Shigella flexneri 2a str. 2457T
gcuucccgauaagggagca

SEQ ID NO: 3849159 - RNA, 21 nt, Shigella flexneri 2a str. 2457T
gcuucccgauaagggagcagg

SEQ ID NO: 3849160 - RNA, 15 nt, Shigella flexneri 2a str. 2457T
gcuuccggcaauggc

SEQ ID NO: 3849161 - RNA, 16 nt, Shigella flexneri 2a str. 2457T
gcuuccggcaauggcu

SEQ ID NO: 3849162 - RNA, 15 nt, Shigella flexneri 2a str. 2457T
gcuuccggucugcga

SEQ ID NO: 3849163 - RNA, 12 nt, Shigella flexneri 2a str. 2457T
gcuuccugcaac

SEQ ID NO: 3849164 - RNA, 16 nt, Shigella flexneri 2a str. 2457T
gcuuccuggcgcuggg

SEQ ID NO: 3849165 - RNA, 23 nt, Shigella flexneri 2a str. 2457T
gcuucgcaucccgguaucaaagc

SEQ ID NO: 3849166 - RNA, 21 nt, Shigella flexneri 2a str. 2457T
gcuucgcggacaucguccagc

SEQ ID NO: 3849167 - RNA, 22 nt, Shigella flexneri 2a str. 2457T
gcuucgcggacaucguccagcu

SEQ ID NO: 3849168 - RNA, 17 nt, Shigella flexneri 2a str. 2457T
gcuucgcuuaucaggcc

SEQ ID NO: 3849169 - RNA, 13 nt, Shigella flexneri 2a str. 2457T
gcuucgcuuccca

SEQ ID NO: 3849170 - RNA, 14 nt, Shigella flexneri 2a str. 2457T
gcuucgcuucccaa

SEQ ID NO: 3849171 - RNA, 14 nt, Shigella flexneri 2a str. 2457T
gcuucggcggguuu

SEQ ID NO: 3849172 - RNA, 17 nt, Shigella flexneri 2a str. 2457T
gcuucguagacgcuuuc

SEQ ID NO: 3849173 - RNA, 14 nt, Shigella flexneri 2a str. 2457T
gcuucguccaugcu

SEQ ID NO: 3849174 - RNA, 13 nt, Shigella flexneri 2a str. 2457T
gcuucguuuucag

SEQ ID NO: 3849175 - RNA, 20 nt, Shigella flexneri 2a str. 2457T
gcuucucaggccuacccggu

SEQ ID NO: 3849176 - RNA, 19 nt, Shigella flexneri 2a str. 2457T
gcuucucccagccgcccug

SEQ ID NO: 3849177 - RNA, 21 nt, Shigella flexneri 2a str. 2457T
gcuucucgugaaacucacgca

SEQ ID NO: 3849178 - RNA, 22 nt, Shigella flexneri 2a str. 2457T
gcuucugacauaaccacucacc

SEQ ID NO: 3849179 - RNA, 12 nt, Shigella flexneri 2a str. 2457T
gcuucugcagcu

SEQ ID NO: 3849180 - RNA, 14 nt, Shigella flexneri 2a str. 2457T
gcuucugcagcuuu

SEQ ID NO: 3849181 - RNA, 18 nt, Shigella flexneri 2a str. 2457T
gcuucugccuuauccagc

SEQ ID NO: 3849182 - RNA, 23 nt, Shigella flexneri 2a str. 2457T
gcuucugcguucugauuuaaucu

SEQ ID NO: 3849183 - RNA, 16 nt, Shigella flexneri 2a str. 2457T
gcuucugcuucagccg

SEQ ID NO: 3849184 - RNA, 13 nt, Shigella flexneri 2a str. 2457T
gcuucuggcuggc

SEQ ID NO: 3849185 - RNA, 19 nt, Shigella flexneri 2a str. 2457T
gcuucuguuuuaccugcgc

SEQ ID NO: 3849186 - RNA, 16 nt, Shigella flexneri 2a str. 2457T
gcuucuucagccugca

SEQ ID NO: 3849187 - RNA, 13 nt, Shigella flexneri 2a str. 2457T
gcuucuuccggcg

SEQ ID NO: 3849188 - RNA, 12 nt, Shigella flexneri 2a str. 2457T
gcuucuucuuca

SEQ ID NO: 3849189 - RNA, 11 nt, Shigella flexneri 2a str. 2457T
gcuucuuucuc

SEQ ID NO: 3849190 - RNA, 22 nt, Shigella flexneri 2a str. 2457T
gcuucuuucucaaucugcuugc

SEQ ID NO: 3849191 - RNA, 16 nt, Shigella flexneri 2a str. 2457T
gcuugaaaaauaaagu

SEQ ID NO: 3849192 - RNA, 15 nt, Shigella flexneri 2a str. 2457T
gcuugaagggcuggc

SEQ ID NO: 3849193 - RNA, 22 nt, Shigella flexneri 2a str. 2457T
gcuugaucaauaacgccaugag

SEQ ID NO: 3849194 - RNA, 18 nt, Shigella flexneri 2a str. 2457T
gcuugaugcacugggaga

SEQ ID NO: 3849195 - RNA, 13 nt, Shigella flexneri 2a str. 2457T
gcuugcaggauca

SEQ ID NO: 3849196 - RNA, 19 nt, Shigella flexneri 2a str. 2457T
gcuugcaggaucagcuccg

SEQ ID NO: 3849197 - RNA, 19 nt, Shigella flexneri 2a str. 2457T
gcuugccagauggcaucca

SEQ ID NO: 3849198 - RNA, 12 nt, Shigella flexneri 2a str. 2457T
gcuugccagcag

SEQ ID NO: 3849199 - RNA, 17 nt, Shigella flexneri 2a str. 2457T
gcuugccggaaccggau

SEQ ID NO: 3849200 - RNA, 20 nt, Shigella flexneri 2a str. 2457T
gcuugccgggccguaauauu

SEQ ID NO: 3849201 - RNA, 17 nt, Shigella flexneri 2a str. 2457T
gcuugcgauauucuuca

SEQ ID NO: 3849202 - RNA, 17 nt, Shigella flexneri 2a str. 2457T
gcuugcgauccugcaga

SEQ ID NO: 3849203 - RNA, 13 nt, Shigella flexneri 2a str. 2457T
gcuugcgccgcuu

SEQ ID NO: 3849204 - RNA, 16 nt, Shigella flexneri 2a str. 2457T
gcuugcgcgcaaucag

SEQ ID NO: 3849205 - RNA, 14 nt, Shigella flexneri 2a str. 2457T
ggaaagaucgccac

SEQ ID NO: 3849206 - RNA, 14 nt, Shigella flexneri 2a str. 2457T
ggaaagcacaaaau

SEQ ID NO: 3849207 - RNA, 16 nt, Shigella flexneri 2a str. 2457T
ggaaagcacaaaauca

SEQ ID NO: 3849208 - RNA, 22 nt, Shigella flexneri 2a str. 2457T
ggaaagccauguugaucauaaa

SEQ ID NO: 3849209 - RNA, 18 nt, Shigella flexneri 2a str. 2457T
ggaaagggccgcagugga

SEQ ID NO: 3849210 - RNA, 16 nt, Shigella flexneri 2a str. 2457T
ggaaaguguguauacg

SEQ ID NO: 3849211 - RNA, 22 nt, Shigella flexneri 2a str. 2457T
ggaaaguuuaauugccauuucu

SEQ ID NO: 3849212 - RNA, 16 nt, Shigella flexneri 2a str. 2457T
ggaaauaacaucccuu

SEQ ID NO: 3849213 - RNA, 22 nt, Shigella flexneri 2a str. 2457T
ggaaauaaucgggaauacagaa

SEQ ID NO: 3849214 - RNA, 22 nt, Shigella flexneri 2a str. 2457T
ggaaauacgcuggcugaacauu

SEQ ID NO: 3849215 - RNA, 17 nt, Shigella flexneri 2a str. 2457T
ggaaaucaccaccagca

SEQ ID NO: 3849216 - RNA, 12 nt, Shigella flexneri 2a str. 2457T
ggaaaucaucca

SEQ ID NO: 3849217 - RNA, 16 nt, Shigella flexneri 2a str. 2457T
ggaaauccaggucagc

SEQ ID NO: 3849218 - RNA, 18 nt, Shigella flexneri 2a str. 2457T
ggaaaucccgugacggua

SEQ ID NO: 3849219 - RNA, 21 nt, Shigella flexneri 2a str. 2457T
ggaaauccugccgcaguuucu

SEQ ID NO: 3849220 - RNA, 19 nt, Shigella flexneri 2a str. 2457T
ggaaaugaggaauuaacga

SEQ ID NO: 3849221 - RNA, 21 nt, Shigella flexneri 2a str. 2457T
ggaaaugggugacaucgcccu

SEQ ID NO: 3849222 - RNA, 17 nt, Shigella flexneri 2a str. 2457T
ggaaauuaaacggcaaa

SEQ ID NO: 3849223 - RNA, 22 nt, Shigella flexneri 2a str. 2457T
ggaaauuaccgcaccaccagca

SEQ ID NO: 3849224 - RNA, 19 nt, Shigella flexneri 2a str. 2457T
ggaaauuauggaucaccau

SEQ ID NO: 3849225 - RNA, 23 nt, Shigella flexneri 2a str. 2457T
ggaaauugcacugcaucauggca

SEQ ID NO: 3849226 - RNA, 17 nt, Shigella flexneri 2a str. 2457T
ggaaauugcagagcugc

SEQ ID NO: 3849227 - RNA, 13 nt, Shigella flexneri 2a str. 2457T
ggaaauugccacu

SEQ ID NO: 3849228 - RNA, 20 nt, Shigella flexneri 2a str. 2457T
ggaacaaaauuuucagcgug

SEQ ID NO: 3849229 - RNA, 16 nt, Shigella flexneri 2a str. 2457T
ggaacaacguaucuug

SEQ ID NO: 3849230 - RNA, 12 nt, Shigella flexneri 2a str. 2457T
ggaacaccagca

SEQ ID NO: 3849231 - RNA, 14 nt, Shigella flexneri 2a str. 2457T
ggaacaccucuggc

SEQ ID NO: 3849232 - RNA, 20 nt, Shigella flexneri 2a str. 2457T
ggaacacucuuccagucgcc

SEQ ID NO: 3849233 - RNA, 19 nt, Shigella flexneri 2a str. 2457T
ggaacaucccuugugcacu

SEQ ID NO: 3849234 - RNA, 15 nt, Shigella flexneri 2a str. 2457T
ggaacauccuuuccu

SEQ ID NO: 3849235 - RNA, 19 nt, Shigella flexneri 2a str. 2457T
ggaacauucgccgcuguga

SEQ ID NO: 3849236 - RNA, 15 nt, Shigella flexneri 2a str. 2457T
ggaacauuuaccgca

SEQ ID NO: 3849237 - RNA, 15 nt, Shigella flexneri 2a str. 2457T
ggaaccuaacgcugu

SEQ ID NO: 3849238 - RNA, 16 nt, Shigella flexneri 2a str. 2457T
ggaaccugugacagca

SEQ ID NO: 3849239 - RNA, 14 nt, Shigella flexneri 2a str. 2457T
ggaacgggcaagca

SEQ ID NO: 3849240 - RNA, 17 nt, Shigella flexneri 2a str. 2457T
ggaacggggguuuuacu

SEQ ID NO: 3849241 - RNA, 20 nt, Shigella flexneri 2a str. 2457T
ggaacugaaaggcgcucauu

SEQ ID NO: 3849242 - RNA, 17 nt, Shigella flexneri 2a str. 2457T
ggaacugcgugccguga

SEQ ID NO: 3849243 - RNA, 20 nt, Shigella flexneri 2a str. 2457T
ggaacuggcaacaauggcau

SEQ ID NO: 3849244 - RNA, 11 nt, Shigella flexneri 2a str. 2457T
ggaagaaaaau

SEQ ID NO: 3849245 - RNA, 13 nt, Shigella flexneri 2a str. 2457T
ggaagaaaaauau

SEQ ID NO: 3849246 - RNA, 13 nt, Shigella flexneri 2a str. 2457T
ggaagaauuucau

SEQ ID NO: 3849247 - RNA, 20 nt, Shigella flexneri 2a str. 2457T
ggaagaauuugcuaccccug

SEQ ID NO: 3849248 - RNA, 14 nt, Shigella flexneri 2a str. 2457T
ggaagaccugacug

SEQ ID NO: 3849249 - RNA, 17 nt, Shigella flexneri 2a str. 2457T
ggaagacguugauucac

SEQ ID NO: 3849250 - RNA, 23 nt, Shigella flexneri 2a str. 2457T
ggaagagauauuuucccaacgug

SEQ ID NO: 3849251 - RNA, 12 nt, Shigella flexneri 2a str. 2457T
ggaagaguuugu

SEQ ID NO: 3849252 - RNA, 18 nt, Shigella flexneri 2a str. 2457T
ggaagccggaauuuuccu

SEQ ID NO: 3849253 - RNA, 20 nt, Shigella flexneri 2a str. 2457T
ggaagccggaauuuuccuuc

SEQ ID NO: 3849254 - RNA, 23 nt, Shigella flexneri 2a str. 2457T
ggaagccuuccgcaaacaggcgc

SEQ ID NO: 3849255 - RNA, 18 nt, Shigella flexneri 2a str. 2457T
ggaagcuuucgcaguaga

SEQ ID NO: 3849256 - RNA, 20 nt, Shigella flexneri 2a str. 2457T
ggaaggauuacucagcgcug

SEQ ID NO: 3849257 - RNA, 14 nt, Shigella flexneri 2a str. 2457T
ggaaggccagcagg

SEQ ID NO: 3849258 - RNA, 22 nt, Shigella flexneri 2a str. 2457T
ggaaggcuagguugaccuggaa

SEQ ID NO: 3849259 - RNA, 20 nt, Shigella flexneri 2a str. 2457T
ggaagggcuuucacugccca

SEQ ID NO: 3849260 - RNA, 19 nt, Shigella flexneri 2a str. 2457T
ggaaggguguucauccugg

SEQ ID NO: 3849261 - RNA, 14 nt, Shigella flexneri 2a str. 2457T
ggaaggucauccaa

SEQ ID NO: 3849262 - RNA, 20 nt, Shigella flexneri 2a str. 2457T
ggaagguuuuaaucgcuauc

SEQ ID NO: 3849263 - RNA, 14 nt, Shigella flexneri 2a str. 2457T
ggaaguauuucaau

SEQ ID NO: 3849264 - RNA, 21 nt, Shigella flexneri 2a str. 2457T
ggaaguauuucaauauggaag

SEQ ID NO: 3849265 - RNA, 15 nt, Shigella flexneri 2a str. 2457T
ggaauaaaagccagg

SEQ ID NO: 3849266 - RNA, 22 nt, Shigella flexneri 2a str. 2457T
ggaaucaacggcaacaauuccc

SEQ ID NO: 3849267 - RNA, 13 nt, Shigella flexneri 2a str. 2457T
ggaaucacucauc

SEQ ID NO: 3849268 - RNA, 19 nt, Shigella flexneri 2a str. 2457T
ggaaucgcaaagccgauac

SEQ ID NO: 3849269 - RNA, 18 nt, Shigella flexneri 2a str. 2457T
ggaaucgcucucagagag

SEQ ID NO: 3849270 - RNA, 16 nt, Shigella flexneri 2a str. 2457T
ggaaugguauaacgca

SEQ ID NO: 3849271 - RNA, 15 nt, Shigella flexneri 2a str. 2457T
ggaaugugaugaaaa

SEQ ID NO: 3849272 - RNA, 18 nt, Shigella flexneri 2a str. 2457T
ggaaugugaugaaaaaag

SEQ ID NO: 3849273 - RNA, 19 nt, Shigella flexneri 2a str. 2457T
ggaauuacgcaauuacaug

SEQ ID NO: 3849274 - RNA, 19 nt, Shigella flexneri 2a str. 2457T
ggaauucucaaacgaaucu

SEQ ID NO: 3849275 - RNA, 13 nt, Shigella flexneri 2a str. 2457T
ggaauuuuacagc

SEQ ID NO: 3849276 - RNA, 14 nt, Shigella flexneri 2a str. 2457T
ggacaaagagcuuu

SEQ ID NO: 3849277 - RNA, 16 nt, Shigella flexneri 2a str. 2457T
ggacaaccauaaauuu

SEQ ID NO: 3849278 - RNA, 19 nt, Shigella flexneri 2a str. 2457T
ggacaauagcuaacgaaaa

SEQ ID NO: 3849279 - RNA, 13 nt, Shigella flexneri 2a str. 2457T
ggacaccucacca

SEQ ID NO: 3849280 - RNA, 20 nt, Shigella flexneri 2a str. 2457T
ggacacucgcugacugauau

SEQ ID NO: 3849281 - RNA, 20 nt, Shigella flexneri 2a str. 2457T
ggacacugcuuacaggcugg

SEQ ID NO: 3849282 - RNA, 21 nt, Shigella flexneri 2a str. 2457T
ggacacugcuuacaggcuggu

SEQ ID NO: 3849283 - RNA, 20 nt, Shigella flexneri 2a str. 2457T
ggacagaccugcgucaccac

SEQ ID NO: 3849284 - RNA, 16 nt, Shigella flexneri 2a str. 2457T
ggacagacuggcuauu

SEQ ID NO: 3849285 - RNA, 18 nt, Shigella flexneri 2a str. 2457T
ggacagacuggcuauuaa

SEQ ID NO: 3849286 - RNA, 16 nt, Shigella flexneri 2a str. 2457T
ggacagcguugccagc

SEQ ID NO: 3849287 - RNA, 17 nt, Shigella flexneri 2a str. 2457T
ggacagcguugccagcu

SEQ ID NO: 3849288 - RNA, 20 nt, Shigella flexneri 2a str. 2457T
ggacaguaaaguuuuauccc

SEQ ID NO: 3849289 - RNA, 14 nt, Shigella flexneri 2a str. 2457T
ggacauagcucugc

SEQ ID NO: 3849290 - RNA, 17 nt, Shigella flexneri 2a str. 2457T
ggacaucccggcagaga

SEQ ID NO: 3849291 - RNA, 22 nt, Shigella flexneri 2a str. 2457T
ggacaugauuacugcaaacuca

SEQ ID NO: 3849292 - RNA, 18 nt, Shigella flexneri 2a str. 2457T
ggaccaaagaaugacacu

SEQ ID NO: 3849293 - RNA, 10 nt, Shigella flexneri 2a str. 2457T
ggaccacgga

SEQ ID NO: 3849294 - RNA, 13 nt, Shigella flexneri 2a str. 2457T
ggaccagcaacaa

SEQ ID NO: 3849295 - RNA, 22 nt, Shigella flexneri 2a str. 2457T
ggaccauucacacuccaguccc

SEQ ID NO: 3849296 - RNA, 19 nt, Shigella flexneri 2a str. 2457T
ggacccuuaaagggucagg

SEQ ID NO: 3849297 - RNA, 20 nt, Shigella flexneri 2a str. 2457T
ggacccuuaaagggucaggg

SEQ ID NO: 3849298 - RNA, 23 nt, Shigella flexneri 2a str. 2457T
ggaccgauggguucagaaucaag

SEQ ID NO: 3849299 - RNA, 17 nt, Shigella flexneri 2a str. 2457T
ggaccgucaucuuccac

SEQ ID NO: 3849300 - RNA, 16 nt, Shigella flexneri 2a str. 2457T
ggaccuuauggaucug

SEQ ID NO: 3849301 - RNA, 18 nt, Shigella flexneri 2a str. 2457T
ggacgaacaguucaacgc

SEQ ID NO: 3849302 - RNA, 15 nt, Shigella flexneri 2a str. 2457T
ggcaaaaaucggcaa

SEQ ID NO: 3849303 - RNA, 17 nt, Shigella flexneri 2a str. 2457T
ggcaaaagacaccaucg

SEQ ID NO: 3849304 - RNA, 14 nt, Shigella flexneri 2a str. 2457T
ggcaaaagucacca

SEQ ID NO: 3849305 - RNA, 12 nt, Shigella flexneri 2a str. 2457T
ggcaaacgcccu

SEQ ID NO: 3849306 - RNA, 16 nt, Shigella flexneri 2a str. 2457T
ggcaaacuacaaaucc

SEQ ID NO: 3849307 - RNA, 16 nt, Shigella flexneri 2a str. 2457T
ggcaaagcugucacca

SEQ ID NO: 3849308 - RNA, 20 nt, Shigella flexneri 2a str. 2457T
ggcaaagcugucaccaauca

SEQ ID NO: 3849309 - RNA, 24 nt, Shigella flexneri 2a str. 2457T
ggcaaaggcuucguucaucucaaa

SEQ ID NO: 3849310 - RNA, 22 nt, Shigella flexneri 2a str. 2457T
ggcaaauaaucccgcgcaacaa

SEQ ID NO: 3849311 - RNA, 22 nt, Shigella flexneri 2a str. 2457T
ggcaaauacaguugcgccagua

SEQ ID NO: 3849312 - RNA, 16 nt, Shigella flexneri 2a str. 2457T
ggcaaauucuucacgg

SEQ ID NO: 3849313 - RNA, 20 nt, Shigella flexneri 2a str. 2457T
ggcaaauugcauacugcgau

SEQ ID NO: 3849314 - RNA, 16 nt, Shigella flexneri 2a str. 2457T
ggcaaccagcagaugu

SEQ ID NO: 3849315 - RNA, 18 nt, Shigella flexneri 2a str. 2457T
ggcaacgacugcgagcaa

SEQ ID NO: 3849316 - RNA, 20 nt, Shigella flexneri 2a str. 2457T
ggcaacgacugcgagcaaaa

SEQ ID NO: 3849317 - RNA, 12 nt, Shigella flexneri 2a str. 2457T
ggcaacugcugc

SEQ ID NO: 3849318 - RNA, 18 nt, Shigella flexneri 2a str. 2457T
ggcaacugcugcgguuga

SEQ ID NO: 3849319 - RNA, 12 nt, Shigella flexneri 2a str. 2457T
ggcaagaaaauu

SEQ ID NO: 3849320 - RNA, 20 nt, Shigella flexneri 2a str. 2457T
ggcaagaaaauuauucgccg

SEQ ID NO: 3849321 - RNA, 15 nt, Shigella flexneri 2a str. 2457T
ggcaagaauuacuuc

SEQ ID NO: 3849322 - RNA, 14 nt, Shigella flexneri 2a str. 2457T
ggcaagauacugca

SEQ ID NO: 3849323 - RNA, 14 nt, Shigella flexneri 2a str. 2457T
ggcaagaucauacu

SEQ ID NO: 3849324 - RNA, 23 nt, Shigella flexneri 2a str. 2457T
ggcaagcagcaaauagccgagcg

SEQ ID NO: 3849325 - RNA, 16 nt, Shigella flexneri 2a str. 2457T
ggcaagcauaugacga

SEQ ID NO: 3849326 - RNA, 13 nt, Shigella flexneri 2a str. 2457T
ggcaagccagcau

SEQ ID NO: 3849327 - RNA, 20 nt, Shigella flexneri 2a str. 2457T
ggcaagccgcuaacagcagc

SEQ ID NO: 3849328 - RNA, 23 nt, Shigella flexneri 2a str. 2457T
ggcaaguaacuucuccacugcug

SEQ ID NO: 3849329 - RNA, 20 nt, Shigella flexneri 2a str. 2457T
ggcaagugguuaaacccgcu

SEQ ID NO: 3849330 - RNA, 19 nt, Shigella flexneri 2a str. 2457T
ggcaagugugaugguauuc

SEQ ID NO: 3849331 - RNA, 23 nt, Shigella flexneri 2a str. 2457T
ggcaauagcgggacacuaccauu

SEQ ID NO: 3849332 - RNA, 16 nt, Shigella flexneri 2a str. 2457T
ggcaauauucauuaaa

SEQ ID NO: 3849333 - RNA, 18 nt, Shigella flexneri 2a str. 2457T
ggcaaucauucccagacc

SEQ ID NO: 3849334 - RNA, 17 nt, Shigella flexneri 2a str. 2457T
ggcaauccccgccagca

SEQ ID NO: 3849335 - RNA, 15 nt, Shigella flexneri 2a str. 2457T
ggcaaucggugcaaa

SEQ ID NO: 3849336 - RNA, 17 nt, Shigella flexneri 2a str. 2457T
ggcaaucuuccucgcca

SEQ ID NO: 3849337 - RNA, 23 nt, Shigella flexneri 2a str. 2457T
ggcaaugacccguaugaugugcg

SEQ ID NO: 3849338 - RNA, 23 nt, Shigella flexneri 2a str. 2457T
ggcaaugacuagcgccauaauaa

SEQ ID NO: 3849339 - RNA, 18 nt, Shigella flexneri 2a str. 2457T
ggcaauguagcgcugcaa

SEQ ID NO: 3849340 - RNA, 17 nt, Shigella flexneri 2a str. 2457T
ggcaaugucgagugaau

SEQ ID NO: 3849341 - RNA, 20 nt, Shigella flexneri 2a str. 2457T
ggcaauguuaccgaucgcca

SEQ ID NO: 3849342 - RNA, 22 nt, Shigella flexneri 2a str. 2457T
ggcaauucacugucgaacuggc

SEQ ID NO: 3849343 - RNA, 19 nt, Shigella flexneri 2a str. 2457T
ggcaauucucucugauuac

SEQ ID NO: 3849344 - RNA, 14 nt, Shigella flexneri 2a str. 2457T
ggcaauuucacguu

SEQ ID NO: 3849345 - RNA, 17 nt, Shigella flexneri 2a str. 2457T
ggcaauuuuuaccgguc

SEQ ID NO: 3849346 - RNA, 21 nt, Shigella flexneri 2a str. 2457T
ggcaauuuuuaccggucagga

SEQ ID NO: 3849347 - RNA, 16 nt, Shigella flexneri 2a str. 2457T
ggcacaacucggcggc

SEQ ID NO: 3849348 - RNA, 17 nt, Shigella flexneri 2a str. 2457T
ggcacaacucggcggcu

SEQ ID NO: 3849349 - RNA, 22 nt, Shigella flexneri 2a str. 2457T
ggcacaagcauuaaggcaagaa

SEQ ID NO: 3849350 - RNA, 14 nt, Shigella flexneri 2a str. 2457T
ggcacacaagcgua

SEQ ID NO: 3849351 - RNA, 16 nt, Shigella flexneri 2a str. 2457T
ggcacaguagcccacc

SEQ ID NO: 3849352 - RNA, 20 nt, Shigella flexneri 2a str. 2457T
ggcacauccagauuuuucag

SEQ ID NO: 3849353 - RNA, 16 nt, Shigella flexneri 2a str. 2457T
ggcacaucgacgguga

SEQ ID NO: 3849354 - RNA, 22 nt, Shigella flexneri 2a str. 2457T
ggcacaucgacggugacacuuu

SEQ ID NO: 3849355 - RNA, 13 nt, Shigella flexneri 2a str. 2457T
ggcaccaaagggc

SEQ ID NO: 3849356 - RNA, 16 nt, Shigella flexneri 2a str. 2457T
ggcaccaaucaccgcc

SEQ ID NO: 3849357 - RNA, 21 nt, Shigella flexneri 2a str. 2457T
ggcaccaaucaccgccagcaa

SEQ ID NO: 3849358 - RNA, 21 nt, Shigella flexneri 2a str. 2457T
ggcaccaccuggcuugccggg

SEQ ID NO: 3849359 - RNA, 13 nt, Shigella flexneri 2a str. 2457T
ggcaccacuugca

SEQ ID NO: 3849360 - RNA, 21 nt, Shigella flexneri 2a str. 2457T
ggcaccagcgcacaguuauaa

SEQ ID NO: 3849361 - RNA, 20 nt, Shigella flexneri 2a str. 2457T
ggcaccauuuaaaucaauaa

SEQ ID NO: 3849362 - RNA, 13 nt, Shigella flexneri 2a str. 2457T
ggcacccagcgcu

SEQ ID NO: 3849363 - RNA, 13 nt, Shigella flexneri 2a str. 2457T
ggcaccgcagauc

SEQ ID NO: 3849364 - RNA, 13 nt, Shigella flexneri 2a str. 2457T
ggcaccuuuucau

SEQ ID NO: 3849365 - RNA, 19 nt, Shigella flexneri 2a str. 2457T
ggcacgaaagguuccaaua

SEQ ID NO: 3849366 - RNA, 12 nt, Shigella flexneri 2a str. 2457T
ggcacguuaccu

SEQ ID NO: 3849367 - RNA, 19 nt, Shigella flexneri 2a str. 2457T
ggcacuggauuauuacugg

SEQ ID NO: 3849368 - RNA, 16 nt, Shigella flexneri 2a str. 2457T
ggcacugguacucaac

SEQ ID NO: 3849369 - RNA, 22 nt, Shigella flexneri 2a str. 2457T
ggcacuuucaucgcggucagcu

SEQ ID NO: 3849370 - RNA, 13 nt, Shigella flexneri 2a str. 2457T
ggcagaacagaac

SEQ ID NO: 3849371 - RNA, 12 nt, Shigella flexneri 2a str. 2457T
ggcagaacgcuu

SEQ ID NO: 3849372 - RNA, 12 nt, Shigella flexneri 2a str. 2457T
ggcagaacggug

SEQ ID NO: 3849373 - RNA, 21 nt, Shigella flexneri 2a str. 2457T
ggcagaauaacggcugauaac

SEQ ID NO: 3849374 - RNA, 22 nt, Shigella flexneri 2a str. 2457T
ggcagaaugguaacaccagagu

SEQ ID NO: 3849375 - RNA, 15 nt, Shigella flexneri 2a str. 2457T
ggcagacaaaacaua

SEQ ID NO: 3849376 - RNA, 20 nt, Shigella flexneri 2a str. 2457T
ggcagaccugcuuuguucag

SEQ ID NO: 3849377 - RNA, 22 nt, Shigella flexneri 2a str. 2457T
ggcagacgcucgccauuuuuca

SEQ ID NO: 3849378 - RNA, 14 nt, Shigella flexneri 2a str. 2457T
ggcagacgugacca

SEQ ID NO: 3849379 - RNA, 18 nt, Shigella flexneri 2a str. 2457T
ggcagagaaagcaaaaau

SEQ ID NO: 3849380 - RNA, 14 nt, Shigella flexneri 2a str. 2457T
ggcagagaucgccg

SEQ ID NO: 3849381 - RNA, 15 nt, Shigella flexneri 2a str. 2457T
ggcagagcaacauac

SEQ ID NO: 3849382 - RNA, 21 nt, Shigella flexneri 2a str. 2457T
ggcagauaaauuacugccgcu

SEQ ID NO: 3849383 - RNA, 13 nt, Shigella flexneri 2a str. 2457T
ggcagaugcgucu

SEQ ID NO: 3849384 - RNA, 16 nt, Shigella flexneri 2a str. 2457T
ggcagauugagcguca

SEQ ID NO: 3849385 - RNA, 22 nt, Shigella flexneri 2a str. 2457T
ggcagcaacggcaguuugcggu

SEQ ID NO: 3849386 - RNA, 18 nt, Shigella flexneri 2a str. 2457T
ggcagcaaucgaccaggc

SEQ ID NO: 3849387 - RNA, 14 nt, Shigella flexneri 2a str. 2457T
ggcagcauguguaa

SEQ ID NO: 3849388 - RNA, 17 nt, Shigella flexneri 2a str. 2457T
ggcagccaccgccagcg

SEQ ID NO: 3849389 - RNA, 22 nt, Shigella flexneri 2a str. 2457T
ggcagccaguucgagaaaaaua

SEQ ID NO: 3849390 - RNA, 12 nt, Shigella flexneri 2a str. 2457T
ggcagccuuucu

SEQ ID NO: 3849391 - RNA, 13 nt, Shigella flexneri 2a str. 2457T
ggcagcgaagggu

SEQ ID NO: 3849392 - RNA, 23 nt, Shigella flexneri 2a str. 2457T
ggcagcgcgaagcuggcggcggc

SEQ ID NO: 3849393 - RNA, 13 nt, Shigella flexneri 2a str. 2457T
ggcagcuccagca

SEQ ID NO: 3849394 - RNA, 18 nt, Shigella flexneri 2a str. 2457T
ggcagcuccagcaaaaag

SEQ ID NO: 3849395 - RNA, 17 nt, Shigella flexneri 2a str. 2457T
ggcagcucgaccgcugc

SEQ ID NO: 3849396 - RNA, 14 nt, Shigella flexneri 2a str. 2457T
ggcaggaguggcag

SEQ ID NO: 3849397 - RNA, 14 nt, Shigella flexneri 2a str. 2457T
ggcaggcagcgcca

SEQ ID NO: 3849398 - RNA, 19 nt, Shigella flexneri 2a str. 2457T
ggcaggcucugguguucuu

SEQ ID NO: 3849399 - RNA, 14 nt, Shigella flexneri 2a str. 2457T
ggccgacagcaggc

SEQ ID NO: 3849400 - RNA, 16 nt, Shigella flexneri 2a str. 2457T
ggccgacagcaggcuc

SEQ ID NO: 3849401 - RNA, 16 nt, Shigella flexneri 2a str. 2457T
ggccgaggcacagcag

SEQ ID NO: 3849402 - RNA, 16 nt, Shigella flexneri 2a str. 2457T
ggccgcaaaccagcgc

SEQ ID NO: 3849403 - RNA, 17 nt, Shigella flexneri 2a str. 2457T
ggccgcaaaccagcgca

SEQ ID NO: 3849404 - RNA, 21 nt, Shigella flexneri 2a str. 2457T
ggccgcaaaccagcgcauggc

SEQ ID NO: 3849405 - RNA, 15 nt, Shigella flexneri 2a str. 2457T
ggccgcaguaaagcg

SEQ ID NO: 3849406 - RNA, 19 nt, Shigella flexneri 2a str. 2457T
ggccgccacacagcacgca

SEQ ID NO: 3849407 - RNA, 14 nt, Shigella flexneri 2a str. 2457T
ggccgcgcagggca

SEQ ID NO: 3849408 - RNA, 16 nt, Shigella flexneri 2a str. 2457T
ggccgcguaccgcagc

SEQ ID NO: 3849409 - RNA, 19 nt, Shigella flexneri 2a str. 2457T
ggccgcuuucugagcggcc

SEQ ID NO: 3849410 - RNA, 20 nt, Shigella flexneri 2a str. 2457T
ggccgcuuucugagcggccu

SEQ ID NO: 3849411 - RNA, 16 nt, Shigella flexneri 2a str. 2457T
ggccggauguggcguu

SEQ ID NO: 3849412 - RNA, 18 nt, Shigella flexneri 2a str. 2457T
ggccgggcaaacaaggca

SEQ ID NO: 3849413 - RNA, 20 nt, Shigella flexneri 2a str. 2457T
ggccggguuuucucccucgc

SEQ ID NO: 3849414 - RNA, 14 nt, Shigella flexneri 2a str. 2457T
ggccgguaacgcuu

SEQ ID NO: 3849415 - RNA, 22 nt, Shigella flexneri 2a str. 2457T
ggccgguaacgcuuucucacca

SEQ ID NO: 3849416 - RNA, 23 nt, Shigella flexneri 2a str. 2457T
ggccgguuuuaaagcaaaaaaag

SEQ ID NO: 3849417 - RNA, 18 nt, Shigella flexneri 2a str. 2457T
ggccguaacugugccaaa

SEQ ID NO: 3849418 - RNA, 15 nt, Shigella flexneri 2a str. 2457T
ggccguacccagcug

SEQ ID NO: 3849419 - RNA, 18 nt, Shigella flexneri 2a str. 2457T
ggccgugcagaccgcuga

SEQ ID NO: 3849420 - RNA, 20 nt, Shigella flexneri 2a str. 2457T
ggccguuaggaccgguuuca

SEQ ID NO: 3849421 - RNA, 18 nt, Shigella flexneri 2a str. 2457T
ggccguuccauucaaacg

SEQ ID NO: 3849422 - RNA, 13 nt, Shigella flexneri 2a str. 2457T
ggccguuccggca

SEQ ID NO: 3849423 - RNA, 13 nt, Shigella flexneri 2a str. 2457T
ggccguuuucaac

SEQ ID NO: 3849424 - RNA, 20 nt, Shigella flexneri 2a str. 2457T
ggccuacaacuccguugaaa

SEQ ID NO: 3849425 - RNA, 19 nt, Shigella flexneri 2a str. 2457T
ggccuacaauguuucugca

SEQ ID NO: 3849426 - RNA, 20 nt, Shigella flexneri 2a str. 2457T
ggccuacagcauauaaugca

SEQ ID NO: 3849427 - RNA, 20 nt, Shigella flexneri 2a str. 2457T
ggccuacauagucccugcaa

SEQ ID NO: 3849428 - RNA, 20 nt, Shigella flexneri 2a str. 2457T
ggccuacaucguuccugcaa

SEQ ID NO: 3849429 - RNA, 21 nt, Shigella flexneri 2a str. 2457T
ggccuacaucguuccugcaau

SEQ ID NO: 3849430 - RNA, 19 nt, Shigella flexneri 2a str. 2457T
ggccuacaugauuucugca

SEQ ID NO: 3849431 - RNA, 20 nt, Shigella flexneri 2a str. 2457T
ggccuaccguucaggcacaa

SEQ ID NO: 3849432 - RNA, 21 nt, Shigella flexneri 2a str. 2457T
ggccuacgugguuuaugcaau

SEQ ID NO: 3849433 - RNA, 16 nt, Shigella flexneri 2a str. 2457T
ggccuccccugauuca

SEQ ID NO: 3849434 - RNA, 14 nt, Shigella flexneri 2a str. 2457T
ggccuccugcagcg

SEQ ID NO: 3849435 - RNA, 17 nt, Shigella flexneri 2a str. 2457T
ggccucgcuacgccagc

SEQ ID NO: 3849436 - RNA, 16 nt, Shigella flexneri 2a str. 2457T
ggccucuccuuuacca

SEQ ID NO: 3849437 - RNA, 15 nt, Shigella flexneri 2a str. 2457T
ggccugaaagcucau

SEQ ID NO: 3849438 - RNA, 15 nt, Shigella flexneri 2a str. 2457T
ggccugaacaagcaa

SEQ ID NO: 3849439 - RNA, 19 nt, Shigella flexneri 2a str. 2457T
ggccugagacugaugacaa

SEQ ID NO: 3849440 - RNA, 20 nt, Shigella flexneri 2a str. 2457T
ggccugauaagcgcagcgca

SEQ ID NO: 3849441 - RNA, 21 nt, Shigella flexneri 2a str. 2457T
ggccugauaagcgcagcgcau

SEQ ID NO: 3849442 - RNA, 20 nt, Shigella flexneri 2a str. 2457T
ggccugauaagcguagcgca

SEQ ID NO: 3849443 - RNA, 20 nt, Shigella flexneri 2a str. 2457T
ggccugauaaguguagcgca

SEQ ID NO: 3849444 - RNA, 21 nt, Shigella flexneri 2a str. 2457T
ggccugcccacgggcaggcuu

SEQ ID NO: 3849445 - RNA, 11 nt, Shigella flexneri 2a str. 2457T
ggccugccgcu

SEQ ID NO: 3849446 - RNA, 15 nt, Shigella flexneri 2a str. 2457T
ggccugcgcgaccuc

SEQ ID NO: 3849447 - RNA, 14 nt, Shigella flexneri 2a str. 2457T
ggccugcucaagcg

SEQ ID NO: 3849448 - RNA, 18 nt, Shigella flexneri 2a str. 2457T
ggccuugauuauuucccu

SEQ ID NO: 3849449 - RNA, 13 nt, Shigella flexneri 2a str. 2457T
ggccuugccguug

SEQ ID NO: 3849450 - RNA, 18 nt, Shigella flexneri 2a str. 2457T
ggccuuuuuggcaagcag

SEQ ID NO: 3849451 - RNA, 14 nt, Shigella flexneri 2a str. 2457T
ggcgaaaagcuucu

SEQ ID NO: 3849452 - RNA, 18 nt, Shigella flexneri 2a str. 2457T
ggcgaaaagcuucuuccu

SEQ ID NO: 3849453 - RNA, 14 nt, Shigella flexneri 2a str. 2457T
ggcgaaaggcuggc

SEQ ID NO: 3849454 - RNA, 15 nt, Shigella flexneri 2a str. 2457T
ggcgaacauuccggu

SEQ ID NO: 3849455 - RNA, 16 nt, Shigella flexneri 2a str. 2457T
ggcgaagagagcgcca

SEQ ID NO: 3849456 - RNA, 23 nt, Shigella flexneri 2a str. 2457T
ggcgaagauacccgcgaggcgca

SEQ ID NO: 3849457 - RNA, 21 nt, Shigella flexneri 2a str. 2457T
ggcgaauagaaagcaagccag

SEQ ID NO: 3849458 - RNA, 14 nt, Shigella flexneri 2a str. 2457T
ggcgacuucugcuu

SEQ ID NO: 3849459 - RNA, 15 nt, Shigella flexneri 2a str. 2457T
ggcgacuucugcuuu

SEQ ID NO: 3849460 - RNA, 15 nt, Shigella flexneri 2a str. 2457T
ggcgagaaacgcuuu

SEQ ID NO: 3849461 - RNA, 18 nt, Shigella flexneri 2a str. 2457T
ggcgagaauagucggccc

SEQ ID NO: 3849462 - RNA, 14 nt, Shigella flexneri 2a str. 2457T
ggcgagagacgcuu

SEQ ID NO: 3849463 - RNA, 14 nt, Shigella flexneri 2a str. 2457T
ggcgagcaucgccc

SEQ ID NO: 3849464 - RNA, 14 nt, Shigella flexneri 2a str. 2457T
ggcgagccagcgca

SEQ ID NO: 3849465 - RNA, 15 nt, Shigella flexneri 2a str. 2457T
ggcgagccagcgcau

SEQ ID NO: 3849466 - RNA, 11 nt, Shigella flexneri 2a str. 2457T
ggcgagcgcca

SEQ ID NO: 3849467 - RNA, 16 nt, Shigella flexneri 2a str. 2457T
ggcgagcgccagcaug

SEQ ID NO: 3849468 - RNA, 21 nt, Shigella flexneri 2a str. 2457T
ggcgaggaacgaucccagcgu

SEQ ID NO: 3849469 - RNA, 17 nt, Shigella flexneri 2a str. 2457T
ggcgaggcggggccaau

SEQ ID NO: 3849470 - RNA, 18 nt, Shigella flexneri 2a str. 2457T
ggcgaggggaccgccccu

SEQ ID NO: 3849471 - RNA, 23 nt, Shigella flexneri 2a str. 2457T
ggcgaggggacgguccgugcgcu

SEQ ID NO: 3849472 - RNA, 21 nt, Shigella flexneri 2a str. 2457T
ggcgaggggacuguccgggca

SEQ ID NO: 3849473 - RNA, 18 nt, Shigella flexneri 2a str. 2457T
ggcgagguaggcagucau

SEQ ID NO: 3849474 - RNA, 17 nt, Shigella flexneri 2a str. 2457T
ggcgaguucagaucagg

SEQ ID NO: 3849475 - RNA, 18 nt, Shigella flexneri 2a str. 2457T
ggcgaguuuccaucaggc

SEQ ID NO: 3849476 - RNA, 22 nt, Shigella flexneri 2a str. 2457T
ggcgauaaucagcgccagcgcg

SEQ ID NO: 3849477 - RNA, 16 nt, Shigella flexneri 2a str. 2457T
ggcgauaaucucaaua

SEQ ID NO: 3849478 - RNA, 13 nt, Shigella flexneri 2a str. 2457T
ggcgauaccagua

SEQ ID NO: 3849479 - RNA, 20 nt, Shigella flexneri 2a str. 2457T
ggcgauauuauccccugcga

SEQ ID NO: 3849480 - RNA, 19 nt, Shigella flexneri 2a str. 2457T
ggcgaugcacaugcuucag

SEQ ID NO: 3849481 - RNA, 20 nt, Shigella flexneri 2a str. 2457T
ggcgaugcuguauucuucag

SEQ ID NO: 3849482 - RNA, 21 nt, Shigella flexneri 2a str. 2457T
ggcgaugcuuugaccucccgc

SEQ ID NO: 3849483 - RNA, 15 nt, Shigella flexneri 2a str. 2457T
ggcgaugggacgcgc

SEQ ID NO: 3849484 - RNA, 21 nt, Shigella flexneri 2a str. 2457T
ggcgaugggcguuucacuggu

SEQ ID NO: 3849485 - RNA, 22 nt, Shigella flexneri 2a str. 2457T
ggcgaugggcguuucacuggua

SEQ ID NO: 3849486 - RNA, 21 nt, Shigella flexneri 2a str. 2457T
ggcgauuuuccuccauuugcc

SEQ ID NO: 3849487 - RNA, 16 nt, Shigella flexneri 2a str. 2457T
ggcgcaagggugccgg

SEQ ID NO: 3849488 - RNA, 20 nt, Shigella flexneri 2a str. 2457T
ggcgcaauguugcgggggcu

SEQ ID NO: 3849489 - RNA, 13 nt, Shigella flexneri 2a str. 2457T
ggcgcaauucccg

SEQ ID NO: 3849490 - RNA, 18 nt, Shigella flexneri 2a str. 2457T
ggcgcaccugaaucguca

SEQ ID NO: 3849491 - RNA, 13 nt, Shigella flexneri 2a str. 2457T
ggcgcaggccaau

SEQ ID NO: 3849492 - RNA, 13 nt, Shigella flexneri 2a str. 2457T
ggcgcagggugua

SEQ ID NO: 3849493 - RNA, 18 nt, Shigella flexneri 2a str. 2457T
ggcgcaguuucgaggcga

SEQ ID NO: 3849494 - RNA, 22 nt, Shigella flexneri 2a str. 2457T
ggcgcaucggucgaugaaagcg

SEQ ID NO: 3849495 - RNA, 22 nt, Shigella flexneri 2a str. 2457T
ggcgcaucuguuucgaucagca

SEQ ID NO: 3849496 - RNA, 23 nt, Shigella flexneri 2a str. 2457T
ggcugcgggaguugcuccacugc

SEQ ID NO: 3849497 - RNA, 20 nt, Shigella flexneri 2a str. 2457T
ggcugcugauguucgccaga

SEQ ID NO: 3849498 - RNA, 18 nt, Shigella flexneri 2a str. 2457T
ggcuggagagggugaccg

SEQ ID NO: 3849499 - RNA, 14 nt, Shigella flexneri 2a str. 2457T
ggcuggaucagacg

SEQ ID NO: 3849500 - RNA, 16 nt, Shigella flexneri 2a str. 2457T
ggcuggaucagacgca

SEQ ID NO: 3849501 - RNA, 14 nt, Shigella flexneri 2a str. 2457T
ggcuggcaaugacc

SEQ ID NO: 3849502 - RNA, 12 nt, Shigella flexneri 2a str. 2457T
ggcuggccaauu

SEQ ID NO: 3849503 - RNA, 20 nt, Shigella flexneri 2a str. 2457T
ggcuggccccgucagcaaaa

SEQ ID NO: 3849504 - RNA, 15 nt, Shigella flexneri 2a str. 2457T
ggcuggcgcauacca

SEQ ID NO: 3849505 - RNA, 20 nt, Shigella flexneri 2a str. 2457T
ggcuggcggcaaucgccaga

SEQ ID NO: 3849506 - RNA, 18 nt, Shigella flexneri 2a str. 2457T
ggcugguuacucaccagc

SEQ ID NO: 3849507 - RNA, 16 nt, Shigella flexneri 2a str. 2457T
ggcugucauccagcag

SEQ ID NO: 3849508 - RNA, 17 nt, Shigella flexneri 2a str. 2457T
ggcugugaaccgcacag

SEQ ID NO: 3849509 - RNA, 18 nt, Shigella flexneri 2a str. 2457T
ggcugugggguauuucca

SEQ ID NO: 3849510 - RNA, 20 nt, Shigella flexneri 2a str. 2457T
ggcugugggucaccguacug

SEQ ID NO: 3849511 - RNA, 19 nt, Shigella flexneri 2a str. 2457T
ggcugugguacugccggcg

SEQ ID NO: 3849512 - RNA, 20 nt, Shigella flexneri 2a str. 2457T
ggcuguucccacgcacagaa

SEQ ID NO: 3849513 - RNA, 20 nt, Shigella flexneri 2a str. 2457T
ggcuguugaaugccgguucc

SEQ ID NO: 3849514 - RNA, 14 nt, Shigella flexneri 2a str. 2457T
ggcuuauccggcau

SEQ ID NO: 3849515 - RNA, 16 nt, Shigella flexneri 2a str. 2457T
ggcuuauggcucgcca

SEQ ID NO: 3849516 - RNA, 17 nt, Shigella flexneri 2a str. 2457T
ggcuuccuuaagccgcu

SEQ ID NO: 3849517 - RNA, 13 nt, Shigella flexneri 2a str. 2457T
ggcuucgacgcuc

SEQ ID NO: 3849518 - RNA, 13 nt, Shigella flexneri 2a str. 2457T
ggcuucgccuccu

SEQ ID NO: 3849519 - RNA, 16 nt, Shigella flexneri 2a str. 2457T
ggcuucugccuuaucc

SEQ ID NO: 3849520 - RNA, 21 nt, Shigella flexneri 2a str. 2457T
ggcuucugccuuauccagcag

SEQ ID NO: 3849521 - RNA, 13 nt, Shigella flexneri 2a str. 2457T
ggcuugcgcgcaa

SEQ ID NO: 3849522 - RNA, 16 nt, Shigella flexneri 2a str. 2457T
ggcuugugcgcccggc

SEQ ID NO: 3849523 - RNA, 20 nt, Shigella flexneri 2a str. 2457T
ggcuuuaauaccugccuggu

SEQ ID NO: 3849524 - RNA, 13 nt, Shigella flexneri 2a str. 2457T
ggcuuuaaucacc

SEQ ID NO: 3849525 - RNA, 15 nt, Shigella flexneri 2a str. 2457T
ggcuuuaucacugag

SEQ ID NO: 3849526 - RNA, 23 nt, Shigella flexneri 2a str. 2457T
ggcuuucuucuggguugccugau

SEQ ID NO: 3849527 - RNA, 21 nt, Shigella flexneri 2a str. 2457T
ggcuuuguuacccccauccac

SEQ ID NO: 3849528 - RNA, 17 nt, Shigella flexneri 2a str. 2457T
ggcuuuuacgcauugcu

SEQ ID NO: 3849529 - RNA, 20 nt, Shigella flexneri 2a str. 2457T
ggcuuuuacgcauugcucac

SEQ ID NO: 3849530 - RNA, 14 nt, Shigella flexneri 2a str. 2457T
ggcuuuucgacaga

SEQ ID NO: 3849531 - RNA, 18 nt, Shigella flexneri 2a str. 2457T
ggcuuuuuacgcgacaca

SEQ ID NO: 3849532 - RNA, 18 nt, Shigella flexneri 2a str. 2457T
ggcuuuuuaugacgcugg

SEQ ID NO: 3849533 - RNA, 18 nt, Shigella flexneri 2a str. 2457T
ggcuuuuuuacaucauca

SEQ ID NO: 3849534 - RNA, 19 nt, Shigella flexneri 2a str. 2457T
ggcuuuuuuauugcuucac

SEQ ID NO: 3849535 - RNA, 18 nt, Shigella flexneri 2a str. 2457T
gggaaaacagcgcaccag

SEQ ID NO: 3849536 - RNA, 16 nt, Shigella flexneri 2a str. 2457T
gggaaaacgcuggcag

SEQ ID NO: 3849537 - RNA, 19 nt, Shigella flexneri 2a str. 2457T
gggaaaacgcuggcagcau

SEQ ID NO: 3849538 - RNA, 14 nt, Shigella flexneri 2a str. 2457T
gggaaaguggcguu

SEQ ID NO: 3849539 - RNA, 13 nt, Shigella flexneri 2a str. 2457T
gggaacagaccag

SEQ ID NO: 3849540 - RNA, 18 nt, Shigella flexneri 2a str. 2457T
gggaagcgcaccaauuca

SEQ ID NO: 3849541 - RNA, 15 nt, Shigella flexneri 2a str. 2457T
gggaagggagcgccg

SEQ ID NO: 3849542 - RNA, 17 nt, Shigella flexneri 2a str. 2457T
gggaaggucagguuuga

SEQ ID NO: 3849543 - RNA, 14 nt, Shigella flexneri 2a str. 2457T
gggaauccagcaau

SEQ ID NO: 3849544 - RNA, 12 nt, Shigella flexneri 2a str. 2457T
gggaauggcaga

SEQ ID NO: 3849545 - RNA, 19 nt, Shigella flexneri 2a str. 2457T
gggaaugugaugaaaaaag

SEQ ID NO: 3849546 - RNA, 17 nt, Shigella flexneri 2a str. 2457T
gggaauugugcuuucag

SEQ ID NO: 3849547 - RNA, 16 nt, Shigella flexneri 2a str. 2457T
gggacgguccgugcgc

SEQ ID NO: 3849548 - RNA, 17 nt, Shigella flexneri 2a str. 2457T
gggagaccucacugaaa

SEQ ID NO: 3849549 - RNA, 15 nt, Shigella flexneri 2a str. 2457T
gggagagggccgggg

SEQ ID NO: 3849550 - RNA, 16 nt, Shigella flexneri 2a str. 2457T
gggagcagacuguaaa

SEQ ID NO: 3849551 - RNA, 23 nt, Shigella flexneri 2a str. 2457T
gggagcagauacggcgcaucugu

SEQ ID NO: 3849552 - RNA, 14 nt, Shigella flexneri 2a str. 2457T
gggagcaggccggg

SEQ ID NO: 3849553 - RNA, 23 nt, Shigella flexneri 2a str. 2457T
gggaggcacaccagauuccucuc

SEQ ID NO: 3849554 - RNA, 13 nt, Shigella flexneri 2a str. 2457T
gggaguccacaac

SEQ ID NO: 3849555 - RNA, 19 nt, Shigella flexneri 2a str. 2457T
gggauaaagcccccgcaac

SEQ ID NO: 3849556 - RNA, 19 nt, Shigella flexneri 2a str. 2457T
gggauagaaacagucugga

SEQ ID NO: 3849557 - RNA, 13 nt, Shigella flexneri 2a str. 2457T
gggauagcucaau

SEQ ID NO: 3849558 - RNA, 18 nt, Shigella flexneri 2a str. 2457T
gggauauccacugucaaa

SEQ ID NO: 3849559 - RNA, 19 nt, Shigella flexneri 2a str. 2457T
gggaucucuuccagugccu

SEQ ID NO: 3849560 - RNA, 22 nt, Shigella flexneri 2a str. 2457T
gggaucugauucugauccugca

SEQ ID NO: 3849561 - RNA, 17 nt, Shigella flexneri 2a str. 2457T
gggaucuucuuccgcgc

SEQ ID NO: 3849562 - RNA, 13 nt, Shigella flexneri 2a str. 2457T
gggaugcagaaug

SEQ ID NO: 3849563 - RNA, 19 nt, Shigella flexneri 2a str. 2457T
gggaugccgaaaaaaguca

SEQ ID NO: 3849564 - RNA, 14 nt, Shigella flexneri 2a str. 2457T
gggaugcuggggcc

SEQ ID NO: 3849565 - RNA, 19 nt, Shigella flexneri 2a str. 2457T
gggauguaauuaagcgcaa

SEQ ID NO: 3849566 - RNA, 13 nt, Shigella flexneri 2a str. 2457T
gggauguguaagu

SEQ ID NO: 3849567 - RNA, 20 nt, Shigella flexneri 2a str. 2457T
gggauguguaaguaaugaca

SEQ ID NO: 3849568 - RNA, 20 nt, Shigella flexneri 2a str. 2457T
gggauuaaaaaguaagaauu

SEQ ID NO: 3849569 - RNA, 19 nt, Shigella flexneri 2a str. 2457T
gggauuaaagcgcuccaga

SEQ ID NO: 3849570 - RNA, 21 nt, Shigella flexneri 2a str. 2457T
gggauucacguugaugguagg

SEQ ID NO: 3849571 - RNA, 21 nt, Shigella flexneri 2a str. 2457T
gggcaaauucuucacggaaaa

SEQ ID NO: 3849572 - RNA, 21 nt, Shigella flexneri 2a str. 2457T
gggcaagcgccuaaauccacc

SEQ ID NO: 3849573 - RNA, 14 nt, Shigella flexneri 2a str. 2457T
gggcaauauuucgc

SEQ ID NO: 3849574 - RNA, 21 nt, Shigella flexneri 2a str. 2457T
gggcaaugcgggugcaaucaa

SEQ ID NO: 3849575 - RNA, 22 nt, Shigella flexneri 2a str. 2457T
gggcaauuucacguucacccau

SEQ ID NO: 3849576 - RNA, 21 nt, Shigella flexneri 2a str. 2457T
gggcacagauuuccaagcgcg

SEQ ID NO: 3849577 - RNA, 22 nt, Shigella flexneri 2a str. 2457T
gggcagacgccacaaucucacc

SEQ ID NO: 3849578 - RNA, 23 nt, Shigella flexneri 2a str. 2457T
gggcaggcuucaacacaggccgg

SEQ ID NO: 3849579 - RNA, 18 nt, Shigella flexneri 2a str. 2457T
gggcaggggcuucuuccg

SEQ ID NO: 3849580 - RNA, 14 nt, Shigella flexneri 2a str. 2457T
gggcaucagcagca

SEQ ID NO: 3849581 - RNA, 16 nt, Shigella flexneri 2a str. 2457T
gggcaucggcaaucac

SEQ ID NO: 3849582 - RNA, 15 nt, Shigella flexneri 2a str. 2457T
gggcaucucaggcag

SEQ ID NO: 3849583 - RNA, 14 nt, Shigella flexneri 2a str. 2457T
gggcaugaguaaaa

SEQ ID NO: 3849584 - RNA, 17 nt, Shigella flexneri 2a str. 2457T
gggcauggcgcagcgau

SEQ ID NO: 3849585 - RNA, 18 nt, Shigella flexneri 2a str. 2457T
gggcauggugucaccacc

SEQ ID NO: 3849586 - RNA, 18 nt, Shigella flexneri 2a str. 2457T
gggcauguguuagcccug

SEQ ID NO: 3849587 - RNA, 19 nt, Shigella flexneri 2a str. 2457T
gggcauguguuagcccugu

SEQ ID NO: 3849588 - RNA, 17 nt, Shigella flexneri 2a str. 2457T
gggccaacuggcaaaag

SEQ ID NO: 3849589 - RNA, 18 nt, Shigella flexneri 2a str. 2457T
gggccgaacaucagauaa

SEQ ID NO: 3849590 - RNA, 20 nt, Shigella flexneri 2a str. 2457T
gggccgaacaucagauaauc

SEQ ID NO: 3849591 - RNA, 14 nt, Shigella flexneri 2a str. 2457T
gggccgucuggcug

SEQ ID NO: 3849592 - RNA, 21 nt, Shigella flexneri 2a str. 2457T
gggcgaauuaucggcagcggc

SEQ ID NO: 3849593 - RNA, 15 nt, Shigella flexneri 2a str. 2457T
ggucaccgccgauac

SEQ ID NO: 3849594 - RNA, 22 nt, Shigella flexneri 2a str. 2457T
ggucaccugccagggugcuggc

SEQ ID NO: 3849595 - RNA, 20 nt, Shigella flexneri 2a str. 2457T
ggucacgauggaaccguaca

SEQ ID NO: 3849596 - RNA, 21 nt, Shigella flexneri 2a str. 2457T
ggucagaacgaccaguucaca

SEQ ID NO: 3849597 - RNA, 11 nt, Shigella flexneri 2a str. 2457T
ggucagacaac

SEQ ID NO: 3849598 - RNA, 14 nt, Shigella flexneri 2a str. 2457T
ggucagagaaucga

SEQ ID NO: 3849599 - RNA, 22 nt, Shigella flexneri 2a str. 2457T
ggucagagagccagccccacag

SEQ ID NO: 3849600 - RNA, 14 nt, Shigella flexneri 2a str. 2457T
ggucagaucagcca

SEQ ID NO: 3849601 - RNA, 23 nt, Shigella flexneri 2a str. 2457T
ggucagcagcuuucuuuauaucu

SEQ ID NO: 3849602 - RNA, 20 nt, Shigella flexneri 2a str. 2457T
ggucagccacaguugaucag

SEQ ID NO: 3849603 - RNA, 23 nt, Shigella flexneri 2a str. 2457T
ggucagccacaguugaucagcca

SEQ ID NO: 3849604 - RNA, 18 nt, Shigella flexneri 2a str. 2457T
ggucagcgccuggcugca

SEQ ID NO: 3849605 - RNA, 21 nt, Shigella flexneri 2a str. 2457T
ggucagcuucaccuuccagua

SEQ ID NO: 3849606 - RNA, 16 nt, Shigella flexneri 2a str. 2457T
ggucaggaaacuugcg

SEQ ID NO: 3849607 - RNA, 19 nt, Shigella flexneri 2a str. 2457T
ggucagguauuuugucagc

SEQ ID NO: 3849608 - RNA, 17 nt, Shigella flexneri 2a str. 2457T
ggucaguccccacgcca

SEQ ID NO: 3849609 - RNA, 13 nt, Shigella flexneri 2a str. 2457T
ggucagugccugc

SEQ ID NO: 3849610 - RNA, 15 nt, Shigella flexneri 2a str. 2457T
ggucaguuggcuggg

SEQ ID NO: 3849611 - RNA, 15 nt, Shigella flexneri 2a str. 2457T
ggucaucacauccca

SEQ ID NO: 3849612 - RNA, 12 nt, Shigella flexneri 2a str. 2457T
ggucauccaaau

SEQ ID NO: 3849613 - RNA, 19 nt, Shigella flexneri 2a str. 2457T
ggucauggcauuaauaugc

SEQ ID NO: 3849614 - RNA, 22 nt, Shigella flexneri 2a str. 2457T
ggucauuuucuucagcaguuca

SEQ ID NO: 3849615 - RNA, 18 nt, Shigella flexneri 2a str. 2457T
ggucauuuugaccacacg

SEQ ID NO: 3849616 - RNA, 17 nt, Shigella flexneri 2a str. 2457T
gguccagccgccagggc

SEQ ID NO: 3849617 - RNA, 15 nt, Shigella flexneri 2a str. 2457T
ggucccugaugcauc

SEQ ID NO: 3849618 - RNA, 20 nt, Shigella flexneri 2a str. 2457T
ggucccugaugcaucaguca

SEQ ID NO: 3849619 - RNA, 14 nt, Shigella flexneri 2a str. 2457T
ggucccuucaaucu

SEQ ID NO: 3849620 - RNA, 16 nt, Shigella flexneri 2a str. 2457T
gguccgggcaucagca

SEQ ID NO: 3849621 - RNA, 18 nt, Shigella flexneri 2a str. 2457T
gguccuggucugaugaau

SEQ ID NO: 3849622 - RNA, 12 nt, Shigella flexneri 2a str. 2457T
gguccuucaucu

SEQ ID NO: 3849623 - RNA, 20 nt, Shigella flexneri 2a str. 2457T
ggucgaaaauaucgguuccg

SEQ ID NO: 3849624 - RNA, 16 nt, Shigella flexneri 2a str. 2457T
ggucgcaucauuuaaa

SEQ ID NO: 3849625 - RNA, 16 nt, Shigella flexneri 2a str. 2457T
ggucgccagaagguga

SEQ ID NO: 3849626 - RNA, 21 nt, Shigella flexneri 2a str. 2457T
ggucgccagcauucccgccag

SEQ ID NO: 3849627 - RNA, 22 nt, Shigella flexneri 2a str. 2457T
ggucgccccggaacgggagaaa

SEQ ID NO: 3849628 - RNA, 13 nt, Shigella flexneri 2a str. 2457T
ggucgcggguucg

SEQ ID NO: 3849629 - RNA, 23 nt, Shigella flexneri 2a str. 2457T
ggucgcucgcgccgcauccgaca

SEQ ID NO: 3849630 - RNA, 19 nt, Shigella flexneri 2a str. 2457T
ggucgcugacgccaugcca

SEQ ID NO: 3849631 - RNA, 15 nt, Shigella flexneri 2a str. 2457T
ggucgcuuuguggcg

SEQ ID NO: 3849632 - RNA, 23 nt, Shigella flexneri 2a str. 2457T
ggucggauaaggcgcucgcgccg

SEQ ID NO: 3849633 - RNA, 15 nt, Shigella flexneri 2a str. 2457T
ggucggcaaacugcu

SEQ ID NO: 3849634 - RNA, 17 nt, Shigella flexneri 2a str. 2457T
ggucggcuucccugcgg

SEQ ID NO: 3849635 - RNA, 21 nt, Shigella flexneri 2a str. 2457T
ggucgugcgguuucagcucac

SEQ ID NO: 3849636 - RNA, 15 nt, Shigella flexneri 2a str. 2457T
ggucuaucaucagca

SEQ ID NO: 3849637 - RNA, 14 nt, Shigella flexneri 2a str. 2457T
ggucugacgcugaa

SEQ ID NO: 3849638 - RNA, 22 nt, Shigella flexneri 2a str. 2457T
ggucugauagcguagcgccuca

SEQ ID NO: 3849639 - RNA, 14 nt, Shigella flexneri 2a str. 2457T
ggucugauauggau

SEQ ID NO: 3849640 - RNA, 14 nt, Shigella flexneri 2a str. 2457T
ggucugccaacuuu

SEQ ID NO: 3849641 - RNA, 18 nt, Shigella flexneri 2a str. 2457T
ggucugcggaucauggua

SEQ ID NO: 3849642 - RNA, 15 nt, Shigella flexneri 2a str. 2457T
ggucuggaacuggcu

SEQ ID NO: 3849643 - RNA, 13 nt, Shigella flexneri 2a str. 2457T
ggucuggcgacgg

SEQ ID NO: 3849644 - RNA, 16 nt, Shigella flexneri 2a str. 2457T
ggucuggcgcaguggg

SEQ ID NO: 3849645 - RNA, 12 nt, Shigella flexneri 2a str. 2457T
ggugaaaaaaac

SEQ ID NO: 3849646 - RNA, 14 nt, Shigella flexneri 2a str. 2457T
ggugaaaaaauuaa

SEQ ID NO: 3849647 - RNA, 13 nt, Shigella flexneri 2a str. 2457T
ggugaaaaaccaa

SEQ ID NO: 3849648 - RNA, 19 nt, Shigella flexneri 2a str. 2457T
ggugaaaguaaaaaagaag

SEQ ID NO: 3849649 - RNA, 22 nt, Shigella flexneri 2a str. 2457T
ggugaaaguaacaaagccugca

SEQ ID NO: 3849650 - RNA, 23 nt, Shigella flexneri 2a str. 2457T
ggugaaaguaacaaagccugcac

SEQ ID NO: 3849651 - RNA, 18 nt, Shigella flexneri 2a str. 2457T
ggugaacaucgcagggaa

SEQ ID NO: 3849652 - RNA, 13 nt, Shigella flexneri 2a str. 2457T
ggugaaggcaaac

SEQ ID NO: 3849653 - RNA, 23 nt, Shigella flexneri 2a str. 2457T
ggugacagguuuaaacagagauu

SEQ ID NO: 3849654 - RNA, 18 nt, Shigella flexneri 2a str. 2457T
ggugaccgaucgcccgcc

SEQ ID NO: 3849655 - RNA, 18 nt, Shigella flexneri 2a str. 2457T
ggugaccuguaacguugc

SEQ ID NO: 3849656 - RNA, 19 nt, Shigella flexneri 2a str. 2457T
ggugacgcaaccgcaaaug

SEQ ID NO: 3849657 - RNA, 17 nt, Shigella flexneri 2a str. 2457T
ggugagcuaaugcaaau

SEQ ID NO: 3849658 - RNA, 16 nt, Shigella flexneri 2a str. 2457T
ggugauaaucauccca

SEQ ID NO: 3849659 - RNA, 19 nt, Shigella flexneri 2a str. 2457T
ggugauaccagaccauaca

SEQ ID NO: 3849660 - RNA, 17 nt, Shigella flexneri 2a str. 2457T
ggugaucaccaguaaca

SEQ ID NO: 3849661 - RNA, 17 nt, Shigella flexneri 2a str. 2457T
ggugaucacccagacgc

SEQ ID NO: 3849662 - RNA, 15 nt, Shigella flexneri 2a str. 2457T
ggugaucagccccgg

SEQ ID NO: 3849663 - RNA, 16 nt, Shigella flexneri 2a str. 2457T
ggugauuaaagaaaau

SEQ ID NO: 3849664 - RNA, 12 nt, Shigella flexneri 2a str. 2457T
ggugauuacauc

SEQ ID NO: 3849665 - RNA, 13 nt, Shigella flexneri 2a str. 2457T
ggugcaaaaaaac

SEQ ID NO: 3849666 - RNA, 17 nt, Shigella flexneri 2a str. 2457T
ggugcaacccgccaggu

SEQ ID NO: 3849667 - RNA, 22 nt, Shigella flexneri 2a str. 2457T
ggugcaagaaaugacagaguuc

SEQ ID NO: 3849668 - RNA, 20 nt, Shigella flexneri 2a str. 2457T
ggugcacaacaaucugcaaa

SEQ ID NO: 3849669 - RNA, 22 nt, Shigella flexneri 2a str. 2457T
ggugcagacaugacgcccggca

SEQ ID NO: 3849670 - RNA, 14 nt, Shigella flexneri 2a str. 2457T
ggugcagccggagc

SEQ ID NO: 3849671 - RNA, 20 nt, Shigella flexneri 2a str. 2457T
ggugccauugaccagcugcc

SEQ ID NO: 3849672 - RNA, 22 nt, Shigella flexneri 2a str. 2457T
ggugccgcagccccagagccug

SEQ ID NO: 3849673 - RNA, 18 nt, Shigella flexneri 2a str. 2457T
ggugcgaccaaacugcuc

SEQ ID NO: 3849674 - RNA, 18 nt, Shigella flexneri 2a str. 2457T
ggugcgaugccuggcaau

SEQ ID NO: 3849675 - RNA, 14 nt, Shigella flexneri 2a str. 2457T
ggugcggcaaaaac

SEQ ID NO: 3849676 - RNA, 19 nt, Shigella flexneri 2a str. 2457T
ggugcguaccaggcgugga

SEQ ID NO: 3849677 - RNA, 15 nt, Shigella flexneri 2a str. 2457T
ggugcguugaagaua

SEQ ID NO: 3849678 - RNA, 22 nt, Shigella flexneri 2a str. 2457T
ggugcucaucagcccggcaaug

SEQ ID NO: 3849679 - RNA, 18 nt, Shigella flexneri 2a str. 2457T
ggugcuuuaaaaaagaau

SEQ ID NO: 3849680 - RNA, 22 nt, Shigella flexneri 2a str. 2457T
ggugcuuuaacgaaagcgccuc

SEQ ID NO: 3849681 - RNA, 13 nt, Shigella flexneri 2a str. 2457T
ggugcuuuugcug

SEQ ID NO: 3849682 - RNA, 14 nt, Shigella flexneri 2a str. 2457T
gguggcaaagaaau

SEQ ID NO: 3849683 - RNA, 15 nt, Shigella flexneri 2a str. 2457T
gguggccauccgcgu

SEQ ID NO: 3849684 - RNA, 13 nt, Shigella flexneri 2a str. 2457T
gguggcgagagcc

SEQ ID NO: 3849685 - RNA, 22 nt, Shigella flexneri 2a str. 2457T
ggugguaaaaauugcccgccgu

SEQ ID NO: 3849686 - RNA, 22 nt, Shigella flexneri 2a str. 2457T
ggugguagugcccaauagggcu

SEQ ID NO: 3849687 - RNA, 18 nt, Shigella flexneri 2a str. 2457T
gguguaucuucagcugca

SEQ ID NO: 3849688 - RNA, 15 nt, Shigella flexneri 2a str. 2457T
ggugucacaugcagc

SEQ ID NO: 3849689 - RNA, 18 nt, Shigella flexneri 2a str. 2457T
ggugucacaugcagcgcc

SEQ ID NO: 3849690 - RNA, 15 nt, Shigella flexneri 2a str. 2457T
guaaacgcagcauca

SEQ ID NO: 3849691 - RNA, 14 nt, Shigella flexneri 2a str. 2457T
guaaacgccuaaua

SEQ ID NO: 3849692 - RNA, 20 nt, Shigella flexneri 2a str. 2457T
guaaacgccuuauccagccu

SEQ ID NO: 3849693 - RNA, 17 nt, Shigella flexneri 2a str. 2457T
guaaacgugcggcugug

SEQ ID NO: 3849694 - RNA, 21 nt, Shigella flexneri 2a str. 2457T
guaaagcccgccaucgcccau

SEQ ID NO: 3849695 - RNA, 13 nt, Shigella flexneri 2a str. 2457T
guaaagccgauua

SEQ ID NO: 3849696 - RNA, 18 nt, Shigella flexneri 2a str. 2457T
guaaagccugcuggcagu

SEQ ID NO: 3849697 - RNA, 19 nt, Shigella flexneri 2a str. 2457T
guaaagcgcgucaccaccu

SEQ ID NO: 3849698 - RNA, 18 nt, Shigella flexneri 2a str. 2457T
guaaaggcggcagaacag

SEQ ID NO: 3849699 - RNA, 19 nt, Shigella flexneri 2a str. 2457T
guaaaggcggcagaacaga

SEQ ID NO: 3849700 - RNA, 17 nt, Shigella flexneri 2a str. 2457T
guaaagggcugccggaa

SEQ ID NO: 3849701 - RNA, 22 nt, Shigella flexneri 2a str. 2457T
guaaagugcgagucgucaguuc

SEQ ID NO: 3849702 - RNA, 23 nt, Shigella flexneri 2a str. 2457T
guaaaguuaccuucgaagaacuc

SEQ ID NO: 3849703 - RNA, 13 nt, Shigella flexneri 2a str. 2457T
guaaauaauaucc

SEQ ID NO: 3849704 - RNA, 18 nt, Shigella flexneri 2a str. 2457T
guaaauacgccccacaga

SEQ ID NO: 3849705 - RNA, 15 nt, Shigella flexneri 2a str. 2457T
guaaauaucggcauu

SEQ ID NO: 3849706 - RNA, 12 nt, Shigella flexneri 2a str. 2457T
guaaaucaccag

SEQ ID NO: 3849707 - RNA, 20 nt, Shigella flexneri 2a str. 2457T
guaaaucccagugccugcau

SEQ ID NO: 3849708 - RNA, 12 nt, Shigella flexneri 2a str. 2457T
guaaaucgccau

SEQ ID NO: 3849709 - RNA, 20 nt, Shigella flexneri 2a str. 2457T
guaaaucugucagguaacaa

SEQ ID NO: 3849710 - RNA, 13 nt, Shigella flexneri 2a str. 2457T
guaaaugaacuca

SEQ ID NO: 3849711 - RNA, 15 nt, Shigella flexneri 2a str. 2457T
guaaauucaauaaau

SEQ ID NO: 3849712 - RNA, 21 nt, Shigella flexneri 2a str. 2457T
guaaauucucgcuaauuuauu

SEQ ID NO: 3849713 - RNA, 19 nt, Shigella flexneri 2a str. 2457T
guaaauugaugugaaaacu

SEQ ID NO: 3849714 - RNA, 17 nt, Shigella flexneri 2a str. 2457T
guaaauugcaaaccuca

SEQ ID NO: 3849715 - RNA, 22 nt, Shigella flexneri 2a str. 2457T
guaaauugcaaaccucaggaau

SEQ ID NO: 3849716 - RNA, 15 nt, Shigella flexneri 2a str. 2457T
guaaauugccccaga

SEQ ID NO: 3849717 - RNA, 13 nt, Shigella flexneri 2a str. 2457T
guaacaaaacuca

SEQ ID NO: 3849718 - RNA, 16 nt, Shigella flexneri 2a str. 2457T
guaacaaagccugcac

SEQ ID NO: 3849719 - RNA, 17 nt, Shigella flexneri 2a str. 2457T
guaacaaaugugccauu

SEQ ID NO: 3849720 - RNA, 15 nt, Shigella flexneri 2a str. 2457T
guaacagcggacggc

SEQ ID NO: 3849721 - RNA, 16 nt, Shigella flexneri 2a str. 2457T
guaacagucaguuauc

SEQ ID NO: 3849722 - RNA, 22 nt, Shigella flexneri 2a str. 2457T
guaacagugcaccggacacugc

SEQ ID NO: 3849723 - RNA, 22 nt, Shigella flexneri 2a str. 2457T
guaacauccagaucacgcagca

SEQ ID NO: 3849724 - RNA, 14 nt, Shigella flexneri 2a str. 2457T
guaacaucccugua

SEQ ID NO: 3849725 - RNA, 22 nt, Shigella flexneri 2a str. 2457T
guaaccaaacguggucgccagc

SEQ ID NO: 3849726 - RNA, 13 nt, Shigella flexneri 2a str. 2457T
guaaccacgcagc

SEQ ID NO: 3849727 - RNA, 14 nt, Shigella flexneri 2a str. 2457T
guaaccacgcagcg

SEQ ID NO: 3849728 - RNA, 17 nt, Shigella flexneri 2a str. 2457T
guaaccacgcagcguug

SEQ ID NO: 3849729 - RNA, 18 nt, Shigella flexneri 2a str. 2457T
guaacccccaaauaaccc

SEQ ID NO: 3849730 - RNA, 22 nt, Shigella flexneri 2a str. 2457T
guaaccuuuaucgcgcagcaga

SEQ ID NO: 3849731 - RNA, 17 nt, Shigella flexneri 2a str. 2457T
guaacgacugacuuucg

SEQ ID NO: 3849732 - RNA, 13 nt, Shigella flexneri 2a str. 2457T
guaacgaucgccu

SEQ ID NO: 3849733 - RNA, 16 nt, Shigella flexneri 2a str. 2457T
guaacgaugcaugaca

SEQ ID NO: 3849734 - RNA, 19 nt, Shigella flexneri 2a str. 2457T
guaacgauggcaauuuuca

SEQ ID NO: 3849735 - RNA, 15 nt, Shigella flexneri 2a str. 2457T
guaacgcacacaucc

SEQ ID NO: 3849736 - RNA, 22 nt, Shigella flexneri 2a str. 2457T
guaacgcacacauccacaaugc

SEQ ID NO: 3849737 - RNA, 20 nt, Shigella flexneri 2a str. 2457T
guaacgccuuuuccagcgcg

SEQ ID NO: 3849738 - RNA, 14 nt, Shigella flexneri 2a str. 2457T
guaacggcagauga

SEQ ID NO: 3849739 - RNA, 21 nt, Shigella flexneri 2a str. 2457T
guaacguagcgggaagugaaa

SEQ ID NO: 3849740 - RNA, 18 nt, Shigella flexneri 2a str. 2457T
guaacucacugaugccgu

SEQ ID NO: 3849741 - RNA, 15 nt, Shigella flexneri 2a str. 2457T
guaacucauugccag

SEQ ID NO: 3849742 - RNA, 22 nt, Shigella flexneri 2a str. 2457T
guaacugcugcucaaucugcgc

SEQ ID NO: 3849743 - RNA, 17 nt, Shigella flexneri 2a str. 2457T
guaacugucuucaccau

SEQ ID NO: 3849744 - RNA, 21 nt, Shigella flexneri 2a str. 2457T
guaacugucuucaccauaguu

SEQ ID NO: 3849745 - RNA, 18 nt, Shigella flexneri 2a str. 2457T
guaagaaaguggcaggcu

SEQ ID NO: 3849746 - RNA, 14 nt, Shigella flexneri 2a str. 2457T
guaagaacguaaau

SEQ ID NO: 3849747 - RNA, 16 nt, Shigella flexneri 2a str. 2457T
guaagagaacagauag

SEQ ID NO: 3849748 - RNA, 15 nt, Shigella flexneri 2a str. 2457T
guaagcaaaggugcc

SEQ ID NO: 3849749 - RNA, 18 nt, Shigella flexneri 2a str. 2457T
guaagcacucugacggau

SEQ ID NO: 3849750 - RNA, 20 nt, Shigella flexneri 2a str. 2457T
guaagcgcguguuacuggaa

SEQ ID NO: 3849751 - RNA, 15 nt, Shigella flexneri 2a str. 2457T
guaagcguacagcga

SEQ ID NO: 3849752 - RNA, 22 nt, Shigella flexneri 2a str. 2457T
guaagcugugcgauagcaacga

SEQ ID NO: 3849753 - RNA, 14 nt, Shigella flexneri 2a str. 2457T
guaaggcaucuucu

SEQ ID NO: 3849754 - RNA, 15 nt, Shigella flexneri 2a str. 2457T
guaaggccgaauacc

SEQ ID NO: 3849755 - RNA, 16 nt, Shigella flexneri 2a str. 2457T
guaaggcuucaaucaa

SEQ ID NO: 3849756 - RNA, 17 nt, Shigella flexneri 2a str. 2457T
guaagguugucgauacc

SEQ ID NO: 3849757 - RNA, 12 nt, Shigella flexneri 2a str. 2457T
guaaguaaugac

SEQ ID NO: 3849758 - RNA, 13 nt, Shigella flexneri 2a str. 2457T
guaaguggaugcc

SEQ ID NO: 3849759 - RNA, 21 nt, Shigella flexneri 2a str. 2457T
guaaguuacauuuuaauaaug

SEQ ID NO: 3849760 - RNA, 16 nt, Shigella flexneri 2a str. 2457T
guaauaaaaucuauua

SEQ ID NO: 3849761 - RNA, 21 nt, Shigella flexneri 2a str. 2457T
guaauaauuacuuacaucugu

SEQ ID NO: 3849762 - RNA, 18 nt, Shigella flexneri 2a str. 2457T
guaauacaaccugcugga

SEQ ID NO: 3849763 - RNA, 17 nt, Shigella flexneri 2a str. 2457T
guaauaccagccuucuu

SEQ ID NO: 3849764 - RNA, 22 nt, Shigella flexneri 2a str. 2457T
guaauaugugcgccacgcagcg

SEQ ID NO: 3849765 - RNA, 22 nt, Shigella flexneri 2a str. 2457T
guaauauuucucggcaaauuca

SEQ ID NO: 3849766 - RNA, 17 nt, Shigella flexneri 2a str. 2457T
guaaucaacauauuccc

SEQ ID NO: 3849767 - RNA, 18 nt, Shigella flexneri 2a str. 2457T
guaaucaacuccgccagc

SEQ ID NO: 3849768 - RNA, 20 nt, Shigella flexneri 2a str. 2457T
guaaucaacuccgccagcaa

SEQ ID NO: 3849769 - RNA, 18 nt, Shigella flexneri 2a str. 2457T
guaaucaaugcguucucc

SEQ ID NO: 3849770 - RNA, 16 nt, Shigella flexneri 2a str. 2457T
guaaucauauugcucu

SEQ ID NO: 3849771 - RNA, 17 nt, Shigella flexneri 2a str. 2457T
guaaucaucuauccggc

SEQ ID NO: 3849772 - RNA, 15 nt, Shigella flexneri 2a str. 2457T
guaaucgacaacgca

SEQ ID NO: 3849773 - RNA, 22 nt, Shigella flexneri 2a str. 2457T
guaaucgcccgcuuccagcgca

SEQ ID NO: 3849774 - RNA, 15 nt, Shigella flexneri 2a str. 2457T
guaaugacuccaacu

SEQ ID NO: 3849775 - RNA, 19 nt, Shigella flexneri 2a str. 2457T
guaaugacuccaacuuacu

SEQ ID NO: 3849776 - RNA, 22 nt, Shigella flexneri 2a str. 2457T
guaaugcgguauccaacccgcg

SEQ ID NO: 3849777 - RNA, 15 nt, Shigella flexneri 2a str. 2457T
guaaugggaucgaaa

SEQ ID NO: 3849778 - RNA, 21 nt, Shigella flexneri 2a str. 2457T
guaaugucggugaaaguaacu

SEQ ID NO: 3849779 - RNA, 19 nt, Shigella flexneri 2a str. 2457T
guaauguuuagagacgcau

SEQ ID NO: 3849780 - RNA, 15 nt, Shigella flexneri 2a str. 2457T
guaauuaacauucau

SEQ ID NO: 3849781 - RNA, 14 nt, Shigella flexneri 2a str. 2457T
guaauuaagcccgg

SEQ ID NO: 3849782 - RNA, 22 nt, Shigella flexneri 2a str. 2457T
guaauuaagcgcaaaggccagc

SEQ ID NO: 3849783 - RNA, 17 nt, Shigella flexneri 2a str. 2457T
guaauuaguggcuaacc

SEQ ID NO: 3849784 - RNA, 19 nt, Shigella flexneri 2a str. 2457T
guaauugcuuuuaccauac

SEQ ID NO: 3849785 - RNA, 20 nt, Shigella flexneri 2a str. 2457T
guaauugcuuuuaccauacu

SEQ ID NO: 3849786 - RNA, 22 nt, Shigella flexneri 2a str. 2457T
guaauugcuuuuaccauacugg

SEQ ID NO: 3849787 - RNA, 22 nt, Shigella flexneri 2a str. 2457T
guagcgaugacagucuggaagc

SEQ ID NO: 3849788 - RNA, 16 nt, Shigella flexneri 2a str. 2457T
guagcggcucggaaua

SEQ ID NO: 3849789 - RNA, 17 nt, Shigella flexneri 2a str. 2457T
guagcguuaccagcaaa

SEQ ID NO: 3849790 - RNA, 19 nt, Shigella flexneri 2a str. 2457T
guagcuacgcaucaacugc

SEQ ID NO: 3849791 - RNA, 22 nt, Shigella flexneri 2a str. 2457T
guagcuacgcaucaacugcguu

SEQ ID NO: 3849792 - RNA, 14 nt, Shigella flexneri 2a str. 2457T
guagcucagcugga

SEQ ID NO: 3849793 - RNA, 23 nt, Shigella flexneri 2a str. 2457T
guagcugaaaaucagauccgcac

SEQ ID NO: 3849794 - RNA, 20 nt, Shigella flexneri 2a str. 2457T
guagcuggcggcaaugaaag

SEQ ID NO: 3849795 - RNA, 22 nt, Shigella flexneri 2a str. 2457T
guagcugguaccuugaaacgau

SEQ ID NO: 3849796 - RNA, 15 nt, Shigella flexneri 2a str. 2457T
guagcuuucaacgcu

SEQ ID NO: 3849797 - RNA, 20 nt, Shigella flexneri 2a str. 2457T
guaggccagauaagacgcgu

SEQ ID NO: 3849798 - RNA, 20 nt, Shigella flexneri 2a str. 2457T
guaggccagauaauacgcgu

SEQ ID NO: 3849799 - RNA, 14 nt, Shigella flexneri 2a str. 2457T
guaggccugauaag

SEQ ID NO: 3849800 - RNA, 20 nt, Shigella flexneri 2a str. 2457T
guaggccugauaagacgcga

SEQ ID NO: 3849801 - RNA, 20 nt, Shigella flexneri 2a str. 2457T
guaggccugauaagacgcgg

SEQ ID NO: 3849802 - RNA, 20 nt, Shigella flexneri 2a str. 2457T
guaggccugauaagcguagc

SEQ ID NO: 3849803 - RNA, 18 nt, Shigella flexneri 2a str. 2457T
guaggcuggauaaggcgu

SEQ ID NO: 3849804 - RNA, 16 nt, Shigella flexneri 2a str. 2457T
guaguauagaaagaua

SEQ ID NO: 3849805 - RNA, 15 nt, Shigella flexneri 2a str. 2457T
guaguauccacacca

SEQ ID NO: 3849806 - RNA, 22 nt, Shigella flexneri 2a str. 2457T
guaguauccgugccgagguggu

SEQ ID NO: 3849807 - RNA, 16 nt, Shigella flexneri 2a str. 2457T
guaguauuugaguuca

SEQ ID NO: 3849808 - RNA, 15 nt, Shigella flexneri 2a str. 2457T
guagugcccgcagua

SEQ ID NO: 3849809 - RNA, 14 nt, Shigella flexneri 2a str. 2457T
guaguuccagcaug

SEQ ID NO: 3849810 - RNA, 14 nt, Shigella flexneri 2a str. 2457T
guaguugaucgccc

SEQ ID NO: 3849811 - RNA, 14 nt, Shigella flexneri 2a str. 2457T
guaguugcugucga

SEQ ID NO: 3849812 - RNA, 17 nt, Shigella flexneri 2a str. 2457T
guaguuuggcuucgugu

SEQ ID NO: 3849813 - RNA, 15 nt, Shigella flexneri 2a str. 2457T
guauaacgcaaaaau

SEQ ID NO: 3849814 - RNA, 16 nt, Shigella flexneri 2a str. 2457T
guauaaguccauaacu

SEQ ID NO: 3849815 - RNA, 14 nt, Shigella flexneri 2a str. 2457T
guauaccauuucug

SEQ ID NO: 3849816 - RNA, 18 nt, Shigella flexneri 2a str. 2457T
guauaccgaaaucgccau

SEQ ID NO: 3849817 - RNA, 13 nt, Shigella flexneri 2a str. 2457T
guauacgcuggcg

SEQ ID NO: 3849818 - RNA, 23 nt, Shigella flexneri 2a str. 2457T
guauacgucccggugaagcgccc

SEQ ID NO: 3849819 - RNA, 21 nt, Shigella flexneri 2a str. 2457T
guaucaaacacaggcaaaaca

SEQ ID NO: 3849820 - RNA, 11 nt, Shigella flexneri 2a str. 2457T
guaucaaagcg

SEQ ID NO: 3849821 - RNA, 22 nt, Shigella flexneri 2a str. 2457T
guaucaacaauaaaaccaguaa

SEQ ID NO: 3849822 - RNA, 22 nt, Shigella flexneri 2a str. 2457T
guaucaucauuauuaauauuca

SEQ ID NO: 3849823 - RNA, 18 nt, Shigella flexneri 2a str. 2457T
guauccugucauacgcgu

SEQ ID NO: 3849824 - RNA, 14 nt, Shigella flexneri 2a str. 2457T
guauccuguuuuua

SEQ ID NO: 3849825 - RNA, 15 nt, Shigella flexneri 2a str. 2457T
guauccuguuuuuaa

SEQ ID NO: 3849826 - RNA, 15 nt, Shigella flexneri 2a str. 2457T
guaucgcugaaagau

SEQ ID NO: 3849827 - RNA, 16 nt, Shigella flexneri 2a str. 2457T
guaucgggcaguuuac

SEQ ID NO: 3849828 - RNA, 12 nt, Shigella flexneri 2a str. 2457T
guaucugcagau

SEQ ID NO: 3849829 - RNA, 16 nt, Shigella flexneri 2a str. 2457T
guaucuggcaagcagg

SEQ ID NO: 3849830 - RNA, 19 nt, Shigella flexneri 2a str. 2457T
guaucuggugucagcguga

SEQ ID NO: 3849831 - RNA, 19 nt, Shigella flexneri 2a str. 2457T
guaucuucccagccaaugc

SEQ ID NO: 3849832 - RNA, 14 nt, Shigella flexneri 2a str. 2457T
guaugccucuuuca

SEQ ID NO: 3849833 - RNA, 14 nt, Shigella flexneri 2a str. 2457T
guaugccuggcauu

SEQ ID NO: 3849834 - RNA, 20 nt, Shigella flexneri 2a str. 2457T
guaugcgccacaggucagca

SEQ ID NO: 3849835 - RNA, 23 nt, Shigella flexneri 2a str. 2457T
guaugcuuccuaacauaaugcaa

SEQ ID NO: 3849836 - RNA, 15 nt, Shigella flexneri 2a str. 2457T
guauggaaaucaccc

SEQ ID NO: 3849837 - RNA, 16 nt, Shigella flexneri 2a str. 2457T
guauggaaaucaccca

SEQ ID NO: 3849838 - RNA, 18 nt, Shigella flexneri 2a str. 2457T
guauggaucccucuuucu

SEQ ID NO: 3849839 - RNA, 16 nt, Shigella flexneri 2a str. 2457T
guaugucgaucaccca

SEQ ID NO: 3849840 - RNA, 23 nt, Shigella flexneri 2a str. 2457T
guauuaaucugccagcguaaauc

SEQ ID NO: 3849841 - RNA, 16 nt, Shigella flexneri 2a str. 2457T
guauuacaacgugcuc

SEQ ID NO: 3849842 - RNA, 14 nt, Shigella flexneri 2a str. 2457T
guauucaaccguuu

SEQ ID NO: 3849843 - RNA, 22 nt, Shigella flexneri 2a str. 2457T
guauucacuuucaaauccggcc

SEQ ID NO: 3849844 - RNA, 15 nt, Shigella flexneri 2a str. 2457T
guauucuucagcgac

SEQ ID NO: 3849845 - RNA, 17 nt, Shigella flexneri 2a str. 2457T
guauugccaugcacgca

SEQ ID NO: 3849846 - RNA, 21 nt, Shigella flexneri 2a str. 2457T
guauugcucaacuucgcuaaa

SEQ ID NO: 3849847 - RNA, 22 nt, Shigella flexneri 2a str. 2457T
guauuggaagguuaauaaauau

SEQ ID NO: 3849848 - RNA, 14 nt, Shigella flexneri 2a str. 2457T
guauuguccugcaa

SEQ ID NO: 3849849 - RNA, 12 nt, Shigella flexneri 2a str. 2457T
guauuuccaggg

SEQ ID NO: 3849850 - RNA, 13 nt, Shigella flexneri 2a str. 2457T
guauuuccagggc

SEQ ID NO: 3849851 - RNA, 13 nt, Shigella flexneri 2a str. 2457T
guauuuuuugcuc

SEQ ID NO: 3849852 - RNA, 12 nt, Shigella flexneri 2a str. 2457T
gucaaaaaaacg

SEQ ID NO: 3849853 - RNA, 21 nt, Shigella flexneri 2a str. 2457T
gucaaaagauugaauuauuca

SEQ ID NO: 3849854 - RNA, 16 nt, Shigella flexneri 2a str. 2457T
gucaaaaucaaaauaa

SEQ ID NO: 3849855 - RNA, 17 nt, Shigella flexneri 2a str. 2457T
gucaaaaucauccgucg

SEQ ID NO: 3849856 - RNA, 16 nt, Shigella flexneri 2a str. 2457T
gucaacagggcagaca

SEQ ID NO: 3849857 - RNA, 17 nt, Shigella flexneri 2a str. 2457T
gucaacaguucaugguu

SEQ ID NO: 3849858 - RNA, 13 nt, Shigella flexneri 2a str. 2457T
gucaacuccaguu

SEQ ID NO: 3849859 - RNA, 21 nt, Shigella flexneri 2a str. 2457T
gucaacugcgccacucgauac

SEQ ID NO: 3849860 - RNA, 20 nt, Shigella flexneri 2a str. 2457T
gucaacuguacgccgacgcc

SEQ ID NO: 3849861 - RNA, 19 nt, Shigella flexneri 2a str. 2457T
gucaagggugucggcacac

SEQ ID NO: 3849862 - RNA, 14 nt, Shigella flexneri 2a str. 2457T
gucaauaaacgccu

SEQ ID NO: 3849863 - RNA, 21 nt, Shigella flexneri 2a str. 2457T
gucaauauucuggguagucca

SEQ ID NO: 3849864 - RNA, 15 nt, Shigella flexneri 2a str. 2457T
gucaaucauccauau

SEQ ID NO: 3849865 - RNA, 12 nt, Shigella flexneri 2a str. 2457T
gucaaucugcuc

SEQ ID NO: 3849866 - RNA, 15 nt, Shigella flexneri 2a str. 2457T
gucaaugauuucugc

SEQ ID NO: 3849867 - RNA, 17 nt, Shigella flexneri 2a str. 2457T
gucaauuccuucugggc

SEQ ID NO: 3849868 - RNA, 16 nt, Shigella flexneri 2a str. 2457T
gucacagccgcaggcc

SEQ ID NO: 3849869 - RNA, 16 nt, Shigella flexneri 2a str. 2457T
gucacaucaggccauc

SEQ ID NO: 3849870 - RNA, 17 nt, Shigella flexneri 2a str. 2457T
gucacaugcagcgccug

SEQ ID NO: 3849871 - RNA, 15 nt, Shigella flexneri 2a str. 2457T
gucaccacccugccc

SEQ ID NO: 3849872 - RNA, 22 nt, Shigella flexneri 2a str. 2457T
gucaccacggccagguuaacca

SEQ ID NO: 3849873 - RNA, 15 nt, Shigella flexneri 2a str. 2457T
gucaccacuucaccc

SEQ ID NO: 3849874 - RNA, 17 nt, Shigella flexneri 2a str. 2457T
gucaccagcaucaacaa

SEQ ID NO: 3849875 - RNA, 17 nt, Shigella flexneri 2a str. 2457T
gucaccgccgauaccga

SEQ ID NO: 3849876 - RNA, 16 nt, Shigella flexneri 2a str. 2457T
gucaccggaauaauga

SEQ ID NO: 3849877 - RNA, 16 nt, Shigella flexneri 2a str. 2457T
gucacgccaauaaucg

SEQ ID NO: 3849878 - RNA, 20 nt, Shigella flexneri 2a str. 2457T
gucacggcgacggcuggcaa

SEQ ID NO: 3849879 - RNA, 19 nt, Shigella flexneri 2a str. 2457T
gucacggugcagcucgcaa

SEQ ID NO: 3849880 - RNA, 21 nt, Shigella flexneri 2a str. 2457T
gucacguagcggcggcagauu

SEQ ID NO: 3849881 - RNA, 17 nt, Shigella flexneri 2a str. 2457T
gucacucgacagcaccg

SEQ ID NO: 3849882 - RNA, 13 nt, Shigella flexneri 2a str. 2457T
gucacugauagug

SEQ ID NO: 3849883 - RNA, 16 nt, Shigella flexneri 2a str. 2457T
gucacugcaucuuccg

SEQ ID NO: 3849884 - RNA, 23 nt, Shigella flexneri 2a str. 2457T
gucacuggugugucaucugcgac

SEQ ID NO: 3849885 - RNA, 21 nt, Shigella flexneri 2a str. 2457T
gucccggaacaggcagggcca

SEQ ID NO: 3849886 - RNA, 22 nt, Shigella flexneri 2a str. 2457T
gucccggcaagauuccagugcc

SEQ ID NO: 3849887 - RNA, 14 nt, Shigella flexneri 2a str. 2457T
gucccguacccagc

SEQ ID NO: 3849888 - RNA, 15 nt, Shigella flexneri 2a str. 2457T
gucccguacccagca

SEQ ID NO: 3849889 - RNA, 14 nt, Shigella flexneri 2a str. 2457T
gucccguccuucau

SEQ ID NO: 3849890 - RNA, 17 nt, Shigella flexneri 2a str. 2457T
gucccugccgcggucug

SEQ ID NO: 3849891 - RNA, 14 nt, Shigella flexneri 2a str. 2457T
guccgccauggcuu

SEQ ID NO: 3849892 - RNA, 14 nt, Shigella flexneri 2a str. 2457T
guccgccguagccg

SEQ ID NO: 3849893 - RNA, 20 nt, Shigella flexneri 2a str. 2457T
guccgcgaacagcagcgguu

SEQ ID NO: 3849894 - RNA, 15 nt, Shigella flexneri 2a str. 2457T
guccgcguccagcuu

SEQ ID NO: 3849895 - RNA, 21 nt, Shigella flexneri 2a str. 2457T
guccgcuuuaagcuuuaucgg

SEQ ID NO: 3849896 - RNA, 14 nt, Shigella flexneri 2a str. 2457T
guccggcgcugcaa

SEQ ID NO: 3849897 - RNA, 15 nt, Shigella flexneri 2a str. 2457T
guccgguuuacuucc

SEQ ID NO: 3849898 - RNA, 22 nt, Shigella flexneri 2a str. 2457T
guccguacccgguugacugcug

SEQ ID NO: 3849899 - RNA, 20 nt, Shigella flexneri 2a str. 2457T
guccuaacaaccauccccaa

SEQ ID NO: 3849900 - RNA, 17 nt, Shigella flexneri 2a str. 2457T
guccuacacacgccagu

SEQ ID NO: 3849901 - RNA, 12 nt, Shigella flexneri 2a str. 2457T
guccuccagcuc

SEQ ID NO: 3849902 - RNA, 17 nt, Shigella flexneri 2a str. 2457T
guccucgccguuuucug

SEQ ID NO: 3849903 - RNA, 15 nt, Shigella flexneri 2a str. 2457T
guccucuucccagac

SEQ ID NO: 3849904 - RNA, 15 nt, Shigella flexneri 2a str. 2457T
guccugcguuucuuc

SEQ ID NO: 3849905 - RNA, 22 nt, Shigella flexneri 2a str. 2457T
guccugcucaaacuucgucaca

SEQ ID NO: 3849906 - RNA, 16 nt, Shigella flexneri 2a str. 2457T
guccuguaaugagaau

SEQ ID NO: 3849907 - RNA, 21 nt, Shigella flexneri 2a str. 2457T
guccuguaaugagaauaauca

SEQ ID NO: 3849908 - RNA, 13 nt, Shigella flexneri 2a str. 2457T
guccuucaggccc

SEQ ID NO: 3849909 - RNA, 12 nt, Shigella flexneri 2a str. 2457T
guccuuccaggu

SEQ ID NO: 3849910 - RNA, 14 nt, Shigella flexneri 2a str. 2457T
guccuucuaccagc

SEQ ID NO: 3849911 - RNA, 11 nt, Shigella flexneri 2a str. 2457T
gucgaaauaau

SEQ ID NO: 3849912 - RNA, 16 nt, Shigella flexneri 2a str. 2457T
gucgaacgcuaugacg

SEQ ID NO: 3849913 - RNA, 20 nt, Shigella flexneri 2a str. 2457T
gucgaagaaaacauggcgug

SEQ ID NO: 3849914 - RNA, 18 nt, Shigella flexneri 2a str. 2457T
gucgaaugcgcaaccgua

SEQ ID NO: 3849915 - RNA, 18 nt, Shigella flexneri 2a str. 2457T
gucgaauggcaucuacgc

SEQ ID NO: 3849916 - RNA, 12 nt, Shigella flexneri 2a str. 2457T
gucgacacagau

SEQ ID NO: 3849917 - RNA, 13 nt, Shigella flexneri 2a str. 2457T
gucgacagcagcc

SEQ ID NO: 3849918 - RNA, 16 nt, Shigella flexneri 2a str. 2457T
gucgagaauaucgaua

SEQ ID NO: 3849919 - RNA, 21 nt, Shigella flexneri 2a str. 2457T
gucgagauacacggugcucca

SEQ ID NO: 3849920 - RNA, 11 nt, Shigella flexneri 2a str. 2457T
gucgagaucgc

SEQ ID NO: 3849921 - RNA, 16 nt, Shigella flexneri 2a str. 2457T
gucgagcagagaaacg

SEQ ID NO: 3849922 - RNA, 14 nt, Shigella flexneri 2a str. 2457T
gucgaggcaaccag

SEQ ID NO: 3849923 - RNA, 15 nt, Shigella flexneri 2a str. 2457T
gucgaggcaaccagc

SEQ ID NO: 3849924 - RNA, 17 nt, Shigella flexneri 2a str. 2457T
gucgauaucgauaauca

SEQ ID NO: 3849925 - RNA, 17 nt, Shigella flexneri 2a str. 2457T
gucgaugaaagcgccau

SEQ ID NO: 3849926 - RNA, 22 nt, Shigella flexneri 2a str. 2457T
gucgaugaugcagccagugauu

SEQ ID NO: 3849927 - RNA, 14 nt, Shigella flexneri 2a str. 2457T
gucgaugcgcuggc

SEQ ID NO: 3849928 - RNA, 14 nt, Shigella flexneri 2a str. 2457T
gucgauuucugggu

SEQ ID NO: 3849929 - RNA, 16 nt, Shigella flexneri 2a str. 2457T
gucgcaaauccgcugu

SEQ ID NO: 3849930 - RNA, 22 nt, Shigella flexneri 2a str. 2457T
gucgcaagacgaaaaaugaaua

SEQ ID NO: 3849931 - RNA, 23 nt, Shigella flexneri 2a str. 2457T
gucgcacacaacagacauuaccc

SEQ ID NO: 3849932 - RNA, 21 nt, Shigella flexneri 2a str. 2457T
gucgcacugcugauuuggaaa

SEQ ID NO: 3849933 - RNA, 13 nt, Shigella flexneri 2a str. 2457T
gucgcagccagcg

SEQ ID NO: 3849934 - RNA, 18 nt, Shigella flexneri 2a str. 2457T
gucgcaucaggcaucaug

SEQ ID NO: 3849935 - RNA, 15 nt, Shigella flexneri 2a str. 2457T
gucgccaaguucgaa

SEQ ID NO: 3849936 - RNA, 16 nt, Shigella flexneri 2a str. 2457T
gucgccagucccuuuc

SEQ ID NO: 3849937 - RNA, 14 nt, Shigella flexneri 2a str. 2457T
gucgccaucaaagg

SEQ ID NO: 3849938 - RNA, 21 nt, Shigella flexneri 2a str. 2457T
gucgcccccgcgccagcgggc

SEQ ID NO: 3849939 - RNA, 18 nt, Shigella flexneri 2a str. 2457T
gucgccccggaacgggag

SEQ ID NO: 3849940 - RNA, 22 nt, Shigella flexneri 2a str. 2457T
gucgccccggaacgggagaaac

SEQ ID NO: 3849941 - RNA, 20 nt, Shigella flexneri 2a str. 2457T
gucgcccgaccaucgccagc

SEQ ID NO: 3849942 - RNA, 23 nt, Shigella flexneri 2a str. 2457T
gucgcccgaccaucgccagcuca

SEQ ID NO: 3849943 - RNA, 21 nt, Shigella flexneri 2a str. 2457T
gucgccgauaauuuucagcgu

SEQ ID NO: 3849944 - RNA, 13 nt, Shigella flexneri 2a str. 2457T
gucgccgccuguu

SEQ ID NO: 3849945 - RNA, 20 nt, Shigella flexneri 2a str. 2457T
gucgccgcgauaaggucaga

SEQ ID NO: 3849946 - RNA, 17 nt, Shigella flexneri 2a str. 2457T
gucgccgcgcaaaucca

SEQ ID NO: 3849947 - RNA, 15 nt, Shigella flexneri 2a str. 2457T
gucgccgcugguggu

SEQ ID NO: 3849948 - RNA, 19 nt, Shigella flexneri 2a str. 2457T
gucgccgggaugcuggggc

SEQ ID NO: 3849949 - RNA, 14 nt, Shigella flexneri 2a str. 2457T
gucgccguaccggg

SEQ ID NO: 3849950 - RNA, 13 nt, Shigella flexneri 2a str. 2457T
gucgcgcagcacu

SEQ ID NO: 3849951 - RNA, 15 nt, Shigella flexneri 2a str. 2457T
gucgcgcccuccugc

SEQ ID NO: 3849952 - RNA, 19 nt, Shigella flexneri 2a str. 2457T
gucgcggaccaacaaaaau

SEQ ID NO: 3849953 - RNA, 18 nt, Shigella flexneri 2a str. 2457T
gucgcuaggaaggcaaga

SEQ ID NO: 3849954 - RNA, 12 nt, Shigella flexneri 2a str. 2457T
gucgcugacgca

SEQ ID NO: 3849955 - RNA, 17 nt, Shigella flexneri 2a str. 2457T
gucgcugacgcacuguu

SEQ ID NO: 3849956 - RNA, 21 nt, Shigella flexneri 2a str. 2457T
gucgcugguugcaugaugacu

SEQ ID NO: 3849957 - RNA, 16 nt, Shigella flexneri 2a str. 2457T
gucgcugucuuccugg

SEQ ID NO: 3849958 - RNA, 22 nt, Shigella flexneri 2a str. 2457T
gucgcuucgcgaaucgccacaa

SEQ ID NO: 3849959 - RNA, 20 nt, Shigella flexneri 2a str. 2457T
gucgcuugcaggaucagcuc

SEQ ID NO: 3849960 - RNA, 16 nt, Shigella flexneri 2a str. 2457T
gucggaaccacaacuc

SEQ ID NO: 3849961 - RNA, 18 nt, Shigella flexneri 2a str. 2457T
gucggaaccacaacucaa

SEQ ID NO: 3849962 - RNA, 12 nt, Shigella flexneri 2a str. 2457T
gucggaccauca

SEQ ID NO: 3849963 - RNA, 13 nt, Shigella flexneri 2a str. 2457T
gucggacggaauu

SEQ ID NO: 3849964 - RNA, 19 nt, Shigella flexneri 2a str. 2457T
gucggcacacacaucacgg

SEQ ID NO: 3849965 - RNA, 15 nt, Shigella flexneri 2a str. 2457T
gucggcagagaguug

SEQ ID NO: 3849966 - RNA, 13 nt, Shigella flexneri 2a str. 2457T
gucggcagauaac

SEQ ID NO: 3849967 - RNA, 15 nt, Shigella flexneri 2a str. 2457T
gucggcagauaacac

SEQ ID NO: 3849968 - RNA, 13 nt, Shigella flexneri 2a str. 2457T
gucggcaguucgu

SEQ ID NO: 3849969 - RNA, 16 nt, Shigella flexneri 2a str. 2457T
gucggcgcugaaauuc

SEQ ID NO: 3849970 - RNA, 17 nt, Shigella flexneri 2a str. 2457T
gucgggaucaucgccca

SEQ ID NO: 3849971 - RNA, 18 nt, Shigella flexneri 2a str. 2457T
gucggggccagcauucca

SEQ ID NO: 3849972 - RNA, 15 nt, Shigella flexneri 2a str. 2457T
gucggggccagcgca

SEQ ID NO: 3849973 - RNA, 21 nt, Shigella flexneri 2a str. 2457T
gucgggugcgacaggagccgc

SEQ ID NO: 3849974 - RNA, 20 nt, Shigella flexneri 2a str. 2457T
gucgguaauuucacaaguug

SEQ ID NO: 3849975 - RNA, 21 nt, Shigella flexneri 2a str. 2457T
gucgguacuucgauuucgcca

SEQ ID NO: 3849976 - RNA, 18 nt, Shigella flexneri 2a str. 2457T
gucggugcucaucagccc

SEQ ID NO: 3849977 - RNA, 15 nt, Shigella flexneri 2a str. 2457T
gucgguuuauggaaa

SEQ ID NO: 3849978 - RNA, 19 nt, Shigella flexneri 2a str. 2457T
gucgguuuguacucuuccg

SEQ ID NO: 3849979 - RNA, 14 nt, Shigella flexneri 2a str. 2457T
gucguaagccaccg

SEQ ID NO: 3849980 - RNA, 16 nt, Shigella flexneri 2a str. 2457T
gucguaugcuggaagc

SEQ ID NO: 3849981 - RNA, 20 nt, Shigella flexneri 2a str. 2457T
gucguccggcagcagaaagc

SEQ ID NO: 3849982 - RNA, 22 nt, Shigella flexneri 2a str. 2457T
gucguccgguacgacaaucuca

SEQ ID NO: 3849983 - RNA, 18 nt, Shigella flexneri 2a str. 2457T
gugacacgcgcgcauggu

SEQ ID NO: 3849984 - RNA, 20 nt, Shigella flexneri 2a str. 2457T
gugacagauuugauuaucaa

SEQ ID NO: 3849985 - RNA, 18 nt, Shigella flexneri 2a str. 2457T
gugacagguuuaaacaga

SEQ ID NO: 3849986 - RNA, 20 nt, Shigella flexneri 2a str. 2457T
gugacaguguuauucccaac

SEQ ID NO: 3849987 - RNA, 23 nt, Shigella flexneri 2a str. 2457T
gugacaucgugcugguagaagcu

SEQ ID NO: 3849988 - RNA, 13 nt, Shigella flexneri 2a str. 2457T
gugacauuaacca

SEQ ID NO: 3849989 - RNA, 18 nt, Shigella flexneri 2a str. 2457T
gugaccaguaccaccgcg

SEQ ID NO: 3849990 - RNA, 22 nt, Shigella flexneri 2a str. 2457T
gugaccaucagcaugacaaaaa

SEQ ID NO: 3849991 - RNA, 19 nt, Shigella flexneri 2a str. 2457T
gugaccgaaauggagccga

SEQ ID NO: 3849992 - RNA, 22 nt, Shigella flexneri 2a str. 2457T
gugaccgaaccuguuuucaccg

SEQ ID NO: 3849993 - RNA, 15 nt, Shigella flexneri 2a str. 2457T
gugaccuguccugua

SEQ ID NO: 3849994 - RNA, 17 nt, Shigella flexneri 2a str. 2457T
gugaccuuucagugggu

SEQ ID NO: 3849995 - RNA, 18 nt, Shigella flexneri 2a str. 2457T
gugacgaaacugcucaaa

SEQ ID NO: 3849996 - RNA, 15 nt, Shigella flexneri 2a str. 2457T
gugacgacaccaucu

SEQ ID NO: 3849997 - RNA, 17 nt, Shigella flexneri 2a str. 2457T
gugacgacaccaucucu

SEQ ID NO: 3849998 - RNA, 20 nt, Shigella flexneri 2a str. 2457T
gugacgcacaguacgcgccc

SEQ ID NO: 3849999 - RNA, 11 nt, Shigella flexneri 2a str. 2457T
gugacugcugg

SEQ ID NO: 3850000 - RNA, 19 nt, Shigella flexneri 2a str. 2457T
gugacuucgccgugaaagu

SEQ ID NO: 3850001 - RNA, 20 nt, Shigella flexneri 2a str. 2457T
gugacuucugccagcugcug

SEQ ID NO: 3850002 - RNA, 12 nt, Shigella flexneri 2a str. 2457T
gugagaacacca

SEQ ID NO: 3850003 - RNA, 13 nt, Shigella flexneri 2a str. 2457T
gugagaacugcug

SEQ ID NO: 3850004 - RNA, 17 nt, Shigella flexneri 2a str. 2457T
gugagagugaagccuga

SEQ ID NO: 3850005 - RNA, 21 nt, Shigella flexneri 2a str. 2457T
gugagaucauuauuaaacaga

SEQ ID NO: 3850006 - RNA, 19 nt, Shigella flexneri 2a str. 2457T
gugagaucgcgcgggagca

SEQ ID NO: 3850007 - RNA, 21 nt, Shigella flexneri 2a str. 2457T
gugagccgaaauauggcgcug

SEQ ID NO: 3850008 - RNA, 16 nt, Shigella flexneri 2a str. 2457T
gugagcgguguugccg

SEQ ID NO: 3850009 - RNA, 20 nt, Shigella flexneri 2a str. 2457T
gugagcguuuucucaaaaaa

SEQ ID NO: 3850010 - RNA, 18 nt, Shigella flexneri 2a str. 2457T
gugaggcgaugccugcuu

SEQ ID NO: 3850011 - RNA, 22 nt, Shigella flexneri 2a str. 2457T
gugaggggaacccguuggcaca

SEQ ID NO: 3850012 - RNA, 15 nt, Shigella flexneri 2a str. 2457T
gugagggggcguuca

SEQ ID NO: 3850013 - RNA, 12 nt, Shigella flexneri 2a str. 2457T
gugagguaacaa

SEQ ID NO: 3850014 - RNA, 21 nt, Shigella flexneri 2a str. 2457T
gugaguaugauacguuuauua

SEQ ID NO: 3850015 - RNA, 17 nt, Shigella flexneri 2a str. 2457T
gugaguugguuauucaa

SEQ ID NO: 3850016 - RNA, 21 nt, Shigella flexneri 2a str. 2457T
gugauaaaacgcagucuuccc

SEQ ID NO: 3850017 - RNA, 23 nt, Shigella flexneri 2a str. 2457T
gugauaaaacgcagucuucccag

SEQ ID NO: 3850018 - RNA, 23 nt, Shigella flexneri 2a str. 2457T
gugauaaacccaacggcaaacau

SEQ ID NO: 3850019 - RNA, 18 nt, Shigella flexneri 2a str. 2457T
gugauaaucaguuugaug

SEQ ID NO: 3850020 - RNA, 17 nt, Shigella flexneri 2a str. 2457T
gugauacugaucgucau

SEQ ID NO: 3850021 - RNA, 18 nt, Shigella flexneri 2a str. 2457T
gugauauuucgaauuuuc

SEQ ID NO: 3850022 - RNA, 17 nt, Shigella flexneri 2a str. 2457T
gugaucaaaucaugccu

SEQ ID NO: 3850023 - RNA, 16 nt, Shigella flexneri 2a str. 2457T
gugaucacccagacgc

SEQ ID NO: 3850024 - RNA, 11 nt, Shigella flexneri 2a str. 2457T
gugauccauca

SEQ ID NO: 3850025 - RNA, 19 nt, Shigella flexneri 2a str. 2457T
gugaucccaauauagacaa

SEQ ID NO: 3850026 - RNA, 21 nt, Shigella flexneri 2a str. 2457T
gugauccgccgcugucgcagc

SEQ ID NO: 3850027 - RNA, 20 nt, Shigella flexneri 2a str. 2457T
gugaucguggccaugaccgc

SEQ ID NO: 3850028 - RNA, 14 nt, Shigella flexneri 2a str. 2457T
gugaugccaucggg

SEQ ID NO: 3850029 - RNA, 20 nt, Shigella flexneri 2a str. 2457T
gugaugcguccgcuaguggc

SEQ ID NO: 3850030 - RNA, 15 nt, Shigella flexneri 2a str. 2457T
gugauggcuauuaga

SEQ ID NO: 3850031 - RNA, 17 nt, Shigella flexneri 2a str. 2457T
gugaugguaacgcgcca

SEQ ID NO: 3850032 - RNA, 19 nt, Shigella flexneri 2a str. 2457T
gugauggugauaaucaguu

SEQ ID NO: 3850033 - RNA, 12 nt, Shigella flexneri 2a str. 2457T
gugaugguggug

SEQ ID NO: 3850034 - RNA, 13 nt, Shigella flexneri 2a str. 2457T
gugaugguggugg

SEQ ID NO: 3850035 - RNA, 21 nt, Shigella flexneri 2a str. 2457T
gugauguagucaucugcaccg

SEQ ID NO: 3850036 - RNA, 22 nt, Shigella flexneri 2a str. 2457T
gugauugccgcaacgguugcgg

SEQ ID NO: 3850037 - RNA, 15 nt, Shigella flexneri 2a str. 2457T
gugauugccgcagaa

SEQ ID NO: 3850038 - RNA, 11 nt, Shigella flexneri 2a str. 2457T
gugauuucaac

SEQ ID NO: 3850039 - RNA, 21 nt, Shigella flexneri 2a str. 2457T
gugauuucaggcuuuuuucca

SEQ ID NO: 3850040 - RNA, 23 nt, Shigella flexneri 2a str. 2457T
gugauuuccccuaacucuuucaa

SEQ ID NO: 3850041 - RNA, 22 nt, Shigella flexneri 2a str. 2457T
gugauuuccgccgccagcagac

SEQ ID NO: 3850042 - RNA, 14 nt, Shigella flexneri 2a str. 2457T
gugauuucuucauu

SEQ ID NO: 3850043 - RNA, 16 nt, Shigella flexneri 2a str. 2457T
gugauuuugugaacau

SEQ ID NO: 3850044 - RNA, 12 nt, Shigella flexneri 2a str. 2457T
gugcaaaaaaac

SEQ ID NO: 3850045 - RNA, 17 nt, Shigella flexneri 2a str. 2457T
gugcaaaaccugguugg

SEQ ID NO: 3850046 - RNA, 15 nt, Shigella flexneri 2a str. 2457T
gugcaaaugccagau

SEQ ID NO: 3850047 - RNA, 17 nt, Shigella flexneri 2a str. 2457T
gugcaaaugccagauaa

SEQ ID NO: 3850048 - RNA, 23 nt, Shigella flexneri 2a str. 2457T
gugcaaaugccagauaagacacu

SEQ ID NO: 3850049 - RNA, 21 nt, Shigella flexneri 2a str. 2457T
gugcaaauugcaccauccauu

SEQ ID NO: 3850050 - RNA, 23 nt, Shigella flexneri 2a str. 2457T
gugcaagcauuagcauacugaaa

SEQ ID NO: 3850051 - RNA, 16 nt, Shigella flexneri 2a str. 2457T
gugcaaucaaacucaa

SEQ ID NO: 3850052 - RNA, 19 nt, Shigella flexneri 2a str. 2457T
gugcaaucaacaccacugc

SEQ ID NO: 3850053 - RNA, 20 nt, Shigella flexneri 2a str. 2457T
gugcacaacaaucugcaaau

SEQ ID NO: 3850054 - RNA, 14 nt, Shigella flexneri 2a str. 2457T
gugcacaauauuuu

SEQ ID NO: 3850055 - RNA, 17 nt, Shigella flexneri 2a str. 2457T
gugcacaauugccggau

SEQ ID NO: 3850056 - RNA, 22 nt, Shigella flexneri 2a str. 2457T
gugcacaauugccggaugcggc

SEQ ID NO: 3850057 - RNA, 16 nt, Shigella flexneri 2a str. 2457T
gugcacaguugauuga

SEQ ID NO: 3850058 - RNA, 20 nt, Shigella flexneri 2a str. 2457T
gugcaccagaaaguuuuuca

SEQ ID NO: 3850059 - RNA, 16 nt, Shigella flexneri 2a str. 2457T
gugcacccgcuucagu

SEQ ID NO: 3850060 - RNA, 18 nt, Shigella flexneri 2a str. 2457T
gugcaccgauugccggau

SEQ ID NO: 3850061 - RNA, 19 nt, Shigella flexneri 2a str. 2457T
gugcacgaaccagagacag

SEQ ID NO: 3850062 - RNA, 17 nt, Shigella flexneri 2a str. 2457T
gugcacgauugccggau

SEQ ID NO: 3850063 - RNA, 22 nt, Shigella flexneri 2a str. 2457T
gugcacgauugccggaugcggc

SEQ ID NO: 3850064 - RNA, 14 nt, Shigella flexneri 2a str. 2457T
gugcagagcccguu

SEQ ID NO: 3850065 - RNA, 16 nt, Shigella flexneri 2a str. 2457T
gugcagcacggagaga

SEQ ID NO: 3850066 - RNA, 11 nt, Shigella flexneri 2a str. 2457T
gugcagcaucg

SEQ ID NO: 3850067 - RNA, 16 nt, Shigella flexneri 2a str. 2457T
gugcagcaugcacccu

SEQ ID NO: 3850068 - RNA, 14 nt, Shigella flexneri 2a str. 2457T
gugcagccaaaaau

SEQ ID NO: 3850069 - RNA, 21 nt, Shigella flexneri 2a str. 2457T
gugcaggcaccagccccugga

SEQ ID NO: 3850070 - RNA, 14 nt, Shigella flexneri 2a str. 2457T
gugcaguacaucgu

SEQ ID NO: 3850071 - RNA, 15 nt, Shigella flexneri 2a str. 2457T
gugcaucaacauaua

SEQ ID NO: 3850072 - RNA, 15 nt, Shigella flexneri 2a str. 2457T
gugcaucauggaagc

SEQ ID NO: 3850073 - RNA, 20 nt, Shigella flexneri 2a str. 2457T
gugcaucauggaagcaaugu

SEQ ID NO: 3850074 - RNA, 14 nt, Shigella flexneri 2a str. 2457T
gugcauccagcagc

SEQ ID NO: 3850075 - RNA, 22 nt, Shigella flexneri 2a str. 2457T
gugcaucggugcgcugugugug

SEQ ID NO: 3850076 - RNA, 19 nt, Shigella flexneri 2a str. 2457T
gugcaucuccugacacaac

SEQ ID NO: 3850077 - RNA, 18 nt, Shigella flexneri 2a str. 2457T
gugcauuucucacuuuuc

SEQ ID NO: 3850078 - RNA, 15 nt, Shigella flexneri 2a str. 2457T
gugccaagcuccagc

SEQ ID NO: 3850079 - RNA, 17 nt, Shigella flexneri 2a str. 2457T
gugccacaccagcuuuc

SEQ ID NO: 3850080 - RNA, 21 nt, Shigella flexneri 2a str. 2457T
guggugcguaccaggcgugga

SEQ ID NO: 3850081 - RNA, 20 nt, Shigella flexneri 2a str. 2457T
guggugcuggacucccagaa

SEQ ID NO: 3850082 - RNA, 15 nt, Shigella flexneri 2a str. 2457T
gugguguagggcagg

SEQ ID NO: 3850083 - RNA, 16 nt, Shigella flexneri 2a str. 2457T
gugguuucgccagcac

SEQ ID NO: 3850084 - RNA, 14 nt, Shigella flexneri 2a str. 2457T
guguaaaacagcac

SEQ ID NO: 3850085 - RNA, 18 nt, Shigella flexneri 2a str. 2457T
guguacuuaucuuuuaca

SEQ ID NO: 3850086 - RNA, 19 nt, Shigella flexneri 2a str. 2457T
guguagcucgccuucaggu

SEQ ID NO: 3850087 - RNA, 23 nt, Shigella flexneri 2a str. 2457T
guguaguauuugaguucacugcc

SEQ ID NO: 3850088 - RNA, 17 nt, Shigella flexneri 2a str. 2457T
guguaucuucagcugca

SEQ ID NO: 3850089 - RNA, 17 nt, Shigella flexneri 2a str. 2457T
guguauggcauugucug

SEQ ID NO: 3850090 - RNA, 16 nt, Shigella flexneri 2a str. 2457T
guguccagccagucca

SEQ ID NO: 3850091 - RNA, 13 nt, Shigella flexneri 2a str. 2457T
gugucccacuggu

SEQ ID NO: 3850092 - RNA, 14 nt, Shigella flexneri 2a str. 2457T
guguccuguugaug

SEQ ID NO: 3850093 - RNA, 19 nt, Shigella flexneri 2a str. 2457T
gugucgccagcaacacaaa

SEQ ID NO: 3850094 - RNA, 24 nt, Shigella flexneri 2a str. 2457T
gugucgccagcaacacaaacgaau

SEQ ID NO: 3850095 - RNA, 17 nt, Shigella flexneri 2a str. 2457T
gugucguuacgccgcag

SEQ ID NO: 3850096 - RNA, 20 nt, Shigella flexneri 2a str. 2457T
gugucuaacgaugccagcac

SEQ ID NO: 3850097 - RNA, 15 nt, Shigella flexneri 2a str. 2457T
gugucuuaucaggcc

SEQ ID NO: 3850098 - RNA, 17 nt, Shigella flexneri 2a str. 2457T
gugugcaaucacuuccu

SEQ ID NO: 3850099 - RNA, 15 nt, Shigella flexneri 2a str. 2457T
gugugccaccagcgc

SEQ ID NO: 3850100 - RNA, 17 nt, Shigella flexneri 2a str. 2457T
guguggcaucguccguc

SEQ ID NO: 3850101 - RNA, 14 nt, Shigella flexneri 2a str. 2457T
guguggccaguucc

SEQ ID NO: 3850102 - RNA, 16 nt, Shigella flexneri 2a str. 2457T
gugugggcacucgaag

SEQ ID NO: 3850103 - RNA, 19 nt, Shigella flexneri 2a str. 2457T
guguggucuuuucaacagu

SEQ ID NO: 3850104 - RNA, 12 nt, Shigella flexneri 2a str. 2457T
guguguccaucc

SEQ ID NO: 3850105 - RNA, 11 nt, Shigella flexneri 2a str. 2457T
gugugugcuga

SEQ ID NO: 3850106 - RNA, 19 nt, Shigella flexneri 2a str. 2457T
guguuaaaugauaccgggc

SEQ ID NO: 3850107 - RNA, 16 nt, Shigella flexneri 2a str. 2457T
guguuaaccaacggcg

SEQ ID NO: 3850108 - RNA, 22 nt, Shigella flexneri 2a str. 2457T
guguuacgcggaucgagaaucu

SEQ ID NO: 3850109 - RNA, 24 nt, Shigella flexneri 2a str. 2457T
guguuagcccugucgaggccaauu

SEQ ID NO: 3850110 - RNA, 18 nt, Shigella flexneri 2a str. 2457T
guguucaauaucgaaaug

SEQ ID NO: 3850111 - RNA, 14 nt, Shigella flexneri 2a str. 2457T
guguuccucugcuc

SEQ ID NO: 3850112 - RNA, 16 nt, Shigella flexneri 2a str. 2457T
guguucucaucgccau

SEQ ID NO: 3850113 - RNA, 15 nt, Shigella flexneri 2a str. 2457T
guguugauuuccaac

SEQ ID NO: 3850114 - RNA, 19 nt, Shigella flexneri 2a str. 2457T
guguugcguaaugguggug

SEQ ID NO: 3850115 - RNA, 14 nt, Shigella flexneri 2a str. 2457T
guguugguaaauaa

SEQ ID NO: 3850116 - RNA, 22 nt, Shigella flexneri 2a str. 2457T
guguuuugacauuggcauccgu

SEQ ID NO: 3850117 - RNA, 16 nt, Shigella flexneri 2a str. 2457T
guuaaaaacagccagc

SEQ ID NO: 3850118 - RNA, 17 nt, Shigella flexneri 2a str. 2457T
guuaaaaacagccagca

SEQ ID NO: 3850119 - RNA, 20 nt, Shigella flexneri 2a str. 2457T
guuaaaacuaaaaacagcau

SEQ ID NO: 3850120 - RNA, 20 nt, Shigella flexneri 2a str. 2457T
guuaaaacuuuccaugccau

SEQ ID NO: 3850121 - RNA, 16 nt, Shigella flexneri 2a str. 2457T
guuaaacccgcucaaa

SEQ ID NO: 3850122 - RNA, 19 nt, Shigella flexneri 2a str. 2457T
guuaaacuuucauaaacac

SEQ ID NO: 3850123 - RNA, 19 nt, Shigella flexneri 2a str. 2457T
guuaaauuccguugcuguu

SEQ ID NO: 3850124 - RNA, 21 nt, Shigella flexneri 2a str. 2457T
guuaaauugaucgaugguugc

SEQ ID NO: 3850125 - RNA, 14 nt, Shigella flexneri 2a str. 2457T
guuaacaaucacaa

SEQ ID NO: 3850126 - RNA, 23 nt, Shigella flexneri 2a str. 2457T
guuaacaccaccgccgacuguca

SEQ ID NO: 3850127 - RNA, 13 nt, Shigella flexneri 2a str. 2457T
guuaacagcgcau

SEQ ID NO: 3850128 - RNA, 14 nt, Shigella flexneri 2a str. 2457T
guuaaccagcacca

SEQ ID NO: 3850129 - RNA, 20 nt, Shigella flexneri 2a str. 2457T
guuaacgccuuauccggccu

SEQ ID NO: 3850130 - RNA, 16 nt, Shigella flexneri 2a str. 2457T
guuaacgcgucuuuga

SEQ ID NO: 3850131 - RNA, 18 nt, Shigella flexneri 2a str. 2457T
guuaacgugucauaacug

SEQ ID NO: 3850132 - RNA, 14 nt, Shigella flexneri 2a str. 2457T
guuaacguuuuucg

SEQ ID NO: 3850133 - RNA, 19 nt, Shigella flexneri 2a str. 2457T
guuaacugaauauuccagu

SEQ ID NO: 3850134 - RNA, 21 nt, Shigella flexneri 2a str. 2457T
guuaacugaauauuccaguua

SEQ ID NO: 3850135 - RNA, 15 nt, Shigella flexneri 2a str. 2457T
guuaagaaaacggaa

SEQ ID NO: 3850136 - RNA, 15 nt, Shigella flexneri 2a str. 2457T
guuaagcaaaaaaac

SEQ ID NO: 3850137 - RNA, 12 nt, Shigella flexneri 2a str. 2457T
guuaagcauucg

SEQ ID NO: 3850138 - RNA, 17 nt, Shigella flexneri 2a str. 2457T
guuaagcccaguucagc

SEQ ID NO: 3850139 - RNA, 14 nt, Shigella flexneri 2a str. 2457T
guuaaguuuauccc

SEQ ID NO: 3850140 - RNA, 19 nt, Shigella flexneri 2a str. 2457T
guuaauccacagcaaugca

SEQ ID NO: 3850141 - RNA, 20 nt, Shigella flexneri 2a str. 2457T
guuaaucuuuucugagucaa

SEQ ID NO: 3850142 - RNA, 14 nt, Shigella flexneri 2a str. 2457T
guuaaugcccauca

SEQ ID NO: 3850143 - RNA, 20 nt, Shigella flexneri 2a str. 2457T
guuaauggcuuuacgcgcca

SEQ ID NO: 3850144 - RNA, 11 nt, Shigella flexneri 2a str. 2457T
guuaaugguug

SEQ ID NO: 3850145 - RNA, 20 nt, Shigella flexneri 2a str. 2457T
guuaauuuuucaaacucuuc

SEQ ID NO: 3850146 - RNA, 22 nt, Shigella flexneri 2a str. 2457T
guuacaaucugcgcuggaacaa

SEQ ID NO: 3850147 - RNA, 12 nt, Shigella flexneri 2a str. 2457T
guuaccagcggc

SEQ ID NO: 3850148 - RNA, 20 nt, Shigella flexneri 2a str. 2457T
guuaccccucuauccagcuc

SEQ ID NO: 3850149 - RNA, 18 nt, Shigella flexneri 2a str. 2457T
guuaccgacugcggccug

SEQ ID NO: 3850150 - RNA, 15 nt, Shigella flexneri 2a str. 2457T
guuaccgaucgccag

SEQ ID NO: 3850151 - RNA, 17 nt, Shigella flexneri 2a str. 2457T
guuaccucauggagaua

SEQ ID NO: 3850152 - RNA, 18 nt, Shigella flexneri 2a str. 2457T
guuaccuucggccccauc

SEQ ID NO: 3850153 - RNA, 19 nt, Shigella flexneri 2a str. 2457T
guuaccuucggccccaucg

SEQ ID NO: 3850154 - RNA, 20 nt, Shigella flexneri 2a str. 2457T
guuacgcaaaaccucuucca

SEQ ID NO: 3850155 - RNA, 21 nt, Shigella flexneri 2a str. 2457T
guuacggacuuuuuauuuaug

SEQ ID NO: 3850156 - RNA, 15 nt, Shigella flexneri 2a str. 2457T
guuacggaucucccg

SEQ ID NO: 3850157 - RNA, 18 nt, Shigella flexneri 2a str. 2457T
guuacggcuggaagguga

SEQ ID NO: 3850158 - RNA, 17 nt, Shigella flexneri 2a str. 2457T
guuacggugcgcagccg

SEQ ID NO: 3850159 - RNA, 17 nt, Shigella flexneri 2a str. 2457T
guuacgugaagucucaa

SEQ ID NO: 3850160 - RNA, 15 nt, Shigella flexneri 2a str. 2457T
guuacguucuccuga

SEQ ID NO: 3850161 - RNA, 21 nt, Shigella flexneri 2a str. 2457T
guuacugagcggaugcuuaac

SEQ ID NO: 3850162 - RNA, 18 nt, Shigella flexneri 2a str. 2457T
guuacugcuggcaacaug

SEQ ID NO: 3850163 - RNA, 18 nt, Shigella flexneri 2a str. 2457T
guuacuuuuuaugucauu

SEQ ID NO: 3850164 - RNA, 18 nt, Shigella flexneri 2a str. 2457T
guuagaaaacgccugcuc

SEQ ID NO: 3850165 - RNA, 21 nt, Shigella flexneri 2a str. 2457T
guuagaauaccugccugucac

SEQ ID NO: 3850166 - RNA, 18 nt, Shigella flexneri 2a str. 2457T
guuagacgcguuuacaga

SEQ ID NO: 3850167 - RNA, 20 nt, Shigella flexneri 2a str. 2457T
guuagacgcguuuacagagc

SEQ ID NO: 3850168 - RNA, 13 nt, Shigella flexneri 2a str. 2457T
guuagagaacaac

SEQ ID NO: 3850169 - RNA, 14 nt, Shigella flexneri 2a str. 2457T
guuagagcacagau

SEQ ID NO: 3850170 - RNA, 23 nt, Shigella flexneri 2a str. 2457T
guuagagccagggaucgggucac

SEQ ID NO: 3850171 - RNA, 21 nt, Shigella flexneri 2a str. 2457T
guuagcaaugccuucuggaaa

SEQ ID NO: 3850172 - RNA, 18 nt, Shigella flexneri 2a str. 2457T
guuagcggcgguaaaauc

SEQ ID NO: 3850173 - RNA, 18 nt, Shigella flexneri 2a str. 2457T
guuagcgggucaggucgu

SEQ ID NO: 3850174 - RNA, 13 nt, Shigella flexneri 2a str. 2457T
guuagucaucauc

SEQ ID NO: 3850175 - RNA, 15 nt, Shigella flexneri 2a str. 2457T
guuagucaucaucag

SEQ ID NO: 3850176 - RNA, 23 nt, Shigella flexneri 2a str. 2457T
guuagucaucaucaggaacaucc

SEQ ID NO: 3850177 - RNA, 16 nt, Shigella flexneri 2a str. 2457T
guucguugauaauaaa

SEQ ID NO: 3850178 - RNA, 22 nt, Shigella flexneri 2a str. 2457T
guucguugauaauaaagcuaca

SEQ ID NO: 3850179 - RNA, 21 nt, Shigella flexneri 2a str. 2457T
guucguugaucacuuucaccg

SEQ ID NO: 3850180 - RNA, 16 nt, Shigella flexneri 2a str. 2457T
guucuacaaucugccc

SEQ ID NO: 3850181 - RNA, 22 nt, Shigella flexneri 2a str. 2457T
guucuacgugcgcuauguguua

SEQ ID NO: 3850182 - RNA, 14 nt, Shigella flexneri 2a str. 2457T
guucucaauuacug

SEQ ID NO: 3850183 - RNA, 23 nt, Shigella flexneri 2a str. 2457T
guucucaucgccaucaauaacca

SEQ ID NO: 3850184 - RNA, 13 nt, Shigella flexneri 2a str. 2457T
guucucaugguuc

SEQ ID NO: 3850185 - RNA, 20 nt, Shigella flexneri 2a str. 2457T
guucucccauaggaugaggu

SEQ ID NO: 3850186 - RNA, 13 nt, Shigella flexneri 2a str. 2457T
guucucuuuaaaa

SEQ ID NO: 3850187 - RNA, 21 nt, Shigella flexneri 2a str. 2457T
guucugaccggccagcaugug

SEQ ID NO: 3850188 - RNA, 16 nt, Shigella flexneri 2a str. 2457T
guucugauaguuaaaa

SEQ ID NO: 3850189 - RNA, 14 nt, Shigella flexneri 2a str. 2457T
guucugaucuuucu

SEQ ID NO: 3850190 - RNA, 16 nt, Shigella flexneri 2a str. 2457T
guucugaucuuucuuc

SEQ ID NO: 3850191 - RNA, 16 nt, Shigella flexneri 2a str. 2457T
guucugcaaggcgagc

SEQ ID NO: 3850192 - RNA, 16 nt, Shigella flexneri 2a str. 2457T
guucugcacuuuucug

SEQ ID NO: 3850193 - RNA, 22 nt, Shigella flexneri 2a str. 2457T
guucugcagcguuagacgcguu

SEQ ID NO: 3850194 - RNA, 20 nt, Shigella flexneri 2a str. 2457T
guucugccgcgcacgucagc

SEQ ID NO: 3850195 - RNA, 15 nt, Shigella flexneri 2a str. 2457T
guucugccucugaaa

SEQ ID NO: 3850196 - RNA, 18 nt, Shigella flexneri 2a str. 2457T
guucugcgacgcgcggug

SEQ ID NO: 3850197 - RNA, 23 nt, Shigella flexneri 2a str. 2457T
guucugcgccguccacaaaccgu

SEQ ID NO: 3850198 - RNA, 22 nt, Shigella flexneri 2a str. 2457T
guucugcggguuagucugcauu

SEQ ID NO: 3850199 - RNA, 20 nt, Shigella flexneri 2a str. 2457T
guucugucgauaaacucaug

SEQ ID NO: 3850200 - RNA, 14 nt, Shigella flexneri 2a str. 2457T
guucugucgcucug

SEQ ID NO: 3850201 - RNA, 21 nt, Shigella flexneri 2a str. 2457T
guucuguggcagggcagcgau

SEQ ID NO: 3850202 - RNA, 16 nt, Shigella flexneri 2a str. 2457T
guucuucgcugacagu

SEQ ID NO: 3850203 - RNA, 22 nt, Shigella flexneri 2a str. 2457T
guucuucuuuauugauuaaagg

SEQ ID NO: 3850204 - RNA, 13 nt, Shigella flexneri 2a str. 2457T
guucuuuuuuuaa

SEQ ID NO: 3850205 - RNA, 12 nt, Shigella flexneri 2a str. 2457T
guugaaaaacca

SEQ ID NO: 3850206 - RNA, 14 nt, Shigella flexneri 2a str. 2457T
guugaaaaaccaga

SEQ ID NO: 3850207 - RNA, 22 nt, Shigella flexneri 2a str. 2457T
guugaaaaaucaaaaaacugga

SEQ ID NO: 3850208 - RNA, 12 nt, Shigella flexneri 2a str. 2457T
guugaagucagg

SEQ ID NO: 3850209 - RNA, 23 nt, Shigella flexneri 2a str. 2457T
guugaagucagggucuuccagca

SEQ ID NO: 3850210 - RNA, 13 nt, Shigella flexneri 2a str. 2457T
guugacaaagugc

SEQ ID NO: 3850211 - RNA, 13 nt, Shigella flexneri 2a str. 2457T
guugaccgcccgg

SEQ ID NO: 3850212 - RNA, 14 nt, Shigella flexneri 2a str. 2457T
guugaccuggaagg

SEQ ID NO: 3850213 - RNA, 18 nt, Shigella flexneri 2a str. 2457T
guugacguucaugccggu

SEQ ID NO: 3850214 - RNA, 16 nt, Shigella flexneri 2a str. 2457T
guugagagaagaaacg

SEQ ID NO: 3850215 - RNA, 18 nt, Shigella flexneri 2a str. 2457T
guugaggaacucaaacca

SEQ ID NO: 3850216 - RNA, 11 nt, Shigella flexneri 2a str. 2457T
guugaggaagc

SEQ ID NO: 3850217 - RNA, 14 nt, Shigella flexneri 2a str. 2457T
guugaggaucacaa

SEQ ID NO: 3850218 - RNA, 14 nt, Shigella flexneri 2a str. 2457T
guugaggcacaucu

SEQ ID NO: 3850219 - RNA, 18 nt, Shigella flexneri 2a str. 2457T
guugaguaagaggccaga

SEQ ID NO: 3850220 - RNA, 16 nt, Shigella flexneri 2a str. 2457T
guugauacaggaacag

SEQ ID NO: 3850221 - RNA, 21 nt, Shigella flexneri 2a str. 2457T
guugauacaggaacagccacu

SEQ ID NO: 3850222 - RNA, 17 nt, Shigella flexneri 2a str. 2457T
guugauauuccaucuga

SEQ ID NO: 3850223 - RNA, 14 nt, Shigella flexneri 2a str. 2457T
guugaucauaaaaa

SEQ ID NO: 3850224 - RNA, 15 nt, Shigella flexneri 2a str. 2457T
guugaucauaaaaau

SEQ ID NO: 3850225 - RNA, 14 nt, Shigella flexneri 2a str. 2457T
guugauccaggagc

SEQ ID NO: 3850226 - RNA, 19 nt, Shigella flexneri 2a str. 2457T
guugauccaggagcuccag

SEQ ID NO: 3850227 - RNA, 12 nt, Shigella flexneri 2a str. 2457T
guugaucgccac

SEQ ID NO: 3850228 - RNA, 14 nt, Shigella flexneri 2a str. 2457T
guugaucuguaacg

SEQ ID NO: 3850229 - RNA, 19 nt, Shigella flexneri 2a str. 2457T
guugaucuucucgucaauc

SEQ ID NO: 3850230 - RNA, 19 nt, Shigella flexneri 2a str. 2457T
guugaugcgcccuugcagg

SEQ ID NO: 3850231 - RNA, 14 nt, Shigella flexneri 2a str. 2457T
guugaugguaaaau

SEQ ID NO: 3850232 - RNA, 16 nt, Shigella flexneri 2a str. 2457T
guugauuggcgcaggu

SEQ ID NO: 3850233 - RNA, 16 nt, Shigella flexneri 2a str. 2457T
guugauuuuauaauca

SEQ ID NO: 3850234 - RNA, 19 nt, Shigella flexneri 2a str. 2457T
guugauuuuucguuuuaau

SEQ ID NO: 3850235 - RNA, 13 nt, Shigella flexneri 2a str. 2457T
guugcaccgaguu

SEQ ID NO: 3850236 - RNA, 22 nt, Shigella flexneri 2a str. 2457T
guugcacgucaauggugagaug

SEQ ID NO: 3850237 - RNA, 15 nt, Shigella flexneri 2a str. 2457T
guugcagacccgcca

SEQ ID NO: 3850238 - RNA, 21 nt, Shigella flexneri 2a str. 2457T
guugcagauuugccaguaccg

SEQ ID NO: 3850239 - RNA, 16 nt, Shigella flexneri 2a str. 2457T
guugcaguucugccau

SEQ ID NO: 3850240 - RNA, 18 nt, Shigella flexneri 2a str. 2457T
guugcauaauuucuucgu

SEQ ID NO: 3850241 - RNA, 17 nt, Shigella flexneri 2a str. 2457T
guugcauccggcauggc

SEQ ID NO: 3850242 - RNA, 21 nt, Shigella flexneri 2a str. 2457T
guugcaugauuucgucauccg

SEQ ID NO: 3850243 - RNA, 13 nt, Shigella flexneri 2a str. 2457T
guugcauuccagu

SEQ ID NO: 3850244 - RNA, 12 nt, Shigella flexneri 2a str. 2457T
guugccaucauc

SEQ ID NO: 3850245 - RNA, 23 nt, Shigella flexneri 2a str. 2457T
guugccaucaucaccagaaucaa

SEQ ID NO: 3850246 - RNA, 21 nt, Shigella flexneri 2a str. 2457T
guugccauuucugcugccacu

SEQ ID NO: 3850247 - RNA, 18 nt, Shigella flexneri 2a str. 2457T
guugcccagcgcaucagg

SEQ ID NO: 3850248 - RNA, 21 nt, Shigella flexneri 2a str. 2457T
guugcccuuuucaccaugggc

SEQ ID NO: 3850249 - RNA, 11 nt, Shigella flexneri 2a str. 2457T
guugccgcagc

SEQ ID NO: 3850250 - RNA, 12 nt, Shigella flexneri 2a str. 2457T
guugccgcccgu

SEQ ID NO: 3850251 - RNA, 12 nt, Shigella flexneri 2a str. 2457T
guugccugcugu

SEQ ID NO: 3850252 - RNA, 13 nt, Shigella flexneri 2a str. 2457T
guugcgaaaaaau

SEQ ID NO: 3850253 - RNA, 23 nt, Shigella flexneri 2a str. 2457T
guugcgaaaaaaucauccauccg

SEQ ID NO: 3850254 - RNA, 16 nt, Shigella flexneri 2a str. 2457T
guugcgaucgaccugc

SEQ ID NO: 3850255 - RNA, 17 nt, Shigella flexneri 2a str. 2457T
guugcgaucgaccugcg

SEQ ID NO: 3850256 - RNA, 14 nt, Shigella flexneri 2a str. 2457T
guugcgccgggaug

SEQ ID NO: 3850257 - RNA, 18 nt, Shigella flexneri 2a str. 2457T
guugcggcugcccaucau

SEQ ID NO: 3850258 - RNA, 21 nt, Shigella flexneri 2a str. 2457T
guugcgucucgacaaacuccg

SEQ ID NO: 3850259 - RNA, 19 nt, Shigella flexneri 2a str. 2457T
guugcguuuuuaucuucac

SEQ ID NO: 3850260 - RNA, 17 nt, Shigella flexneri 2a str. 2457T
guugcuauggggaaaaa

SEQ ID NO: 3850261 - RNA, 22 nt, Shigella flexneri 2a str. 2457T
guugcuccccagaauccaggaa

SEQ ID NO: 3850262 - RNA, 19 nt, Shigella flexneri 2a str. 2457T
guugcugccuugcgggcug

SEQ ID NO: 3850263 - RNA, 14 nt, Shigella flexneri 2a str. 2457T
guugcuggaaagag

SEQ ID NO: 3850264 - RNA, 14 nt, Shigella flexneri 2a str. 2457T
guugcuucaucuca

SEQ ID NO: 3850265 - RNA, 15 nt, Shigella flexneri 2a str. 2457T
guugcuuuucacaac

SEQ ID NO: 3850266 - RNA, 23 nt, Shigella flexneri 2a str. 2457T
guuggauaaggcgguuacgccgc

SEQ ID NO: 3850267 - RNA, 12 nt, Shigella flexneri 2a str. 2457T
guuggcaaaaaa

SEQ ID NO: 3850268 - RNA, 14 nt, Shigella flexneri 2a str. 2457T
guuggcaaaaaaau

SEQ ID NO: 3850269 - RNA, 22 nt, Shigella flexneri 2a str. 2457T
guuggcaagauaggcaucccgc

SEQ ID NO: 3850270 - RNA, 16 nt, Shigella flexneri 2a str. 2457T
guuggcaccaaagggc

SEQ ID NO: 3850271 - RNA, 13 nt, Shigella flexneri 2a str. 2457T
guuggcaggccaa

SEQ ID NO: 3850272 - RNA, 21 nt, Shigella flexneri 2a str. 2457T
guuggcaugcguauccuccug

SEQ ID NO: 3850273 - RNA, 15 nt, Shigella flexneri 2a str. 2457T
guuggccugccggau

SEQ ID NO: 3850274 - RNA, 14 nt, Shigella flexneri 2a str. 2457T
guuggcgaaaaucu

SEQ ID NO: 3850275 - RNA, 14 nt, Shigella flexneri 2a str. 2457T
guuuuacuccaacu

SEQ ID NO: 3850276 - RNA, 22 nt, Shigella flexneri 2a str. 2457T
guuuuacucuuucucggaguaa

SEQ ID NO: 3850277 - RNA, 18 nt, Shigella flexneri 2a str. 2457T
guuuuacuuuuuaacuuu

SEQ ID NO: 3850278 - RNA, 21 nt, Shigella flexneri 2a str. 2457T
guuuuacuuuuuaacuuuaau

SEQ ID NO: 3850279 - RNA, 13 nt, Shigella flexneri 2a str. 2457T
guuuuaguaacaa

SEQ ID NO: 3850280 - RNA, 17 nt, Shigella flexneri 2a str. 2457T
guuuuaguguuuguauu

SEQ ID NO: 3850281 - RNA, 20 nt, Shigella flexneri 2a str. 2457T
guuuuauagcgggaaauacu

SEQ ID NO: 3850282 - RNA, 14 nt, Shigella flexneri 2a str. 2457T
guuuuaucagaccg

SEQ ID NO: 3850283 - RNA, 14 nt, Shigella flexneri 2a str. 2457T
guuuuaucccgcuc

SEQ ID NO: 3850284 - RNA, 21 nt, Shigella flexneri 2a str. 2457T
guuuuauguucagauaaugcc

SEQ ID NO: 3850285 - RNA, 19 nt, Shigella flexneri 2a str. 2457T
guuuuauuauuccauccug

SEQ ID NO: 3850286 - RNA, 22 nt, Shigella flexneri 2a str. 2457T
guuuuauuauuccauccugcuc

SEQ ID NO: 3850287 - RNA, 12 nt, Shigella flexneri 2a str. 2457T
guuuucaccagu

SEQ ID NO: 3850288 - RNA, 17 nt, Shigella flexneri 2a str. 2457T
guuuucacccuuucguu

SEQ ID NO: 3850289 - RNA, 17 nt, Shigella flexneri 2a str. 2457T
guuuucagaagcaugaa

SEQ ID NO: 3850290 - RNA, 16 nt, Shigella flexneri 2a str. 2457T
guuuucagaugaaaac

SEQ ID NO: 3850291 - RNA, 16 nt, Shigella flexneri 2a str. 2457T
guuuucagcaccagau

SEQ ID NO: 3850292 - RNA, 20 nt, Shigella flexneri 2a str. 2457T
guuuucagcuucgguuucac

SEQ ID NO: 3850293 - RNA, 11 nt, Shigella flexneri 2a str. 2457T
guuuucaucau

SEQ ID NO: 3850294 - RNA, 17 nt, Shigella flexneri 2a str. 2457T
guuuuccagugccagaa

SEQ ID NO: 3850295 - RNA, 13 nt, Shigella flexneri 2a str. 2457T
guuuuccaguuca

SEQ ID NO: 3850296 - RNA, 12 nt, Shigella flexneri 2a str. 2457T
guuuuccuucag

SEQ ID NO: 3850297 - RNA, 14 nt, Shigella flexneri 2a str. 2457T
guuuucgccacauc

SEQ ID NO: 3850298 - RNA, 19 nt, Shigella flexneri 2a str. 2457T
guuuucgccggaaccugau

SEQ ID NO: 3850299 - RNA, 17 nt, Shigella flexneri 2a str. 2457T
guuuucgcgcgcaguua

SEQ ID NO: 3850300 - RNA, 16 nt, Shigella flexneri 2a str. 2457T
guuuucgcugccacac

SEQ ID NO: 3850301 - RNA, 20 nt, Shigella flexneri 2a str. 2457T
guuuucuacuuuguaaacga

SEQ ID NO: 3850302 - RNA, 23 nt, Shigella flexneri 2a str. 2457T
guuuucucaagucuggguauuca

SEQ ID NO: 3850303 - RNA, 14 nt, Shigella flexneri 2a str. 2457T
guuuucucaucgcu

SEQ ID NO: 3850304 - RNA, 18 nt, Shigella flexneri 2a str. 2457T
guuuucucgcuccauucc

SEQ ID NO: 3850305 - RNA, 15 nt, Shigella flexneri 2a str. 2457T
guuuucuggcugaca

SEQ ID NO: 3850306 - RNA, 13 nt, Shigella flexneri 2a str. 2457T
guuuucuuugcca

SEQ ID NO: 3850307 - RNA, 17 nt, Shigella flexneri 2a str. 2457T
guuuugccagucagcuc

SEQ ID NO: 3850308 - RNA, 17 nt, Shigella flexneri 2a str. 2457T
guuuugcggcgugaccu

SEQ ID NO: 3850309 - RNA, 22 nt, Shigella flexneri 2a str. 2457T
guuuugcuuucuauaagauacu

SEQ ID NO: 3850310 - RNA, 20 nt, Shigella flexneri 2a str. 2457T
guuuuggccgugaauuacug

SEQ ID NO: 3850311 - RNA, 22 nt, Shigella flexneri 2a str. 2457T
guuuugguuaacugaauauucc

SEQ ID NO: 3850312 - RNA, 15 nt, Shigella flexneri 2a str. 2457T
guuuuguagaccuga

SEQ ID NO: 3850313 - RNA, 20 nt, Shigella flexneri 2a str. 2457T
guuuuguggguggucagcgu

SEQ ID NO: 3850314 - RNA, 22 nt, Shigella flexneri 2a str. 2457T
guuuuguugcccagcgcaucag

SEQ ID NO: 3850315 - RNA, 12 nt, Shigella flexneri 2a str. 2457T
guuuuuaaaaua

SEQ ID NO: 3850316 - RNA, 16 nt, Shigella flexneri 2a str. 2457T
guuuuuacccagcagc

SEQ ID NO: 3850317 - RNA, 17 nt, Shigella flexneri 2a str. 2457T
guuuuuacccagcagca

SEQ ID NO: 3850318 - RNA, 15 nt, Shigella flexneri 2a str. 2457T
guuuuuaucuucaca

SEQ ID NO: 3850319 - RNA, 14 nt, Shigella flexneri 2a str. 2457T
guuuuuauugguca

SEQ ID NO: 3850320 - RNA, 15 nt, Shigella flexneri 2a str. 2457T
guuuuuauuuugccc

SEQ ID NO: 3850321 - RNA, 19 nt, Shigella flexneri 2a str. 2457T
guuuuucagcgccagcgcg

SEQ ID NO: 3850322 - RNA, 21 nt, Shigella flexneri 2a str. 2457T
guuuuucaucgcuaauaauaa

SEQ ID NO: 3850323 - RNA, 22 nt, Shigella flexneri 2a str. 2457T
guuuuucauugcacucuccucc

SEQ ID NO: 3850324 - RNA, 16 nt, Shigella flexneri 2a str. 2457T
guuuuuccaaaacugg

SEQ ID NO: 3850325 - RNA, 12 nt, Shigella flexneri 2a str. 2457T
guuuuucuuuuu

SEQ ID NO: 3850326 - RNA, 15 nt, Shigella flexneri 2a str. 2457T
guuuuucuuuuucaa

SEQ ID NO: 3850327 - RNA, 21 nt, Shigella flexneri 2a str. 2457T
guuuuugcacgcuuucugcgu

SEQ ID NO: 3850328 - RNA, 22 nt, Shigella flexneri 2a str. 2457T
guuuuuguccccucaucaguga

SEQ ID NO: 3850329 - RNA, 14 nt, Shigella flexneri 2a str. 2457T
guuuuuguugauaa

SEQ ID NO: 3850330 - RNA, 21 nt, Shigella flexneri 2a str. 2457T
guuuuuuaaaggaaaguaaau

SEQ ID NO: 3850331 - RNA, 16 nt, Shigella flexneri 2a str. 2457T
guuuuuuauacuugca

SEQ ID NO: 3850332 - RNA, 17 nt, Shigella flexneri 2a str. 2457T
guuuuuuuauagcuuau

SEQ ID NO: 3850333 - RNA, 23 nt, Shigella flexneri 2a str. 2457T
guuuuuuuauaucucagauaaau

SEQ ID NO: 3850334 - RNA, 21 nt, Shigella flexneri 2a str. 2457T
uaaaaaaaacgccagcaacac

SEQ ID NO: 3850335 - RNA, 19 nt, Shigella flexneri 2a str. 2457T
uaaaaaaagaaacuaucag

SEQ ID NO: 3850336 - RNA, 10 nt, Shigella flexneri 2a str. 2457T
uaaaaaagaa

SEQ ID NO: 3850337 - RNA, 17 nt, Shigella flexneri 2a str. 2457T
uaaaaaagaaggaaaau

SEQ ID NO: 3850338 - RNA, 18 nt, Shigella flexneri 2a str. 2457T
uaaaaaagaaggaaaaua

SEQ ID NO: 3850339 - RNA, 19 nt, Shigella flexneri 2a str. 2457T
uaaaaaagaaggaaaauac

SEQ ID NO: 3850340 - RNA, 20 nt, Shigella flexneri 2a str. 2457T
uaaaaaagaaggaaaauaca

SEQ ID NO: 3850341 - RNA, 17 nt, Shigella flexneri 2a str. 2457T
uaaaaaaggcugcauaa

SEQ ID NO: 3850342 - RNA, 17 nt, Shigella flexneri 2a str. 2457T
uaaaaaagggugcugca

SEQ ID NO: 3850343 - RNA, 21 nt, Shigella flexneri 2a str. 2457T
uaaaaaaggugcucaaugagc

SEQ ID NO: 3850344 - RNA, 21 nt, Shigella flexneri 2a str. 2457T
uaaaaacagcaucaauaauca

SEQ ID NO: 3850345 - RNA, 14 nt, Shigella flexneri 2a str. 2457T
uaaaaacagccagc

SEQ ID NO: 3850346 - RNA, 15 nt, Shigella flexneri 2a str. 2457T
uaaaaacagccagca

SEQ ID NO: 3850347 - RNA, 23 nt, Shigella flexneri 2a str. 2457T
uaaaaacaguaccagaccaacau

SEQ ID NO: 3850348 - RNA, 14 nt, Shigella flexneri 2a str. 2457T
uaaaaacaucauga

SEQ ID NO: 3850349 - RNA, 11 nt, Shigella flexneri 2a str. 2457T
uaaaaaccaga

SEQ ID NO: 3850350 - RNA, 22 nt, Shigella flexneri 2a str. 2457T
uaaaaacuccgccgcaucuucc

SEQ ID NO: 3850351 - RNA, 15 nt, Shigella flexneri 2a str. 2457T
uaaaaagaaaaucgu

SEQ ID NO: 3850352 - RNA, 12 nt, Shigella flexneri 2a str. 2457T
uaaaaagaaagu

SEQ ID NO: 3850353 - RNA, 20 nt, Shigella flexneri 2a str. 2457T
uaaaaagagauuguauuuaa

SEQ ID NO: 3850354 - RNA, 13 nt, Shigella flexneri 2a str. 2457T
uaaaaagauaaac

SEQ ID NO: 3850355 - RNA, 19 nt, Shigella flexneri 2a str. 2457T
uaaaaagguccuguaauga

SEQ ID NO: 3850356 - RNA, 18 nt, Shigella flexneri 2a str. 2457T
uaaaaaguaagaauugau

SEQ ID NO: 3850357 - RNA, 20 nt, Shigella flexneri 2a str. 2457T
uaaaaaguaagaauugauaa

SEQ ID NO: 3850358 - RNA, 23 nt, Shigella flexneri 2a str. 2457T
uaaaaauacauacgcaaaaaaca

SEQ ID NO: 3850359 - RNA, 13 nt, Shigella flexneri 2a str. 2457T
uaaaaauauuucu

SEQ ID NO: 3850360 - RNA, 14 nt, Shigella flexneri 2a str. 2457T
uaaaaaugaagccu

SEQ ID NO: 3850361 - RNA, 22 nt, Shigella flexneri 2a str. 2457T
uaaaaauuuuaguuuaaacauu

SEQ ID NO: 3850362 - RNA, 23 nt, Shigella flexneri 2a str. 2457T
uaaaacaacggaacgaaaaaaau

SEQ ID NO: 3850363 - RNA, 15 nt, Shigella flexneri 2a str. 2457T
uaaaacaagaucgcc

SEQ ID NO: 3850364 - RNA, 20 nt, Shigella flexneri 2a str. 2457T
uaaaacaggcagcugccaga

SEQ ID NO: 3850365 - RNA, 13 nt, Shigella flexneri 2a str. 2457T
uaaaaccaguaau

SEQ ID NO: 3850366 - RNA, 20 nt, Shigella flexneri 2a str. 2457T
uaaaaccaguaaugaucggc

SEQ ID NO: 3850367 - RNA, 14 nt, Shigella flexneri 2a str. 2457T
uaaaaccccaaaaa

SEQ ID NO: 3850368 - RNA, 20 nt, Shigella flexneri 2a str. 2457T
uaaaaccccgcguacugaau

SEQ ID NO: 3850369 - RNA, 19 nt, Shigella flexneri 2a str. 2457T
uaaaacccuugugcucaau

SEQ ID NO: 3850370 - RNA, 16 nt, Shigella flexneri 2a str. 2457T
uaaaaccgacuuaaaa

SEQ ID NO: 3850371 - RNA, 16 nt, Shigella flexneri 2a str. 2457T
uaaaaccugacaacaa

SEQ ID NO: 3850372 - RNA, 21 nt, Shigella flexneri 2a str. 2457T
uaaagccugcuucaaacgcug

SEQ ID NO: 3850373 - RNA, 19 nt, Shigella flexneri 2a str. 2457T
uaaagcgcgaucgcuaccu

SEQ ID NO: 3850374 - RNA, 23 nt, Shigella flexneri 2a str. 2457T
uaaagcgcgcaguuugucuucaa

SEQ ID NO: 3850375 - RNA, 14 nt, Shigella flexneri 2a str. 2457T
uaaagcggcggugu

SEQ ID NO: 3850376 - RNA, 17 nt, Shigella flexneri 2a str. 2457T
uaaagcuaauaccguuu

SEQ ID NO: 3850377 - RNA, 15 nt, Shigella flexneri 2a str. 2457T
uaaagcugaucacau

SEQ ID NO: 3850378 - RNA, 23 nt, Shigella flexneri 2a str. 2457T
uaaagcugcggauccugagcaaa

SEQ ID NO: 3850379 - RNA, 15 nt, Shigella flexneri 2a str. 2457T
uaaaggaaaguaaau

SEQ ID NO: 3850380 - RNA, 16 nt, Shigella flexneri 2a str. 2457T
uaaaggaaaguaaauu

SEQ ID NO: 3850381 - RNA, 16 nt, Shigella flexneri 2a str. 2457T
uaaaggcaaaaugcca

SEQ ID NO: 3850382 - RNA, 17 nt, Shigella flexneri 2a str. 2457T
uaaaggcggcagaacag

SEQ ID NO: 3850383 - RNA, 17 nt, Shigella flexneri 2a str. 2457T
uaaaggggugaaaaaaa

SEQ ID NO: 3850384 - RNA, 14 nt, Shigella flexneri 2a str. 2457T
uaaaggucaucaca

SEQ ID NO: 3850385 - RNA, 15 nt, Shigella flexneri 2a str. 2457T
uaaaggucaucacau

SEQ ID NO: 3850386 - RNA, 18 nt, Shigella flexneri 2a str. 2457T
uaaaggucgacagcagcc

SEQ ID NO: 3850387 - RNA, 18 nt, Shigella flexneri 2a str. 2457T
uaaaguacgcuuucccuu

SEQ ID NO: 3850388 - RNA, 23 nt, Shigella flexneri 2a str. 2457T
uaaaguacguguggucuuuucaa

SEQ ID NO: 3850389 - RNA, 19 nt, Shigella flexneri 2a str. 2457T
uaaaguagaaauuauuucu

SEQ ID NO: 3850390 - RNA, 16 nt, Shigella flexneri 2a str. 2457T
uaaaguaggccagaua

SEQ ID NO: 3850391 - RNA, 21 nt, Shigella flexneri 2a str. 2457T
uaaaguaggccagauaagacg

SEQ ID NO: 3850392 - RNA, 15 nt, Shigella flexneri 2a str. 2457T
uaaaguauguaauaa

SEQ ID NO: 3850393 - RNA, 19 nt, Shigella flexneri 2a str. 2457T
uaaagucuaaaaaugugcc

SEQ ID NO: 3850394 - RNA, 16 nt, Shigella flexneri 2a str. 2457T
uaaagucuuuguauuu

SEQ ID NO: 3850395 - RNA, 15 nt, Shigella flexneri 2a str. 2457T
uaaagugcaaaaauu

SEQ ID NO: 3850396 - RNA, 20 nt, Shigella flexneri 2a str. 2457T
uaaaguggcggggaucacuc

SEQ ID NO: 3850397 - RNA, 24 nt, Shigella flexneri 2a str. 2457T
uaaaguguuaccccucuauccagc

SEQ ID NO: 3850398 - RNA, 19 nt, Shigella flexneri 2a str. 2457T
uaaaguuaccuguggcgua

SEQ ID NO: 3850399 - RNA, 20 nt, Shigella flexneri 2a str. 2457T
uaaaguuaccuucgaagaac

SEQ ID NO: 3850400 - RNA, 18 nt, Shigella flexneri 2a str. 2457T
uaaaguugcucucaaaga

SEQ ID NO: 3850401 - RNA, 18 nt, Shigella flexneri 2a str. 2457T
uaaaguuuggcugugccc

SEQ ID NO: 3850402 - RNA, 18 nt, Shigella flexneri 2a str. 2457T
uaaauaaaaagagauugu

SEQ ID NO: 3850403 - RNA, 14 nt, Shigella flexneri 2a str. 2457T
uaaauaauaucccc

SEQ ID NO: 3850404 - RNA, 14 nt, Shigella flexneri 2a str. 2457T
uaaauaaucgaucg

SEQ ID NO: 3850405 - RNA, 11 nt, Shigella flexneri 2a str. 2457T
uaaauacagag

SEQ ID NO: 3850406 - RNA, 23 nt, Shigella flexneri 2a str. 2457T
uaaauacgccccacagacccagg

SEQ ID NO: 3850407 - RNA, 21 nt, Shigella flexneri 2a str. 2457T
uaaauacgccucuucauacau

SEQ ID NO: 3850408 - RNA, 19 nt, Shigella flexneri 2a str. 2457T
uaaauagaggaaucugauu

SEQ ID NO: 3850409 - RNA, 16 nt, Shigella flexneri 2a str. 2457T
uaaauaucaucaaaau

SEQ ID NO: 3850410 - RNA, 21 nt, Shigella flexneri 2a str. 2457T
uaaauauugucgauacgccuc

SEQ ID NO: 3850411 - RNA, 20 nt, Shigella flexneri 2a str. 2457T
uaaaucaagcgccgccaguc

SEQ ID NO: 3850412 - RNA, 14 nt, Shigella flexneri 2a str. 2457T
uaaaucacaccauu

SEQ ID NO: 3850413 - RNA, 15 nt, Shigella flexneri 2a str. 2457T
uaaaucacgcuuauc

SEQ ID NO: 3850414 - RNA, 20 nt, Shigella flexneri 2a str. 2457T
uaaaucacgcuuaucgcccu

SEQ ID NO: 3850415 - RNA, 16 nt, Shigella flexneri 2a str. 2457T
uaaaucaucggguuac

SEQ ID NO: 3850416 - RNA, 16 nt, Shigella flexneri 2a str. 2457T
uaaaucccaggcuuca

SEQ ID NO: 3850417 - RNA, 20 nt, Shigella flexneri 2a str. 2457T
uaaaucccgccgcuucacca

SEQ ID NO: 3850418 - RNA, 15 nt, Shigella flexneri 2a str. 2457T
uaaauccugaaacca

SEQ ID NO: 3850419 - RNA, 16 nt, Shigella flexneri 2a str. 2457T
uaaaucgguauuucca

SEQ ID NO: 3850420 - RNA, 15 nt, Shigella flexneri 2a str. 2457T
uaaaucuguucaucu

SEQ ID NO: 3850421 - RNA, 16 nt, Shigella flexneri 2a str. 2457T
uaaaucuuugcccgca

SEQ ID NO: 3850422 - RNA, 16 nt, Shigella flexneri 2a str. 2457T
uaaaugacagcgaaug

SEQ ID NO: 3850423 - RNA, 20 nt, Shigella flexneri 2a str. 2457T
uaaaugcacaauaauauuac

SEQ ID NO: 3850424 - RNA, 17 nt, Shigella flexneri 2a str. 2457T
uaaaugcacccgccaga

SEQ ID NO: 3850425 - RNA, 11 nt, Shigella flexneri 2a str. 2457T
uaaaugccacc

SEQ ID NO: 3850426 - RNA, 19 nt, Shigella flexneri 2a str. 2457T
uaaaugccacugaauaaag

SEQ ID NO: 3850427 - RNA, 18 nt, Shigella flexneri 2a str. 2457T
uaaaugccgcguggccug

SEQ ID NO: 3850428 - RNA, 18 nt, Shigella flexneri 2a str. 2457T
uaaaugccggaagcugca

SEQ ID NO: 3850429 - RNA, 20 nt, Shigella flexneri 2a str. 2457T
uaaaugccuuauccggccua

SEQ ID NO: 3850430 - RNA, 15 nt, Shigella flexneri 2a str. 2457T
uaaaugcugcagcca

SEQ ID NO: 3850431 - RNA, 18 nt, Shigella flexneri 2a str. 2457T
uaaaugcugcagccaggg

SEQ ID NO: 3850432 - RNA, 18 nt, Shigella flexneri 2a str. 2457T
uaaauuaccuguaaagua

SEQ ID NO: 3850433 - RNA, 21 nt, Shigella flexneri 2a str. 2457T
uaaauuacugagcaauugcuc

SEQ ID NO: 3850434 - RNA, 15 nt, Shigella flexneri 2a str. 2457T
uaaauuaucaacuau

SEQ ID NO: 3850435 - RNA, 13 nt, Shigella flexneri 2a str. 2457T
uaaauuccacgcg

SEQ ID NO: 3850436 - RNA, 17 nt, Shigella flexneri 2a str. 2457T
uaaauuccuaaaguugu

SEQ ID NO: 3850437 - RNA, 18 nt, Shigella flexneri 2a str. 2457T
uaaauuccuaaaguuguu

SEQ ID NO: 3850438 - RNA, 21 nt, Shigella flexneri 2a str. 2457T
uaaauucgcugcggacaaaac

SEQ ID NO: 3850439 - RNA, 17 nt, Shigella flexneri 2a str. 2457T
uaaauucuaauguuaaa

SEQ ID NO: 3850440 - RNA, 17 nt, Shigella flexneri 2a str. 2457T
uaaauucucaauaucau

SEQ ID NO: 3850441 - RNA, 19 nt, Shigella flexneri 2a str. 2457T
uaaauugaugugaaaacuc

SEQ ID NO: 3850442 - RNA, 15 nt, Shigella flexneri 2a str. 2457T
uaaauugcagcacac

SEQ ID NO: 3850443 - RNA, 15 nt, Shigella flexneri 2a str. 2457T
uaaauugcagcgauu

SEQ ID NO: 3850444 - RNA, 22 nt, Shigella flexneri 2a str. 2457T
uaaauugcaggguuuuguuuaa

SEQ ID NO: 3850445 - RNA, 17 nt, Shigella flexneri 2a str. 2457T
uaaauugcgauucaccg

SEQ ID NO: 3850446 - RNA, 14 nt, Shigella flexneri 2a str. 2457T
uaaauugcgccaga

SEQ ID NO: 3850447 - RNA, 17 nt, Shigella flexneri 2a str. 2457T
uaaauuuaucaaugcau

SEQ ID NO: 3850448 - RNA, 22 nt, Shigella flexneri 2a str. 2457T
uaaauuucuuaccacugccgca

SEQ ID NO: 3850449 - RNA, 17 nt, Shigella flexneri 2a str. 2457T
uaaauuugccaucucug

SEQ ID NO: 3850450 - RNA, 23 nt, Shigella flexneri 2a str. 2457T
uaaauuuuuucacuguucugaua

SEQ ID NO: 3850451 - RNA, 13 nt, Shigella flexneri 2a str. 2457T
uaacaaaacucag

SEQ ID NO: 3850452 - RNA, 20 nt, Shigella flexneri 2a str. 2457T
uaacaaaauaaccuauaaaa

SEQ ID NO: 3850453 - RNA, 21 nt, Shigella flexneri 2a str. 2457T
uaacaaaaucgugaaaaauca

SEQ ID NO: 3850454 - RNA, 16 nt, Shigella flexneri 2a str. 2457T
uaacaaaugugccauu

SEQ ID NO: 3850455 - RNA, 19 nt, Shigella flexneri 2a str. 2457T
uaacaaaugugccauuaau

SEQ ID NO: 3850456 - RNA, 16 nt, Shigella flexneri 2a str. 2457T
uaacaacgugguuuuc

SEQ ID NO: 3850457 - RNA, 16 nt, Shigella flexneri 2a str. 2457T
uaacaacguuuuucua

SEQ ID NO: 3850458 - RNA, 19 nt, Shigella flexneri 2a str. 2457T
uaacaacguuuuucuaagc

SEQ ID NO: 3850459 - RNA, 22 nt, Shigella flexneri 2a str. 2457T
uaacaacuggcggucaugacga

SEQ ID NO: 3850460 - RNA, 13 nt, Shigella flexneri 2a str. 2457T
uaacaauacaucu

SEQ ID NO: 3850461 - RNA, 19 nt, Shigella flexneri 2a str. 2457T
uaacaauagcgaacagaca

SEQ ID NO: 3850462 - RNA, 14 nt, Shigella flexneri 2a str. 2457T
uaacaauuuaucag

SEQ ID NO: 3850463 - RNA, 14 nt, Shigella flexneri 2a str. 2457T
uaacacacaauuac

SEQ ID NO: 3850464 - RNA, 15 nt, Shigella flexneri 2a str. 2457T
uaacaccacgccugc

SEQ ID NO: 3850465 - RNA, 21 nt, Shigella flexneri 2a str. 2457T
uaacaccgauuuuguaaaaga

SEQ ID NO: 3850466 - RNA, 20 nt, Shigella flexneri 2a str. 2457T
uaacacgcccguuguuuuau

SEQ ID NO: 3850467 - RNA, 17 nt, Shigella flexneri 2a str. 2457T
uaacacgcucuggcagg

SEQ ID NO: 3850468 - RNA, 22 nt, Shigella flexneri 2a str. 2457T
uaacacgcucuggcaggcuuca

SEQ ID NO: 3850469 - RNA, 19 nt, Shigella flexneri 2a str. 2457T
uaacgugcagcuuucccuu

SEQ ID NO: 3850470 - RNA, 23 nt, Shigella flexneri 2a str. 2457T
uaacguggugaaagcauagcucg

SEQ ID NO: 3850471 - RNA, 18 nt, Shigella flexneri 2a str. 2457T
uaacgugucauaacuggu

SEQ ID NO: 3850472 - RNA, 20 nt, Shigella flexneri 2a str. 2457T
uaacguuucuuucaucaggu

SEQ ID NO: 3850473 - RNA, 14 nt, Shigella flexneri 2a str. 2457T
uaacguuuuuaaaa

SEQ ID NO: 3850474 - RNA, 22 nt, Shigella flexneri 2a str. 2457T
uaacguuuuuucgucaguucau

SEQ ID NO: 3850475 - RNA, 17 nt, Shigella flexneri 2a str. 2457T
uaacuaggcgaacauuc

SEQ ID NO: 3850476 - RNA, 24 nt, Shigella flexneri 2a str. 2457T
uaacucaauaccugaugagaugcu

SEQ ID NO: 3850477 - RNA, 12 nt, Shigella flexneri 2a str. 2457T
uaacucaccauc

SEQ ID NO: 3850478 - RNA, 14 nt, Shigella flexneri 2a str. 2457T
uaacucaccaucaa

SEQ ID NO: 3850479 - RNA, 15 nt, Shigella flexneri 2a str. 2457T
uaacucagcauuauu

SEQ ID NO: 3850480 - RNA, 15 nt, Shigella flexneri 2a str. 2457T
uaacucauauaacgc

SEQ ID NO: 3850481 - RNA, 19 nt, Shigella flexneri 2a str. 2457T
uaacuccccgagaaauacu

SEQ ID NO: 3850482 - RNA, 20 nt, Shigella flexneri 2a str. 2457T
uaacucucuuuugcuugaca

SEQ ID NO: 3850483 - RNA, 14 nt, Shigella flexneri 2a str. 2457T
uaacucuuucaaug

SEQ ID NO: 3850484 - RNA, 22 nt, Shigella flexneri 2a str. 2457T
uaacugacuuucguuugaaaac

SEQ ID NO: 3850485 - RNA, 17 nt, Shigella flexneri 2a str. 2457T
uaacugccggaugcggc

SEQ ID NO: 3850486 - RNA, 19 nt, Shigella flexneri 2a str. 2457T
uaacugcgcgauuaucauu

SEQ ID NO: 3850487 - RNA, 19 nt, Shigella flexneri 2a str. 2457T
uaacugcguuucuggcuua

SEQ ID NO: 3850488 - RNA, 14 nt, Shigella flexneri 2a str. 2457T
uaacugcugcucaa

SEQ ID NO: 3850489 - RNA, 15 nt, Shigella flexneri 2a str. 2457T
uaacugcugcucaau

SEQ ID NO: 3850490 - RNA, 17 nt, Shigella flexneri 2a str. 2457T
uaacuggcgggcuuuuu

SEQ ID NO: 3850491 - RNA, 13 nt, Shigella flexneri 2a str. 2457T
uaacugugccaaa

SEQ ID NO: 3850492 - RNA, 19 nt, Shigella flexneri 2a str. 2457T
uaacuguggcguuauggca

SEQ ID NO: 3850493 - RNA, 16 nt, Shigella flexneri 2a str. 2457T
uaacuguucugaaaac

SEQ ID NO: 3850494 - RNA, 15 nt, Shigella flexneri 2a str. 2457T
uaacuuaauaaacau

SEQ ID NO: 3850495 - RNA, 16 nt, Shigella flexneri 2a str. 2457T
uaacuuaauaaacauc

SEQ ID NO: 3850496 - RNA, 16 nt, Shigella flexneri 2a str. 2457T
uaacuuacgcgucaga

SEQ ID NO: 3850497 - RNA, 15 nt, Shigella flexneri 2a str. 2457T
uaacuuaucuguaau

SEQ ID NO: 3850498 - RNA, 19 nt, Shigella flexneri 2a str. 2457T
uaacuucccgcauccagaa

SEQ ID NO: 3850499 - RNA, 23 nt, Shigella flexneri 2a str. 2457T
uaacuucuuuacuggcuuucauu

SEQ ID NO: 3850500 - RNA, 15 nt, Shigella flexneri 2a str. 2457T
uaacuuuaauuuugu

SEQ ID NO: 3850501 - RNA, 21 nt, Shigella flexneri 2a str. 2457T
uaacuuuaauuuugugcagca

SEQ ID NO: 3850502 - RNA, 18 nt, Shigella flexneri 2a str. 2457T
uaagaaaacggaagcuca

SEQ ID NO: 3850503 - RNA, 17 nt, Shigella flexneri 2a str. 2457T
uaagaaaguggcaggcu

SEQ ID NO: 3850504 - RNA, 21 nt, Shigella flexneri 2a str. 2457T
uaagaacuccagcccggaaga

SEQ ID NO: 3850505 - RNA, 20 nt, Shigella flexneri 2a str. 2457T
uaagaacuccugaaagcgaa

SEQ ID NO: 3850506 - RNA, 18 nt, Shigella flexneri 2a str. 2457T
uaagaauugauaaaaaaa

SEQ ID NO: 3850507 - RNA, 13 nt, Shigella flexneri 2a str. 2457T
uaagaauuuuaua

SEQ ID NO: 3850508 - RNA, 22 nt, Shigella flexneri 2a str. 2457T
uaagaauuuuauacuuuuucgc

SEQ ID NO: 3850509 - RNA, 24 nt, Shigella flexneri 2a str. 2457T
uaagaauuuuauacuuuuucgcca

SEQ ID NO: 3850510 - RNA, 14 nt, Shigella flexneri 2a str. 2457T
uaagacaauugaug

SEQ ID NO: 3850511 - RNA, 23 nt, Shigella flexneri 2a str. 2457T
uaagacaccccacagcucuugcu

SEQ ID NO: 3850512 - RNA, 23 nt, Shigella flexneri 2a str. 2457T
uaagacgcgacaagcgucgcauc

SEQ ID NO: 3850513 - RNA, 15 nt, Shigella flexneri 2a str. 2457T
uaagacgcgaccggc

SEQ ID NO: 3850514 - RNA, 22 nt, Shigella flexneri 2a str. 2457T
uaagacgcgccagcgucgcauc

SEQ ID NO: 3850515 - RNA, 20 nt, Shigella flexneri 2a str. 2457T
uaagacuuuuuucaugggua

SEQ ID NO: 3850516 - RNA, 21 nt, Shigella flexneri 2a str. 2457T
uaagagauggaaugagcaucu

SEQ ID NO: 3850517 - RNA, 18 nt, Shigella flexneri 2a str. 2457T
uaagagcgggacaacaaa

SEQ ID NO: 3850518 - RNA, 20 nt, Shigella flexneri 2a str. 2457T
uaagagcuggcaucagcaaa

SEQ ID NO: 3850519 - RNA, 22 nt, Shigella flexneri 2a str. 2457T
uaagagcuggcaucagcaaaca

SEQ ID NO: 3850520 - RNA, 21 nt, Shigella flexneri 2a str. 2457T
uaagaggcuaaccuuauggug

SEQ ID NO: 3850521 - RNA, 14 nt, Shigella flexneri 2a str. 2457T
uaagauaaaagcaa

SEQ ID NO: 3850522 - RNA, 19 nt, Shigella flexneri 2a str. 2457T
uaagauaccccagcgcaag

SEQ ID NO: 3850523 - RNA, 20 nt, Shigella flexneri 2a str. 2457T
uaagaucagaagcguaaccg

SEQ ID NO: 3850524 - RNA, 17 nt, Shigella flexneri 2a str. 2457T
uaagaugcgaguaaaca

SEQ ID NO: 3850525 - RNA, 20 nt, Shigella flexneri 2a str. 2457T
uaagaugcuacaacaucgua

SEQ ID NO: 3850526 - RNA, 14 nt, Shigella flexneri 2a str. 2457T
uaagcaaacagcgc

SEQ ID NO: 3850527 - RNA, 14 nt, Shigella flexneri 2a str. 2457T
uaagcaaaggugcc

SEQ ID NO: 3850528 - RNA, 16 nt, Shigella flexneri 2a str. 2457T
uaagcaacgcgcaccg

SEQ ID NO: 3850529 - RNA, 14 nt, Shigella flexneri 2a str. 2457T
uaagcaacugacug

SEQ ID NO: 3850530 - RNA, 23 nt, Shigella flexneri 2a str. 2457T
uaagcaacugacuggcucuuuuu

SEQ ID NO: 3850531 - RNA, 19 nt, Shigella flexneri 2a str. 2457T
uaagcacuacucuauacag

SEQ ID NO: 3850532 - RNA, 17 nt, Shigella flexneri 2a str. 2457T
uaagcaucuauuauugu

SEQ ID NO: 3850533 - RNA, 16 nt, Shigella flexneri 2a str. 2457T
uaagcaugaauaucaa

SEQ ID NO: 3850534 - RNA, 18 nt, Shigella flexneri 2a str. 2457T
uaagcauuuagcgccggg

SEQ ID NO: 3850535 - RNA, 16 nt, Shigella flexneri 2a str. 2457T
uaagccaaauccagcg

SEQ ID NO: 3850536 - RNA, 20 nt, Shigella flexneri 2a str. 2457T
uaagccaaauccagcgccac

SEQ ID NO: 3850537 - RNA, 23 nt, Shigella flexneri 2a str. 2457T
uaagccaagcgccgccucagcca

SEQ ID NO: 3850538 - RNA, 18 nt, Shigella flexneri 2a str. 2457T
uaagccauguuuaacucc

SEQ ID NO: 3850539 - RNA, 15 nt, Shigella flexneri 2a str. 2457T
uaagccggaucggag

SEQ ID NO: 3850540 - RNA, 22 nt, Shigella flexneri 2a str. 2457T
uaagccggcguaaacgccuaau

SEQ ID NO: 3850541 - RNA, 14 nt, Shigella flexneri 2a str. 2457T
uaagccgugcauag

SEQ ID NO: 3850542 - RNA, 12 nt, Shigella flexneri 2a str. 2457T
uaagccuuccgc

SEQ ID NO: 3850543 - RNA, 15 nt, Shigella flexneri 2a str. 2457T
uaagccuuccgcuga

SEQ ID NO: 3850544 - RNA, 23 nt, Shigella flexneri 2a str. 2457T
uaagccuuccgcugacagcgcgu

SEQ ID NO: 3850545 - RNA, 24 nt, Shigella flexneri 2a str. 2457T
uaagcgacgggcgacaaacgcugu

SEQ ID NO: 3850546 - RNA, 14 nt, Shigella flexneri 2a str. 2457T
uaagcgauucagca

SEQ ID NO: 3850547 - RNA, 14 nt, Shigella flexneri 2a str. 2457T
uaagcgcagcgcau

SEQ ID NO: 3850548 - RNA, 20 nt, Shigella flexneri 2a str. 2457T
uaagcgcagucaccagcauc

SEQ ID NO: 3850549 - RNA, 14 nt, Shigella flexneri 2a str. 2457T
uaagcgccaccguc

SEQ ID NO: 3850550 - RNA, 21 nt, Shigella flexneri 2a str. 2457T
uaagcguaaaaccucacgcau

SEQ ID NO: 3850551 - RNA, 22 nt, Shigella flexneri 2a str. 2457T
uaagcguaagcgcauccggcac

SEQ ID NO: 3850552 - RNA, 14 nt, Shigella flexneri 2a str. 2457T
uaagcguagcgcau

SEQ ID NO: 3850553 - RNA, 19 nt, Shigella flexneri 2a str. 2457T
uaagcguagcgcaucaggc

SEQ ID NO: 3850554 - RNA, 14 nt, Shigella flexneri 2a str. 2457T
uaagcgucgguaca

SEQ ID NO: 3850555 - RNA, 22 nt, Shigella flexneri 2a str. 2457T
uaagcguugugcaucaggcaaa

SEQ ID NO: 3850556 - RNA, 13 nt, Shigella flexneri 2a str. 2457T
uaagcugaugacg

SEQ ID NO: 3850557 - RNA, 20 nt, Shigella flexneri 2a str. 2457T
uaagcuuuccggcaucacau

SEQ ID NO: 3850558 - RNA, 20 nt, Shigella flexneri 2a str. 2457T
uaaggaaaauaaucaugcag

SEQ ID NO: 3850559 - RNA, 17 nt, Shigella flexneri 2a str. 2457T
uaaggaaacuccagccc

SEQ ID NO: 3850560 - RNA, 14 nt, Shigella flexneri 2a str. 2457T
uaaggaauucacgc

SEQ ID NO: 3850561 - RNA, 20 nt, Shigella flexneri 2a str. 2457T
uaaggaauucacgccgcauc

SEQ ID NO: 3850562 - RNA, 12 nt, Shigella flexneri 2a str. 2457T
uaaggauaaaaa

SEQ ID NO: 3850563 - RNA, 17 nt, Shigella flexneri 2a str. 2457T
uaaggcaacgccccuuc

SEQ ID NO: 3850564 - RNA, 20 nt, Shigella flexneri 2a str. 2457T
uaaggcauuuacgccgcauc

SEQ ID NO: 3850565 - RNA, 19 nt, Shigella flexneri 2a str. 2457T
uaaggccgaauaccggcgu

SEQ ID NO: 3850566 - RNA, 22 nt, Shigella flexneri 2a str. 2457T
uaaggcgcgagguuuuccuuca

SEQ ID NO: 3850567 - RNA, 20 nt, Shigella flexneri 2a str. 2457T
uaaggcgcucgugccgcauc

SEQ ID NO: 3850568 - RNA, 20 nt, Shigella flexneri 2a str. 2457T
uaaggcgguuacgccgcauc

SEQ ID NO: 3850569 - RNA, 20 nt, Shigella flexneri 2a str. 2457T
uaaggcguuaacgccgcauc

SEQ ID NO: 3850570 - RNA, 12 nt, Shigella flexneri 2a str. 2457T
uaaggcguucac

SEQ ID NO: 3850571 - RNA, 20 nt, Shigella flexneri 2a str. 2457T
uaaggcguucgcgccgcauc

SEQ ID NO: 3850572 - RNA, 17 nt, Shigella flexneri 2a str. 2457T
uaaggcguuuacgccgc

SEQ ID NO: 3850573 - RNA, 20 nt, Shigella flexneri 2a str. 2457T
uaaggcguuuucgccgcauc

SEQ ID NO: 3850574 - RNA, 15 nt, Shigella flexneri 2a str. 2457T
uaaggcuguucccac

SEQ ID NO: 3850575 - RNA, 14 nt, Shigella flexneri 2a str. 2457T
uaaggcuucaauca

SEQ ID NO: 3850576 - RNA, 16 nt, Shigella flexneri 2a str. 2457T
uaagggcugacaguug

SEQ ID NO: 3850577 - RNA, 17 nt, Shigella flexneri 2a str. 2457T
uaaggguauagaagcca

SEQ ID NO: 3850578 - RNA, 23 nt, Shigella flexneri 2a str. 2457T
uaagggugucuguuaaucgcauu

SEQ ID NO: 3850579 - RNA, 19 nt, Shigella flexneri 2a str. 2457T
uaagguaucgcgaaaaaaa

SEQ ID NO: 3850580 - RNA, 16 nt, Shigella flexneri 2a str. 2457T
uaaggucaccaguuca

SEQ ID NO: 3850581 - RNA, 21 nt, Shigella flexneri 2a str. 2457T
uaaggucagacgaagucaaca

SEQ ID NO: 3850582 - RNA, 16 nt, Shigella flexneri 2a str. 2457T
uaagguccuccagcuc

SEQ ID NO: 3850583 - RNA, 20 nt, Shigella flexneri 2a str. 2457T
uaaggugguagcugcccccg

SEQ ID NO: 3850584 - RNA, 19 nt, Shigella flexneri 2a str. 2457T
uaagguguuuacaccgcau

SEQ ID NO: 3850585 - RNA, 18 nt, Shigella flexneri 2a str. 2457T
uaagguucacuuaaucuc

SEQ ID NO: 3850586 - RNA, 16 nt, Shigella flexneri 2a str. 2457T
uaaguaaugaacuccg

SEQ ID NO: 3850587 - RNA, 14 nt, Shigella flexneri 2a str. 2457T
uaaguacauuaaaa

SEQ ID NO: 3850588 - RNA, 13 nt, Shigella flexneri 2a str. 2457T
uaaguacauuaag

SEQ ID NO: 3850589 - RNA, 15 nt, Shigella flexneri 2a str. 2457T
uaagucagaaagccg

SEQ ID NO: 3850590 - RNA, 18 nt, Shigella flexneri 2a str. 2457T
uaagucggucaaguaauu

SEQ ID NO: 3850591 - RNA, 22 nt, Shigella flexneri 2a str. 2457T
uaagugauacccaucaucgcau

SEQ ID NO: 3850592 - RNA, 17 nt, Shigella flexneri 2a str. 2457T
uaaguggggguuuuauu

SEQ ID NO: 3850593 - RNA, 20 nt, Shigella flexneri 2a str. 2457T
uaaguggggguuuuauuuaa

SEQ ID NO: 3850594 - RNA, 20 nt, Shigella flexneri 2a str. 2457T
uaaguuaauucugagagcau

SEQ ID NO: 3850595 - RNA, 15 nt, Shigella flexneri 2a str. 2457T
uaaguuacacaucau

SEQ ID NO: 3850596 - RNA, 21 nt, Shigella flexneri 2a str. 2457T
uaaguuacauuuuaauaauga

SEQ ID NO: 3850597 - RNA, 19 nt, Shigella flexneri 2a str. 2457T
uaaguucaaguuugcuuca

SEQ ID NO: 3850598 - RNA, 12 nt, Shigella flexneri 2a str. 2457T
uaaguuuaaccu

SEQ ID NO: 3850599 - RNA, 23 nt, Shigella flexneri 2a str. 2457T
uaaguuuaucccaauuaucugga

SEQ ID NO: 3850600 - RNA, 13 nt, Shigella flexneri 2a str. 2457T
uaauaaaaauuuu

SEQ ID NO: 3850601 - RNA, 20 nt, Shigella flexneri 2a str. 2457T
uaauaaaauuuacaguauaa

SEQ ID NO: 3850602 - RNA, 14 nt, Shigella flexneri 2a str. 2457T
uaauaaacaucagc

SEQ ID NO: 3850603 - RNA, 15 nt, Shigella flexneri 2a str. 2457T
uaauaaacaucagcu

SEQ ID NO: 3850604 - RNA, 22 nt, Shigella flexneri 2a str. 2457T
uaauaaagcccccuguuugucu

SEQ ID NO: 3850605 - RNA, 11 nt, Shigella flexneri 2a str. 2457T
uaauaaagcgg

SEQ ID NO: 3850606 - RNA, 23 nt, Shigella flexneri 2a str. 2457T
uaauaaagcggcucauugccauu

SEQ ID NO: 3850607 - RNA, 21 nt, Shigella flexneri 2a str. 2457T
uaauaaaugccggaagcugca

SEQ ID NO: 3850608 - RNA, 20 nt, Shigella flexneri 2a str. 2457T
uaauaaauguggagauaaac

SEQ ID NO: 3850609 - RNA, 21 nt, Shigella flexneri 2a str. 2457T
uaauaaauuugguucaauuug

SEQ ID NO: 3850610 - RNA, 15 nt, Shigella flexneri 2a str. 2457T
uaauaacaauacauc

SEQ ID NO: 3850611 - RNA, 17 nt, Shigella flexneri 2a str. 2457T
uaauaacaauacaucuu

SEQ ID NO: 3850612 - RNA, 19 nt, Shigella flexneri 2a str. 2457T
uaauaaccgaaucccgcug

SEQ ID NO: 3850613 - RNA, 22 nt, Shigella flexneri 2a str. 2457T
uaauaagcgcaaggguaaacgu

SEQ ID NO: 3850614 - RNA, 13 nt, Shigella flexneri 2a str. 2457T
uaauaaucaucac

SEQ ID NO: 3850615 - RNA, 20 nt, Shigella flexneri 2a str. 2457T
uaauaauugccccuuggcau

SEQ ID NO: 3850616 - RNA, 21 nt, Shigella flexneri 2a str. 2457T
uaauacacuaacagaacaaua

SEQ ID NO: 3850617 - RNA, 14 nt, Shigella flexneri 2a str. 2457T
uaauaccagccuuc

SEQ ID NO: 3850618 - RNA, 20 nt, Shigella flexneri 2a str. 2457T
uaauaccagccuucuucauc

SEQ ID NO: 3850619 - RNA, 13 nt, Shigella flexneri 2a str. 2457T
uaauaccaucggc

SEQ ID NO: 3850620 - RNA, 21 nt, Shigella flexneri 2a str. 2457T
uaauaccgacuccguagaacc

SEQ ID NO: 3850621 - RNA, 22 nt, Shigella flexneri 2a str. 2457T
uaauaccgacuccguagaaccu

SEQ ID NO: 3850622 - RNA, 11 nt, Shigella flexneri 2a str. 2457T
uaauaccggau

SEQ ID NO: 3850623 - RNA, 15 nt, Shigella flexneri 2a str. 2457T
uaauaccugccuggu

SEQ ID NO: 3850624 - RNA, 16 nt, Shigella flexneri 2a str. 2457T
uaauacgcaucgacau

SEQ ID NO: 3850625 - RNA, 15 nt, Shigella flexneri 2a str. 2457T
uaauacgcucaucug

SEQ ID NO: 3850626 - RNA, 18 nt, Shigella flexneri 2a str. 2457T
uaauagauccuuuuuccc

SEQ ID NO: 3850627 - RNA, 14 nt, Shigella flexneri 2a str. 2457T
uaauagguaaacau

SEQ ID NO: 3850628 - RNA, 23 nt, Shigella flexneri 2a str. 2457T
uaauaguauuaagccaguucuca

SEQ ID NO: 3850629 - RNA, 13 nt, Shigella flexneri 2a str. 2457T
uaauaguuucuga

SEQ ID NO: 3850630 - RNA, 12 nt, Shigella flexneri 2a str. 2457T
uaauauaaauuc

SEQ ID NO: 3850631 - RNA, 12 nt, Shigella flexneri 2a str. 2457T
uaauauaacagc

SEQ ID NO: 3850632 - RNA, 15 nt, Shigella flexneri 2a str. 2457T
uaauaucaggcauuc

SEQ ID NO: 3850633 - RNA, 23 nt, Shigella flexneri 2a str. 2457T
uaauauccccagccuaagccauu

SEQ ID NO: 3850634 - RNA, 19 nt, Shigella flexneri 2a str. 2457T
uaauauccggugcauucau

SEQ ID NO: 3850635 - RNA, 23 nt, Shigella flexneri 2a str. 2457T
uaauauccugccguuuuuuauuu

SEQ ID NO: 3850636 - RNA, 19 nt, Shigella flexneri 2a str. 2457T
uaauaucgcgcagaaauuc

SEQ ID NO: 3850637 - RNA, 17 nt, Shigella flexneri 2a str. 2457T
uaauaucuuuucuuaac

SEQ ID NO: 3850638 - RNA, 14 nt, Shigella flexneri 2a str. 2457T
uaauaugcaauuca

SEQ ID NO: 3850639 - RNA, 16 nt, Shigella flexneri 2a str. 2457T
uaauaugcaauucaca

SEQ ID NO: 3850640 - RNA, 21 nt, Shigella flexneri 2a str. 2457T
uaauaugcucaacaauaaacu

SEQ ID NO: 3850641 - RNA, 13 nt, Shigella flexneri 2a str. 2457T
uaauaugcugguu

SEQ ID NO: 3850642 - RNA, 19 nt, Shigella flexneri 2a str. 2457T
uaauauucagcaugcauuu

SEQ ID NO: 3850643 - RNA, 15 nt, Shigella flexneri 2a str. 2457T
uaaucaacaaaccaa

SEQ ID NO: 3850644 - RNA, 14 nt, Shigella flexneri 2a str. 2457T
uaaucaauaaaaau

SEQ ID NO: 3850645 - RNA, 19 nt, Shigella flexneri 2a str. 2457T
uaaucaauacgcacaaugc

SEQ ID NO: 3850646 - RNA, 20 nt, Shigella flexneri 2a str. 2457T
uaaucaaucuuuacacacaa

SEQ ID NO: 3850647 - RNA, 19 nt, Shigella flexneri 2a str. 2457T
uaaucacauaauccagaca

SEQ ID NO: 3850648 - RNA, 12 nt, Shigella flexneri 2a str. 2457T
uaaucaccagcg

SEQ ID NO: 3850649 - RNA, 18 nt, Shigella flexneri 2a str. 2457T
uaaucaccaucagcagca

SEQ ID NO: 3850650 - RNA, 21 nt, Shigella flexneri 2a str. 2457T
uaaucacuucuucuuguucau

SEQ ID NO: 3850651 - RNA, 18 nt, Shigella flexneri 2a str. 2457T
uaaucagaucguugaccu

SEQ ID NO: 3850652 - RNA, 12 nt, Shigella flexneri 2a str. 2457T
uaaucagcacaa

SEQ ID NO: 3850653 - RNA, 17 nt, Shigella flexneri 2a str. 2457T
uaaucagcuaauggcug

SEQ ID NO: 3850654 - RNA, 15 nt, Shigella flexneri 2a str. 2457T
uaaucagcuuuucca

SEQ ID NO: 3850655 - RNA, 17 nt, Shigella flexneri 2a str. 2457T
uaaucaggaacuggaag

SEQ ID NO: 3850656 - RNA, 14 nt, Shigella flexneri 2a str. 2457T
uaaucaggcuaucu

SEQ ID NO: 3850657 - RNA, 22 nt, Shigella flexneri 2a str. 2457T
uaaucaguuugaugccugcauc

SEQ ID NO: 3850658 - RNA, 13 nt, Shigella flexneri 2a str. 2457T
uaaucauauuaaa

SEQ ID NO: 3850659 - RNA, 16 nt, Shigella flexneri 2a str. 2457T
uaaucauauuaaauuu

SEQ ID NO: 3850660 - RNA, 15 nt, Shigella flexneri 2a str. 2457T
uaaucaucucuccuu

SEQ ID NO: 3850661 - RNA, 22 nt, Shigella flexneri 2a str. 2457T
uaaucaucuguugugccacauc

SEQ ID NO: 3850662 - RNA, 17 nt, Shigella flexneri 2a str. 2457T
uaaucaugcagcgcuua

SEQ ID NO: 3850663 - RNA, 15 nt, Shigella flexneri 2a str. 2457T
uaauuucauuuugau

SEQ ID NO: 3850664 - RNA, 15 nt, Shigella flexneri 2a str. 2457T
uaauuuccagcagug

SEQ ID NO: 3850665 - RNA, 13 nt, Shigella flexneri 2a str. 2457T
uaauuuuaaauau

SEQ ID NO: 3850666 - RNA, 22 nt, Shigella flexneri 2a str. 2457T
uaauuuuaaauaucaucaaaau

SEQ ID NO: 3850667 - RNA, 18 nt, Shigella flexneri 2a str. 2457T
uaauuuuucaaacucuuc

SEQ ID NO: 3850668 - RNA, 14 nt, Shigella flexneri 2a str. 2457T
uaauuuuuccagca

SEQ ID NO: 3850669 - RNA, 17 nt, Shigella flexneri 2a str. 2457T
uaauuuuuccagcauuu

SEQ ID NO: 3850670 - RNA, 17 nt, Shigella flexneri 2a str. 2457T
uaauuuuuguuguuuaa

SEQ ID NO: 3850671 - RNA, 23 nt, Shigella flexneri 2a str. 2457T
uaauuuuuucgccaacuucgauu

SEQ ID NO: 3850672 - RNA, 15 nt, Shigella flexneri 2a str. 2457T
uaauuuuuugcgcca

SEQ ID NO: 3850673 - RNA, 23 nt, Shigella flexneri 2a str. 2457T
uacaaaaccacacuucuucagcc

SEQ ID NO: 3850674 - RNA, 16 nt, Shigella flexneri 2a str. 2457T
uacaaaagcaauaauu

SEQ ID NO: 3850675 - RNA, 16 nt, Shigella flexneri 2a str. 2457T
uacaaaaucuauugca

SEQ ID NO: 3850676 - RNA, 18 nt, Shigella flexneri 2a str. 2457T
uacaaaauuuaacaccau

SEQ ID NO: 3850677 - RNA, 13 nt, Shigella flexneri 2a str. 2457T
uacaaacccagcc

SEQ ID NO: 3850678 - RNA, 19 nt, Shigella flexneri 2a str. 2457T
uacaaagggcuaacgugca

SEQ ID NO: 3850679 - RNA, 21 nt, Shigella flexneri 2a str. 2457T
uacaaagggcuaacgugcagg

SEQ ID NO: 3850680 - RNA, 20 nt, Shigella flexneri 2a str. 2457T
uacaaaguguuguucuagcg

SEQ ID NO: 3850681 - RNA, 18 nt, Shigella flexneri 2a str. 2457T
uacaacaucguaucuggc

SEQ ID NO: 3850682 - RNA, 19 nt, Shigella flexneri 2a str. 2457T
uacaaccaccccaccuuac

SEQ ID NO: 3850683 - RNA, 18 nt, Shigella flexneri 2a str. 2457T
uacaacgcaauauccgcc

SEQ ID NO: 3850684 - RNA, 20 nt, Shigella flexneri 2a str. 2457T
uacaacgccguuuaauauua

SEQ ID NO: 3850685 - RNA, 14 nt, Shigella flexneri 2a str. 2457T
uacaacgcuuuauc

SEQ ID NO: 3850686 - RNA, 16 nt, Shigella flexneri 2a str. 2457T
uacaacguauugaaau

SEQ ID NO: 3850687 - RNA, 19 nt, Shigella flexneri 2a str. 2457T
uacaacucgcuuaagccau

SEQ ID NO: 3850688 - RNA, 20 nt, Shigella flexneri 2a str. 2457T
uacaacucgcuuaagccauc

SEQ ID NO: 3850689 - RNA, 20 nt, Shigella flexneri 2a str. 2457T
uacaacugcuuuuugcucuc

SEQ ID NO: 3850690 - RNA, 12 nt, Shigella flexneri 2a str. 2457T
uacaacuuucuc

SEQ ID NO: 3850691 - RNA, 21 nt, Shigella flexneri 2a str. 2457T
uacaagaaccaaagaaaucag

SEQ ID NO: 3850692 - RNA, 17 nt, Shigella flexneri 2a str. 2457T
uacaagaaucaugccaa

SEQ ID NO: 3850693 - RNA, 19 nt, Shigella flexneri 2a str. 2457T
uacaagcaacuugcaaucu

SEQ ID NO: 3850694 - RNA, 18 nt, Shigella flexneri 2a str. 2457T
uacaaggccaauccagcc

SEQ ID NO: 3850695 - RNA, 19 nt, Shigella flexneri 2a str. 2457T
uacaaucaccguuucuggu

SEQ ID NO: 3850696 - RNA, 19 nt, Shigella flexneri 2a str. 2457T
uacaaucacgauagccaga

SEQ ID NO: 3850697 - RNA, 16 nt, Shigella flexneri 2a str. 2457T
uacaaucaggccaauc

SEQ ID NO: 3850698 - RNA, 18 nt, Shigella flexneri 2a str. 2457T
uacaaucguuucaugcca

SEQ ID NO: 3850699 - RNA, 16 nt, Shigella flexneri 2a str. 2457T
uacaaucugcgcugga

SEQ ID NO: 3850700 - RNA, 22 nt, Shigella flexneri 2a str. 2457T
uacaauguuucugcaauauauu

SEQ ID NO: 3850701 - RNA, 17 nt, Shigella flexneri 2a str. 2457T
uacaauuuacguuuuaa

SEQ ID NO: 3850702 - RNA, 17 nt, Shigella flexneri 2a str. 2457T
uacacacuuuccaggcg

SEQ ID NO: 3850703 - RNA, 14 nt, Shigella flexneri 2a str. 2457T
uacacauuaucuca

SEQ ID NO: 3850704 - RNA, 14 nt, Shigella flexneri 2a str. 2457T
uacaccaaagcggu

SEQ ID NO: 3850705 - RNA, 20 nt, Shigella flexneri 2a str. 2457T
uacaccauuaacuacaccgu

SEQ ID NO: 3850706 - RNA, 22 nt, Shigella flexneri 2a str. 2457T
uacaccuuaaggcuguucccac

SEQ ID NO: 3850707 - RNA, 17 nt, Shigella flexneri 2a str. 2457T
uacacgcggcuguugcc

SEQ ID NO: 3850708 - RNA, 18 nt, Shigella flexneri 2a str. 2457T
uacacuaaacgucucacu

SEQ ID NO: 3850709 - RNA, 20 nt, Shigella flexneri 2a str. 2457T
uacacucuuucaauauugca

SEQ ID NO: 3850710 - RNA, 20 nt, Shigella flexneri 2a str. 2457T
uacacuucacacacuuuuau

SEQ ID NO: 3850711 - RNA, 21 nt, Shigella flexneri 2a str. 2457T
uacacuucacacacuuuuauu

SEQ ID NO: 3850712 - RNA, 17 nt, Shigella flexneri 2a str. 2457T
uacagaaaugaaaaaau

SEQ ID NO: 3850713 - RNA, 18 nt, Shigella flexneri 2a str. 2457T
uacagaaaugaaaaaaua

SEQ ID NO: 3850714 - RNA, 13 nt, Shigella flexneri 2a str. 2457T
uacagaagcaccg

SEQ ID NO: 3850715 - RNA, 16 nt, Shigella flexneri 2a str. 2457T
uacagacagauaaaau

SEQ ID NO: 3850716 - RNA, 17 nt, Shigella flexneri 2a str. 2457T
uacagacucaaaccaau

SEQ ID NO: 3850717 - RNA, 21 nt, Shigella flexneri 2a str. 2457T
uacagacucaaaccaauggca

SEQ ID NO: 3850718 - RNA, 16 nt, Shigella flexneri 2a str. 2457T
uacagagggcaggcaa

SEQ ID NO: 3850719 - RNA, 14 nt, Shigella flexneri 2a str. 2457T
uacagauccgccau

SEQ ID NO: 3850720 - RNA, 22 nt, Shigella flexneri 2a str. 2457T
uacagauccgccauuucuccuc

SEQ ID NO: 3850721 - RNA, 20 nt, Shigella flexneri 2a str. 2457T
uacagaucgugcaucuccug

SEQ ID NO: 3850722 - RNA, 20 nt, Shigella flexneri 2a str. 2457T
uacagcagccauucauucaa

SEQ ID NO: 3850723 - RNA, 16 nt, Shigella flexneri 2a str. 2457T
uacagcagguguuacc

SEQ ID NO: 3850724 - RNA, 19 nt, Shigella flexneri 2a str. 2457T
uacagcaguacgccgagaa

SEQ ID NO: 3850725 - RNA, 21 nt, Shigella flexneri 2a str. 2457T
uacagcaguacgccgagaaua

SEQ ID NO: 3850726 - RNA, 13 nt, Shigella flexneri 2a str. 2457T
uacagcauugucu

SEQ ID NO: 3850727 - RNA, 18 nt, Shigella flexneri 2a str. 2457T
uacagcauugucucccac

SEQ ID NO: 3850728 - RNA, 13 nt, Shigella flexneri 2a str. 2457T
uacagccaaauca

SEQ ID NO: 3850729 - RNA, 18 nt, Shigella flexneri 2a str. 2457T
uacagccaaaucaucagu

SEQ ID NO: 3850730 - RNA, 23 nt, Shigella flexneri 2a str. 2457T
uacagccagccagcaccaggcuu

SEQ ID NO: 3850731 - RNA, 18 nt, Shigella flexneri 2a str. 2457T
uacagcccagacaaauga

SEQ ID NO: 3850732 - RNA, 15 nt, Shigella flexneri 2a str. 2457T
uacagccgccagaca

SEQ ID NO: 3850733 - RNA, 16 nt, Shigella flexneri 2a str. 2457T
uacagccgccagacaa

SEQ ID NO: 3850734 - RNA, 16 nt, Shigella flexneri 2a str. 2457T
uacagccggacccaca

SEQ ID NO: 3850735 - RNA, 19 nt, Shigella flexneri 2a str. 2457T
uacagcgcccgccagcacc

SEQ ID NO: 3850736 - RNA, 14 nt, Shigella flexneri 2a str. 2457T
uacagcgcgggcug

SEQ ID NO: 3850737 - RNA, 16 nt, Shigella flexneri 2a str. 2457T
uacagcggacagccau

SEQ ID NO: 3850738 - RNA, 16 nt, Shigella flexneri 2a str. 2457T
uacagcggccagccau

SEQ ID NO: 3850739 - RNA, 15 nt, Shigella flexneri 2a str. 2457T
uacagcguuaaaaag

SEQ ID NO: 3850740 - RNA, 13 nt, Shigella flexneri 2a str. 2457T
uacagcucgguau

SEQ ID NO: 3850741 - RNA, 21 nt, Shigella flexneri 2a str. 2457T
uacagcucgguauggccuuuc

SEQ ID NO: 3850742 - RNA, 16 nt, Shigella flexneri 2a str. 2457T
uacagcucucacuuau

SEQ ID NO: 3850743 - RNA, 13 nt, Shigella flexneri 2a str. 2457T
uacagcuggagua

SEQ ID NO: 3850744 - RNA, 18 nt, Shigella flexneri 2a str. 2457T
uacagcuuaaucaccagc

SEQ ID NO: 3850745 - RNA, 13 nt, Shigella flexneri 2a str. 2457T
uacagcuuagcgc

SEQ ID NO: 3850746 - RNA, 16 nt, Shigella flexneri 2a str. 2457T
uacagcuuagcgccuu

SEQ ID NO: 3850747 - RNA, 22 nt, Shigella flexneri 2a str. 2457T
uacagcuucacgcgccagcuua

SEQ ID NO: 3850748 - RNA, 15 nt, Shigella flexneri 2a str. 2457T
uacaggaacagccac

SEQ ID NO: 3850749 - RNA, 14 nt, Shigella flexneri 2a str. 2457T
uacaggauauauuu

SEQ ID NO: 3850750 - RNA, 20 nt, Shigella flexneri 2a str. 2457T
uacaggauauauuucaucaa

SEQ ID NO: 3850751 - RNA, 17 nt, Shigella flexneri 2a str. 2457T
uacaggcugguuucucu

SEQ ID NO: 3850752 - RNA, 13 nt, Shigella flexneri 2a str. 2457T
uacaggugcucgc

SEQ ID NO: 3850753 - RNA, 17 nt, Shigella flexneri 2a str. 2457T
uacauaaagucuuucuu

SEQ ID NO: 3850754 - RNA, 20 nt, Shigella flexneri 2a str. 2457T
uacauacccuugaucaccgu

SEQ ID NO: 3850755 - RNA, 17 nt, Shigella flexneri 2a str. 2457T
uacauacgcaaaaaaca

SEQ ID NO: 3850756 - RNA, 20 nt, Shigella flexneri 2a str. 2457T
uacauacgcaaaaaacauug

SEQ ID NO: 3850757 - RNA, 20 nt, Shigella flexneri 2a str. 2457T
uacauacuuaaauaaugcuu

SEQ ID NO: 3850758 - RNA, 21 nt, Shigella flexneri 2a str. 2457T
uacauagccaucugccugauc

SEQ ID NO: 3850759 - RNA, 20 nt, Shigella flexneri 2a str. 2457T
uacauagcgccucuuuauaa

SEQ ID NO: 3850760 - RNA, 21 nt, Shigella flexneri 2a str. 2457T
uaccgccgccaugcuugaagg

SEQ ID NO: 3850761 - RNA, 16 nt, Shigella flexneri 2a str. 2457T
uaccgccucgcggcag

SEQ ID NO: 3850762 - RNA, 16 nt, Shigella flexneri 2a str. 2457T
uaccgccuuacgcugc

SEQ ID NO: 3850763 - RNA, 14 nt, Shigella flexneri 2a str. 2457T
uaccgcgaagaaca

SEQ ID NO: 3850764 - RNA, 13 nt, Shigella flexneri 2a str. 2457T
uaccgcgguugau

SEQ ID NO: 3850765 - RNA, 17 nt, Shigella flexneri 2a str. 2457T
uaccgcguaauacauca

SEQ ID NO: 3850766 - RNA, 14 nt, Shigella flexneri 2a str. 2457T
uaccgcuccgggua

SEQ ID NO: 3850767 - RNA, 21 nt, Shigella flexneri 2a str. 2457T
uaccgcugcuggcguugucau

SEQ ID NO: 3850768 - RNA, 21 nt, Shigella flexneri 2a str. 2457T
uaccggaacacucuuccaguc

SEQ ID NO: 3850769 - RNA, 15 nt, Shigella flexneri 2a str. 2457T
uaccggacacacuuc

SEQ ID NO: 3850770 - RNA, 13 nt, Shigella flexneri 2a str. 2457T
uaccggacuccag

SEQ ID NO: 3850771 - RNA, 16 nt, Shigella flexneri 2a str. 2457T
uaccggcacuggcagc

SEQ ID NO: 3850772 - RNA, 13 nt, Shigella flexneri 2a str. 2457T
uaccgggaugcug

SEQ ID NO: 3850773 - RNA, 14 nt, Shigella flexneri 2a str. 2457T
uaccgggcguccug

SEQ ID NO: 3850774 - RNA, 17 nt, Shigella flexneri 2a str. 2457T
uaccggugacagcggug

SEQ ID NO: 3850775 - RNA, 17 nt, Shigella flexneri 2a str. 2457T
uaccggugccagcaacu

SEQ ID NO: 3850776 - RNA, 15 nt, Shigella flexneri 2a str. 2457T
uaccgucgaugccaa

SEQ ID NO: 3850777 - RNA, 23 nt, Shigella flexneri 2a str. 2457T
uaccgucgccagacgcagcaagg

SEQ ID NO: 3850778 - RNA, 18 nt, Shigella flexneri 2a str. 2457T
uaccgucuguaaccagau

SEQ ID NO: 3850779 - RNA, 15 nt, Shigella flexneri 2a str. 2457T
uaccgugcacaauau

SEQ ID NO: 3850780 - RNA, 15 nt, Shigella flexneri 2a str. 2457T
uaccguucucuuuaa

SEQ ID NO: 3850781 - RNA, 19 nt, Shigella flexneri 2a str. 2457T
uaccuaaaagcacgccaga

SEQ ID NO: 3850782 - RNA, 21 nt, Shigella flexneri 2a str. 2457T
uaccuaaaagcacgccagaca

SEQ ID NO: 3850783 - RNA, 16 nt, Shigella flexneri 2a str. 2457T
uaccuaaggaauccag

SEQ ID NO: 3850784 - RNA, 20 nt, Shigella flexneri 2a str. 2457T
uaccuaaggaauccagcgac

SEQ ID NO: 3850785 - RNA, 14 nt, Shigella flexneri 2a str. 2457T
uaccucauggagau

SEQ ID NO: 3850786 - RNA, 15 nt, Shigella flexneri 2a str. 2457T
uaccuccuucacagu

SEQ ID NO: 3850787 - RNA, 14 nt, Shigella flexneri 2a str. 2457T
uaccugacagcaga

SEQ ID NO: 3850788 - RNA, 15 nt, Shigella flexneri 2a str. 2457T
uaccugacagcagag

SEQ ID NO: 3850789 - RNA, 17 nt, Shigella flexneri 2a str. 2457T
uaccugacagcagagca

SEQ ID NO: 3850790 - RNA, 22 nt, Shigella flexneri 2a str. 2457T
uaccugagucaucaacucaguu

SEQ ID NO: 3850791 - RNA, 12 nt, Shigella flexneri 2a str. 2457T
uaccugaugaga

SEQ ID NO: 3850792 - RNA, 20 nt, Shigella flexneri 2a str. 2457T
uaccugccuggcaguggaau

SEQ ID NO: 3850793 - RNA, 11 nt, Shigella flexneri 2a str. 2457T
uaccugccugu

SEQ ID NO: 3850794 - RNA, 17 nt, Shigella flexneri 2a str. 2457T
uaccugguccuucaucu

SEQ ID NO: 3850795 - RNA, 20 nt, Shigella flexneri 2a str. 2457T
uaccuguauaaacuauccug

SEQ ID NO: 3850796 - RNA, 22 nt, Shigella flexneri 2a str. 2457T
uaccuguauaaacuauccugug

SEQ ID NO: 3850797 - RNA, 18 nt, Shigella flexneri 2a str. 2457T
uaccuguccguuuucagu

SEQ ID NO: 3850798 - RNA, 13 nt, Shigella flexneri 2a str. 2457T
uaccuuaaccguu

SEQ ID NO: 3850799 - RNA, 19 nt, Shigella flexneri 2a str. 2457T
uaccuuaacgguaucuuuc

SEQ ID NO: 3850800 - RNA, 22 nt, Shigella flexneri 2a str. 2457T
uaccuuaucaaucucagcaaga

SEQ ID NO: 3850801 - RNA, 13 nt, Shigella flexneri 2a str. 2457T
uaccuucauuugc

SEQ ID NO: 3850802 - RNA, 17 nt, Shigella flexneri 2a str. 2457T
uaccuuccacaauggca

SEQ ID NO: 3850803 - RNA, 12 nt, Shigella flexneri 2a str. 2457T
uaccuuccuuau

SEQ ID NO: 3850804 - RNA, 22 nt, Shigella flexneri 2a str. 2457T
uaccuucgccgcccagccagcc

SEQ ID NO: 3850805 - RNA, 19 nt, Shigella flexneri 2a str. 2457T
uacgaauucuaucaugcaa

SEQ ID NO: 3850806 - RNA, 16 nt, Shigella flexneri 2a str. 2457T
uacgaccgcaugcggu

SEQ ID NO: 3850807 - RNA, 23 nt, Shigella flexneri 2a str. 2457T
uacgacgcuucaguucagcgaua

SEQ ID NO: 3850808 - RNA, 20 nt, Shigella flexneri 2a str. 2457T
uacgacgugccgcagcuucu

SEQ ID NO: 3850809 - RNA, 22 nt, Shigella flexneri 2a str. 2457T
uacgagucgccuguacuuccug

SEQ ID NO: 3850810 - RNA, 18 nt, Shigella flexneri 2a str. 2457T
uacgauacagaagcaccg

SEQ ID NO: 3850811 - RNA, 16 nt, Shigella flexneri 2a str. 2457T
uacgauccugguggua

SEQ ID NO: 3850812 - RNA, 19 nt, Shigella flexneri 2a str. 2457T
uacgauuaacguaaggcgc

SEQ ID NO: 3850813 - RNA, 11 nt, Shigella flexneri 2a str. 2457T
uacgcaaaaaa

SEQ ID NO: 3850814 - RNA, 13 nt, Shigella flexneri 2a str. 2457T
uacgcaaaaaaca

SEQ ID NO: 3850815 - RNA, 14 nt, Shigella flexneri 2a str. 2457T
uacgcaaaaaacau

SEQ ID NO: 3850816 - RNA, 14 nt, Shigella flexneri 2a str. 2457T
uacgcaagucauac

SEQ ID NO: 3850817 - RNA, 21 nt, Shigella flexneri 2a str. 2457T
uacgcaaucaaaaucuccugc

SEQ ID NO: 3850818 - RNA, 21 nt, Shigella flexneri 2a str. 2457T
uacgcaccgcuccaucgccuu

SEQ ID NO: 3850819 - RNA, 17 nt, Shigella flexneri 2a str. 2457T
uacgcagacguaagcgg

SEQ ID NO: 3850820 - RNA, 15 nt, Shigella flexneri 2a str. 2457T
uacgcauaaaaccag

SEQ ID NO: 3850821 - RNA, 22 nt, Shigella flexneri 2a str. 2457T
uacgcauaaaaccagcaaacag

SEQ ID NO: 3850822 - RNA, 13 nt, Shigella flexneri 2a str. 2457T
uacgccacaucau

SEQ ID NO: 3850823 - RNA, 14 nt, Shigella flexneri 2a str. 2457T
uacgccagacugcg

SEQ ID NO: 3850824 - RNA, 13 nt, Shigella flexneri 2a str. 2457T
uacgccagucacg

SEQ ID NO: 3850825 - RNA, 20 nt, Shigella flexneri 2a str. 2457T
uacgccagucacggugcagc

SEQ ID NO: 3850826 - RNA, 15 nt, Shigella flexneri 2a str. 2457T
uacgccaucccaacu

SEQ ID NO: 3850827 - RNA, 14 nt, Shigella flexneri 2a str. 2457T
uacgccaucgccag

SEQ ID NO: 3850828 - RNA, 17 nt, Shigella flexneri 2a str. 2457T
uacgccggugucauggc

SEQ ID NO: 3850829 - RNA, 16 nt, Shigella flexneri 2a str. 2457T
uacgccucacagggcu

SEQ ID NO: 3850830 - RNA, 18 nt, Shigella flexneri 2a str. 2457T
uacgcgcaauauccugcg

SEQ ID NO: 3850831 - RNA, 15 nt, Shigella flexneri 2a str. 2457T
uacgcgccccuucca

SEQ ID NO: 3850832 - RNA, 17 nt, Shigella flexneri 2a str. 2457T
uacgcgcccgcgcagcu

SEQ ID NO: 3850833 - RNA, 20 nt, Shigella flexneri 2a str. 2457T
uacgcgggucguugaucggc

SEQ ID NO: 3850834 - RNA, 22 nt, Shigella flexneri 2a str. 2457T
uacgcguaaaacagccagcgcu

SEQ ID NO: 3850835 - RNA, 18 nt, Shigella flexneri 2a str. 2457T
uacgcguacacuuuccug

SEQ ID NO: 3850836 - RNA, 11 nt, Shigella flexneri 2a str. 2457T
uacgcuaccau

SEQ ID NO: 3850837 - RNA, 19 nt, Shigella flexneri 2a str. 2457T
uacgcucacgcgcugccuc

SEQ ID NO: 3850838 - RNA, 16 nt, Shigella flexneri 2a str. 2457T
uacgcucaucaggccu

SEQ ID NO: 3850839 - RNA, 16 nt, Shigella flexneri 2a str. 2457T
uacgcucaucggcaua

SEQ ID NO: 3850840 - RNA, 20 nt, Shigella flexneri 2a str. 2457T
uacgcucaucggcauacagc

SEQ ID NO: 3850841 - RNA, 12 nt, Shigella flexneri 2a str. 2457T
uacgcucaucug

SEQ ID NO: 3850842 - RNA, 12 nt, Shigella flexneri 2a str. 2457T
uacgcucggcaa

SEQ ID NO: 3850843 - RNA, 20 nt, Shigella flexneri 2a str. 2457T
uacgcugaaaguucaugauu

SEQ ID NO: 3850844 - RNA, 13 nt, Shigella flexneri 2a str. 2457T
uacgcuuaucagg

SEQ ID NO: 3850845 - RNA, 17 nt, Shigella flexneri 2a str. 2457T
uacgcuuaucaggccua

SEQ ID NO: 3850846 - RNA, 16 nt, Shigella flexneri 2a str. 2457T
uacgcuugccggacau

SEQ ID NO: 3850847 - RNA, 12 nt, Shigella flexneri 2a str. 2457T
uacgcuuuucuu

SEQ ID NO: 3850848 - RNA, 19 nt, Shigella flexneri 2a str. 2457T
uacggacgcggcauuuuua

SEQ ID NO: 3850849 - RNA, 19 nt, Shigella flexneri 2a str. 2457T
uacggauauguuuacuucu

SEQ ID NO: 3850850 - RNA, 15 nt, Shigella flexneri 2a str. 2457T
uacggcacuccucuu

SEQ ID NO: 3850851 - RNA, 12 nt, Shigella flexneri 2a str. 2457T
uacggcagugaa

SEQ ID NO: 3850852 - RNA, 14 nt, Shigella flexneri 2a str. 2457T
uacggcggucuggc

SEQ ID NO: 3850853 - RNA, 20 nt, Shigella flexneri 2a str. 2457T
uacggcguuucacuucugag

SEQ ID NO: 3850854 - RNA, 14 nt, Shigella flexneri 2a str. 2457T
uacggcuaaaaaaa

SEQ ID NO: 3850855 - RNA, 23 nt, Shigella flexneri 2a str. 2457T
uacggcuaaaaaaagccgccauc

SEQ ID NO: 3850856 - RNA, 20 nt, Shigella flexneri 2a str. 2457T
uacggcuccgcaagcgaaug

SEQ ID NO: 3850857 - RNA, 16 nt, Shigella flexneri 2a str. 2457T
uacgggcaaucuccug

SEQ ID NO: 3850858 - RNA, 12 nt, Shigella flexneri 2a str. 2457T
uagaaagggaag

SEQ ID NO: 3850859 - RNA, 15 nt, Shigella flexneri 2a str. 2457T
uagaaauuauuucuu

SEQ ID NO: 3850860 - RNA, 22 nt, Shigella flexneri 2a str. 2457T
uagaaauuccuaugcaacaacu

SEQ ID NO: 3850861 - RNA, 16 nt, Shigella flexneri 2a str. 2457T
uagaaccuaagaacca

SEQ ID NO: 3850862 - RNA, 17 nt, Shigella flexneri 2a str. 2457T
uagaacguaacaguaca

SEQ ID NO: 3850863 - RNA, 18 nt, Shigella flexneri 2a str. 2457T
uagaacuauaauugcuuu

SEQ ID NO: 3850864 - RNA, 16 nt, Shigella flexneri 2a str. 2457T
uagaagccagucagcu

SEQ ID NO: 3850865 - RNA, 19 nt, Shigella flexneri 2a str. 2457T
uagaagccauuaaacacca

SEQ ID NO: 3850866 - RNA, 23 nt, Shigella flexneri 2a str. 2457T
uagaagccauuaaacaccaguac

SEQ ID NO: 3850867 - RNA, 15 nt, Shigella flexneri 2a str. 2457T
uagaauaaggcuuuc

SEQ ID NO: 3850868 - RNA, 16 nt, Shigella flexneri 2a str. 2457T
uagaauaccugccugu

SEQ ID NO: 3850869 - RNA, 19 nt, Shigella flexneri 2a str. 2457T
uagaauccgcgacuggcau

SEQ ID NO: 3850870 - RNA, 17 nt, Shigella flexneri 2a str. 2457T
uagaaugccaaguaaua

SEQ ID NO: 3850871 - RNA, 19 nt, Shigella flexneri 2a str. 2457T
uagaauggcaucagaagga

SEQ ID NO: 3850872 - RNA, 20 nt, Shigella flexneri 2a str. 2457T
uagaauuguaaucuauugaa

SEQ ID NO: 3850873 - RNA, 15 nt, Shigella flexneri 2a str. 2457T
uagacaguucuuccu

SEQ ID NO: 3850874 - RNA, 16 nt, Shigella flexneri 2a str. 2457T
uagacaucuuuauaug

SEQ ID NO: 3850875 - RNA, 21 nt, Shigella flexneri 2a str. 2457T
uagacaucuuuauaugcaacg

SEQ ID NO: 3850876 - RNA, 16 nt, Shigella flexneri 2a str. 2457T
uagaccggaccugucg

SEQ ID NO: 3850877 - RNA, 14 nt, Shigella flexneri 2a str. 2457T
uagaccugauacau

SEQ ID NO: 3850878 - RNA, 15 nt, Shigella flexneri 2a str. 2457T
uagaccugauacaua

SEQ ID NO: 3850879 - RNA, 16 nt, Shigella flexneri 2a str. 2457T
uagaccugauacauag

SEQ ID NO: 3850880 - RNA, 20 nt, Shigella flexneri 2a str. 2457T
uagacgaacguuuaauaaaa

SEQ ID NO: 3850881 - RNA, 15 nt, Shigella flexneri 2a str. 2457T
uagacgaugaaaaag

SEQ ID NO: 3850882 - RNA, 16 nt, Shigella flexneri 2a str. 2457T
uagacguucaguuccg

SEQ ID NO: 3850883 - RNA, 12 nt, Shigella flexneri 2a str. 2457T
uagacugcagcg

SEQ ID NO: 3850884 - RNA, 20 nt, Shigella flexneri 2a str. 2457T
uagacuuuagcgcaaucgca

SEQ ID NO: 3850885 - RNA, 17 nt, Shigella flexneri 2a str. 2457T
uagacuuuagucaucag

SEQ ID NO: 3850886 - RNA, 22 nt, Shigella flexneri 2a str. 2457T
uagagaaaguaaaccaccaguc

SEQ ID NO: 3850887 - RNA, 13 nt, Shigella flexneri 2a str. 2457T
uagagaauuaauc

SEQ ID NO: 3850888 - RNA, 21 nt, Shigella flexneri 2a str. 2457T
uagagaucucucuugcuauca

SEQ ID NO: 3850889 - RNA, 15 nt, Shigella flexneri 2a str. 2457T
uagagcaaccaccug

SEQ ID NO: 3850890 - RNA, 19 nt, Shigella flexneri 2a str. 2457T
uagagcacaucacucauaa

SEQ ID NO: 3850891 - RNA, 21 nt, Shigella flexneri 2a str. 2457T
uagagcgcggcgcaggcaaua

SEQ ID NO: 3850892 - RNA, 19 nt, Shigella flexneri 2a str. 2457T
uagagcuugugcaccagcu

SEQ ID NO: 3850893 - RNA, 16 nt, Shigella flexneri 2a str. 2457T
uagagggaauggcaga

SEQ ID NO: 3850894 - RNA, 14 nt, Shigella flexneri 2a str. 2457T
uagagguuauaaau

SEQ ID NO: 3850895 - RNA, 15 nt, Shigella flexneri 2a str. 2457T
uagauaaaaaugaag

SEQ ID NO: 3850896 - RNA, 15 nt, Shigella flexneri 2a str. 2457T
uagauaaaacacucu

SEQ ID NO: 3850897 - RNA, 13 nt, Shigella flexneri 2a str. 2457T
uagauaagcaagg

SEQ ID NO: 3850898 - RNA, 22 nt, Shigella flexneri 2a str. 2457T
uagauacccggauacaacucgc

SEQ ID NO: 3850899 - RNA, 13 nt, Shigella flexneri 2a str. 2457T
uagauagcguucu

SEQ ID NO: 3850900 - RNA, 16 nt, Shigella flexneri 2a str. 2457T
uagauagcguucuuua

SEQ ID NO: 3850901 - RNA, 15 nt, Shigella flexneri 2a str. 2457T
uagaucuaaaugcca

SEQ ID NO: 3850902 - RNA, 15 nt, Shigella flexneri 2a str. 2457T
uagaucuugauuuac

SEQ ID NO: 3850903 - RNA, 16 nt, Shigella flexneri 2a str. 2457T
uagaugugcaguuccu

SEQ ID NO: 3850904 - RNA, 19 nt, Shigella flexneri 2a str. 2457T
uagaugugcaguuccugca

SEQ ID NO: 3850905 - RNA, 18 nt, Shigella flexneri 2a str. 2457T
uagaugugggcaaucuca

SEQ ID NO: 3850906 - RNA, 22 nt, Shigella flexneri 2a str. 2457T
uagaugugggcaaucucacucc

SEQ ID NO: 3850907 - RNA, 17 nt, Shigella flexneri 2a str. 2457T
uagauuuacgcucuucc

SEQ ID NO: 3850908 - RNA, 23 nt, Shigella flexneri 2a str. 2457T
uagauuuacuauuauuuuucaua

SEQ ID NO: 3850909 - RNA, 17 nt, Shigella flexneri 2a str. 2457T
uagauuugguggggcuu

SEQ ID NO: 3850910 - RNA, 12 nt, Shigella flexneri 2a str. 2457T
uagcaaaacaau

SEQ ID NO: 3850911 - RNA, 13 nt, Shigella flexneri 2a str. 2457T
uagcaaaacaauu

SEQ ID NO: 3850912 - RNA, 20 nt, Shigella flexneri 2a str. 2457T
uagcaaacuaucuguguaau

SEQ ID NO: 3850913 - RNA, 11 nt, Shigella flexneri 2a str. 2457T
uagcaaggcga

SEQ ID NO: 3850914 - RNA, 17 nt, Shigella flexneri 2a str. 2457T
uagcaaugccuucugga

SEQ ID NO: 3850915 - RNA, 18 nt, Shigella flexneri 2a str. 2457T
uagcacacggauauugcu

SEQ ID NO: 3850916 - RNA, 14 nt, Shigella flexneri 2a str. 2457T
uagcacgucaucug

SEQ ID NO: 3850917 - RNA, 16 nt, Shigella flexneri 2a str. 2457T
uagcacgucaucugca

SEQ ID NO: 3850918 - RNA, 14 nt, Shigella flexneri 2a str. 2457T
uagcacugcuuucc

SEQ ID NO: 3850919 - RNA, 15 nt, Shigella flexneri 2a str. 2457T
uagcagcuccgccag

SEQ ID NO: 3850920 - RNA, 14 nt, Shigella flexneri 2a str. 2457T
uagcagcuuucagc

SEQ ID NO: 3850921 - RNA, 15 nt, Shigella flexneri 2a str. 2457T
uagcagcuuucagca

SEQ ID NO: 3850922 - RNA, 14 nt, Shigella flexneri 2a str. 2457T
uagcaguuccagca

SEQ ID NO: 3850923 - RNA, 17 nt, Shigella flexneri 2a str. 2457T
uagcaguuccagcaucu

SEQ ID NO: 3850924 - RNA, 14 nt, Shigella flexneri 2a str. 2457T
uagcaucagcgcca

SEQ ID NO: 3850925 - RNA, 18 nt, Shigella flexneri 2a str. 2457T
uagcaucccaauacccgc

SEQ ID NO: 3850926 - RNA, 23 nt, Shigella flexneri 2a str. 2457T
uagcauccccauaucccggaagg

SEQ ID NO: 3850927 - RNA, 21 nt, Shigella flexneri 2a str. 2457T
uagcauugaugcguuagauga

SEQ ID NO: 3850928 - RNA, 18 nt, Shigella flexneri 2a str. 2457T
uagccaaagcaccacucc

SEQ ID NO: 3850929 - RNA, 18 nt, Shigella flexneri 2a str. 2457T
uagccaaucauucccauu

SEQ ID NO: 3850930 - RNA, 16 nt, Shigella flexneri 2a str. 2457T
uagccacauugcugca

SEQ ID NO: 3850931 - RNA, 12 nt, Shigella flexneri 2a str. 2457T
uagccagcagag

SEQ ID NO: 3850932 - RNA, 13 nt, Shigella flexneri 2a str. 2457T
uagccagcagagc

SEQ ID NO: 3850933 - RNA, 14 nt, Shigella flexneri 2a str. 2457T
uagccagccucauc

SEQ ID NO: 3850934 - RNA, 12 nt, Shigella flexneri 2a str. 2457T
uagccagcgcac

SEQ ID NO: 3850935 - RNA, 16 nt, Shigella flexneri 2a str. 2457T
uagccaguaccacccc

SEQ ID NO: 3850936 - RNA, 15 nt, Shigella flexneri 2a str. 2457T
uagcccggauagcgu

SEQ ID NO: 3850937 - RNA, 20 nt, Shigella flexneri 2a str. 2457T
uagcccugucgaggccaauu

SEQ ID NO: 3850938 - RNA, 23 nt, Shigella flexneri 2a str. 2457T
uagccgaccgcaaggaagccuga

SEQ ID NO: 3850939 - RNA, 16 nt, Shigella flexneri 2a str. 2457T
uagccgaucaggcuuu

SEQ ID NO: 3850940 - RNA, 17 nt, Shigella flexneri 2a str. 2457T
uagccgaugccgcugca

SEQ ID NO: 3850941 - RNA, 23 nt, Shigella flexneri 2a str. 2457T
uagccgccagcucuuuaaacacg

SEQ ID NO: 3850942 - RNA, 12 nt, Shigella flexneri 2a str. 2457T
uagccgcccugu

SEQ ID NO: 3850943 - RNA, 13 nt, Shigella flexneri 2a str. 2457T
uagccgcgcaguu

SEQ ID NO: 3850944 - RNA, 15 nt, Shigella flexneri 2a str. 2457T
uagccgcuucugcag

SEQ ID NO: 3850945 - RNA, 22 nt, Shigella flexneri 2a str. 2457T
uagccgcuuuuucugcgcacac

SEQ ID NO: 3850946 - RNA, 23 nt, Shigella flexneri 2a str. 2457T
uagccgcuuuuucugcgcacaca

SEQ ID NO: 3850947 - RNA, 23 nt, Shigella flexneri 2a str. 2457T
uagccucacuuuguacugacccc

SEQ ID NO: 3850948 - RNA, 16 nt, Shigella flexneri 2a str. 2457T
uagccucccugccucc

SEQ ID NO: 3850949 - RNA, 14 nt, Shigella flexneri 2a str. 2457T
uagccucucggcau

SEQ ID NO: 3850950 - RNA, 12 nt, Shigella flexneri 2a str. 2457T
uagccugccaga

SEQ ID NO: 3850951 - RNA, 19 nt, Shigella flexneri 2a str. 2457T
uagccuucaucagaugaag

SEQ ID NO: 3850952 - RNA, 23 nt, Shigella flexneri 2a str. 2457T
uagcgaaaucuuccggcguggcg

SEQ ID NO: 3850953 - RNA, 19 nt, Shigella flexneri 2a str. 2457T
uagcgaauaaaguagaaau

SEQ ID NO: 3850954 - RNA, 21 nt, Shigella flexneri 2a str. 2457T
uagcgaauaaucccggcacca

SEQ ID NO: 3850955 - RNA, 14 nt, Shigella flexneri 2a str. 2457T
uagcgaauuuuucg

SEQ ID NO: 3850956 - RNA, 14 nt, Shigella flexneri 2a str. 2457T
uauaaauaaaaaga

SEQ ID NO: 3850957 - RNA, 13 nt, Shigella flexneri 2a str. 2457T
uauaaauaaaaau

SEQ ID NO: 3850958 - RNA, 21 nt, Shigella flexneri 2a str. 2457T
uauaaauaaaaauugaaucac

SEQ ID NO: 3850959 - RNA, 11 nt, Shigella flexneri 2a str. 2457T
uauaaauauuu

SEQ ID NO: 3850960 - RNA, 22 nt, Shigella flexneri 2a str. 2457T
uauaacccccuccuuuuaucau

SEQ ID NO: 3850961 - RNA, 16 nt, Shigella flexneri 2a str. 2457T
uauaaccgccauagaa

SEQ ID NO: 3850962 - RNA, 18 nt, Shigella flexneri 2a str. 2457T
uauaaccggcaacagaac

SEQ ID NO: 3850963 - RNA, 20 nt, Shigella flexneri 2a str. 2457T
uauaaccggcaacagaacgc

SEQ ID NO: 3850964 - RNA, 16 nt, Shigella flexneri 2a str. 2457T
uauaaccugaauauua

SEQ ID NO: 3850965 - RNA, 16 nt, Shigella flexneri 2a str. 2457T
uauaagcguuacgcag

SEQ ID NO: 3850966 - RNA, 20 nt, Shigella flexneri 2a str. 2457T
uauaauaucuuuucuuaaca

SEQ ID NO: 3850967 - RNA, 17 nt, Shigella flexneri 2a str. 2457T
uauaaucacucaaaaua

SEQ ID NO: 3850968 - RNA, 21 nt, Shigella flexneri 2a str. 2457T
uauaauccccggccuuugauu

SEQ ID NO: 3850969 - RNA, 22 nt, Shigella flexneri 2a str. 2457T
uauaaucgcgaauagcuucaaa

SEQ ID NO: 3850970 - RNA, 17 nt, Shigella flexneri 2a str. 2457T
uauacaaccagauaacc

SEQ ID NO: 3850971 - RNA, 22 nt, Shigella flexneri 2a str. 2457T
uauacaggcggguaaucuuucc

SEQ ID NO: 3850972 - RNA, 19 nt, Shigella flexneri 2a str. 2457T
uauacauaaagucuuucuu

SEQ ID NO: 3850973 - RNA, 18 nt, Shigella flexneri 2a str. 2457T
uauacaucgcuuuccagg

SEQ ID NO: 3850974 - RNA, 20 nt, Shigella flexneri 2a str. 2457T
uauaccauggaagaaaaaua

SEQ ID NO: 3850975 - RNA, 21 nt, Shigella flexneri 2a str. 2457T
uauaccauggaagaaaaauau

SEQ ID NO: 3850976 - RNA, 22 nt, Shigella flexneri 2a str. 2457T
uauaccauggaagaaaaauaua

SEQ ID NO: 3850977 - RNA, 18 nt, Shigella flexneri 2a str. 2457T
uauacccuucucagcagu

SEQ ID NO: 3850978 - RNA, 15 nt, Shigella flexneri 2a str. 2457T
uauaccgcaucagca

SEQ ID NO: 3850979 - RNA, 19 nt, Shigella flexneri 2a str. 2457T
uauaccucugcgauggcga

SEQ ID NO: 3850980 - RNA, 22 nt, Shigella flexneri 2a str. 2457T
uauacgccucacagggcucuua

SEQ ID NO: 3850981 - RNA, 22 nt, Shigella flexneri 2a str. 2457T
uauacgcgccacaucagacuca

SEQ ID NO: 3850982 - RNA, 16 nt, Shigella flexneri 2a str. 2457T
uauacgcucaucggca

SEQ ID NO: 3850983 - RNA, 17 nt, Shigella flexneri 2a str. 2457T
uauacgcucaucggcau

SEQ ID NO: 3850984 - RNA, 20 nt, Shigella flexneri 2a str. 2457T
uauacggcguuuccagcucg

SEQ ID NO: 3850985 - RNA, 14 nt, Shigella flexneri 2a str. 2457T
uauacucagucagg

SEQ ID NO: 3850986 - RNA, 15 nt, Shigella flexneri 2a str. 2457T
uauagaaugccugug

SEQ ID NO: 3850987 - RNA, 15 nt, Shigella flexneri 2a str. 2457T
uauagagauuuuucc

SEQ ID NO: 3850988 - RNA, 15 nt, Shigella flexneri 2a str. 2457T
uauagcacccgccag

SEQ ID NO: 3850989 - RNA, 21 nt, Shigella flexneri 2a str. 2457T
uauagccagccucauccauac

SEQ ID NO: 3850990 - RNA, 16 nt, Shigella flexneri 2a str. 2457T
uauagcgggaaauacu

SEQ ID NO: 3850991 - RNA, 22 nt, Shigella flexneri 2a str. 2457T
uauagcguugcccgauugguuc

SEQ ID NO: 3850992 - RNA, 17 nt, Shigella flexneri 2a str. 2457T
uauagcuggauuuucau

SEQ ID NO: 3850993 - RNA, 14 nt, Shigella flexneri 2a str. 2457T
uauagcuuauucuu

SEQ ID NO: 3850994 - RNA, 21 nt, Shigella flexneri 2a str. 2457T
uauaguaucguuaaauucuaa

SEQ ID NO: 3850995 - RNA, 13 nt, Shigella flexneri 2a str. 2457T
uauagucaauaag

SEQ ID NO: 3850996 - RNA, 16 nt, Shigella flexneri 2a str. 2457T
uauagucaauaagucc

SEQ ID NO: 3850997 - RNA, 22 nt, Shigella flexneri 2a str. 2457T
uauagugauccugcauacugac

SEQ ID NO: 3850998 - RNA, 21 nt, Shigella flexneri 2a str. 2457T
uauagugugcaaucacuuccu

SEQ ID NO: 3850999 - RNA, 19 nt, Shigella flexneri 2a str. 2457T
uauauaaaaaaacaaugcg

SEQ ID NO: 3851000 - RNA, 18 nt, Shigella flexneri 2a str. 2457T
uauauaacggaacauuag

SEQ ID NO: 3851001 - RNA, 14 nt, Shigella flexneri 2a str. 2457T
uauauaauuaaaaa

SEQ ID NO: 3851002 - RNA, 18 nt, Shigella flexneri 2a str. 2457T
uauauaauuaaaaauagu

SEQ ID NO: 3851003 - RNA, 13 nt, Shigella flexneri 2a str. 2457T
uauaucagugaua

SEQ ID NO: 3851004 - RNA, 16 nt, Shigella flexneri 2a str. 2457T
uauauccgaaaaagga

SEQ ID NO: 3851005 - RNA, 19 nt, Shigella flexneri 2a str. 2457T
uauaucucagauaaaugca

SEQ ID NO: 3851006 - RNA, 22 nt, Shigella flexneri 2a str. 2457T
uauaucucagauaaaugcaaac

SEQ ID NO: 3851007 - RNA, 20 nt, Shigella flexneri 2a str. 2457T
uauauuacgaauauaaauau

SEQ ID NO: 3851008 - RNA, 23 nt, Shigella flexneri 2a str. 2457T
uauauuacgaauauaaauauuuu

SEQ ID NO: 3851009 - RNA, 21 nt, Shigella flexneri 2a str. 2457T
uauauuccccggucagcagca

SEQ ID NO: 3851010 - RNA, 18 nt, Shigella flexneri 2a str. 2457T
uauauucguuacuggcau

SEQ ID NO: 3851011 - RNA, 13 nt, Shigella flexneri 2a str. 2457T
uauauucucuuuu

SEQ ID NO: 3851012 - RNA, 14 nt, Shigella flexneri 2a str. 2457T
uauauucucuuuug

SEQ ID NO: 3851013 - RNA, 16 nt, Shigella flexneri 2a str. 2457T
uauauugaauuugcau

SEQ ID NO: 3851014 - RNA, 13 nt, Shigella flexneri 2a str. 2457T
uauauuucaucaa

SEQ ID NO: 3851015 - RNA, 14 nt, Shigella flexneri 2a str. 2457T
uauauuuccagaca

SEQ ID NO: 3851016 - RNA, 21 nt, Shigella flexneri 2a str. 2457T
uauauuuccagacaucuguua

SEQ ID NO: 3851017 - RNA, 13 nt, Shigella flexneri 2a str. 2457T
uauauuuuuaaau

SEQ ID NO: 3851018 - RNA, 15 nt, Shigella flexneri 2a str. 2457T
uauauuuuuaaauau

SEQ ID NO: 3851019 - RNA, 20 nt, Shigella flexneri 2a str. 2457T
uauauuuuuaaauauaaaac

SEQ ID NO: 3851020 - RNA, 12 nt, Shigella flexneri 2a str. 2457T
uaucaaacguga

SEQ ID NO: 3851021 - RNA, 14 nt, Shigella flexneri 2a str. 2457T
uaucaaucaccgcu

SEQ ID NO: 3851022 - RNA, 18 nt, Shigella flexneri 2a str. 2457T
uaucaaucucagcaagag

SEQ ID NO: 3851023 - RNA, 17 nt, Shigella flexneri 2a str. 2457T
uaucaaucuucucuucc

SEQ ID NO: 3851024 - RNA, 16 nt, Shigella flexneri 2a str. 2457T
uaucacaaauucuggc

SEQ ID NO: 3851025 - RNA, 12 nt, Shigella flexneri 2a str. 2457T
uaucacauccag

SEQ ID NO: 3851026 - RNA, 14 nt, Shigella flexneri 2a str. 2457T
uaucacauccagcg

SEQ ID NO: 3851027 - RNA, 14 nt, Shigella flexneri 2a str. 2457T
uaucaccaaucaca

SEQ ID NO: 3851028 - RNA, 15 nt, Shigella flexneri 2a str. 2457T
uaucaccaaugauaa

SEQ ID NO: 3851029 - RNA, 16 nt, Shigella flexneri 2a str. 2457T
uaucaccccaucagcc

SEQ ID NO: 3851030 - RNA, 18 nt, Shigella flexneri 2a str. 2457T
uaucacgaugcuaaaaac

SEQ ID NO: 3851031 - RNA, 20 nt, Shigella flexneri 2a str. 2457T
uaucacgaugcuaaaaacau

SEQ ID NO: 3851032 - RNA, 13 nt, Shigella flexneri 2a str. 2457T
uaucacucugccg

SEQ ID NO: 3851033 - RNA, 17 nt, Shigella flexneri 2a str. 2457T
uaucagaagauuaagag

SEQ ID NO: 3851034 - RNA, 13 nt, Shigella flexneri 2a str. 2457T
uaucagacaccag

SEQ ID NO: 3851035 - RNA, 21 nt, Shigella flexneri 2a str. 2457T
uaucagagauucuuuuccuuu

SEQ ID NO: 3851036 - RNA, 17 nt, Shigella flexneri 2a str. 2457T
uaucagauuggcuucau

SEQ ID NO: 3851037 - RNA, 17 nt, Shigella flexneri 2a str. 2457T
uaucagcaaagcaaauu

SEQ ID NO: 3851038 - RNA, 20 nt, Shigella flexneri 2a str. 2457T
uaucagcaaagcaaauuuug

SEQ ID NO: 3851039 - RNA, 12 nt, Shigella flexneri 2a str. 2457T
uaucagcaacuc

SEQ ID NO: 3851040 - RNA, 15 nt, Shigella flexneri 2a str. 2457T
uaucagcaacuggca

SEQ ID NO: 3851041 - RNA, 19 nt, Shigella flexneri 2a str. 2457T
uaucagcaacuggcaaaaa

SEQ ID NO: 3851042 - RNA, 13 nt, Shigella flexneri 2a str. 2457T
uaucagccugcaa

SEQ ID NO: 3851043 - RNA, 19 nt, Shigella flexneri 2a str. 2457T
uaucagcgccaccacaaaa

SEQ ID NO: 3851044 - RNA, 15 nt, Shigella flexneri 2a str. 2457T
uaucaggcaaaaaaa

SEQ ID NO: 3851045 - RNA, 16 nt, Shigella flexneri 2a str. 2457T
uaucaggcaaaaaaau

SEQ ID NO: 3851046 - RNA, 21 nt, Shigella flexneri 2a str. 2457T
uaucaggcauucuuuuucauu

SEQ ID NO: 3851047 - RNA, 18 nt, Shigella flexneri 2a str. 2457T
uaucaggccuacaacucc

SEQ ID NO: 3851048 - RNA, 17 nt, Shigella flexneri 2a str. 2457T
uaucaggccuacaaugu

SEQ ID NO: 3851049 - RNA, 20 nt, Shigella flexneri 2a str. 2457T
uaucagggagucuugcugga

SEQ ID NO: 3851050 - RNA, 15 nt, Shigella flexneri 2a str. 2457T
uaucaguauacgcca

SEQ ID NO: 3851051 - RNA, 22 nt, Shigella flexneri 2a str. 2457T
uaucaguucagaagcugaagca

SEQ ID NO: 3851052 - RNA, 20 nt, Shigella flexneri 2a str. 2457T
uaucaguuggggaaaaguug

SEQ ID NO: 3851053 - RNA, 14 nt, Shigella flexneri 2a str. 2457T
uaugaugaaacuga

SEQ ID NO: 3851054 - RNA, 23 nt, Shigella flexneri 2a str. 2457T
uaugaugaaggcuaaugcugucg

SEQ ID NO: 3851055 - RNA, 17 nt, Shigella flexneri 2a str. 2457T
uaugauuaauuacacca

SEQ ID NO: 3851056 - RNA, 15 nt, Shigella flexneri 2a str. 2457T
uaugauuuaaaaaau

SEQ ID NO: 3851057 - RNA, 14 nt, Shigella flexneri 2a str. 2457T
uaugcacucagucg

SEQ ID NO: 3851058 - RNA, 15 nt, Shigella flexneri 2a str. 2457T
uaugcagugcaucca

SEQ ID NO: 3851059 - RNA, 18 nt, Shigella flexneri 2a str. 2457T
uaugcagugcauccagca

SEQ ID NO: 3851060 - RNA, 20 nt, Shigella flexneri 2a str. 2457T
uaugcauaauuugcggaauu

SEQ ID NO: 3851061 - RNA, 14 nt, Shigella flexneri 2a str. 2457T
uaugccacgugagc

SEQ ID NO: 3851062 - RNA, 15 nt, Shigella flexneri 2a str. 2457T
uaugccagccccagc

SEQ ID NO: 3851063 - RNA, 22 nt, Shigella flexneri 2a str. 2457T
uaugccaugcgauggcggcagc

SEQ ID NO: 3851064 - RNA, 13 nt, Shigella flexneri 2a str. 2457T
uaugcccagggca

SEQ ID NO: 3851065 - RNA, 17 nt, Shigella flexneri 2a str. 2457T
uaugcccagggcaaugu

SEQ ID NO: 3851066 - RNA, 15 nt, Shigella flexneri 2a str. 2457T
uaugccggaugcgga

SEQ ID NO: 3851067 - RNA, 14 nt, Shigella flexneri 2a str. 2457T
uaugccucuuucag

SEQ ID NO: 3851068 - RNA, 14 nt, Shigella flexneri 2a str. 2457T
uaugccuggcauuu

SEQ ID NO: 3851069 - RNA, 17 nt, Shigella flexneri 2a str. 2457T
uaugccuguccucuuca

SEQ ID NO: 3851070 - RNA, 19 nt, Shigella flexneri 2a str. 2457T
uaugcgaccauaugaauau

SEQ ID NO: 3851071 - RNA, 13 nt, Shigella flexneri 2a str. 2457T
uaugcgccacagg

SEQ ID NO: 3851072 - RNA, 17 nt, Shigella flexneri 2a str. 2457T
uaugcgcgucagagauu

SEQ ID NO: 3851073 - RNA, 14 nt, Shigella flexneri 2a str. 2457T
uaugcgcuggcagu

SEQ ID NO: 3851074 - RNA, 17 nt, Shigella flexneri 2a str. 2457T
uaugcgggcguuuugcu

SEQ ID NO: 3851075 - RNA, 21 nt, Shigella flexneri 2a str. 2457T
uaugcggugccauuaaaccaa

SEQ ID NO: 3851076 - RNA, 22 nt, Shigella flexneri 2a str. 2457T
uaugcugaaugaucggauaucu

SEQ ID NO: 3851077 - RNA, 13 nt, Shigella flexneri 2a str. 2457T
uaugcuuaauguu

SEQ ID NO: 3851078 - RNA, 22 nt, Shigella flexneri 2a str. 2457T
uauggaucagaguugaaaaaca

SEQ ID NO: 3851079 - RNA, 19 nt, Shigella flexneri 2a str. 2457T
uauggcaaucguggucugg

SEQ ID NO: 3851080 - RNA, 21 nt, Shigella flexneri 2a str. 2457T
uauggcaaucuuccucgccag

SEQ ID NO: 3851081 - RNA, 19 nt, Shigella flexneri 2a str. 2457T
uauggccguuuuccccaac

SEQ ID NO: 3851082 - RNA, 17 nt, Shigella flexneri 2a str. 2457T
uauggcgaacuggucug

SEQ ID NO: 3851083 - RNA, 13 nt, Shigella flexneri 2a str. 2457T
uauggcucgccau

SEQ ID NO: 3851084 - RNA, 16 nt, Shigella flexneri 2a str. 2457T
uauggucggucaggag

SEQ ID NO: 3851085 - RNA, 21 nt, Shigella flexneri 2a str. 2457T
uauggucggucaggagcaacu

SEQ ID NO: 3851086 - RNA, 15 nt, Shigella flexneri 2a str. 2457T
uauggucguuugccu

SEQ ID NO: 3851087 - RNA, 19 nt, Shigella flexneri 2a str. 2457T
uauggugagcgauauuuau

SEQ ID NO: 3851088 - RNA, 14 nt, Shigella flexneri 2a str. 2457T
uauggugguaacua

SEQ ID NO: 3851089 - RNA, 15 nt, Shigella flexneri 2a str. 2457T
uaugguucacuugcu

SEQ ID NO: 3851090 - RNA, 16 nt, Shigella flexneri 2a str. 2457T
uaugucguuauauaaa

SEQ ID NO: 3851091 - RNA, 14 nt, Shigella flexneri 2a str. 2457T
uaugugaaauuuau

SEQ ID NO: 3851092 - RNA, 19 nt, Shigella flexneri 2a str. 2457T
uaugugacuggaaaucaaa

SEQ ID NO: 3851093 - RNA, 15 nt, Shigella flexneri 2a str. 2457T
uaugugaucuuuauc

SEQ ID NO: 3851094 - RNA, 19 nt, Shigella flexneri 2a str. 2457T
uaugugcuucuaccaugau

SEQ ID NO: 3851095 - RNA, 18 nt, Shigella flexneri 2a str. 2457T
uauguggaaacagugauu

SEQ ID NO: 3851096 - RNA, 22 nt, Shigella flexneri 2a str. 2457T
uauguucagaaagcgccagcaa

SEQ ID NO: 3851097 - RNA, 15 nt, Shigella flexneri 2a str. 2457T
uauguucagauaaug

SEQ ID NO: 3851098 - RNA, 21 nt, Shigella flexneri 2a str. 2457T
uauguucagauaaugcccgau

SEQ ID NO: 3851099 - RNA, 22 nt, Shigella flexneri 2a str. 2457T
uauguucaggauauuuauauuu

SEQ ID NO: 3851100 - RNA, 13 nt, Shigella flexneri 2a str. 2457T
uauguugaaaagc

SEQ ID NO: 3851101 - RNA, 16 nt, Shigella flexneri 2a str. 2457T
uauguuuaucaggcca

SEQ ID NO: 3851102 - RNA, 13 nt, Shigella flexneri 2a str. 2457T
uauuaaaccaccc

SEQ ID NO: 3851103 - RNA, 14 nt, Shigella flexneri 2a str. 2457T
uauuaaauuuuuuc

SEQ ID NO: 3851104 - RNA, 14 nt, Shigella flexneri 2a str. 2457T
uauuaacggcucug

SEQ ID NO: 3851105 - RNA, 19 nt, Shigella flexneri 2a str. 2457T
uauuaacucagcauuauuu

SEQ ID NO: 3851106 - RNA, 15 nt, Shigella flexneri 2a str. 2457T
uauuaacuuaauaaa

SEQ ID NO: 3851107 - RNA, 14 nt, Shigella flexneri 2a str. 2457T
uauuaagaauuuua

SEQ ID NO: 3851108 - RNA, 21 nt, Shigella flexneri 2a str. 2457T
uauuaagcagacggcucaucu

SEQ ID NO: 3851109 - RNA, 18 nt, Shigella flexneri 2a str. 2457T
uauuaaggguaaaaggau

SEQ ID NO: 3851110 - RNA, 17 nt, Shigella flexneri 2a str. 2457T
uauuaaucgugaaaagc

SEQ ID NO: 3851111 - RNA, 14 nt, Shigella flexneri 2a str. 2457T
uauuaauuaugaug

SEQ ID NO: 3851112 - RNA, 22 nt, Shigella flexneri 2a str. 2457T
uauuacgagucacaaacaucau

SEQ ID NO: 3851113 - RNA, 21 nt, Shigella flexneri 2a str. 2457T
uauuacguuccuuuacgguga

SEQ ID NO: 3851114 - RNA, 12 nt, Shigella flexneri 2a str. 2457T
uauuacugcaac

SEQ ID NO: 3851115 - RNA, 20 nt, Shigella flexneri 2a str. 2457T
uauuacugcguauuuccugc

SEQ ID NO: 3851116 - RNA, 20 nt, Shigella flexneri 2a str. 2457T
uauuagccgccagcucuuua

SEQ ID NO: 3851117 - RNA, 14 nt, Shigella flexneri 2a str. 2457T
uauuaguacucauu

SEQ ID NO: 3851118 - RNA, 12 nt, Shigella flexneri 2a str. 2457T
uauuauagacau

SEQ ID NO: 3851119 - RNA, 20 nt, Shigella flexneri 2a str. 2457T
uauuauagacaucuuuauau

SEQ ID NO: 3851120 - RNA, 13 nt, Shigella flexneri 2a str. 2457T
uauuauauauaau

SEQ ID NO: 3851121 - RNA, 16 nt, Shigella flexneri 2a str. 2457T
uauuaucuaucgcguu

SEQ ID NO: 3851122 - RNA, 20 nt, Shigella flexneri 2a str. 2457T
uauuaucugaucaauauaga

SEQ ID NO: 3851123 - RNA, 19 nt, Shigella flexneri 2a str. 2457T
uauuaucuucaucgauacu

SEQ ID NO: 3851124 - RNA, 20 nt, Shigella flexneri 2a str. 2457T
uauuaugcgaccauaugaau

SEQ ID NO: 3851125 - RNA, 16 nt, Shigella flexneri 2a str. 2457T
uauuauucauaaugcc

SEQ ID NO: 3851126 - RNA, 16 nt, Shigella flexneri 2a str. 2457T
uauuauuugcuaucgc

SEQ ID NO: 3851127 - RNA, 13 nt, Shigella flexneri 2a str. 2457T
uauucaaaggcuc

SEQ ID NO: 3851128 - RNA, 16 nt, Shigella flexneri 2a str. 2457T
uauucaacgucacugg

SEQ ID NO: 3851129 - RNA, 17 nt, Shigella flexneri 2a str. 2457T
uauucaaucucuucaca

SEQ ID NO: 3851130 - RNA, 21 nt, Shigella flexneri 2a str. 2457T
uauucaccgcaucaauauuaa

SEQ ID NO: 3851131 - RNA, 20 nt, Shigella flexneri 2a str. 2457T
uauucacgaaucuauucauu

SEQ ID NO: 3851132 - RNA, 22 nt, Shigella flexneri 2a str. 2457T
uauucacgaaucuauucauuua

SEQ ID NO: 3851133 - RNA, 21 nt, Shigella flexneri 2a str. 2457T
uauucacuacggucacgccac

SEQ ID NO: 3851134 - RNA, 12 nt, Shigella flexneri 2a str. 2457T
uauucagcagca

SEQ ID NO: 3851135 - RNA, 14 nt, Shigella flexneri 2a str. 2457T
uauucauaaaugcu

SEQ ID NO: 3851136 - RNA, 11 nt, Shigella flexneri 2a str. 2457T
uauucaucugg

SEQ ID NO: 3851137 - RNA, 12 nt, Shigella flexneri 2a str. 2457T
uauucaugcccu

SEQ ID NO: 3851138 - RNA, 16 nt, Shigella flexneri 2a str. 2457T
uauucauggugaauau

SEQ ID NO: 3851139 - RNA, 14 nt, Shigella flexneri 2a str. 2457T
uauucauuuauguu

SEQ ID NO: 3851140 - RNA, 17 nt, Shigella flexneri 2a str. 2457T
uauuccauccugcucaa

SEQ ID NO: 3851141 - RNA, 21 nt, Shigella flexneri 2a str. 2457T
uauucccaacgcgccaccgac

SEQ ID NO: 3851142 - RNA, 11 nt, Shigella flexneri 2a str. 2457T
uauuccccaga

SEQ ID NO: 3851143 - RNA, 20 nt, Shigella flexneri 2a str. 2457T
uauucccguauuacugagau

SEQ ID NO: 3851144 - RNA, 19 nt, Shigella flexneri 2a str. 2457T
uauuccgcgugaaaugcca

SEQ ID NO: 3851145 - RNA, 16 nt, Shigella flexneri 2a str. 2457T
uauuccugacccagca

SEQ ID NO: 3851146 - RNA, 10 nt, Shigella flexneri 2a str. 2457T
uauuccuuag

SEQ ID NO: 3851147 - RNA, 15 nt, Shigella flexneri 2a str. 2457T
uauuccuuuaucauu

SEQ ID NO: 3851148 - RNA, 19 nt, Shigella flexneri 2a str. 2457T
uauucgcagcgauaacauc

SEQ ID NO: 3851149 - RNA, 15 nt, Shigella flexneri 2a str. 2457T
uauucgcugauuuuu

SEQ ID NO: 3851150 - RNA, 15 nt, Shigella flexneri 2a str. 2457T
uauucggcuccagau

SEQ ID NO: 3851151 - RNA, 19 nt, Shigella flexneri 2a str. 2457T
ucaaacggcauaugccaug

SEQ ID NO: 3851152 - RNA, 18 nt, Shigella flexneri 2a str. 2457T
ucaaacggcguuuucuca

SEQ ID NO: 3851153 - RNA, 14 nt, Shigella flexneri 2a str. 2457T
ucaaacucaauuac

SEQ ID NO: 3851154 - RNA, 21 nt, Shigella flexneri 2a str. 2457T
ucaaacuucgucacagcggcu

SEQ ID NO: 3851155 - RNA, 18 nt, Shigella flexneri 2a str. 2457T
ucaaacuuuuaaauugaa

SEQ ID NO: 3851156 - RNA, 16 nt, Shigella flexneri 2a str. 2457T
ucaaagacguuaaaaa

SEQ ID NO: 3851157 - RNA, 20 nt, Shigella flexneri 2a str. 2457T
ucaaagaguuauuucauaaa

SEQ ID NO: 3851158 - RNA, 22 nt, Shigella flexneri 2a str. 2457T
ucaaagauuguuggcaaaaaaa

SEQ ID NO: 3851159 - RNA, 16 nt, Shigella flexneri 2a str. 2457T
ucaaagccgaagcugu

SEQ ID NO: 3851160 - RNA, 15 nt, Shigella flexneri 2a str. 2457T
ucaaagcugcuuuuc

SEQ ID NO: 3851161 - RNA, 20 nt, Shigella flexneri 2a str. 2457T
ucaaaggcauuaaacgcaua

SEQ ID NO: 3851162 - RNA, 23 nt, Shigella flexneri 2a str. 2457T
ucaaaggcauuaaacgcauacau

SEQ ID NO: 3851163 - RNA, 20 nt, Shigella flexneri 2a str. 2457T
ucaaaggccgacagcaggcu

SEQ ID NO: 3851164 - RNA, 19 nt, Shigella flexneri 2a str. 2457T
ucaaaggccuugaacaaac

SEQ ID NO: 3851165 - RNA, 15 nt, Shigella flexneri 2a str. 2457T
ucaaaggcuucaacg

SEQ ID NO: 3851166 - RNA, 14 nt, Shigella flexneri 2a str. 2457T
ucaaaguaaucaag

SEQ ID NO: 3851167 - RNA, 14 nt, Shigella flexneri 2a str. 2457T
ucaaauaaaaauac

SEQ ID NO: 3851168 - RNA, 15 nt, Shigella flexneri 2a str. 2457T
ucaaauacuucaaua

SEQ ID NO: 3851169 - RNA, 18 nt, Shigella flexneri 2a str. 2457T
ucaaauaucuauuucagg

SEQ ID NO: 3851170 - RNA, 16 nt, Shigella flexneri 2a str. 2457T
ucaaauauucugccca

SEQ ID NO: 3851171 - RNA, 23 nt, Shigella flexneri 2a str. 2457T
ucaaaucaccauauucagcagca

SEQ ID NO: 3851172 - RNA, 13 nt, Shigella flexneri 2a str. 2457T
ucaaaucaugccu

SEQ ID NO: 3851173 - RNA, 23 nt, Shigella flexneri 2a str. 2457T
ucaaaucaugccugcgacaagaa

SEQ ID NO: 3851174 - RNA, 20 nt, Shigella flexneri 2a str. 2457T
ucaaauguugcguucaucag

SEQ ID NO: 3851175 - RNA, 20 nt, Shigella flexneri 2a str. 2457T
ucaaauuacgauccaccacc

SEQ ID NO: 3851176 - RNA, 11 nt, Shigella flexneri 2a str. 2457T
ucaacaaacca

SEQ ID NO: 3851177 - RNA, 18 nt, Shigella flexneri 2a str. 2457T
ucaacaaaccaaaaccgc

SEQ ID NO: 3851178 - RNA, 19 nt, Shigella flexneri 2a str. 2457T
ucaacaaacgauuuaucga

SEQ ID NO: 3851179 - RNA, 21 nt, Shigella flexneri 2a str. 2457T
ucaacaaauucuggcaccacc

SEQ ID NO: 3851180 - RNA, 16 nt, Shigella flexneri 2a str. 2457T
ucaacaaccuugcguu

SEQ ID NO: 3851181 - RNA, 16 nt, Shigella flexneri 2a str. 2457T
ucaacaauacgcaccg

SEQ ID NO: 3851182 - RNA, 21 nt, Shigella flexneri 2a str. 2457T
ucaacacagugaugaaaacga

SEQ ID NO: 3851183 - RNA, 13 nt, Shigella flexneri 2a str. 2457T
ucaacacauccag

SEQ ID NO: 3851184 - RNA, 16 nt, Shigella flexneri 2a str. 2457T
ucaacacauccagugg

SEQ ID NO: 3851185 - RNA, 15 nt, Shigella flexneri 2a str. 2457T
ucaacaccgaugcaa

SEQ ID NO: 3851186 - RNA, 23 nt, Shigella flexneri 2a str. 2457T
ucaacagcggcauuacgcgcccc

SEQ ID NO: 3851187 - RNA, 16 nt, Shigella flexneri 2a str. 2457T
ucaacagcguuucuuc

SEQ ID NO: 3851188 - RNA, 19 nt, Shigella flexneri 2a str. 2457T
ucaacaggcuaccagcaaa

SEQ ID NO: 3851189 - RNA, 19 nt, Shigella flexneri 2a str. 2457T
ucaacagggcagacauucg

SEQ ID NO: 3851190 - RNA, 13 nt, Shigella flexneri 2a str. 2457T
ucaacaguaaacu

SEQ ID NO: 3851191 - RNA, 14 nt, Shigella flexneri 2a str. 2457T
ucaacauauuaaaa

SEQ ID NO: 3851192 - RNA, 13 nt, Shigella flexneri 2a str. 2457T
ucaacaucgcguu

SEQ ID NO: 3851193 - RNA, 12 nt, Shigella flexneri 2a str. 2457T
ucaaccacucac

SEQ ID NO: 3851194 - RNA, 22 nt, Shigella flexneri 2a str. 2457T
ucaaccacucaccgcuggcgua

SEQ ID NO: 3851195 - RNA, 20 nt, Shigella flexneri 2a str. 2457T
ucaaccacuuuaucgagaau

SEQ ID NO: 3851196 - RNA, 20 nt, Shigella flexneri 2a str. 2457T
ucaaccagaucggacuucau

SEQ ID NO: 3851197 - RNA, 18 nt, Shigella flexneri 2a str. 2457T
ucaaccagcacaaagugg

SEQ ID NO: 3851198 - RNA, 17 nt, Shigella flexneri 2a str. 2457T
ucaaccagcacuucgcc

SEQ ID NO: 3851199 - RNA, 14 nt, Shigella flexneri 2a str. 2457T
ucaaccauugaaac

SEQ ID NO: 3851200 - RNA, 20 nt, Shigella flexneri 2a str. 2457T
ucaaccgucgcgcccuccug

SEQ ID NO: 3851201 - RNA, 22 nt, Shigella flexneri 2a str. 2457T
ucaaccgucgcgcccuccugca

SEQ ID NO: 3851202 - RNA, 14 nt, Shigella flexneri 2a str. 2457T
ucaaccugaggcuc

SEQ ID NO: 3851203 - RNA, 17 nt, Shigella flexneri 2a str. 2457T
ucaacgauucaagaaac

SEQ ID NO: 3851204 - RNA, 20 nt, Shigella flexneri 2a str. 2457T
ucaacgauuucucagcagac

SEQ ID NO: 3851205 - RNA, 22 nt, Shigella flexneri 2a str. 2457T
ucaacgcaccgacaaauuucau

SEQ ID NO: 3851206 - RNA, 20 nt, Shigella flexneri 2a str. 2457T
ucaacgccauacggcuauga

SEQ ID NO: 3851207 - RNA, 16 nt, Shigella flexneri 2a str. 2457T
ucaacgccaucgccag

SEQ ID NO: 3851208 - RNA, 17 nt, Shigella flexneri 2a str. 2457T
ucaacgccaucgccagg

SEQ ID NO: 3851209 - RNA, 21 nt, Shigella flexneri 2a str. 2457T
ucaacgccgcuaucagauucg

SEQ ID NO: 3851210 - RNA, 14 nt, Shigella flexneri 2a str. 2457T
ucaacgcgccgcca

SEQ ID NO: 3851211 - RNA, 19 nt, Shigella flexneri 2a str. 2457T
ucaacggauauuguuugcu

SEQ ID NO: 3851212 - RNA, 21 nt, Shigella flexneri 2a str. 2457T
ucaacggcaacaauucccgca

SEQ ID NO: 3851213 - RNA, 22 nt, Shigella flexneri 2a str. 2457T
ucaacggcggcuuguacgccgc

SEQ ID NO: 3851214 - RNA, 12 nt, Shigella flexneri 2a str. 2457T
ucaacgucaaac

SEQ ID NO: 3851215 - RNA, 21 nt, Shigella flexneri 2a str. 2457T
ucaacgucacuggguucaaaa

SEQ ID NO: 3851216 - RNA, 14 nt, Shigella flexneri 2a str. 2457T
ucaacgugucuuuu

SEQ ID NO: 3851217 - RNA, 18 nt, Shigella flexneri 2a str. 2457T
ucaacguuauucgcuucc

SEQ ID NO: 3851218 - RNA, 22 nt, Shigella flexneri 2a str. 2457T
ucaacguucagcaucuggaaag

SEQ ID NO: 3851219 - RNA, 18 nt, Shigella flexneri 2a str. 2457T
ucaacuccgccagcaacu

SEQ ID NO: 3851220 - RNA, 12 nt, Shigella flexneri 2a str. 2457T
ucaacuccgucg

SEQ ID NO: 3851221 - RNA, 16 nt, Shigella flexneri 2a str. 2457T
ucaacugccaguuccc

SEQ ID NO: 3851222 - RNA, 12 nt, Shigella flexneri 2a str. 2457T
ucaacugcgguu

SEQ ID NO: 3851223 - RNA, 17 nt, Shigella flexneri 2a str. 2457T
ucaacugcguucugucg

SEQ ID NO: 3851224 - RNA, 14 nt, Shigella flexneri 2a str. 2457T
ucaacuggauaaaa

SEQ ID NO: 3851225 - RNA, 15 nt, Shigella flexneri 2a str. 2457T
ucaacuggauaaaau

SEQ ID NO: 3851226 - RNA, 15 nt, Shigella flexneri 2a str. 2457T
ucaacuuaagucucc

SEQ ID NO: 3851227 - RNA, 18 nt, Shigella flexneri 2a str. 2457T
ucaacuuggcugggauag

SEQ ID NO: 3851228 - RNA, 22 nt, Shigella flexneri 2a str. 2457T
ucaacuuuguuagcgaauaaag

SEQ ID NO: 3851229 - RNA, 13 nt, Shigella flexneri 2a str. 2457T
ucaagaauacugu

SEQ ID NO: 3851230 - RNA, 15 nt, Shigella flexneri 2a str. 2457T
ucaagaaugacgcca

SEQ ID NO: 3851231 - RNA, 15 nt, Shigella flexneri 2a str. 2457T
ucaagacaucaauaa

SEQ ID NO: 3851232 - RNA, 17 nt, Shigella flexneri 2a str. 2457T
ucaagauauuucaccag

SEQ ID NO: 3851233 - RNA, 18 nt, Shigella flexneri 2a str. 2457T
ucaagauauuucaccagc

SEQ ID NO: 3851234 - RNA, 22 nt, Shigella flexneri 2a str. 2457T
ucaagauuagcccccguuuugu

SEQ ID NO: 3851235 - RNA, 19 nt, Shigella flexneri 2a str. 2457T
ucaagauuagcgacgaaca

SEQ ID NO: 3851236 - RNA, 16 nt, Shigella flexneri 2a str. 2457T
ucaagcaaggccaggu

SEQ ID NO: 3851237 - RNA, 17 nt, Shigella flexneri 2a str. 2457T
ucaagcacaaucacguc

SEQ ID NO: 3851238 - RNA, 20 nt, Shigella flexneri 2a str. 2457T
ucaagcaguugguuaaucuu

SEQ ID NO: 3851239 - RNA, 15 nt, Shigella flexneri 2a str. 2457T
ucaagccauagcgcc

SEQ ID NO: 3851240 - RNA, 19 nt, Shigella flexneri 2a str. 2457T
ucaagccccagcaggaugu

SEQ ID NO: 3851241 - RNA, 20 nt, Shigella flexneri 2a str. 2457T
ucaagcccugguaacugcca

SEQ ID NO: 3851242 - RNA, 22 nt, Shigella flexneri 2a str. 2457T
ucaagcgccgaguaaaaaaaca

SEQ ID NO: 3851243 - RNA, 13 nt, Shigella flexneri 2a str. 2457T
ucaagcgccgcca

SEQ ID NO: 3851244 - RNA, 19 nt, Shigella flexneri 2a str. 2457T
ucaagcgguaaccauccau

SEQ ID NO: 3851245 - RNA, 15 nt, Shigella flexneri 2a str. 2457T
ucaagcgucgcauca

SEQ ID NO: 3851246 - RNA, 18 nt, Shigella flexneri 2a str. 2457T
ucaagcgucgcaucaggc

SEQ ID NO: 3851247 - RNA, 21 nt, Shigella flexneri 2a str. 2457T
ucaagcgucgcaucaggcaug

SEQ ID NO: 3851248 - RNA, 17 nt, Shigella flexneri 2a str. 2457T
ucacgcccaucagcauc

SEQ ID NO: 3851249 - RNA, 15 nt, Shigella flexneri 2a str. 2457T
ucacgcccgccccag

SEQ ID NO: 3851250 - RNA, 18 nt, Shigella flexneri 2a str. 2457T
ucacgcccggaauuucaa

SEQ ID NO: 3851251 - RNA, 16 nt, Shigella flexneri 2a str. 2457T
ucacgccgaccagacc

SEQ ID NO: 3851252 - RNA, 23 nt, Shigella flexneri 2a str. 2457T
ucacgccgcauccgacauuugca

SEQ ID NO: 3851253 - RNA, 18 nt, Shigella flexneri 2a str. 2457T
ucacgccgcauccggcaa

SEQ ID NO: 3851254 - RNA, 18 nt, Shigella flexneri 2a str. 2457T
ucacgccgcauccggcag

SEQ ID NO: 3851255 - RNA, 19 nt, Shigella flexneri 2a str. 2457T
ucacgccgcauccggcaua

SEQ ID NO: 3851256 - RNA, 19 nt, Shigella flexneri 2a str. 2457T
ucacgccgcauccggcauu

SEQ ID NO: 3851257 - RNA, 21 nt, Shigella flexneri 2a str. 2457T
ucacgccgggaaauuuuuccg

SEQ ID NO: 3851258 - RNA, 22 nt, Shigella flexneri 2a str. 2457T
ucacgccgggaaauuuuuccgu

SEQ ID NO: 3851259 - RNA, 21 nt, Shigella flexneri 2a str. 2457T
ucacgccuugcggaaauucca

SEQ ID NO: 3851260 - RNA, 18 nt, Shigella flexneri 2a str. 2457T
ucacgcgcaucuguaacg

SEQ ID NO: 3851261 - RNA, 21 nt, Shigella flexneri 2a str. 2457T
ucacgcgcaucuguaacggag

SEQ ID NO: 3851262 - RNA, 13 nt, Shigella flexneri 2a str. 2457T
ucacgcgccagcu

SEQ ID NO: 3851263 - RNA, 12 nt, Shigella flexneri 2a str. 2457T
ucacgcgcugcc

SEQ ID NO: 3851264 - RNA, 14 nt, Shigella flexneri 2a str. 2457T
ucacgcgguuacgc

SEQ ID NO: 3851265 - RNA, 15 nt, Shigella flexneri 2a str. 2457T
ucacgcgucuuauca

SEQ ID NO: 3851266 - RNA, 20 nt, Shigella flexneri 2a str. 2457T
ucacgcguugcuaugcugaa

SEQ ID NO: 3851267 - RNA, 12 nt, Shigella flexneri 2a str. 2457T
ucacgcuaaaag

SEQ ID NO: 3851268 - RNA, 22 nt, Shigella flexneri 2a str. 2457T
ucacgcuuaucgcccuggauuu

SEQ ID NO: 3851269 - RNA, 19 nt, Shigella flexneri 2a str. 2457T
ucacggaaucccguaaucc

SEQ ID NO: 3851270 - RNA, 15 nt, Shigella flexneri 2a str. 2457T
ucacggcgcaugccu

SEQ ID NO: 3851271 - RNA, 19 nt, Shigella flexneri 2a str. 2457T
ucacggugucgguauacac

SEQ ID NO: 3851272 - RNA, 14 nt, Shigella flexneri 2a str. 2457T
ucacguaggccuga

SEQ ID NO: 3851273 - RNA, 16 nt, Shigella flexneri 2a str. 2457T
ucacguaggccugaua

SEQ ID NO: 3851274 - RNA, 16 nt, Shigella flexneri 2a str. 2457T
ucacgugacaaaaauu

SEQ ID NO: 3851275 - RNA, 15 nt, Shigella flexneri 2a str. 2457T
ucacguucgugaaca

SEQ ID NO: 3851276 - RNA, 16 nt, Shigella flexneri 2a str. 2457T
ucacguugacgcauac

SEQ ID NO: 3851277 - RNA, 16 nt, Shigella flexneri 2a str. 2457T
ucacuaaaacaggcuu

SEQ ID NO: 3851278 - RNA, 21 nt, Shigella flexneri 2a str. 2457T
ucacuaaacccgaccacuucc

SEQ ID NO: 3851279 - RNA, 20 nt, Shigella flexneri 2a str. 2457T
ucacuaagaauguccauuau

SEQ ID NO: 3851280 - RNA, 19 nt, Shigella flexneri 2a str. 2457T
ucacuaaggguaaaacgac

SEQ ID NO: 3851281 - RNA, 21 nt, Shigella flexneri 2a str. 2457T
ucacuacaaccgggaucaccg

SEQ ID NO: 3851282 - RNA, 16 nt, Shigella flexneri 2a str. 2457T
ucacuaccuucuuccc

SEQ ID NO: 3851283 - RNA, 21 nt, Shigella flexneri 2a str. 2457T
ucacuaugagguagccugagu

SEQ ID NO: 3851284 - RNA, 21 nt, Shigella flexneri 2a str. 2457T
ucacuauuucuuuguagauga

SEQ ID NO: 3851285 - RNA, 17 nt, Shigella flexneri 2a str. 2457T
ucacucaccgcagaaua

SEQ ID NO: 3851286 - RNA, 22 nt, Shigella flexneri 2a str. 2457T
ucacucacgccguuaacuucac

SEQ ID NO: 3851287 - RNA, 12 nt, Shigella flexneri 2a str. 2457T
ucacucaguguu

SEQ ID NO: 3851288 - RNA, 16 nt, Shigella flexneri 2a str. 2457T
ucacuccacaccauau

SEQ ID NO: 3851289 - RNA, 16 nt, Shigella flexneri 2a str. 2457T
ucacuccagccagagc

SEQ ID NO: 3851290 - RNA, 16 nt, Shigella flexneri 2a str. 2457T
ucacuccauccagcaa

SEQ ID NO: 3851291 - RNA, 23 nt, Shigella flexneri 2a str. 2457T
ucacucccggauaaaucuccauu

SEQ ID NO: 3851292 - RNA, 14 nt, Shigella flexneri 2a str. 2457T
ucacuccggccaga

SEQ ID NO: 3851293 - RNA, 16 nt, Shigella flexneri 2a str. 2457T
ucacuccggccagagc

SEQ ID NO: 3851294 - RNA, 16 nt, Shigella flexneri 2a str. 2457T
ucacucgacagcaccg

SEQ ID NO: 3851295 - RNA, 17 nt, Shigella flexneri 2a str. 2457T
ucacucggggcuuuucu

SEQ ID NO: 3851296 - RNA, 21 nt, Shigella flexneri 2a str. 2457T
ucacucuauagucuuuucgcu

SEQ ID NO: 3851297 - RNA, 20 nt, Shigella flexneri 2a str. 2457T
ucacucugcugccacauucc

SEQ ID NO: 3851298 - RNA, 16 nt, Shigella flexneri 2a str. 2457T
ucacugacaccagcau

SEQ ID NO: 3851299 - RNA, 11 nt, Shigella flexneri 2a str. 2457T
ucacugacgcc

SEQ ID NO: 3851300 - RNA, 20 nt, Shigella flexneri 2a str. 2457T
ucacugaugacaagcguaug

SEQ ID NO: 3851301 - RNA, 21 nt, Shigella flexneri 2a str. 2457T
ucacugcaaauacccaaaaaa

SEQ ID NO: 3851302 - RNA, 15 nt, Shigella flexneri 2a str. 2457T
ucacugccugcugau

SEQ ID NO: 3851303 - RNA, 23 nt, Shigella flexneri 2a str. 2457T
ucacugcgaaagcgucagcuuuc

SEQ ID NO: 3851304 - RNA, 16 nt, Shigella flexneri 2a str. 2457T
ucacugcuuaauauua

SEQ ID NO: 3851305 - RNA, 11 nt, Shigella flexneri 2a str. 2457T
ucacuggagac

SEQ ID NO: 3851306 - RNA, 12 nt, Shigella flexneri 2a str. 2457T
ucacuggcaaug

SEQ ID NO: 3851307 - RNA, 13 nt, Shigella flexneri 2a str. 2457T
ucacugggcgauu

SEQ ID NO: 3851308 - RNA, 14 nt, Shigella flexneri 2a str. 2457T
ucacugguucaaag

SEQ ID NO: 3851309 - RNA, 18 nt, Shigella flexneri 2a str. 2457T
ucacugucgaacuggcag

SEQ ID NO: 3851310 - RNA, 20 nt, Shigella flexneri 2a str. 2457T
ucacugugauggaccgugcc

SEQ ID NO: 3851311 - RNA, 16 nt, Shigella flexneri 2a str. 2457T
ucacugugcuuuacau

SEQ ID NO: 3851312 - RNA, 21 nt, Shigella flexneri 2a str. 2457T
ucacuguucugauaguuaaaa

SEQ ID NO: 3851313 - RNA, 17 nt, Shigella flexneri 2a str. 2457T
ucacuguugaagccgcc

SEQ ID NO: 3851314 - RNA, 20 nt, Shigella flexneri 2a str. 2457T
ucacuguugaguaagaggcc

SEQ ID NO: 3851315 - RNA, 17 nt, Shigella flexneri 2a str. 2457T
ucacuuaacccauuaca

SEQ ID NO: 3851316 - RNA, 23 nt, Shigella flexneri 2a str. 2457T
ucacuuaacccauuacaagcccg

SEQ ID NO: 3851317 - RNA, 13 nt, Shigella flexneri 2a str. 2457T
ucacuucaggaug

SEQ ID NO: 3851318 - RNA, 15 nt, Shigella flexneri 2a str. 2457T
ucacuucaucaucgu

SEQ ID NO: 3851319 - RNA, 18 nt, Shigella flexneri 2a str. 2457T
ucacuuccaguacgcgca

SEQ ID NO: 3851320 - RNA, 17 nt, Shigella flexneri 2a str. 2457T
ucacuucgauccaguga

SEQ ID NO: 3851321 - RNA, 16 nt, Shigella flexneri 2a str. 2457T
ucacuucgucagaaau

SEQ ID NO: 3851322 - RNA, 18 nt, Shigella flexneri 2a str. 2457T
ucacuucgucagaaaugg

SEQ ID NO: 3851323 - RNA, 13 nt, Shigella flexneri 2a str. 2457T
ucacuucugaguu

SEQ ID NO: 3851324 - RNA, 12 nt, Shigella flexneri 2a str. 2457T
ucacuugcuacc

SEQ ID NO: 3851325 - RNA, 14 nt, Shigella flexneri 2a str. 2457T
ucacuugcuguaau

SEQ ID NO: 3851326 - RNA, 20 nt, Shigella flexneri 2a str. 2457T
ucacuuucaaauccggccag

SEQ ID NO: 3851327 - RNA, 18 nt, Shigella flexneri 2a str. 2457T
ucacuuucggugacagaa

SEQ ID NO: 3851328 - RNA, 15 nt, Shigella flexneri 2a str. 2457T
ucacuuucuggcagc

SEQ ID NO: 3851329 - RNA, 19 nt, Shigella flexneri 2a str. 2457T
ucacuuuugccagacgaau

SEQ ID NO: 3851330 - RNA, 18 nt, Shigella flexneri 2a str. 2457T
ucacuuuuggugcuuuug

SEQ ID NO: 3851331 - RNA, 13 nt, Shigella flexneri 2a str. 2457T
ucacuuuuuuccg

SEQ ID NO: 3851332 - RNA, 14 nt, Shigella flexneri 2a str. 2457T
ucagaaacacacuu

SEQ ID NO: 3851333 - RNA, 22 nt, Shigella flexneri 2a str. 2457T
ucagaaacgcucauaaauugca

SEQ ID NO: 3851334 - RNA, 19 nt, Shigella flexneri 2a str. 2457T
ucagaaacuguaauugaga

SEQ ID NO: 3851335 - RNA, 20 nt, Shigella flexneri 2a str. 2457T
ucagaaagccgccgacaugu

SEQ ID NO: 3851336 - RNA, 18 nt, Shigella flexneri 2a str. 2457T
ucagaaagcgccagcaag

SEQ ID NO: 3851337 - RNA, 20 nt, Shigella flexneri 2a str. 2457T
ucagaaaguaauuacacccu

SEQ ID NO: 3851338 - RNA, 16 nt, Shigella flexneri 2a str. 2457T
ucagaaagugccacgc

SEQ ID NO: 3851339 - RNA, 20 nt, Shigella flexneri 2a str. 2457T
ucagaaauuuggcuccucug

SEQ ID NO: 3851340 - RNA, 22 nt, Shigella flexneri 2a str. 2457T
ucagaaauuuggcuccucugac

SEQ ID NO: 3851341 - RNA, 18 nt, Shigella flexneri 2a str. 2457T
ucagaacacuucuucugu

SEQ ID NO: 3851342 - RNA, 20 nt, Shigella flexneri 2a str. 2457T
ucagaacgguucuugaaaau

SEQ ID NO: 3851343 - RNA, 16 nt, Shigella flexneri 2a str. 2457T
ucagaacguaaacgca

SEQ ID NO: 3851344 - RNA, 21 nt, Shigella flexneri 2a str. 2457T
ucagaacguaaacgcagcauc

SEQ ID NO: 3851345 - RNA, 19 nt, Shigella flexneri 2a str. 2457T
ucagcccaaagcagaguug

SEQ ID NO: 3851346 - RNA, 15 nt, Shigella flexneri 2a str. 2457T
ucagcccaacaaagc

SEQ ID NO: 3851347 - RNA, 13 nt, Shigella flexneri 2a str. 2457T
ucagcccaaccac

SEQ ID NO: 3851348 - RNA, 18 nt, Shigella flexneri 2a str. 2457T
ucagcccacauccaugug

SEQ ID NO: 3851349 - RNA, 13 nt, Shigella flexneri 2a str. 2457T
ucagccccuccac

SEQ ID NO: 3851350 - RNA, 14 nt, Shigella flexneri 2a str. 2457T
ucagccccuccaca

SEQ ID NO: 3851351 - RNA, 14 nt, Shigella flexneri 2a str. 2457T
ucagcccgaugaua

SEQ ID NO: 3851352 - RNA, 16 nt, Shigella flexneri 2a str. 2457T
ucagcccuucuuuaug

SEQ ID NO: 3851353 - RNA, 14 nt, Shigella flexneri 2a str. 2457T
ucagccgcaaacuc

SEQ ID NO: 3851354 - RNA, 22 nt, Shigella flexneri 2a str. 2457T
ucagccgcccgcgauaaaaauc

SEQ ID NO: 3851355 - RNA, 18 nt, Shigella flexneri 2a str. 2457T
ucagccgucauccaggaa

SEQ ID NO: 3851356 - RNA, 12 nt, Shigella flexneri 2a str. 2457T
ucagccucgcug

SEQ ID NO: 3851357 - RNA, 11 nt, Shigella flexneri 2a str. 2457T
ucagccucugc

SEQ ID NO: 3851358 - RNA, 20 nt, Shigella flexneri 2a str. 2457T
ucagccugcucaguugcauc

SEQ ID NO: 3851359 - RNA, 16 nt, Shigella flexneri 2a str. 2457T
ucagcgaguuaccuua

SEQ ID NO: 3851360 - RNA, 16 nt, Shigella flexneri 2a str. 2457T
ucagcgaucagcauuu

SEQ ID NO: 3851361 - RNA, 16 nt, Shigella flexneri 2a str. 2457T
ucagcgaucgcuuucg

SEQ ID NO: 3851362 - RNA, 19 nt, Shigella flexneri 2a str. 2457T
ucagcgaucguuuuuaacc

SEQ ID NO: 3851363 - RNA, 23 nt, Shigella flexneri 2a str. 2457T
ucagcgaucguuuuuaaccccag

SEQ ID NO: 3851364 - RNA, 14 nt, Shigella flexneri 2a str. 2457T
ucagcgcaaagagu

SEQ ID NO: 3851365 - RNA, 20 nt, Shigella flexneri 2a str. 2457T
ucagcgcaacuugcagaucc

SEQ ID NO: 3851366 - RNA, 20 nt, Shigella flexneri 2a str. 2457T
ucagcgcagacaaucacauc

SEQ ID NO: 3851367 - RNA, 13 nt, Shigella flexneri 2a str. 2457T
ucagcgcagcacc

SEQ ID NO: 3851368 - RNA, 14 nt, Shigella flexneri 2a str. 2457T
ucagcgcagcgcga

SEQ ID NO: 3851369 - RNA, 18 nt, Shigella flexneri 2a str. 2457T
ucagcgccagcgcggaag

SEQ ID NO: 3851370 - RNA, 14 nt, Shigella flexneri 2a str. 2457T
ucagcgccaggcuu

SEQ ID NO: 3851371 - RNA, 13 nt, Shigella flexneri 2a str. 2457T
ucagcgccugaua

SEQ ID NO: 3851372 - RNA, 17 nt, Shigella flexneri 2a str. 2457T
ucagcgccugcugcacg

SEQ ID NO: 3851373 - RNA, 16 nt, Shigella flexneri 2a str. 2457T
ucagcggccaguuucg

SEQ ID NO: 3851374 - RNA, 19 nt, Shigella flexneri 2a str. 2457T
ucagcggugccgcgauacc

SEQ ID NO: 3851375 - RNA, 14 nt, Shigella flexneri 2a str. 2457T
ucagcgguuuugcc

SEQ ID NO: 3851376 - RNA, 21 nt, Shigella flexneri 2a str. 2457T
ucagcgucaacggagcaccgu

SEQ ID NO: 3851377 - RNA, 12 nt, Shigella flexneri 2a str. 2457T
ucagcgucguga

SEQ ID NO: 3851378 - RNA, 21 nt, Shigella flexneri 2a str. 2457T
ucagcgucucacuaucgcuga

SEQ ID NO: 3851379 - RNA, 13 nt, Shigella flexneri 2a str. 2457T
ucagcgugcccac

SEQ ID NO: 3851380 - RNA, 15 nt, Shigella flexneri 2a str. 2457T
ucagcguuccccaga

SEQ ID NO: 3851381 - RNA, 19 nt, Shigella flexneri 2a str. 2457T
ucagcuaaacagcccaauc

SEQ ID NO: 3851382 - RNA, 23 nt, Shigella flexneri 2a str. 2457T
ucagcuauucuuauaaagaaaau

SEQ ID NO: 3851383 - RNA, 13 nt, Shigella flexneri 2a str. 2457T
ucagcucaagaau

SEQ ID NO: 3851384 - RNA, 15 nt, Shigella flexneri 2a str. 2457T
ucagcucauccagcg

SEQ ID NO: 3851385 - RNA, 19 nt, Shigella flexneri 2a str. 2457T
ucagcuccacaagaaugcc

SEQ ID NO: 3851386 - RNA, 19 nt, Shigella flexneri 2a str. 2457T
ucagcuccggcagcugcuc

SEQ ID NO: 3851387 - RNA, 13 nt, Shigella flexneri 2a str. 2457T
ucagcuccucuuu

SEQ ID NO: 3851388 - RNA, 16 nt, Shigella flexneri 2a str. 2457T
ucagcucuuccuucag

SEQ ID NO: 3851389 - RNA, 15 nt, Shigella flexneri 2a str. 2457T
ucagcugccagggca

SEQ ID NO: 3851390 - RNA, 15 nt, Shigella flexneri 2a str. 2457T
ucagcuggaucgaga

SEQ ID NO: 3851391 - RNA, 20 nt, Shigella flexneri 2a str. 2457T
ucagcuuauuaucgcuaucc

SEQ ID NO: 3851392 - RNA, 13 nt, Shigella flexneri 2a str. 2457T
ucagcuucaccuu

SEQ ID NO: 3851393 - RNA, 17 nt, Shigella flexneri 2a str. 2457T
ucagcuugcguccauaa

SEQ ID NO: 3851394 - RNA, 17 nt, Shigella flexneri 2a str. 2457T
ucagcuuuuuauagcaa

SEQ ID NO: 3851395 - RNA, 22 nt, Shigella flexneri 2a str. 2457T
ucaggaauagcggcaagcccag

SEQ ID NO: 3851396 - RNA, 15 nt, Shigella flexneri 2a str. 2457T
ucaggaauauguuca

SEQ ID NO: 3851397 - RNA, 16 nt, Shigella flexneri 2a str. 2457T
ucaggagcuggaugcc

SEQ ID NO: 3851398 - RNA, 13 nt, Shigella flexneri 2a str. 2457T
ucaggaguuuaau

SEQ ID NO: 3851399 - RNA, 16 nt, Shigella flexneri 2a str. 2457T
ucaggaguuuaaucuc

SEQ ID NO: 3851400 - RNA, 14 nt, Shigella flexneri 2a str. 2457T
ucaggauaaacucc

SEQ ID NO: 3851401 - RNA, 18 nt, Shigella flexneri 2a str. 2457T
ucaggauaaacuccugca

SEQ ID NO: 3851402 - RNA, 17 nt, Shigella flexneri 2a str. 2457T
ucaggauauuuauauuu

SEQ ID NO: 3851403 - RNA, 21 nt, Shigella flexneri 2a str. 2457T
ucaggaucagccauuuugcac

SEQ ID NO: 3851404 - RNA, 16 nt, Shigella flexneri 2a str. 2457T
ucaggaucugacaucc

SEQ ID NO: 3851405 - RNA, 22 nt, Shigella flexneri 2a str. 2457T
ucaggcaagccgcuaacagcag

SEQ ID NO: 3851406 - RNA, 19 nt, Shigella flexneri 2a str. 2457T
ucaggcacccgccguuauc

SEQ ID NO: 3851407 - RNA, 18 nt, Shigella flexneri 2a str. 2457T
ucaggcacuucuucugca

SEQ ID NO: 3851408 - RNA, 18 nt, Shigella flexneri 2a str. 2457T
ucaggcaggucuuucacc

SEQ ID NO: 3851409 - RNA, 20 nt, Shigella flexneri 2a str. 2457T
ucaggcaucgugcaccaauu

SEQ ID NO: 3851410 - RNA, 17 nt, Shigella flexneri 2a str. 2457T
ucaggcauuacugugca

SEQ ID NO: 3851411 - RNA, 18 nt, Shigella flexneri 2a str. 2457T
ucaggcauucuuuuucau

SEQ ID NO: 3851412 - RNA, 17 nt, Shigella flexneri 2a str. 2457T
ucaggcauuugcuccag

SEQ ID NO: 3851413 - RNA, 21 nt, Shigella flexneri 2a str. 2457T
ucaggccacgucuuaauguaa

SEQ ID NO: 3851414 - RNA, 11 nt, Shigella flexneri 2a str. 2457T
ucaggccagga

SEQ ID NO: 3851415 - RNA, 12 nt, Shigella flexneri 2a str. 2457T
ucaggccaggau

SEQ ID NO: 3851416 - RNA, 21 nt, Shigella flexneri 2a str. 2457T
ucaggccaggauuacgcucac

SEQ ID NO: 3851417 - RNA, 20 nt, Shigella flexneri 2a str. 2457T
ucaggcccgcauagagaaaa

SEQ ID NO: 3851418 - RNA, 16 nt, Shigella flexneri 2a str. 2457T
ucaggccgaggcacag

SEQ ID NO: 3851419 - RNA, 15 nt, Shigella flexneri 2a str. 2457T
ucaggccgauuucau

SEQ ID NO: 3851420 - RNA, 15 nt, Shigella flexneri 2a str. 2457T
ucaggccuacaaaau

SEQ ID NO: 3851421 - RNA, 14 nt, Shigella flexneri 2a str. 2457T
ucaggccuaccggu

SEQ ID NO: 3851422 - RNA, 23 nt, Shigella flexneri 2a str. 2457T
ucaggcgagucgagaucccuucc

SEQ ID NO: 3851423 - RNA, 22 nt, Shigella flexneri 2a str. 2457T
ucaggcgcugaaagaagcggug

SEQ ID NO: 3851424 - RNA, 12 nt, Shigella flexneri 2a str. 2457T
ucaggcgcugca

SEQ ID NO: 3851425 - RNA, 15 nt, Shigella flexneri 2a str. 2457T
ucaggcggcucaccu

SEQ ID NO: 3851426 - RNA, 18 nt, Shigella flexneri 2a str. 2457T
ucaggcggcuucgucguu

SEQ ID NO: 3851427 - RNA, 14 nt, Shigella flexneri 2a str. 2457T
ucaggcguugaaaa

SEQ ID NO: 3851428 - RNA, 16 nt, Shigella flexneri 2a str. 2457T
ucaggcguugaaaaau

SEQ ID NO: 3851429 - RNA, 22 nt, Shigella flexneri 2a str. 2457T
ucaggcguuuguaacccaccau

SEQ ID NO: 3851430 - RNA, 16 nt, Shigella flexneri 2a str. 2457T
ucaggcuacuuuucca

SEQ ID NO: 3851431 - RNA, 16 nt, Shigella flexneri 2a str. 2457T
ucaggcucucauuuuu

SEQ ID NO: 3851432 - RNA, 15 nt, Shigella flexneri 2a str. 2457T
ucaggcuucuguacc

SEQ ID NO: 3851433 - RNA, 22 nt, Shigella flexneri 2a str. 2457T
ucagggcgacaaucaucgccuu

SEQ ID NO: 3851434 - RNA, 13 nt, Shigella flexneri 2a str. 2457T
ucagggcgcuggc

SEQ ID NO: 3851435 - RNA, 17 nt, Shigella flexneri 2a str. 2457T
ucaggggcagcaccauc

SEQ ID NO: 3851436 - RNA, 21 nt, Shigella flexneri 2a str. 2457T
ucaggguaaauuuauagucau

SEQ ID NO: 3851437 - RNA, 21 nt, Shigella flexneri 2a str. 2457T
ucagggucuuccagcaaaucc

SEQ ID NO: 3851438 - RNA, 18 nt, Shigella flexneri 2a str. 2457T
ucagguagcgcauaagcc

SEQ ID NO: 3851439 - RNA, 20 nt, Shigella flexneri 2a str. 2457T
ucagguauucguuaaaacca

SEQ ID NO: 3851440 - RNA, 16 nt, Shigella flexneri 2a str. 2457T
ucagguauuuugucag

SEQ ID NO: 3851441 - RNA, 14 nt, Shigella flexneri 2a str. 2457T
ucaggucagcgaau

SEQ ID NO: 3851442 - RNA, 17 nt, Shigella flexneri 2a str. 2457T
ucaggucgcuggcggua

SEQ ID NO: 3851443 - RNA, 15 nt, Shigella flexneri 2a str. 2457T
ucaucagcauucuca

SEQ ID NO: 3851444 - RNA, 19 nt, Shigella flexneri 2a str. 2457T
ucaucagcggcgaagccua

SEQ ID NO: 3851445 - RNA, 17 nt, Shigella flexneri 2a str. 2457T
ucaucagcgucgguuuc

SEQ ID NO: 3851446 - RNA, 18 nt, Shigella flexneri 2a str. 2457T
ucaucaggccuacaaaau

SEQ ID NO: 3851447 - RNA, 18 nt, Shigella flexneri 2a str. 2457T
ucaucaggggcagcacca

SEQ ID NO: 3851448 - RNA, 17 nt, Shigella flexneri 2a str. 2457T
ucaucaguuucaaaugg

SEQ ID NO: 3851449 - RNA, 18 nt, Shigella flexneri 2a str. 2457T
ucaucauagacuucccuc

SEQ ID NO: 3851450 - RNA, 13 nt, Shigella flexneri 2a str. 2457T
ucaucaucagcau

SEQ ID NO: 3851451 - RNA, 13 nt, Shigella flexneri 2a str. 2457T
ucaucauccagca

SEQ ID NO: 3851452 - RNA, 14 nt, Shigella flexneri 2a str. 2457T
ucaucauccagcac

SEQ ID NO: 3851453 - RNA, 21 nt, Shigella flexneri 2a str. 2457T
ucaucaucgcagauuucuucu

SEQ ID NO: 3851454 - RNA, 22 nt, Shigella flexneri 2a str. 2457T
ucaucaucgcagauuucuucug

SEQ ID NO: 3851455 - RNA, 16 nt, Shigella flexneri 2a str. 2457T
ucaucaucgccaggcu

SEQ ID NO: 3851456 - RNA, 21 nt, Shigella flexneri 2a str. 2457T
ucaucaucgcgcccaaaccac

SEQ ID NO: 3851457 - RNA, 18 nt, Shigella flexneri 2a str. 2457T
ucaucaugggcaagguau

SEQ ID NO: 3851458 - RNA, 17 nt, Shigella flexneri 2a str. 2457T
ucaucauugcagucaua

SEQ ID NO: 3851459 - RNA, 12 nt, Shigella flexneri 2a str. 2457T
ucauccaacaau

SEQ ID NO: 3851460 - RNA, 22 nt, Shigella flexneri 2a str. 2457T
ucauccagaccgcucagcuccu

SEQ ID NO: 3851461 - RNA, 17 nt, Shigella flexneri 2a str. 2457T
ucauccagacugcucag

SEQ ID NO: 3851462 - RNA, 11 nt, Shigella flexneri 2a str. 2457T
ucauccagcac

SEQ ID NO: 3851463 - RNA, 13 nt, Shigella flexneri 2a str. 2457T
ucauccagcauca

SEQ ID NO: 3851464 - RNA, 17 nt, Shigella flexneri 2a str. 2457T
ucauccagcgcacgggc

SEQ ID NO: 3851465 - RNA, 17 nt, Shigella flexneri 2a str. 2457T
ucauccaggaacuccag

SEQ ID NO: 3851466 - RNA, 22 nt, Shigella flexneri 2a str. 2457T
ucaucccgaucaaacgccgaug

SEQ ID NO: 3851467 - RNA, 16 nt, Shigella flexneri 2a str. 2457T
ucaucccuacagguaa

SEQ ID NO: 3851468 - RNA, 19 nt, Shigella flexneri 2a str. 2457T
ucaucccucucauccacgu

SEQ ID NO: 3851469 - RNA, 16 nt, Shigella flexneri 2a str. 2457T
ucauccgccgcucaau

SEQ ID NO: 3851470 - RNA, 19 nt, Shigella flexneri 2a str. 2457T
ucauccggcacgcuaccau

SEQ ID NO: 3851471 - RNA, 15 nt, Shigella flexneri 2a str. 2457T
ucauccggcuguucc

SEQ ID NO: 3851472 - RNA, 18 nt, Shigella flexneri 2a str. 2457T
ucauccggcuuucuucug

SEQ ID NO: 3851473 - RNA, 17 nt, Shigella flexneri 2a str. 2457T
ucauccgguguggcaug

SEQ ID NO: 3851474 - RNA, 23 nt, Shigella flexneri 2a str. 2457T
ucauccgucaccggaauaaugau

SEQ ID NO: 3851475 - RNA, 19 nt, Shigella flexneri 2a str. 2457T
ucauccguuucucuguuca

SEQ ID NO: 3851476 - RNA, 15 nt, Shigella flexneri 2a str. 2457T
ucauccugcugcacg

SEQ ID NO: 3851477 - RNA, 22 nt, Shigella flexneri 2a str. 2457T
ucauccuguacgacaaaagaau

SEQ ID NO: 3851478 - RNA, 20 nt, Shigella flexneri 2a str. 2457T
ucauccuucauuauccuucg

SEQ ID NO: 3851479 - RNA, 23 nt, Shigella flexneri 2a str. 2457T
ucauccuuugggcauuugcacaa

SEQ ID NO: 3851480 - RNA, 13 nt, Shigella flexneri 2a str. 2457T
ucaucgaauaaau

SEQ ID NO: 3851481 - RNA, 13 nt, Shigella flexneri 2a str. 2457T
ucaucgacaucaa

SEQ ID NO: 3851482 - RNA, 14 nt, Shigella flexneri 2a str. 2457T
ucaucgaccccagg

SEQ ID NO: 3851483 - RNA, 19 nt, Shigella flexneri 2a str. 2457T
ucaucgauauuaucuucau

SEQ ID NO: 3851484 - RNA, 17 nt, Shigella flexneri 2a str. 2457T
ucaucgaugagaugacg

SEQ ID NO: 3851485 - RNA, 16 nt, Shigella flexneri 2a str. 2457T
ucaucgaugcgaucau

SEQ ID NO: 3851486 - RNA, 22 nt, Shigella flexneri 2a str. 2457T
ucaucgcaaacccaaccgguaa

SEQ ID NO: 3851487 - RNA, 19 nt, Shigella flexneri 2a str. 2457T
ucaucgcagauuucuucug

SEQ ID NO: 3851488 - RNA, 13 nt, Shigella flexneri 2a str. 2457T
ucaucgcauccag

SEQ ID NO: 3851489 - RNA, 14 nt, Shigella flexneri 2a str. 2457T
ucaucgcaucgccu

SEQ ID NO: 3851490 - RNA, 20 nt, Shigella flexneri 2a str. 2457T
ucaucgcccuuuuuucaggu

SEQ ID NO: 3851491 - RNA, 21 nt, Shigella flexneri 2a str. 2457T
ucaucgccgcuggccauuucu

SEQ ID NO: 3851492 - RNA, 18 nt, Shigella flexneri 2a str. 2457T
ucaucgccgucacgguaa

SEQ ID NO: 3851493 - RNA, 19 nt, Shigella flexneri 2a str. 2457T
ucaucgcgcccaaaccacc

SEQ ID NO: 3851494 - RNA, 16 nt, Shigella flexneri 2a str. 2457T
ucaucgcuaauaauaa

SEQ ID NO: 3851495 - RNA, 23 nt, Shigella flexneri 2a str. 2457T
ucaucgcuuucggaaagaucgcc

SEQ ID NO: 3851496 - RNA, 16 nt, Shigella flexneri 2a str. 2457T
ucaucggaucauuagu

SEQ ID NO: 3851497 - RNA, 23 nt, Shigella flexneri 2a str. 2457T
ucaucggcguugcccaucgccac

SEQ ID NO: 3851498 - RNA, 22 nt, Shigella flexneri 2a str. 2457T
ucaucgggaagaggaucugcuc

SEQ ID NO: 3851499 - RNA, 14 nt, Shigella flexneri 2a str. 2457T
ucaucggguaacgg

SEQ ID NO: 3851500 - RNA, 16 nt, Shigella flexneri 2a str. 2457T
ucaucggguuacugau

SEQ ID NO: 3851501 - RNA, 16 nt, Shigella flexneri 2a str. 2457T
ucaucgguauaaccaa

SEQ ID NO: 3851502 - RNA, 23 nt, Shigella flexneri 2a str. 2457T
ucaucggucagcgcagugacauu

SEQ ID NO: 3851503 - RNA, 19 nt, Shigella flexneri 2a str. 2457T
ucaucguugaucuguaacg

SEQ ID NO: 3851504 - RNA, 22 nt, Shigella flexneri 2a str. 2457T
ucaucguugaucuguaacgcac

SEQ ID NO: 3851505 - RNA, 21 nt, Shigella flexneri 2a str. 2457T
ucaucuauagcacccgccagc

SEQ ID NO: 3851506 - RNA, 14 nt, Shigella flexneri 2a str. 2457T
ucaucucuccuuuc

SEQ ID NO: 3851507 - RNA, 22 nt, Shigella flexneri 2a str. 2457T
ucaucucuuccggcaccacaaa

SEQ ID NO: 3851508 - RNA, 19 nt, Shigella flexneri 2a str. 2457T
ucaucucuucuuccggcac

SEQ ID NO: 3851509 - RNA, 16 nt, Shigella flexneri 2a str. 2457T
ucaucugauaucucac

SEQ ID NO: 3851510 - RNA, 19 nt, Shigella flexneri 2a str. 2457T
ucaucugauaucucaccag

SEQ ID NO: 3851511 - RNA, 15 nt, Shigella flexneri 2a str. 2457T
ucaucugcaccgauu

SEQ ID NO: 3851512 - RNA, 16 nt, Shigella flexneri 2a str. 2457T
ucaucuucaacugcca

SEQ ID NO: 3851513 - RNA, 21 nt, Shigella flexneri 2a str. 2457T
ucaucuucacuucaucccuga

SEQ ID NO: 3851514 - RNA, 15 nt, Shigella flexneri 2a str. 2457T
ucaucuucagucagg

SEQ ID NO: 3851515 - RNA, 13 nt, Shigella flexneri 2a str. 2457T
ucaucuucuucug

SEQ ID NO: 3851516 - RNA, 15 nt, Shigella flexneri 2a str. 2457T
ucaucuuguaggccu

SEQ ID NO: 3851517 - RNA, 15 nt, Shigella flexneri 2a str. 2457T
ucaucuuugaaauca

SEQ ID NO: 3851518 - RNA, 20 nt, Shigella flexneri 2a str. 2457T
ucaucuuugaaaucacgcau

SEQ ID NO: 3851519 - RNA, 21 nt, Shigella flexneri 2a str. 2457T
ucaucuuugagcaugauuuca

SEQ ID NO: 3851520 - RNA, 14 nt, Shigella flexneri 2a str. 2457T
ucaucuuugccuga

SEQ ID NO: 3851521 - RNA, 20 nt, Shigella flexneri 2a str. 2457T
ucaugaauauauaauuaaaa

SEQ ID NO: 3851522 - RNA, 23 nt, Shigella flexneri 2a str. 2457T
ucaugaauauauaauuaaaaaua

SEQ ID NO: 3851523 - RNA, 22 nt, Shigella flexneri 2a str. 2457T
ucaugacgauacggaauaucgc

SEQ ID NO: 3851524 - RNA, 17 nt, Shigella flexneri 2a str. 2457T
ucaugauacagccgaca

SEQ ID NO: 3851525 - RNA, 12 nt, Shigella flexneri 2a str. 2457T
ucaugcaauaaa

SEQ ID NO: 3851526 - RNA, 18 nt, Shigella flexneri 2a str. 2457T
ucaugccaaaaauaaucu

SEQ ID NO: 3851527 - RNA, 18 nt, Shigella flexneri 2a str. 2457T
ucaugccgaucgucuggg

SEQ ID NO: 3851528 - RNA, 19 nt, Shigella flexneri 2a str. 2457T
ucaugccgaucgucugggc

SEQ ID NO: 3851529 - RNA, 21 nt, Shigella flexneri 2a str. 2457T
ucaugccgccgcagaaaaaga

SEQ ID NO: 3851530 - RNA, 22 nt, Shigella flexneri 2a str. 2457T
ucaugccggccagcgccaccac

SEQ ID NO: 3851531 - RNA, 20 nt, Shigella flexneri 2a str. 2457T
ucaugccgggcaaaagucac

SEQ ID NO: 3851532 - RNA, 20 nt, Shigella flexneri 2a str. 2457T
ucaugccuacaaccguugcc

SEQ ID NO: 3851533 - RNA, 15 nt, Shigella flexneri 2a str. 2457T
ucaugccuacauauu

SEQ ID NO: 3851534 - RNA, 15 nt, Shigella flexneri 2a str. 2457T
ucaugcgccagguaa

SEQ ID NO: 3851535 - RNA, 21 nt, Shigella flexneri 2a str. 2457T
ucaugcgccagguaacgaaga

SEQ ID NO: 3851536 - RNA, 15 nt, Shigella flexneri 2a str. 2457T
ucaugcguuuguagg

SEQ ID NO: 3851537 - RNA, 16 nt, Shigella flexneri 2a str. 2457T
ucaugcuauuccuuga

SEQ ID NO: 3851538 - RNA, 20 nt, Shigella flexneri 2a str. 2457T
ucaugcucagaugccugaug

SEQ ID NO: 3851539 - RNA, 14 nt, Shigella flexneri 2a str. 2457T
ucauggugcaagaa

SEQ ID NO: 3851540 - RNA, 19 nt, Shigella flexneri 2a str. 2457T
uccagauaauuaugccgau

SEQ ID NO: 3851541 - RNA, 23 nt, Shigella flexneri 2a str. 2457T
uccagauagaacaucucuuccca

SEQ ID NO: 3851542 - RNA, 20 nt, Shigella flexneri 2a str. 2457T
uccagauccauaagguccuc

SEQ ID NO: 3851543 - RNA, 23 nt, Shigella flexneri 2a str. 2457T
uccagauccauaagguccuccag

SEQ ID NO: 3851544 - RNA, 18 nt, Shigella flexneri 2a str. 2457T
uccagaucgaucauauuu

SEQ ID NO: 3851545 - RNA, 17 nt, Shigella flexneri 2a str. 2457T
uccagaucugaaucauu

SEQ ID NO: 3851546 - RNA, 20 nt, Shigella flexneri 2a str. 2457T
uccagaugcgagaugucccc

SEQ ID NO: 3851547 - RNA, 20 nt, Shigella flexneri 2a str. 2457T
uccagauggcuauaaucacu

SEQ ID NO: 3851548 - RNA, 22 nt, Shigella flexneri 2a str. 2457T
uccagauucaguuucaccgcgu

SEQ ID NO: 3851549 - RNA, 17 nt, Shigella flexneri 2a str. 2457T
uccagauuuauaaaaga

SEQ ID NO: 3851550 - RNA, 14 nt, Shigella flexneri 2a str. 2457T
uccagauuuuucag

SEQ ID NO: 3851551 - RNA, 16 nt, Shigella flexneri 2a str. 2457T
uccagcaacaacagcg

SEQ ID NO: 3851552 - RNA, 19 nt, Shigella flexneri 2a str. 2457T
uccagcaacaacagcgcga

SEQ ID NO: 3851553 - RNA, 14 nt, Shigella flexneri 2a str. 2457T
uccagcaagccacu

SEQ ID NO: 3851554 - RNA, 17 nt, Shigella flexneri 2a str. 2457T
uccagcaaugucauaaa

SEQ ID NO: 3851555 - RNA, 10 nt, Shigella flexneri 2a str. 2457T
uccagcacca

SEQ ID NO: 3851556 - RNA, 13 nt, Shigella flexneri 2a str. 2457T
uccagcaccacuu

SEQ ID NO: 3851557 - RNA, 23 nt, Shigella flexneri 2a str. 2457T
uccagcacuugcaggaacagugc

SEQ ID NO: 3851558 - RNA, 17 nt, Shigella flexneri 2a str. 2457T
uccagcagaccagcaaa

SEQ ID NO: 3851559 - RNA, 18 nt, Shigella flexneri 2a str. 2457T
uccagcagaccagcaaaa

SEQ ID NO: 3851560 - RNA, 22 nt, Shigella flexneri 2a str. 2457T
uccagcagaccuucugccagac

SEQ ID NO: 3851561 - RNA, 12 nt, Shigella flexneri 2a str. 2457T
uccagcagcccu

SEQ ID NO: 3851562 - RNA, 14 nt, Shigella flexneri 2a str. 2457T
uccagcagcggauc

SEQ ID NO: 3851563 - RNA, 16 nt, Shigella flexneri 2a str. 2457T
uccagcauaaugugcg

SEQ ID NO: 3851564 - RNA, 22 nt, Shigella flexneri 2a str. 2457T
uccagcauaccuuccagcgcgu

SEQ ID NO: 3851565 - RNA, 18 nt, Shigella flexneri 2a str. 2457T
uccagcauaguacgggca

SEQ ID NO: 3851566 - RNA, 19 nt, Shigella flexneri 2a str. 2457T
uccagcauauguuuacgcu

SEQ ID NO: 3851567 - RNA, 16 nt, Shigella flexneri 2a str. 2457T
uccagcaucuccugca

SEQ ID NO: 3851568 - RNA, 16 nt, Shigella flexneri 2a str. 2457T
uccagcaucuguucuu

SEQ ID NO: 3851569 - RNA, 19 nt, Shigella flexneri 2a str. 2457T
uccagccacggcuccagca

SEQ ID NO: 3851570 - RNA, 12 nt, Shigella flexneri 2a str. 2457T
uccagccagagc

SEQ ID NO: 3851571 - RNA, 16 nt, Shigella flexneri 2a str. 2457T
uccagccagucggaac

SEQ ID NO: 3851572 - RNA, 20 nt, Shigella flexneri 2a str. 2457T
uccagccagucggaaccggc

SEQ ID NO: 3851573 - RNA, 23 nt, Shigella flexneri 2a str. 2457T
uccagccagucggaaccggcgau

SEQ ID NO: 3851574 - RNA, 17 nt, Shigella flexneri 2a str. 2457T
uccagccaguguuaacc

SEQ ID NO: 3851575 - RNA, 22 nt, Shigella flexneri 2a str. 2457T
uccagcccgcgcgaugagccgc

SEQ ID NO: 3851576 - RNA, 15 nt, Shigella flexneri 2a str. 2457T
uccagcccugccagg

SEQ ID NO: 3851577 - RNA, 16 nt, Shigella flexneri 2a str. 2457T
uccagcgacuccaguu

SEQ ID NO: 3851578 - RNA, 16 nt, Shigella flexneri 2a str. 2457T
uccagcgcaucgaucu

SEQ ID NO: 3851579 - RNA, 22 nt, Shigella flexneri 2a str. 2457T
uccagcgccgccagaagggaag

SEQ ID NO: 3851580 - RNA, 20 nt, Shigella flexneri 2a str. 2457T
uccagcgcggcgaaggugcc

SEQ ID NO: 3851581 - RNA, 18 nt, Shigella flexneri 2a str. 2457T
uccagcgcguaaauaccu

SEQ ID NO: 3851582 - RNA, 14 nt, Shigella flexneri 2a str. 2457T
uccagcggcaggcc

SEQ ID NO: 3851583 - RNA, 17 nt, Shigella flexneri 2a str. 2457T
uccagcguaccugccgc

SEQ ID NO: 3851584 - RNA, 16 nt, Shigella flexneri 2a str. 2457T
uccagcgucacgucac

SEQ ID NO: 3851585 - RNA, 16 nt, Shigella flexneri 2a str. 2457T
uccagcguuaccggcu

SEQ ID NO: 3851586 - RNA, 17 nt, Shigella flexneri 2a str. 2457T
uccagcguuaccggcuu

SEQ ID NO: 3851587 - RNA, 13 nt, Shigella flexneri 2a str. 2457T
uccagcucaacca

SEQ ID NO: 3851588 - RNA, 23 nt, Shigella flexneri 2a str. 2457T
uccagcuuauuagggaucaucuu

SEQ ID NO: 3851589 - RNA, 15 nt, Shigella flexneri 2a str. 2457T
uccagcuuccaggca

SEQ ID NO: 3851590 - RNA, 20 nt, Shigella flexneri 2a str. 2457T
uccagcuuuuuaaucgccau

SEQ ID NO: 3851591 - RNA, 17 nt, Shigella flexneri 2a str. 2457T
uccaggaacagaagaaa

SEQ ID NO: 3851592 - RNA, 13 nt, Shigella flexneri 2a str. 2457T
uccaggaacucca

SEQ ID NO: 3851593 - RNA, 23 nt, Shigella flexneri 2a str. 2457T
uccaggaagggcauaucagcaac

SEQ ID NO: 3851594 - RNA, 17 nt, Shigella flexneri 2a str. 2457T
uccaggagcuccagguc

SEQ ID NO: 3851595 - RNA, 20 nt, Shigella flexneri 2a str. 2457T
uccaggagcuccagguccuc

SEQ ID NO: 3851596 - RNA, 17 nt, Shigella flexneri 2a str. 2457T
uccaggaguuccggguc

SEQ ID NO: 3851597 - RNA, 23 nt, Shigella flexneri 2a str. 2457T
uccaggaguuccgggucauccag

SEQ ID NO: 3851598 - RNA, 20 nt, Shigella flexneri 2a str. 2457T
uccaggcagauuuuuuaacu

SEQ ID NO: 3851599 - RNA, 16 nt, Shigella flexneri 2a str. 2457T
uccaggcucgccgccg

SEQ ID NO: 3851600 - RNA, 22 nt, Shigella flexneri 2a str. 2457T
uccaggcugcaaagucugggcu

SEQ ID NO: 3851601 - RNA, 15 nt, Shigella flexneri 2a str. 2457T
uccagggccucuccu

SEQ ID NO: 3851602 - RNA, 15 nt, Shigella flexneri 2a str. 2457T
uccaggguaaacauc

SEQ ID NO: 3851603 - RNA, 14 nt, Shigella flexneri 2a str. 2457T
uccagguauuuaac

SEQ ID NO: 3851604 - RNA, 15 nt, Shigella flexneri 2a str. 2457T
uccagguauuuaacc

SEQ ID NO: 3851605 - RNA, 13 nt, Shigella flexneri 2a str. 2457T
uccagguccuccu

SEQ ID NO: 3851606 - RNA, 23 nt, Shigella flexneri 2a str. 2457T
uccagguccuccuguaccuucac

SEQ ID NO: 3851607 - RNA, 16 nt, Shigella flexneri 2a str. 2457T
uccaguaagcugugcg

SEQ ID NO: 3851608 - RNA, 22 nt, Shigella flexneri 2a str. 2457T
uccaguacaugaagcacugcau

SEQ ID NO: 3851609 - RNA, 15 nt, Shigella flexneri 2a str. 2457T
uccaguaccugcaaa

SEQ ID NO: 3851610 - RNA, 22 nt, Shigella flexneri 2a str. 2457T
uccaguacgcguacacuuuccu

SEQ ID NO: 3851611 - RNA, 19 nt, Shigella flexneri 2a str. 2457T
uccagucagugguuugccc

SEQ ID NO: 3851612 - RNA, 17 nt, Shigella flexneri 2a str. 2457T
uccagucgagaaccuga

SEQ ID NO: 3851613 - RNA, 20 nt, Shigella flexneri 2a str. 2457T
uccagucgcaaaccuggcau

SEQ ID NO: 3851614 - RNA, 15 nt, Shigella flexneri 2a str. 2457T
uccagucgcugcuga

SEQ ID NO: 3851615 - RNA, 16 nt, Shigella flexneri 2a str. 2457T
uccagucgcugcugac

SEQ ID NO: 3851616 - RNA, 22 nt, Shigella flexneri 2a str. 2457T
uccagucggcguaauccugaaa

SEQ ID NO: 3851617 - RNA, 13 nt, Shigella flexneri 2a str. 2457T
uccagugauucca

SEQ ID NO: 3851618 - RNA, 16 nt, Shigella flexneri 2a str. 2457T
uccagugcauccagca

SEQ ID NO: 3851619 - RNA, 19 nt, Shigella flexneri 2a str. 2457T
uccagugcauccagcacga

SEQ ID NO: 3851620 - RNA, 21 nt, Shigella flexneri 2a str. 2457T
uccagugccggaugauucaca

SEQ ID NO: 3851621 - RNA, 17 nt, Shigella flexneri 2a str. 2457T
uccagugccucaagaau

SEQ ID NO: 3851622 - RNA, 21 nt, Shigella flexneri 2a str. 2457T
uccagugcguacccagcgugu

SEQ ID NO: 3851623 - RNA, 21 nt, Shigella flexneri 2a str. 2457T
uccagugcguccgguuuacuu

SEQ ID NO: 3851624 - RNA, 12 nt, Shigella flexneri 2a str. 2457T
uccaguggcuga

SEQ ID NO: 3851625 - RNA, 16 nt, Shigella flexneri 2a str. 2457T
uccaguggugauacca

SEQ ID NO: 3851626 - RNA, 20 nt, Shigella flexneri 2a str. 2457T
uccaguuaucaagccauagc

SEQ ID NO: 3851627 - RNA, 20 nt, Shigella flexneri 2a str. 2457T
uccaguucaagugcuaccca

SEQ ID NO: 3851628 - RNA, 19 nt, Shigella flexneri 2a str. 2457T
uccaguucgaucucuucgc

SEQ ID NO: 3851629 - RNA, 15 nt, Shigella flexneri 2a str. 2457T
uccaguucugcuuca

SEQ ID NO: 3851630 - RNA, 14 nt, Shigella flexneri 2a str. 2457T
uccaguugauacag

SEQ ID NO: 3851631 - RNA, 23 nt, Shigella flexneri 2a str. 2457T
uccaguuugcucaaauccaucag

SEQ ID NO: 3851632 - RNA, 16 nt, Shigella flexneri 2a str. 2457T
uccaguuuucaaauau

SEQ ID NO: 3851633 - RNA, 13 nt, Shigella flexneri 2a str. 2457T
uccauaagguccu

SEQ ID NO: 3851634 - RNA, 11 nt, Shigella flexneri 2a str. 2457T
uccauacagcu

SEQ ID NO: 3851635 - RNA, 22 nt, Shigella flexneri 2a str. 2457T
uccauacagcucagguucaacc

SEQ ID NO: 3851636 - RNA, 16 nt, Shigella flexneri 2a str. 2457T
uccauacccagcauca

SEQ ID NO: 3851637 - RNA, 15 nt, Shigella flexneri 2a str. 2457T
ucccggcagagaaaa

SEQ ID NO: 3851638 - RNA, 21 nt, Shigella flexneri 2a str. 2457T
ucccgggucgcgacugccagc

SEQ ID NO: 3851639 - RNA, 17 nt, Shigella flexneri 2a str. 2457T
ucccggucaguagaaua

SEQ ID NO: 3851640 - RNA, 13 nt, Shigella flexneri 2a str. 2457T
ucccggugaagcg

SEQ ID NO: 3851641 - RNA, 24 nt, Shigella flexneri 2a str. 2457T
ucccguacccagcaagaccgcgac

SEQ ID NO: 3851642 - RNA, 17 nt, Shigella flexneri 2a str. 2457T
ucccguauuacugagau

SEQ ID NO: 3851643 - RNA, 19 nt, Shigella flexneri 2a str. 2457T
ucccgucaggagcuggaug

SEQ ID NO: 3851644 - RNA, 14 nt, Shigella flexneri 2a str. 2457T
ucccgugaugcggu

SEQ ID NO: 3851645 - RNA, 14 nt, Shigella flexneri 2a str. 2457T
ucccgugcacaaau

SEQ ID NO: 3851646 - RNA, 16 nt, Shigella flexneri 2a str. 2457T
ucccgugccagagcau

SEQ ID NO: 3851647 - RNA, 15 nt, Shigella flexneri 2a str. 2457T
ucccguuucccuguc

SEQ ID NO: 3851648 - RNA, 12 nt, Shigella flexneri 2a str. 2457T
ucccuaaaauau

SEQ ID NO: 3851649 - RNA, 19 nt, Shigella flexneri 2a str. 2457T
ucccuacucucgcaugggg

SEQ ID NO: 3851650 - RNA, 15 nt, Shigella flexneri 2a str. 2457T
ucccuauuuuuucgu

SEQ ID NO: 3851651 - RNA, 22 nt, Shigella flexneri 2a str. 2457T
ucccucaacaacagucucugcc

SEQ ID NO: 3851652 - RNA, 13 nt, Shigella flexneri 2a str. 2457T
ucccucauauuua

SEQ ID NO: 3851653 - RNA, 21 nt, Shigella flexneri 2a str. 2457T
ucccucgccccuucggggaga

SEQ ID NO: 3851654 - RNA, 14 nt, Shigella flexneri 2a str. 2457T
ucccucuuucuggc

SEQ ID NO: 3851655 - RNA, 11 nt, Shigella flexneri 2a str. 2457T
ucccugaaggc

SEQ ID NO: 3851656 - RNA, 21 nt, Shigella flexneri 2a str. 2457T
ucccugacaaaucaugcggau

SEQ ID NO: 3851657 - RNA, 20 nt, Shigella flexneri 2a str. 2457T
ucccugaugcaucagucacg

SEQ ID NO: 3851658 - RNA, 22 nt, Shigella flexneri 2a str. 2457T
ucccugcaauagauugaauuag

SEQ ID NO: 3851659 - RNA, 11 nt, Shigella flexneri 2a str. 2457T
ucccugcauau

SEQ ID NO: 3851660 - RNA, 16 nt, Shigella flexneri 2a str. 2457T
ucccugccuccaugaa

SEQ ID NO: 3851661 - RNA, 11 nt, Shigella flexneri 2a str. 2457T
ucccugcggua

SEQ ID NO: 3851662 - RNA, 14 nt, Shigella flexneri 2a str. 2457T
ucccugcgguaagu

SEQ ID NO: 3851663 - RNA, 16 nt, Shigella flexneri 2a str. 2457T
ucccugcuguccugag

SEQ ID NO: 3851664 - RNA, 21 nt, Shigella flexneri 2a str. 2457T
ucccuggcccaucgccagugc

SEQ ID NO: 3851665 - RNA, 15 nt, Shigella flexneri 2a str. 2457T
ucccugguaaaaaau

SEQ ID NO: 3851666 - RNA, 19 nt, Shigella flexneri 2a str. 2457T
ucccuuaacacuuguuaug

SEQ ID NO: 3851667 - RNA, 17 nt, Shigella flexneri 2a str. 2457T
ucccuuagcuaauuuuu

SEQ ID NO: 3851668 - RNA, 18 nt, Shigella flexneri 2a str. 2457T
ucccuuaguaacgccagc

SEQ ID NO: 3851669 - RNA, 13 nt, Shigella flexneri 2a str. 2457T
ucccuucaaucuc

SEQ ID NO: 3851670 - RNA, 17 nt, Shigella flexneri 2a str. 2457T
ucccuucagccaccagg

SEQ ID NO: 3851671 - RNA, 20 nt, Shigella flexneri 2a str. 2457T
ucccuucagccaccagguuc

SEQ ID NO: 3851672 - RNA, 21 nt, Shigella flexneri 2a str. 2457T
ucccuucagccaccagguuca

SEQ ID NO: 3851673 - RNA, 21 nt, Shigella flexneri 2a str. 2457T
ucccuuccgcaauacagccag

SEQ ID NO: 3851674 - RNA, 19 nt, Shigella flexneri 2a str. 2457T
ucccuuccggugcaaucag

SEQ ID NO: 3851675 - RNA, 16 nt, Shigella flexneri 2a str. 2457T
ucccuugcucugguuc

SEQ ID NO: 3851676 - RNA, 22 nt, Shigella flexneri 2a str. 2457T
ucccuuucagcaaaccacugau

SEQ ID NO: 3851677 - RNA, 14 nt, Shigella flexneri 2a str. 2457T
ucccuuucgauaag

SEQ ID NO: 3851678 - RNA, 13 nt, Shigella flexneri 2a str. 2457T
ucccuuucugcag

SEQ ID NO: 3851679 - RNA, 19 nt, Shigella flexneri 2a str. 2457T
ucccuuuugcaguuaaaau

SEQ ID NO: 3851680 - RNA, 13 nt, Shigella flexneri 2a str. 2457T
uccgaaaaaggau

SEQ ID NO: 3851681 - RNA, 21 nt, Shigella flexneri 2a str. 2457T
uccgaauacggucuuuuuaua

SEQ ID NO: 3851682 - RNA, 15 nt, Shigella flexneri 2a str. 2457T
uccgacaucaaccgc

SEQ ID NO: 3851683 - RNA, 20 nt, Shigella flexneri 2a str. 2457T
uccgacauuucugcugccua

SEQ ID NO: 3851684 - RNA, 15 nt, Shigella flexneri 2a str. 2457T
uccgagguuaauauu

SEQ ID NO: 3851685 - RNA, 17 nt, Shigella flexneri 2a str. 2457T
uccgcaaagcgccaggg

SEQ ID NO: 3851686 - RNA, 16 nt, Shigella flexneri 2a str. 2457T
uccgcaaauaacguaa

SEQ ID NO: 3851687 - RNA, 22 nt, Shigella flexneri 2a str. 2457T
uccgcaagcgaaugaggcagca

SEQ ID NO: 3851688 - RNA, 14 nt, Shigella flexneri 2a str. 2457T
uccgcaauacagcc

SEQ ID NO: 3851689 - RNA, 18 nt, Shigella flexneri 2a str. 2457T
uccgcaccaacuccacuu

SEQ ID NO: 3851690 - RNA, 22 nt, Shigella flexneri 2a str. 2457T
uccgcaccaacuccacuucacc

SEQ ID NO: 3851691 - RNA, 20 nt, Shigella flexneri 2a str. 2457T
uccgcaccugaguaauuaau

SEQ ID NO: 3851692 - RNA, 17 nt, Shigella flexneri 2a str. 2457T
uccgcauccggcauaaa

SEQ ID NO: 3851693 - RNA, 19 nt, Shigella flexneri 2a str. 2457T
uccgcaugauucugagaaa

SEQ ID NO: 3851694 - RNA, 21 nt, Shigella flexneri 2a str. 2457T
uccgcauuuguaggcaggaua

SEQ ID NO: 3851695 - RNA, 13 nt, Shigella flexneri 2a str. 2457T
uccgccaccugcg

SEQ ID NO: 3851696 - RNA, 21 nt, Shigella flexneri 2a str. 2457T
uccgccagaccaaucaccacu

SEQ ID NO: 3851697 - RNA, 18 nt, Shigella flexneri 2a str. 2457T
uccgccagauuuauuuac

SEQ ID NO: 3851698 - RNA, 13 nt, Shigella flexneri 2a str. 2457T
uccgccagcgcca

SEQ ID NO: 3851699 - RNA, 11 nt, Shigella flexneri 2a str. 2457T
uccgccagcgg

SEQ ID NO: 3851700 - RNA, 21 nt, Shigella flexneri 2a str. 2457T
uccgccagcuccgggcugguu

SEQ ID NO: 3851701 - RNA, 17 nt, Shigella flexneri 2a str. 2457T
uccgccagugccaaagc

SEQ ID NO: 3851702 - RNA, 17 nt, Shigella flexneri 2a str. 2457T
uccgccaguucuuccag

SEQ ID NO: 3851703 - RNA, 18 nt, Shigella flexneri 2a str. 2457T
uccgccaguucuuccagu

SEQ ID NO: 3851704 - RNA, 14 nt, Shigella flexneri 2a str. 2457T
uccgccaucagucg

SEQ ID NO: 3851705 - RNA, 18 nt, Shigella flexneri 2a str. 2457T
uccgccauccaccagcau

SEQ ID NO: 3851706 - RNA, 15 nt, Shigella flexneri 2a str. 2457T
uccgccauuuuaauc

SEQ ID NO: 3851707 - RNA, 16 nt, Shigella flexneri 2a str. 2457T
uccgccccauuuuuaa

SEQ ID NO: 3851708 - RNA, 16 nt, Shigella flexneri 2a str. 2457T
uccgccgccagcagac

SEQ ID NO: 3851709 - RNA, 21 nt, Shigella flexneri 2a str. 2457T
uccgccgccauugacguuccu

SEQ ID NO: 3851710 - RNA, 19 nt, Shigella flexneri 2a str. 2457T
uccgccguacgccgggugc

SEQ ID NO: 3851711 - RNA, 18 nt, Shigella flexneri 2a str. 2457T
uccgccgucgggucagcu

SEQ ID NO: 3851712 - RNA, 17 nt, Shigella flexneri 2a str. 2457T
uccgccguggaugcgau

SEQ ID NO: 3851713 - RNA, 18 nt, Shigella flexneri 2a str. 2457T
uccgccucuaacagauca

SEQ ID NO: 3851714 - RNA, 23 nt, Shigella flexneri 2a str. 2457T
uccgccucuaacagaucauccau

SEQ ID NO: 3851715 - RNA, 15 nt, Shigella flexneri 2a str. 2457T
uccgcgacuggcaug

SEQ ID NO: 3851716 - RNA, 18 nt, Shigella flexneri 2a str. 2457T
uccgcggcuuugucauaa

SEQ ID NO: 3851717 - RNA, 19 nt, Shigella flexneri 2a str. 2457T
uccgcgucauugacgcugg

SEQ ID NO: 3851718 - RNA, 17 nt, Shigella flexneri 2a str. 2457T
uccgcgugacgcuggca

SEQ ID NO: 3851719 - RNA, 20 nt, Shigella flexneri 2a str. 2457T
uccgcuaguguacccuucgu

SEQ ID NO: 3851720 - RNA, 16 nt, Shigella flexneri 2a str. 2457T
uccgcuaucaguucag

SEQ ID NO: 3851721 - RNA, 21 nt, Shigella flexneri 2a str. 2457T
uccgcuaucaguucagaagcu

SEQ ID NO: 3851722 - RNA, 13 nt, Shigella flexneri 2a str. 2457T
uccgcuauuucuu

SEQ ID NO: 3851723 - RNA, 20 nt, Shigella flexneri 2a str. 2457T
uccgcucggucacugacacc

SEQ ID NO: 3851724 - RNA, 18 nt, Shigella flexneri 2a str. 2457T
uccgcucucauccauucg

SEQ ID NO: 3851725 - RNA, 14 nt, Shigella flexneri 2a str. 2457T
uccgcugagacgcg

SEQ ID NO: 3851726 - RNA, 21 nt, Shigella flexneri 2a str. 2457T
uccgcugauucaaaaccgguu

SEQ ID NO: 3851727 - RNA, 20 nt, Shigella flexneri 2a str. 2457T
uccgcugauucaagauuagc

SEQ ID NO: 3851728 - RNA, 18 nt, Shigella flexneri 2a str. 2457T
uccgcugcgguaagguug

SEQ ID NO: 3851729 - RNA, 23 nt, Shigella flexneri 2a str. 2457T
uccgcuggagcggggaacaccuc

SEQ ID NO: 3851730 - RNA, 17 nt, Shigella flexneri 2a str. 2457T
uccgcuggcccaucaga

SEQ ID NO: 3851731 - RNA, 16 nt, Shigella flexneri 2a str. 2457T
uccgcuggcgucuggg

SEQ ID NO: 3851732 - RNA, 17 nt, Shigella flexneri 2a str. 2457T
uccgcuggcgucugggc

SEQ ID NO: 3851733 - RNA, 21 nt, Shigella flexneri 2a str. 2457T
uccgcuuacucauccacugcc

SEQ ID NO: 3851734 - RNA, 20 nt, Shigella flexneri 2a str. 2457T
uccucuucccagacccaguu

SEQ ID NO: 3851735 - RNA, 23 nt, Shigella flexneri 2a str. 2457T
uccugaacggucgaggcaaccag

SEQ ID NO: 3851736 - RNA, 14 nt, Shigella flexneri 2a str. 2457T
uccugaacuuucuc

SEQ ID NO: 3851737 - RNA, 14 nt, Shigella flexneri 2a str. 2457T
uccugaagacgccu

SEQ ID NO: 3851738 - RNA, 19 nt, Shigella flexneri 2a str. 2457T
uccugaagacgccucgcau

SEQ ID NO: 3851739 - RNA, 15 nt, Shigella flexneri 2a str. 2457T
uccugaagaugcugc

SEQ ID NO: 3851740 - RNA, 21 nt, Shigella flexneri 2a str. 2457T
uccugaagcgcuggggaaaau

SEQ ID NO: 3851741 - RNA, 18 nt, Shigella flexneri 2a str. 2457T
uccugacaagguacgaaa

SEQ ID NO: 3851742 - RNA, 22 nt, Shigella flexneri 2a str. 2457T
uccugacggugauacagcaaaa

SEQ ID NO: 3851743 - RNA, 18 nt, Shigella flexneri 2a str. 2457T
uccugacuccuguaucgu

SEQ ID NO: 3851744 - RNA, 20 nt, Shigella flexneri 2a str. 2457T
uccugacuccuguaucguca

SEQ ID NO: 3851745 - RNA, 16 nt, Shigella flexneri 2a str. 2457T
uccugagcacuggggc

SEQ ID NO: 3851746 - RNA, 18 nt, Shigella flexneri 2a str. 2457T
uccugagcuauaccaugc

SEQ ID NO: 3851747 - RNA, 22 nt, Shigella flexneri 2a str. 2457T
uccugauaaaaaccauucaggc

SEQ ID NO: 3851748 - RNA, 23 nt, Shigella flexneri 2a str. 2457T
uccugaucaagcacaugcugaca

SEQ ID NO: 3851749 - RNA, 23 nt, Shigella flexneri 2a str. 2457T
uccugcaaacaguaacccggcac

SEQ ID NO: 3851750 - RNA, 19 nt, Shigella flexneri 2a str. 2457T
uccugcaaauucaucgcug

SEQ ID NO: 3851751 - RNA, 13 nt, Shigella flexneri 2a str. 2457T
uccugcaacagca

SEQ ID NO: 3851752 - RNA, 14 nt, Shigella flexneri 2a str. 2457T
uccugcaacagcac

SEQ ID NO: 3851753 - RNA, 21 nt, Shigella flexneri 2a str. 2457T
uccugcaacuucucuuucggc

SEQ ID NO: 3851754 - RNA, 14 nt, Shigella flexneri 2a str. 2457T
uccugcaagccaac

SEQ ID NO: 3851755 - RNA, 22 nt, Shigella flexneri 2a str. 2457T
uccugcacggcuucccacguca

SEQ ID NO: 3851756 - RNA, 15 nt, Shigella flexneri 2a str. 2457T
uccugcacuuucagc

SEQ ID NO: 3851757 - RNA, 15 nt, Shigella flexneri 2a str. 2457T
uccugcagcguugcc

SEQ ID NO: 3851758 - RNA, 17 nt, Shigella flexneri 2a str. 2457T
uccugccaguuuuuccg

SEQ ID NO: 3851759 - RNA, 18 nt, Shigella flexneri 2a str. 2457T
uccugcccacuccagcua

SEQ ID NO: 3851760 - RNA, 19 nt, Shigella flexneri 2a str. 2457T
uccugccgcguuggcaaug

SEQ ID NO: 3851761 - RNA, 13 nt, Shigella flexneri 2a str. 2457T
uccugcgcuucca

SEQ ID NO: 3851762 - RNA, 16 nt, Shigella flexneri 2a str. 2457T
uccugcgcuuccagcu

SEQ ID NO: 3851763 - RNA, 17 nt, Shigella flexneri 2a str. 2457T
uccugcgcuuccagcuc

SEQ ID NO: 3851764 - RNA, 18 nt, Shigella flexneri 2a str. 2457T
uccugcggagcaaccugc

SEQ ID NO: 3851765 - RNA, 20 nt, Shigella flexneri 2a str. 2457T
uccugcggaugcgccaucca

SEQ ID NO: 3851766 - RNA, 21 nt, Shigella flexneri 2a str. 2457T
uccugcggcagacgcucgcca

SEQ ID NO: 3851767 - RNA, 23 nt, Shigella flexneri 2a str. 2457T
uccugcggcagacgcucgccauu

SEQ ID NO: 3851768 - RNA, 13 nt, Shigella flexneri 2a str. 2457T
uccugcgucgcua

SEQ ID NO: 3851769 - RNA, 19 nt, Shigella flexneri 2a str. 2457T
uccugcugcacgcccugau

SEQ ID NO: 3851770 - RNA, 17 nt, Shigella flexneri 2a str. 2457T
uccuggaacagaccgac

SEQ ID NO: 3851771 - RNA, 19 nt, Shigella flexneri 2a str. 2457T
uccuggaucacaauccgcu

SEQ ID NO: 3851772 - RNA, 23 nt, Shigella flexneri 2a str. 2457T
uccuggcgaaaacgcccggcauu

SEQ ID NO: 3851773 - RNA, 13 nt, Shigella flexneri 2a str. 2457T
uccuggcgcuggg

SEQ ID NO: 3851774 - RNA, 19 nt, Shigella flexneri 2a str. 2457T
uccuggcggggauuauugc

SEQ ID NO: 3851775 - RNA, 19 nt, Shigella flexneri 2a str. 2457T
uccuggcgguuaauaauga

SEQ ID NO: 3851776 - RNA, 20 nt, Shigella flexneri 2a str. 2457T
uccuggcgguuaauaaugau

SEQ ID NO: 3851777 - RNA, 21 nt, Shigella flexneri 2a str. 2457T
uccuggcgguuaauaaugauu

SEQ ID NO: 3851778 - RNA, 21 nt, Shigella flexneri 2a str. 2457T
uccuggcugauugauauccag

SEQ ID NO: 3851779 - RNA, 21 nt, Shigella flexneri 2a str. 2457T
uccuggcuguuacucaacuga

SEQ ID NO: 3851780 - RNA, 14 nt, Shigella flexneri 2a str. 2457T
uccuggcuuggcug

SEQ ID NO: 3851781 - RNA, 18 nt, Shigella flexneri 2a str. 2457T
uccuggggguucaucacc

SEQ ID NO: 3851782 - RNA, 22 nt, Shigella flexneri 2a str. 2457T
uccuggggguucaucaccacug

SEQ ID NO: 3851783 - RNA, 18 nt, Shigella flexneri 2a str. 2457T
uccuggggucaucagcau

SEQ ID NO: 3851784 - RNA, 18 nt, Shigella flexneri 2a str. 2457T
uccugguaguccaggaug

SEQ ID NO: 3851785 - RNA, 18 nt, Shigella flexneri 2a str. 2457T
uccugguuucuggucauu

SEQ ID NO: 3851786 - RNA, 18 nt, Shigella flexneri 2a str. 2457T
uccuguaaugagaauaau

SEQ ID NO: 3851787 - RNA, 18 nt, Shigella flexneri 2a str. 2457T
uccuguagcuggaaaauc

SEQ ID NO: 3851788 - RNA, 13 nt, Shigella flexneri 2a str. 2457T
uccuguaucguca

SEQ ID NO: 3851789 - RNA, 15 nt, Shigella flexneri 2a str. 2457T
uccuguaugacccgg

SEQ ID NO: 3851790 - RNA, 15 nt, Shigella flexneri 2a str. 2457T
uccugucuucccugc

SEQ ID NO: 3851791 - RNA, 22 nt, Shigella flexneri 2a str. 2457T
uccuguucaaacauuagcgcau

SEQ ID NO: 3851792 - RNA, 15 nt, Shigella flexneri 2a str. 2457T
uccuguucauccucu

SEQ ID NO: 3851793 - RNA, 23 nt, Shigella flexneri 2a str. 2457T
uccuguucugugcgccaugcuuc

SEQ ID NO: 3851794 - RNA, 20 nt, Shigella flexneri 2a str. 2457T
uccuguugucuuuccagacu

SEQ ID NO: 3851795 - RNA, 13 nt, Shigella flexneri 2a str. 2457T
uccuguuucacuu

SEQ ID NO: 3851796 - RNA, 15 nt, Shigella flexneri 2a str. 2457T
uccuguuucggacuu

SEQ ID NO: 3851797 - RNA, 14 nt, Shigella flexneri 2a str. 2457T
uccuuaaacaccug

SEQ ID NO: 3851798 - RNA, 18 nt, Shigella flexneri 2a str. 2457T
uccuuaacuccucgccuu

SEQ ID NO: 3851799 - RNA, 17 nt, Shigella flexneri 2a str. 2457T
uccuuaauaaaaauuuu

SEQ ID NO: 3851800 - RNA, 15 nt, Shigella flexneri 2a str. 2457T
uccuuacugcccccg

SEQ ID NO: 3851801 - RNA, 15 nt, Shigella flexneri 2a str. 2457T
uccuuaugaacgacc

SEQ ID NO: 3851802 - RNA, 20 nt, Shigella flexneri 2a str. 2457T
uccuucaaacguuuugcaau

SEQ ID NO: 3851803 - RNA, 13 nt, Shigella flexneri 2a str. 2457T
uccuucaacccgc

SEQ ID NO: 3851804 - RNA, 23 nt, Shigella flexneri 2a str. 2457T
uccuucacuuuugccagacgaau

SEQ ID NO: 3851805 - RNA, 12 nt, Shigella flexneri 2a str. 2457T
uccuucagcaac

SEQ ID NO: 3851806 - RNA, 20 nt, Shigella flexneri 2a str. 2457T
uccuucaucuucaacugcca

SEQ ID NO: 3851807 - RNA, 12 nt, Shigella flexneri 2a str. 2457T
uccuuccagcug

SEQ ID NO: 3851808 - RNA, 13 nt, Shigella flexneri 2a str. 2457T
uccuuccagguca

SEQ ID NO: 3851809 - RNA, 15 nt, Shigella flexneri 2a str. 2457T
uccuucccccaccac

SEQ ID NO: 3851810 - RNA, 22 nt, Shigella flexneri 2a str. 2457T
uccuuccuuggauauuuuaauc

SEQ ID NO: 3851811 - RNA, 15 nt, Shigella flexneri 2a str. 2457T
uccuucgauaaaagc

SEQ ID NO: 3851812 - RNA, 16 nt, Shigella flexneri 2a str. 2457T
uccuucgauaaaagcc

SEQ ID NO: 3851813 - RNA, 21 nt, Shigella flexneri 2a str. 2457T
uccuucgauaaaagccauccc

SEQ ID NO: 3851814 - RNA, 19 nt, Shigella flexneri 2a str. 2457T
uccuucgcagacugggcaa

SEQ ID NO: 3851815 - RNA, 16 nt, Shigella flexneri 2a str. 2457T
uccuucugucaugauu

SEQ ID NO: 3851816 - RNA, 16 nt, Shigella flexneri 2a str. 2457T
uccuuuaccucgaaaa

SEQ ID NO: 3851817 - RNA, 21 nt, Shigella flexneri 2a str. 2457T
uccuuuguacaggauauauuu

SEQ ID NO: 3851818 - RNA, 20 nt, Shigella flexneri 2a str. 2457T
uccuuuuaccacuacaucaa

SEQ ID NO: 3851819 - RNA, 16 nt, Shigella flexneri 2a str. 2457T
uccuuuuauuuaaccg

SEQ ID NO: 3851820 - RNA, 19 nt, Shigella flexneri 2a str. 2457T
ucgaaaaacucuccucguu

SEQ ID NO: 3851821 - RNA, 16 nt, Shigella flexneri 2a str. 2457T
ucgaaaaccacuccug

SEQ ID NO: 3851822 - RNA, 14 nt, Shigella flexneri 2a str. 2457T
ucgaaaaucucaua

SEQ ID NO: 3851823 - RNA, 13 nt, Shigella flexneri 2a str. 2457T
ucgaaaaugcgca

SEQ ID NO: 3851824 - RNA, 23 nt, Shigella flexneri 2a str. 2457T
ucgaaaccaagaccaauccgcca

SEQ ID NO: 3851825 - RNA, 17 nt, Shigella flexneri 2a str. 2457T
ucgaaaucaacauguuc

SEQ ID NO: 3851826 - RNA, 24 nt, Shigella flexneri 2a str. 2457T
ucgaaauccauguugcuggaagau

SEQ ID NO: 3851827 - RNA, 15 nt, Shigella flexneri 2a str. 2457T
ucgaacaaaaaaagc

SEQ ID NO: 3851828 - RNA, 16 nt, Shigella flexneri 2a str. 2457T
ucgaacauacacaagc

SEQ ID NO: 3851829 - RNA, 17 nt, Shigella flexneri 2a str. 2457T
ucgaacauacacaagcc

SEQ ID NO: 3851830 - RNA, 20 nt, Shigella flexneri 2a str. 2457T
ucgaaccaucggcuuuggca

SEQ ID NO: 3851831 - RNA, 20 nt, Shigella flexneri 2a str. 2457T
ucgcaggcgguggaagcacc

SEQ ID NO: 3851832 - RNA, 18 nt, Shigella flexneri 2a str. 2457T
ucgcaggcugagaaaugc

SEQ ID NO: 3851833 - RNA, 20 nt, Shigella flexneri 2a str. 2457T
ucgcaggcugagaaaugcca

SEQ ID NO: 3851834 - RNA, 22 nt, Shigella flexneri 2a str. 2457T
ucgcagggaucauccacccgca

SEQ ID NO: 3851835 - RNA, 16 nt, Shigella flexneri 2a str. 2457T
ucgcagguauaccgga

SEQ ID NO: 3851836 - RNA, 17 nt, Shigella flexneri 2a str. 2457T
ucgcaguagccaugcau

SEQ ID NO: 3851837 - RNA, 14 nt, Shigella flexneri 2a str. 2457T
ucgcagucgccagc

SEQ ID NO: 3851838 - RNA, 22 nt, Shigella flexneri 2a str. 2457T
ucgcauacaaaaacacauucaa

SEQ ID NO: 3851839 - RNA, 15 nt, Shigella flexneri 2a str. 2457T
ucgcauaucuucaac

SEQ ID NO: 3851840 - RNA, 15 nt, Shigella flexneri 2a str. 2457T
ucgcaucaggcauuu

SEQ ID NO: 3851841 - RNA, 20 nt, Shigella flexneri 2a str. 2457T
ucgcaucaggcauuugcucc

SEQ ID NO: 3851842 - RNA, 22 nt, Shigella flexneri 2a str. 2457T
ucgcaucccgguaucaaagcgc

SEQ ID NO: 3851843 - RNA, 15 nt, Shigella flexneri 2a str. 2457T
ucgcauccggcacua

SEQ ID NO: 3851844 - RNA, 22 nt, Shigella flexneri 2a str. 2457T
ucgcaucgaugguugcccugcu

SEQ ID NO: 3851845 - RNA, 17 nt, Shigella flexneri 2a str. 2457T
ucgcaucggauugcucc

SEQ ID NO: 3851846 - RNA, 23 nt, Shigella flexneri 2a str. 2457T
ucgcauggccuaaauccuccacg

SEQ ID NO: 3851847 - RNA, 17 nt, Shigella flexneri 2a str. 2457T
ucgcauggcggaucacg

SEQ ID NO: 3851848 - RNA, 17 nt, Shigella flexneri 2a str. 2457T
ucgcauuaacagccaga

SEQ ID NO: 3851849 - RNA, 22 nt, Shigella flexneri 2a str. 2457T
ucgccaaaugucaccagccgau

SEQ ID NO: 3851850 - RNA, 13 nt, Shigella flexneri 2a str. 2457T
ucgccaaguucga

SEQ ID NO: 3851851 - RNA, 23 nt, Shigella flexneri 2a str. 2457T
ucgccaaguucgaacgccgccag

SEQ ID NO: 3851852 - RNA, 21 nt, Shigella flexneri 2a str. 2457T
ucgccaaugaaguggcauccg

SEQ ID NO: 3851853 - RNA, 13 nt, Shigella flexneri 2a str. 2457T
ucgccaccggcac

SEQ ID NO: 3851854 - RNA, 16 nt, Shigella flexneri 2a str. 2457T
ucgccacggcaugaaa

SEQ ID NO: 3851855 - RNA, 19 nt, Shigella flexneri 2a str. 2457T
ucgccacggcaugaaagcg

SEQ ID NO: 3851856 - RNA, 16 nt, Shigella flexneri 2a str. 2457T
ucgccacuaaagccug

SEQ ID NO: 3851857 - RNA, 13 nt, Shigella flexneri 2a str. 2457T
ucgccagaaauca

SEQ ID NO: 3851858 - RNA, 16 nt, Shigella flexneri 2a str. 2457T
ucgccagcaacacaaa

SEQ ID NO: 3851859 - RNA, 14 nt, Shigella flexneri 2a str. 2457T
ucgccagcaucggc

SEQ ID NO: 3851860 - RNA, 20 nt, Shigella flexneri 2a str. 2457T
ucgccagccucccagccauu

SEQ ID NO: 3851861 - RNA, 13 nt, Shigella flexneri 2a str. 2457T
ucgccagcggcag

SEQ ID NO: 3851862 - RNA, 13 nt, Shigella flexneri 2a str. 2457T
ucgccagcucaag

SEQ ID NO: 3851863 - RNA, 20 nt, Shigella flexneri 2a str. 2457T
ucgccaggcuuaccgccacu

SEQ ID NO: 3851864 - RNA, 18 nt, Shigella flexneri 2a str. 2457T
ucgccaguaccagcagcg

SEQ ID NO: 3851865 - RNA, 16 nt, Shigella flexneri 2a str. 2457T
ucgccagucccuuuca

SEQ ID NO: 3851866 - RNA, 18 nt, Shigella flexneri 2a str. 2457T
ucgccagucccuuucagg

SEQ ID NO: 3851867 - RNA, 19 nt, Shigella flexneri 2a str. 2457T
ucgccagucccuuucaggu

SEQ ID NO: 3851868 - RNA, 14 nt, Shigella flexneri 2a str. 2457T
ucgccaguccuuca

SEQ ID NO: 3851869 - RNA, 19 nt, Shigella flexneri 2a str. 2457T
ucgccauaauaagcgccau

SEQ ID NO: 3851870 - RNA, 15 nt, Shigella flexneri 2a str. 2457T
ucgccaucaaaucac

SEQ ID NO: 3851871 - RNA, 20 nt, Shigella flexneri 2a str. 2457T
ucgccaucccugucguccag

SEQ ID NO: 3851872 - RNA, 23 nt, Shigella flexneri 2a str. 2457T
ucgccauccgaauucacuuaauc

SEQ ID NO: 3851873 - RNA, 22 nt, Shigella flexneri 2a str. 2457T
ucgccaucuuuacaccuuacuu

SEQ ID NO: 3851874 - RNA, 17 nt, Shigella flexneri 2a str. 2457T
ucgccaugaacgcgaag

SEQ ID NO: 3851875 - RNA, 22 nt, Shigella flexneri 2a str. 2457T
ucgccauggucggcagagaguu

SEQ ID NO: 3851876 - RNA, 16 nt, Shigella flexneri 2a str. 2457T
ucgccauuucgucguc

SEQ ID NO: 3851877 - RNA, 13 nt, Shigella flexneri 2a str. 2457T
ucgcccacaucau

SEQ ID NO: 3851878 - RNA, 23 nt, Shigella flexneri 2a str. 2457T
ucgcccacgccagagauaaccca

SEQ ID NO: 3851879 - RNA, 23 nt, Shigella flexneri 2a str. 2457T
ucgcccacuucuuucgcccagcg

SEQ ID NO: 3851880 - RNA, 13 nt, Shigella flexneri 2a str. 2457T
ucgcccagcgcgu

SEQ ID NO: 3851881 - RNA, 19 nt, Shigella flexneri 2a str. 2457T
ucgcccaguugaucaccag

SEQ ID NO: 3851882 - RNA, 18 nt, Shigella flexneri 2a str. 2457T
ucgccccgagaaaaauag

SEQ ID NO: 3851883 - RNA, 20 nt, Shigella flexneri 2a str. 2457T
ucgcccguucauccgcuuca

SEQ ID NO: 3851884 - RNA, 23 nt, Shigella flexneri 2a str. 2457T
ucgcccguuucaaugauaagccu

SEQ ID NO: 3851885 - RNA, 17 nt, Shigella flexneri 2a str. 2457T
ucgcccugcuccagcaa

SEQ ID NO: 3851886 - RNA, 21 nt, Shigella flexneri 2a str. 2457T
ucgcccugcuccagcaacuca

SEQ ID NO: 3851887 - RNA, 22 nt, Shigella flexneri 2a str. 2457T
ucgcccuggacaacauuccugc

SEQ ID NO: 3851888 - RNA, 14 nt, Shigella flexneri 2a str. 2457T
ucgccgaggcgcug

SEQ ID NO: 3851889 - RNA, 18 nt, Shigella flexneri 2a str. 2457T
ucgccgaggcgcuggcag

SEQ ID NO: 3851890 - RNA, 16 nt, Shigella flexneri 2a str. 2457T
ucgccgauuuugccuu

SEQ ID NO: 3851891 - RNA, 15 nt, Shigella flexneri 2a str. 2457T
ucgccgcacgcucaa

SEQ ID NO: 3851892 - RNA, 20 nt, Shigella flexneri 2a str. 2457T
ucgccgccagcgucugagca

SEQ ID NO: 3851893 - RNA, 18 nt, Shigella flexneri 2a str. 2457T
ucgccgccgcaaacaucg

SEQ ID NO: 3851894 - RNA, 17 nt, Shigella flexneri 2a str. 2457T
ucgccgccgcuggcgug

SEQ ID NO: 3851895 - RNA, 19 nt, Shigella flexneri 2a str. 2457T
ucgccgcgacacaacgcuu

SEQ ID NO: 3851896 - RNA, 17 nt, Shigella flexneri 2a str. 2457T
ucgccgcggacaaacgg

SEQ ID NO: 3851897 - RNA, 22 nt, Shigella flexneri 2a str. 2457T
ucgccgcguagagaaaaccaau

SEQ ID NO: 3851898 - RNA, 20 nt, Shigella flexneri 2a str. 2457T
ucgccgcugacggcucgccc

SEQ ID NO: 3851899 - RNA, 23 nt, Shigella flexneri 2a str. 2457T
ucgccggaaccugaucagacacg

SEQ ID NO: 3851900 - RNA, 23 nt, Shigella flexneri 2a str. 2457T
ucgccggaauuucuuucagcagu

SEQ ID NO: 3851901 - RNA, 20 nt, Shigella flexneri 2a str. 2457T
ucgccggaugaaaagucauc

SEQ ID NO: 3851902 - RNA, 18 nt, Shigella flexneri 2a str. 2457T
ucgccgguaaugacucca

SEQ ID NO: 3851903 - RNA, 20 nt, Shigella flexneri 2a str. 2457T
ucgccgguuccagcuucaga

SEQ ID NO: 3851904 - RNA, 15 nt, Shigella flexneri 2a str. 2457T
ucgccgucaggcaag

SEQ ID NO: 3851905 - RNA, 21 nt, Shigella flexneri 2a str. 2457T
ucgccguuuucuggggcgggg

SEQ ID NO: 3851906 - RNA, 21 nt, Shigella flexneri 2a str. 2457T
ucgccuaccaacgacauacuc

SEQ ID NO: 3851907 - RNA, 17 nt, Shigella flexneri 2a str. 2457T
ucgccuccuguucugug

SEQ ID NO: 3851908 - RNA, 14 nt, Shigella flexneri 2a str. 2457T
ucgccucgccgaaa

SEQ ID NO: 3851909 - RNA, 17 nt, Shigella flexneri 2a str. 2457T
ucgccugcaccaugucc

SEQ ID NO: 3851910 - RNA, 16 nt, Shigella flexneri 2a str. 2457T
ucgccugccagaugca

SEQ ID NO: 3851911 - RNA, 14 nt, Shigella flexneri 2a str. 2457T
ucgccugccgccag

SEQ ID NO: 3851912 - RNA, 19 nt, Shigella flexneri 2a str. 2457T
ucgccugguaccagcaccg

SEQ ID NO: 3851913 - RNA, 17 nt, Shigella flexneri 2a str. 2457T
ucgccugguacuggauu

SEQ ID NO: 3851914 - RNA, 12 nt, Shigella flexneri 2a str. 2457T
ucgccuuaauaa

SEQ ID NO: 3851915 - RNA, 21 nt, Shigella flexneri 2a str. 2457T
ucgccuuaugcugcuucauug

SEQ ID NO: 3851916 - RNA, 19 nt, Shigella flexneri 2a str. 2457T
ucgccuucagguuuuucag

SEQ ID NO: 3851917 - RNA, 16 nt, Shigella flexneri 2a str. 2457T
ucgccuuucggcugca

SEQ ID NO: 3851918 - RNA, 15 nt, Shigella flexneri 2a str. 2457T
ucgcgaaaaaaagau

SEQ ID NO: 3851919 - RNA, 16 nt, Shigella flexneri 2a str. 2457T
ucgcgaaucgccacaa

SEQ ID NO: 3851920 - RNA, 16 nt, Shigella flexneri 2a str. 2457T
ucgcgaccaaucacac

SEQ ID NO: 3851921 - RNA, 22 nt, Shigella flexneri 2a str. 2457T
ucgcgaccuguucuccuggccg

SEQ ID NO: 3851922 - RNA, 12 nt, Shigella flexneri 2a str. 2457T
ucgcgacgcuga

SEQ ID NO: 3851923 - RNA, 15 nt, Shigella flexneri 2a str. 2457T
ucgcgauaacggauc

SEQ ID NO: 3851924 - RNA, 19 nt, Shigella flexneri 2a str. 2457T
ucgcgauagaacuucugca

SEQ ID NO: 3851925 - RNA, 16 nt, Shigella flexneri 2a str. 2457T
ucgcgauagcgcaccg

SEQ ID NO: 3851926 - RNA, 20 nt, Shigella flexneri 2a str. 2457T
ucgcgaucaaacgccagauc

SEQ ID NO: 3851927 - RNA, 15 nt, Shigella flexneri 2a str. 2457T
ucgcgaugaugcgac

SEQ ID NO: 3851928 - RNA, 12 nt, Shigella flexneri 2a str. 2457T
ucggccaugggc

SEQ ID NO: 3851929 - RNA, 22 nt, Shigella flexneri 2a str. 2457T
ucggcccggcgacuaacggaau

SEQ ID NO: 3851930 - RNA, 21 nt, Shigella flexneri 2a str. 2457T
ucggccuuccauaaugcugac

SEQ ID NO: 3851931 - RNA, 13 nt, Shigella flexneri 2a str. 2457T
ucggcgcaaucgc

SEQ ID NO: 3851932 - RNA, 16 nt, Shigella flexneri 2a str. 2457T
ucggcgcagguuuaau

SEQ ID NO: 3851933 - RNA, 17 nt, Shigella flexneri 2a str. 2457T
ucggcgcagucacacca

SEQ ID NO: 3851934 - RNA, 22 nt, Shigella flexneri 2a str. 2457T
ucggcgcggcgguugacgcccc

SEQ ID NO: 3851935 - RNA, 20 nt, Shigella flexneri 2a str. 2457T
ucggcgcucucguuuuauuc

SEQ ID NO: 3851936 - RNA, 13 nt, Shigella flexneri 2a str. 2457T
ucggcggcgugcc

SEQ ID NO: 3851937 - RNA, 21 nt, Shigella flexneri 2a str. 2457T
ucggcguaauccugaaagcgu

SEQ ID NO: 3851938 - RNA, 22 nt, Shigella flexneri 2a str. 2457T
ucggcgucaucgacaucaacga

SEQ ID NO: 3851939 - RNA, 22 nt, Shigella flexneri 2a str. 2457T
ucggcgugaacgcgcucgacuu

SEQ ID NO: 3851940 - RNA, 14 nt, Shigella flexneri 2a str. 2457T
ucggcucagccgau

SEQ ID NO: 3851941 - RNA, 15 nt, Shigella flexneri 2a str. 2457T
ucggcugccagccau

SEQ ID NO: 3851942 - RNA, 22 nt, Shigella flexneri 2a str. 2457T
ucggcuuugaauaucuccucug

SEQ ID NO: 3851943 - RNA, 18 nt, Shigella flexneri 2a str. 2457T
ucgggaacgcuuuugcau

SEQ ID NO: 3851944 - RNA, 13 nt, Shigella flexneri 2a str. 2457T
ucgggaagaccug

SEQ ID NO: 3851945 - RNA, 22 nt, Shigella flexneri 2a str. 2457T
ucgggaaggcccuuccccuucu

SEQ ID NO: 3851946 - RNA, 13 nt, Shigella flexneri 2a str. 2457T
ucgggaugccuuc

SEQ ID NO: 3851947 - RNA, 20 nt, Shigella flexneri 2a str. 2457T
ucgggcaacguugaccaguc

SEQ ID NO: 3851948 - RNA, 20 nt, Shigella flexneri 2a str. 2457T
ucgggcaauggcuccgggug

SEQ ID NO: 3851949 - RNA, 13 nt, Shigella flexneri 2a str. 2457T
ucgggcagcaucg

SEQ ID NO: 3851950 - RNA, 14 nt, Shigella flexneri 2a str. 2457T
ucgggcaucagaag

SEQ ID NO: 3851951 - RNA, 17 nt, Shigella flexneri 2a str. 2457T
ucgggccgaucauacga

SEQ ID NO: 3851952 - RNA, 21 nt, Shigella flexneri 2a str. 2457T
ucgggccguauugauuuucuu

SEQ ID NO: 3851953 - RNA, 16 nt, Shigella flexneri 2a str. 2457T
ucgggccgucuggcug

SEQ ID NO: 3851954 - RNA, 21 nt, Shigella flexneri 2a str. 2457T
ucgggcguuucgccaggacag

SEQ ID NO: 3851955 - RNA, 21 nt, Shigella flexneri 2a str. 2457T
ucgggcuuugcuacagccugg

SEQ ID NO: 3851956 - RNA, 22 nt, Shigella flexneri 2a str. 2457T
ucgggcuuugcuacagccuggu

SEQ ID NO: 3851957 - RNA, 17 nt, Shigella flexneri 2a str. 2457T
ucggggcuguuuuccag

SEQ ID NO: 3851958 - RNA, 19 nt, Shigella flexneri 2a str. 2457T
ucggggcuguuuuccagca

SEQ ID NO: 3851959 - RNA, 13 nt, Shigella flexneri 2a str. 2457T
ucggguaacggac

SEQ ID NO: 3851960 - RNA, 13 nt, Shigella flexneri 2a str. 2457T
ucgguaacgcuug

SEQ ID NO: 3851961 - RNA, 11 nt, Shigella flexneri 2a str. 2457T
ucggucacagu

SEQ ID NO: 3851962 - RNA, 19 nt, Shigella flexneri 2a str. 2457T
ucggucacugacaccagca

SEQ ID NO: 3851963 - RNA, 13 nt, Shigella flexneri 2a str. 2457T
ucggucagagaau

SEQ ID NO: 3851964 - RNA, 14 nt, Shigella flexneri 2a str. 2457T
ucggucagcacgcg

SEQ ID NO: 3851965 - RNA, 22 nt, Shigella flexneri 2a str. 2457T
ucgguccaccacguaccacggc

SEQ ID NO: 3851966 - RNA, 15 nt, Shigella flexneri 2a str. 2457T
ucggugacagaaacu

SEQ ID NO: 3851967 - RNA, 22 nt, Shigella flexneri 2a str. 2457T
ucggugagcuaaugcaaaucac

SEQ ID NO: 3851968 - RNA, 12 nt, Shigella flexneri 2a str. 2457T
ucggugaucuca

SEQ ID NO: 3851969 - RNA, 18 nt, Shigella flexneri 2a str. 2457T
ucggugcaaaugccagau

SEQ ID NO: 3851970 - RNA, 21 nt, Shigella flexneri 2a str. 2457T
ucggugcacaauugccggaug

SEQ ID NO: 3851971 - RNA, 19 nt, Shigella flexneri 2a str. 2457T
ucggugcacgaugccugau

SEQ ID NO: 3851972 - RNA, 20 nt, Shigella flexneri 2a str. 2457T
ucggugcacgaugccugaug

SEQ ID NO: 3851973 - RNA, 18 nt, Shigella flexneri 2a str. 2457T
ucggugcgacaucaucag

SEQ ID NO: 3851974 - RNA, 16 nt, Shigella flexneri 2a str. 2457T
ucgguggaaaauagca

SEQ ID NO: 3851975 - RNA, 24 nt, Shigella flexneri 2a str. 2457T
ucgguguuaaaacgcacgcuguca

SEQ ID NO: 3851976 - RNA, 18 nt, Shigella flexneri 2a str. 2457T
ucgguuaccacaccggca

SEQ ID NO: 3851977 - RNA, 16 nt, Shigella flexneri 2a str. 2457T
ucgguucgccugcacc

SEQ ID NO: 3851978 - RNA, 12 nt, Shigella flexneri 2a str. 2457T
ucgguugccaua

SEQ ID NO: 3851979 - RNA, 14 nt, Shigella flexneri 2a str. 2457T
ucgguuguuuucag

SEQ ID NO: 3851980 - RNA, 19 nt, Shigella flexneri 2a str. 2457T
ucgguuuaaccggccuuuu

SEQ ID NO: 3851981 - RNA, 16 nt, Shigella flexneri 2a str. 2457T
ucgguuucaucacaua

SEQ ID NO: 3851982 - RNA, 14 nt, Shigella flexneri 2a str. 2457T
ucgguuuucaaucg

SEQ ID NO: 3851983 - RNA, 20 nt, Shigella flexneri 2a str. 2457T
ucgguuuucgcgccagccag

SEQ ID NO: 3851984 - RNA, 22 nt, Shigella flexneri 2a str. 2457T
ucguaaaaacggauuucauaag

SEQ ID NO: 3851985 - RNA, 18 nt, Shigella flexneri 2a str. 2457T
ucguaagccgugaaaaca

SEQ ID NO: 3851986 - RNA, 17 nt, Shigella flexneri 2a str. 2457T
ucguaaugcuccggcuc

SEQ ID NO: 3851987 - RNA, 19 nt, Shigella flexneri 2a str. 2457T
ucguaccaucauuggagag

SEQ ID NO: 3851988 - RNA, 23 nt, Shigella flexneri 2a str. 2457T
ucguacgcuuuugaggauuaugc

SEQ ID NO: 3851989 - RNA, 15 nt, Shigella flexneri 2a str. 2457T
ucguacucaccagac

SEQ ID NO: 3851990 - RNA, 18 nt, Shigella flexneri 2a str. 2457T
ucguagccaccaucuuuu

SEQ ID NO: 3851991 - RNA, 19 nt, Shigella flexneri 2a str. 2457T
ucguagccuuuuucagccg

SEQ ID NO: 3851992 - RNA, 14 nt, Shigella flexneri 2a str. 2457T
ucguaggccugaua

SEQ ID NO: 3851993 - RNA, 15 nt, Shigella flexneri 2a str. 2457T
ucguaguaguucauc

SEQ ID NO: 3851994 - RNA, 20 nt, Shigella flexneri 2a str. 2457T
ucguaucuggcaagcaggac

SEQ ID NO: 3851995 - RNA, 18 nt, Shigella flexneri 2a str. 2457T
ucguauugguacauaaca

SEQ ID NO: 3851996 - RNA, 13 nt, Shigella flexneri 2a str. 2457T
ucguauuuaaaac

SEQ ID NO: 3851997 - RNA, 19 nt, Shigella flexneri 2a str. 2457T
ucgucaaaaaacuucuuca

SEQ ID NO: 3851998 - RNA, 20 nt, Shigella flexneri 2a str. 2457T
ucgucaaaaaacuucuucac

SEQ ID NO: 3851999 - RNA, 22 nt, Shigella flexneri 2a str. 2457T
ucgucaaucagcgugaccaguu

SEQ ID NO: 3852000 - RNA, 14 nt, Shigella flexneri 2a str. 2457T
ucgucagaaauggu

SEQ ID NO: 3852001 - RNA, 13 nt, Shigella flexneri 2a str. 2457T
ucgucagauuuua

SEQ ID NO: 3852002 - RNA, 22 nt, Shigella flexneri 2a str. 2457T
ucgucaguuccauaauguacau

SEQ ID NO: 3852003 - RNA, 15 nt, Shigella flexneri 2a str. 2457T
ucgucaucagcucca

SEQ ID NO: 3852004 - RNA, 13 nt, Shigella flexneri 2a str. 2457T
ucgucaucccagu

SEQ ID NO: 3852005 - RNA, 17 nt, Shigella flexneri 2a str. 2457T
ucguccacgucaucaaa

SEQ ID NO: 3852006 - RNA, 16 nt, Shigella flexneri 2a str. 2457T
ucguccacuugaaaau

SEQ ID NO: 3852007 - RNA, 15 nt, Shigella flexneri 2a str. 2457T
ucguccgcguccagc

SEQ ID NO: 3852008 - RNA, 15 nt, Shigella flexneri 2a str. 2457T
ucguccuuuuauuac

SEQ ID NO: 3852009 - RNA, 14 nt, Shigella flexneri 2a str. 2457T
ucgucgccagacca

SEQ ID NO: 3852010 - RNA, 21 nt, Shigella flexneri 2a str. 2457T
ucgucgccgauaauuuucagc

SEQ ID NO: 3852011 - RNA, 22 nt, Shigella flexneri 2a str. 2457T
ucgucguuaagccuuucgcaaa

SEQ ID NO: 3852012 - RNA, 17 nt, Shigella flexneri 2a str. 2457T
ucgucucccgucaggag

SEQ ID NO: 3852013 - RNA, 14 nt, Shigella flexneri 2a str. 2457T
ucgucuccuggccg

SEQ ID NO: 3852014 - RNA, 21 nt, Shigella flexneri 2a str. 2457T
ucgucugggcauugaaggcag

SEQ ID NO: 3852015 - RNA, 14 nt, Shigella flexneri 2a str. 2457T
ucgucuguuuuauc

SEQ ID NO: 3852016 - RNA, 21 nt, Shigella flexneri 2a str. 2457T
ucgucuguuuuaucucccugu

SEQ ID NO: 3852017 - RNA, 21 nt, Shigella flexneri 2a str. 2457T
ucgugaagcuggcagaaguug

SEQ ID NO: 3852018 - RNA, 20 nt, Shigella flexneri 2a str. 2457T
ucgugaauaugucgcgccag

SEQ ID NO: 3852019 - RNA, 23 nt, Shigella flexneri 2a str. 2457T
ucgugaaugcccggcugcgcgac

SEQ ID NO: 3852020 - RNA, 21 nt, Shigella flexneri 2a str. 2457T
ucgugacaauaauacccagca

SEQ ID NO: 3852021 - RNA, 13 nt, Shigella flexneri 2a str. 2457T
ucgugaucguggu

SEQ ID NO: 3852022 - RNA, 21 nt, Shigella flexneri 2a str. 2457T
ucgugcaccaauugccggaug

SEQ ID NO: 3852023 - RNA, 20 nt, Shigella flexneri 2a str. 2457T
ucgugcggguaaccagccaa

SEQ ID NO: 3852024 - RNA, 19 nt, Shigella flexneri 2a str. 2457T
ucgugcgucgcauccggca

SEQ ID NO: 3852025 - RNA, 15 nt, Shigella flexneri 2a str. 2457T
ucucagcugcaagau

SEQ ID NO: 3852026 - RNA, 22 nt, Shigella flexneri 2a str. 2457T
ucucaguggcuauuuaccaaua

SEQ ID NO: 3852027 - RNA, 12 nt, Shigella flexneri 2a str. 2457T
ucucauccauca

SEQ ID NO: 3852028 - RNA, 13 nt, Shigella flexneri 2a str. 2457T
ucucauccaucaa

SEQ ID NO: 3852029 - RNA, 14 nt, Shigella flexneri 2a str. 2457T
ucucauccuucccc

SEQ ID NO: 3852030 - RNA, 22 nt, Shigella flexneri 2a str. 2457T
ucucaucgccaucaauaaccag

SEQ ID NO: 3852031 - RNA, 18 nt, Shigella flexneri 2a str. 2457T
ucucaucuuugaaaucac

SEQ ID NO: 3852032 - RNA, 21 nt, Shigella flexneri 2a str. 2457T
ucucauuccaccgaaacuuuu

SEQ ID NO: 3852033 - RNA, 12 nt, Shigella flexneri 2a str. 2457T
ucucauuuuuca

SEQ ID NO: 3852034 - RNA, 21 nt, Shigella flexneri 2a str. 2457T
ucuccaacaucgaaaacgcca

SEQ ID NO: 3852035 - RNA, 13 nt, Shigella flexneri 2a str. 2457T
ucuccacgccagu

SEQ ID NO: 3852036 - RNA, 16 nt, Shigella flexneri 2a str. 2457T
ucuccagauaauuaug

SEQ ID NO: 3852037 - RNA, 16 nt, Shigella flexneri 2a str. 2457T
ucuccagcgaauccgu

SEQ ID NO: 3852038 - RNA, 18 nt, Shigella flexneri 2a str. 2457T
ucuccagcgcaucgaucu

SEQ ID NO: 3852039 - RNA, 12 nt, Shigella flexneri 2a str. 2457T
ucuccagcuccc

SEQ ID NO: 3852040 - RNA, 18 nt, Shigella flexneri 2a str. 2457T
ucuccagcuccccacgau

SEQ ID NO: 3852041 - RNA, 19 nt, Shigella flexneri 2a str. 2457T
ucuccagcuucaaaucauu

SEQ ID NO: 3852042 - RNA, 15 nt, Shigella flexneri 2a str. 2457T
ucucccagccgcccu

SEQ ID NO: 3852043 - RNA, 15 nt, Shigella flexneri 2a str. 2457T
ucucccagccgggua

SEQ ID NO: 3852044 - RNA, 13 nt, Shigella flexneri 2a str. 2457T
ucucccaguaagc

SEQ ID NO: 3852045 - RNA, 15 nt, Shigella flexneri 2a str. 2457T
ucuccccaagggggc

SEQ ID NO: 3852046 - RNA, 21 nt, Shigella flexneri 2a str. 2457T
ucuccccgaaggggcgaggga

SEQ ID NO: 3852047 - RNA, 14 nt, Shigella flexneri 2a str. 2457T
ucucccgccagcga

SEQ ID NO: 3852048 - RNA, 20 nt, Shigella flexneri 2a str. 2457T
ucucccuacagagcgaggga

SEQ ID NO: 3852049 - RNA, 20 nt, Shigella flexneri 2a str. 2457T
ucucccucaucauuugaaau

SEQ ID NO: 3852050 - RNA, 17 nt, Shigella flexneri 2a str. 2457T
ucuccgcuggagcgggg

SEQ ID NO: 3852051 - RNA, 11 nt, Shigella flexneri 2a str. 2457T
ucuccggcguu

SEQ ID NO: 3852052 - RNA, 22 nt, Shigella flexneri 2a str. 2457T
ucuccugcaacagguugcgcug

SEQ ID NO: 3852053 - RNA, 21 nt, Shigella flexneri 2a str. 2457T
ucuccugccaauacaaaauuu

SEQ ID NO: 3852054 - RNA, 12 nt, Shigella flexneri 2a str. 2457T
ucuccugcgcac

SEQ ID NO: 3852055 - RNA, 21 nt, Shigella flexneri 2a str. 2457T
ucuccugcgccucuccacacg

SEQ ID NO: 3852056 - RNA, 17 nt, Shigella flexneri 2a str. 2457T
ucuccuguucucacuaa

SEQ ID NO: 3852057 - RNA, 17 nt, Shigella flexneri 2a str. 2457T
ucuccuguugugaugca

SEQ ID NO: 3852058 - RNA, 18 nt, Shigella flexneri 2a str. 2457T
ucuccuguugugaugcaa

SEQ ID NO: 3852059 - RNA, 14 nt, Shigella flexneri 2a str. 2457T
ucuccuuacugccc

SEQ ID NO: 3852060 - RNA, 15 nt, Shigella flexneri 2a str. 2457T
ucuccuucacucuau

SEQ ID NO: 3852061 - RNA, 17 nt, Shigella flexneri 2a str. 2457T
ucuccuuuaccacucuc

SEQ ID NO: 3852062 - RNA, 15 nt, Shigella flexneri 2a str. 2457T
ucuccuuugccaaaa

SEQ ID NO: 3852063 - RNA, 15 nt, Shigella flexneri 2a str. 2457T
ucucgaucacuucgc

SEQ ID NO: 3852064 - RNA, 16 nt, Shigella flexneri 2a str. 2457T
ucucgcagcucaucaa

SEQ ID NO: 3852065 - RNA, 15 nt, Shigella flexneri 2a str. 2457T
ucucgccgcccugaa

SEQ ID NO: 3852066 - RNA, 18 nt, Shigella flexneri 2a str. 2457T
ucucgccuaccauccaua

SEQ ID NO: 3852067 - RNA, 23 nt, Shigella flexneri 2a str. 2457T
ucucgcgcagcgguuucacagga

SEQ ID NO: 3852068 - RNA, 21 nt, Shigella flexneri 2a str. 2457T
ucucgcucgagagagaaaaua

SEQ ID NO: 3852069 - RNA, 15 nt, Shigella flexneri 2a str. 2457T
ucucggcgcggcccu

SEQ ID NO: 3852070 - RNA, 15 nt, Shigella flexneri 2a str. 2457T
ucucggcuuugguau

SEQ ID NO: 3852071 - RNA, 13 nt, Shigella flexneri 2a str. 2457T
ucucgggaaggcc

SEQ ID NO: 3852072 - RNA, 22 nt, Shigella flexneri 2a str. 2457T
ucucgucgaacucauacaccag

SEQ ID NO: 3852073 - RNA, 12 nt, Shigella flexneri 2a str. 2457T
ucucgucucccg

SEQ ID NO: 3852074 - RNA, 13 nt, Shigella flexneri 2a str. 2457T
ucucgucucccgu

SEQ ID NO: 3852075 - RNA, 17 nt, Shigella flexneri 2a str. 2457T
ucucgugccaccagugc

SEQ ID NO: 3852076 - RNA, 18 nt, Shigella flexneri 2a str. 2457T
ucucuacgacuugaaaaa

SEQ ID NO: 3852077 - RNA, 13 nt, Shigella flexneri 2a str. 2457T
ucucucagcacac

SEQ ID NO: 3852078 - RNA, 20 nt, Shigella flexneri 2a str. 2457T
ucucucugauuacccuucgc

SEQ ID NO: 3852079 - RNA, 17 nt, Shigella flexneri 2a str. 2457T
ucucucuugcuaucacc

SEQ ID NO: 3852080 - RNA, 11 nt, Shigella flexneri 2a str. 2457T
ucucugaaauu

SEQ ID NO: 3852081 - RNA, 17 nt, Shigella flexneri 2a str. 2457T
ucucugacgcucucuac

SEQ ID NO: 3852082 - RNA, 17 nt, Shigella flexneri 2a str. 2457T
ucucugcaaaaaacuua

SEQ ID NO: 3852083 - RNA, 20 nt, Shigella flexneri 2a str. 2457T
ucucuggcacgagaucguca

SEQ ID NO: 3852084 - RNA, 19 nt, Shigella flexneri 2a str. 2457T
ucucuggcccgcuuuucau

SEQ ID NO: 3852085 - RNA, 23 nt, Shigella flexneri 2a str. 2457T
ucucuggcccgcuuuucauuauc

SEQ ID NO: 3852086 - RNA, 18 nt, Shigella flexneri 2a str. 2457T
ucucuguuuugcaugggg

SEQ ID NO: 3852087 - RNA, 13 nt, Shigella flexneri 2a str. 2457T
ucucuuaucaucc

SEQ ID NO: 3852088 - RNA, 14 nt, Shigella flexneri 2a str. 2457T
ucucuucagccaac

SEQ ID NO: 3852089 - RNA, 14 nt, Shigella flexneri 2a str. 2457T
ucucuuccagugcc

SEQ ID NO: 3852090 - RNA, 23 nt, Shigella flexneri 2a str. 2457T
ucucuucggcuucugccuuaucc

SEQ ID NO: 3852091 - RNA, 15 nt, Shigella flexneri 2a str. 2457T
ucucuucguuuucaa

SEQ ID NO: 3852092 - RNA, 20 nt, Shigella flexneri 2a str. 2457T
ucucuucuucuucggucaga

SEQ ID NO: 3852093 - RNA, 14 nt, Shigella flexneri 2a str. 2457T
ucucuugccaggcu

SEQ ID NO: 3852094 - RNA, 18 nt, Shigella flexneri 2a str. 2457T
ucucuugccgguuuugca

SEQ ID NO: 3852095 - RNA, 18 nt, Shigella flexneri 2a str. 2457T
ucucuuggggcuucaucu

SEQ ID NO: 3852096 - RNA, 18 nt, Shigella flexneri 2a str. 2457T
ucucuuucaacauccugu

SEQ ID NO: 3852097 - RNA, 22 nt, Shigella flexneri 2a str. 2457T
ucucuuuccuuaauaaaaauuu

SEQ ID NO: 3852098 - RNA, 12 nt, Shigella flexneri 2a str. 2457T
ucugaacugaac

SEQ ID NO: 3852099 - RNA, 11 nt, Shigella flexneri 2a str. 2457T
ucugaauaaac

SEQ ID NO: 3852100 - RNA, 21 nt, Shigella flexneri 2a str. 2457T
ucugaauauucggcuccagau

SEQ ID NO: 3852101 - RNA, 12 nt, Shigella flexneri 2a str. 2457T
ucugaauuucag

SEQ ID NO: 3852102 - RNA, 21 nt, Shigella flexneri 2a str. 2457T
ucugaauuucagcgccugaua

SEQ ID NO: 3852103 - RNA, 22 nt, Shigella flexneri 2a str. 2457T
ucugacaacguagcguuaaaac

SEQ ID NO: 3852104 - RNA, 12 nt, Shigella flexneri 2a str. 2457T
ucugacagcaaa

SEQ ID NO: 3852105 - RNA, 23 nt, Shigella flexneri 2a str. 2457T
ucugacauaaccacucaccgccg

SEQ ID NO: 3852106 - RNA, 19 nt, Shigella flexneri 2a str. 2457T
ucugacauuuuuacuccuu

SEQ ID NO: 3852107 - RNA, 23 nt, Shigella flexneri 2a str. 2457T
ucugacauuuuuacuccuuagca

SEQ ID NO: 3852108 - RNA, 20 nt, Shigella flexneri 2a str. 2457T
ucugaccacggccacagcca

SEQ ID NO: 3852109 - RNA, 22 nt, Shigella flexneri 2a str. 2457T
ucugacgugcgcaaacuucuuc

SEQ ID NO: 3852110 - RNA, 21 nt, Shigella flexneri 2a str. 2457T
ucugacguuuucucguccagu

SEQ ID NO: 3852111 - RNA, 13 nt, Shigella flexneri 2a str. 2457T
ucugacugucaga

SEQ ID NO: 3852112 - RNA, 17 nt, Shigella flexneri 2a str. 2457T
ucugagagcaugaaaug

SEQ ID NO: 3852113 - RNA, 19 nt, Shigella flexneri 2a str. 2457T
ucugagagcaugaaaugaa

SEQ ID NO: 3852114 - RNA, 17 nt, Shigella flexneri 2a str. 2457T
ucugagauucaauuaua

SEQ ID NO: 3852115 - RNA, 20 nt, Shigella flexneri 2a str. 2457T
ucugagcaucacauaaucga

SEQ ID NO: 3852116 - RNA, 20 nt, Shigella flexneri 2a str. 2457T
ucugagcaugaugccugaug

SEQ ID NO: 3852117 - RNA, 20 nt, Shigella flexneri 2a str. 2457T
ucugagccagcuucccaaag

SEQ ID NO: 3852118 - RNA, 12 nt, Shigella flexneri 2a str. 2457T
ucugauaagccc

SEQ ID NO: 3852119 - RNA, 17 nt, Shigella flexneri 2a str. 2457T
ucugauacaugcuguug

SEQ ID NO: 3852120 - RNA, 20 nt, Shigella flexneri 2a str. 2457T
ucugauagugauccaucagg

SEQ ID NO: 3852121 - RNA, 14 nt, Shigella flexneri 2a str. 2457T
ucugauaguuaaaa

SEQ ID NO: 3852122 - RNA, 23 nt, Shigella flexneri 2a str. 2457T
ucugauaguuaaaauucaagaca

SEQ ID NO: 3852123 - RNA, 16 nt, Shigella flexneri 2a str. 2457T
ucugucagguaacaag

SEQ ID NO: 3852124 - RNA, 18 nt, Shigella flexneri 2a str. 2457T
ucugucaguuggcugugg

SEQ ID NO: 3852125 - RNA, 22 nt, Shigella flexneri 2a str. 2457T
ucugucaguuggcugugguacu

SEQ ID NO: 3852126 - RNA, 17 nt, Shigella flexneri 2a str. 2457T
ucugucgauaaacucau

SEQ ID NO: 3852127 - RNA, 15 nt, Shigella flexneri 2a str. 2457T
ucuguggcagggcag

SEQ ID NO: 3852128 - RNA, 15 nt, Shigella flexneri 2a str. 2457T
ucuguucaucuauac

SEQ ID NO: 3852129 - RNA, 14 nt, Shigella flexneri 2a str. 2457T
ucuguugugccaca

SEQ ID NO: 3852130 - RNA, 23 nt, Shigella flexneri 2a str. 2457T
ucuguugugccacauccaguggc

SEQ ID NO: 3852131 - RNA, 16 nt, Shigella flexneri 2a str. 2457T
ucuguuucaucucuuc

SEQ ID NO: 3852132 - RNA, 19 nt, Shigella flexneri 2a str. 2457T
ucuguuugcaggugaccag

SEQ ID NO: 3852133 - RNA, 18 nt, Shigella flexneri 2a str. 2457T
ucuuaaaauaguccugag

SEQ ID NO: 3852134 - RNA, 15 nt, Shigella flexneri 2a str. 2457T
ucuuaacgucgcaag

SEQ ID NO: 3852135 - RNA, 20 nt, Shigella flexneri 2a str. 2457T
ucuuaagguucacuuaaucu

SEQ ID NO: 3852136 - RNA, 17 nt, Shigella flexneri 2a str. 2457T
ucuuaaucgcuucuucu

SEQ ID NO: 3852137 - RNA, 20 nt, Shigella flexneri 2a str. 2457T
ucuuaaucgcuucuucuuua

SEQ ID NO: 3852138 - RNA, 22 nt, Shigella flexneri 2a str. 2457T
ucuuacagaaaugguaaagaag

SEQ ID NO: 3852139 - RNA, 14 nt, Shigella flexneri 2a str. 2457T
ucuuaccccugauu

SEQ ID NO: 3852140 - RNA, 17 nt, Shigella flexneri 2a str. 2457T
ucuuaccgcuucaauua

SEQ ID NO: 3852141 - RNA, 21 nt, Shigella flexneri 2a str. 2457T
ucuuaccggucccuucaaucu

SEQ ID NO: 3852142 - RNA, 17 nt, Shigella flexneri 2a str. 2457T
ucuuacgcgaauaguuu

SEQ ID NO: 3852143 - RNA, 19 nt, Shigella flexneri 2a str. 2457T
ucuuacuaaguacauuaag

SEQ ID NO: 3852144 - RNA, 17 nt, Shigella flexneri 2a str. 2457T
ucuuacucuuucaauuu

SEQ ID NO: 3852145 - RNA, 23 nt, Shigella flexneri 2a str. 2457T
ucuuacuguguugccgcauuuuc

SEQ ID NO: 3852146 - RNA, 13 nt, Shigella flexneri 2a str. 2457T
ucuuacuucaaca

SEQ ID NO: 3852147 - RNA, 15 nt, Shigella flexneri 2a str. 2457T
ucuuauaaagaaaau

SEQ ID NO: 3852148 - RNA, 17 nt, Shigella flexneri 2a str. 2457T
ucuuauaugaugaaacu

SEQ ID NO: 3852149 - RNA, 17 nt, Shigella flexneri 2a str. 2457T
ucuuaucaggccuacaa

SEQ ID NO: 3852150 - RNA, 20 nt, Shigella flexneri 2a str. 2457T
ucuuaucaugccuacauauu

SEQ ID NO: 3852151 - RNA, 19 nt, Shigella flexneri 2a str. 2457T
ucuuauccggccuuccugu

SEQ ID NO: 3852152 - RNA, 20 nt, Shigella flexneri 2a str. 2457T
ucuuauuaaauugucuuaaa

SEQ ID NO: 3852153 - RNA, 13 nt, Shigella flexneri 2a str. 2457T
ucuuauuucacua

SEQ ID NO: 3852154 - RNA, 22 nt, Shigella flexneri 2a str. 2457T
ucuucaacacacugaauaaaaa

SEQ ID NO: 3852155 - RNA, 22 nt, Shigella flexneri 2a str. 2457T
ucuucaaccgcagugauuucaa

SEQ ID NO: 3852156 - RNA, 20 nt, Shigella flexneri 2a str. 2457T
ucuucaaccgucaccagccc

SEQ ID NO: 3852157 - RNA, 14 nt, Shigella flexneri 2a str. 2457T
ucuucaacugccau

SEQ ID NO: 3852158 - RNA, 19 nt, Shigella flexneri 2a str. 2457T
ucuucaacugccaugaccg

SEQ ID NO: 3852159 - RNA, 13 nt, Shigella flexneri 2a str. 2457T
ucuucaacuucag

SEQ ID NO: 3852160 - RNA, 17 nt, Shigella flexneri 2a str. 2457T
ucuucaacuucagcagc

SEQ ID NO: 3852161 - RNA, 16 nt, Shigella flexneri 2a str. 2457T
ucuucaagaauacugu

SEQ ID NO: 3852162 - RNA, 13 nt, Shigella flexneri 2a str. 2457T
ucuucaaugguca

SEQ ID NO: 3852163 - RNA, 14 nt, Shigella flexneri 2a str. 2457T
ucuucacaucauca

SEQ ID NO: 3852164 - RNA, 15 nt, Shigella flexneri 2a str. 2457T
ucuucacaucaucau

SEQ ID NO: 3852165 - RNA, 18 nt, Shigella flexneri 2a str. 2457T
ucuucacgcgcagaucgu

SEQ ID NO: 3852166 - RNA, 16 nt, Shigella flexneri 2a str. 2457T
ucuucacggaaaauau

SEQ ID NO: 3852167 - RNA, 19 nt, Shigella flexneri 2a str. 2457T
ucuucacguuuuucgaaaa

SEQ ID NO: 3852168 - RNA, 21 nt, Shigella flexneri 2a str. 2457T
ucuucacguuuuucgaaaauc

SEQ ID NO: 3852169 - RNA, 14 nt, Shigella flexneri 2a str. 2457T
ucuucagcaucaau

SEQ ID NO: 3852170 - RNA, 16 nt, Shigella flexneri 2a str. 2457T
ucuucagccccuccac

SEQ ID NO: 3852171 - RNA, 23 nt, Shigella flexneri 2a str. 2457T
ucuucagcgacugucuuucaggc

SEQ ID NO: 3852172 - RNA, 21 nt, Shigella flexneri 2a str. 2457T
ucuucauacgcggcagaaugg

SEQ ID NO: 3852173 - RNA, 12 nt, Shigella flexneri 2a str. 2457T
ucuucaucaucc

SEQ ID NO: 3852174 - RNA, 17 nt, Shigella flexneri 2a str. 2457T
ucuucaucgcuaaaaua

SEQ ID NO: 3852175 - RNA, 15 nt, Shigella flexneri 2a str. 2457T
ucuucauuaccuuca

SEQ ID NO: 3852176 - RNA, 16 nt, Shigella flexneri 2a str. 2457T
ucuuccacgccugcau

SEQ ID NO: 3852177 - RNA, 19 nt, Shigella flexneri 2a str. 2457T
ucuuccagaauaaacaacu

SEQ ID NO: 3852178 - RNA, 20 nt, Shigella flexneri 2a str. 2457T
ucuuccagaauaaacaacug

SEQ ID NO: 3852179 - RNA, 21 nt, Shigella flexneri 2a str. 2457T
ucuuccagaucaccgcagaag

SEQ ID NO: 3852180 - RNA, 21 nt, Shigella flexneri 2a str. 2457T
ucuuccagcagcggcagauca

SEQ ID NO: 3852181 - RNA, 14 nt, Shigella flexneri 2a str. 2457T
ucuuccagucgccu

SEQ ID NO: 3852182 - RNA, 20 nt, Shigella flexneri 2a str. 2457T
ucuuccagugccucaagaau

SEQ ID NO: 3852183 - RNA, 19 nt, Shigella flexneri 2a str. 2457T
ucuuccauaaucgacuccc

SEQ ID NO: 3852184 - RNA, 15 nt, Shigella flexneri 2a str. 2457T
ucuuccaucacaaag

SEQ ID NO: 3852185 - RNA, 18 nt, Shigella flexneri 2a str. 2457T
ucuucccagccaaugcag

SEQ ID NO: 3852186 - RNA, 17 nt, Shigella flexneri 2a str. 2457T
ucuucccagcccccgca

SEQ ID NO: 3852187 - RNA, 21 nt, Shigella flexneri 2a str. 2457T
ucuucccagguuucaaugccg

SEQ ID NO: 3852188 - RNA, 17 nt, Shigella flexneri 2a str. 2457T
ucuucccauggauuacc

SEQ ID NO: 3852189 - RNA, 22 nt, Shigella flexneri 2a str. 2457T
ucuucccgagacauuccuuuac

SEQ ID NO: 3852190 - RNA, 23 nt, Shigella flexneri 2a str. 2457T
ucuucccgagacauuccuuuacu

SEQ ID NO: 3852191 - RNA, 24 nt, Shigella flexneri 2a str. 2457T
ucuucccgagacauuccuuuacuu

SEQ ID NO: 3852192 - RNA, 13 nt, Shigella flexneri 2a str. 2457T
ucuucccgcagcc

SEQ ID NO: 3852193 - RNA, 21 nt, Shigella flexneri 2a str. 2457T
ucuucccugcugaauccccuu

SEQ ID NO: 3852194 - RNA, 14 nt, Shigella flexneri 2a str. 2457T
ucuuccgcuucaau

SEQ ID NO: 3852195 - RNA, 19 nt, Shigella flexneri 2a str. 2457T
ucuuccggcaccauuccac

SEQ ID NO: 3852196 - RNA, 22 nt, Shigella flexneri 2a str. 2457T
ucuuccgggcuauauacccuuc

SEQ ID NO: 3852197 - RNA, 22 nt, Shigella flexneri 2a str. 2457T
ucuuccucacacccuugccaga

SEQ ID NO: 3852198 - RNA, 14 nt, Shigella flexneri 2a str. 2457T
ucuucgaaucuuug

SEQ ID NO: 3852199 - RNA, 17 nt, Shigella flexneri 2a str. 2457T
ucuucgauauugacgau

SEQ ID NO: 3852200 - RNA, 23 nt, Shigella flexneri 2a str. 2457T
ucuucgauuuaaccgcuuucacc

SEQ ID NO: 3852201 - RNA, 19 nt, Shigella flexneri 2a str. 2457T
ucuucgcacuuaccuucac

SEQ ID NO: 3852202 - RNA, 19 nt, Shigella flexneri 2a str. 2457T
ucuucgcgugugccgguaa

SEQ ID NO: 3852203 - RNA, 16 nt, Shigella flexneri 2a str. 2457T
ucuucggucagagaau

SEQ ID NO: 3852204 - RNA, 21 nt, Shigella flexneri 2a str. 2457T
ucuucgguggucauuuuauug

SEQ ID NO: 3852205 - RNA, 20 nt, Shigella flexneri 2a str. 2457T
ucuucguagcguuuuuucau

SEQ ID NO: 3852206 - RNA, 14 nt, Shigella flexneri 2a str. 2457T
ucuucguucgcugc

SEQ ID NO: 3852207 - RNA, 13 nt, Shigella flexneri 2a str. 2457T
ucuucuccggcau

SEQ ID NO: 3852208 - RNA, 20 nt, Shigella flexneri 2a str. 2457T
ucuucucgauaaaaccuucc

SEQ ID NO: 3852209 - RNA, 21 nt, Shigella flexneri 2a str. 2457T
ucuucugaaaaggucacuccc

SEQ ID NO: 3852210 - RNA, 18 nt, Shigella flexneri 2a str. 2457T
ucuucugcagucaccugc

SEQ ID NO: 3852211 - RNA, 18 nt, Shigella flexneri 2a str. 2457T
ucuucuggguugccugau

SEQ ID NO: 3852212 - RNA, 15 nt, Shigella flexneri 2a str. 2457T
ucuucuugaccguuu

SEQ ID NO: 3852213 - RNA, 20 nt, Shigella flexneri 2a str. 2457T
ucuucuugaccguuuuacuc

SEQ ID NO: 3852214 - RNA, 14 nt, Shigella flexneri 2a str. 2457T
ucuucuugcagcuu

SEQ ID NO: 3852215 - RNA, 20 nt, Shigella flexneri 2a str. 2457T
ucuugaugugcuucaucaga

SEQ ID NO: 3852216 - RNA, 21 nt, Shigella flexneri 2a str. 2457T
ucuugauuugcuuguuucauu

SEQ ID NO: 3852217 - RNA, 22 nt, Shigella flexneri 2a str. 2457T
ucuugcaggaagggauugugca

SEQ ID NO: 3852218 - RNA, 20 nt, Shigella flexneri 2a str. 2457T
ucuugccuuuccuccugucu

SEQ ID NO: 3852219 - RNA, 18 nt, Shigella flexneri 2a str. 2457T
ucuugcugauacuccuca

SEQ ID NO: 3852220 - RNA, 18 nt, Shigella flexneri 2a str. 2457T
ugaaaugaaaaucaccau

SEQ ID NO: 3852221 - RNA, 17 nt, Shigella flexneri 2a str. 2457T
ugaaaugaugucgcugu

SEQ ID NO: 3852222 - RNA, 13 nt, Shigella flexneri 2a str. 2457T
ugaaaugcggcga

SEQ ID NO: 3852223 - RNA, 22 nt, Shigella flexneri 2a str. 2457T
ugaaaugugguuucacuuucug

SEQ ID NO: 3852224 - RNA, 14 nt, Shigella flexneri 2a str. 2457T
ugaaauuccaucac

SEQ ID NO: 3852225 - RNA, 21 nt, Shigella flexneri 2a str. 2457T
ugaaauucuccuuucuuucug

SEQ ID NO: 3852226 - RNA, 13 nt, Shigella flexneri 2a str. 2457T
ugaaauugcuggu

SEQ ID NO: 3852227 - RNA, 14 nt, Shigella flexneri 2a str. 2457T
ugaaauugcugguu

SEQ ID NO: 3852228 - RNA, 19 nt, Shigella flexneri 2a str. 2457T
ugaaauugugauaaaaauc

SEQ ID NO: 3852229 - RNA, 22 nt, Shigella flexneri 2a str. 2457T
ugaaauuuaugcgcuaaauguu

SEQ ID NO: 3852230 - RNA, 17 nt, Shigella flexneri 2a str. 2457T
ugaacaaaaaagaguaa

SEQ ID NO: 3852231 - RNA, 12 nt, Shigella flexneri 2a str. 2457T
ugaacaaagcgc

SEQ ID NO: 3852232 - RNA, 23 nt, Shigella flexneri 2a str. 2457T
ugaacaacuuaacuugcuuaaaa

SEQ ID NO: 3852233 - RNA, 20 nt, Shigella flexneri 2a str. 2457T
ugaacaccaaacccugagug

SEQ ID NO: 3852234 - RNA, 21 nt, Shigella flexneri 2a str. 2457T
ugaacaccaaacccugaguga

SEQ ID NO: 3852235 - RNA, 17 nt, Shigella flexneri 2a str. 2457T
ugaacaccuucucaggc

SEQ ID NO: 3852236 - RNA, 20 nt, Shigella flexneri 2a str. 2457T
ugaacacgaucucacgcuga

SEQ ID NO: 3852237 - RNA, 14 nt, Shigella flexneri 2a str. 2457T
ugaacacguaauuc

SEQ ID NO: 3852238 - RNA, 19 nt, Shigella flexneri 2a str. 2457T
ugaacagaccacauuccag

SEQ ID NO: 3852239 - RNA, 12 nt, Shigella flexneri 2a str. 2457T
ugaacagccaga

SEQ ID NO: 3852240 - RNA, 13 nt, Shigella flexneri 2a str. 2457T
ugaacagccugug

SEQ ID NO: 3852241 - RNA, 22 nt, Shigella flexneri 2a str. 2457T
ugaacaggcaacaacaaccgau

SEQ ID NO: 3852242 - RNA, 23 nt, Shigella flexneri 2a str. 2457T
ugaacagggcgucaccggucaga

SEQ ID NO: 3852243 - RNA, 23 nt, Shigella flexneri 2a str. 2457T
ugaacaucgcagggaaaauuaac

SEQ ID NO: 3852244 - RNA, 14 nt, Shigella flexneri 2a str. 2457T
ugaacauugcugcu

SEQ ID NO: 3852245 - RNA, 13 nt, Shigella flexneri 2a str. 2457T
ugaacauuuucuu

SEQ ID NO: 3852246 - RNA, 22 nt, Shigella flexneri 2a str. 2457T
ugaaccagauaucgcggauaug

SEQ ID NO: 3852247 - RNA, 16 nt, Shigella flexneri 2a str. 2457T
ugaaccgcacagguug

SEQ ID NO: 3852248 - RNA, 17 nt, Shigella flexneri 2a str. 2457T
ugaaccgugucgccauc

SEQ ID NO: 3852249 - RNA, 21 nt, Shigella flexneri 2a str. 2457T
ugaaccgugucgccaucaaag

SEQ ID NO: 3852250 - RNA, 21 nt, Shigella flexneri 2a str. 2457T
ugaacgaaaagcgcacaacgu

SEQ ID NO: 3852251 - RNA, 22 nt, Shigella flexneri 2a str. 2457T
ugaacgagaaaagccaaccugc

SEQ ID NO: 3852252 - RNA, 18 nt, Shigella flexneri 2a str. 2457T
ugaacgagucaacgcuuc

SEQ ID NO: 3852253 - RNA, 20 nt, Shigella flexneri 2a str. 2457T
ugaacgcaccuuccaguuug

SEQ ID NO: 3852254 - RNA, 18 nt, Shigella flexneri 2a str. 2457T
ugaacgccaaauucuuua

SEQ ID NO: 3852255 - RNA, 20 nt, Shigella flexneri 2a str. 2457T
ugaacgccaaauucuuuauc

SEQ ID NO: 3852256 - RNA, 21 nt, Shigella flexneri 2a str. 2457T
ugaacgccacgcucacucauc

SEQ ID NO: 3852257 - RNA, 15 nt, Shigella flexneri 2a str. 2457T
ugaacgcccccucac

SEQ ID NO: 3852258 - RNA, 20 nt, Shigella flexneri 2a str. 2457T
ugaacgccuaauccagccua

SEQ ID NO: 3852259 - RNA, 14 nt, Shigella flexneri 2a str. 2457T
ugaacgccuuaucc

SEQ ID NO: 3852260 - RNA, 20 nt, Shigella flexneri 2a str. 2457T
ugaacgccuuauccgaccua

SEQ ID NO: 3852261 - RNA, 20 nt, Shigella flexneri 2a str. 2457T
ugaacgccuuauccggccug

SEQ ID NO: 3852262 - RNA, 14 nt, Shigella flexneri 2a str. 2457T
ugaacgccuuaucu

SEQ ID NO: 3852263 - RNA, 20 nt, Shigella flexneri 2a str. 2457T
ugaacgcguuauccggcuaa

SEQ ID NO: 3852264 - RNA, 14 nt, Shigella flexneri 2a str. 2457T
ugaacggcaaacgc

SEQ ID NO: 3852265 - RNA, 15 nt, Shigella flexneri 2a str. 2457T
ugaacgggugauuaa

SEQ ID NO: 3852266 - RNA, 15 nt, Shigella flexneri 2a str. 2457T
ugaacggugaugcuc

SEQ ID NO: 3852267 - RNA, 14 nt, Shigella flexneri 2a str. 2457T
ugaacgugcaaaau

SEQ ID NO: 3852268 - RNA, 19 nt, Shigella flexneri 2a str. 2457T
ugaacgugcaaaaucaaac

SEQ ID NO: 3852269 - RNA, 20 nt, Shigella flexneri 2a str. 2457T
ugaacgugcaaaaucaaaca

SEQ ID NO: 3852270 - RNA, 21 nt, Shigella flexneri 2a str. 2457T
ugaacgugcaaaaucaaacag

SEQ ID NO: 3852271 - RNA, 19 nt, Shigella flexneri 2a str. 2457T
ugaacucgccgcacaggcg

SEQ ID NO: 3852272 - RNA, 20 nt, Shigella flexneri 2a str. 2457T
ugaacucgccgcacaggcgu

SEQ ID NO: 3852273 - RNA, 13 nt, Shigella flexneri 2a str. 2457T
ugaacucuucuuc

SEQ ID NO: 3852274 - RNA, 17 nt, Shigella flexneri 2a str. 2457T
ugaacugaacaaaaaag

SEQ ID NO: 3852275 - RNA, 19 nt, Shigella flexneri 2a str. 2457T
ugaacugacagccaaaggg

SEQ ID NO: 3852276 - RNA, 19 nt, Shigella flexneri 2a str. 2457T
ugaacuggcuuuuuucaau

SEQ ID NO: 3852277 - RNA, 19 nt, Shigella flexneri 2a str. 2457T
ugaacugggccugcauauc

SEQ ID NO: 3852278 - RNA, 17 nt, Shigella flexneri 2a str. 2457T
ugaacuguacaaagccg

SEQ ID NO: 3852279 - RNA, 22 nt, Shigella flexneri 2a str. 2457T
ugaacuucgcagccgugacugg

SEQ ID NO: 3852280 - RNA, 23 nt, Shigella flexneri 2a str. 2457T
ugaagaaaucaguugauuaugau

SEQ ID NO: 3852281 - RNA, 23 nt, Shigella flexneri 2a str. 2457T
ugaagaagcggaaaucacgcauc

SEQ ID NO: 3852282 - RNA, 16 nt, Shigella flexneri 2a str. 2457T
ugaagaauuuuugcgg

SEQ ID NO: 3852283 - RNA, 18 nt, Shigella flexneri 2a str. 2457T
ugaagaggaacaaauuuu

SEQ ID NO: 3852284 - RNA, 21 nt, Shigella flexneri 2a str. 2457T
ugaagauggucuguaccacca

SEQ ID NO: 3852285 - RNA, 21 nt, Shigella flexneri 2a str. 2457T
ugaagcaagcgucgccagcgc

SEQ ID NO: 3852286 - RNA, 21 nt, Shigella flexneri 2a str. 2457T
ugaagcaguuucaccagcagu

SEQ ID NO: 3852287 - RNA, 18 nt, Shigella flexneri 2a str. 2457T
ugaagccaaaucauccag

SEQ ID NO: 3852288 - RNA, 22 nt, Shigella flexneri 2a str. 2457T
ugaagccaaaucauccagaccg

SEQ ID NO: 3852289 - RNA, 19 nt, Shigella flexneri 2a str. 2457T
ugaagcccaguaccgccag

SEQ ID NO: 3852290 - RNA, 20 nt, Shigella flexneri 2a str. 2457T
ugaagcccgcugaaaagcgg

SEQ ID NO: 3852291 - RNA, 20 nt, Shigella flexneri 2a str. 2457T
ugaagccuucgccuuucagu

SEQ ID NO: 3852292 - RNA, 14 nt, Shigella flexneri 2a str. 2457T
ugaagcgcugggga

SEQ ID NO: 3852293 - RNA, 23 nt, Shigella flexneri 2a str. 2457T
ugaagcucacuucgcuuacgccu

SEQ ID NO: 3852294 - RNA, 19 nt, Shigella flexneri 2a str. 2457T
ugaagcuggcagaaguugu

SEQ ID NO: 3852295 - RNA, 20 nt, Shigella flexneri 2a str. 2457T
ugaagcuggcagaaguuguc

SEQ ID NO: 3852296 - RNA, 20 nt, Shigella flexneri 2a str. 2457T
ugaaggaugaaacugccgga

SEQ ID NO: 3852297 - RNA, 23 nt, Shigella flexneri 2a str. 2457T
ugaaggcgacguagcccgguaca

SEQ ID NO: 3852298 - RNA, 20 nt, Shigella flexneri 2a str. 2457T
ugaaggcgcauugcuggcug

SEQ ID NO: 3852299 - RNA, 15 nt, Shigella flexneri 2a str. 2457T
ugaaggcggcgcauc

SEQ ID NO: 3852300 - RNA, 14 nt, Shigella flexneri 2a str. 2457T
ugaagggcuggcug

SEQ ID NO: 3852301 - RNA, 22 nt, Shigella flexneri 2a str. 2457T
ugaagguuguuaaccaccagua

SEQ ID NO: 3852302 - RNA, 22 nt, Shigella flexneri 2a str. 2457T
ugaagguuucugcauuauccag

SEQ ID NO: 3852303 - RNA, 15 nt, Shigella flexneri 2a str. 2457T
ugaaguacacauaaa

SEQ ID NO: 3852304 - RNA, 21 nt, Shigella flexneri 2a str. 2457T
ugaaguacgaaaaaaccggga

SEQ ID NO: 3852305 - RNA, 13 nt, Shigella flexneri 2a str. 2457T
ugaaguagccagu

SEQ ID NO: 3852306 - RNA, 21 nt, Shigella flexneri 2a str. 2457T
ugaagucagggucuuccagca

SEQ ID NO: 3852307 - RNA, 15 nt, Shigella flexneri 2a str. 2457T
ugaagucucaauuag

SEQ ID NO: 3852308 - RNA, 19 nt, Shigella flexneri 2a str. 2457T
ugaagucuuuuuucaacuu

SEQ ID NO: 3852309 - RNA, 22 nt, Shigella flexneri 2a str. 2457T
ugaagucuuuuuucaacuuuau

SEQ ID NO: 3852310 - RNA, 20 nt, Shigella flexneri 2a str. 2457T
ugaagugagaauuuuucacu

SEQ ID NO: 3852311 - RNA, 23 nt, Shigella flexneri 2a str. 2457T
ugaagugugcaaacgauaaaagu

SEQ ID NO: 3852312 - RNA, 20 nt, Shigella flexneri 2a str. 2457T
ugaauaaaguuuuaguugcc

SEQ ID NO: 3852313 - RNA, 14 nt, Shigella flexneri 2a str. 2457T
ugaauaacaccagc

SEQ ID NO: 3852314 - RNA, 15 nt, Shigella flexneri 2a str. 2457T
ugaauaauacacaca

SEQ ID NO: 3852315 - RNA, 20 nt, Shigella flexneri 2a str. 2457T
ugaauagcggaaaucuccag

SEQ ID NO: 3852316 - RNA, 19 nt, Shigella flexneri 2a str. 2457T
ugaauagugccacaccagc

SEQ ID NO: 3852317 - RNA, 22 nt, Shigella flexneri 2a str. 2457T
ugaauauaccauggaagaaaaa

SEQ ID NO: 3852318 - RNA, 23 nt, Shigella flexneri 2a str. 2457T
ugaauauaccauggaagaaaaau

SEQ ID NO: 3852319 - RNA, 18 nt, Shigella flexneri 2a str. 2457T
ugaauauauccgaaaaag

SEQ ID NO: 3852320 - RNA, 19 nt, Shigella flexneri 2a str. 2457T
ugaauaugucgcgccaggc

SEQ ID NO: 3852321 - RNA, 14 nt, Shigella flexneri 2a str. 2457T
ugaauauucagaau

SEQ ID NO: 3852322 - RNA, 20 nt, Shigella flexneri 2a str. 2457T
ugaauauuccacagcucacg

SEQ ID NO: 3852323 - RNA, 16 nt, Shigella flexneri 2a str. 2457T
ugaauauuccuuaugg

SEQ ID NO: 3852324 - RNA, 18 nt, Shigella flexneri 2a str. 2457T
ugaauauuccuuaugguu

SEQ ID NO: 3852325 - RNA, 22 nt, Shigella flexneri 2a str. 2457T
ugaauauugccggaugugaugc

SEQ ID NO: 3852326 - RNA, 13 nt, Shigella flexneri 2a str. 2457T
ugaaucaacacca

SEQ ID NO: 3852327 - RNA, 23 nt, Shigella flexneri 2a str. 2457T
ugaaucaucguucauauauuccu

SEQ ID NO: 3852328 - RNA, 22 nt, Shigella flexneri 2a str. 2457T
ugaaucccugcgaacugcgcag

SEQ ID NO: 3852329 - RNA, 23 nt, Shigella flexneri 2a str. 2457T
ugaaucgcuauuaacccgcaaca

SEQ ID NO: 3852330 - RNA, 16 nt, Shigella flexneri 2a str. 2457T
ugaaucgucagacgau

SEQ ID NO: 3852331 - RNA, 23 nt, Shigella flexneri 2a str. 2457T
ugaaucucuuaucauccagguga

SEQ ID NO: 3852332 - RNA, 13 nt, Shigella flexneri 2a str. 2457T
ugaaucugagcau

SEQ ID NO: 3852333 - RNA, 13 nt, Shigella flexneri 2a str. 2457T
ugaaucuuuucau

SEQ ID NO: 3852334 - RNA, 16 nt, Shigella flexneri 2a str. 2457T
ugaaucuuuucaucgc

SEQ ID NO: 3852335 - RNA, 18 nt, Shigella flexneri 2a str. 2457T
ugaaugauaaaauucauu

SEQ ID NO: 3852336 - RNA, 19 nt, Shigella flexneri 2a str. 2457T
ugaaugccggaugcggcgu

SEQ ID NO: 3852337 - RNA, 19 nt, Shigella flexneri 2a str. 2457T
ugaaugccguaggcccagc

SEQ ID NO: 3852338 - RNA, 20 nt, Shigella flexneri 2a str. 2457T
ugaauggggcuaucucaccc

SEQ ID NO: 3852339 - RNA, 22 nt, Shigella flexneri 2a str. 2457T
ugaaugguggcgaugauuuccg

SEQ ID NO: 3852340 - RNA, 15 nt, Shigella flexneri 2a str. 2457T
ugaauguugcgcggu

SEQ ID NO: 3852341 - RNA, 14 nt, Shigella flexneri 2a str. 2457T
ugaauuaaugccuc

SEQ ID NO: 3852342 - RNA, 16 nt, Shigella flexneri 2a str. 2457T
ugaauuacgcaaacgu

SEQ ID NO: 3852343 - RNA, 17 nt, Shigella flexneri 2a str. 2457T
ugaauuacuucucuuuc

SEQ ID NO: 3852344 - RNA, 19 nt, Shigella flexneri 2a str. 2457T
ugaauuccgaauuucaucc

SEQ ID NO: 3852345 - RNA, 23 nt, Shigella flexneri 2a str. 2457T
ugaauuccgaauuucauccugua

SEQ ID NO: 3852346 - RNA, 15 nt, Shigella flexneri 2a str. 2457T
ugaauugugaugguu

SEQ ID NO: 3852347 - RNA, 14 nt, Shigella flexneri 2a str. 2457T
ugaauuguuuuaua

SEQ ID NO: 3852348 - RNA, 15 nt, Shigella flexneri 2a str. 2457T
ugaauuguuuuauaa

SEQ ID NO: 3852349 - RNA, 19 nt, Shigella flexneri 2a str. 2457T
ugaauuuacacaauuuugu

SEQ ID NO: 3852350 - RNA, 12 nt, Shigella flexneri 2a str. 2457T
ugaauuucacuu

SEQ ID NO: 3852351 - RNA, 17 nt, Shigella flexneri 2a str. 2457T
ugaauuucacuucgcca

SEQ ID NO: 3852352 - RNA, 18 nt, Shigella flexneri 2a str. 2457T
ugaauuucuaucaaggcg

SEQ ID NO: 3852353 - RNA, 15 nt, Shigella flexneri 2a str. 2457T
ugaauuugcaugacu

SEQ ID NO: 3852354 - RNA, 17 nt, Shigella flexneri 2a str. 2457T
ugaauuugucgauuucc

SEQ ID NO: 3852355 - RNA, 22 nt, Shigella flexneri 2a str. 2457T
ugacaaacgcaaaacugccuga

SEQ ID NO: 3852356 - RNA, 20 nt, Shigella flexneri 2a str. 2457T
ugacaacguagcguuaaaac

SEQ ID NO: 3852357 - RNA, 18 nt, Shigella flexneri 2a str. 2457T
ugacaacucaucacugua

SEQ ID NO: 3852358 - RNA, 18 nt, Shigella flexneri 2a str. 2457T
ugacaagcguaugauugc

SEQ ID NO: 3852359 - RNA, 15 nt, Shigella flexneri 2a str. 2457T
ugacaagcucaccuc

SEQ ID NO: 3852360 - RNA, 21 nt, Shigella flexneri 2a str. 2457T
ugacaauaauugucaacggca

SEQ ID NO: 3852361 - RNA, 17 nt, Shigella flexneri 2a str. 2457T
ugacaaucgcugcggca

SEQ ID NO: 3852362 - RNA, 15 nt, Shigella flexneri 2a str. 2457T
ugacacaaucaaauc

SEQ ID NO: 3852363 - RNA, 16 nt, Shigella flexneri 2a str. 2457T
ugacacaaucaaaucc

SEQ ID NO: 3852364 - RNA, 19 nt, Shigella flexneri 2a str. 2457T
ugacacaaucaaauccugc

SEQ ID NO: 3852365 - RNA, 16 nt, Shigella flexneri 2a str. 2457T
ugacacaggcagcaau

SEQ ID NO: 3852366 - RNA, 18 nt, Shigella flexneri 2a str. 2457T
ugacacaucaccuccagc

SEQ ID NO: 3852367 - RNA, 11 nt, Shigella flexneri 2a str. 2457T
ugacaccagca

SEQ ID NO: 3852368 - RNA, 16 nt, Shigella flexneri 2a str. 2457T
ugacaccagcauaaua

SEQ ID NO: 3852369 - RNA, 13 nt, Shigella flexneri 2a str. 2457T
ugacacccaaugu

SEQ ID NO: 3852370 - RNA, 16 nt, Shigella flexneri 2a str. 2457T
ugacacuauucgccag

SEQ ID NO: 3852371 - RNA, 20 nt, Shigella flexneri 2a str. 2457T
ugacacuauucgccagcacg

SEQ ID NO: 3852372 - RNA, 22 nt, Shigella flexneri 2a str. 2457T
ugacacuucauuaaccacgauc

SEQ ID NO: 3852373 - RNA, 22 nt, Shigella flexneri 2a str. 2457T
ugacagaccguugcucagaauc

SEQ ID NO: 3852374 - RNA, 17 nt, Shigella flexneri 2a str. 2457T
ugacagaguuccggccc

SEQ ID NO: 3852375 - RNA, 17 nt, Shigella flexneri 2a str. 2457T
ugacagauuugauuauc

SEQ ID NO: 3852376 - RNA, 18 nt, Shigella flexneri 2a str. 2457T
ugacagauuuugccagca

SEQ ID NO: 3852377 - RNA, 13 nt, Shigella flexneri 2a str. 2457T
ugacagcaaauac

SEQ ID NO: 3852378 - RNA, 12 nt, Shigella flexneri 2a str. 2457T
ugacagcccggc

SEQ ID NO: 3852379 - RNA, 21 nt, Shigella flexneri 2a str. 2457T
ugacagcggugauuuccgccg

SEQ ID NO: 3852380 - RNA, 17 nt, Shigella flexneri 2a str. 2457T
ugacaggcgggaagaac

SEQ ID NO: 3852381 - RNA, 23 nt, Shigella flexneri 2a str. 2457T
ugacaggcgggaagaacggcaac

SEQ ID NO: 3852382 - RNA, 15 nt, Shigella flexneri 2a str. 2457T
ugacagggugagcag

SEQ ID NO: 3852383 - RNA, 16 nt, Shigella flexneri 2a str. 2457T
ugacagggugagcagg

SEQ ID NO: 3852384 - RNA, 21 nt, Shigella flexneri 2a str. 2457T
ugacagguugcucauaaaaug

SEQ ID NO: 3852385 - RNA, 22 nt, Shigella flexneri 2a str. 2457T
ugacagguugcucauaaaauga

SEQ ID NO: 3852386 - RNA, 14 nt, Shigella flexneri 2a str. 2457T
ugacaguagccuuu

SEQ ID NO: 3852387 - RNA, 14 nt, Shigella flexneri 2a str. 2457T
ugacagucuggaag

SEQ ID NO: 3852388 - RNA, 16 nt, Shigella flexneri 2a str. 2457T
ugacagucuggaagcc

SEQ ID NO: 3852389 - RNA, 19 nt, Shigella flexneri 2a str. 2457T
ugacagucuggaagccagu

SEQ ID NO: 3852390 - RNA, 14 nt, Shigella flexneri 2a str. 2457T
ugacaguugucagc

SEQ ID NO: 3852391 - RNA, 16 nt, Shigella flexneri 2a str. 2457T
ugacaguuuauuuucu

SEQ ID NO: 3852392 - RNA, 18 nt, Shigella flexneri 2a str. 2457T
ugacauaaacaccagcaa

SEQ ID NO: 3852393 - RNA, 14 nt, Shigella flexneri 2a str. 2457T
ugacauaaugcaaa

SEQ ID NO: 3852394 - RNA, 13 nt, Shigella flexneri 2a str. 2457T
ugacauaauuggc

SEQ ID NO: 3852395 - RNA, 18 nt, Shigella flexneri 2a str. 2457T
ugacauaguagccagcca

SEQ ID NO: 3852396 - RNA, 20 nt, Shigella flexneri 2a str. 2457T
ugacauaguagccagccaga

SEQ ID NO: 3852397 - RNA, 21 nt, Shigella flexneri 2a str. 2457T
ugacauauaaccggcaacaga

SEQ ID NO: 3852398 - RNA, 15 nt, Shigella flexneri 2a str. 2457T
ugacaucgugcuggu

SEQ ID NO: 3852399 - RNA, 19 nt, Shigella flexneri 2a str. 2457T
ugacaucgugcugguagaa

SEQ ID NO: 3852400 - RNA, 14 nt, Shigella flexneri 2a str. 2457T
ugacaucuccagcg

SEQ ID NO: 3852401 - RNA, 21 nt, Shigella flexneri 2a str. 2457T
ugacauuaaccaaccaccaaa

SEQ ID NO: 3852402 - RNA, 18 nt, Shigella flexneri 2a str. 2457T
ugacauuaucagacaccg

SEQ ID NO: 3852403 - RNA, 21 nt, Shigella flexneri 2a str. 2457T
ugacauucaccucacgacgua

SEQ ID NO: 3852404 - RNA, 23 nt, Shigella flexneri 2a str. 2457T
ugacauuugcuuuuguuaauugc

SEQ ID NO: 3852405 - RNA, 14 nt, Shigella flexneri 2a str. 2457T
ugaccaccagcacg

SEQ ID NO: 3852406 - RNA, 20 nt, Shigella flexneri 2a str. 2457T
ugaccacggccacagccagc

SEQ ID NO: 3852407 - RNA, 14 nt, Shigella flexneri 2a str. 2457T
ugaccagaacugau

SEQ ID NO: 3852408 - RNA, 17 nt, Shigella flexneri 2a str. 2457T
ugaccagcgauaaaaau

SEQ ID NO: 3852409 - RNA, 13 nt, Shigella flexneri 2a str. 2457T
ugaccagcuccag

SEQ ID NO: 3852410 - RNA, 19 nt, Shigella flexneri 2a str. 2457T
ugaccaggacuuugaaagc

SEQ ID NO: 3852411 - RNA, 23 nt, Shigella flexneri 2a str. 2457T
ugaccaguaauauccccagccua

SEQ ID NO: 3852412 - RNA, 17 nt, Shigella flexneri 2a str. 2457T
ugaccaguaccaccgcg

SEQ ID NO: 3852413 - RNA, 20 nt, Shigella flexneri 2a str. 2457T
ugagauaauucuguaauccu

SEQ ID NO: 3852414 - RNA, 22 nt, Shigella flexneri 2a str. 2457T
ugagauacucaagcagccaggu

SEQ ID NO: 3852415 - RNA, 20 nt, Shigella flexneri 2a str. 2457T
ugagaucauuauuaaacaga

SEQ ID NO: 3852416 - RNA, 16 nt, Shigella flexneri 2a str. 2457T
ugagaugcuggagaac

SEQ ID NO: 3852417 - RNA, 21 nt, Shigella flexneri 2a str. 2457T
ugagauuuauuuaccgcuacu

SEQ ID NO: 3852418 - RNA, 13 nt, Shigella flexneri 2a str. 2457T
ugagcaaacaguu

SEQ ID NO: 3852419 - RNA, 19 nt, Shigella flexneri 2a str. 2457T
ugagcaaacaguucugcag

SEQ ID NO: 3852420 - RNA, 22 nt, Shigella flexneri 2a str. 2457T
ugagcaaauccgcacucaucuu

SEQ ID NO: 3852421 - RNA, 20 nt, Shigella flexneri 2a str. 2457T
ugagcaccuuuuuucugucu

SEQ ID NO: 3852422 - RNA, 12 nt, Shigella flexneri 2a str. 2457T
ugagcagaaaaa

SEQ ID NO: 3852423 - RNA, 16 nt, Shigella flexneri 2a str. 2457T
ugagcagaccaauaac

SEQ ID NO: 3852424 - RNA, 16 nt, Shigella flexneri 2a str. 2457T
ugagcagccaccacuu

SEQ ID NO: 3852425 - RNA, 18 nt, Shigella flexneri 2a str. 2457T
ugagcaggaugccugaug

SEQ ID NO: 3852426 - RNA, 21 nt, Shigella flexneri 2a str. 2457T
ugagcaguagcgucgccagca

SEQ ID NO: 3852427 - RNA, 17 nt, Shigella flexneri 2a str. 2457T
ugagcaguccccacauc

SEQ ID NO: 3852428 - RNA, 12 nt, Shigella flexneri 2a str. 2457T
ugagcaugaugc

SEQ ID NO: 3852429 - RNA, 21 nt, Shigella flexneri 2a str. 2457T
ugagccgaaauauggcgcugc

SEQ ID NO: 3852430 - RNA, 13 nt, Shigella flexneri 2a str. 2457T
ugagcgauaccca

SEQ ID NO: 3852431 - RNA, 14 nt, Shigella flexneri 2a str. 2457T
ugagcgauauuuau

SEQ ID NO: 3852432 - RNA, 23 nt, Shigella flexneri 2a str. 2457T
ugagcgauuuuuuauaguacuuc

SEQ ID NO: 3852433 - RNA, 15 nt, Shigella flexneri 2a str. 2457T
ugagcggacugaacg

SEQ ID NO: 3852434 - RNA, 16 nt, Shigella flexneri 2a str. 2457T
ugagcggccuuuuccu

SEQ ID NO: 3852435 - RNA, 19 nt, Shigella flexneri 2a str. 2457T
ugagcgggcgaaccaggcc

SEQ ID NO: 3852436 - RNA, 15 nt, Shigella flexneri 2a str. 2457T
ugagcguauccagca

SEQ ID NO: 3852437 - RNA, 13 nt, Shigella flexneri 2a str. 2457T
ugagcgucauuau

SEQ ID NO: 3852438 - RNA, 20 nt, Shigella flexneri 2a str. 2457T
ugagcguuacccgcagccau

SEQ ID NO: 3852439 - RNA, 18 nt, Shigella flexneri 2a str. 2457T
ugagcuaaugcaaaucac

SEQ ID NO: 3852440 - RNA, 20 nt, Shigella flexneri 2a str. 2457T
ugagcugcgcgacucccuga

SEQ ID NO: 3852441 - RNA, 18 nt, Shigella flexneri 2a str. 2457T
ugagcugucgacuaaccu

SEQ ID NO: 3852442 - RNA, 13 nt, Shigella flexneri 2a str. 2457T
ugagcuucucgau

SEQ ID NO: 3852443 - RNA, 14 nt, Shigella flexneri 2a str. 2457T
ugaggaagcgcagc

SEQ ID NO: 3852444 - RNA, 22 nt, Shigella flexneri 2a str. 2457T
ugaggaucaccaguccaucggc

SEQ ID NO: 3852445 - RNA, 17 nt, Shigella flexneri 2a str. 2457T
ugaggaugcuaaggcug

SEQ ID NO: 3852446 - RNA, 19 nt, Shigella flexneri 2a str. 2457T
ugaggcgcuacgcuaucag

SEQ ID NO: 3852447 - RNA, 23 nt, Shigella flexneri 2a str. 2457T
ugaggcggucuggauuuggcugc

SEQ ID NO: 3852448 - RNA, 22 nt, Shigella flexneri 2a str. 2457T
ugaggcuuuaauaccugccugg

SEQ ID NO: 3852449 - RNA, 16 nt, Shigella flexneri 2a str. 2457T
ugagggcaaacaccgc

SEQ ID NO: 3852450 - RNA, 16 nt, Shigella flexneri 2a str. 2457T
ugagggcgcaauuucc

SEQ ID NO: 3852451 - RNA, 18 nt, Shigella flexneri 2a str. 2457T
ugaggggggauguuggcg

SEQ ID NO: 3852452 - RNA, 22 nt, Shigella flexneri 2a str. 2457T
ugagguccggccauacccgcca

SEQ ID NO: 3852453 - RNA, 20 nt, Shigella flexneri 2a str. 2457T
ugagguggccgagaggcuga

SEQ ID NO: 3852454 - RNA, 15 nt, Shigella flexneri 2a str. 2457T
ugagguuuuugacga

SEQ ID NO: 3852455 - RNA, 16 nt, Shigella flexneri 2a str. 2457T
ugaguaaacuuuugga

SEQ ID NO: 3852456 - RNA, 13 nt, Shigella flexneri 2a str. 2457T
ugaguaauaacuu

SEQ ID NO: 3852457 - RNA, 16 nt, Shigella flexneri 2a str. 2457T
ugaguaauaacuuccu

SEQ ID NO: 3852458 - RNA, 16 nt, Shigella flexneri 2a str. 2457T
ugagucaauuucugca

SEQ ID NO: 3852459 - RNA, 20 nt, Shigella flexneri 2a str. 2457T
ugagucaauuucugcaaaau

SEQ ID NO: 3852460 - RNA, 15 nt, Shigella flexneri 2a str. 2457T
ugagucacauuuuua

SEQ ID NO: 3852461 - RNA, 19 nt, Shigella flexneri 2a str. 2457T
ugagucgggaccagcauuc

SEQ ID NO: 3852462 - RNA, 15 nt, Shigella flexneri 2a str. 2457T
ugagugcucaaccgu

SEQ ID NO: 3852463 - RNA, 18 nt, Shigella flexneri 2a str. 2457T
ugaguggaguccagcgcc

SEQ ID NO: 3852464 - RNA, 14 nt, Shigella flexneri 2a str. 2457T
ugaguuaagaagau

SEQ ID NO: 3852465 - RNA, 16 nt, Shigella flexneri 2a str. 2457T
ugaguuaagcaaaaaa

SEQ ID NO: 3852466 - RNA, 22 nt, Shigella flexneri 2a str. 2457T
ugaguuaagcaaaaaaacauaa

SEQ ID NO: 3852467 - RNA, 21 nt, Shigella flexneri 2a str. 2457T
ugaguuacgccaucccaacug

SEQ ID NO: 3852468 - RNA, 19 nt, Shigella flexneri 2a str. 2457T
ugaguugaguaucagagaa

SEQ ID NO: 3852469 - RNA, 13 nt, Shigella flexneri 2a str. 2457T
ugaguugccauca

SEQ ID NO: 3852470 - RNA, 15 nt, Shigella flexneri 2a str. 2457T
ugauaaaaaacccgc

SEQ ID NO: 3852471 - RNA, 21 nt, Shigella flexneri 2a str. 2457T
ugauaaaauucauucaauuaa

SEQ ID NO: 3852472 - RNA, 17 nt, Shigella flexneri 2a str. 2457T
ugauaaacaaacagcgc

SEQ ID NO: 3852473 - RNA, 13 nt, Shigella flexneri 2a str. 2457T
ugauaaacaagcg

SEQ ID NO: 3852474 - RNA, 16 nt, Shigella flexneri 2a str. 2457T
ugauaaacccaacggc

SEQ ID NO: 3852475 - RNA, 16 nt, Shigella flexneri 2a str. 2457T
ugauaaaccuccagca

SEQ ID NO: 3852476 - RNA, 18 nt, Shigella flexneri 2a str. 2457T
ugauaaaugagugaugau

SEQ ID NO: 3852477 - RNA, 20 nt, Shigella flexneri 2a str. 2457T
ugauaaccccgcaauuucau

SEQ ID NO: 3852478 - RNA, 15 nt, Shigella flexneri 2a str. 2457T
ugauaacgccugggc

SEQ ID NO: 3852479 - RNA, 12 nt, Shigella flexneri 2a str. 2457T
ugauaacgcuua

SEQ ID NO: 3852480 - RNA, 18 nt, Shigella flexneri 2a str. 2457T
ugauaacgugcagcuuuc

SEQ ID NO: 3852481 - RNA, 14 nt, Shigella flexneri 2a str. 2457T
ugauaacuucuacc

SEQ ID NO: 3852482 - RNA, 12 nt, Shigella flexneri 2a str. 2457T
ugauaaggaaau

SEQ ID NO: 3852483 - RNA, 17 nt, Shigella flexneri 2a str. 2457T
ugauaaggaaauucagc

SEQ ID NO: 3852484 - RNA, 14 nt, Shigella flexneri 2a str. 2457T
ugauaaucagaagg

SEQ ID NO: 3852485 - RNA, 14 nt, Shigella flexneri 2a str. 2457T
ugauaaucauccca

SEQ ID NO: 3852486 - RNA, 13 nt, Shigella flexneri 2a str. 2457T
ugauaauccauca

SEQ ID NO: 3852487 - RNA, 18 nt, Shigella flexneri 2a str. 2457T
ugauaauccaucacuuca

SEQ ID NO: 3852488 - RNA, 19 nt, Shigella flexneri 2a str. 2457T
ugauaauccaucacuucau

SEQ ID NO: 3852489 - RNA, 22 nt, Shigella flexneri 2a str. 2457T
ugauaauccaucacuucaucau

SEQ ID NO: 3852490 - RNA, 23 nt, Shigella flexneri 2a str. 2457T
ugauaauguuauuuaauuacuga

SEQ ID NO: 3852491 - RNA, 18 nt, Shigella flexneri 2a str. 2457T
ugauaauuauuauaauaa

SEQ ID NO: 3852492 - RNA, 22 nt, Shigella flexneri 2a str. 2457T
ugauaauuguuaucguuugcau

SEQ ID NO: 3852493 - RNA, 15 nt, Shigella flexneri 2a str. 2457T
ugauacaggcgcugu

SEQ ID NO: 3852494 - RNA, 14 nt, Shigella flexneri 2a str. 2457T
ugauacaucaaguc

SEQ ID NO: 3852495 - RNA, 17 nt, Shigella flexneri 2a str. 2457T
ugauacaucaagucaga

SEQ ID NO: 3852496 - RNA, 22 nt, Shigella flexneri 2a str. 2457T
ugauaccgauuacucagcaacu

SEQ ID NO: 3852497 - RNA, 21 nt, Shigella flexneri 2a str. 2457T
ugauaccgggcguccugcuug

SEQ ID NO: 3852498 - RNA, 19 nt, Shigella flexneri 2a str. 2457T
ugauacgggaggucaucag

SEQ ID NO: 3852499 - RNA, 18 nt, Shigella flexneri 2a str. 2457T
ugauacugaacaacuuaa

SEQ ID NO: 3852500 - RNA, 15 nt, Shigella flexneri 2a str. 2457T
ugauacugacauuaa

SEQ ID NO: 3852501 - RNA, 18 nt, Shigella flexneri 2a str. 2457T
ugauagcccggauuucca

SEQ ID NO: 3852502 - RNA, 21 nt, Shigella flexneri 2a str. 2457T
ugauagcuuacggcgcuguga

SEQ ID NO: 3852503 - RNA, 23 nt, Shigella flexneri 2a str. 2457T
ugauaggcgaggcggggccaauu

SEQ ID NO: 3852504 - RNA, 12 nt, Shigella flexneri 2a str. 2457T
ugauaggcguug

SEQ ID NO: 3852505 - RNA, 13 nt, Shigella flexneri 2a str. 2457T
ugauagugcugcc

SEQ ID NO: 3852506 - RNA, 19 nt, Shigella flexneri 2a str. 2457T
ugauaguguuuuauguuca

SEQ ID NO: 3852507 - RNA, 18 nt, Shigella flexneri 2a str. 2457T
ugauaguuuacuucuaua

SEQ ID NO: 3852508 - RNA, 23 nt, Shigella flexneri 2a str. 2457T
ugauaucagccugcaaacgcuuu

SEQ ID NO: 3852509 - RNA, 13 nt, Shigella flexneri 2a str. 2457T
ugauaucccugcu

SEQ ID NO: 3852510 - RNA, 20 nt, Shigella flexneri 2a str. 2457T
ugauucacuuucugaaggau

SEQ ID NO: 3852511 - RNA, 13 nt, Shigella flexneri 2a str. 2457T
ugauucaggauau

SEQ ID NO: 3852512 - RNA, 20 nt, Shigella flexneri 2a str. 2457T
ugauucauaaagcagccuau

SEQ ID NO: 3852513 - RNA, 12 nt, Shigella flexneri 2a str. 2457T
ugauucauacag

SEQ ID NO: 3852514 - RNA, 19 nt, Shigella flexneri 2a str. 2457T
ugauucaucucuucuuccg

SEQ ID NO: 3852515 - RNA, 15 nt, Shigella flexneri 2a str. 2457T
ugauucauggcauuu

SEQ ID NO: 3852516 - RNA, 19 nt, Shigella flexneri 2a str. 2457T
ugauucauggcauuuucuc

SEQ ID NO: 3852517 - RNA, 20 nt, Shigella flexneri 2a str. 2457T
ugauuccagcauaaugacuc

SEQ ID NO: 3852518 - RNA, 16 nt, Shigella flexneri 2a str. 2457T
ugauuccgaauccaac

SEQ ID NO: 3852519 - RNA, 20 nt, Shigella flexneri 2a str. 2457T
ugauuccggcaaauaacaga

SEQ ID NO: 3852520 - RNA, 11 nt, Shigella flexneri 2a str. 2457T
ugauuccugca

SEQ ID NO: 3852521 - RNA, 22 nt, Shigella flexneri 2a str. 2457T
ugauucgaucaaacaauuuuca

SEQ ID NO: 3852522 - RNA, 16 nt, Shigella flexneri 2a str. 2457T
ugauucgauucacauu

SEQ ID NO: 3852523 - RNA, 21 nt, Shigella flexneri 2a str. 2457T
ugauucgcgccacguucggug

SEQ ID NO: 3852524 - RNA, 17 nt, Shigella flexneri 2a str. 2457T
ugauucucccucaucau

SEQ ID NO: 3852525 - RNA, 21 nt, Shigella flexneri 2a str. 2457T
ugauucugauccugcacuuuc

SEQ ID NO: 3852526 - RNA, 14 nt, Shigella flexneri 2a str. 2457T
ugauugaacugugg

SEQ ID NO: 3852527 - RNA, 20 nt, Shigella flexneri 2a str. 2457T
ugauugacgcguucgcuaaa

SEQ ID NO: 3852528 - RNA, 22 nt, Shigella flexneri 2a str. 2457T
ugauugagauaaacugccgaca

SEQ ID NO: 3852529 - RNA, 18 nt, Shigella flexneri 2a str. 2457T
ugauugagcugcccggcu

SEQ ID NO: 3852530 - RNA, 15 nt, Shigella flexneri 2a str. 2457T
ugauugccuuccacc

SEQ ID NO: 3852531 - RNA, 13 nt, Shigella flexneri 2a str. 2457T
ugauugcggagaa

SEQ ID NO: 3852532 - RNA, 19 nt, Shigella flexneri 2a str. 2457T
ugauugcuuuaucaaucac

SEQ ID NO: 3852533 - RNA, 16 nt, Shigella flexneri 2a str. 2457T
ugauuggcaucaucag

SEQ ID NO: 3852534 - RNA, 22 nt, Shigella flexneri 2a str. 2457T
ugauuggcgcgaaccaucaccu

SEQ ID NO: 3852535 - RNA, 17 nt, Shigella flexneri 2a str. 2457T
ugauuguuaacaacgug

SEQ ID NO: 3852536 - RNA, 23 nt, Shigella flexneri 2a str. 2457T
ugauuuaucccaaccuaaaaagu

SEQ ID NO: 3852537 - RNA, 22 nt, Shigella flexneri 2a str. 2457T
ugauuuccccuaacucuuucaa

SEQ ID NO: 3852538 - RNA, 20 nt, Shigella flexneri 2a str. 2457T
ugauuuccugcgugacuaaa

SEQ ID NO: 3852539 - RNA, 19 nt, Shigella flexneri 2a str. 2457T
ugauuucguagacugcagc

SEQ ID NO: 3852540 - RNA, 21 nt, Shigella flexneri 2a str. 2457T
ugauuucguccauguuggaga

SEQ ID NO: 3852541 - RNA, 17 nt, Shigella flexneri 2a str. 2457T
ugauuuugauggaagaa

SEQ ID NO: 3852542 - RNA, 17 nt, Shigella flexneri 2a str. 2457T
ugauuuugcauuuuaaa

SEQ ID NO: 3852543 - RNA, 18 nt, Shigella flexneri 2a str. 2457T
ugauuuugcauuuuaaau

SEQ ID NO: 3852544 - RNA, 20 nt, Shigella flexneri 2a str. 2457T
ugauuuugccugugcaaccu

SEQ ID NO: 3852545 - RNA, 18 nt, Shigella flexneri 2a str. 2457T
ugauuuuucguuuuaaug

SEQ ID NO: 3852546 - RNA, 23 nt, Shigella flexneri 2a str. 2457T
ugauuuuucguuuuaaugcgauc

SEQ ID NO: 3852547 - RNA, 20 nt, Shigella flexneri 2a str. 2457T
ugcaaaaaauacguaaaauc

SEQ ID NO: 3852548 - RNA, 22 nt, Shigella flexneri 2a str. 2457T
ugcaaaaaauugcgucaguauu

SEQ ID NO: 3852549 - RNA, 13 nt, Shigella flexneri 2a str. 2457T
ugcaaaaccuggu

SEQ ID NO: 3852550 - RNA, 16 nt, Shigella flexneri 2a str. 2457T
ugcaaaaccugguugg

SEQ ID NO: 3852551 - RNA, 16 nt, Shigella flexneri 2a str. 2457T
ugcaaaauaccaauaa

SEQ ID NO: 3852552 - RNA, 17 nt, Shigella flexneri 2a str. 2457T
ugcaaaauaccaauaau

SEQ ID NO: 3852553 - RNA, 16 nt, Shigella flexneri 2a str. 2457T
ugcaaaauauggggca

SEQ ID NO: 3852554 - RNA, 22 nt, Shigella flexneri 2a str. 2457T
ugcaaaauuuucauugccgcau

SEQ ID NO: 3852555 - RNA, 13 nt, Shigella flexneri 2a str. 2457T
ugcaaacauuuca

SEQ ID NO: 3852556 - RNA, 19 nt, Shigella flexneri 2a str. 2457T
ugcaaaccacgguucagcg

SEQ ID NO: 3852557 - RNA, 17 nt, Shigella flexneri 2a str. 2457T
ugcaaacgauaaaagug

SEQ ID NO: 3852558 - RNA, 18 nt, Shigella flexneri 2a str. 2457T
ugcaaauacccaaaaaau

SEQ ID NO: 3852559 - RNA, 14 nt, Shigella flexneri 2a str. 2457T
ugcaaaucaccaca

SEQ ID NO: 3852560 - RNA, 13 nt, Shigella flexneri 2a str. 2457T
ugcaaaugccaga

SEQ ID NO: 3852561 - RNA, 14 nt, Shigella flexneri 2a str. 2457T
ugcaaaugccagau

SEQ ID NO: 3852562 - RNA, 17 nt, Shigella flexneri 2a str. 2457T
ugcaaaugccagauaag

SEQ ID NO: 3852563 - RNA, 18 nt, Shigella flexneri 2a str. 2457T
ugcaaauuauuugcguag

SEQ ID NO: 3852564 - RNA, 15 nt, Shigella flexneri 2a str. 2457T
ugcaaauucaauaua

SEQ ID NO: 3852565 - RNA, 22 nt, Shigella flexneri 2a str. 2457T
ugcaacaagaggcaauaguucu

SEQ ID NO: 3852566 - RNA, 13 nt, Shigella flexneri 2a str. 2457T
ugcaacagcacca

SEQ ID NO: 3852567 - RNA, 14 nt, Shigella flexneri 2a str. 2457T
ugcaacagcaccag

SEQ ID NO: 3852568 - RNA, 12 nt, Shigella flexneri 2a str. 2457T
ugcaaccacaca

SEQ ID NO: 3852569 - RNA, 14 nt, Shigella flexneri 2a str. 2457T
ugcaaccuuuucca

SEQ ID NO: 3852570 - RNA, 17 nt, Shigella flexneri 2a str. 2457T
ugcaaccuuuuccauug

SEQ ID NO: 3852571 - RNA, 13 nt, Shigella flexneri 2a str. 2457T
ugcaacgagugca

SEQ ID NO: 3852572 - RNA, 21 nt, Shigella flexneri 2a str. 2457T
ugcaacgcuuugcugauugcu

SEQ ID NO: 3852573 - RNA, 15 nt, Shigella flexneri 2a str. 2457T
ugcaacucgacugga

SEQ ID NO: 3852574 - RNA, 22 nt, Shigella flexneri 2a str. 2457T
ugcaacugaguucucaugguuc

SEQ ID NO: 3852575 - RNA, 12 nt, Shigella flexneri 2a str. 2457T
ugcaagaaauga

SEQ ID NO: 3852576 - RNA, 21 nt, Shigella flexneri 2a str. 2457T
ugcaagacgaugacauuaucu

SEQ ID NO: 3852577 - RNA, 15 nt, Shigella flexneri 2a str. 2457T
ugcaagauagcgcgu

SEQ ID NO: 3852578 - RNA, 17 nt, Shigella flexneri 2a str. 2457T
ugcaagauagcgcguug

SEQ ID NO: 3852579 - RNA, 20 nt, Shigella flexneri 2a str. 2457T
ugcaagaucgcgcaucagcu

SEQ ID NO: 3852580 - RNA, 13 nt, Shigella flexneri 2a str. 2457T
ugcaagauguuaa

SEQ ID NO: 3852581 - RNA, 17 nt, Shigella flexneri 2a str. 2457T
ugcaagccuguaguaca

SEQ ID NO: 3852582 - RNA, 18 nt, Shigella flexneri 2a str. 2457T
ugcaaggugaaagcaauu

SEQ ID NO: 3852583 - RNA, 22 nt, Shigella flexneri 2a str. 2457T
ugcaagguggucagacggaaca

SEQ ID NO: 3852584 - RNA, 18 nt, Shigella flexneri 2a str. 2457T
ugcaagugagucggcuuu

SEQ ID NO: 3852585 - RNA, 18 nt, Shigella flexneri 2a str. 2457T
ugcaauaauggaaccuaa

SEQ ID NO: 3852586 - RNA, 22 nt, Shigella flexneri 2a str. 2457T
ugcaauaauggaaccuaacgcu

SEQ ID NO: 3852587 - RNA, 21 nt, Shigella flexneri 2a str. 2457T
ugcaauagauugaauuagcaa

SEQ ID NO: 3852588 - RNA, 16 nt, Shigella flexneri 2a str. 2457T
ugcaauaucaaccuga

SEQ ID NO: 3852589 - RNA, 15 nt, Shigella flexneri 2a str. 2457T
ugcaauaugcuggca

SEQ ID NO: 3852590 - RNA, 23 nt, Shigella flexneri 2a str. 2457T
ugcaaucaaaaauggcuuuauuc

SEQ ID NO: 3852591 - RNA, 16 nt, Shigella flexneri 2a str. 2457T
ugcaaucacuuccuca

SEQ ID NO: 3852592 - RNA, 13 nt, Shigella flexneri 2a str. 2457T
ugcaaucagauaa

SEQ ID NO: 3852593 - RNA, 16 nt, Shigella flexneri 2a str. 2457T
ugcaaucagauaaaau

SEQ ID NO: 3852594 - RNA, 12 nt, Shigella flexneri 2a str. 2457T
ugcaaucagcgg

SEQ ID NO: 3852595 - RNA, 22 nt, Shigella flexneri 2a str. 2457T
ugcaaucagugguguagggcag

SEQ ID NO: 3852596 - RNA, 20 nt, Shigella flexneri 2a str. 2457T
ugcaaucaguucaaauucau

SEQ ID NO: 3852597 - RNA, 12 nt, Shigella flexneri 2a str. 2457T
ugcaaucaucuu

SEQ ID NO: 3852598 - RNA, 23 nt, Shigella flexneri 2a str. 2457T
ugcaaucuguuuauuugacagcc

SEQ ID NO: 3852599 - RNA, 20 nt, Shigella flexneri 2a str. 2457T
ugcaaucuuuaacggcggca

SEQ ID NO: 3852600 - RNA, 18 nt, Shigella flexneri 2a str. 2457T
ugcaaugaaaaaccgugu

SEQ ID NO: 3852601 - RNA, 15 nt, Shigella flexneri 2a str. 2457T
ugcaaugauucaggc

SEQ ID NO: 3852602 - RNA, 19 nt, Shigella flexneri 2a str. 2457T
ugcaaugccguuugcugca

SEQ ID NO: 3852603 - RNA, 23 nt, Shigella flexneri 2a str. 2457T
ugcaaugccguuugcugcaugau

SEQ ID NO: 3852604 - RNA, 16 nt, Shigella flexneri 2a str. 2457T
ugcaauggaauggcug

SEQ ID NO: 3852605 - RNA, 22 nt, Shigella flexneri 2a str. 2457T
ugcaaugucaucagcauucuca

SEQ ID NO: 3852606 - RNA, 14 nt, Shigella flexneri 2a str. 2457T
ugcacaacaaucug

SEQ ID NO: 3852607 - RNA, 23 nt, Shigella flexneri 2a str. 2457T
ugcauauccaggcuaauccaguc

SEQ ID NO: 3852608 - RNA, 16 nt, Shigella flexneri 2a str. 2457T
ugcauaucucccagua

SEQ ID NO: 3852609 - RNA, 23 nt, Shigella flexneri 2a str. 2457T
ugcaucacauccggcaauauuca

SEQ ID NO: 3852610 - RNA, 18 nt, Shigella flexneri 2a str. 2457T
ugcaucacgcgcaucugu

SEQ ID NO: 3852611 - RNA, 17 nt, Shigella flexneri 2a str. 2457T
ugcaucagaucggcagg

SEQ ID NO: 3852612 - RNA, 13 nt, Shigella flexneri 2a str. 2457T
ugcaucagucacg

SEQ ID NO: 3852613 - RNA, 15 nt, Shigella flexneri 2a str. 2457T
ugcaucauggaagca

SEQ ID NO: 3852614 - RNA, 16 nt, Shigella flexneri 2a str. 2457T
ugcauccacuuugguu

SEQ ID NO: 3852615 - RNA, 14 nt, Shigella flexneri 2a str. 2457T
ugcauccagcagcc

SEQ ID NO: 3852616 - RNA, 20 nt, Shigella flexneri 2a str. 2457T
ugcaucccgccguaccggca

SEQ ID NO: 3852617 - RNA, 23 nt, Shigella flexneri 2a str. 2457T
ugcauccggucagacaacuuccc

SEQ ID NO: 3852618 - RNA, 15 nt, Shigella flexneri 2a str. 2457T
ugcauccguucuucg

SEQ ID NO: 3852619 - RNA, 21 nt, Shigella flexneri 2a str. 2457T
ugcaucgccaaucugcugaua

SEQ ID NO: 3852620 - RNA, 21 nt, Shigella flexneri 2a str. 2457T
ugcaucgccugauucaaugag

SEQ ID NO: 3852621 - RNA, 17 nt, Shigella flexneri 2a str. 2457T
ugcaucgcgcugaacau

SEQ ID NO: 3852622 - RNA, 18 nt, Shigella flexneri 2a str. 2457T
ugcaucgcuugaaaaggu

SEQ ID NO: 3852623 - RNA, 23 nt, Shigella flexneri 2a str. 2457T
ugcaucggggaauugugcuuuca

SEQ ID NO: 3852624 - RNA, 15 nt, Shigella flexneri 2a str. 2457T
ugcaucggugcgcug

SEQ ID NO: 3852625 - RNA, 22 nt, Shigella flexneri 2a str. 2457T
ugcaucgucuguuuuaucuccc

SEQ ID NO: 3852626 - RNA, 23 nt, Shigella flexneri 2a str. 2457T
ugcaucgucuguuuuaucucccu

SEQ ID NO: 3852627 - RNA, 12 nt, Shigella flexneri 2a str. 2457T
ugcaucugaaac

SEQ ID NO: 3852628 - RNA, 23 nt, Shigella flexneri 2a str. 2457T
ugcaucugaaugcuggcguggcg

SEQ ID NO: 3852629 - RNA, 17 nt, Shigella flexneri 2a str. 2457T
ugcaucuucacacugau

SEQ ID NO: 3852630 - RNA, 14 nt, Shigella flexneri 2a str. 2457T
ugcaugauccggca

SEQ ID NO: 3852631 - RNA, 17 nt, Shigella flexneri 2a str. 2457T
ugcauggucgauucuua

SEQ ID NO: 3852632 - RNA, 19 nt, Shigella flexneri 2a str. 2457T
ugcauggucgauucuuaua

SEQ ID NO: 3852633 - RNA, 16 nt, Shigella flexneri 2a str. 2457T
ugcauguaaaucaagc

SEQ ID NO: 3852634 - RNA, 20 nt, Shigella flexneri 2a str. 2457T
ugcauguaaaucaagcgccg

SEQ ID NO: 3852635 - RNA, 21 nt, Shigella flexneri 2a str. 2457T
ugcauucaacuggauaaaauu

SEQ ID NO: 3852636 - RNA, 20 nt, Shigella flexneri 2a str. 2457T
ugcauuccaguccacaucaa

SEQ ID NO: 3852637 - RNA, 22 nt, Shigella flexneri 2a str. 2457T
ugcauuccaguccacaucaacc

SEQ ID NO: 3852638 - RNA, 15 nt, Shigella flexneri 2a str. 2457T
ugcauuuauauuaca

SEQ ID NO: 3852639 - RNA, 15 nt, Shigella flexneri 2a str. 2457T
ugcauuucauugagc

SEQ ID NO: 3852640 - RNA, 18 nt, Shigella flexneri 2a str. 2457T
ugcauuuccauaaauugc

SEQ ID NO: 3852641 - RNA, 18 nt, Shigella flexneri 2a str. 2457T
ugcauuuccgcugauuca

SEQ ID NO: 3852642 - RNA, 19 nt, Shigella flexneri 2a str. 2457T
ugcauuuccgcugauucaa

SEQ ID NO: 3852643 - RNA, 20 nt, Shigella flexneri 2a str. 2457T
ugcauuucgcuaccaccaaa

SEQ ID NO: 3852644 - RNA, 21 nt, Shigella flexneri 2a str. 2457T
ugcauuuucggcgcucucguu

SEQ ID NO: 3852645 - RNA, 19 nt, Shigella flexneri 2a str. 2457T
ugccaaacacccgucgcgg

SEQ ID NO: 3852646 - RNA, 18 nt, Shigella flexneri 2a str. 2457T
ugccaaacgcguccauca

SEQ ID NO: 3852647 - RNA, 22 nt, Shigella flexneri 2a str. 2457T
ugccaaacuggaacugaaaggc

SEQ ID NO: 3852648 - RNA, 13 nt, Shigella flexneri 2a str. 2457T
ugccaaagccagu

SEQ ID NO: 3852649 - RNA, 14 nt, Shigella flexneri 2a str. 2457T
ugccaaauauuucu

SEQ ID NO: 3852650 - RNA, 15 nt, Shigella flexneri 2a str. 2457T
ugccaaaucuaccgu

SEQ ID NO: 3852651 - RNA, 15 nt, Shigella flexneri 2a str. 2457T
ugccaacggcacgau

SEQ ID NO: 3852652 - RNA, 21 nt, Shigella flexneri 2a str. 2457T
ugccaagcuccagcaucccgu

SEQ ID NO: 3852653 - RNA, 14 nt, Shigella flexneri 2a str. 2457T
ugccaaucagcaga

SEQ ID NO: 3852654 - RNA, 15 nt, Shigella flexneri 2a str. 2457T
ugccaaucagcagaa

SEQ ID NO: 3852655 - RNA, 11 nt, Shigella flexneri 2a str. 2457T
ugccacaaacg

SEQ ID NO: 3852656 - RNA, 21 nt, Shigella flexneri 2a str. 2457T
ugccacacaggccauuucccc

SEQ ID NO: 3852657 - RNA, 18 nt, Shigella flexneri 2a str. 2457T
ugccacacgcccaacuaa

SEQ ID NO: 3852658 - RNA, 13 nt, Shigella flexneri 2a str. 2457T
ugccacaucacug

SEQ ID NO: 3852659 - RNA, 14 nt, Shigella flexneri 2a str. 2457T
ugccacaucacugu

SEQ ID NO: 3852660 - RNA, 23 nt, Shigella flexneri 2a str. 2457T
ugccacauuagauaaaaaugaag

SEQ ID NO: 3852661 - RNA, 20 nt, Shigella flexneri 2a str. 2457T
ugccacauugcguccaggcc

SEQ ID NO: 3852662 - RNA, 18 nt, Shigella flexneri 2a str. 2457T
ugccaccacaccggacca

SEQ ID NO: 3852663 - RNA, 15 nt, Shigella flexneri 2a str. 2457T
ugccaccaccagcgu

SEQ ID NO: 3852664 - RNA, 14 nt, Shigella flexneri 2a str. 2457T
ugccaccacugcaa

SEQ ID NO: 3852665 - RNA, 18 nt, Shigella flexneri 2a str. 2457T
ugccaccacugcaaugac

SEQ ID NO: 3852666 - RNA, 15 nt, Shigella flexneri 2a str. 2457T
ugccaccagcgcaau

SEQ ID NO: 3852667 - RNA, 14 nt, Shigella flexneri 2a str. 2457T
ugccaccagggaua

SEQ ID NO: 3852668 - RNA, 15 nt, Shigella flexneri 2a str. 2457T
ugccaccugugcaau

SEQ ID NO: 3852669 - RNA, 22 nt, Shigella flexneri 2a str. 2457T
ugccacgcacaggugcaaaaaa

SEQ ID NO: 3852670 - RNA, 16 nt, Shigella flexneri 2a str. 2457T
ugccacgccacagccg

SEQ ID NO: 3852671 - RNA, 22 nt, Shigella flexneri 2a str. 2457T
ugccacgguaugacccagcgcg

SEQ ID NO: 3852672 - RNA, 16 nt, Shigella flexneri 2a str. 2457T
ugccacguucugaucu

SEQ ID NO: 3852673 - RNA, 18 nt, Shigella flexneri 2a str. 2457T
ugccacugccggugucga

SEQ ID NO: 3852674 - RNA, 22 nt, Shigella flexneri 2a str. 2457T
ugccacugguuuuccugagcaa

SEQ ID NO: 3852675 - RNA, 21 nt, Shigella flexneri 2a str. 2457T
ugccagaaagcguauccauca

SEQ ID NO: 3852676 - RNA, 22 nt, Shigella flexneri 2a str. 2457T
ugccagaaagcguauccaucac

SEQ ID NO: 3852677 - RNA, 16 nt, Shigella flexneri 2a str. 2457T
ugccagaaauccaggc

SEQ ID NO: 3852678 - RNA, 22 nt, Shigella flexneri 2a str. 2457T
ugccagaaauccaggcccgcau

SEQ ID NO: 3852679 - RNA, 14 nt, Shigella flexneri 2a str. 2457T
ugccagaaccgcuu

SEQ ID NO: 3852680 - RNA, 13 nt, Shigella flexneri 2a str. 2457T
ugccagaacugau

SEQ ID NO: 3852681 - RNA, 20 nt, Shigella flexneri 2a str. 2457T
ugccagaauagccgcagcca

SEQ ID NO: 3852682 - RNA, 22 nt, Shigella flexneri 2a str. 2457T
ugccagaauagccgcagccauc

SEQ ID NO: 3852683 - RNA, 23 nt, Shigella flexneri 2a str. 2457T
ugccagaauuaacgcugacaccc

SEQ ID NO: 3852684 - RNA, 18 nt, Shigella flexneri 2a str. 2457T
ugccagacaacaugagaa

SEQ ID NO: 3852685 - RNA, 16 nt, Shigella flexneri 2a str. 2457T
ugccagaccaaacagc

SEQ ID NO: 3852686 - RNA, 19 nt, Shigella flexneri 2a str. 2457T
ugccagacccauaaucaga

SEQ ID NO: 3852687 - RNA, 22 nt, Shigella flexneri 2a str. 2457T
ugccagacuucaucggcgguga

SEQ ID NO: 3852688 - RNA, 21 nt, Shigella flexneri 2a str. 2457T
ugccagaggagccaucaccau

SEQ ID NO: 3852689 - RNA, 16 nt, Shigella flexneri 2a str. 2457T
ugccagauaauggcug

SEQ ID NO: 3852690 - RNA, 13 nt, Shigella flexneri 2a str. 2457T
ugccagcacagau

SEQ ID NO: 3852691 - RNA, 12 nt, Shigella flexneri 2a str. 2457T
ugccagcaccac

SEQ ID NO: 3852692 - RNA, 13 nt, Shigella flexneri 2a str. 2457T
ugccagccaggau

SEQ ID NO: 3852693 - RNA, 22 nt, Shigella flexneri 2a str. 2457T
ugccagccaggauaugcgccuu

SEQ ID NO: 3852694 - RNA, 21 nt, Shigella flexneri 2a str. 2457T
ugccagccauuuggugaagac

SEQ ID NO: 3852695 - RNA, 18 nt, Shigella flexneri 2a str. 2457T
ugccagcccuaaucccgu

SEQ ID NO: 3852696 - RNA, 16 nt, Shigella flexneri 2a str. 2457T
ugccagcgaagaagug

SEQ ID NO: 3852697 - RNA, 22 nt, Shigella flexneri 2a str. 2457T
ugccagcgauuuaucggcaauu

SEQ ID NO: 3852698 - RNA, 19 nt, Shigella flexneri 2a str. 2457T
ugccagcguaaauccugac

SEQ ID NO: 3852699 - RNA, 15 nt, Shigella flexneri 2a str. 2457T
ugccagcguugagga

SEQ ID NO: 3852700 - RNA, 18 nt, Shigella flexneri 2a str. 2457T
ugccagcuugcuuuccag

SEQ ID NO: 3852701 - RNA, 19 nt, Shigella flexneri 2a str. 2457T
ugccagcuugcuuuccagc

SEQ ID NO: 3852702 - RNA, 15 nt, Shigella flexneri 2a str. 2457T
ugccagcuuucaccu

SEQ ID NO: 3852703 - RNA, 18 nt, Shigella flexneri 2a str. 2457T
ugccaggaacacugguuc

SEQ ID NO: 3852704 - RNA, 12 nt, Shigella flexneri 2a str. 2457T
ugccgccaggcu

SEQ ID NO: 3852705 - RNA, 18 nt, Shigella flexneri 2a str. 2457T
ugccgccaguucuuccag

SEQ ID NO: 3852706 - RNA, 20 nt, Shigella flexneri 2a str. 2457T
ugccgcccuaaagggcggca

SEQ ID NO: 3852707 - RNA, 19 nt, Shigella flexneri 2a str. 2457T
ugccgccgaggauacagcc

SEQ ID NO: 3852708 - RNA, 17 nt, Shigella flexneri 2a str. 2457T
ugccgccggaaacauaa

SEQ ID NO: 3852709 - RNA, 16 nt, Shigella flexneri 2a str. 2457T
ugccgcguaaucaaca

SEQ ID NO: 3852710 - RNA, 21 nt, Shigella flexneri 2a str. 2457T
ugccgcguaaucaacauauuc

SEQ ID NO: 3852711 - RNA, 22 nt, Shigella flexneri 2a str. 2457T
ugccgcgucuuaucaggccuac

SEQ ID NO: 3852712 - RNA, 14 nt, Shigella flexneri 2a str. 2457T
ugccgcuacaucac

SEQ ID NO: 3852713 - RNA, 14 nt, Shigella flexneri 2a str. 2457T
ugccgcucaccuga

SEQ ID NO: 3852714 - RNA, 19 nt, Shigella flexneri 2a str. 2457T
ugccgcuucauugaccuuu

SEQ ID NO: 3852715 - RNA, 23 nt, Shigella flexneri 2a str. 2457T
ugccgcuuuaugugcuucuacca

SEQ ID NO: 3852716 - RNA, 14 nt, Shigella flexneri 2a str. 2457T
ugccggaacgugca

SEQ ID NO: 3852717 - RNA, 18 nt, Shigella flexneri 2a str. 2457T
ugccggaacuauuggucu

SEQ ID NO: 3852718 - RNA, 18 nt, Shigella flexneri 2a str. 2457T
ugccggaagacacauugc

SEQ ID NO: 3852719 - RNA, 19 nt, Shigella flexneri 2a str. 2457T
ugccggaagagagcagccg

SEQ ID NO: 3852720 - RNA, 22 nt, Shigella flexneri 2a str. 2457T
ugccggaaggcagccuuucuca

SEQ ID NO: 3852721 - RNA, 20 nt, Shigella flexneri 2a str. 2457T
ugccggacagaucugccugu

SEQ ID NO: 3852722 - RNA, 17 nt, Shigella flexneri 2a str. 2457T
ugccggacaugcugccu

SEQ ID NO: 3852723 - RNA, 15 nt, Shigella flexneri 2a str. 2457T
ugccggagucgcauu

SEQ ID NO: 3852724 - RNA, 21 nt, Shigella flexneri 2a str. 2457T
ugccggauauacccgccaaac

SEQ ID NO: 3852725 - RNA, 20 nt, Shigella flexneri 2a str. 2457T
ugccggaucacguacacaac

SEQ ID NO: 3852726 - RNA, 15 nt, Shigella flexneri 2a str. 2457T
ugccggaugacagac

SEQ ID NO: 3852727 - RNA, 15 nt, Shigella flexneri 2a str. 2457T
ugccggaugcaugau

SEQ ID NO: 3852728 - RNA, 23 nt, Shigella flexneri 2a str. 2457T
ugccggaugcgaugcugacgcau

SEQ ID NO: 3852729 - RNA, 20 nt, Shigella flexneri 2a str. 2457T
ugccggaugcgccagcaucc

SEQ ID NO: 3852730 - RNA, 23 nt, Shigella flexneri 2a str. 2457T
ugccggaugcggcguaaaugccu

SEQ ID NO: 3852731 - RNA, 22 nt, Shigella flexneri 2a str. 2457T
ugccggaugcggcgugaacgcc

SEQ ID NO: 3852732 - RNA, 13 nt, Shigella flexneri 2a str. 2457T
ugccggccugaua

SEQ ID NO: 3852733 - RNA, 21 nt, Shigella flexneri 2a str. 2457T
ugccggggagauauuccccag

SEQ ID NO: 3852734 - RNA, 14 nt, Shigella flexneri 2a str. 2457T
ugccgguaaugcug

SEQ ID NO: 3852735 - RNA, 14 nt, Shigella flexneri 2a str. 2457T
ugccggucggcagu

SEQ ID NO: 3852736 - RNA, 18 nt, Shigella flexneri 2a str. 2457T
ugccgguggaagggcuuu

SEQ ID NO: 3852737 - RNA, 17 nt, Shigella flexneri 2a str. 2457T
ugccgguggccuugccg

SEQ ID NO: 3852738 - RNA, 18 nt, Shigella flexneri 2a str. 2457T
ugccgguuccugcaucgc

SEQ ID NO: 3852739 - RNA, 23 nt, Shigella flexneri 2a str. 2457T
ugccgguucgacggcuggacaaa

SEQ ID NO: 3852740 - RNA, 14 nt, Shigella flexneri 2a str. 2457T
ugccguacagacag

SEQ ID NO: 3852741 - RNA, 14 nt, Shigella flexneri 2a str. 2457T
ugccguacaggcag

SEQ ID NO: 3852742 - RNA, 15 nt, Shigella flexneri 2a str. 2457T
ugccguacaggcagc

SEQ ID NO: 3852743 - RNA, 16 nt, Shigella flexneri 2a str. 2457T
ugccguacaggcagcu

SEQ ID NO: 3852744 - RNA, 21 nt, Shigella flexneri 2a str. 2457T
ugccgucaauuuuaagcagau

SEQ ID NO: 3852745 - RNA, 14 nt, Shigella flexneri 2a str. 2457T
ugccgucaccagca

SEQ ID NO: 3852746 - RNA, 15 nt, Shigella flexneri 2a str. 2457T
ugccgucaccagcau

SEQ ID NO: 3852747 - RNA, 13 nt, Shigella flexneri 2a str. 2457T
ugccgucagcagg

SEQ ID NO: 3852748 - RNA, 19 nt, Shigella flexneri 2a str. 2457T
ugccgucagccacuucuuc

SEQ ID NO: 3852749 - RNA, 15 nt, Shigella flexneri 2a str. 2457T
ugccgucugggcaaa

SEQ ID NO: 3852750 - RNA, 17 nt, Shigella flexneri 2a str. 2457T
ugccgucugggcaaaau

SEQ ID NO: 3852751 - RNA, 12 nt, Shigella flexneri 2a str. 2457T
ugccgugcagca

SEQ ID NO: 3852752 - RNA, 16 nt, Shigella flexneri 2a str. 2457T
ugccgugcagcacgga

SEQ ID NO: 3852753 - RNA, 19 nt, Shigella flexneri 2a str. 2457T
ugccguggcgauacacuga

SEQ ID NO: 3852754 - RNA, 13 nt, Shigella flexneri 2a str. 2457T
ugccguuaaaacu

SEQ ID NO: 3852755 - RNA, 13 nt, Shigella flexneri 2a str. 2457T
ugccguugccacg

SEQ ID NO: 3852756 - RNA, 18 nt, Shigella flexneri 2a str. 2457T
ugccguuugcugcaugau

SEQ ID NO: 3852757 - RNA, 21 nt, Shigella flexneri 2a str. 2457T
ugccuaacaauucgccagggc

SEQ ID NO: 3852758 - RNA, 22 nt, Shigella flexneri 2a str. 2457T
ugccuacacaaugccugaugcg

SEQ ID NO: 3852759 - RNA, 20 nt, Shigella flexneri 2a str. 2457T
ugccucaacccuuuuuuaaa

SEQ ID NO: 3852760 - RNA, 22 nt, Shigella flexneri 2a str. 2457T
ugccucaacccuuuuuuaaaca

SEQ ID NO: 3852761 - RNA, 13 nt, Shigella flexneri 2a str. 2457T
ugccuccagcgac

SEQ ID NO: 3852762 - RNA, 19 nt, Shigella flexneri 2a str. 2457T
ugccucgggauccaugcac

SEQ ID NO: 3852763 - RNA, 22 nt, Shigella flexneri 2a str. 2457T
ugccucggggaacgcaaaauuc

SEQ ID NO: 3852764 - RNA, 14 nt, Shigella flexneri 2a str. 2457T
ugccucguucuucc

SEQ ID NO: 3852765 - RNA, 17 nt, Shigella flexneri 2a str. 2457T
ugccucguuggucagcu

SEQ ID NO: 3852766 - RNA, 21 nt, Shigella flexneri 2a str. 2457T
ugccugacguuguacauuauc

SEQ ID NO: 3852767 - RNA, 19 nt, Shigella flexneri 2a str. 2457T
ugccugagacagacagccu

SEQ ID NO: 3852768 - RNA, 16 nt, Shigella flexneri 2a str. 2457T
ugccugauccugggcu

SEQ ID NO: 3852769 - RNA, 15 nt, Shigella flexneri 2a str. 2457T
ugccugaugcggcgu

SEQ ID NO: 3852770 - RNA, 22 nt, Shigella flexneri 2a str. 2457T
ugccugaugcggcguaaacgcc

SEQ ID NO: 3852771 - RNA, 18 nt, Shigella flexneri 2a str. 2457T
ugccugauguacaaccau

SEQ ID NO: 3852772 - RNA, 17 nt, Shigella flexneri 2a str. 2457T
ugccugcacuuuguguc

SEQ ID NO: 3852773 - RNA, 21 nt, Shigella flexneri 2a str. 2457T
ugccugcagcugcucauuaca

SEQ ID NO: 3852774 - RNA, 18 nt, Shigella flexneri 2a str. 2457T
ugccugccagucaaucau

SEQ ID NO: 3852775 - RNA, 17 nt, Shigella flexneri 2a str. 2457T
ugccugcgaagcucuuu

SEQ ID NO: 3852776 - RNA, 19 nt, Shigella flexneri 2a str. 2457T
ugccugcugugccagugcc

SEQ ID NO: 3852777 - RNA, 17 nt, Shigella flexneri 2a str. 2457T
ugccuggcuugccggaa

SEQ ID NO: 3852778 - RNA, 20 nt, Shigella flexneri 2a str. 2457T
ugccuggguuuucacagaag

SEQ ID NO: 3852779 - RNA, 22 nt, Shigella flexneri 2a str. 2457T
ugccuguacggcagugaacgcg

SEQ ID NO: 3852780 - RNA, 21 nt, Shigella flexneri 2a str. 2457T
ugccuguccucuucagcauca

SEQ ID NO: 3852781 - RNA, 14 nt, Shigella flexneri 2a str. 2457T
ugccugucgggaca

SEQ ID NO: 3852782 - RNA, 22 nt, Shigella flexneri 2a str. 2457T
ugccugugcaaccuuuuccauu

SEQ ID NO: 3852783 - RNA, 14 nt, Shigella flexneri 2a str. 2457T
ugccugugcaggcg

SEQ ID NO: 3852784 - RNA, 19 nt, Shigella flexneri 2a str. 2457T
ugccuuaaacaugagcgaa

SEQ ID NO: 3852785 - RNA, 19 nt, Shigella flexneri 2a str. 2457T
ugccuuauccggcaugaaa

SEQ ID NO: 3852786 - RNA, 18 nt, Shigella flexneri 2a str. 2457T
ugccuucacaggccgcca

SEQ ID NO: 3852787 - RNA, 14 nt, Shigella flexneri 2a str. 2457T
ugccuucauacugc

SEQ ID NO: 3852788 - RNA, 14 nt, Shigella flexneri 2a str. 2457T
ugccuuccagcgau

SEQ ID NO: 3852789 - RNA, 22 nt, Shigella flexneri 2a str. 2457T
ugccuugaguuuuucaucccuc

SEQ ID NO: 3852790 - RNA, 18 nt, Shigella flexneri 2a str. 2457T
ugccuugugggccugaaa

SEQ ID NO: 3852791 - RNA, 21 nt, Shigella flexneri 2a str. 2457T
ugccuugugggccugaaagcu

SEQ ID NO: 3852792 - RNA, 17 nt, Shigella flexneri 2a str. 2457T
ugccuuuccuccugucu

SEQ ID NO: 3852793 - RNA, 16 nt, Shigella flexneri 2a str. 2457T
ugccuuuuuuguacuc

SEQ ID NO: 3852794 - RNA, 14 nt, Shigella flexneri 2a str. 2457T
ugcgaaaaaaaagc

SEQ ID NO: 3852795 - RNA, 18 nt, Shigella flexneri 2a str. 2457T
ugcgaaaaaaucauccau

SEQ ID NO: 3852796 - RNA, 11 nt, Shigella flexneri 2a str. 2457T
ugcgaaacgau

SEQ ID NO: 3852797 - RNA, 16 nt, Shigella flexneri 2a str. 2457T
ugcgaacugugcaccc

SEQ ID NO: 3852798 - RNA, 22 nt, Shigella flexneri 2a str. 2457T
ugcgaacugugcacccgcuuca

SEQ ID NO: 3852799 - RNA, 15 nt, Shigella flexneri 2a str. 2457T
ugcgaaguuuuuccg

SEQ ID NO: 3852800 - RNA, 22 nt, Shigella flexneri 2a str. 2457T
ugcgaauaagcugcgugacgaa

SEQ ID NO: 3852801 - RNA, 12 nt, Shigella flexneri 2a str. 2457T
ugcggcaaauac

SEQ ID NO: 3852802 - RNA, 17 nt, Shigella flexneri 2a str. 2457T
ugcggcaaugcguagcu

SEQ ID NO: 3852803 - RNA, 13 nt, Shigella flexneri 2a str. 2457T
ugcggcaggcaca

SEQ ID NO: 3852804 - RNA, 22 nt, Shigella flexneri 2a str. 2457T
ugcggcaggucaucgugcguca

SEQ ID NO: 3852805 - RNA, 17 nt, Shigella flexneri 2a str. 2457T
ugcggcaucuucuccac

SEQ ID NO: 3852806 - RNA, 16 nt, Shigella flexneri 2a str. 2457T
ugcggcauucccagcc

SEQ ID NO: 3852807 - RNA, 20 nt, Shigella flexneri 2a str. 2457T
ugcggcauuuccauaccuaa

SEQ ID NO: 3852808 - RNA, 13 nt, Shigella flexneri 2a str. 2457T
ugcggccagcagc

SEQ ID NO: 3852809 - RNA, 14 nt, Shigella flexneri 2a str. 2457T
ugcggccagcagcu

SEQ ID NO: 3852810 - RNA, 22 nt, Shigella flexneri 2a str. 2457T
ugcggcgcaagcggcgacugag

SEQ ID NO: 3852811 - RNA, 18 nt, Shigella flexneri 2a str. 2457T
ugcggcgcaccagcaggc

SEQ ID NO: 3852812 - RNA, 19 nt, Shigella flexneri 2a str. 2457T
ugcggcgcaugcauuuuca

SEQ ID NO: 3852813 - RNA, 18 nt, Shigella flexneri 2a str. 2457T
ugcggcggcgcaccggcc

SEQ ID NO: 3852814 - RNA, 17 nt, Shigella flexneri 2a str. 2457T
ugcggcguaaacgccuu

SEQ ID NO: 3852815 - RNA, 20 nt, Shigella flexneri 2a str. 2457T
ugcggcguaaacgccuuauc

SEQ ID NO: 3852816 - RNA, 20 nt, Shigella flexneri 2a str. 2457T
ugcggcguaaaugccuuauc

SEQ ID NO: 3852817 - RNA, 15 nt, Shigella flexneri 2a str. 2457T
ugcggcgugggcgcu

SEQ ID NO: 3852818 - RNA, 17 nt, Shigella flexneri 2a str. 2457T
ugcggcugauggucagu

SEQ ID NO: 3852819 - RNA, 22 nt, Shigella flexneri 2a str. 2457T
ugcggcugcaucuccggcgcau

SEQ ID NO: 3852820 - RNA, 19 nt, Shigella flexneri 2a str. 2457T
ugcggcuguagagcuaccg

SEQ ID NO: 3852821 - RNA, 20 nt, Shigella flexneri 2a str. 2457T
ugcggcuuauucauuacuca

SEQ ID NO: 3852822 - RNA, 16 nt, Shigella flexneri 2a str. 2457T
ugcgggaugguugguc

SEQ ID NO: 3852823 - RNA, 20 nt, Shigella flexneri 2a str. 2457T
ugcgggaugguuggucuggc

SEQ ID NO: 3852824 - RNA, 13 nt, Shigella flexneri 2a str. 2457T
ugcgggccaaaga

SEQ ID NO: 3852825 - RNA, 15 nt, Shigella flexneri 2a str. 2457T
ugcgggcgaaaacau

SEQ ID NO: 3852826 - RNA, 19 nt, Shigella flexneri 2a str. 2457T
ugcgggcgcaagggcugga

SEQ ID NO: 3852827 - RNA, 15 nt, Shigella flexneri 2a str. 2457T
ugcggguaaccagcc

SEQ ID NO: 3852828 - RNA, 15 nt, Shigella flexneri 2a str. 2457T
ugcgggucaggccag

SEQ ID NO: 3852829 - RNA, 16 nt, Shigella flexneri 2a str. 2457T
ugcggguuagucugca

SEQ ID NO: 3852830 - RNA, 22 nt, Shigella flexneri 2a str. 2457T
ugcggguuagucugcauuuucu

SEQ ID NO: 3852831 - RNA, 17 nt, Shigella flexneri 2a str. 2457T
ugcggguuuucgcugcc

SEQ ID NO: 3852832 - RNA, 18 nt, Shigella flexneri 2a str. 2457T
ugcgguaaccuggcaguu

SEQ ID NO: 3852833 - RNA, 14 nt, Shigella flexneri 2a str. 2457T
ugcgguaagcugcg

SEQ ID NO: 3852834 - RNA, 18 nt, Shigella flexneri 2a str. 2457T
ugcgguaaucgcccggau

SEQ ID NO: 3852835 - RNA, 23 nt, Shigella flexneri 2a str. 2457T
ugcggucguaaucgcccgcuucc

SEQ ID NO: 3852836 - RNA, 14 nt, Shigella flexneri 2a str. 2457T
ugcgguuaaugguu

SEQ ID NO: 3852837 - RNA, 16 nt, Shigella flexneri 2a str. 2457T
ugcgguuucagcucac

SEQ ID NO: 3852838 - RNA, 21 nt, Shigella flexneri 2a str. 2457T
ugcguaaucuuuucauauuau

SEQ ID NO: 3852839 - RNA, 14 nt, Shigella flexneri 2a str. 2457T
ugcguacaccaaca

SEQ ID NO: 3852840 - RNA, 15 nt, Shigella flexneri 2a str. 2457T
ugcguacuucuuacc

SEQ ID NO: 3852841 - RNA, 18 nt, Shigella flexneri 2a str. 2457T
ugcguagccgauccgcgu

SEQ ID NO: 3852842 - RNA, 21 nt, Shigella flexneri 2a str. 2457T
ugcguagucugaccucuucua

SEQ ID NO: 3852843 - RNA, 22 nt, Shigella flexneri 2a str. 2457T
ugcguaucgacggcguauugca

SEQ ID NO: 3852844 - RNA, 19 nt, Shigella flexneri 2a str. 2457T
ugcgucaccacauccagcu

SEQ ID NO: 3852845 - RNA, 23 nt, Shigella flexneri 2a str. 2457T
ugcgucaguauugggaugccgaa

SEQ ID NO: 3852846 - RNA, 16 nt, Shigella flexneri 2a str. 2457T
ugcgucauccagcacu

SEQ ID NO: 3852847 - RNA, 18 nt, Shigella flexneri 2a str. 2457T
ugcguccaaauagcucaa

SEQ ID NO: 3852848 - RNA, 18 nt, Shigella flexneri 2a str. 2457T
ugcguccgguaauuuuua

SEQ ID NO: 3852849 - RNA, 17 nt, Shigella flexneri 2a str. 2457T
ugcgucgcauccggcaa

SEQ ID NO: 3852850 - RNA, 15 nt, Shigella flexneri 2a str. 2457T
ugcgucuuccgugcc

SEQ ID NO: 3852851 - RNA, 13 nt, Shigella flexneri 2a str. 2457T
ugcgugaccgcca

SEQ ID NO: 3852852 - RNA, 16 nt, Shigella flexneri 2a str. 2457T
ugcgugacuaaaaccc

SEQ ID NO: 3852853 - RNA, 16 nt, Shigella flexneri 2a str. 2457T
ugcgugagguaacaau

SEQ ID NO: 3852854 - RNA, 16 nt, Shigella flexneri 2a str. 2457T
ugcgugaguuuuuguc

SEQ ID NO: 3852855 - RNA, 19 nt, Shigella flexneri 2a str. 2457T
ugcgugcgcugcuuguucc

SEQ ID NO: 3852856 - RNA, 20 nt, Shigella flexneri 2a str. 2457T
ugcgugcggcaaauaccgga

SEQ ID NO: 3852857 - RNA, 20 nt, Shigella flexneri 2a str. 2457T
ugcguuaagacuuuuuucau

SEQ ID NO: 3852858 - RNA, 14 nt, Shigella flexneri 2a str. 2457T
ugcguuaaucgccg

SEQ ID NO: 3852859 - RNA, 13 nt, Shigella flexneri 2a str. 2457T
ugcguucagcagu

SEQ ID NO: 3852860 - RNA, 14 nt, Shigella flexneri 2a str. 2457T
ugcguucaucaguu

SEQ ID NO: 3852861 - RNA, 22 nt, Shigella flexneri 2a str. 2457T
ugcguuccccgaagacgugcgc

SEQ ID NO: 3852862 - RNA, 18 nt, Shigella flexneri 2a str. 2457T
ugcguuccggcaugauuc

SEQ ID NO: 3852863 - RNA, 19 nt, Shigella flexneri 2a str. 2457T
ugcguugauagcauuugua

SEQ ID NO: 3852864 - RNA, 20 nt, Shigella flexneri 2a str. 2457T
ugcguugcacgcagacacug

SEQ ID NO: 3852865 - RNA, 15 nt, Shigella flexneri 2a str. 2457T
ugcguugcgcuucuc

SEQ ID NO: 3852866 - RNA, 20 nt, Shigella flexneri 2a str. 2457T
ugcuaaaccagcccugguuu

SEQ ID NO: 3852867 - RNA, 13 nt, Shigella flexneri 2a str. 2457T
ugcuaacucauca

SEQ ID NO: 3852868 - RNA, 22 nt, Shigella flexneri 2a str. 2457T
ugcuaacucaucaccaucaggc

SEQ ID NO: 3852869 - RNA, 11 nt, Shigella flexneri 2a str. 2457T
ugcuaaggcug

SEQ ID NO: 3852870 - RNA, 14 nt, Shigella flexneri 2a str. 2457T
ugcuacccacuucc

SEQ ID NO: 3852871 - RNA, 23 nt, Shigella flexneri 2a str. 2457T
ugcuaccgcuucgcucacaucau

SEQ ID NO: 3852872 - RNA, 19 nt, Shigella flexneri 2a str. 2457T
ugcuacggcaauucccaga

SEQ ID NO: 3852873 - RNA, 19 nt, Shigella flexneri 2a str. 2457T
ugcuaguuaucuccuugcu

SEQ ID NO: 3852874 - RNA, 22 nt, Shigella flexneri 2a str. 2457T
ugcuaugcuuaagaaauuauuc

SEQ ID NO: 3852875 - RNA, 15 nt, Shigella flexneri 2a str. 2457T
ugcuauggggaaaaa

SEQ ID NO: 3852876 - RNA, 16 nt, Shigella flexneri 2a str. 2457T
ugcuauucaccagcaa

SEQ ID NO: 3852877 - RNA, 17 nt, Shigella flexneri 2a str. 2457T
ugcuauuuuagaaaaac

SEQ ID NO: 3852878 - RNA, 21 nt, Shigella flexneri 2a str. 2457T
ugcuauuuuagaaaaacuuaa

SEQ ID NO: 3852879 - RNA, 11 nt, Shigella flexneri 2a str. 2457T
ugcucaaagcc

SEQ ID NO: 3852880 - RNA, 13 nt, Shigella flexneri 2a str. 2457T
ugcucaaccguag

SEQ ID NO: 3852881 - RNA, 21 nt, Shigella flexneri 2a str. 2457T
ugcucaaggguuucgcgguug

SEQ ID NO: 3852882 - RNA, 13 nt, Shigella flexneri 2a str. 2457T
ugcucaaugaguu

SEQ ID NO: 3852883 - RNA, 20 nt, Shigella flexneri 2a str. 2457T
ugcucaauugacaguuuauu

SEQ ID NO: 3852884 - RNA, 22 nt, Shigella flexneri 2a str. 2457T
ugcucacagaguauuuccagcu

SEQ ID NO: 3852885 - RNA, 22 nt, Shigella flexneri 2a str. 2457T
ugcucacucccggggcgcggug

SEQ ID NO: 3852886 - RNA, 17 nt, Shigella flexneri 2a str. 2457T
ugcucagaugccugaug

SEQ ID NO: 3852887 - RNA, 19 nt, Shigella flexneri 2a str. 2457T
ugcucagcccguaacucac

SEQ ID NO: 3852888 - RNA, 20 nt, Shigella flexneri 2a str. 2457T
ugcucaggaguaaacuuucc

SEQ ID NO: 3852889 - RNA, 20 nt, Shigella flexneri 2a str. 2457T
ugcucaggcgaggcggacug

SEQ ID NO: 3852890 - RNA, 16 nt, Shigella flexneri 2a str. 2457T
ugcucauaaaaugauu

SEQ ID NO: 3852891 - RNA, 14 nt, Shigella flexneri 2a str. 2457T
ugcucauaaacgcg

SEQ ID NO: 3852892 - RNA, 23 nt, Shigella flexneri 2a str. 2457T
ugcucauagaccauugcaucauc

SEQ ID NO: 3852893 - RNA, 16 nt, Shigella flexneri 2a str. 2457T
ugcucaucgauaucga

SEQ ID NO: 3852894 - RNA, 14 nt, Shigella flexneri 2a str. 2457T
ugcuccacgcugca

SEQ ID NO: 3852895 - RNA, 14 nt, Shigella flexneri 2a str. 2457T
ugcuccacuccugc

SEQ ID NO: 3852896 - RNA, 17 nt, Shigella flexneri 2a str. 2457T
ugcuccagcagauggca

SEQ ID NO: 3852897 - RNA, 20 nt, Shigella flexneri 2a str. 2457T
ugcuccagucguucaaccac

SEQ ID NO: 3852898 - RNA, 12 nt, Shigella flexneri 2a str. 2457T
ugcuuuaaaaaa

SEQ ID NO: 3852899 - RNA, 15 nt, Shigella flexneri 2a str. 2457T
ugcuuuaaucgccuu

SEQ ID NO: 3852900 - RNA, 19 nt, Shigella flexneri 2a str. 2457T
ugcuuuauacgaugccugc

SEQ ID NO: 3852901 - RNA, 13 nt, Shigella flexneri 2a str. 2457T
ugcuuuaucgaac

SEQ ID NO: 3852902 - RNA, 17 nt, Shigella flexneri 2a str. 2457T
ugcuuucagcacuuauc

SEQ ID NO: 3852903 - RNA, 11 nt, Shigella flexneri 2a str. 2457T
ugcuuucaguu

SEQ ID NO: 3852904 - RNA, 19 nt, Shigella flexneri 2a str. 2457T
ugcuuuccaacuguaccag

SEQ ID NO: 3852905 - RNA, 15 nt, Shigella flexneri 2a str. 2457T
ugcuuuggcugccgc

SEQ ID NO: 3852906 - RNA, 19 nt, Shigella flexneri 2a str. 2457T
ugcuuugguggucaccaug

SEQ ID NO: 3852907 - RNA, 20 nt, Shigella flexneri 2a str. 2457T
ugcuuuuaccauacuggauu

SEQ ID NO: 3852908 - RNA, 17 nt, Shigella flexneri 2a str. 2457T
ugcuuuucauacaaucg

SEQ ID NO: 3852909 - RNA, 15 nt, Shigella flexneri 2a str. 2457T
ugcuuuucccuccac

SEQ ID NO: 3852910 - RNA, 18 nt, Shigella flexneri 2a str. 2457T
ugcuuuucccuccacucc

SEQ ID NO: 3852911 - RNA, 14 nt, Shigella flexneri 2a str. 2457T
ugcuuuuuccugcg

SEQ ID NO: 3852912 - RNA, 14 nt, Shigella flexneri 2a str. 2457T
ugcuuuuucgcgau

SEQ ID NO: 3852913 - RNA, 12 nt, Shigella flexneri 2a str. 2457T
uggaaaacaaca

SEQ ID NO: 3852914 - RNA, 13 nt, Shigella flexneri 2a str. 2457T
uggaaaagaaaac

SEQ ID NO: 3852915 - RNA, 14 nt, Shigella flexneri 2a str. 2457T
uggaaacagcacca

SEQ ID NO: 3852916 - RNA, 17 nt, Shigella flexneri 2a str. 2457T
uggaaacgcgaucgcca

SEQ ID NO: 3852917 - RNA, 12 nt, Shigella flexneri 2a str. 2457T
uggaaaucaaaa

SEQ ID NO: 3852918 - RNA, 21 nt, Shigella flexneri 2a str. 2457T
uggaaauguccgcgaacagca

SEQ ID NO: 3852919 - RNA, 17 nt, Shigella flexneri 2a str. 2457T
uggaacggcagauccaa

SEQ ID NO: 3852920 - RNA, 18 nt, Shigella flexneri 2a str. 2457T
uggaagaaaccagcgugu

SEQ ID NO: 3852921 - RNA, 15 nt, Shigella flexneri 2a str. 2457T
uggaagaaacgcuua

SEQ ID NO: 3852922 - RNA, 21 nt, Shigella flexneri 2a str. 2457T
uggaagagcgacaaucccugc

SEQ ID NO: 3852923 - RNA, 12 nt, Shigella flexneri 2a str. 2457T
uggaagcaaaau

SEQ ID NO: 3852924 - RNA, 20 nt, Shigella flexneri 2a str. 2457T
uggaagcauaauaagcuuuu

SEQ ID NO: 3852925 - RNA, 15 nt, Shigella flexneri 2a str. 2457T
uggaagccagucaca

SEQ ID NO: 3852926 - RNA, 16 nt, Shigella flexneri 2a str. 2457T
uggaagccagucacau

SEQ ID NO: 3852927 - RNA, 19 nt, Shigella flexneri 2a str. 2457T
uggaagguaaggauaaaaa

SEQ ID NO: 3852928 - RNA, 15 nt, Shigella flexneri 2a str. 2457T
uggaaguuacucaaa

SEQ ID NO: 3852929 - RNA, 13 nt, Shigella flexneri 2a str. 2457T
uggaauaagccaa

SEQ ID NO: 3852930 - RNA, 21 nt, Shigella flexneri 2a str. 2457T
uggaauaagccaaauccagcg

SEQ ID NO: 3852931 - RNA, 22 nt, Shigella flexneri 2a str. 2457T
uggaauauccgucacuucagga

SEQ ID NO: 3852932 - RNA, 16 nt, Shigella flexneri 2a str. 2457T
uggaaucacucaucau

SEQ ID NO: 3852933 - RNA, 19 nt, Shigella flexneri 2a str. 2457T
uggaaucacucaucaugca

SEQ ID NO: 3852934 - RNA, 16 nt, Shigella flexneri 2a str. 2457T
uggaaucgcucucaga

SEQ ID NO: 3852935 - RNA, 14 nt, Shigella flexneri 2a str. 2457T
uggaaugagcaucu

SEQ ID NO: 3852936 - RNA, 15 nt, Shigella flexneri 2a str. 2457T
uggaauggaaacagc

SEQ ID NO: 3852937 - RNA, 12 nt, Shigella flexneri 2a str. 2457T
uggaauggucaa

SEQ ID NO: 3852938 - RNA, 20 nt, Shigella flexneri 2a str. 2457T
uggaauggucaaugguggca

SEQ ID NO: 3852939 - RNA, 19 nt, Shigella flexneri 2a str. 2457T
uggaauuacugauugcuca

SEQ ID NO: 3852940 - RNA, 12 nt, Shigella flexneri 2a str. 2457T
uggacaccagcu

SEQ ID NO: 3852941 - RNA, 16 nt, Shigella flexneri 2a str. 2457T
uggacagacuggcuau

SEQ ID NO: 3852942 - RNA, 17 nt, Shigella flexneri 2a str. 2457T
uggacauagcucugcca

SEQ ID NO: 3852943 - RNA, 13 nt, Shigella flexneri 2a str. 2457T
uggacauucuccg

SEQ ID NO: 3852944 - RNA, 20 nt, Shigella flexneri 2a str. 2457T
uggaccacggcgugccgucg

SEQ ID NO: 3852945 - RNA, 16 nt, Shigella flexneri 2a str. 2457T
uggacgauaagcaccg

SEQ ID NO: 3852946 - RNA, 19 nt, Shigella flexneri 2a str. 2457T
uggacgcaacuuccccucu

SEQ ID NO: 3852947 - RNA, 21 nt, Shigella flexneri 2a str. 2457T
uggacgccguauucacuuuca

SEQ ID NO: 3852948 - RNA, 19 nt, Shigella flexneri 2a str. 2457T
uggacgccguuuaaaggga

SEQ ID NO: 3852949 - RNA, 16 nt, Shigella flexneri 2a str. 2457T
uggacgcgccaacaaa

SEQ ID NO: 3852950 - RNA, 18 nt, Shigella flexneri 2a str. 2457T
uggacguuugauuuuuaa

SEQ ID NO: 3852951 - RNA, 16 nt, Shigella flexneri 2a str. 2457T
uggagaacgccugugu

SEQ ID NO: 3852952 - RNA, 17 nt, Shigella flexneri 2a str. 2457T
uggagagugacaguuca

SEQ ID NO: 3852953 - RNA, 17 nt, Shigella flexneri 2a str. 2457T
uggagaguugcaccagc

SEQ ID NO: 3852954 - RNA, 18 nt, Shigella flexneri 2a str. 2457T
uggagaguugcaccagca

SEQ ID NO: 3852955 - RNA, 22 nt, Shigella flexneri 2a str. 2457T
uggagaguugcaccagcaacaa

SEQ ID NO: 3852956 - RNA, 16 nt, Shigella flexneri 2a str. 2457T
uggagauaaacuccac

SEQ ID NO: 3852957 - RNA, 16 nt, Shigella flexneri 2a str. 2457T
uggagauaucgccagg

SEQ ID NO: 3852958 - RNA, 19 nt, Shigella flexneri 2a str. 2457T
uggagcaacacgccagcgu

SEQ ID NO: 3852959 - RNA, 20 nt, Shigella flexneri 2a str. 2457T
uggagcacauugccugaugc

SEQ ID NO: 3852960 - RNA, 15 nt, Shigella flexneri 2a str. 2457T
uggagcagcaaagac

SEQ ID NO: 3852961 - RNA, 14 nt, Shigella flexneri 2a str. 2457T
uggagcaggaacuu

SEQ ID NO: 3852962 - RNA, 19 nt, Shigella flexneri 2a str. 2457T
uggagccgaaagaucgcgg

SEQ ID NO: 3852963 - RNA, 21 nt, Shigella flexneri 2a str. 2457T
uggagcuggacggucugcuca

SEQ ID NO: 3852964 - RNA, 15 nt, Shigella flexneri 2a str. 2457T
uggagugagaaugca

SEQ ID NO: 3852965 - RNA, 14 nt, Shigella flexneri 2a str. 2457T
uggaguggcccagg

SEQ ID NO: 3852966 - RNA, 14 nt, Shigella flexneri 2a str. 2457T
uggauaaaauuauc

SEQ ID NO: 3852967 - RNA, 13 nt, Shigella flexneri 2a str. 2457T
uggauaaucauac

SEQ ID NO: 3852968 - RNA, 13 nt, Shigella flexneri 2a str. 2457T
uggauaggcaccg

SEQ ID NO: 3852969 - RNA, 14 nt, Shigella flexneri 2a str. 2457T
uggauauuuuaauc

SEQ ID NO: 3852970 - RNA, 14 nt, Shigella flexneri 2a str. 2457T
uggaucaaaucucg

SEQ ID NO: 3852971 - RNA, 16 nt, Shigella flexneri 2a str. 2457T
uggaucaacaggcacu

SEQ ID NO: 3852972 - RNA, 20 nt, Shigella flexneri 2a str. 2457T
uggaucaacgaccagcgcgu

SEQ ID NO: 3852973 - RNA, 13 nt, Shigella flexneri 2a str. 2457T
uggaucaagcccc

SEQ ID NO: 3852974 - RNA, 21 nt, Shigella flexneri 2a str. 2457T
uggaucaagccccagcaggau

SEQ ID NO: 3852975 - RNA, 21 nt, Shigella flexneri 2a str. 2457T
uggaucaaggauugcagcacu

SEQ ID NO: 3852976 - RNA, 23 nt, Shigella flexneri 2a str. 2457T
uggaucaaggauugcagcacuga

SEQ ID NO: 3852977 - RNA, 20 nt, Shigella flexneri 2a str. 2457T
uggaucaguguacuuaucuu

SEQ ID NO: 3852978 - RNA, 15 nt, Shigella flexneri 2a str. 2457T
uggaucccucuuucu

SEQ ID NO: 3852979 - RNA, 20 nt, Shigella flexneri 2a str. 2457T
uggaucuggaguuccuggau

SEQ ID NO: 3852980 - RNA, 22 nt, Shigella flexneri 2a str. 2457T
uggaugcccggauuuggcaaau

SEQ ID NO: 3852981 - RNA, 20 nt, Shigella flexneri 2a str. 2457T
uggaugcgauguucccccag

SEQ ID NO: 3852982 - RNA, 23 nt, Shigella flexneri 2a str. 2457T
uggaugcgauguucccccagcca

SEQ ID NO: 3852983 - RNA, 21 nt, Shigella flexneri 2a str. 2457T
uggaugcggcaugaacaccuu

SEQ ID NO: 3852984 - RNA, 16 nt, Shigella flexneri 2a str. 2457T
uggaugucuggcagag

SEQ ID NO: 3852985 - RNA, 22 nt, Shigella flexneri 2a str. 2457T
uggauuagcgaccgaacagauc

SEQ ID NO: 3852986 - RNA, 14 nt, Shigella flexneri 2a str. 2457T
uggauuaucuucac

SEQ ID NO: 3852987 - RNA, 14 nt, Shigella flexneri 2a str. 2457T
uggauucagcaccg

SEQ ID NO: 3852988 - RNA, 21 nt, Shigella flexneri 2a str. 2457T
uggauuuaccguuaagcugga

SEQ ID NO: 3852989 - RNA, 19 nt, Shigella flexneri 2a str. 2457T
uggauuuucaugaagcaag

SEQ ID NO: 3852990 - RNA, 16 nt, Shigella flexneri 2a str. 2457T
uggcaaaaaaauucag

SEQ ID NO: 3852991 - RNA, 17 nt, Shigella flexneri 2a str. 2457T
uggcaaaacggcucuua

SEQ ID NO: 3852992 - RNA, 14 nt, Shigella flexneri 2a str. 2457T
uggcaaacuacaaa

SEQ ID NO: 3852993 - RNA, 19 nt, Shigella flexneri 2a str. 2457T
uggcaaaugcaucagugac

SEQ ID NO: 3852994 - RNA, 13 nt, Shigella flexneri 2a str. 2457T
uggcaacacagau

SEQ ID NO: 3852995 - RNA, 16 nt, Shigella flexneri 2a str. 2457T
uggcaaccagcggcug

SEQ ID NO: 3852996 - RNA, 12 nt, Shigella flexneri 2a str. 2457T
uggcgcugcuca

SEQ ID NO: 3852997 - RNA, 23 nt, Shigella flexneri 2a str. 2457T
uggcgcuucacuggcgacaugca

SEQ ID NO: 3852998 - RNA, 14 nt, Shigella flexneri 2a str. 2457T
uggcggaaacgggu

SEQ ID NO: 3852999 - RNA, 16 nt, Shigella flexneri 2a str. 2457T
uggcggaauaccgaca

SEQ ID NO: 3853000 - RNA, 19 nt, Shigella flexneri 2a str. 2457T
uggcggaauaccgacauca

SEQ ID NO: 3853001 - RNA, 14 nt, Shigella flexneri 2a str. 2457T
uggcggacggguga

SEQ ID NO: 3853002 - RNA, 16 nt, Shigella flexneri 2a str. 2457T
uggcggagcucccagg

SEQ ID NO: 3853003 - RNA, 18 nt, Shigella flexneri 2a str. 2457T
uggcggcguugagaaaac

SEQ ID NO: 3853004 - RNA, 17 nt, Shigella flexneri 2a str. 2457T
uggcgggaucaccugca

SEQ ID NO: 3853005 - RNA, 15 nt, Shigella flexneri 2a str. 2457T
uggcgggauguguaa

SEQ ID NO: 3853006 - RNA, 23 nt, Shigella flexneri 2a str. 2457T
uggcgggcguuaucacguugcug

SEQ ID NO: 3853007 - RNA, 21 nt, Shigella flexneri 2a str. 2457T
uggcggggagggaauccagca

SEQ ID NO: 3853008 - RNA, 16 nt, Shigella flexneri 2a str. 2457T
uggcgguaacauccag

SEQ ID NO: 3853009 - RNA, 20 nt, Shigella flexneri 2a str. 2457T
uggcguccggaaauccucaa

SEQ ID NO: 3853010 - RNA, 17 nt, Shigella flexneri 2a str. 2457T
uggcguggcgcuccacu

SEQ ID NO: 3853011 - RNA, 15 nt, Shigella flexneri 2a str. 2457T
uggcguucagcgacg

SEQ ID NO: 3853012 - RNA, 14 nt, Shigella flexneri 2a str. 2457T
uggcguugcaccga

SEQ ID NO: 3853013 - RNA, 22 nt, Shigella flexneri 2a str. 2457T
uggcguugggugcuugaggcug

SEQ ID NO: 3853014 - RNA, 21 nt, Shigella flexneri 2a str. 2457T
uggcuauaaaugaacugggca

SEQ ID NO: 3853015 - RNA, 18 nt, Shigella flexneri 2a str. 2457T
uggcuauaaucacucaaa

SEQ ID NO: 3853016 - RNA, 15 nt, Shigella flexneri 2a str. 2457T
uggcuaugggauauu

SEQ ID NO: 3853017 - RNA, 15 nt, Shigella flexneri 2a str. 2457T
uggcuauguaggcuu

SEQ ID NO: 3853018 - RNA, 23 nt, Shigella flexneri 2a str. 2457T
uggcuauuuaccaauauaauucc

SEQ ID NO: 3853019 - RNA, 18 nt, Shigella flexneri 2a str. 2457T
uggcucaaucgccaccac

SEQ ID NO: 3853020 - RNA, 19 nt, Shigella flexneri 2a str. 2457T
uggcucaaucgccaccacc

SEQ ID NO: 3853021 - RNA, 18 nt, Shigella flexneri 2a str. 2457T
uggcucagauugaacgcu

SEQ ID NO: 3853022 - RNA, 13 nt, Shigella flexneri 2a str. 2457T
uggcucaucgccu

SEQ ID NO: 3853023 - RNA, 20 nt, Shigella flexneri 2a str. 2457T
uggcuccgggugugacaaca

SEQ ID NO: 3853024 - RNA, 15 nt, Shigella flexneri 2a str. 2457T
uggcucgccauccag

SEQ ID NO: 3853025 - RNA, 23 nt, Shigella flexneri 2a str. 2457T
uggcucgguaaaaucaacgccgc

SEQ ID NO: 3853026 - RNA, 22 nt, Shigella flexneri 2a str. 2457T
uggcugacacuauucgccagca

SEQ ID NO: 3853027 - RNA, 20 nt, Shigella flexneri 2a str. 2457T
uggcugacauaaacaccagc

SEQ ID NO: 3853028 - RNA, 14 nt, Shigella flexneri 2a str. 2457T
uggcugacugucgc

SEQ ID NO: 3853029 - RNA, 21 nt, Shigella flexneri 2a str. 2457T
uggcugacugucgcagccagc

SEQ ID NO: 3853030 - RNA, 23 nt, Shigella flexneri 2a str. 2457T
uggcugagcaaacaguucugcag

SEQ ID NO: 3853031 - RNA, 15 nt, Shigella flexneri 2a str. 2457T
uggcugagcacuauc

SEQ ID NO: 3853032 - RNA, 15 nt, Shigella flexneri 2a str. 2457T
uggcugauauuaagc

SEQ ID NO: 3853033 - RNA, 21 nt, Shigella flexneri 2a str. 2457T
uggcugauuaacguuuccauu

SEQ ID NO: 3853034 - RNA, 16 nt, Shigella flexneri 2a str. 2457T
uggcugcauggcaauu

SEQ ID NO: 3853035 - RNA, 21 nt, Shigella flexneri 2a str. 2457T
uggcugccgagcaaaucgcgg

SEQ ID NO: 3853036 - RNA, 20 nt, Shigella flexneri 2a str. 2457T
uggcugcgcgaaaacccucg

SEQ ID NO: 3853037 - RNA, 19 nt, Shigella flexneri 2a str. 2457T
uggcuggccccgucagcaa

SEQ ID NO: 3853038 - RNA, 19 nt, Shigella flexneri 2a str. 2457T
uggcuguuuucagcaccag

SEQ ID NO: 3853039 - RNA, 19 nt, Shigella flexneri 2a str. 2457T
uggcuuaaacgcagagaca

SEQ ID NO: 3853040 - RNA, 14 nt, Shigella flexneri 2a str. 2457T
uggcuuaaucugcc

SEQ ID NO: 3853041 - RNA, 18 nt, Shigella flexneri 2a str. 2457T
uggcuuaucuuccuguuc

SEQ ID NO: 3853042 - RNA, 13 nt, Shigella flexneri 2a str. 2457T
uggcuucauccac

SEQ ID NO: 3853043 - RNA, 16 nt, Shigella flexneri 2a str. 2457T
uggcuuccagcguucg

SEQ ID NO: 3853044 - RNA, 18 nt, Shigella flexneri 2a str. 2457T
uggcuucgguuuuuauuu

SEQ ID NO: 3853045 - RNA, 14 nt, Shigella flexneri 2a str. 2457T
uggcuugccagcca

SEQ ID NO: 3853046 - RNA, 17 nt, Shigella flexneri 2a str. 2457T
uggcuugcgucauccag

SEQ ID NO: 3853047 - RNA, 12 nt, Shigella flexneri 2a str. 2457T
uggcuuuauucg

SEQ ID NO: 3853048 - RNA, 17 nt, Shigella flexneri 2a str. 2457T
uggcuuuccaccaucac

SEQ ID NO: 3853049 - RNA, 14 nt, Shigella flexneri 2a str. 2457T
uggcuuuccgggag

SEQ ID NO: 3853050 - RNA, 15 nt, Shigella flexneri 2a str. 2457T
uggcuuugcccuggc

SEQ ID NO: 3853051 - RNA, 17 nt, Shigella flexneri 2a str. 2457T
uggcuuugcccuggcgc

SEQ ID NO: 3853052 - RNA, 14 nt, Shigella flexneri 2a str. 2457T
uggcuuuugccgcc

SEQ ID NO: 3853053 - RNA, 21 nt, Shigella flexneri 2a str. 2457T
ugggaacaguacauuguuuuc

SEQ ID NO: 3853054 - RNA, 23 nt, Shigella flexneri 2a str. 2457T
ugggagcagccagccagacgcug

SEQ ID NO: 3853055 - RNA, 23 nt, Shigella flexneri 2a str. 2457T
ugggagcgagaaguauucuuuua

SEQ ID NO: 3853056 - RNA, 20 nt, Shigella flexneri 2a str. 2457T
ugggagcgauucggcuacua

SEQ ID NO: 3853057 - RNA, 21 nt, Shigella flexneri 2a str. 2457T
ugggaugguuuugcuuuauua

SEQ ID NO: 3853058 - RNA, 23 nt, Shigella flexneri 2a str. 2457T
ugggauucaccaaucggcagaac

SEQ ID NO: 3853059 - RNA, 15 nt, Shigella flexneri 2a str. 2457T
ugggcaaucucacuc

SEQ ID NO: 3853060 - RNA, 20 nt, Shigella flexneri 2a str. 2457T
ugggcaggccuggguaaaaa

SEQ ID NO: 3853061 - RNA, 18 nt, Shigella flexneri 2a str. 2457T
ugggcauugaaggcagca

SEQ ID NO: 3853062 - RNA, 15 nt, Shigella flexneri 2a str. 2457T
ugggccagaaaaaac

SEQ ID NO: 3853063 - RNA, 18 nt, Shigella flexneri 2a str. 2457T
ugggccgccauccggcaa

SEQ ID NO: 3853064 - RNA, 20 nt, Shigella flexneri 2a str. 2457T
ugggcgaagagaaagaacga

SEQ ID NO: 3853065 - RNA, 13 nt, Shigella flexneri 2a str. 2457T
ugggcgaggucca

SEQ ID NO: 3853066 - RNA, 15 nt, Shigella flexneri 2a str. 2457T
ugggcgauuuccuuc

SEQ ID NO: 3853067 - RNA, 14 nt, Shigella flexneri 2a str. 2457T
ugggcgcugcugua

SEQ ID NO: 3853068 - RNA, 11 nt, Shigella flexneri 2a str. 2457T
ugggcgcuggc

SEQ ID NO: 3853069 - RNA, 22 nt, Shigella flexneri 2a str. 2457T
ugggcggcgugauuggcaucau

SEQ ID NO: 3853070 - RNA, 14 nt, Shigella flexneri 2a str. 2457T
ugggcguagcuggg

SEQ ID NO: 3853071 - RNA, 12 nt, Shigella flexneri 2a str. 2457T
ugggcucaucaa

SEQ ID NO: 3853072 - RNA, 15 nt, Shigella flexneri 2a str. 2457T
ugggcugccccagcc

SEQ ID NO: 3853073 - RNA, 15 nt, Shigella flexneri 2a str. 2457T
ugggcuucuuuauga

SEQ ID NO: 3853074 - RNA, 16 nt, Shigella flexneri 2a str. 2457T
uggggaaaaugggcau

SEQ ID NO: 3853075 - RNA, 18 nt, Shigella flexneri 2a str. 2457T
uggggauagcgcugcugc

SEQ ID NO: 3853076 - RNA, 19 nt, Shigella flexneri 2a str. 2457T
uggggauagcgcugcugca

SEQ ID NO: 3853077 - RNA, 19 nt, Shigella flexneri 2a str. 2457T
uggggcagaugggcuggcu

SEQ ID NO: 3853078 - RNA, 19 nt, Shigella flexneri 2a str. 2457T
uggggcaggggcuucuucc

SEQ ID NO: 3853079 - RNA, 20 nt, Shigella flexneri 2a str. 2457T
uggggcauauuaucagcaaa

SEQ ID NO: 3853080 - RNA, 17 nt, Shigella flexneri 2a str. 2457T
uggggcguguuuuguca

SEQ ID NO: 3853081 - RNA, 14 nt, Shigella flexneri 2a str. 2457T
uggggcuaucucac

SEQ ID NO: 3853082 - RNA, 20 nt, Shigella flexneri 2a str. 2457T
ugggggcugaaaauucgcgg

SEQ ID NO: 3853083 - RNA, 23 nt, Shigella flexneri 2a str. 2457T
uggggguccugagcacuuuucug

SEQ ID NO: 3853084 - RNA, 19 nt, Shigella flexneri 2a str. 2457T
ugggguauuuccagggccu

SEQ ID NO: 3853085 - RNA, 15 nt, Shigella flexneri 2a str. 2457T
uggguaaugcuguga

SEQ ID NO: 3853086 - RNA, 22 nt, Shigella flexneri 2a str. 2457T
uggguaccgagaaaaucauccg

SEQ ID NO: 3853087 - RNA, 18 nt, Shigella flexneri 2a str. 2457T
ugggugccgcgcagcgug

SEQ ID NO: 3853088 - RNA, 17 nt, Shigella flexneri 2a str. 2457T
uggguggugauuuucgc

SEQ ID NO: 3853089 - RNA, 17 nt, Shigella flexneri 2a str. 2457T
ugggugucgccuuccac

SEQ ID NO: 3853090 - RNA, 18 nt, Shigella flexneri 2a str. 2457T
uggguucgauuucauuca

SEQ ID NO: 3853091 - RNA, 15 nt, Shigella flexneri 2a str. 2457T
uggguuucauccugc

SEQ ID NO: 3853092 - RNA, 12 nt, Shigella flexneri 2a str. 2457T
uggguuuccgga

SEQ ID NO: 3853093 - RNA, 22 nt, Shigella flexneri 2a str. 2457T
uguccauagcgauguauuucau

SEQ ID NO: 3853094 - RNA, 14 nt, Shigella flexneri 2a str. 2457T
uguccauccauacg

SEQ ID NO: 3853095 - RNA, 20 nt, Shigella flexneri 2a str. 2457T
uguccauggugucugaugag

SEQ ID NO: 3853096 - RNA, 23 nt, Shigella flexneri 2a str. 2457T
ugucccacuggucgcccugggua

SEQ ID NO: 3853097 - RNA, 18 nt, Shigella flexneri 2a str. 2457T
uguccgccaauuucauca

SEQ ID NO: 3853098 - RNA, 19 nt, Shigella flexneri 2a str. 2457T
uguccgccaauuucaucac

SEQ ID NO: 3853099 - RNA, 17 nt, Shigella flexneri 2a str. 2457T
uguccggcgcacuggug

SEQ ID NO: 3853100 - RNA, 18 nt, Shigella flexneri 2a str. 2457T
uguccggcgcacuggugc

SEQ ID NO: 3853101 - RNA, 19 nt, Shigella flexneri 2a str. 2457T
ugucgacuaaccugagagu

SEQ ID NO: 3853102 - RNA, 19 nt, Shigella flexneri 2a str. 2457T
ugucgagauuaaacaaggu

SEQ ID NO: 3853103 - RNA, 21 nt, Shigella flexneri 2a str. 2457T
ugucgaggccaauuuggcugc

SEQ ID NO: 3853104 - RNA, 23 nt, Shigella flexneri 2a str. 2457T
ugucgauaaacaguuucgccagg

SEQ ID NO: 3853105 - RNA, 21 nt, Shigella flexneri 2a str. 2457T
ugucgaucaucaggcccgcau

SEQ ID NO: 3853106 - RNA, 22 nt, Shigella flexneri 2a str. 2457T
ugucgcauccgacaaggcauca

SEQ ID NO: 3853107 - RNA, 17 nt, Shigella flexneri 2a str. 2457T
ugucgcauccggcaauu

SEQ ID NO: 3853108 - RNA, 22 nt, Shigella flexneri 2a str. 2457T
ugucgcauccggcaauuggugc

SEQ ID NO: 3853109 - RNA, 20 nt, Shigella flexneri 2a str. 2457T
ugucgcucaaugugcugagu

SEQ ID NO: 3853110 - RNA, 16 nt, Shigella flexneri 2a str. 2457T
ugucgcuguuucugga

SEQ ID NO: 3853111 - RNA, 20 nt, Shigella flexneri 2a str. 2457T
ugucggcacugaccaccacc

SEQ ID NO: 3853112 - RNA, 17 nt, Shigella flexneri 2a str. 2457T
ugucggcccgcauuauu

SEQ ID NO: 3853113 - RNA, 17 nt, Shigella flexneri 2a str. 2457T
ugucgggcaggcuucaa

SEQ ID NO: 3853114 - RNA, 12 nt, Shigella flexneri 2a str. 2457T
ugucgggcauca

SEQ ID NO: 3853115 - RNA, 19 nt, Shigella flexneri 2a str. 2457T
ugucgggcguuucgccagg

SEQ ID NO: 3853116 - RNA, 19 nt, Shigella flexneri 2a str. 2457T
ugucggugguguuaucacc

SEQ ID NO: 3853117 - RNA, 15 nt, Shigella flexneri 2a str. 2457T
ugucgguuuguacuc

SEQ ID NO: 3853118 - RNA, 16 nt, Shigella flexneri 2a str. 2457T
ugucgugcgaggaaaa

SEQ ID NO: 3853119 - RNA, 17 nt, Shigella flexneri 2a str. 2457T
ugucguuaaugcgccaa

SEQ ID NO: 3853120 - RNA, 19 nt, Shigella flexneri 2a str. 2457T
ugucguuuccauggacgau

SEQ ID NO: 3853121 - RNA, 19 nt, Shigella flexneri 2a str. 2457T
ugucuaacaugagguccag

SEQ ID NO: 3853122 - RNA, 15 nt, Shigella flexneri 2a str. 2457T
ugucuaccagcaccu

SEQ ID NO: 3853123 - RNA, 16 nt, Shigella flexneri 2a str. 2457T
ugucuauuccgcguga

SEQ ID NO: 3853124 - RNA, 15 nt, Shigella flexneri 2a str. 2457T
ugucucagauucaga

SEQ ID NO: 3853125 - RNA, 15 nt, Shigella flexneri 2a str. 2457T
ugucucccacaugcu

SEQ ID NO: 3853126 - RNA, 18 nt, Shigella flexneri 2a str. 2457T
ugucucccgcccaaucga

SEQ ID NO: 3853127 - RNA, 18 nt, Shigella flexneri 2a str. 2457T
ugucuccggcauccagcg

SEQ ID NO: 3853128 - RNA, 13 nt, Shigella flexneri 2a str. 2457T
ugucugagccgaa

SEQ ID NO: 3853129 - RNA, 22 nt, Shigella flexneri 2a str. 2457T
ugucugaugcgcugcgcuuauc

SEQ ID NO: 3853130 - RNA, 15 nt, Shigella flexneri 2a str. 2457T
ugucugcuucugccu

SEQ ID NO: 3853131 - RNA, 11 nt, Shigella flexneri 2a str. 2457T
ugucuuaucug

SEQ ID NO: 3853132 - RNA, 16 nt, Shigella flexneri 2a str. 2457T
ugucuuaucuggcauu

SEQ ID NO: 3853133 - RNA, 16 nt, Shigella flexneri 2a str. 2457T
ugucuuccuguggugc

SEQ ID NO: 3853134 - RNA, 23 nt, Shigella flexneri 2a str. 2457T
ugucuuuugaucugcuaaacgua

SEQ ID NO: 3853135 - RNA, 17 nt, Shigella flexneri 2a str. 2457T
ugucuuuuuacucccgc

SEQ ID NO: 3853136 - RNA, 22 nt, Shigella flexneri 2a str. 2457T
ugugaaaacucuuagcaaacag

SEQ ID NO: 3853137 - RNA, 14 nt, Shigella flexneri 2a str. 2457T
ugugaaccucacag

SEQ ID NO: 3853138 - RNA, 17 nt, Shigella flexneri 2a str. 2457T
ugugaacgagaaaauga

SEQ ID NO: 3853139 - RNA, 15 nt, Shigella flexneri 2a str. 2457T
ugugacaacaacauc

SEQ ID NO: 3853140 - RNA, 13 nt, Shigella flexneri 2a str. 2457T
ugugacagagcca

SEQ ID NO: 3853141 - RNA, 21 nt, Shigella flexneri 2a str. 2457T
ugugacagauuuugccagcau

SEQ ID NO: 3853142 - RNA, 13 nt, Shigella flexneri 2a str. 2457T
ugugacagcagcg

SEQ ID NO: 3853143 - RNA, 16 nt, Shigella flexneri 2a str. 2457T
ugugacgacaccaucu

SEQ ID NO: 3853144 - RNA, 21 nt, Shigella flexneri 2a str. 2457T
ugugacgcuaccgggcucuuu

SEQ ID NO: 3853145 - RNA, 22 nt, Shigella flexneri 2a str. 2457T
ugugaugaaaaaaguuuuauug

SEQ ID NO: 3853146 - RNA, 12 nt, Shigella flexneri 2a str. 2457T
ugugauggaccg

SEQ ID NO: 3853147 - RNA, 14 nt, Shigella flexneri 2a str. 2457T
ugugauggcuauua

SEQ ID NO: 3853148 - RNA, 21 nt, Shigella flexneri 2a str. 2457T
ugugcaauauuacuucagacg

SEQ ID NO: 3853149 - RNA, 15 nt, Shigella flexneri 2a str. 2457T
ugugcagcaugcacc

SEQ ID NO: 3853150 - RNA, 22 nt, Shigella flexneri 2a str. 2457T
ugugcagguggaauauccguca

SEQ ID NO: 3853151 - RNA, 20 nt, Shigella flexneri 2a str. 2457T
ugugcaucaggcaaacuuca

SEQ ID NO: 3853152 - RNA, 14 nt, Shigella flexneri 2a str. 2457T
ugugccacauccag

SEQ ID NO: 3853153 - RNA, 19 nt, Shigella flexneri 2a str. 2457T
ugugccagcucgugcagaa

SEQ ID NO: 3853154 - RNA, 20 nt, Shigella flexneri 2a str. 2457T
ugugcccguaaaaaauggcu

SEQ ID NO: 3853155 - RNA, 16 nt, Shigella flexneri 2a str. 2457T
ugugccgcgacagauu

SEQ ID NO: 3853156 - RNA, 18 nt, Shigella flexneri 2a str. 2457T
ugugccgcgaugauuggg

SEQ ID NO: 3853157 - RNA, 22 nt, Shigella flexneri 2a str. 2457T
ugugccggcaacaauauuaacu

SEQ ID NO: 3853158 - RNA, 14 nt, Shigella flexneri 2a str. 2457T
ugugccguaaccaa

SEQ ID NO: 3853159 - RNA, 17 nt, Shigella flexneri 2a str. 2457T
ugugcgcgauccggcgg

SEQ ID NO: 3853160 - RNA, 21 nt, Shigella flexneri 2a str. 2457T
ugugcuaacucaucaccauca

SEQ ID NO: 3853161 - RNA, 18 nt, Shigella flexneri 2a str. 2457T
ugugcuauuuuagaaaaa

SEQ ID NO: 3853162 - RNA, 14 nt, Shigella flexneri 2a str. 2457T
ugugcucacacuua

SEQ ID NO: 3853163 - RNA, 21 nt, Shigella flexneri 2a str. 2457T
ugugcugaacgaaaagcgcac

SEQ ID NO: 3853164 - RNA, 20 nt, Shigella flexneri 2a str. 2457T
ugugcuggauaacgacaccu

SEQ ID NO: 3853165 - RNA, 16 nt, Shigella flexneri 2a str. 2457T
ugugcugugacagauu

SEQ ID NO: 3853166 - RNA, 13 nt, Shigella flexneri 2a str. 2457T
ugugcuuuacacc

SEQ ID NO: 3853167 - RNA, 23 nt, Shigella flexneri 2a str. 2457T
ugugcuuucaguucuagaacuaa

SEQ ID NO: 3853168 - RNA, 15 nt, Shigella flexneri 2a str. 2457T
uguggcccagccuuu

SEQ ID NO: 3853169 - RNA, 17 nt, Shigella flexneri 2a str. 2457T
ugugggauuccagcgcc

SEQ ID NO: 3853170 - RNA, 15 nt, Shigella flexneri 2a str. 2457T
ugugggguauuucca

SEQ ID NO: 3853171 - RNA, 16 nt, Shigella flexneri 2a str. 2457T
ugugggucgaggaaau

SEQ ID NO: 3853172 - RNA, 17 nt, Shigella flexneri 2a str. 2457T
uguggugaucacccaga

SEQ ID NO: 3853173 - RNA, 23 nt, Shigella flexneri 2a str. 2457T
ugugguguaacgagacaaugcaa

SEQ ID NO: 3853174 - RNA, 21 nt, Shigella flexneri 2a str. 2457T
ugugguuggcguguuucagcu

SEQ ID NO: 3853175 - RNA, 15 nt, Shigella flexneri 2a str. 2457T
uguguaaacccagcc

SEQ ID NO: 3853176 - RNA, 21 nt, Shigella flexneri 2a str. 2457T
uguguaagaaaggcagagugc

SEQ ID NO: 3853177 - RNA, 13 nt, Shigella flexneri 2a str. 2457T
ugugucacuuuga

SEQ ID NO: 3853178 - RNA, 13 nt, Shigella flexneri 2a str. 2457T
ugugucagcgcca

SEQ ID NO: 3853179 - RNA, 12 nt, Shigella flexneri 2a str. 2457T
ugugucgccagc

SEQ ID NO: 3853180 - RNA, 12 nt, Shigella flexneri 2a str. 2457T
ugugugaaaguc

SEQ ID NO: 3853181 - RNA, 21 nt, Shigella flexneri 2a str. 2457T
uguguugcauccggcauggca

SEQ ID NO: 3853182 - RNA, 15 nt, Shigella flexneri 2a str. 2457T
uguguuugaucacuu

SEQ ID NO: 3853183 - RNA, 21 nt, Shigella flexneri 2a str. 2457T
uguuaaaugauaccgggcugu

SEQ ID NO: 3853184 - RNA, 21 nt, Shigella flexneri 2a str. 2457T
uguuaaccaccaguaaauugu

SEQ ID NO: 3853185 - RNA, 21 nt, Shigella flexneri 2a str. 2457T
uguuacugagcggaugcuuaa

SEQ ID NO: 3853186 - RNA, 22 nt, Shigella flexneri 2a str. 2457T
uguuagcaugcuggcugcgcuc

SEQ ID NO: 3853187 - RNA, 20 nt, Shigella flexneri 2a str. 2457T
uguuagcgaauaaaguagaa

SEQ ID NO: 3853188 - RNA, 14 nt, Shigella flexneri 2a str. 2457T
uguuaucaauaagu

SEQ ID NO: 3853189 - RNA, 16 nt, Shigella flexneri 2a str. 2457T
uguuaucccgaugaug

SEQ ID NO: 3853190 - RNA, 18 nt, Shigella flexneri 2a str. 2457T
uuaaacacgggguuaaau

SEQ ID NO: 3853191 - RNA, 15 nt, Shigella flexneri 2a str. 2457T
uuaaacauuaaaauu

SEQ ID NO: 3853192 - RNA, 17 nt, Shigella flexneri 2a str. 2457T
uuaaacccgcucaaaca

SEQ ID NO: 3853193 - RNA, 22 nt, Shigella flexneri 2a str. 2457T
uuaaacccuacccggcaaguaa

SEQ ID NO: 3853194 - RNA, 15 nt, Shigella flexneri 2a str. 2457T
uuaaaccuaaaaaga

SEQ ID NO: 3853195 - RNA, 19 nt, Shigella flexneri 2a str. 2457T
uuaaacgcagagacaucac

SEQ ID NO: 3853196 - RNA, 22 nt, Shigella flexneri 2a str. 2457T
uuaaacgcaguaagcgccaggg

SEQ ID NO: 3853197 - RNA, 18 nt, Shigella flexneri 2a str. 2457T
uuaaacgggcguauaaca

SEQ ID NO: 3853198 - RNA, 18 nt, Shigella flexneri 2a str. 2457T
uuaaacgggucaucaaaa

SEQ ID NO: 3853199 - RNA, 20 nt, Shigella flexneri 2a str. 2457T
uuaaacgggucaucaaaauc

SEQ ID NO: 3853200 - RNA, 15 nt, Shigella flexneri 2a str. 2457T
uuaaacucugccgca

SEQ ID NO: 3853201 - RNA, 15 nt, Shigella flexneri 2a str. 2457T
uuaaacuuucauaaa

SEQ ID NO: 3853202 - RNA, 13 nt, Shigella flexneri 2a str. 2457T
uuaaagaaaauaa

SEQ ID NO: 3853203 - RNA, 17 nt, Shigella flexneri 2a str. 2457T
uuaaagagacagaauca

SEQ ID NO: 3853204 - RNA, 12 nt, Shigella flexneri 2a str. 2457T
uuaaagcaaaaa

SEQ ID NO: 3853205 - RNA, 20 nt, Shigella flexneri 2a str. 2457T
uuaaagcaucugccagccau

SEQ ID NO: 3853206 - RNA, 19 nt, Shigella flexneri 2a str. 2457T
uuaaagccgccaaacggau

SEQ ID NO: 3853207 - RNA, 12 nt, Shigella flexneri 2a str. 2457T
uuaaaggaaagu

SEQ ID NO: 3853208 - RNA, 17 nt, Shigella flexneri 2a str. 2457T
uuaaaggcaccaauauu

SEQ ID NO: 3853209 - RNA, 21 nt, Shigella flexneri 2a str. 2457T
uuaaaguugagcgaaaacgaa

SEQ ID NO: 3853210 - RNA, 15 nt, Shigella flexneri 2a str. 2457T
uuaaauaaagccuau

SEQ ID NO: 3853211 - RNA, 18 nt, Shigella flexneri 2a str. 2457T
uuaaauacagcuuaauca

SEQ ID NO: 3853212 - RNA, 15 nt, Shigella flexneri 2a str. 2457T
uuaaauauaaaacaa

SEQ ID NO: 3853213 - RNA, 19 nt, Shigella flexneri 2a str. 2457T
uuaaauauaaaacaacgga

SEQ ID NO: 3853214 - RNA, 15 nt, Shigella flexneri 2a str. 2457T
uuaaauaucaucaaa

SEQ ID NO: 3853215 - RNA, 16 nt, Shigella flexneri 2a str. 2457T
uuaaauaucaucaaaa

SEQ ID NO: 3853216 - RNA, 20 nt, Shigella flexneri 2a str. 2457T
uuaaaucgguauuuccauuu

SEQ ID NO: 3853217 - RNA, 17 nt, Shigella flexneri 2a str. 2457T
uuaaaugauaccgggcu

SEQ ID NO: 3853218 - RNA, 15 nt, Shigella flexneri 2a str. 2457T
uuaaauugucuuaaa

SEQ ID NO: 3853219 - RNA, 13 nt, Shigella flexneri 2a str. 2457T
uuaaauuuaauaa

SEQ ID NO: 3853220 - RNA, 18 nt, Shigella flexneri 2a str. 2457T
uuaaauuuauauuuuuua

SEQ ID NO: 3853221 - RNA, 14 nt, Shigella flexneri 2a str. 2457T
uuaacaaucacaau

SEQ ID NO: 3853222 - RNA, 17 nt, Shigella flexneri 2a str. 2457T
uuaacaaucacaauaga

SEQ ID NO: 3853223 - RNA, 19 nt, Shigella flexneri 2a str. 2457T
uuaacacacaauuaccuuc

SEQ ID NO: 3853224 - RNA, 16 nt, Shigella flexneri 2a str. 2457T
uuaacagguauagaau

SEQ ID NO: 3853225 - RNA, 23 nt, Shigella flexneri 2a str. 2457T
uuaacauguguugucgcuguaau

SEQ ID NO: 3853226 - RNA, 14 nt, Shigella flexneri 2a str. 2457T
uuaaccaacaauaa

SEQ ID NO: 3853227 - RNA, 15 nt, Shigella flexneri 2a str. 2457T
uuaaccaacaauaaa

SEQ ID NO: 3853228 - RNA, 23 nt, Shigella flexneri 2a str. 2457T
uuaaccaccaguaaauugucgcc

SEQ ID NO: 3853229 - RNA, 17 nt, Shigella flexneri 2a str. 2457T
uuaaccacuucagaacc

SEQ ID NO: 3853230 - RNA, 20 nt, Shigella flexneri 2a str. 2457T
uuaaccagcacguugaacug

SEQ ID NO: 3853231 - RNA, 12 nt, Shigella flexneri 2a str. 2457T
uuaacccauuuu

SEQ ID NO: 3853232 - RNA, 17 nt, Shigella flexneri 2a str. 2457T
uuaacccgcaacagcaa

SEQ ID NO: 3853233 - RNA, 23 nt, Shigella flexneri 2a str. 2457T
uuaaccugcuccucaguuucgac

SEQ ID NO: 3853234 - RNA, 14 nt, Shigella flexneri 2a str. 2457T
uuaaccuuauauug

SEQ ID NO: 3853235 - RNA, 21 nt, Shigella flexneri 2a str. 2457T
uuaacgacacucucuucaaca

SEQ ID NO: 3853236 - RNA, 13 nt, Shigella flexneri 2a str. 2457T
uuaacgacgcaua

SEQ ID NO: 3853237 - RNA, 23 nt, Shigella flexneri 2a str. 2457T
uuaacgcgccggaaauugccacu

SEQ ID NO: 3853238 - RNA, 18 nt, Shigella flexneri 2a str. 2457T
uuaacgcuucucccagcc

SEQ ID NO: 3853239 - RNA, 19 nt, Shigella flexneri 2a str. 2457T
uuaacggaggagagugcaa

SEQ ID NO: 3853240 - RNA, 17 nt, Shigella flexneri 2a str. 2457T
uuaacggcggcaaauau

SEQ ID NO: 3853241 - RNA, 22 nt, Shigella flexneri 2a str. 2457T
uuaacggcggcaaauauuaugg

SEQ ID NO: 3853242 - RNA, 15 nt, Shigella flexneri 2a str. 2457T
uuaacgggcagguca

SEQ ID NO: 3853243 - RNA, 14 nt, Shigella flexneri 2a str. 2457T
uuaacgguaagcgc

SEQ ID NO: 3853244 - RNA, 14 nt, Shigella flexneri 2a str. 2457T
uuaacgguaucuuu

SEQ ID NO: 3853245 - RNA, 18 nt, Shigella flexneri 2a str. 2457T
uuaacuccuucuaaagca

SEQ ID NO: 3853246 - RNA, 22 nt, Shigella flexneri 2a str. 2457T
uuaacugacuuucguuugaaaa

SEQ ID NO: 3853247 - RNA, 23 nt, Shigella flexneri 2a str. 2457T
uuaacugacuuucguuugaaaac

SEQ ID NO: 3853248 - RNA, 16 nt, Shigella flexneri 2a str. 2457T
uuaacugauauuuaaa

SEQ ID NO: 3853249 - RNA, 21 nt, Shigella flexneri 2a str. 2457T
uuaacugcccgaucaacggau

SEQ ID NO: 3853250 - RNA, 14 nt, Shigella flexneri 2a str. 2457T
uuaacugcuccgcc

SEQ ID NO: 3853251 - RNA, 17 nt, Shigella flexneri 2a str. 2457T
uuaacugcuuaucauca

SEQ ID NO: 3853252 - RNA, 22 nt, Shigella flexneri 2a str. 2457T
uuaacugggcgucaaagugaaa

SEQ ID NO: 3853253 - RNA, 17 nt, Shigella flexneri 2a str. 2457T
uuaacuguucugaaaac

SEQ ID NO: 3853254 - RNA, 14 nt, Shigella flexneri 2a str. 2457T
uuaagaaaaaagau

SEQ ID NO: 3853255 - RNA, 11 nt, Shigella flexneri 2a str. 2457T
uuaagaaaacg

SEQ ID NO: 3853256 - RNA, 20 nt, Shigella flexneri 2a str. 2457T
uuaagaaaacggaagcucag

SEQ ID NO: 3853257 - RNA, 18 nt, Shigella flexneri 2a str. 2457T
uuaagagcuggcaucagc

SEQ ID NO: 3853258 - RNA, 21 nt, Shigella flexneri 2a str. 2457T
uuaagagcuggcaucagcaaa

SEQ ID NO: 3853259 - RNA, 15 nt, Shigella flexneri 2a str. 2457T
uuaagcaaaaaaaca

SEQ ID NO: 3853260 - RNA, 17 nt, Shigella flexneri 2a str. 2457T
uuaagcaaaaaaacaua

SEQ ID NO: 3853261 - RNA, 22 nt, Shigella flexneri 2a str. 2457T
uuaagcaagugcaaucuacaaa

SEQ ID NO: 3853262 - RNA, 20 nt, Shigella flexneri 2a str. 2457T
uuaagcaauaccgcgaauca

SEQ ID NO: 3853263 - RNA, 22 nt, Shigella flexneri 2a str. 2457T
uuaagcacuggcggcagcaggu

SEQ ID NO: 3853264 - RNA, 15 nt, Shigella flexneri 2a str. 2457T
uuaagccaucaucaa

SEQ ID NO: 3853265 - RNA, 22 nt, Shigella flexneri 2a str. 2457T
uuaagccaucccagacaccgcc

SEQ ID NO: 3853266 - RNA, 18 nt, Shigella flexneri 2a str. 2457T
uuaagcgauucagcaccu

SEQ ID NO: 3853267 - RNA, 15 nt, Shigella flexneri 2a str. 2457T
uuaagcgcaaaggcc

SEQ ID NO: 3853268 - RNA, 22 nt, Shigella flexneri 2a str. 2457T
uuaagcgcaucgacgccaucau

SEQ ID NO: 3853269 - RNA, 15 nt, Shigella flexneri 2a str. 2457T
uuaaggaaaaacgaa

SEQ ID NO: 3853270 - RNA, 15 nt, Shigella flexneri 2a str. 2457T
uuaaggcaagaaaau

SEQ ID NO: 3853271 - RNA, 14 nt, Shigella flexneri 2a str. 2457T
uuaaggguauuuuu

SEQ ID NO: 3853272 - RNA, 13 nt, Shigella flexneri 2a str. 2457T
uuaagggugauca

SEQ ID NO: 3853273 - RNA, 20 nt, Shigella flexneri 2a str. 2457T
uuaaguguccgccaauuuca

SEQ ID NO: 3853274 - RNA, 13 nt, Shigella flexneri 2a str. 2457T
uuaaguuuauccc

SEQ ID NO: 3853275 - RNA, 19 nt, Shigella flexneri 2a str. 2457T
uuaauaaaaauuuuaguuu

SEQ ID NO: 3853276 - RNA, 16 nt, Shigella flexneri 2a str. 2457T
uuaauaaaauuaucca

SEQ ID NO: 3853277 - RNA, 20 nt, Shigella flexneri 2a str. 2457T
uuaauaaaauuauccagcuu

SEQ ID NO: 3853278 - RNA, 14 nt, Shigella flexneri 2a str. 2457T
uuaauaaacaucag

SEQ ID NO: 3853279 - RNA, 17 nt, Shigella flexneri 2a str. 2457T
uuaauaacacauauauu

SEQ ID NO: 3853280 - RNA, 18 nt, Shigella flexneri 2a str. 2457T
uuaauaacacauauauua

SEQ ID NO: 3853281 - RNA, 14 nt, Shigella flexneri 2a str. 2457T
uuaauaccaucggc

SEQ ID NO: 3853282 - RNA, 22 nt, Shigella flexneri 2a str. 2457T
uuaauaccaucggcagcgccaa

SEQ ID NO: 3853283 - RNA, 22 nt, Shigella flexneri 2a str. 2457T
uuaauacugcuccccgaacgau

SEQ ID NO: 3853284 - RNA, 14 nt, Shigella flexneri 2a str. 2457T
uuaaucaacucacg

SEQ ID NO: 3853285 - RNA, 23 nt, Shigella flexneri 2a str. 2457T
uuaaucaagaaaccgaaguugua

SEQ ID NO: 3853286 - RNA, 20 nt, Shigella flexneri 2a str. 2457T
uuaaucagcgaguuaccuua

SEQ ID NO: 3853287 - RNA, 16 nt, Shigella flexneri 2a str. 2457T
uuacguuuuaaaccua

SEQ ID NO: 3853288 - RNA, 17 nt, Shigella flexneri 2a str. 2457T
uuacuaaguacauuaag

SEQ ID NO: 3853289 - RNA, 19 nt, Shigella flexneri 2a str. 2457T
uuacuacccuguccgccau

SEQ ID NO: 3853290 - RNA, 13 nt, Shigella flexneri 2a str. 2457T
uuacucauaaaua

SEQ ID NO: 3853291 - RNA, 19 nt, Shigella flexneri 2a str. 2457T
uuacucauuucuguauaau

SEQ ID NO: 3853292 - RNA, 19 nt, Shigella flexneri 2a str. 2457T
uuacuccgacaacgucauu

SEQ ID NO: 3853293 - RNA, 21 nt, Shigella flexneri 2a str. 2457T
uuacuccuuagcaacaggcca

SEQ ID NO: 3853294 - RNA, 13 nt, Shigella flexneri 2a str. 2457T
uuacucuccugcg

SEQ ID NO: 3853295 - RNA, 18 nt, Shigella flexneri 2a str. 2457T
uuacugacaauuugccca

SEQ ID NO: 3853296 - RNA, 13 nt, Shigella flexneri 2a str. 2457T
uuacugacaucaa

SEQ ID NO: 3853297 - RNA, 19 nt, Shigella flexneri 2a str. 2457T
uuacugacaucaaacccuu

SEQ ID NO: 3853298 - RNA, 13 nt, Shigella flexneri 2a str. 2457T
uuacugacugucc

SEQ ID NO: 3853299 - RNA, 16 nt, Shigella flexneri 2a str. 2457T
uuacugagaacgcaau

SEQ ID NO: 3853300 - RNA, 22 nt, Shigella flexneri 2a str. 2457T
uuacugaggccggaugucgcug

SEQ ID NO: 3853301 - RNA, 22 nt, Shigella flexneri 2a str. 2457T
uuacugcguauuuccugccaga

SEQ ID NO: 3853302 - RNA, 18 nt, Shigella flexneri 2a str. 2457T
uuacuggaguuauucauu

SEQ ID NO: 3853303 - RNA, 16 nt, Shigella flexneri 2a str. 2457T
uuacugucgcgcagca

SEQ ID NO: 3853304 - RNA, 14 nt, Shigella flexneri 2a str. 2457T
uuacugucugcuuc

SEQ ID NO: 3853305 - RNA, 10 nt, Shigella flexneri 2a str. 2457T
uuacuuaaug

SEQ ID NO: 3853306 - RNA, 16 nt, Shigella flexneri 2a str. 2457T
uuacuucaccuucuuu

SEQ ID NO: 3853307 - RNA, 20 nt, Shigella flexneri 2a str. 2457T
uuacuuccgguuacgccacc

SEQ ID NO: 3853308 - RNA, 15 nt, Shigella flexneri 2a str. 2457T
uuacuucuauaauga

SEQ ID NO: 3853309 - RNA, 16 nt, Shigella flexneri 2a str. 2457T
uuacuucucgauaaac

SEQ ID NO: 3853310 - RNA, 23 nt, Shigella flexneri 2a str. 2457T
uuacuugcugcucugaagguugu

SEQ ID NO: 3853311 - RNA, 12 nt, Shigella flexneri 2a str. 2457T
uuacuuuauuua

SEQ ID NO: 3853312 - RNA, 15 nt, Shigella flexneri 2a str. 2457T
uuacuuuauuuauau

SEQ ID NO: 3853313 - RNA, 12 nt, Shigella flexneri 2a str. 2457T
uuacuuuccuua

SEQ ID NO: 3853314 - RNA, 20 nt, Shigella flexneri 2a str. 2457T
uuacuuucggugacuucaaa

SEQ ID NO: 3853315 - RNA, 21 nt, Shigella flexneri 2a str. 2457T
uuagaaauucacagguaacau

SEQ ID NO: 3853316 - RNA, 17 nt, Shigella flexneri 2a str. 2457T
uuagaauaccugccugu

SEQ ID NO: 3853317 - RNA, 13 nt, Shigella flexneri 2a str. 2457T
uuagagacgcauu

SEQ ID NO: 3853318 - RNA, 18 nt, Shigella flexneri 2a str. 2457T
uuagaugauggcauucuc

SEQ ID NO: 3853319 - RNA, 21 nt, Shigella flexneri 2a str. 2457T
uuagaugauggcauucucacu

SEQ ID NO: 3853320 - RNA, 19 nt, Shigella flexneri 2a str. 2457T
uuagcaaccaaaaaaagaa

SEQ ID NO: 3853321 - RNA, 18 nt, Shigella flexneri 2a str. 2457T
uuagcaaugccuucugga

SEQ ID NO: 3853322 - RNA, 14 nt, Shigella flexneri 2a str. 2457T
uuagcaucagucuc

SEQ ID NO: 3853323 - RNA, 12 nt, Shigella flexneri 2a str. 2457T
uuagcaucccca

SEQ ID NO: 3853324 - RNA, 21 nt, Shigella flexneri 2a str. 2457T
uuagccaggcaccgaaaauca

SEQ ID NO: 3853325 - RNA, 14 nt, Shigella flexneri 2a str. 2457T
uuagcccuuuguag

SEQ ID NO: 3853326 - RNA, 19 nt, Shigella flexneri 2a str. 2457T
uuagccgcagguaaacuca

SEQ ID NO: 3853327 - RNA, 16 nt, Shigella flexneri 2a str. 2457T
uuagccgccagcucuu

SEQ ID NO: 3853328 - RNA, 15 nt, Shigella flexneri 2a str. 2457T
uuagccggauaaaca

SEQ ID NO: 3853329 - RNA, 13 nt, Shigella flexneri 2a str. 2457T
uuagccgguuuuu

SEQ ID NO: 3853330 - RNA, 18 nt, Shigella flexneri 2a str. 2457T
uuagcgcaugaccaguga

SEQ ID NO: 3853331 - RNA, 22 nt, Shigella flexneri 2a str. 2457T
uuagcgucaaggggucaaugcc

SEQ ID NO: 3853332 - RNA, 23 nt, Shigella flexneri 2a str. 2457T
uuagcguugcgccuguucccuuc

SEQ ID NO: 3853333 - RNA, 16 nt, Shigella flexneri 2a str. 2457T
uuagcuuucuuuuucu

SEQ ID NO: 3853334 - RNA, 17 nt, Shigella flexneri 2a str. 2457T
uuaggaccgguuucaaa

SEQ ID NO: 3853335 - RNA, 15 nt, Shigella flexneri 2a str. 2457T
uuaggcauuaucucu

SEQ ID NO: 3853336 - RNA, 15 nt, Shigella flexneri 2a str. 2457T
uuagggacaaagaau

SEQ ID NO: 3853337 - RNA, 20 nt, Shigella flexneri 2a str. 2457T
uuagggugaggggaacagac

SEQ ID NO: 3853338 - RNA, 17 nt, Shigella flexneri 2a str. 2457T
uuagguacaaagccaac

SEQ ID NO: 3853339 - RNA, 22 nt, Shigella flexneri 2a str. 2457T
uuagguacaaagccaacagcag

SEQ ID NO: 3853340 - RNA, 19 nt, Shigella flexneri 2a str. 2457T
uuaguaaacgcguagaucu

SEQ ID NO: 3853341 - RNA, 15 nt, Shigella flexneri 2a str. 2457T
uuaguaacaacggau

SEQ ID NO: 3853342 - RNA, 15 nt, Shigella flexneri 2a str. 2457T
uuaguagaagaggaa

SEQ ID NO: 3853343 - RNA, 16 nt, Shigella flexneri 2a str. 2457T
uuaguagaagaggaac

SEQ ID NO: 3853344 - RNA, 20 nt, Shigella flexneri 2a str. 2457T
uuagucgcccauuuugccac

SEQ ID NO: 3853345 - RNA, 23 nt, Shigella flexneri 2a str. 2457T
uuagucgucgccgauaauuuuca

SEQ ID NO: 3853346 - RNA, 16 nt, Shigella flexneri 2a str. 2457T
uuagucugcauuuucu

SEQ ID NO: 3853347 - RNA, 22 nt, Shigella flexneri 2a str. 2457T
uuagugccgcuggcauacaguu

SEQ ID NO: 3853348 - RNA, 21 nt, Shigella flexneri 2a str. 2457T
uuagugcugcuggaagguaag

SEQ ID NO: 3853349 - RNA, 13 nt, Shigella flexneri 2a str. 2457T
uuaguucaaugcg

SEQ ID NO: 3853350 - RNA, 16 nt, Shigella flexneri 2a str. 2457T
uuaguuuuauacucag

SEQ ID NO: 3853351 - RNA, 13 nt, Shigella flexneri 2a str. 2457T
uuauaaauaaaaa

SEQ ID NO: 3853352 - RNA, 15 nt, Shigella flexneri 2a str. 2457T
uuauaaauaaaaaga

SEQ ID NO: 3853353 - RNA, 16 nt, Shigella flexneri 2a str. 2457T
uuauaaauaaaaagag

SEQ ID NO: 3853354 - RNA, 14 nt, Shigella flexneri 2a str. 2457T
uuauaaauaaaaau

SEQ ID NO: 3853355 - RNA, 16 nt, Shigella flexneri 2a str. 2457T
uuauaacggugcugca

SEQ ID NO: 3853356 - RNA, 16 nt, Shigella flexneri 2a str. 2457T
uuauaaucuuuaaaaa

SEQ ID NO: 3853357 - RNA, 19 nt, Shigella flexneri 2a str. 2457T
uuauaaucuuuaaaaaaag

SEQ ID NO: 3853358 - RNA, 15 nt, Shigella flexneri 2a str. 2457T
uuauacaucgcuuuc

SEQ ID NO: 3853359 - RNA, 14 nt, Shigella flexneri 2a str. 2457T
uuauagcaguaauu

SEQ ID NO: 3853360 - RNA, 17 nt, Shigella flexneri 2a str. 2457T
uuauagcucaacgcugc

SEQ ID NO: 3853361 - RNA, 17 nt, Shigella flexneri 2a str. 2457T
uuauaggguaaauuacc

SEQ ID NO: 3853362 - RNA, 17 nt, Shigella flexneri 2a str. 2457T
uuauauaacgccauauu

SEQ ID NO: 3853363 - RNA, 22 nt, Shigella flexneri 2a str. 2457T
uuauauagaacaagugccacgc

SEQ ID NO: 3853364 - RNA, 16 nt, Shigella flexneri 2a str. 2457T
uuauaucccauuuuug

SEQ ID NO: 3853365 - RNA, 14 nt, Shigella flexneri 2a str. 2457T
uuauaucucagaua

SEQ ID NO: 3853366 - RNA, 20 nt, Shigella flexneri 2a str. 2457T
uuauaugaugaaacugauaa

SEQ ID NO: 3853367 - RNA, 23 nt, Shigella flexneri 2a str. 2457T
uuauauuacgaauauaaauauuu

SEQ ID NO: 3853368 - RNA, 21 nt, Shigella flexneri 2a str. 2457T
uuauauugauuaccaauauca

SEQ ID NO: 3853369 - RNA, 11 nt, Shigella flexneri 2a str. 2457T
uuauauuguuu

SEQ ID NO: 3853370 - RNA, 11 nt, Shigella flexneri 2a str. 2457T
uuauauuuccc

SEQ ID NO: 3853371 - RNA, 16 nt, Shigella flexneri 2a str. 2457T
uuauauuugaacaucg

SEQ ID NO: 3853372 - RNA, 13 nt, Shigella flexneri 2a str. 2457T
uuaucaagauauu

SEQ ID NO: 3853373 - RNA, 19 nt, Shigella flexneri 2a str. 2457T
uuaucaauuccuauuuugu

SEQ ID NO: 3853374 - RNA, 20 nt, Shigella flexneri 2a str. 2457T
uuaucacgaugcuaaaaaca

SEQ ID NO: 3853375 - RNA, 23 nt, Shigella flexneri 2a str. 2457T
uuaucacgaugcuaaaaacauca

SEQ ID NO: 3853376 - RNA, 14 nt, Shigella flexneri 2a str. 2457T
uuaucacugugaug

SEQ ID NO: 3853377 - RNA, 21 nt, Shigella flexneri 2a str. 2457T
uuaucagacaccgauugcccc

SEQ ID NO: 3853378 - RNA, 22 nt, Shigella flexneri 2a str. 2457T
uuaucagacaccgauugccccu

SEQ ID NO: 3853379 - RNA, 14 nt, Shigella flexneri 2a str. 2457T
uuaucaggccuaca

SEQ ID NO: 3853380 - RNA, 17 nt, Shigella flexneri 2a str. 2457T
uuaucaggccuacaaaa

SEQ ID NO: 3853381 - RNA, 18 nt, Shigella flexneri 2a str. 2457T
uuaucaggccuacaaaau

SEQ ID NO: 3853382 - RNA, 18 nt, Shigella flexneri 2a str. 2457T
uuaucaggccuacaaguc

SEQ ID NO: 3853383 - RNA, 20 nt, Shigella flexneri 2a str. 2457T
uuaucaggccuacagcauau

SEQ ID NO: 3853384 - RNA, 21 nt, Shigella flexneri 2a str. 2457T
uuaucaggccuacauuggugc

SEQ ID NO: 3853385 - RNA, 17 nt, Shigella flexneri 2a str. 2457T
uucaacagcgugaacug

SEQ ID NO: 3853386 - RNA, 22 nt, Shigella flexneri 2a str. 2457T
uucaacaguaaacucgacuuuc

SEQ ID NO: 3853387 - RNA, 13 nt, Shigella flexneri 2a str. 2457T
uucaacaguuuuc

SEQ ID NO: 3853388 - RNA, 18 nt, Shigella flexneri 2a str. 2457T
uucaacauauccuucaca

SEQ ID NO: 3853389 - RNA, 22 nt, Shigella flexneri 2a str. 2457T
uucaacauauccuucacacaua

SEQ ID NO: 3853390 - RNA, 18 nt, Shigella flexneri 2a str. 2457T
uucaacauguugaaauuc

SEQ ID NO: 3853391 - RNA, 18 nt, Shigella flexneri 2a str. 2457T
uucaaccauccuaaaaaa

SEQ ID NO: 3853392 - RNA, 21 nt, Shigella flexneri 2a str. 2457T
uucaaccauccuaaaaaagca

SEQ ID NO: 3853393 - RNA, 15 nt, Shigella flexneri 2a str. 2457T
uucaacgaagaaaac

SEQ ID NO: 3853394 - RNA, 19 nt, Shigella flexneri 2a str. 2457T
uucaacgcacccuauuuuu

SEQ ID NO: 3853395 - RNA, 20 nt, Shigella flexneri 2a str. 2457T
uucaacgcagcgccauauaa

SEQ ID NO: 3853396 - RNA, 19 nt, Shigella flexneri 2a str. 2457T
uucaacguacucugccacu

SEQ ID NO: 3853397 - RNA, 16 nt, Shigella flexneri 2a str. 2457T
uucaacuggauaaaau

SEQ ID NO: 3853398 - RNA, 19 nt, Shigella flexneri 2a str. 2457T
uucaagacaucaauaaaca

SEQ ID NO: 3853399 - RNA, 22 nt, Shigella flexneri 2a str. 2457T
uucaagacgaauaccuucuucc

SEQ ID NO: 3853400 - RNA, 21 nt, Shigella flexneri 2a str. 2457T
uucaaggagggaucgacagau

SEQ ID NO: 3853401 - RNA, 13 nt, Shigella flexneri 2a str. 2457T
uucaaguaauuca

SEQ ID NO: 3853402 - RNA, 19 nt, Shigella flexneri 2a str. 2457T
uucaauaaccugcaaaaua

SEQ ID NO: 3853403 - RNA, 22 nt, Shigella flexneri 2a str. 2457T
uucaauaaccugcaaaauaguc

SEQ ID NO: 3853404 - RNA, 18 nt, Shigella flexneri 2a str. 2457T
uucaauaccgccugcaaa

SEQ ID NO: 3853405 - RNA, 22 nt, Shigella flexneri 2a str. 2457T
uucaauaccgccugcaaauaaa

SEQ ID NO: 3853406 - RNA, 23 nt, Shigella flexneri 2a str. 2457T
uucaauaccgccugcaaauaaau

SEQ ID NO: 3853407 - RNA, 22 nt, Shigella flexneri 2a str. 2457T
uucaauacgcuccaguaccugc

SEQ ID NO: 3853408 - RNA, 17 nt, Shigella flexneri 2a str. 2457T
uucaauacgcucgaaca

SEQ ID NO: 3853409 - RNA, 21 nt, Shigella flexneri 2a str. 2457T
uucaauauauugcugaaauaa

SEQ ID NO: 3853410 - RNA, 13 nt, Shigella flexneri 2a str. 2457T
uucaaucugguga

SEQ ID NO: 3853411 - RNA, 20 nt, Shigella flexneri 2a str. 2457T
uucaaugauaaaggucauca

SEQ ID NO: 3853412 - RNA, 22 nt, Shigella flexneri 2a str. 2457T
uucaaugauaaaggucaucaca

SEQ ID NO: 3853413 - RNA, 17 nt, Shigella flexneri 2a str. 2457T
uucaaugcauuaucaga

SEQ ID NO: 3853414 - RNA, 17 nt, Shigella flexneri 2a str. 2457T
uucaaugcgaucuaccc

SEQ ID NO: 3853415 - RNA, 23 nt, Shigella flexneri 2a str. 2457T
uucaaugcugccgggguaaagcg

SEQ ID NO: 3853416 - RNA, 14 nt, Shigella flexneri 2a str. 2457T
uucaauguaucucu

SEQ ID NO: 3853417 - RNA, 16 nt, Shigella flexneri 2a str. 2457T
uucaauuaauugugaa

SEQ ID NO: 3853418 - RNA, 20 nt, Shigella flexneri 2a str. 2457T
uucaauuagcgccucggggc

SEQ ID NO: 3853419 - RNA, 22 nt, Shigella flexneri 2a str. 2457T
uucaauuauaguaucguuaaau

SEQ ID NO: 3853420 - RNA, 18 nt, Shigella flexneri 2a str. 2457T
uucaauuuaaggaauacc

SEQ ID NO: 3853421 - RNA, 16 nt, Shigella flexneri 2a str. 2457T
uucacaaacagcgccu

SEQ ID NO: 3853422 - RNA, 21 nt, Shigella flexneri 2a str. 2457T
uucacaaagacgccaucaauu

SEQ ID NO: 3853423 - RNA, 15 nt, Shigella flexneri 2a str. 2457T
uucacaaguuguccc

SEQ ID NO: 3853424 - RNA, 22 nt, Shigella flexneri 2a str. 2457T
uucacaaugaugcccgguugcu

SEQ ID NO: 3853425 - RNA, 21 nt, Shigella flexneri 2a str. 2457T
uucacacacaucgacccagaa

SEQ ID NO: 3853426 - RNA, 17 nt, Shigella flexneri 2a str. 2457T
uucacacacuuuuauua

SEQ ID NO: 3853427 - RNA, 23 nt, Shigella flexneri 2a str. 2457T
uucacacccgguaucaaacccuu

SEQ ID NO: 3853428 - RNA, 20 nt, Shigella flexneri 2a str. 2457T
uucacacugaugacaggcua

SEQ ID NO: 3853429 - RNA, 18 nt, Shigella flexneri 2a str. 2457T
uucacaggccgccaggca

SEQ ID NO: 3853430 - RNA, 19 nt, Shigella flexneri 2a str. 2457T
uucacaggccgccaggcag

SEQ ID NO: 3853431 - RNA, 22 nt, Shigella flexneri 2a str. 2457T
uucacaguuaaguuaauucuga

SEQ ID NO: 3853432 - RNA, 16 nt, Shigella flexneri 2a str. 2457T
uucacauauugcagcu

SEQ ID NO: 3853433 - RNA, 20 nt, Shigella flexneri 2a str. 2457T
uucacaucaccauagccuaa

SEQ ID NO: 3853434 - RNA, 12 nt, Shigella flexneri 2a str. 2457T
uucacaucauca

SEQ ID NO: 3853435 - RNA, 13 nt, Shigella flexneri 2a str. 2457T
uucacaucaucau

SEQ ID NO: 3853436 - RNA, 22 nt, Shigella flexneri 2a str. 2457T
uucacaucauccggcaccuuuu

SEQ ID NO: 3853437 - RNA, 11 nt, Shigella flexneri 2a str. 2457T
uucacauguuc

SEQ ID NO: 3853438 - RNA, 15 nt, Shigella flexneri 2a str. 2457T
uucacauuuaaacaa

SEQ ID NO: 3853439 - RNA, 20 nt, Shigella flexneri 2a str. 2457T
uucaccacuguuaacggccg

SEQ ID NO: 3853440 - RNA, 16 nt, Shigella flexneri 2a str. 2457T
uucaccagaccugaaa

SEQ ID NO: 3853441 - RNA, 13 nt, Shigella flexneri 2a str. 2457T
uucaccagcaucg

SEQ ID NO: 3853442 - RNA, 16 nt, Shigella flexneri 2a str. 2457T
uucaccagcaucgccg

SEQ ID NO: 3853443 - RNA, 21 nt, Shigella flexneri 2a str. 2457T
uucaccaguugguagguccag

SEQ ID NO: 3853444 - RNA, 19 nt, Shigella flexneri 2a str. 2457T
uucaccaucgcgaucauca

SEQ ID NO: 3853445 - RNA, 21 nt, Shigella flexneri 2a str. 2457T
uucacccaucacuaccugauu

SEQ ID NO: 3853446 - RNA, 16 nt, Shigella flexneri 2a str. 2457T
uucacccaucgccaga

SEQ ID NO: 3853447 - RNA, 15 nt, Shigella flexneri 2a str. 2457T
uucacccauugccgc

SEQ ID NO: 3853448 - RNA, 18 nt, Shigella flexneri 2a str. 2457T
uucaccgcaucgucacug

SEQ ID NO: 3853449 - RNA, 23 nt, Shigella flexneri 2a str. 2457T
uucaccgcguaugcccagcgcag

SEQ ID NO: 3853450 - RNA, 16 nt, Shigella flexneri 2a str. 2457T
uucaccggugagcugc

SEQ ID NO: 3853451 - RNA, 20 nt, Shigella flexneri 2a str. 2457T
uucaccugcugauuaucggc

SEQ ID NO: 3853452 - RNA, 16 nt, Shigella flexneri 2a str. 2457T
uucacgaauauuuccc

SEQ ID NO: 3853453 - RNA, 23 nt, Shigella flexneri 2a str. 2457T
uucacgaaucuauucauuuaugu

SEQ ID NO: 3853454 - RNA, 17 nt, Shigella flexneri 2a str. 2457T
uucacgacgcauccggc

SEQ ID NO: 3853455 - RNA, 15 nt, Shigella flexneri 2a str. 2457T
uucacgcaaggcaca

SEQ ID NO: 3853456 - RNA, 14 nt, Shigella flexneri 2a str. 2457T
uucacgcacuuccg

SEQ ID NO: 3853457 - RNA, 19 nt, Shigella flexneri 2a str. 2457T
uucacgcacuuccggugcc

SEQ ID NO: 3853458 - RNA, 18 nt, Shigella flexneri 2a str. 2457T
uucacgcaggcgagaauc

SEQ ID NO: 3853459 - RNA, 18 nt, Shigella flexneri 2a str. 2457T
uucacgccaaccagcuga

SEQ ID NO: 3853460 - RNA, 21 nt, Shigella flexneri 2a str. 2457T
uucacgcccgccccaguaaau

SEQ ID NO: 3853461 - RNA, 18 nt, Shigella flexneri 2a str. 2457T
uucacgccgcauccggca

SEQ ID NO: 3853462 - RNA, 19 nt, Shigella flexneri 2a str. 2457T
uucacgccgcauccggcaa

SEQ ID NO: 3853463 - RNA, 23 nt, Shigella flexneri 2a str. 2457T
uucacgccgcauccggcaaguug

SEQ ID NO: 3853464 - RNA, 23 nt, Shigella flexneri 2a str. 2457T
uucacgccgcauccggcaauaag

SEQ ID NO: 3853465 - RNA, 18 nt, Shigella flexneri 2a str. 2457T
uucacgccgcaucuggca

SEQ ID NO: 3853466 - RNA, 18 nt, Shigella flexneri 2a str. 2457T
uucacgcuaaaagcgauu

SEQ ID NO: 3853467 - RNA, 21 nt, Shigella flexneri 2a str. 2457T
uucacgcuaauaccggaugcc

SEQ ID NO: 3853468 - RNA, 13 nt, Shigella flexneri 2a str. 2457T
uucacgcugucgg

SEQ ID NO: 3853469 - RNA, 19 nt, Shigella flexneri 2a str. 2457T
uucacgcuuugcaggcugg

SEQ ID NO: 3853470 - RNA, 13 nt, Shigella flexneri 2a str. 2457T
uucacggcaccag

SEQ ID NO: 3853471 - RNA, 17 nt, Shigella flexneri 2a str. 2457T
uucacggcaccagccau

SEQ ID NO: 3853472 - RNA, 20 nt, Shigella flexneri 2a str. 2457T
uucacggcuuugucauuaaa

SEQ ID NO: 3853473 - RNA, 16 nt, Shigella flexneri 2a str. 2457T
uucacgguauuauuca

SEQ ID NO: 3853474 - RNA, 15 nt, Shigella flexneri 2a str. 2457T
uucacguucacccau

SEQ ID NO: 3853475 - RNA, 13 nt, Shigella flexneri 2a str. 2457T
uucacuauuucuu

SEQ ID NO: 3853476 - RNA, 12 nt, Shigella flexneri 2a str. 2457T
uucacucacgcc

SEQ ID NO: 3853477 - RNA, 13 nt, Shigella flexneri 2a str. 2457T
uucacucacgccg

SEQ ID NO: 3853478 - RNA, 19 nt, Shigella flexneri 2a str. 2457T
uucacucacgccguuaacu

SEQ ID NO: 3853479 - RNA, 16 nt, Shigella flexneri 2a str. 2457T
uucacugacgcccguu

SEQ ID NO: 3853480 - RNA, 22 nt, Shigella flexneri 2a str. 2457T
uucacugacuuuucgucuuacu

SEQ ID NO: 3853481 - RNA, 13 nt, Shigella flexneri 2a str. 2457T
uucaucucaaaca

SEQ ID NO: 3853482 - RNA, 13 nt, Shigella flexneri 2a str. 2457T
uucaucucaguga

SEQ ID NO: 3853483 - RNA, 15 nt, Shigella flexneri 2a str. 2457T
uucaucucuucuucc

SEQ ID NO: 3853484 - RNA, 14 nt, Shigella flexneri 2a str. 2457T
uucaugcacuuggu

SEQ ID NO: 3853485 - RNA, 15 nt, Shigella flexneri 2a str. 2457T
uucaugccauccgca

SEQ ID NO: 3853486 - RNA, 17 nt, Shigella flexneri 2a str. 2457T
uucaugcuauuccuuga

SEQ ID NO: 3853487 - RNA, 14 nt, Shigella flexneri 2a str. 2457T
uucaugcuccagca

SEQ ID NO: 3853488 - RNA, 17 nt, Shigella flexneri 2a str. 2457T
uucauggaugguugaac

SEQ ID NO: 3853489 - RNA, 21 nt, Shigella flexneri 2a str. 2457T
uucaugguacgggacagcagg

SEQ ID NO: 3853490 - RNA, 22 nt, Shigella flexneri 2a str. 2457T
uucaugguacgggacagcaggu

SEQ ID NO: 3853491 - RNA, 16 nt, Shigella flexneri 2a str. 2457T
uucauggugcaagaaa

SEQ ID NO: 3853492 - RNA, 21 nt, Shigella flexneri 2a str. 2457T
uucauggugcaagaaaugaca

SEQ ID NO: 3853493 - RNA, 15 nt, Shigella flexneri 2a str. 2457T
uucauuaaagccgcc

SEQ ID NO: 3853494 - RNA, 16 nt, Shigella flexneri 2a str. 2457T
uucauuaccaaccuga

SEQ ID NO: 3853495 - RNA, 19 nt, Shigella flexneri 2a str. 2457T
uucauuaugaucaaaauca

SEQ ID NO: 3853496 - RNA, 22 nt, Shigella flexneri 2a str. 2457T
uucauugaacgggugauuuccc

SEQ ID NO: 3853497 - RNA, 13 nt, Shigella flexneri 2a str. 2457T
uucauuguugacu

SEQ ID NO: 3853498 - RNA, 13 nt, Shigella flexneri 2a str. 2457T
uucauuuacauca

SEQ ID NO: 3853499 - RNA, 13 nt, Shigella flexneri 2a str. 2457T
uucauuugccagc

SEQ ID NO: 3853500 - RNA, 15 nt, Shigella flexneri 2a str. 2457T
uucauuuuucucaac

SEQ ID NO: 3853501 - RNA, 21 nt, Shigella flexneri 2a str. 2457T
uuccaacuguaccagcaacug

SEQ ID NO: 3853502 - RNA, 20 nt, Shigella flexneri 2a str. 2457T
uuccaagauuaaaggcacca

SEQ ID NO: 3853503 - RNA, 17 nt, Shigella flexneri 2a str. 2457T
uuccacagcucacggcc

SEQ ID NO: 3853504 - RNA, 18 nt, Shigella flexneri 2a str. 2457T
uuccacagcucacggccc

SEQ ID NO: 3853505 - RNA, 21 nt, Shigella flexneri 2a str. 2457T
uuccacccacggcguuaacug

SEQ ID NO: 3853506 - RNA, 16 nt, Shigella flexneri 2a str. 2457T
uuccacgcaucaagca

SEQ ID NO: 3853507 - RNA, 21 nt, Shigella flexneri 2a str. 2457T
uuccacgccugcauccgccau

SEQ ID NO: 3853508 - RNA, 19 nt, Shigella flexneri 2a str. 2457T
uuccacggaauauuucacc

SEQ ID NO: 3853509 - RNA, 19 nt, Shigella flexneri 2a str. 2457T
uuccacucuuucagcacca

SEQ ID NO: 3853510 - RNA, 12 nt, Shigella flexneri 2a str. 2457T
uuccacuucauc

SEQ ID NO: 3853511 - RNA, 17 nt, Shigella flexneri 2a str. 2457T
uuccacuuucacgccca

SEQ ID NO: 3853512 - RNA, 13 nt, Shigella flexneri 2a str. 2457T
uuccagaauaucu

SEQ ID NO: 3853513 - RNA, 14 nt, Shigella flexneri 2a str. 2457T
uuccagacucaaca

SEQ ID NO: 3853514 - RNA, 18 nt, Shigella flexneri 2a str. 2457T
uuccagacucaacaggcc

SEQ ID NO: 3853515 - RNA, 23 nt, Shigella flexneri 2a str. 2457T
uuccagaucaccgcagaagcgau

SEQ ID NO: 3853516 - RNA, 22 nt, Shigella flexneri 2a str. 2457T
uuccagcagaccagcaauaacu

SEQ ID NO: 3853517 - RNA, 19 nt, Shigella flexneri 2a str. 2457T
uuccagcagauauugcccc

SEQ ID NO: 3853518 - RNA, 14 nt, Shigella flexneri 2a str. 2457T
uuccagcaguucca

SEQ ID NO: 3853519 - RNA, 14 nt, Shigella flexneri 2a str. 2457T
uuccagcaguucgc

SEQ ID NO: 3853520 - RNA, 19 nt, Shigella flexneri 2a str. 2457T
uuccagcauaaugacucuc

SEQ ID NO: 3853521 - RNA, 11 nt, Shigella flexneri 2a str. 2457T
uuccagcaucg

SEQ ID NO: 3853522 - RNA, 16 nt, Shigella flexneri 2a str. 2457T
uuccagcggcaggccg

SEQ ID NO: 3853523 - RNA, 18 nt, Shigella flexneri 2a str. 2457T
uuccagcgguaacuuauc

SEQ ID NO: 3853524 - RNA, 18 nt, Shigella flexneri 2a str. 2457T
uuccagcuccauccacca

SEQ ID NO: 3853525 - RNA, 18 nt, Shigella flexneri 2a str. 2457T
uuccagcucggcaaucug

SEQ ID NO: 3853526 - RNA, 12 nt, Shigella flexneri 2a str. 2457T
uuccagcucuua

SEQ ID NO: 3853527 - RNA, 13 nt, Shigella flexneri 2a str. 2457T
uuccagcuucaaa

SEQ ID NO: 3853528 - RNA, 23 nt, Shigella flexneri 2a str. 2457T
uuccagcuucaaauuagccgcag

SEQ ID NO: 3853529 - RNA, 20 nt, Shigella flexneri 2a str. 2457T
uuccagcuucgcuaccugag

SEQ ID NO: 3853530 - RNA, 13 nt, Shigella flexneri 2a str. 2457T
uuccaggcaucag

SEQ ID NO: 3853531 - RNA, 15 nt, Shigella flexneri 2a str. 2457T
uuccaggcaucagca

SEQ ID NO: 3853532 - RNA, 16 nt, Shigella flexneri 2a str. 2457T
uuccagggccucuccu

SEQ ID NO: 3853533 - RNA, 22 nt, Shigella flexneri 2a str. 2457T
uuccagucggcguaauccugaa

SEQ ID NO: 3853534 - RNA, 23 nt, Shigella flexneri 2a str. 2457T
uuccagucggcguaauccugaaa

SEQ ID NO: 3853535 - RNA, 22 nt, Shigella flexneri 2a str. 2457T
uuccaguguuuccggaauuaaa

SEQ ID NO: 3853536 - RNA, 22 nt, Shigella flexneri 2a str. 2457T
uuccaguuccggcaucgacagu

SEQ ID NO: 3853537 - RNA, 23 nt, Shigella flexneri 2a str. 2457T
uuccauaaucgacucccgcgccg

SEQ ID NO: 3853538 - RNA, 18 nt, Shigella flexneri 2a str. 2457T
uuccauaccgaccaugua

SEQ ID NO: 3853539 - RNA, 14 nt, Shigella flexneri 2a str. 2457T
uuccaucuccagcu

SEQ ID NO: 3853540 - RNA, 17 nt, Shigella flexneri 2a str. 2457T
uuccaucuuuccucacu

SEQ ID NO: 3853541 - RNA, 16 nt, Shigella flexneri 2a str. 2457T
uuccauugccgcuuuc

SEQ ID NO: 3853542 - RNA, 13 nt, Shigella flexneri 2a str. 2457T
uuccauugccguu

SEQ ID NO: 3853543 - RNA, 16 nt, Shigella flexneri 2a str. 2457T
uuccauuucaucgcca

SEQ ID NO: 3853544 - RNA, 17 nt, Shigella flexneri 2a str. 2457T
uuccauuuuucacuuaa

SEQ ID NO: 3853545 - RNA, 14 nt, Shigella flexneri 2a str. 2457T
uucccaacaacagc

SEQ ID NO: 3853546 - RNA, 17 nt, Shigella flexneri 2a str. 2457T
uucccaacaacagcgcg

SEQ ID NO: 3853547 - RNA, 15 nt, Shigella flexneri 2a str. 2457T
uucccagcaagaacc

SEQ ID NO: 3853548 - RNA, 12 nt, Shigella flexneri 2a str. 2457T
uucccaggcacc

SEQ ID NO: 3853549 - RNA, 18 nt, Shigella flexneri 2a str. 2457T
uucccaucucaauauuag

SEQ ID NO: 3853550 - RNA, 12 nt, Shigella flexneri 2a str. 2457T
uuccccagacga

SEQ ID NO: 3853551 - RNA, 12 nt, Shigella flexneri 2a str. 2457T
uucccccacagc

SEQ ID NO: 3853552 - RNA, 14 nt, Shigella flexneri 2a str. 2457T
uucccccugccaga

SEQ ID NO: 3853553 - RNA, 17 nt, Shigella flexneri 2a str. 2457T
uucccccuuugaccagc

SEQ ID NO: 3853554 - RNA, 20 nt, Shigella flexneri 2a str. 2457T
uuccccggaaccugaacucg

SEQ ID NO: 3853555 - RNA, 15 nt, Shigella flexneri 2a str. 2457T
uuccccuaacucuuu

SEQ ID NO: 3853556 - RNA, 12 nt, Shigella flexneri 2a str. 2457T
uuccccucugcg

SEQ ID NO: 3853557 - RNA, 23 nt, Shigella flexneri 2a str. 2457T
uuccccuguaacgagaaguuuuu

SEQ ID NO: 3853558 - RNA, 23 nt, Shigella flexneri 2a str. 2457T
uuccccuguugugccagaccaaa

SEQ ID NO: 3853559 - RNA, 15 nt, Shigella flexneri 2a str. 2457T
uuccccuugauaacg

SEQ ID NO: 3853560 - RNA, 21 nt, Shigella flexneri 2a str. 2457T
uucccgagacauuccuuuacu

SEQ ID NO: 3853561 - RNA, 23 nt, Shigella flexneri 2a str. 2457T
uucccgagcggccaaagggagca

SEQ ID NO: 3853562 - RNA, 13 nt, Shigella flexneri 2a str. 2457T
uucccgcaacacc

SEQ ID NO: 3853563 - RNA, 14 nt, Shigella flexneri 2a str. 2457T
uucccgggcuucuc

SEQ ID NO: 3853564 - RNA, 21 nt, Shigella flexneri 2a str. 2457T
uucccgggucgcgacugccag

SEQ ID NO: 3853565 - RNA, 18 nt, Shigella flexneri 2a str. 2457T
uucccucccguuucccug

SEQ ID NO: 3853566 - RNA, 13 nt, Shigella flexneri 2a str. 2457T
uucccugacaaau

SEQ ID NO: 3853567 - RNA, 21 nt, Shigella flexneri 2a str. 2457T
uucccugcugaauccccuucu

SEQ ID NO: 3853568 - RNA, 22 nt, Shigella flexneri 2a str. 2457T
uucccuggcguucgguauuaau

SEQ ID NO: 3853569 - RNA, 23 nt, Shigella flexneri 2a str. 2457T
uuccgaccaggcguucugccugg

SEQ ID NO: 3853570 - RNA, 13 nt, Shigella flexneri 2a str. 2457T
uuccgaugagcga

SEQ ID NO: 3853571 - RNA, 14 nt, Shigella flexneri 2a str. 2457T
uuccgcaauacagc

SEQ ID NO: 3853572 - RNA, 20 nt, Shigella flexneri 2a str. 2457T
uuccgccagcgacugcgccg

SEQ ID NO: 3853573 - RNA, 14 nt, Shigella flexneri 2a str. 2457T
uuccgccgguugcc

SEQ ID NO: 3853574 - RNA, 18 nt, Shigella flexneri 2a str. 2457T
uuccgcgcaaucgcccag

SEQ ID NO: 3853575 - RNA, 22 nt, Shigella flexneri 2a str. 2457T
uuccgcgcaaucgcccagcgcg

SEQ ID NO: 3853576 - RNA, 20 nt, Shigella flexneri 2a str. 2457T
uuccgcgucaaucugcccga

SEQ ID NO: 3853577 - RNA, 21 nt, Shigella flexneri 2a str. 2457T
uuccgcugcaaguuuugucag

SEQ ID NO: 3853578 - RNA, 14 nt, Shigella flexneri 2a str. 2457T
uuccggacguucag

SEQ ID NO: 3853579 - RNA, 15 nt, Shigella flexneri 2a str. 2457T
uucgcugacaguacc

SEQ ID NO: 3853580 - RNA, 16 nt, Shigella flexneri 2a str. 2457T
uucgcuggaauaaucg

SEQ ID NO: 3853581 - RNA, 18 nt, Shigella flexneri 2a str. 2457T
uucgcuggaauaaucgua

SEQ ID NO: 3853582 - RNA, 16 nt, Shigella flexneri 2a str. 2457T
uucgcuggauuuuuga

SEQ ID NO: 3853583 - RNA, 16 nt, Shigella flexneri 2a str. 2457T
uucgcuuaccaugcca

SEQ ID NO: 3853584 - RNA, 18 nt, Shigella flexneri 2a str. 2457T
uucgcuuacgccugccag

SEQ ID NO: 3853585 - RNA, 17 nt, Shigella flexneri 2a str. 2457T
uucgcuuuaucgccuac

SEQ ID NO: 3853586 - RNA, 14 nt, Shigella flexneri 2a str. 2457T
uucgcuuucacuca

SEQ ID NO: 3853587 - RNA, 17 nt, Shigella flexneri 2a str. 2457T
uucgcuuucacucagug

SEQ ID NO: 3853588 - RNA, 14 nt, Shigella flexneri 2a str. 2457T
uucgcuuucggugc

SEQ ID NO: 3853589 - RNA, 16 nt, Shigella flexneri 2a str. 2457T
uucggacguuugccau

SEQ ID NO: 3853590 - RNA, 17 nt, Shigella flexneri 2a str. 2457T
uucggacguuugccaug

SEQ ID NO: 3853591 - RNA, 18 nt, Shigella flexneri 2a str. 2457T
uucggcaaccgcauccag

SEQ ID NO: 3853592 - RNA, 13 nt, Shigella flexneri 2a str. 2457T
uucggcaaucacc

SEQ ID NO: 3853593 - RNA, 13 nt, Shigella flexneri 2a str. 2457T
uucggcaauccag

SEQ ID NO: 3853594 - RNA, 20 nt, Shigella flexneri 2a str. 2457T
uucggcauacauaaucaaua

SEQ ID NO: 3853595 - RNA, 17 nt, Shigella flexneri 2a str. 2457T
uucggccauauccagcc

SEQ ID NO: 3853596 - RNA, 19 nt, Shigella flexneri 2a str. 2457T
uucggcgcagucacaccag

SEQ ID NO: 3853597 - RNA, 18 nt, Shigella flexneri 2a str. 2457T
uucggcgucuuguugaac

SEQ ID NO: 3853598 - RNA, 18 nt, Shigella flexneri 2a str. 2457T
uucggggcuaaugccagu

SEQ ID NO: 3853599 - RNA, 20 nt, Shigella flexneri 2a str. 2457T
uucgguaaugacuccaacuu

SEQ ID NO: 3853600 - RNA, 22 nt, Shigella flexneri 2a str. 2457T
uucgguauuaaucugccagcgu

SEQ ID NO: 3853601 - RNA, 23 nt, Shigella flexneri 2a str. 2457T
uucgguccgacgugcucgaacau

SEQ ID NO: 3853602 - RNA, 14 nt, Shigella flexneri 2a str. 2457T
uucggugacagaaa

SEQ ID NO: 3853603 - RNA, 18 nt, Shigella flexneri 2a str. 2457T
uucggugauauacgucac

SEQ ID NO: 3853604 - RNA, 15 nt, Shigella flexneri 2a str. 2457T
uucgguucaaguccc

SEQ ID NO: 3853605 - RNA, 15 nt, Shigella flexneri 2a str. 2457T
uucgguugccagcgc

SEQ ID NO: 3853606 - RNA, 17 nt, Shigella flexneri 2a str. 2457T
uucguaaguacauuaaa

SEQ ID NO: 3853607 - RNA, 14 nt, Shigella flexneri 2a str. 2457T
uucguaauaauuca

SEQ ID NO: 3853608 - RNA, 20 nt, Shigella flexneri 2a str. 2457T
uucguaauaauucacggccc

SEQ ID NO: 3853609 - RNA, 12 nt, Shigella flexneri 2a str. 2457T
uucguauuuaaa

SEQ ID NO: 3853610 - RNA, 21 nt, Shigella flexneri 2a str. 2457T
uucgucccagucgucauccca

SEQ ID NO: 3853611 - RNA, 22 nt, Shigella flexneri 2a str. 2457T
uucgucguaguaguucaucccc

SEQ ID NO: 3853612 - RNA, 19 nt, Shigella flexneri 2a str. 2457T
uucguguggaguaauaauu

SEQ ID NO: 3853613 - RNA, 19 nt, Shigella flexneri 2a str. 2457T
uucguuacgcggcauugca

SEQ ID NO: 3853614 - RNA, 23 nt, Shigella flexneri 2a str. 2457T
uucguuagguucucucagucuuu

SEQ ID NO: 3853615 - RNA, 17 nt, Shigella flexneri 2a str. 2457T
uucguuuuaaugcgauc

SEQ ID NO: 3853616 - RNA, 17 nt, Shigella flexneri 2a str. 2457T
uucuaaauguucaauaa

SEQ ID NO: 3853617 - RNA, 23 nt, Shigella flexneri 2a str. 2457T
uucuaacgacauuuucugcccau

SEQ ID NO: 3853618 - RNA, 20 nt, Shigella flexneri 2a str. 2457T
uucuaauuuuuccagcauuu

SEQ ID NO: 3853619 - RNA, 14 nt, Shigella flexneri 2a str. 2457T
uucuacaagcagag

SEQ ID NO: 3853620 - RNA, 16 nt, Shigella flexneri 2a str. 2457T
uucuacacccagcccc

SEQ ID NO: 3853621 - RNA, 15 nt, Shigella flexneri 2a str. 2457T
uucuacgaugcgaua

SEQ ID NO: 3853622 - RNA, 20 nt, Shigella flexneri 2a str. 2457T
uucuacggguaaguguuuca

SEQ ID NO: 3853623 - RNA, 18 nt, Shigella flexneri 2a str. 2457T
uucuacgugcgcuaugug

SEQ ID NO: 3853624 - RNA, 23 nt, Shigella flexneri 2a str. 2457T
uucuacgugcgcuauguguuaaa

SEQ ID NO: 3853625 - RNA, 21 nt, Shigella flexneri 2a str. 2457T
uucuauaccgugcacaauauu

SEQ ID NO: 3853626 - RNA, 19 nt, Shigella flexneri 2a str. 2457T
uucuaucaaccugaggcuc

SEQ ID NO: 3853627 - RNA, 14 nt, Shigella flexneri 2a str. 2457T
uucuaugaagaacu

SEQ ID NO: 3853628 - RNA, 20 nt, Shigella flexneri 2a str. 2457T
uucucaauaaaaggaaacag

SEQ ID NO: 3853629 - RNA, 16 nt, Shigella flexneri 2a str. 2457T
uucucaaucugcuugc

SEQ ID NO: 3853630 - RNA, 14 nt, Shigella flexneri 2a str. 2457T
uucucaccagcuga

SEQ ID NO: 3853631 - RNA, 21 nt, Shigella flexneri 2a str. 2457T
uucuccagcgaauccguucuu

SEQ ID NO: 3853632 - RNA, 21 nt, Shigella flexneri 2a str. 2457T
uucucccugguucaagagaga

SEQ ID NO: 3853633 - RNA, 17 nt, Shigella flexneri 2a str. 2457T
uucuccgcguucaauac

SEQ ID NO: 3853634 - RNA, 15 nt, Shigella flexneri 2a str. 2457T
uucuccugaaguagc

SEQ ID NO: 3853635 - RNA, 17 nt, Shigella flexneri 2a str. 2457T
uucuccuucacucuaua

SEQ ID NO: 3853636 - RNA, 17 nt, Shigella flexneri 2a str. 2457T
uucucgauaaaaccuuc

SEQ ID NO: 3853637 - RNA, 18 nt, Shigella flexneri 2a str. 2457T
uucucgcccagcagacgu

SEQ ID NO: 3853638 - RNA, 18 nt, Shigella flexneri 2a str. 2457T
uucucgccguggcuguug

SEQ ID NO: 3853639 - RNA, 15 nt, Shigella flexneri 2a str. 2457T
uucucggcaauaauu

SEQ ID NO: 3853640 - RNA, 19 nt, Shigella flexneri 2a str. 2457T
uucucggcaucacgcuuga

SEQ ID NO: 3853641 - RNA, 14 nt, Shigella flexneri 2a str. 2457T
uucucuauuucacc

SEQ ID NO: 3853642 - RNA, 20 nt, Shigella flexneri 2a str. 2457T
uucucucaauccgccaaaac

SEQ ID NO: 3853643 - RNA, 17 nt, Shigella flexneri 2a str. 2457T
uucucugacgcucucua

SEQ ID NO: 3853644 - RNA, 17 nt, Shigella flexneri 2a str. 2457T
uucucuguucagccuga

SEQ ID NO: 3853645 - RNA, 15 nt, Shigella flexneri 2a str. 2457T
uucucuuucggcagu

SEQ ID NO: 3853646 - RNA, 16 nt, Shigella flexneri 2a str. 2457T
uucugaacugaacaaa

SEQ ID NO: 3853647 - RNA, 22 nt, Shigella flexneri 2a str. 2457T
uucugaacugaacaaaaaagag

SEQ ID NO: 3853648 - RNA, 20 nt, Shigella flexneri 2a str. 2457T
uucugaaggaauauucaggc

SEQ ID NO: 3853649 - RNA, 21 nt, Shigella flexneri 2a str. 2457T
uucugagagcaugaaaugaaa

SEQ ID NO: 3853650 - RNA, 19 nt, Shigella flexneri 2a str. 2457T
uucugagaucaaugcgcca

SEQ ID NO: 3853651 - RNA, 14 nt, Shigella flexneri 2a str. 2457T
uucugagcaucaca

SEQ ID NO: 3853652 - RNA, 20 nt, Shigella flexneri 2a str. 2457T
uucugagcggccuuuuccuu

SEQ ID NO: 3853653 - RNA, 13 nt, Shigella flexneri 2a str. 2457T
uucugauccugca

SEQ ID NO: 3853654 - RNA, 20 nt, Shigella flexneri 2a str. 2457T
uucugauugccgcuuucggc

SEQ ID NO: 3853655 - RNA, 20 nt, Shigella flexneri 2a str. 2457T
uucugauuuaaucuguauca

SEQ ID NO: 3853656 - RNA, 23 nt, Shigella flexneri 2a str. 2457T
uucugcaauauauugaauuugga

SEQ ID NO: 3853657 - RNA, 18 nt, Shigella flexneri 2a str. 2457T
uucugcacuuuucugggu

SEQ ID NO: 3853658 - RNA, 13 nt, Shigella flexneri 2a str. 2457T
uucugcagcucca

SEQ ID NO: 3853659 - RNA, 23 nt, Shigella flexneri 2a str. 2457T
uucugccaaacgcucccugccag

SEQ ID NO: 3853660 - RNA, 21 nt, Shigella flexneri 2a str. 2457T
uucugccacgccacgcugccg

SEQ ID NO: 3853661 - RNA, 19 nt, Shigella flexneri 2a str. 2457T
uucugccgcgcacgucagc

SEQ ID NO: 3853662 - RNA, 17 nt, Shigella flexneri 2a str. 2457T
uucugccgcuuccagca

SEQ ID NO: 3853663 - RNA, 18 nt, Shigella flexneri 2a str. 2457T
uucugccgcuuccagcag

SEQ ID NO: 3853664 - RNA, 13 nt, Shigella flexneri 2a str. 2457T
uucugcgacguga

SEQ ID NO: 3853665 - RNA, 18 nt, Shigella flexneri 2a str. 2457T
uucugcgcacacacgccc

SEQ ID NO: 3853666 - RNA, 19 nt, Shigella flexneri 2a str. 2457T
uucugcguucugauuuaau

SEQ ID NO: 3853667 - RNA, 19 nt, Shigella flexneri 2a str. 2457T
uucugcucgcgguuaaguu

SEQ ID NO: 3853668 - RNA, 18 nt, Shigella flexneri 2a str. 2457T
uucugcuuuucccuccac

SEQ ID NO: 3853669 - RNA, 19 nt, Shigella flexneri 2a str. 2457T
uucuggaaguaaucacgaa

SEQ ID NO: 3853670 - RNA, 22 nt, Shigella flexneri 2a str. 2457T
uucuggcagcgcgcauucagca

SEQ ID NO: 3853671 - RNA, 12 nt, Shigella flexneri 2a str. 2457T
uucuggcaucac

SEQ ID NO: 3853672 - RNA, 19 nt, Shigella flexneri 2a str. 2457T
uucuggcgcgaacagcaca

SEQ ID NO: 3853673 - RNA, 14 nt, Shigella flexneri 2a str. 2457T
uucuggcggcggug

SEQ ID NO: 3853674 - RNA, 21 nt, Shigella flexneri 2a str. 2457T
uucuggcugacauaaacacca

SEQ ID NO: 3853675 - RNA, 12 nt, Shigella flexneri 2a str. 2457T
uucugguaacag

SEQ ID NO: 3853676 - RNA, 21 nt, Shigella flexneri 2a str. 2457T
uugauccaggagcuccagguc

SEQ ID NO: 3853677 - RNA, 21 nt, Shigella flexneri 2a str. 2457T
uugauccccgcuuccugcagc

SEQ ID NO: 3853678 - RNA, 18 nt, Shigella flexneri 2a str. 2457T
uugaucgcaccuuaucga

SEQ ID NO: 3853679 - RNA, 16 nt, Shigella flexneri 2a str. 2457T
uugaucgccaaagaaa

SEQ ID NO: 3853680 - RNA, 20 nt, Shigella flexneri 2a str. 2457T
uugaugaguugaaaaccucu

SEQ ID NO: 3853681 - RNA, 14 nt, Shigella flexneri 2a str. 2457T
uugaugccguucca

SEQ ID NO: 3853682 - RNA, 19 nt, Shigella flexneri 2a str. 2457T
uugaugcgaguaaucaggc

SEQ ID NO: 3853683 - RNA, 13 nt, Shigella flexneri 2a str. 2457T
uugaugguaaaau

SEQ ID NO: 3853684 - RNA, 12 nt, Shigella flexneri 2a str. 2457T
uugauguacgcu

SEQ ID NO: 3853685 - RNA, 17 nt, Shigella flexneri 2a str. 2457T
uugauguccaguuccca

SEQ ID NO: 3853686 - RNA, 22 nt, Shigella flexneri 2a str. 2457T
uugaugugaaaacucuuagcaa

SEQ ID NO: 3853687 - RNA, 19 nt, Shigella flexneri 2a str. 2457T
uugaugugcuucaucagac

SEQ ID NO: 3853688 - RNA, 19 nt, Shigella flexneri 2a str. 2457T
uugauguugguaaccaaau

SEQ ID NO: 3853689 - RNA, 13 nt, Shigella flexneri 2a str. 2457T
uugauuaaaggaa

SEQ ID NO: 3853690 - RNA, 16 nt, Shigella flexneri 2a str. 2457T
uugauucuguucagua

SEQ ID NO: 3853691 - RNA, 13 nt, Shigella flexneri 2a str. 2457T
uugauuuaucagg

SEQ ID NO: 3853692 - RNA, 12 nt, Shigella flexneri 2a str. 2457T
uugauuuuauug

SEQ ID NO: 3853693 - RNA, 16 nt, Shigella flexneri 2a str. 2457T
uugauuuugcauuuua

SEQ ID NO: 3853694 - RNA, 18 nt, Shigella flexneri 2a str. 2457T
uugauuuuuuugauaaac

SEQ ID NO: 3853695 - RNA, 16 nt, Shigella flexneri 2a str. 2457T
uugcaacauguugaau

SEQ ID NO: 3853696 - RNA, 16 nt, Shigella flexneri 2a str. 2457T
uugcaacgaacgcauc

SEQ ID NO: 3853697 - RNA, 19 nt, Shigella flexneri 2a str. 2457T
uugcaagccuguaguacaa

SEQ ID NO: 3853698 - RNA, 18 nt, Shigella flexneri 2a str. 2457T
uugcaaucagauaaaaua

SEQ ID NO: 3853699 - RNA, 20 nt, Shigella flexneri 2a str. 2457T
uugcaaucagauaaaauaca

SEQ ID NO: 3853700 - RNA, 19 nt, Shigella flexneri 2a str. 2457T
uugcaauuucccugacauu

SEQ ID NO: 3853701 - RNA, 16 nt, Shigella flexneri 2a str. 2457T
uugcacagacuuaaua

SEQ ID NO: 3853702 - RNA, 23 nt, Shigella flexneri 2a str. 2457T
uugcacagguggcaaacgccacc

SEQ ID NO: 3853703 - RNA, 21 nt, Shigella flexneri 2a str. 2457T
uugcaccagcaacaagccagu

SEQ ID NO: 3853704 - RNA, 20 nt, Shigella flexneri 2a str. 2457T
uugcaccauccauuuuucac

SEQ ID NO: 3853705 - RNA, 17 nt, Shigella flexneri 2a str. 2457T
uugcaccgggcuuuuuu

SEQ ID NO: 3853706 - RNA, 14 nt, Shigella flexneri 2a str. 2457T
uugcaccugaucca

SEQ ID NO: 3853707 - RNA, 19 nt, Shigella flexneri 2a str. 2457T
uugcaccugauccagcucu

SEQ ID NO: 3853708 - RNA, 20 nt, Shigella flexneri 2a str. 2457T
uugcacgcagacacugcuga

SEQ ID NO: 3853709 - RNA, 12 nt, Shigella flexneri 2a str. 2457T
uugcagaaacau

SEQ ID NO: 3853710 - RNA, 15 nt, Shigella flexneri 2a str. 2457T
uugcagaaacauaau

SEQ ID NO: 3853711 - RNA, 22 nt, Shigella flexneri 2a str. 2457T
uugcagacccguuaagcguuca

SEQ ID NO: 3853712 - RNA, 14 nt, Shigella flexneri 2a str. 2457T
uugcagagcauccu

SEQ ID NO: 3853713 - RNA, 19 nt, Shigella flexneri 2a str. 2457T
uugcagaggugcugaaagg

SEQ ID NO: 3853714 - RNA, 16 nt, Shigella flexneri 2a str. 2457T
uugcagauaccacauc

SEQ ID NO: 3853715 - RNA, 16 nt, Shigella flexneri 2a str. 2457T
uugcagaucgccaaua

SEQ ID NO: 3853716 - RNA, 19 nt, Shigella flexneri 2a str. 2457T
uugcaggaaaaacugcccg

SEQ ID NO: 3853717 - RNA, 12 nt, Shigella flexneri 2a str. 2457T
uugcaggaucag

SEQ ID NO: 3853718 - RNA, 12 nt, Shigella flexneri 2a str. 2457T
uugcaggcuauu

SEQ ID NO: 3853719 - RNA, 22 nt, Shigella flexneri 2a str. 2457T
uugcagggaggcaagacaugcu

SEQ ID NO: 3853720 - RNA, 22 nt, Shigella flexneri 2a str. 2457T
uugcaggggagcgaauacuccc

SEQ ID NO: 3853721 - RNA, 21 nt, Shigella flexneri 2a str. 2457T
uugcaguuccugccagauuug

SEQ ID NO: 3853722 - RNA, 22 nt, Shigella flexneri 2a str. 2457T
uugcaguuccugccagauuugc

SEQ ID NO: 3853723 - RNA, 20 nt, Shigella flexneri 2a str. 2457T
uugcauaaugguggaguggc

SEQ ID NO: 3853724 - RNA, 22 nt, Shigella flexneri 2a str. 2457T
uugcauaaugguggaguggccc

SEQ ID NO: 3853725 - RNA, 17 nt, Shigella flexneri 2a str. 2457T
uugcauccggcauggca

SEQ ID NO: 3853726 - RNA, 16 nt, Shigella flexneri 2a str. 2457T
uugcaucgucuguuuu

SEQ ID NO: 3853727 - RNA, 22 nt, Shigella flexneri 2a str. 2457T
uugcaucgucuguuuuaucucc

SEQ ID NO: 3853728 - RNA, 23 nt, Shigella flexneri 2a str. 2457T
uugcauuacuacgguaauacaac

SEQ ID NO: 3853729 - RNA, 23 nt, Shigella flexneri 2a str. 2457T
uugcauuagcacaaacccagggc

SEQ ID NO: 3853730 - RNA, 15 nt, Shigella flexneri 2a str. 2457T
uugccaaauaucuua

SEQ ID NO: 3853731 - RNA, 19 nt, Shigella flexneri 2a str. 2457T
uugccaccccuuuugacuu

SEQ ID NO: 3853732 - RNA, 18 nt, Shigella flexneri 2a str. 2457T
uugccagaaauccaggcc

SEQ ID NO: 3853733 - RNA, 13 nt, Shigella flexneri 2a str. 2457T
uugccagaucgcc

SEQ ID NO: 3853734 - RNA, 20 nt, Shigella flexneri 2a str. 2457T
uugccagaucgccugccgcc

SEQ ID NO: 3853735 - RNA, 19 nt, Shigella flexneri 2a str. 2457T
uugccaguccuaaaaacag

SEQ ID NO: 3853736 - RNA, 20 nt, Shigella flexneri 2a str. 2457T
uugccaucaaucacuuugcg

SEQ ID NO: 3853737 - RNA, 15 nt, Shigella flexneri 2a str. 2457T
uugccaucaucacca

SEQ ID NO: 3853738 - RNA, 21 nt, Shigella flexneri 2a str. 2457T
uugccaugcauauccaggcua

SEQ ID NO: 3853739 - RNA, 16 nt, Shigella flexneri 2a str. 2457T
uugccauguugauccc

SEQ ID NO: 3853740 - RNA, 19 nt, Shigella flexneri 2a str. 2457T
uugccccagcgggaucggc

SEQ ID NO: 3853741 - RNA, 17 nt, Shigella flexneri 2a str. 2457T
uugcccccugaagcagu

SEQ ID NO: 3853742 - RNA, 16 nt, Shigella flexneri 2a str. 2457T
uugcccgcaagcugcg

SEQ ID NO: 3853743 - RNA, 17 nt, Shigella flexneri 2a str. 2457T
uugcccgguuucgccac

SEQ ID NO: 3853744 - RNA, 16 nt, Shigella flexneri 2a str. 2457T
uugcccucacccugua

SEQ ID NO: 3853745 - RNA, 21 nt, Shigella flexneri 2a str. 2457T
uugcccucugaauaacaccca

SEQ ID NO: 3853746 - RNA, 17 nt, Shigella flexneri 2a str. 2457T
uugcccuguuacaaacc

SEQ ID NO: 3853747 - RNA, 16 nt, Shigella flexneri 2a str. 2457T
uugccgaugucucgug

SEQ ID NO: 3853748 - RNA, 15 nt, Shigella flexneri 2a str. 2457T
uugccgcacuuaaua

SEQ ID NO: 3853749 - RNA, 18 nt, Shigella flexneri 2a str. 2457T
uugccgcagcaguugcca

SEQ ID NO: 3853750 - RNA, 18 nt, Shigella flexneri 2a str. 2457T
uugccgcgcucuuuaaag

SEQ ID NO: 3853751 - RNA, 20 nt, Shigella flexneri 2a str. 2457T
uugccggauauuccugaaug

SEQ ID NO: 3853752 - RNA, 15 nt, Shigella flexneri 2a str. 2457T
uugccggaugcgaca

SEQ ID NO: 3853753 - RNA, 22 nt, Shigella flexneri 2a str. 2457T
uugccggaugcggcguaaaugc

SEQ ID NO: 3853754 - RNA, 17 nt, Shigella flexneri 2a str. 2457T
uugccggaugugaugca

SEQ ID NO: 3853755 - RNA, 13 nt, Shigella flexneri 2a str. 2457T
uugccguaagcaa

SEQ ID NO: 3853756 - RNA, 20 nt, Shigella flexneri 2a str. 2457T
uugccgucgauaugcaaauc

SEQ ID NO: 3853757 - RNA, 18 nt, Shigella flexneri 2a str. 2457T
uugccgugccccauaugg

SEQ ID NO: 3853758 - RNA, 22 nt, Shigella flexneri 2a str. 2457T
uugccguuaaaacuaaaaacag

SEQ ID NO: 3853759 - RNA, 13 nt, Shigella flexneri 2a str. 2457T
uugccguuggcgg

SEQ ID NO: 3853760 - RNA, 18 nt, Shigella flexneri 2a str. 2457T
uugccguuuaccgccauc

SEQ ID NO: 3853761 - RNA, 20 nt, Shigella flexneri 2a str. 2457T
uugccugauggccugcucaa

SEQ ID NO: 3853762 - RNA, 14 nt, Shigella flexneri 2a str. 2457T
uugccugggugcaa

SEQ ID NO: 3853763 - RNA, 21 nt, Shigella flexneri 2a str. 2457T
uugccugugacuuucugagau

SEQ ID NO: 3853764 - RNA, 15 nt, Shigella flexneri 2a str. 2457T
uugccugugcaaccu

SEQ ID NO: 3853765 - RNA, 17 nt, Shigella flexneri 2a str. 2457T
uugccugugcaaccuuu

SEQ ID NO: 3853766 - RNA, 21 nt, Shigella flexneri 2a str. 2457T
uugcgagccuguaccacaacc

SEQ ID NO: 3853767 - RNA, 18 nt, Shigella flexneri 2a str. 2457T
uugcgauauucuucagua

SEQ ID NO: 3853768 - RNA, 17 nt, Shigella flexneri 2a str. 2457T
uugcgaucgaccugcgc

SEQ ID NO: 3853769 - RNA, 21 nt, Shigella flexneri 2a str. 2457T
uugcgcacaucaauuugccca

SEQ ID NO: 3853770 - RNA, 15 nt, Shigella flexneri 2a str. 2457T
uugcgcaguaccagc

SEQ ID NO: 3853771 - RNA, 16 nt, Shigella flexneri 2a str. 2457T
uugcgcauggcauuuu

SEQ ID NO: 3853772 - RNA, 18 nt, Shigella flexneri 2a str. 2457T
uugcgccacuaacgcauu

SEQ ID NO: 3853773 - RNA, 18 nt, Shigella flexneri 2a str. 2457T
uuguaugcguuucacaau

SEQ ID NO: 3853774 - RNA, 18 nt, Shigella flexneri 2a str. 2457T
uuguauuacaacgugcuc

SEQ ID NO: 3853775 - RNA, 19 nt, Shigella flexneri 2a str. 2457T
uuguauuuuaucugaggca

SEQ ID NO: 3853776 - RNA, 18 nt, Shigella flexneri 2a str. 2457T
uugucaacgacguaccaa

SEQ ID NO: 3853777 - RNA, 15 nt, Shigella flexneri 2a str. 2457T
uugucaagauugaua

SEQ ID NO: 3853778 - RNA, 21 nt, Shigella flexneri 2a str. 2457T
uugucagcaaucugauugaca

SEQ ID NO: 3853779 - RNA, 16 nt, Shigella flexneri 2a str. 2457T
uugucauaaccaaugu

SEQ ID NO: 3853780 - RNA, 19 nt, Shigella flexneri 2a str. 2457T
uugucauagcgacuaccac

SEQ ID NO: 3853781 - RNA, 17 nt, Shigella flexneri 2a str. 2457T
uugucaucaguuucaaa

SEQ ID NO: 3853782 - RNA, 17 nt, Shigella flexneri 2a str. 2457T
uuguccgcuauuucuug

SEQ ID NO: 3853783 - RNA, 15 nt, Shigella flexneri 2a str. 2457T
uugucgaaguuacca

SEQ ID NO: 3853784 - RNA, 18 nt, Shigella flexneri 2a str. 2457T
uugucgaaguuaccaccc

SEQ ID NO: 3853785 - RNA, 17 nt, Shigella flexneri 2a str. 2457T
uugucgauaaacaguuu

SEQ ID NO: 3853786 - RNA, 14 nt, Shigella flexneri 2a str. 2457T
uugucgauuuccau

SEQ ID NO: 3853787 - RNA, 16 nt, Shigella flexneri 2a str. 2457T
uugucuccaccaauga

SEQ ID NO: 3853788 - RNA, 18 nt, Shigella flexneri 2a str. 2457T
uugucuccaccaaugacg

SEQ ID NO: 3853789 - RNA, 16 nt, Shigella flexneri 2a str. 2457T
uugucucuucaugccu

SEQ ID NO: 3853790 - RNA, 16 nt, Shigella flexneri 2a str. 2457T
uugucugaacguuuug

SEQ ID NO: 3853791 - RNA, 21 nt, Shigella flexneri 2a str. 2457T
uugucuucaagaucagcggca

SEQ ID NO: 3853792 - RNA, 17 nt, Shigella flexneri 2a str. 2457T
uugucuuuuuaaugacu

SEQ ID NO: 3853793 - RNA, 18 nt, Shigella flexneri 2a str. 2457T
uugucuuuuuaaugacuu

SEQ ID NO: 3853794 - RNA, 20 nt, Shigella flexneri 2a str. 2457T
uugugaacgagaaaaugacg

SEQ ID NO: 3853795 - RNA, 14 nt, Shigella flexneri 2a str. 2457T
uugugaucuuuuuc

SEQ ID NO: 3853796 - RNA, 11 nt, Shigella flexneri 2a str. 2457T
uugugaugcaa

SEQ ID NO: 3853797 - RNA, 16 nt, Shigella flexneri 2a str. 2457T
uugugcaaauucaaua

SEQ ID NO: 3853798 - RNA, 20 nt, Shigella flexneri 2a str. 2457T
uugugcaaauucaauaaauu

SEQ ID NO: 3853799 - RNA, 14 nt, Shigella flexneri 2a str. 2457T
uugugcaccaccaa

SEQ ID NO: 3853800 - RNA, 15 nt, Shigella flexneri 2a str. 2457T
uugugcaccaccaaa

SEQ ID NO: 3853801 - RNA, 18 nt, Shigella flexneri 2a str. 2457T
uugugcacgugccagaug

SEQ ID NO: 3853802 - RNA, 16 nt, Shigella flexneri 2a str. 2457T
uugugcagcaugcacc

SEQ ID NO: 3853803 - RNA, 19 nt, Shigella flexneri 2a str. 2457T
uugugcgccacauccggca

SEQ ID NO: 3853804 - RNA, 17 nt, Shigella flexneri 2a str. 2457T
uuguguaaguuuaaccu

SEQ ID NO: 3853805 - RNA, 16 nt, Shigella flexneri 2a str. 2457T
uuguguuuauuuaaug

SEQ ID NO: 3853806 - RNA, 20 nt, Shigella flexneri 2a str. 2457T
uuguuaaauauuaaggguaa

SEQ ID NO: 3853807 - RNA, 22 nt, Shigella flexneri 2a str. 2457T
uuguuaacaacgugugcuuugu

SEQ ID NO: 3853808 - RNA, 20 nt, Shigella flexneri 2a str. 2457T
uuguuaaugugacagagcca

SEQ ID NO: 3853809 - RNA, 20 nt, Shigella flexneri 2a str. 2457T
uuguuauccaccgaaauaau

SEQ ID NO: 3853810 - RNA, 14 nt, Shigella flexneri 2a str. 2457T
uuguugauaaggaa

SEQ ID NO: 3853811 - RNA, 15 nt, Shigella flexneri 2a str. 2457T
uuguugcaggaacag

SEQ ID NO: 3853812 - RNA, 11 nt, Shigella flexneri 2a str. 2457T
uuguugccgcc

SEQ ID NO: 3853813 - RNA, 19 nt, Shigella flexneri 2a str. 2457T
uuguugccgcccguuuucu

SEQ ID NO: 3853814 - RNA, 20 nt, Shigella flexneri 2a str. 2457T
uuguugcgcuaagccugcug

SEQ ID NO: 3853815 - RNA, 20 nt, Shigella flexneri 2a str. 2457T
uuguugcuauggggaaaaau

SEQ ID NO: 3853816 - RNA, 14 nt, Shigella flexneri 2a str. 2457T
uuguuggcaaaaaa

SEQ ID NO: 3853817 - RNA, 18 nt, Shigella flexneri 2a str. 2457T
uuguuggcaaaaaaauuc

SEQ ID NO: 3853818 - RNA, 18 nt, Shigella flexneri 2a str. 2457T
uuguuggcgaaaaucuuu

SEQ ID NO: 3853819 - RNA, 21 nt, Shigella flexneri 2a str. 2457T
uuguuggcgaaaaucuuugca

SEQ ID NO: 3853820 - RNA, 13 nt, Shigella flexneri 2a str. 2457T
uuguugucacacc

SEQ ID NO: 3853821 - RNA, 19 nt, Shigella flexneri 2a str. 2457T
uuguuuaauggcaaaaacu

SEQ ID NO: 3853822 - RNA, 19 nt, Shigella flexneri 2a str. 2457T
uuguuuagauccauaucca

SEQ ID NO: 3853823 - RNA, 16 nt, Shigella flexneri 2a str. 2457T
uuguuuaugccggaug

SEQ ID NO: 3853824 - RNA, 22 nt, Shigella flexneri 2a str. 2457T
uuguuucaacacaggauacgca

SEQ ID NO: 3853825 - RNA, 15 nt, Shigella flexneri 2a str. 2457T
uuguuuccauaugua

SEQ ID NO: 3853826 - RNA, 15 nt, Shigella flexneri 2a str. 2457T
uuguuuuauaaagaa

SEQ ID NO: 3853827 - RNA, 14 nt, Shigella flexneri 2a str. 2457T
uuguuuucaugccg

SEQ ID NO: 3853828 - RNA, 18 nt, Shigella flexneri 2a str. 2457T
uuuaaaaagaaaaaacua

SEQ ID NO: 3853829 - RNA, 15 nt, Shigella flexneri 2a str. 2457T
uuuaaaaaguaaaac

SEQ ID NO: 3853830 - RNA, 20 nt, Shigella flexneri 2a str. 2457T
uuuaaaaccacuacccauau

SEQ ID NO: 3853831 - RNA, 18 nt, Shigella flexneri 2a str. 2457T
uuuaaacaauuucagaau

SEQ ID NO: 3853832 - RNA, 13 nt, Shigella flexneri 2a str. 2457T
uuuaaacagagau

SEQ ID NO: 3853833 - RNA, 19 nt, Shigella flexneri 2a str. 2457T
uuuaaacagagauuacuuu

SEQ ID NO: 3853834 - RNA, 22 nt, Shigella flexneri 2a str. 2457T
uuuaaacaucaaaccacuuaau

SEQ ID NO: 3853835 - RNA, 23 nt, Shigella flexneri 2a str. 2457T
uuuaaacaucaaaccacuuaauu

SEQ ID NO: 3853836 - RNA, 23 nt, Shigella flexneri 2a str. 2457T
uuuaaacccuacccggcaaguaa

SEQ ID NO: 3853837 - RNA, 20 nt, Shigella flexneri 2a str. 2457T
uuuaaagagacagaaucagg

SEQ ID NO: 3853838 - RNA, 17 nt, Shigella flexneri 2a str. 2457T
uuuaaagugcaaaaauu

SEQ ID NO: 3853839 - RNA, 19 nt, Shigella flexneri 2a str. 2457T
uuuaaauaucaucaaaauu

SEQ ID NO: 3853840 - RNA, 17 nt, Shigella flexneri 2a str. 2457T
uuuaacaauuuaucaga

SEQ ID NO: 3853841 - RNA, 20 nt, Shigella flexneri 2a str. 2457T
uuuaacaguuguccaaacgu

SEQ ID NO: 3853842 - RNA, 22 nt, Shigella flexneri 2a str. 2457T
uuuaacggacacuccuuccuga

SEQ ID NO: 3853843 - RNA, 22 nt, Shigella flexneri 2a str. 2457T
uuuaacuucgcguucuguggca

SEQ ID NO: 3853844 - RNA, 15 nt, Shigella flexneri 2a str. 2457T
uuuaaggguauuuuu

SEQ ID NO: 3853845 - RNA, 18 nt, Shigella flexneri 2a str. 2457T
uuuaaggguauuuuucua

SEQ ID NO: 3853846 - RNA, 21 nt, Shigella flexneri 2a str. 2457T
uuuaauaaugagcguuuuuug

SEQ ID NO: 3853847 - RNA, 13 nt, Shigella flexneri 2a str. 2457T
uuuaaucacacca

SEQ ID NO: 3853848 - RNA, 18 nt, Shigella flexneri 2a str. 2457T
uuuaaugccacauuagau

SEQ ID NO: 3853849 - RNA, 12 nt, Shigella flexneri 2a str. 2457T
uuuaauuuuuca

SEQ ID NO: 3853850 - RNA, 15 nt, Shigella flexneri 2a str. 2457T
uuuacaagcaacuug

SEQ ID NO: 3853851 - RNA, 22 nt, Shigella flexneri 2a str. 2457T
uuuacagcccuggcucugcacu

SEQ ID NO: 3853852 - RNA, 16 nt, Shigella flexneri 2a str. 2457T
uuuacagcuuagcgcc

SEQ ID NO: 3853853 - RNA, 21 nt, Shigella flexneri 2a str. 2457T
uuuacaucaucagaaaugcca

SEQ ID NO: 3853854 - RNA, 14 nt, Shigella flexneri 2a str. 2457T
uuuacauccggcaa

SEQ ID NO: 3853855 - RNA, 22 nt, Shigella flexneri 2a str. 2457T
uuuacauuaucgcgucuaaauu

SEQ ID NO: 3853856 - RNA, 13 nt, Shigella flexneri 2a str. 2457T
uuuaccaauauaa

SEQ ID NO: 3853857 - RNA, 20 nt, Shigella flexneri 2a str. 2457T
uuuaccaauauaauuccauu

SEQ ID NO: 3853858 - RNA, 19 nt, Shigella flexneri 2a str. 2457T
uuuaccaccgucaaaaaaa

SEQ ID NO: 3853859 - RNA, 20 nt, Shigella flexneri 2a str. 2457T
uuuaccaccgucaaaaaaac

SEQ ID NO: 3853860 - RNA, 21 nt, Shigella flexneri 2a str. 2457T
uuuaccaccgucaaaaaaacg

SEQ ID NO: 3853861 - RNA, 13 nt, Shigella flexneri 2a str. 2457T
uuuaccagcagcc

SEQ ID NO: 3853862 - RNA, 14 nt, Shigella flexneri 2a str. 2457T
uuuacccagcagca

SEQ ID NO: 3853863 - RNA, 11 nt, Shigella flexneri 2a str. 2457T
uuuacccagcg

SEQ ID NO: 3853864 - RNA, 18 nt, Shigella flexneri 2a str. 2457T
uuuacccaggccugccca

SEQ ID NO: 3853865 - RNA, 11 nt, Shigella flexneri 2a str. 2457T
uuuacccuucg

SEQ ID NO: 3853866 - RNA, 17 nt, Shigella flexneri 2a str. 2457T
uuuaccggugccagcaa

SEQ ID NO: 3853867 - RNA, 18 nt, Shigella flexneri 2a str. 2457T
uuuaccugcgccggucac

SEQ ID NO: 3853868 - RNA, 20 nt, Shigella flexneri 2a str. 2457T
uuuaccugcuuaaucauauu

SEQ ID NO: 3853869 - RNA, 16 nt, Shigella flexneri 2a str. 2457T
uuuacgcaaccacaaa

SEQ ID NO: 3853870 - RNA, 12 nt, Shigella flexneri 2a str. 2457T
uuuacgccgcau

SEQ ID NO: 3853871 - RNA, 19 nt, Shigella flexneri 2a str. 2457T
uuuacgccgcauccggcaa

SEQ ID NO: 3853872 - RNA, 19 nt, Shigella flexneri 2a str. 2457T
uuuacgccgcauccggcau

SEQ ID NO: 3853873 - RNA, 17 nt, Shigella flexneri 2a str. 2457T
uuuacggcugcauuaug

SEQ ID NO: 3853874 - RNA, 14 nt, Shigella flexneri 2a str. 2457T
uuuacgggccggau

SEQ ID NO: 3853875 - RNA, 12 nt, Shigella flexneri 2a str. 2457T
uuuacgucugca

SEQ ID NO: 3853876 - RNA, 18 nt, Shigella flexneri 2a str. 2457T
uuuacguucuuacauucc

SEQ ID NO: 3853877 - RNA, 19 nt, Shigella flexneri 2a str. 2457T
uuuacuacguaauuucaau

SEQ ID NO: 3853878 - RNA, 22 nt, Shigella flexneri 2a str. 2457T
uuuacugacuagaugugcaguu

SEQ ID NO: 3853879 - RNA, 17 nt, Shigella flexneri 2a str. 2457T
uuuacugauaauuuuuu

SEQ ID NO: 3853880 - RNA, 19 nt, Shigella flexneri 2a str. 2457T
uuuacugauaauuuuuuca

SEQ ID NO: 3853881 - RNA, 16 nt, Shigella flexneri 2a str. 2457T
uuuacuuacuucagca

SEQ ID NO: 3853882 - RNA, 13 nt, Shigella flexneri 2a str. 2457T
uuuacuucucagc

SEQ ID NO: 3853883 - RNA, 15 nt, Shigella flexneri 2a str. 2457T
uuuacuuguuuuuca

SEQ ID NO: 3853884 - RNA, 14 nt, Shigella flexneri 2a str. 2457T
uuuagaaaaacuua

SEQ ID NO: 3853885 - RNA, 14 nt, Shigella flexneri 2a str. 2457T
uuuagagaauuaau

SEQ ID NO: 3853886 - RNA, 13 nt, Shigella flexneri 2a str. 2457T
uuuagcaaacuga

SEQ ID NO: 3853887 - RNA, 13 nt, Shigella flexneri 2a str. 2457T
uuuagcauaaaaa

SEQ ID NO: 3853888 - RNA, 14 nt, Shigella flexneri 2a str. 2457T
uuuagcauaaaaac

SEQ ID NO: 3853889 - RNA, 18 nt, Shigella flexneri 2a str. 2457T
uuuagccgcuucugcagc

SEQ ID NO: 3853890 - RNA, 11 nt, Shigella flexneri 2a str. 2457T
uuuagcgccag

SEQ ID NO: 3853891 - RNA, 19 nt, Shigella flexneri 2a str. 2457T
uuuaggcacaguagcccac

SEQ ID NO: 3853892 - RNA, 22 nt, Shigella flexneri 2a str. 2457T
uuuaguaacaacggauuauccc

SEQ ID NO: 3853893 - RNA, 23 nt, Shigella flexneri 2a str. 2457T
uuuauaaagaacucgaggauaaa

SEQ ID NO: 3853894 - RNA, 18 nt, Shigella flexneri 2a str. 2457T
uuuauaaucuuuaaaaaa

SEQ ID NO: 3853895 - RNA, 16 nt, Shigella flexneri 2a str. 2457T
uuuauagggugcaauu

SEQ ID NO: 3853896 - RNA, 22 nt, Shigella flexneri 2a str. 2457T
uuuaucacgcaaccacaacgca

SEQ ID NO: 3853897 - RNA, 12 nt, Shigella flexneri 2a str. 2457T
uuuaucacugag

SEQ ID NO: 3853898 - RNA, 12 nt, Shigella flexneri 2a str. 2457T
uuuaucaggcca

SEQ ID NO: 3853899 - RNA, 16 nt, Shigella flexneri 2a str. 2457T
uuuaucaucacccaac

SEQ ID NO: 3853900 - RNA, 18 nt, Shigella flexneri 2a str. 2457T
uuuaucccaaccuaaaaa

SEQ ID NO: 3853901 - RNA, 22 nt, Shigella flexneri 2a str. 2457T
uuuaucccaaccuaaaaaguua

SEQ ID NO: 3853902 - RNA, 15 nt, Shigella flexneri 2a str. 2457T
uuuaucccuucucca

SEQ ID NO: 3853903 - RNA, 20 nt, Shigella flexneri 2a str. 2457T
uuuaucgaaguugucgauaa

SEQ ID NO: 3853904 - RNA, 23 nt, Shigella flexneri 2a str. 2457T
uuuaucgauaaauggcgcaucca

SEQ ID NO: 3853905 - RNA, 16 nt, Shigella flexneri 2a str. 2457T
uuuaucgcgcaaaaaa

SEQ ID NO: 3853906 - RNA, 15 nt, Shigella flexneri 2a str. 2457T
uuuaucggucuuagc

SEQ ID NO: 3853907 - RNA, 18 nt, Shigella flexneri 2a str. 2457T
uuuaucucuuacagaaau

SEQ ID NO: 3853908 - RNA, 20 nt, Shigella flexneri 2a str. 2457T
uuuaucugucuguacggcag

SEQ ID NO: 3853909 - RNA, 12 nt, Shigella flexneri 2a str. 2457T
uuuaucuuccca

SEQ ID NO: 3853910 - RNA, 13 nt, Shigella flexneri 2a str. 2457T
uuuaucuucccag

SEQ ID NO: 3853911 - RNA, 13 nt, Shigella flexneri 2a str. 2457T
uuuaugauauuuu

SEQ ID NO: 3853912 - RNA, 15 nt, Shigella flexneri 2a str. 2457T
uuuaugauauuuuuu

SEQ ID NO: 3853913 - RNA, 19 nt, Shigella flexneri 2a str. 2457T
uuuaugccggaucaggcgu

SEQ ID NO: 3853914 - RNA, 16 nt, Shigella flexneri 2a str. 2457T
uuuaugggagauuuua

SEQ ID NO: 3853915 - RNA, 22 nt, Shigella flexneri 2a str. 2457T
uuuaugguagugccgucagcag

SEQ ID NO: 3853916 - RNA, 17 nt, Shigella flexneri 2a str. 2457T
uuuauggucguuugccu

SEQ ID NO: 3853917 - RNA, 23 nt, Shigella flexneri 2a str. 2457T
uuuauuaauccagggaucaacau

SEQ ID NO: 3853918 - RNA, 18 nt, Shigella flexneri 2a str. 2457T
uuuauuaaugacauucag

SEQ ID NO: 3853919 - RNA, 15 nt, Shigella flexneri 2a str. 2457T
uuuauuaauucuaaa

SEQ ID NO: 3853920 - RNA, 20 nt, Shigella flexneri 2a str. 2457T
uuuauuaugccacagagaau

SEQ ID NO: 3853921 - RNA, 11 nt, Shigella flexneri 2a str. 2457T
uuuauuauucc

SEQ ID NO: 3853922 - RNA, 14 nt, Shigella flexneri 2a str. 2457T
uuuauucaccagua

SEQ ID NO: 3853923 - RNA, 22 nt, Shigella flexneri 2a str. 2457T
uuuauucauucgcucaggaaaa

SEQ ID NO: 3853924 - RNA, 22 nt, Shigella flexneri 2a str. 2457T
uuuauucuugacgccauuuuuu

SEQ ID NO: 3853925 - RNA, 18 nt, Shigella flexneri 2a str. 2457T
uuuauuggcauggcgcug

SEQ ID NO: 3853926 - RNA, 22 nt, Shigella flexneri 2a str. 2457T
uuuauuguuaaguuuaucccaa

SEQ ID NO: 3853927 - RNA, 19 nt, Shigella flexneri 2a str. 2457T
uuuauuuauucaaaccaau

SEQ ID NO: 3853928 - RNA, 13 nt, Shigella flexneri 2a str. 2457T
uuuauuuccgaaa

SEQ ID NO: 3853929 - RNA, 13 nt, Shigella flexneri 2a str. 2457T
uuuauuucggaaa

SEQ ID NO: 3853930 - RNA, 19 nt, Shigella flexneri 2a str. 2457T
uuuauuucuguauuacaga

SEQ ID NO: 3853931 - RNA, 21 nt, Shigella flexneri 2a str. 2457T
uuuauuugacccgcaguaaau

SEQ ID NO: 3853932 - RNA, 22 nt, Shigella flexneri 2a str. 2457T
uuuauuuugcgagcagcauucc

SEQ ID NO: 3853933 - RNA, 14 nt, Shigella flexneri 2a str. 2457T
uuucaaacaggcug

SEQ ID NO: 3853934 - RNA, 18 nt, Shigella flexneri 2a str. 2457T
uuucaaacucuucacacc

SEQ ID NO: 3853935 - RNA, 14 nt, Shigella flexneri 2a str. 2457T
uuucaaauaucuau

SEQ ID NO: 3853936 - RNA, 20 nt, Shigella flexneri 2a str. 2457T
uuucaacaauacaaaugccu

SEQ ID NO: 3853937 - RNA, 23 nt, Shigella flexneri 2a str. 2457T
uuucaacgacccagccagacgcc

SEQ ID NO: 3853938 - RNA, 17 nt, Shigella flexneri 2a str. 2457T
uuucaacggaccaauaa

SEQ ID NO: 3853939 - RNA, 19 nt, Shigella flexneri 2a str. 2457T
uuucaauaucguuaucacc

SEQ ID NO: 3853940 - RNA, 20 nt, Shigella flexneri 2a str. 2457T
uuucaauauugcacaguaua

SEQ ID NO: 3853941 - RNA, 23 nt, Shigella flexneri 2a str. 2457T
uuucaaugauaaaggucaucaca

SEQ ID NO: 3853942 - RNA, 13 nt, Shigella flexneri 2a str. 2457T
uuucaaugcuuuu

SEQ ID NO: 3853943 - RNA, 12 nt, Shigella flexneri 2a str. 2457T
uuucaauuauca

SEQ ID NO: 3853944 - RNA, 16 nt, Shigella flexneri 2a str. 2457T
uuucaauuccauuucc

SEQ ID NO: 3853945 - RNA, 19 nt, Shigella flexneri 2a str. 2457T
uuucaauuccauuucccug

SEQ ID NO: 3853946 - RNA, 18 nt, Shigella flexneri 2a str. 2457T
uuucacaggaaaaacuuu

SEQ ID NO: 3853947 - RNA, 20 nt, Shigella flexneri 2a str. 2457T
uuucacaggaaaaacuuuua

SEQ ID NO: 3853948 - RNA, 15 nt, Shigella flexneri 2a str. 2457T
uuucacccacuaauc

SEQ ID NO: 3853949 - RNA, 19 nt, Shigella flexneri 2a str. 2457T
uuucaccugauuaccguga

SEQ ID NO: 3853950 - RNA, 23 nt, Shigella flexneri 2a str. 2457T
uuucaccugcugauuauccgcau

SEQ ID NO: 3853951 - RNA, 15 nt, Shigella flexneri 2a str. 2457T
uuucacgaacacagu

SEQ ID NO: 3853952 - RNA, 21 nt, Shigella flexneri 2a str. 2457T
uuucacgagagauacgcuugc

SEQ ID NO: 3853953 - RNA, 16 nt, Shigella flexneri 2a str. 2457T
uuucacggcaccagcc

SEQ ID NO: 3853954 - RNA, 14 nt, Shigella flexneri 2a str. 2457T
uuucacuauuucuu

SEQ ID NO: 3853955 - RNA, 15 nt, Shigella flexneri 2a str. 2457T
uuucacuauuucuuu

SEQ ID NO: 3853956 - RNA, 16 nt, Shigella flexneri 2a str. 2457T
uuucacuuaaugaauc

SEQ ID NO: 3853957 - RNA, 20 nt, Shigella flexneri 2a str. 2457T
uuucacuucgucagaaaugg

SEQ ID NO: 3853958 - RNA, 23 nt, Shigella flexneri 2a str. 2457T
uuucacuucucauuucugccauu

SEQ ID NO: 3853959 - RNA, 17 nt, Shigella flexneri 2a str. 2457T
uuucagaauagacaaaa

SEQ ID NO: 3853960 - RNA, 22 nt, Shigella flexneri 2a str. 2457T
uuucagaaucagguugaugcga

SEQ ID NO: 3853961 - RNA, 23 nt, Shigella flexneri 2a str. 2457T
uuucagacggcugucuuccugug

SEQ ID NO: 3853962 - RNA, 19 nt, Shigella flexneri 2a str. 2457T
uuucagauuauugacaaag

SEQ ID NO: 3853963 - RNA, 19 nt, Shigella flexneri 2a str. 2457T
uuucagauuggugacaaag

SEQ ID NO: 3853964 - RNA, 19 nt, Shigella flexneri 2a str. 2457T
uuucagauuguugacaaag

SEQ ID NO: 3853965 - RNA, 14 nt, Shigella flexneri 2a str. 2457T
uuucagcaccagau

SEQ ID NO: 3853966 - RNA, 14 nt, Shigella flexneri 2a str. 2457T
uuucagcacuuauc

SEQ ID NO: 3853967 - RNA, 21 nt, Shigella flexneri 2a str. 2457T
uuucucggaucgcacaaucca

SEQ ID NO: 3853968 - RNA, 17 nt, Shigella flexneri 2a str. 2457T
uuucucggcaauaauuu

SEQ ID NO: 3853969 - RNA, 20 nt, Shigella flexneri 2a str. 2457T
uuucucgguauuacaaugcg

SEQ ID NO: 3853970 - RNA, 19 nt, Shigella flexneri 2a str. 2457T
uuucucugcaaauauuaau

SEQ ID NO: 3853971 - RNA, 13 nt, Shigella flexneri 2a str. 2457T
uuucucuucaucu

SEQ ID NO: 3853972 - RNA, 17 nt, Shigella flexneri 2a str. 2457T
uuucucuuucuucagca

SEQ ID NO: 3853973 - RNA, 21 nt, Shigella flexneri 2a str. 2457T
uuucugaaggauuagccggau

SEQ ID NO: 3853974 - RNA, 23 nt, Shigella flexneri 2a str. 2457T
uuucugacauuauuuaucugccu

SEQ ID NO: 3853975 - RNA, 16 nt, Shigella flexneri 2a str. 2457T
uuucugagauucaauu

SEQ ID NO: 3853976 - RNA, 17 nt, Shigella flexneri 2a str. 2457T
uuucugagucaauuucu

SEQ ID NO: 3853977 - RNA, 22 nt, Shigella flexneri 2a str. 2457T
uuucugcagcgcggcgagagcu

SEQ ID NO: 3853978 - RNA, 17 nt, Shigella flexneri 2a str. 2457T
uuucugcaucaaccaac

SEQ ID NO: 3853979 - RNA, 17 nt, Shigella flexneri 2a str. 2457T
uuucugccauuuugcuu

SEQ ID NO: 3853980 - RNA, 15 nt, Shigella flexneri 2a str. 2457T
uuucugcugccacuu

SEQ ID NO: 3853981 - RNA, 19 nt, Shigella flexneri 2a str. 2457T
uuucuggacacagcgugca

SEQ ID NO: 3853982 - RNA, 16 nt, Shigella flexneri 2a str. 2457T
uuucuggaugccaucg

SEQ ID NO: 3853983 - RNA, 18 nt, Shigella flexneri 2a str. 2457T
uuucuggaugccaucgca

SEQ ID NO: 3853984 - RNA, 17 nt, Shigella flexneri 2a str. 2457T
uuucuggcaucacuucu

SEQ ID NO: 3853985 - RNA, 19 nt, Shigella flexneri 2a str. 2457T
uuucuggcaucacuucuuu

SEQ ID NO: 3853986 - RNA, 22 nt, Shigella flexneri 2a str. 2457T
uuucugggaugaucaccugcau

SEQ ID NO: 3853987 - RNA, 21 nt, Shigella flexneri 2a str. 2457T
uuucugucuuaacgcaccaug

SEQ ID NO: 3853988 - RNA, 21 nt, Shigella flexneri 2a str. 2457T
uuucuuaccccugauuuuguu

SEQ ID NO: 3853989 - RNA, 14 nt, Shigella flexneri 2a str. 2457T
uuucuucauuaaau

SEQ ID NO: 3853990 - RNA, 12 nt, Shigella flexneri 2a str. 2457T
uuucuucauucg

SEQ ID NO: 3853991 - RNA, 16 nt, Shigella flexneri 2a str. 2457T
uuucuuccagcgccau

SEQ ID NO: 3853992 - RNA, 19 nt, Shigella flexneri 2a str. 2457T
uuucuugcagcucuugcag

SEQ ID NO: 3853993 - RNA, 16 nt, Shigella flexneri 2a str. 2457T
uuucuuucaccucuuc

SEQ ID NO: 3853994 - RNA, 13 nt, Shigella flexneri 2a str. 2457T
uuucuuucaucag

SEQ ID NO: 3853995 - RNA, 14 nt, Shigella flexneri 2a str. 2457T
uuucuuuugccaga

SEQ ID NO: 3853996 - RNA, 21 nt, Shigella flexneri 2a str. 2457T
uuugaaaugaugucgcugucu

SEQ ID NO: 3853997 - RNA, 18 nt, Shigella flexneri 2a str. 2457T
uuugaaauugugauaaaa

SEQ ID NO: 3853998 - RNA, 22 nt, Shigella flexneri 2a str. 2457T
uuugaacauaucagcgcaaaga

SEQ ID NO: 3853999 - RNA, 16 nt, Shigella flexneri 2a str. 2457T
uuugacaacucaucac

SEQ ID NO: 3854000 - RNA, 22 nt, Shigella flexneri 2a str. 2457T
uuugacagccccugugccagcu

SEQ ID NO: 3854001 - RNA, 14 nt, Shigella flexneri 2a str. 2457T
uuugaugccugcau

SEQ ID NO: 3854002 - RNA, 14 nt, Shigella flexneri 2a str. 2457T
uuugauugccggau

SEQ ID NO: 3854003 - RNA, 15 nt, Shigella flexneri 2a str. 2457T
uuugcaaucagauaa

SEQ ID NO: 3854004 - RNA, 20 nt, Shigella flexneri 2a str. 2457T
uuugcacgcuuucugcguga

SEQ ID NO: 3854005 - RNA, 18 nt, Shigella flexneri 2a str. 2457T
uuugcaggugaccagcag

SEQ ID NO: 3854006 - RNA, 20 nt, Shigella flexneri 2a str. 2457T
uuugcagugaucgugugcca

SEQ ID NO: 3854007 - RNA, 16 nt, Shigella flexneri 2a str. 2457T
uuugcagugcuuguua

SEQ ID NO: 3854008 - RNA, 14 nt, Shigella flexneri 2a str. 2457T
uuugcauaauuucc

SEQ ID NO: 3854009 - RNA, 17 nt, Shigella flexneri 2a str. 2457T
uuugcauccacaacccg

SEQ ID NO: 3854010 - RNA, 14 nt, Shigella flexneri 2a str. 2457T
uuugcauccagcuc

SEQ ID NO: 3854011 - RNA, 13 nt, Shigella flexneri 2a str. 2457T
uuugcaucgccau

SEQ ID NO: 3854012 - RNA, 16 nt, Shigella flexneri 2a str. 2457T
uuugcauuacugcuau

SEQ ID NO: 3854013 - RNA, 24 nt, Shigella flexneri 2a str. 2457T
uuugcauuacugcuaucugccaga

SEQ ID NO: 3854014 - RNA, 19 nt, Shigella flexneri 2a str. 2457T
uuugcauucggauugcuau

SEQ ID NO: 3854015 - RNA, 18 nt, Shigella flexneri 2a str. 2457T
uuugccaaauaucuuaua

SEQ ID NO: 3854016 - RNA, 20 nt, Shigella flexneri 2a str. 2457T
uuugccaauagcguuuugcg

SEQ ID NO: 3854017 - RNA, 14 nt, Shigella flexneri 2a str. 2457T
uuugccacugccgg

SEQ ID NO: 3854018 - RNA, 21 nt, Shigella flexneri 2a str. 2457T
uuugccaucagcgccugaugg

SEQ ID NO: 3854019 - RNA, 15 nt, Shigella flexneri 2a str. 2457T
uuugccaucucugca

SEQ ID NO: 3854020 - RNA, 13 nt, Shigella flexneri 2a str. 2457T
uuugcccaucaug

SEQ ID NO: 3854021 - RNA, 16 nt, Shigella flexneri 2a str. 2457T
uuugcccgcagaucca

SEQ ID NO: 3854022 - RNA, 17 nt, Shigella flexneri 2a str. 2457T
uuugccgaggaagacaa

SEQ ID NO: 3854023 - RNA, 17 nt, Shigella flexneri 2a str. 2457T
uuugccucguucuuccc

SEQ ID NO: 3854024 - RNA, 19 nt, Shigella flexneri 2a str. 2457T
uuugccugugcaaccuuuu

SEQ ID NO: 3854025 - RNA, 15 nt, Shigella flexneri 2a str. 2457T
uuugccuuauugccu

SEQ ID NO: 3854026 - RNA, 20 nt, Shigella flexneri 2a str. 2457T
uuugcgaacgcguucacugc

SEQ ID NO: 3854027 - RNA, 20 nt, Shigella flexneri 2a str. 2457T
uuugcgagucugcuccagaa

SEQ ID NO: 3854028 - RNA, 18 nt, Shigella flexneri 2a str. 2457T
uuugcgcguaaacaaaca

SEQ ID NO: 3854029 - RNA, 19 nt, Shigella flexneri 2a str. 2457T
uuugcgcguaaacaaacaa

SEQ ID NO: 3854030 - RNA, 17 nt, Shigella flexneri 2a str. 2457T
uuugcggcccuucuucu

SEQ ID NO: 3854031 - RNA, 18 nt, Shigella flexneri 2a str. 2457T
uuugcgucagcucacaaa

SEQ ID NO: 3854032 - RNA, 22 nt, Shigella flexneri 2a str. 2457T
uuugcguccgguaauuuuuaua

SEQ ID NO: 3854033 - RNA, 14 nt, Shigella flexneri 2a str. 2457T
uuugcguguuucag

SEQ ID NO: 3854034 - RNA, 20 nt, Shigella flexneri 2a str. 2457T
uuugcguuccaucagauuca

SEQ ID NO: 3854035 - RNA, 17 nt, Shigella flexneri 2a str. 2457T
uuugcguuugucauaaa

SEQ ID NO: 3854036 - RNA, 20 nt, Shigella flexneri 2a str. 2457T
uuugcucgcgacguaauuua

SEQ ID NO: 3854037 - RNA, 13 nt, Shigella flexneri 2a str. 2457T
uuugcugaugcag

SEQ ID NO: 3854038 - RNA, 19 nt, Shigella flexneri 2a str. 2457T
uuugcuugccggaagcaaa

SEQ ID NO: 3854039 - RNA, 14 nt, Shigella flexneri 2a str. 2457T
uuugcuuuguaaag

SEQ ID NO: 3854040 - RNA, 20 nt, Shigella flexneri 2a str. 2457T
uuugcuuuugucaucagacu

SEQ ID NO: 3854041 - RNA, 18 nt, Shigella flexneri 2a str. 2457T
uuuggcaaacuacaaauc

SEQ ID NO: 3854042 - RNA, 17 nt, Shigella flexneri 2a str. 2457T
uuuggcaaaugcaucag

SEQ ID NO: 3854043 - RNA, 20 nt, Shigella flexneri 2a str. 2457T
uuuggcagacaaccauauuu

SEQ ID NO: 3854044 - RNA, 22 nt, Shigella flexneri 2a str. 2457T
uuuggccgaagaggaacuguua

SEQ ID NO: 3854045 - RNA, 13 nt, Shigella flexneri 2a str. 2457T
uuuggccgcgcca

SEQ ID NO: 3854046 - RNA, 11 nt, Shigella flexneri 2a str. 2457T
uuuggcucuuc

SEQ ID NO: 3854047 - RNA, 11 nt, Shigella flexneri 2a str. 2457T
uuuggcugccg

SEQ ID NO: 3854048 - RNA, 14 nt, Shigella flexneri 2a str. 2457T
uuuggcugccgcca

SEQ ID NO: 3854049 - RNA, 18 nt, Shigella flexneri 2a str. 2457T
uuuggucuggcaaaaaua

SEQ ID NO: 3854050 - RNA, 16 nt, Shigella flexneri 2a str. 2457T
uuuggugagaacacca

SEQ ID NO: 3854051 - RNA, 17 nt, Shigella flexneri 2a str. 2457T
uuuggugagaacaccaa

SEQ ID NO: 3854052 - RNA, 18 nt, Shigella flexneri 2a str. 2457T
uuuguaaagucaucgcau

SEQ ID NO: 3854053 - RNA, 13 nt, Shigella flexneri 2a str. 2457T
uuuguagaacgua

SEQ ID NO: 3854054 - RNA, 15 nt, Shigella flexneri 2a str. 2457T
uuuguaggccugaua

SEQ ID NO: 3854055 - RNA, 13 nt, Shigella flexneri 2a str. 2457T
uuuguaucgcuga

SEQ ID NO: 3854056 - RNA, 20 nt, Shigella flexneri 2a str. 2457T
uuuguauuaauuaacaacgu

SEQ ID NO: 3854057 - RNA, 20 nt, Shigella flexneri 2a str. 2457T
uuugucaguucggcaucauc

SEQ ID NO: 3854058 - RNA, 16 nt, Shigella flexneri 2a str. 2457T
uuugucaucaguuuca

SEQ ID NO: 3854059 - RNA, 20 nt, Shigella flexneri 2a str. 2457T
uuugucaugacgacaaggca

SEQ ID NO: 3854060 - RNA, 16 nt, Shigella flexneri 2a str. 2457T
uuuguccgcuauuucu

SEQ ID NO: 3854061 - RNA, 20 nt, Shigella flexneri 2a str. 2457T
uuugucgccaacuucaugac

SEQ ID NO: 3854062 - RNA, 21 nt, Shigella flexneri 2a str. 2457T
uuugucgugggcaggaaaauc

SEQ ID NO: 3854063 - RNA, 12 nt, Shigella flexneri 2a str. 2457T
uuugucuucaau

SEQ ID NO: 3854064 - RNA, 12 nt, Shigella flexneri 2a str. 2457T
uuuuuaucuuca

SEQ ID NO: 3854065 - RNA, 21 nt, Shigella flexneri 2a str. 2457T
uuuuuaugguggaguuaccag

SEQ ID NO: 3854066 - RNA, 19 nt, Shigella flexneri 2a str. 2457T
uuuuucacugcggcaagaa

SEQ ID NO: 3854067 - RNA, 19 nt, Shigella flexneri 2a str. 2457T
uuuuucaucgcuaauaaua

SEQ ID NO: 3854068 - RNA, 22 nt, Shigella flexneri 2a str. 2457T
uuuuucaucgcuaauaauaagc

SEQ ID NO: 3854069 - RNA, 23 nt, Shigella flexneri 2a str. 2457T
uuuuuccacuuccaccagcggcu

SEQ ID NO: 3854070 - RNA, 14 nt, Shigella flexneri 2a str. 2457T
uuuuuccgcuuugu

SEQ ID NO: 3854071 - RNA, 13 nt, Shigella flexneri 2a str. 2457T
uuuuucgaaccga

SEQ ID NO: 3854072 - RNA, 22 nt, Shigella flexneri 2a str. 2457T
uuuuucgacaucaagaaaugca

SEQ ID NO: 3854073 - RNA, 22 nt, Shigella flexneri 2a str. 2457T
uuuuucgcgauagccgcuuucu

SEQ ID NO: 3854074 - RNA, 21 nt, Shigella flexneri 2a str. 2457T
uuuuucgcgcguuaucccuua

SEQ ID NO: 3854075 - RNA, 23 nt, Shigella flexneri 2a str. 2457T
uuuuucgugagagugaagccuga

SEQ ID NO: 3854076 - RNA, 20 nt, Shigella flexneri 2a str. 2457T
uuuuucuaugaguaauguua

SEQ ID NO: 3854077 - RNA, 11 nt, Shigella flexneri 2a str. 2457T
uuuuucucaac

SEQ ID NO: 3854078 - RNA, 16 nt, Shigella flexneri 2a str. 2457T
uuuuucucggcaauaa

SEQ ID NO: 3854079 - RNA, 21 nt, Shigella flexneri 2a str. 2457T
uuuuucugcacuacgcaggga

SEQ ID NO: 3854080 - RNA, 20 nt, Shigella flexneri 2a str. 2457T
uuuuucugcguuccugggga

SEQ ID NO: 3854081 - RNA, 12 nt, Shigella flexneri 2a str. 2457T
uuuuugaacaga

SEQ ID NO: 3854082 - RNA, 16 nt, Shigella flexneri 2a str. 2457T
uuuuugagcagcauua

SEQ ID NO: 3854083 - RNA, 15 nt, Shigella flexneri 2a str. 2457T
uuuuugcauuuccgc

SEQ ID NO: 3854084 - RNA, 18 nt, Shigella flexneri 2a str. 2457T
uuuuugccccagaauuuu

SEQ ID NO: 3854085 - RNA, 19 nt, Shigella flexneri 2a str. 2457T
uuuuugcgcgaagaaacga

SEQ ID NO: 3854086 - RNA, 18 nt, Shigella flexneri 2a str. 2457T
uuuuugcguccuggcaac

SEQ ID NO: 3854087 - RNA, 14 nt, Shigella flexneri 2a str. 2457T
uuuuugucugcuau

SEQ ID NO: 3854088 - RNA, 18 nt, Shigella flexneri 2a str. 2457T
uuuuugucugcuauuuac

SEQ ID NO: 3854089 - RNA, 16 nt, Shigella flexneri 2a str. 2457T
uuuuuuaaacauuaaa

SEQ ID NO: 3854090 - RNA, 12 nt, Shigella flexneri 2a str. 2457T
uuuuuucacaug

SEQ ID NO: 3854091 - RNA, 13 nt, Shigella flexneri 2a str. 2457T
uuuuuucuuccca

SEQ ID NO: 3854092 - RNA, 13 nt, Shigella flexneri 2a str. 2457T
uuuuuugcauuac

SEQ ID NO: 3854093 - RNA, 16 nt, Shigella flexneri 2a str. 2457T
uuuuuugccaaauauc

SEQ ID NO: 3854094 - RNA, 11 nt, Shigella flexneri 2a str. 2457T
uuuuuuuaugc

SEQ ID NO: 3854095 - RNA, 15 nt, Shigella flexneri 2a str. 2457T
gcggcggcgggcgca

SEQ ID NO: 3854096 - RNA, 17 nt, Shigella flexneri 2a str. 2457T
gcggcggcgggcgcagu

SEQ ID NO: 3854097 - RNA, 15 nt, Shigella flexneri 2a str. 2457T
gcggcggucuucuca

SEQ ID NO: 3854098 - RNA, 15 nt, Shigella flexneri 2a str. 2457T
gcggcggugauauaa

SEQ ID NO: 3854099 - RNA, 17 nt, Shigella flexneri 2a str. 2457T
gcggcguaaacgccuua

SEQ ID NO: 3854100 - RNA, 23 nt, Shigella flexneri 2a str. 2457T
gcggcguaaacgccuuauccagc

SEQ ID NO: 3854101 - RNA, 21 nt, Shigella flexneri 2a str. 2457T
gcggcguaucgacaaucacca

SEQ ID NO: 3854102 - RNA, 18 nt, Shigella flexneri 2a str. 2457T
gcggcgugaacgccuuau

SEQ ID NO: 3854103 - RNA, 15 nt, Shigella flexneri 2a str. 2457T
gcggcuagccaggaa

SEQ ID NO: 3854104 - RNA, 14 nt, Shigella flexneri 2a str. 2457T
gcggcucaccugca

SEQ ID NO: 3854105 - RNA, 13 nt, Shigella flexneri 2a str. 2457T
gcggcuccagaau

SEQ ID NO: 3854106 - RNA, 23 nt, Shigella flexneri 2a str. 2457T
gcggcucuccugaacuuucuccc

SEQ ID NO: 3854107 - RNA, 21 nt, Shigella flexneri 2a str. 2457T
gcggcugcccaucaucgucgu

SEQ ID NO: 3854108 - RNA, 13 nt, Shigella flexneri 2a str. 2457T
gcggcugguuaaa

SEQ ID NO: 3854109 - RNA, 13 nt, Shigella flexneri 2a str. 2457T
gcggcuguccggc

SEQ ID NO: 3854110 - RNA, 15 nt, Shigella flexneri 2a str. 2457T
gcggcuuauucauua

SEQ ID NO: 3854111 - RNA, 15 nt, Shigella flexneri 2a str. 2457T
gcggcuuccaccgcc

SEQ ID NO: 3854112 - RNA, 21 nt, Shigella flexneri 2a str. 2457T
gcgggaucgccgcguagagaa

SEQ ID NO: 3854113 - RNA, 15 nt, Shigella flexneri 2a str. 2457T
gcgggcaacagaauu

SEQ ID NO: 3854114 - RNA, 22 nt, Shigella flexneri 2a str. 2457T
gcgggcgaaucaacuccagaau

SEQ ID NO: 3854115 - RNA, 20 nt, Shigella flexneri 2a str. 2457T
gcgggcguagugcccgcagu

SEQ ID NO: 3854116 - RNA, 16 nt, Shigella flexneri 2a str. 2457T
gcggggcuaccgccag

SEQ ID NO: 3854117 - RNA, 20 nt, Shigella flexneri 2a str. 2457T
gcggggcuaccgccagacca

SEQ ID NO: 3854118 - RNA, 21 nt, Shigella flexneri 2a str. 2457T
gcgggguuuuuuuaugggcac

SEQ ID NO: 3854119 - RNA, 22 nt, Shigella flexneri 2a str. 2457T
gcgggguuuuuuuaugggcacg

SEQ ID NO: 3854120 - RNA, 14 nt, Shigella flexneri 2a str. 2457T
gcggguaaccagcc

SEQ ID NO: 3854121 - RNA, 15 nt, Shigella flexneri 2a str. 2457T
gcgggucaggccagg

SEQ ID NO: 3854122 - RNA, 16 nt, Shigella flexneri 2a str. 2457T
gcggguuaaccagcac

SEQ ID NO: 3854123 - RNA, 17 nt, Shigella flexneri 2a str. 2457T
gcggguuaaccagcacc

SEQ ID NO: 3854124 - RNA, 18 nt, Shigella flexneri 2a str. 2457T
gcggguuucaacauuucc

SEQ ID NO: 3854125 - RNA, 17 nt, Shigella flexneri 2a str. 2457T
gcgguaaaccguuauca

SEQ ID NO: 3854126 - RNA, 20 nt, Shigella flexneri 2a str. 2457T
gcgguaaagcgcggcaguga

SEQ ID NO: 3854127 - RNA, 13 nt, Shigella flexneri 2a str. 2457T
gcgguaaauuuuu

SEQ ID NO: 3854128 - RNA, 20 nt, Shigella flexneri 2a str. 2457T
gcgguaaauuuuuugaucaa

SEQ ID NO: 3854129 - RNA, 16 nt, Shigella flexneri 2a str. 2457T
gcgguaacauccagau

SEQ ID NO: 3854130 - RNA, 15 nt, Shigella flexneri 2a str. 2457T
gcgguaaccuggcag

SEQ ID NO: 3854131 - RNA, 13 nt, Shigella flexneri 2a str. 2457T
gcgguaauggucg

SEQ ID NO: 3854132 - RNA, 20 nt, Shigella flexneri 2a str. 2457T
gcgguacaccaaagcgguaa

SEQ ID NO: 3854133 - RNA, 13 nt, Shigella flexneri 2a str. 2457T
gcgguaucaccac

SEQ ID NO: 3854134 - RNA, 17 nt, Shigella flexneri 2a str. 2457T
gcgguauccaacccgcg

SEQ ID NO: 3854135 - RNA, 13 nt, Shigella flexneri 2a str. 2457T
gcggucaaccauc

SEQ ID NO: 3854136 - RNA, 14 nt, Shigella flexneri 2a str. 2457T
gcggucaaugguca

SEQ ID NO: 3854137 - RNA, 14 nt, Shigella flexneri 2a str. 2457T
gcggucagcugcug

SEQ ID NO: 3854138 - RNA, 13 nt, Shigella flexneri 2a str. 2457T
gcggucguaaucg

SEQ ID NO: 3854139 - RNA, 17 nt, Shigella flexneri 2a str. 2457T
gcggucguaaucgcccg

SEQ ID NO: 3854140 - RNA, 19 nt, Shigella flexneri 2a str. 2457T
gcggucguaaucgcccgcu

SEQ ID NO: 3854141 - RNA, 15 nt, Shigella flexneri 2a str. 2457T
gcggugaccagcagc

SEQ ID NO: 3854142 - RNA, 17 nt, Shigella flexneri 2a str. 2457T
gcggugaccagcagcau

SEQ ID NO: 3854143 - RNA, 22 nt, Shigella flexneri 2a str. 2457T
gcggugaucccaauauagacaa

SEQ ID NO: 3854144 - RNA, 20 nt, Shigella flexneri 2a str. 2457T
gcggugccaucgauaaucac

SEQ ID NO: 3854145 - RNA, 16 nt, Shigella flexneri 2a str. 2457T
gcgguggcuucgccuu

SEQ ID NO: 3854146 - RNA, 16 nt, Shigella flexneri 2a str. 2457T
gcgguggucgaugccc

SEQ ID NO: 3854147 - RNA, 14 nt, Shigella flexneri 2a str. 2457T
gcggugucgccaga

SEQ ID NO: 3854148 - RNA, 19 nt, Shigella flexneri 2a str. 2457T
gcgguuaacaauacgccca

SEQ ID NO: 3854149 - RNA, 22 nt, Shigella flexneri 2a str. 2457T
gcgguugacgccccuggcgaug

SEQ ID NO: 3854150 - RNA, 16 nt, Shigella flexneri 2a str. 2457T
gcgguugcaggcuauu

SEQ ID NO: 3854151 - RNA, 21 nt, Shigella flexneri 2a str. 2457T
gcgguuuucucuuuaaacaga

SEQ ID NO: 3854152 - RNA, 12 nt, Shigella flexneri 2a str. 2457T
gcgguuuuucuu

SEQ ID NO: 3854153 - RNA, 22 nt, Shigella flexneri 2a str. 2457T
gcguaaaacagccagcgcugac

SEQ ID NO: 3854154 - RNA, 18 nt, Shigella flexneri 2a str. 2457T
gcguaaacgccuaauaaa

SEQ ID NO: 3854155 - RNA, 19 nt, Shigella flexneri 2a str. 2457T
gcguaaacgccuuauccag

SEQ ID NO: 3854156 - RNA, 22 nt, Shigella flexneri 2a str. 2457T
gcguaagcgcauccggcaccag

SEQ ID NO: 3854157 - RNA, 21 nt, Shigella flexneri 2a str. 2457T
gcguaauggugguguuuucga

SEQ ID NO: 3854158 - RNA, 13 nt, Shigella flexneri 2a str. 2457T
gcguaauuugcga

SEQ ID NO: 3854159 - RNA, 19 nt, Shigella flexneri 2a str. 2457T
gcguacagagggcaggcaa

SEQ ID NO: 3854160 - RNA, 16 nt, Shigella flexneri 2a str. 2457T
gcguagauucgaaaug

SEQ ID NO: 3854161 - RNA, 17 nt, Shigella flexneri 2a str. 2457T
gcguagccgauccgcgu

SEQ ID NO: 3854162 - RNA, 15 nt, Shigella flexneri 2a str. 2457T
gcguagccggugccg

SEQ ID NO: 3854163 - RNA, 20 nt, Shigella flexneri 2a str. 2457T
gcguagcuaccuugcucggc

SEQ ID NO: 3854164 - RNA, 15 nt, Shigella flexneri 2a str. 2457T
gcguaguaaagccuu

SEQ ID NO: 3854165 - RNA, 16 nt, Shigella flexneri 2a str. 2457T
gcguagugaaggcaaa

SEQ ID NO: 3854166 - RNA, 16 nt, Shigella flexneri 2a str. 2457T
gcguagugcccgcagu

SEQ ID NO: 3854167 - RNA, 17 nt, Shigella flexneri 2a str. 2457T
gcguauccagcauaccu

SEQ ID NO: 3854168 - RNA, 15 nt, Shigella flexneri 2a str. 2457T
gcguaucgcccugcc

SEQ ID NO: 3854169 - RNA, 14 nt, Shigella flexneri 2a str. 2457T
gcguaugcccagcg

SEQ ID NO: 3854170 - RNA, 13 nt, Shigella flexneri 2a str. 2457T
gcguauggcgaca

SEQ ID NO: 3854171 - RNA, 12 nt, Shigella flexneri 2a str. 2457T
gcgucaaacggc

SEQ ID NO: 3854172 - RNA, 16 nt, Shigella flexneri 2a str. 2457T
gcgucaacagggcaga

SEQ ID NO: 3854173 - RNA, 19 nt, Shigella flexneri 2a str. 2457T
gcgucaagcgucgcaucag

SEQ ID NO: 3854174 - RNA, 22 nt, Shigella flexneri 2a str. 2457T
gcgucaaugccgcuucgagcug

SEQ ID NO: 3854175 - RNA, 19 nt, Shigella flexneri 2a str. 2457T
gcgucacgccgaccagacc

SEQ ID NO: 3854176 - RNA, 20 nt, Shigella flexneri 2a str. 2457T
gcgucacgccgaccagaccg

SEQ ID NO: 3854177 - RNA, 13 nt, Shigella flexneri 2a str. 2457T
gcgucagaaacag

SEQ ID NO: 3854178 - RNA, 17 nt, Shigella flexneri 2a str. 2457T
gcgucagaguuuagcga

SEQ ID NO: 3854179 - RNA, 16 nt, Shigella flexneri 2a str. 2457T
gcgucagcaccagaga

SEQ ID NO: 3854180 - RNA, 16 nt, Shigella flexneri 2a str. 2457T
gcgucagccagaaaga

SEQ ID NO: 3854181 - RNA, 16 nt, Shigella flexneri 2a str. 2457T
gcgucagcucacaaau

SEQ ID NO: 3854182 - RNA, 17 nt, Shigella flexneri 2a str. 2457T
gcgucagcuuucagaga

SEQ ID NO: 3854183 - RNA, 14 nt, Shigella flexneri 2a str. 2457T
gcgucaguuuuugc

SEQ ID NO: 3854184 - RNA, 22 nt, Shigella flexneri 2a str. 2457T
gcgucauauuacugcaacugcg

SEQ ID NO: 3854185 - RNA, 19 nt, Shigella flexneri 2a str. 2457T
gcgucauccagcacuugca

SEQ ID NO: 3854186 - RNA, 17 nt, Shigella flexneri 2a str. 2457T
gcgucauuaugucuggc

SEQ ID NO: 3854187 - RNA, 17 nt, Shigella flexneri 2a str. 2457T
gcgucauugacgcuggc

SEQ ID NO: 3854188 - RNA, 21 nt, Shigella flexneri 2a str. 2457T
gcgucauuuucaucgcuuucu

SEQ ID NO: 3854189 - RNA, 22 nt, Shigella flexneri 2a str. 2457T
gcgucauuuucaucgcuuucuu

SEQ ID NO: 3854190 - RNA, 18 nt, Shigella flexneri 2a str. 2457T
gcgucccagauagcuguc

SEQ ID NO: 3854191 - RNA, 14 nt, Shigella flexneri 2a str. 2457T
gcgucccaguaacg

SEQ ID NO: 3854192 - RNA, 23 nt, Shigella flexneri 2a str. 2457T
gcguccccugcaauauuuugaau

SEQ ID NO: 3854193 - RNA, 21 nt, Shigella flexneri 2a str. 2457T
gcguccgcucggucacugaca

SEQ ID NO: 3854194 - RNA, 14 nt, Shigella flexneri 2a str. 2457T
gccagaaucaccuc

SEQ ID NO: 3854195 - RNA, 23 nt, Shigella flexneri 2a str. 2457T
gccagaaucaccucuuuuuccac

SEQ ID NO: 3854196 - RNA, 15 nt, Shigella flexneri 2a str. 2457T
gccagacaaaccacg

SEQ ID NO: 3854197 - RNA, 15 nt, Shigella flexneri 2a str. 2457T
gccagacaauugccg

SEQ ID NO: 3854198 - RNA, 17 nt, Shigella flexneri 2a str. 2457T
gccagaccaaacagcau

SEQ ID NO: 3854199 - RNA, 12 nt, Shigella flexneri 2a str. 2457T
gccagaccacug

SEQ ID NO: 3854200 - RNA, 14 nt, Shigella flexneri 2a str. 2457T
gccagaccacugcg

SEQ ID NO: 3854201 - RNA, 20 nt, Shigella flexneri 2a str. 2457T
gccagaccacugcgccgcuc

SEQ ID NO: 3854202 - RNA, 22 nt, Shigella flexneri 2a str. 2457T
gccagaccugcgacauauuccc

SEQ ID NO: 3854203 - RNA, 22 nt, Shigella flexneri 2a str. 2457T
gccagacgaauaaaacagaaac

SEQ ID NO: 3854204 - RNA, 15 nt, Shigella flexneri 2a str. 2457T
gccagacgguauagc

SEQ ID NO: 3854205 - RNA, 13 nt, Shigella flexneri 2a str. 2457T
gccagacucgcca

SEQ ID NO: 3854206 - RNA, 20 nt, Shigella flexneri 2a str. 2457T
gccagacugcgcuaccagga

SEQ ID NO: 3854207 - RNA, 15 nt, Shigella flexneri 2a str. 2457T
gccagagaagcgacu

SEQ ID NO: 3854208 - RNA, 16 nt, Shigella flexneri 2a str. 2457T
gccagagagaacugcg

SEQ ID NO: 3854209 - RNA, 12 nt, Shigella flexneri 2a str. 2457T
gccagagagcga

SEQ ID NO: 3854210 - RNA, 18 nt, Shigella flexneri 2a str. 2457T
gccagagcaucaguuaac

SEQ ID NO: 3854211 - RNA, 17 nt, Shigella flexneri 2a str. 2457T
gccagaggagccaucac

SEQ ID NO: 3854212 - RNA, 22 nt, Shigella flexneri 2a str. 2457T
gccagaguggauuaucuucacc

SEQ ID NO: 3854213 - RNA, 19 nt, Shigella flexneri 2a str. 2457T
gccagauaaauauuauugg

SEQ ID NO: 3854214 - RNA, 13 nt, Shigella flexneri 2a str. 2457T
gccagauaagaca

SEQ ID NO: 3854215 - RNA, 22 nt, Shigella flexneri 2a str. 2457T
gccagauaaggcguucacgccg

SEQ ID NO: 3854216 - RNA, 21 nt, Shigella flexneri 2a str. 2457T
gccagaucgccugccgccagu

SEQ ID NO: 3854217 - RNA, 17 nt, Shigella flexneri 2a str. 2457T
gccagaugccuugccaa

SEQ ID NO: 3854218 - RNA, 16 nt, Shigella flexneri 2a str. 2457T
gccagauggcauccag

SEQ ID NO: 3854219 - RNA, 18 nt, Shigella flexneri 2a str. 2457T
gccagauggcuuugcccu

SEQ ID NO: 3854220 - RNA, 12 nt, Shigella flexneri 2a str. 2457T
gccagaugggau

SEQ ID NO: 3854221 - RNA, 16 nt, Shigella flexneri 2a str. 2457T
gccagauucuccaaca

SEQ ID NO: 3854222 - RNA, 19 nt, Shigella flexneri 2a str. 2457T
gccagcaaaaucaccauca

SEQ ID NO: 3854223 - RNA, 23 nt, Shigella flexneri 2a str. 2457T
gccagcaaaaugcauaaccgcag

SEQ ID NO: 3854224 - RNA, 17 nt, Shigella flexneri 2a str. 2457T
gccagcaacugauaaac

SEQ ID NO: 3854225 - RNA, 19 nt, Shigella flexneri 2a str. 2457T
gccagcaagagcaaauaaa

SEQ ID NO: 3854226 - RNA, 15 nt, Shigella flexneri 2a str. 2457T
gccagcaauccccag

SEQ ID NO: 3854227 - RNA, 18 nt, Shigella flexneri 2a str. 2457T
gccagcacgaccgccauu

SEQ ID NO: 3854228 - RNA, 17 nt, Shigella flexneri 2a str. 2457T
gccagcacggcgcugac

SEQ ID NO: 3854229 - RNA, 18 nt, Shigella flexneri 2a str. 2457T
gccagcagagggauaucu

SEQ ID NO: 3854230 - RNA, 14 nt, Shigella flexneri 2a str. 2457T
gccagcagccauuc

SEQ ID NO: 3854231 - RNA, 18 nt, Shigella flexneri 2a str. 2457T
gccagcagcgaaucagcc

SEQ ID NO: 3854232 - RNA, 11 nt, Shigella flexneri 2a str. 2457T
gccagcaggaa

SEQ ID NO: 3854233 - RNA, 17 nt, Shigella flexneri 2a str. 2457T
gccagcaguuucuucug

SEQ ID NO: 3854234 - RNA, 21 nt, Shigella flexneri 2a str. 2457T
gccagcauaaucaccaucagc

SEQ ID NO: 3854235 - RNA, 23 nt, Shigella flexneri 2a str. 2457T
gccagcauaaucaccaucagcag

SEQ ID NO: 3854236 - RNA, 19 nt, Shigella flexneri 2a str. 2457T
gccagcaucggcagcgcca

SEQ ID NO: 3854237 - RNA, 23 nt, Shigella flexneri 2a str. 2457T
gccagcaucucaaucgcacccgc

SEQ ID NO: 3854238 - RNA, 17 nt, Shigella flexneri 2a str. 2457T
gccagcaugaccaccgg

SEQ ID NO: 3854239 - RNA, 14 nt, Shigella flexneri 2a str. 2457T
gccagcaugacuac

SEQ ID NO: 3854240 - RNA, 22 nt, Shigella flexneri 2a str. 2457T
gccagcauucccgccagcggcc

SEQ ID NO: 3854241 - RNA, 22 nt, Shigella flexneri 2a str. 2457T
gccagcauuggcguuugaccaa

SEQ ID NO: 3854242 - RNA, 15 nt, Shigella flexneri 2a str. 2457T
gccagccaagcaugu

SEQ ID NO: 3854243 - RNA, 16 nt, Shigella flexneri 2a str. 2457T
gccagccacaccacuu

SEQ ID NO: 3854244 - RNA, 16 nt, Shigella flexneri 2a str. 2457T
gccagccacaggcuuu

SEQ ID NO: 3854245 - RNA, 16 nt, Shigella flexneri 2a str. 2457T
gccagccagcaccagg

SEQ ID NO: 3854246 - RNA, 19 nt, Shigella flexneri 2a str. 2457T
gccagccauccgucaucca

SEQ ID NO: 3854247 - RNA, 16 nt, Shigella flexneri 2a str. 2457T
gccagccauucaaucu

SEQ ID NO: 3854248 - RNA, 13 nt, Shigella flexneri 2a str. 2457T
gccagccccagcg

SEQ ID NO: 3854249 - RNA, 16 nt, Shigella flexneri 2a str. 2457T
gccagccccagcguca

SEQ ID NO: 3854250 - RNA, 17 nt, Shigella flexneri 2a str. 2457T
gccagccgaacagcgcc

SEQ ID NO: 3854251 - RNA, 10 nt, Shigella flexneri 2a str. 2457T
gccagccuca

SEQ ID NO: 3854252 - RNA, 13 nt, Shigella flexneri 2a str. 2457T
gccagcgaagaag

SEQ ID NO: 3854253 - RNA, 14 nt, Shigella flexneri 2a str. 2457T
gccagcgcaccagc

SEQ ID NO: 3854254 - RNA, 17 nt, Shigella flexneri 2a str. 2457T
gccagcgccaccaccag

SEQ ID NO: 3854255 - RNA, 17 nt, Shigella flexneri 2a str. 2457T
gccagcgccgacagcag

SEQ ID NO: 3854256 - RNA, 14 nt, Shigella flexneri 2a str. 2457T
gccagcgcugacgu

SEQ ID NO: 3854257 - RNA, 17 nt, Shigella flexneri 2a str. 2457T
gccagcggcagcucgcg

SEQ ID NO: 3854258 - RNA, 19 nt, Shigella flexneri 2a str. 2457T
gccagcggcguucgcguaa

SEQ ID NO: 3854259 - RNA, 22 nt, Shigella flexneri 2a str. 2457T
gccagcgucaucauagacuucc

SEQ ID NO: 3854260 - RNA, 18 nt, Shigella flexneri 2a str. 2457T
gccagcgucgcacccggc

SEQ ID NO: 3854261 - RNA, 21 nt, Shigella flexneri 2a str. 2457T
gccagcgucgcaucaggcauc

SEQ ID NO: 3854262 - RNA, 14 nt, Shigella flexneri 2a str. 2457T
gccagcgucugagc

SEQ ID NO: 3854263 - RNA, 20 nt, Shigella flexneri 2a str. 2457T
gccagcgucugagcaggcgg

SEQ ID NO: 3854264 - RNA, 16 nt, Shigella flexneri 2a str. 2457T
gccagcgugucgagca

SEQ ID NO: 3854265 - RNA, 18 nt, Shigella flexneri 2a str. 2457T
gccagcuccgggcugguu

SEQ ID NO: 3854266 - RNA, 11 nt, Shigella flexneri 2a str. 2457T
gccagcuuagu

SEQ ID NO: 3854267 - RNA, 22 nt, Shigella flexneri 2a str. 2457T
gccagcuucgcuucccaacgca

SEQ ID NO: 3854268 - RNA, 21 nt, Shigella flexneri 2a str. 2457T
gccagcuugcgauccugcaga

SEQ ID NO: 3854269 - RNA, 23 nt, Shigella flexneri 2a str. 2457T
gccaggaaccaccgaugcacagc

SEQ ID NO: 3854270 - RNA, 19 nt, Shigella flexneri 2a str. 2457T
gccaggaaucagauacugc

SEQ ID NO: 3854271 - RNA, 21 nt, Shigella flexneri 2a str. 2457T
gccaggaaucgcaaaccacgg

SEQ ID NO: 3854272 - RNA, 17 nt, Shigella flexneri 2a str. 2457T
gccaggacgcaguccag

SEQ ID NO: 3854273 - RNA, 21 nt, Shigella flexneri 2a str. 2457T
gccaggagacgcgcaaaucag

SEQ ID NO: 3854274 - RNA, 22 nt, Shigella flexneri 2a str. 2457T
gccaggagccaacacuuucacu

SEQ ID NO: 3854275 - RNA, 23 nt, Shigella flexneri 2a str. 2457T
gccaggcaacgaaaggugaagug

SEQ ID NO: 3854276 - RNA, 19 nt, Shigella flexneri 2a str. 2457T
gccaggcagagcucaacca

SEQ ID NO: 3854277 - RNA, 16 nt, Shigella flexneri 2a str. 2457T
gccaggcaucgaugga

SEQ ID NO: 3854278 - RNA, 16 nt, Shigella flexneri 2a str. 2457T
gccaggccagccuggu

SEQ ID NO: 3854279 - RNA, 17 nt, Shigella flexneri 2a str. 2457T
gccagggugcuggcgcu

SEQ ID NO: 3854280 - RNA, 23 nt, Shigella flexneri 2a str. 2457T
gccaggguuucggcuuuuuccug

SEQ ID NO: 3854281 - RNA, 14 nt, Shigella flexneri 2a str. 2457T
gccaggugcagccc

SEQ ID NO: 3854282 - RNA, 16 nt, Shigella flexneri 2a str. 2457T
gccagguuaaccagca

SEQ ID NO: 3854283 - RNA, 18 nt, Shigella flexneri 2a str. 2457T
gccagguuuaccagcagc

SEQ ID NO: 3854284 - RNA, 20 nt, Shigella flexneri 2a str. 2457T
gccagguuucauagcguccc

SEQ ID NO: 3854285 - RNA, 21 nt, Shigella flexneri 2a str. 2457T
gccaguaaauuuaucaaugca

SEQ ID NO: 3854286 - RNA, 14 nt, Shigella flexneri 2a str. 2457T
gccaguaacucauu

SEQ ID NO: 3854287 - RNA, 15 nt, Shigella flexneri 2a str. 2457T
gccaguaagcagucc

SEQ ID NO: 3854288 - RNA, 15 nt, Shigella flexneri 2a str. 2457T
gccaguaauccggcu

SEQ ID NO: 3854289 - RNA, 19 nt, Shigella flexneri 2a str. 2457T
gccaguaauccggcuuccu

SEQ ID NO: 3854290 - RNA, 16 nt, Shigella flexneri 2a str. 2457T
gccaguaaucuggcca

SEQ ID NO: 3854291 - RNA, 18 nt, Shigella flexneri 2a str. 2457T
gccaguaaucuggccaau

SEQ ID NO: 3854292 - RNA, 19 nt, Shigella flexneri 2a str. 2457T
gccaguaaucuggccaaug

SEQ ID NO: 3854293 - RNA, 15 nt, Shigella flexneri 2a str. 2457T
gccaguaaucuucaa

SEQ ID NO: 3854294 - RNA, 18 nt, Shigella flexneri 2a str. 2457T
gccaguaccagcagcgcc

SEQ ID NO: 3854295 - RNA, 15 nt, Shigella flexneri 2a str. 2457T
gccagucacaucagc

SEQ ID NO: 3854296 - RNA, 19 nt, Shigella flexneri 2a str. 2457T
gccagucacaucagcgauc

SEQ ID NO: 3854297 - RNA, 16 nt, Shigella flexneri 2a str. 2457T
gccagucccuuucagg

SEQ ID NO: 3854298 - RNA, 20 nt, Shigella flexneri 2a str. 2457T
gccagucgcacacaacagac

SEQ ID NO: 3854299 - RNA, 21 nt, Shigella flexneri 2a str. 2457T
gccagucgcgccuuacgcugc

SEQ ID NO: 3854300 - RNA, 15 nt, Shigella flexneri 2a str. 2457T
gccagucuggcuucg

SEQ ID NO: 3854301 - RNA, 15 nt, Shigella flexneri 2a str. 2457T
gccagugccaaagcc

SEQ ID NO: 3854302 - RNA, 15 nt, Shigella flexneri 2a str. 2457T
gccagugccacacgc

SEQ ID NO: 3854303 - RNA, 15 nt, Shigella flexneri 2a str. 2457T
gccagugccgguggc

SEQ ID NO: 3854304 - RNA, 22 nt, Shigella flexneri 2a str. 2457T
gccaguguuaaccagauaagcc

SEQ ID NO: 3854305 - RNA, 14 nt, Shigella flexneri 2a str. 2457T
gccaguuacugcca

SEQ ID NO: 3854306 - RNA, 15 nt, Shigella flexneri 2a str. 2457T
gccaguuacugccac

SEQ ID NO: 3854307 - RNA, 20 nt, Shigella flexneri 2a str. 2457T
gccaguuacugccaccaucc

SEQ ID NO: 3854308 - RNA, 19 nt, Shigella flexneri 2a str. 2457T
gccaguucaaaguugcauu

SEQ ID NO: 3854309 - RNA, 21 nt, Shigella flexneri 2a str. 2457T
gccaguucauuugaacuggcu

SEQ ID NO: 3854310 - RNA, 12 nt, Shigella flexneri 2a str. 2457T
gccaguuccccc

SEQ ID NO: 3854311 - RNA, 19 nt, Shigella flexneri 2a str. 2457T
gccaguucgaaauccagac

SEQ ID NO: 3854312 - RNA, 22 nt, Shigella flexneri 2a str. 2457T
gccaguucggaugugaaccuca

SEQ ID NO: 3854313 - RNA, 23 nt, Shigella flexneri 2a str. 2457T
gccaguucguuguaguguuccug

SEQ ID NO: 3854314 - RNA, 14 nt, Shigella flexneri 2a str. 2457T
gccaguucucacca

SEQ ID NO: 3854315 - RNA, 15 nt, Shigella flexneri 2a str. 2457T
gccaguucuuccagu

SEQ ID NO: 3854316 - RNA, 13 nt, Shigella flexneri 2a str. 2457T
gccaguugcggcu

SEQ ID NO: 3854317 - RNA, 18 nt, Shigella flexneri 2a str. 2457T
gccaguugcuuauccagc

SEQ ID NO: 3854318 - RNA, 23 nt, Shigella flexneri 2a str. 2457T
gccaguuguugauaagccccagu

SEQ ID NO: 3854319 - RNA, 23 nt, Shigella flexneri 2a str. 2457T
gccaguuuacugucugcuucugc

SEQ ID NO: 3854320 - RNA, 23 nt, Shigella flexneri 2a str. 2457T
gccaguuuggucuggcaaaaaua

SEQ ID NO: 3854321 - RNA, 22 nt, Shigella flexneri 2a str. 2457T
gccaguuuuucagcgccagcgc

SEQ ID NO: 3854322 - RNA, 16 nt, Shigella flexneri 2a str. 2457T
gccauaaacagcaggc

SEQ ID NO: 3854323 - RNA, 19 nt, Shigella flexneri 2a str. 2457T
gccauaaagaaaucaccug

SEQ ID NO: 3854324 - RNA, 17 nt, Shigella flexneri 2a str. 2457T
gccauaaauguugccgu

SEQ ID NO: 3854325 - RNA, 16 nt, Shigella flexneri 2a str. 2457T
gccauaauaaucauca

SEQ ID NO: 3854326 - RNA, 19 nt, Shigella flexneri 2a str. 2457T
gccauaccaugcaccaacc

SEQ ID NO: 3854327 - RNA, 13 nt, Shigella flexneri 2a str. 2457T
gccauauaaauuu

SEQ ID NO: 3854328 - RNA, 23 nt, Shigella flexneri 2a str. 2457T
gccauauacgccaucgccagcag

SEQ ID NO: 3854329 - RNA, 16 nt, Shigella flexneri 2a str. 2457T
gccauaucauucgaca

SEQ ID NO: 3854330 - RNA, 19 nt, Shigella flexneri 2a str. 2457T
gccauauguguuugugcug

SEQ ID NO: 3854331 - RNA, 19 nt, Shigella flexneri 2a str. 2457T
gccauauuguuucaacaca

SEQ ID NO: 3854332 - RNA, 20 nt, Shigella flexneri 2a str. 2457T
gccauauuguuucaacacag

SEQ ID NO: 3854333 - RNA, 15 nt, Shigella flexneri 2a str. 2457T
gccauauuucuccau

SEQ ID NO: 3854334 - RNA, 24 nt, Shigella flexneri 2a str. 2457T
gccaucaaauagccccugacuggu

SEQ ID NO: 3854335 - RNA, 14 nt, Shigella flexneri 2a str. 2457T
gccaucaacacuuu

SEQ ID NO: 3854336 - RNA, 16 nt, Shigella flexneri 2a str. 2457T
gccaucaauaaccagc

SEQ ID NO: 3854337 - RNA, 16 nt, Shigella flexneri 2a str. 2457T
gccaucaaucccaucu

SEQ ID NO: 3854338 - RNA, 15 nt, Shigella flexneri 2a str. 2457T
gccaucaaugugcug

SEQ ID NO: 3854339 - RNA, 21 nt, Shigella flexneri 2a str. 2457T
gccaucaauugcucacucccg

SEQ ID NO: 3854340 - RNA, 21 nt, Shigella flexneri 2a str. 2457T
gccaucaccaucguugcuaac

SEQ ID NO: 3854341 - RNA, 12 nt, Shigella flexneri 2a str. 2457T
gccaucagcagc

SEQ ID NO: 3854342 - RNA, 13 nt, Shigella flexneri 2a str. 2457T
gccaucagcagcg

SEQ ID NO: 3854343 - RNA, 18 nt, Shigella flexneri 2a str. 2457T
gccaucaucccuacaggu

SEQ ID NO: 3854344 - RNA, 17 nt, Shigella flexneri 2a str. 2457T
gccauccaccagugacu

SEQ ID NO: 3854345 - RNA, 18 nt, Shigella flexneri 2a str. 2457T
gccauccaucaacgccag

SEQ ID NO: 3854346 - RNA, 20 nt, Shigella flexneri 2a str. 2457T
gccaucccugucguccagac

SEQ ID NO: 3854347 - RNA, 13 nt, Shigella flexneri 2a str. 2457T
gccauccgcguga

SEQ ID NO: 3854348 - RNA, 15 nt, Shigella flexneri 2a str. 2457T
gccauccgcugcggu

SEQ ID NO: 3854349 - RNA, 15 nt, Shigella flexneri 2a str. 2457T
gccauccgucaucca

SEQ ID NO: 3854350 - RNA, 21 nt, Shigella flexneri 2a str. 2457T
gccaucgcauagcgcaauaac

SEQ ID NO: 3854351 - RNA, 15 nt, Shigella flexneri 2a str. 2457T
gccaucgccagcagc

SEQ ID NO: 3854352 - RNA, 16 nt, Shigella flexneri 2a str. 2457T
gccaucgccagcagcc

SEQ ID NO: 3854353 - RNA, 23 nt, Shigella flexneri 2a str. 2457T
gccaucgggaugccauuugccag

SEQ ID NO: 3854354 - RNA, 21 nt, Shigella flexneri 2a str. 2457T
gccaucucaaaacguccggca

SEQ ID NO: 3854355 - RNA, 21 nt, Shigella flexneri 2a str. 2457T
gccaucuccgcauguuucgac

SEQ ID NO: 3854356 - RNA, 14 nt, Shigella flexneri 2a str. 2457T
gccaucucuuccag

SEQ ID NO: 3854357 - RNA, 22 nt, Shigella flexneri 2a str. 2457T
gccaucugaauaaacggcucau

SEQ ID NO: 3854358 - RNA, 17 nt, Shigella flexneri 2a str. 2457T
gccaucugccagcaagc

SEQ ID NO: 3854359 - RNA, 14 nt, Shigella flexneri 2a str. 2457T
gccaucugccugau

SEQ ID NO: 3854360 - RNA, 15 nt, Shigella flexneri 2a str. 2457T
gccaucuucuugcag

SEQ ID NO: 3854361 - RNA, 15 nt, Shigella flexneri 2a str. 2457T
gccaugacuuucugg

SEQ ID NO: 3854362 - RNA, 21 nt, Shigella flexneri 2a str. 2457T
gccaugagcggacugaacgcg

SEQ ID NO: 3854363 - RNA, 18 nt, Shigella flexneri 2a str. 2457T
gccaugcccgugcugaca

SEQ ID NO: 3854364 - RNA, 15 nt, Shigella flexneri 2a str. 2457T
gccaugcgaaugcca

SEQ ID NO: 3854365 - RNA, 18 nt, Shigella flexneri 2a str. 2457T
gccaugcgugaacguggg

SEQ ID NO: 3854366 - RNA, 20 nt, Shigella flexneri 2a str. 2457T
gccaugcuucaauuuccuga

SEQ ID NO: 3854367 - RNA, 18 nt, Shigella flexneri 2a str. 2457T
gccaugcuugaagggcug

SEQ ID NO: 3854368 - RNA, 22 nt, Shigella flexneri 2a str. 2457T
gccaugcuuugcaucccagaaa

SEQ ID NO: 3854369 - RNA, 22 nt, Shigella flexneri 2a str. 2457T
gccauggcuucucgccagccuc

SEQ ID NO: 3854370 - RNA, 22 nt, Shigella flexneri 2a str. 2457T
gccaugguuugggcguuacagc

SEQ ID NO: 3854371 - RNA, 13 nt, Shigella flexneri 2a str. 2457T
gccauuaaacaac

SEQ ID NO: 3854372 - RNA, 13 nt, Shigella flexneri 2a str. 2457T
gccauuaaacgca

SEQ ID NO: 3854373 - RNA, 15 nt, Shigella flexneri 2a str. 2457T
gccauuaccaccgga

SEQ ID NO: 3854374 - RNA, 22 nt, Shigella flexneri 2a str. 2457T
gccauuccuggggucaucagca

SEQ ID NO: 3854375 - RNA, 15 nt, Shigella flexneri 2a str. 2457T
gccauugaccagcug

SEQ ID NO: 3854376 - RNA, 17 nt, Shigella flexneri 2a str. 2457T
gccauugaccagcugcc

SEQ ID NO: 3854377 - RNA, 20 nt, Shigella flexneri 2a str. 2457T
gccauuuccccaaucuucuc

SEQ ID NO: 3854378 - RNA, 13 nt, Shigella flexneri 2a str. 2457T
gccauuuuaauca

SEQ ID NO: 3854379 - RNA, 16 nt, Shigella flexneri 2a str. 2457T
gccauuuuuuugucug

SEQ ID NO: 3854380 - RNA, 12 nt, Shigella flexneri 2a str. 2457T
gcccaaaccacc

SEQ ID NO: 3854381 - RNA, 13 nt, Shigella flexneri 2a str. 2457T
gcccaaacuaaua

SEQ ID NO: 3854382 - RNA, 22 nt, Shigella flexneri 2a str. 2457T
gcccaacauacuguaacugcgu

SEQ ID NO: 3854383 - RNA, 23 nt, Shigella flexneri 2a str. 2457T
gcccaaccacggaguugaccagc

SEQ ID NO: 3854384 - RNA, 22 nt, Shigella flexneri 2a str. 2457T
gcccaacuaaaugcugcagcca

SEQ ID NO: 3854385 - RNA, 13 nt, Shigella flexneri 2a str. 2457T
gcccaacuguuga

SEQ ID NO: 3854386 - RNA, 21 nt, Shigella flexneri 2a str. 2457T
gcccaacuguugauccaggag

SEQ ID NO: 3854387 - RNA, 13 nt, Shigella flexneri 2a str. 2457T
gcccaagcgggga

SEQ ID NO: 3854388 - RNA, 22 nt, Shigella flexneri 2a str. 2457T
gcccaauauccauagugaagug

SEQ ID NO: 3854389 - RNA, 17 nt, Shigella flexneri 2a str. 2457T
gcccaaucaucgcggca

SEQ ID NO: 3854390 - RNA, 19 nt, Shigella flexneri 2a str. 2457T
gcccaaucaucgcggcaca

SEQ ID NO: 3854391 - RNA, 20 nt, Shigella flexneri 2a str. 2457T
gcccacaccagucagcgaac

SEQ ID NO: 3854392 - RNA, 21 nt, Shigella flexneri 2a str. 2457T
gcccaccaccagcgaaaucac

SEQ ID NO: 3854393 - RNA, 12 nt, Shigella flexneri 2a str. 2457T
gcccaccuggcu

SEQ ID NO: 3854394 - RNA, 18 nt, Shigella flexneri 2a str. 2457T
gcccacgccaucauaccc

SEQ ID NO: 3854395 - RNA, 14 nt, Shigella flexneri 2a str. 2457T
gcccacgccgccca

SEQ ID NO: 3854396 - RNA, 18 nt, Shigella flexneri 2a str. 2457T
gcccacgccgcccagaga

SEQ ID NO: 3854397 - RNA, 23 nt, Shigella flexneri 2a str. 2457T
gcccacgcgcauucccagcgcgu

SEQ ID NO: 3854398 - RNA, 13 nt, Shigella flexneri 2a str. 2457T
gcccacuccagcu

SEQ ID NO: 3854399 - RNA, 17 nt, Shigella flexneri 2a str. 2457T
gcccacuccagcuaucg

SEQ ID NO: 3854400 - RNA, 21 nt, Shigella flexneri 2a str. 2457T
gcccacuuucaggccagcggc

SEQ ID NO: 3854401 - RNA, 14 nt, Shigella flexneri 2a str. 2457T
gcccagaacaaaua

SEQ ID NO: 3854402 - RNA, 14 nt, Shigella flexneri 2a str. 2457T
gcccagaccagaau

SEQ ID NO: 3854403 - RNA, 22 nt, Shigella flexneri 2a str. 2457T
gcccagaccugcguucagcagu

SEQ ID NO: 3854404 - RNA, 19 nt, Shigella flexneri 2a str. 2457T
gcccagagaacuggcggca

SEQ ID NO: 3854405 - RNA, 16 nt, Shigella flexneri 2a str. 2457T
gcccagaggaugcacu

SEQ ID NO: 3854406 - RNA, 11 nt, Shigella flexneri 2a str. 2457T
gcccagcagac

SEQ ID NO: 3854407 - RNA, 14 nt, Shigella flexneri 2a str. 2457T
gcccagccgugaau

SEQ ID NO: 3854408 - RNA, 17 nt, Shigella flexneri 2a str. 2457T
gcccagccuuuccggca

SEQ ID NO: 3854409 - RNA, 17 nt, Shigella flexneri 2a str. 2457T
gcccagcgcaucaggca

SEQ ID NO: 3854410 - RNA, 22 nt, Shigella flexneri 2a str. 2457T
gcccagcgcaucaggcaaucuu

SEQ ID NO: 3854411 - RNA, 22 nt, Shigella flexneri 2a str. 2457T
gcccagcgcguaaauaucggca

SEQ ID NO: 3854412 - RNA, 13 nt, Shigella flexneri 2a str. 2457T
gcccagcgcuuca

SEQ ID NO: 3854413 - RNA, 21 nt, Shigella flexneri 2a str. 2457T
gcccagguuauacaccuguuc

SEQ ID NO: 3854414 - RNA, 16 nt, Shigella flexneri 2a str. 2457T
gcccaguaccgccagu

SEQ ID NO: 3854415 - RNA, 19 nt, Shigella flexneri 2a str. 2457T
gcccaguaucugacagcaa

SEQ ID NO: 3854416 - RNA, 22 nt, Shigella flexneri 2a str. 2457T
gcccaguaucugacagcaaaua

SEQ ID NO: 3854417 - RNA, 16 nt, Shigella flexneri 2a str. 2457T
gcccagugaccaaagg

SEQ ID NO: 3854418 - RNA, 17 nt, Shigella flexneri 2a str. 2457T
gcccagugaccaaaggc

SEQ ID NO: 3854419 - RNA, 18 nt, Shigella flexneri 2a str. 2457T
gcccagugaccaaaggcg

SEQ ID NO: 3854420 - RNA, 22 nt, Shigella flexneri 2a str. 2457T
gcccagugagucggggccagca

SEQ ID NO: 3854421 - RNA, 18 nt, Shigella flexneri 2a str. 2457T
gcccagugaguuggggcc

SEQ ID NO: 3854422 - RNA, 22 nt, Shigella flexneri 2a str. 2457T
gcccagugaguuggggccagca

SEQ ID NO: 3854423 - RNA, 15 nt, Shigella flexneri 2a str. 2457T
gcccagugccagcac

SEQ ID NO: 3854424 - RNA, 15 nt, Shigella flexneri 2a str. 2457T
gcccaguucagcggc

SEQ ID NO: 3854425 - RNA, 17 nt, Shigella flexneri 2a str. 2457T
gcccauaaauacgucuu

SEQ ID NO: 3854426 - RNA, 14 nt, Shigella flexneri 2a str. 2457T
gcccauaccacagc

SEQ ID NO: 3854427 - RNA, 23 nt, Shigella flexneri 2a str. 2457T
gcccauaugaacauuacuuuccg

SEQ ID NO: 3854428 - RNA, 14 nt, Shigella flexneri 2a str. 2457T
gcccaucaugcgcc

SEQ ID NO: 3854429 - RNA, 21 nt, Shigella flexneri 2a str. 2457T
gcccaucgccacgccuguacc

SEQ ID NO: 3854430 - RNA, 16 nt, Shigella flexneri 2a str. 2457T
gcccaucgccagugcc

SEQ ID NO: 3854431 - RNA, 17 nt, Shigella flexneri 2a str. 2457T
gcccaucgccagugccg

SEQ ID NO: 3854432 - RNA, 18 nt, Shigella flexneri 2a str. 2457T
gcccaucgcgcccgccgc

SEQ ID NO: 3854433 - RNA, 17 nt, Shigella flexneri 2a str. 2457T
gcccaugauagugucca

SEQ ID NO: 3854434 - RNA, 19 nt, Shigella flexneri 2a str. 2457T
gcccaugaugacaacauag

SEQ ID NO: 3854435 - RNA, 17 nt, Shigella flexneri 2a str. 2457T
gcccauuauugacagac

SEQ ID NO: 3854436 - RNA, 19 nt, Shigella flexneri 2a str. 2457T
gcccauuauugacagaccg

SEQ ID NO: 3854437 - RNA, 16 nt, Shigella flexneri 2a str. 2457T
gcccauuccaguaauu

SEQ ID NO: 3854438 - RNA, 14 nt, Shigella flexneri 2a str. 2457T
gccccacagaccca

SEQ ID NO: 3854439 - RNA, 14 nt, Shigella flexneri 2a str. 2457T
gccccaccagcaaa

SEQ ID NO: 3854440 - RNA, 16 nt, Shigella flexneri 2a str. 2457T
gccccaccagcaaaua

SEQ ID NO: 3854441 - RNA, 22 nt, Shigella flexneri 2a str. 2457T
gccccagaauucacgcacuucc

SEQ ID NO: 3854442 - RNA, 17 nt, Shigella flexneri 2a str. 2457T
gccccagaauuuucucu

SEQ ID NO: 3854443 - RNA, 13 nt, Shigella flexneri 2a str. 2457T
gccccagacacag

SEQ ID NO: 3854444 - RNA, 16 nt, Shigella flexneri 2a str. 2457T
gccccagaccugaauu

SEQ ID NO: 3854445 - RNA, 16 nt, Shigella flexneri 2a str. 2457T
gccccagauugccgau

SEQ ID NO: 3854446 - RNA, 15 nt, Shigella flexneri 2a str. 2457T
gccccagcaggaugu

SEQ ID NO: 3854447 - RNA, 14 nt, Shigella flexneri 2a str. 2457T
gccccagccuacag

SEQ ID NO: 3854448 - RNA, 20 nt, Shigella flexneri 2a str. 2457T
gccccagcuugucauacgga

SEQ ID NO: 3854449 - RNA, 16 nt, Shigella flexneri 2a str. 2457T
gccccaggccagcagc

SEQ ID NO: 3854450 - RNA, 19 nt, Shigella flexneri 2a str. 2457T
gccccaggccagcagcaga

SEQ ID NO: 3854451 - RNA, 16 nt, Shigella flexneri 2a str. 2457T
gccccagucuuccugc

SEQ ID NO: 3854452 - RNA, 12 nt, Shigella flexneri 2a str. 2457T
gccccaguuccg

SEQ ID NO: 3854453 - RNA, 22 nt, Shigella flexneri 2a str. 2457T
gccccaguuccuuaacuucauc

SEQ ID NO: 3854454 - RNA, 16 nt, Shigella flexneri 2a str. 2457T
gccccaucaacgccau

SEQ ID NO: 3854455 - RNA, 22 nt, Shigella flexneri 2a str. 2457T
gccccaucaacgccaucgccag

SEQ ID NO: 3854456 - RNA, 20 nt, Shigella flexneri 2a str. 2457T
gccccaucgaaccaucggcu

SEQ ID NO: 3854457 - RNA, 20 nt, Shigella flexneri 2a str. 2457T
gccccauugcugaugcaccu

SEQ ID NO: 3854458 - RNA, 13 nt, Shigella flexneri 2a str. 2457T
gcccccgauccag

SEQ ID NO: 3854459 - RNA, 21 nt, Shigella flexneri 2a str. 2457T
gcccccucacaugaguugcug

SEQ ID NO: 3854460 - RNA, 19 nt, Shigella flexneri 2a str. 2457T
gccccgacgaacgcagcgu

SEQ ID NO: 3854461 - RNA, 23 nt, Shigella flexneri 2a str. 2457T
gccccgacgaacgcagcgucuca

SEQ ID NO: 3854462 - RNA, 15 nt, Shigella flexneri 2a str. 2457T
gccccgagaaaaaua

SEQ ID NO: 3854463 - RNA, 21 nt, Shigella flexneri 2a str. 2457T
gccccgaugccaucauggcga

SEQ ID NO: 3854464 - RNA, 22 nt, Shigella flexneri 2a str. 2457T
gccccgccuaaagaagccgcca

SEQ ID NO: 3854465 - RNA, 23 nt, Shigella flexneri 2a str. 2457T
gccccgcgaacggggcugccagc

SEQ ID NO: 3854466 - RNA, 13 nt, Shigella flexneri 2a str. 2457T
gccccgcgcggcg

SEQ ID NO: 3854467 - RNA, 21 nt, Shigella flexneri 2a str. 2457T
gccccgcgcggcgcaggcgcu

SEQ ID NO: 3854468 - RNA, 23 nt, Shigella flexneri 2a str. 2457T
gccccgcuguuugaaauugugau

SEQ ID NO: 3854469 - RNA, 23 nt, Shigella flexneri 2a str. 2457T
gccccgcuucccgauaagggagc

SEQ ID NO: 3854470 - RNA, 15 nt, Shigella flexneri 2a str. 2457T
gccccgguuucucuu

SEQ ID NO: 3854471 - RNA, 21 nt, Shigella flexneri 2a str. 2457T
gccccucuaacucuucugaaa

SEQ ID NO: 3854472 - RNA, 15 nt, Shigella flexneri 2a str. 2457T
gccccugaauaaucg

SEQ ID NO: 3854473 - RNA, 19 nt, Shigella flexneri 2a str. 2457T
gccccugaauaaucguaau

SEQ ID NO: 3854474 - RNA, 21 nt, Shigella flexneri 2a str. 2457T
gccccugagcguuacccgcag

SEQ ID NO: 3854475 - RNA, 14 nt, Shigella flexneri 2a str. 2457T
gccccugcgccagc

SEQ ID NO: 3854476 - RNA, 16 nt, Shigella flexneri 2a str. 2457T
gccccugcgccagcgc

SEQ ID NO: 3854477 - RNA, 18 nt, Shigella flexneri 2a str. 2457T
gccccugguuaucuucca

SEQ ID NO: 3854478 - RNA, 16 nt, Shigella flexneri 2a str. 2457T
gcccgacaaagcauga

SEQ ID NO: 3854479 - RNA, 14 nt, Shigella flexneri 2a str. 2457T
gcccgacgaggcgc

SEQ ID NO: 3854480 - RNA, 21 nt, Shigella flexneri 2a str. 2457T
gcccgacgaggcgcuggcgca

SEQ ID NO: 3854481 - RNA, 16 nt, Shigella flexneri 2a str. 2457T
gcccgaggagggcgag

SEQ ID NO: 3854482 - RNA, 16 nt, Shigella flexneri 2a str. 2457T
gcccgauagaaaccau

SEQ ID NO: 3854483 - RNA, 20 nt, Shigella flexneri 2a str. 2457T
gcccgauagaaaccaugucc

SEQ ID NO: 3854484 - RNA, 14 nt, Shigella flexneri 2a str. 2457T
gcccgaugaccuug

SEQ ID NO: 3854485 - RNA, 20 nt, Shigella flexneri 2a str. 2457T
gcccgaugacuggccggaag

SEQ ID NO: 3854486 - RNA, 17 nt, Shigella flexneri 2a str. 2457T
gcccgauggcaucacca

SEQ ID NO: 3854487 - RNA, 13 nt, Shigella flexneri 2a str. 2457T
gcccgauucacau

SEQ ID NO: 3854488 - RNA, 22 nt, Shigella flexneri 2a str. 2457T
gcccgcaacaaacuuaugcugc

SEQ ID NO: 3854489 - RNA, 19 nt, Shigella flexneri 2a str. 2457T
gcccgcacaaagcacgcug

SEQ ID NO: 3854490 - RNA, 19 nt, Shigella flexneri 2a str. 2457T
gcccgcagccaucacugac

SEQ ID NO: 3854491 - RNA, 13 nt, Shigella flexneri 2a str. 2457T
gcccgccagcacc

SEQ ID NO: 3854492 - RNA, 15 nt, Shigella flexneri 2a str. 2457T
gcccgccagcaccgg

SEQ ID NO: 3854493 - RNA, 17 nt, Shigella flexneri 2a str. 2457T
gcccgcccccgggccuc

SEQ ID NO: 3854494 - RNA, 13 nt, Shigella flexneri 2a str. 2457T
gcccgccgccauu

SEQ ID NO: 3854495 - RNA, 14 nt, Shigella flexneri 2a str. 2457T
gcccgccgcugguu

SEQ ID NO: 3854496 - RNA, 14 nt, Shigella flexneri 2a str. 2457T
gcccgccguuaugg

SEQ ID NO: 3854497 - RNA, 22 nt, Shigella flexneri 2a str. 2457T
gcccgcgcgagcuuuccggcgg

SEQ ID NO: 3854498 - RNA, 22 nt, Shigella flexneri 2a str. 2457T
gcccgcgggcgaauuaucggca

SEQ ID NO: 3854499 - RNA, 18 nt, Shigella flexneri 2a str. 2457T
gcccgcuuccagcgcauc

SEQ ID NO: 3854500 - RNA, 17 nt, Shigella flexneri 2a str. 2457T
gcccgcuuucaccaucg

SEQ ID NO: 3854501 - RNA, 21 nt, Shigella flexneri 2a str. 2457T
gcccggaacuugccgggcgca

SEQ ID NO: 3854502 - RNA, 23 nt, Shigella flexneri 2a str. 2457T
gcccggaacuugccgggcgcagu

SEQ ID NO: 3854503 - RNA, 15 nt, Shigella flexneri 2a str. 2457T
gcccggagcagcagu

SEQ ID NO: 3854504 - RNA, 15 nt, Shigella flexneri 2a str. 2457T
gcccggcaacaacag

SEQ ID NO: 3854505 - RNA, 16 nt, Shigella flexneri 2a str. 2457T
gcccggcauucaccuc

SEQ ID NO: 3854506 - RNA, 12 nt, Shigella flexneri 2a str. 2457T
gcccgguaucaa

SEQ ID NO: 3854507 - RNA, 15 nt, Shigella flexneri 2a str. 2457T
gcccgguauccauca

SEQ ID NO: 3854508 - RNA, 14 nt, Shigella flexneri 2a str. 2457T
gcccgguugcaguu

SEQ ID NO: 3854509 - RNA, 20 nt, Shigella flexneri 2a str. 2457T
gcccguaaaaaauggcuggc

SEQ ID NO: 3854510 - RNA, 23 nt, Shigella flexneri 2a str. 2457T
gcccguaacucacugaugccguu

SEQ ID NO: 3854511 - RNA, 11 nt, Shigella flexneri 2a str. 2457T
gcccguccauc

SEQ ID NO: 3854512 - RNA, 14 nt, Shigella flexneri 2a str. 2457T
gcccgucgugaaga

SEQ ID NO: 3854513 - RNA, 17 nt, Shigella flexneri 2a str. 2457T
gcccgucugggcgcggc

SEQ ID NO: 3854514 - RNA, 15 nt, Shigella flexneri 2a str. 2457T
gcccgugacucccac

SEQ ID NO: 3854515 - RNA, 22 nt, Shigella flexneri 2a str. 2457T
gcccguuguuuuauuuaugugg

SEQ ID NO: 3854516 - RNA, 23 nt, Shigella flexneri 2a str. 2457T
gcccguuuggugguuuggcggcg

SEQ ID NO: 3854517 - RNA, 19 nt, Shigella flexneri 2a str. 2457T
gcccguuuucuccagcgcc

SEQ ID NO: 3854518 - RNA, 20 nt, Shigella flexneri 2a str. 2457T
gcccuacuccgccuuugaaa

SEQ ID NO: 3854519 - RNA, 15 nt, Shigella flexneri 2a str. 2457T
gcccuaggcauagaa

SEQ ID NO: 3854520 - RNA, 18 nt, Shigella flexneri 2a str. 2457T
gcccuaggcauagaaaaa

SEQ ID NO: 3854521 - RNA, 20 nt, Shigella flexneri 2a str. 2457T
gcccuaggcauagaaaaaga

SEQ ID NO: 3854522 - RNA, 21 nt, Shigella flexneri 2a str. 2457T
gcccucaaacaacacagcgau

SEQ ID NO: 3854523 - RNA, 15 nt, Shigella flexneri 2a str. 2457T
gcccucagcccacau

SEQ ID NO: 3854524 - RNA, 12 nt, Shigella flexneri 2a str. 2457T
gcccucgacggc

SEQ ID NO: 3854525 - RNA, 21 nt, Shigella flexneri 2a str. 2457T
gcccucgaucggcucuuccgc

SEQ ID NO: 3854526 - RNA, 19 nt, Shigella flexneri 2a str. 2457T
gcccugaaaacgcaguucc

SEQ ID NO: 3854527 - RNA, 21 nt, Shigella flexneri 2a str. 2457T
gcccugaaccaucgacgucca

SEQ ID NO: 3854528 - RNA, 23 nt, Shigella flexneri 2a str. 2457T
gcccugaaccgacgacagauucc

SEQ ID NO: 3854529 - RNA, 17 nt, Shigella flexneri 2a str. 2457T
gcccugcaaugucauca

SEQ ID NO: 3854530 - RNA, 21 nt, Shigella flexneri 2a str. 2457T
gcccugcagcaucaccggaug

SEQ ID NO: 3854531 - RNA, 14 nt, Shigella flexneri 2a str. 2457T
gcccugcuaugcaa

SEQ ID NO: 3854532 - RNA, 19 nt, Shigella flexneri 2a str. 2457T
gcccugcuccagcaacuca

SEQ ID NO: 3854533 - RNA, 18 nt, Shigella flexneri 2a str. 2457T
gcccuggacaacauuccu

SEQ ID NO: 3854534 - RNA, 15 nt, Shigella flexneri 2a str. 2457T
gcccuggaugcaguc

SEQ ID NO: 3854535 - RNA, 19 nt, Shigella flexneri 2a str. 2457T
gcccugucgaggccaauuu

SEQ ID NO: 3854536 - RNA, 22 nt, Shigella flexneri 2a str. 2457T
gcccuucggggcuaaugccagu

SEQ ID NO: 3854537 - RNA, 19 nt, Shigella flexneri 2a str. 2457T
gcccuugccaacgcaaacg

SEQ ID NO: 3854538 - RNA, 23 nt, Shigella flexneri 2a str. 2457T
gcccuuguugcuauggggaaaaa

SEQ ID NO: 3854539 - RNA, 22 nt, Shigella flexneri 2a str. 2457T
gcccuuucugcauccguucuuc

SEQ ID NO: 3854540 - RNA, 17 nt, Shigella flexneri 2a str. 2457T
gcccuuugcuggcauga

SEQ ID NO: 3854541 - RNA, 14 nt, Shigella flexneri 2a str. 2457T
gcccuuuucaccau

SEQ ID NO: 3854542 - RNA, 19 nt, Shigella flexneri 2a str. 2457T
gcccuuuuuucguaaguaa

SEQ ID NO: 3854543 - RNA, 23 nt, Shigella flexneri 2a str. 2457T
gcccuuuuuucguaaguaagcaa

SEQ ID NO: 3854544 - RNA, 21 nt, Shigella flexneri 2a str. 2457T
gccgaacagcgccagacaaac

SEQ ID NO: 3854545 - RNA, 15 nt, Shigella flexneri 2a str. 2457T
gccgaacaggcugcu

SEQ ID NO: 3854546 - RNA, 20 nt, Shigella flexneri 2a str. 2457T
gccgaagaacauaaacagcg

SEQ ID NO: 3854547 - RNA, 15 nt, Shigella flexneri 2a str. 2457T
gccgaagcagcuacu

SEQ ID NO: 3854548 - RNA, 19 nt, Shigella flexneri 2a str. 2457T
gccgaaugccacgacguuu

SEQ ID NO: 3854549 - RNA, 12 nt, Shigella flexneri 2a str. 2457T
gccgacaaagau

SEQ ID NO: 3854550 - RNA, 16 nt, Shigella flexneri 2a str. 2457T
gccgacaaaugcaguu

SEQ ID NO: 3854551 - RNA, 12 nt, Shigella flexneri 2a str. 2457T
gccgacagcagc

SEQ ID NO: 3854552 - RNA, 13 nt, Shigella flexneri 2a str. 2457T
gccgaccgcuuca

SEQ ID NO: 3854553 - RNA, 22 nt, Shigella flexneri 2a str. 2457T
gccgacgacaacaggguugaau

SEQ ID NO: 3854554 - RNA, 15 nt, Shigella flexneri 2a str. 2457T
gccgacggcgcacag

SEQ ID NO: 3854555 - RNA, 16 nt, Shigella flexneri 2a str. 2457T
gccgacuggcgcgagc

SEQ ID NO: 3854556 - RNA, 22 nt, Shigella flexneri 2a str. 2457T
gccgagaagauuuuuugccagc

SEQ ID NO: 3854557 - RNA, 11 nt, Shigella flexneri 2a str. 2457T
gccgagcgcgu

SEQ ID NO: 3854558 - RNA, 15 nt, Shigella flexneri 2a str. 2457T
gccgagcugaacaag

SEQ ID NO: 3854559 - RNA, 16 nt, Shigella flexneri 2a str. 2457T
gccgaggauacagccg

SEQ ID NO: 3854560 - RNA, 20 nt, Shigella flexneri 2a str. 2457T
gccgaggcacagcaggccaa

SEQ ID NO: 3854561 - RNA, 16 nt, Shigella flexneri 2a str. 2457T
gccgaggcgcuggcag

SEQ ID NO: 3854562 - RNA, 20 nt, Shigella flexneri 2a str. 2457T
gccgaggugcucuccacgcu

SEQ ID NO: 3854563 - RNA, 21 nt, Shigella flexneri 2a str. 2457T
gccgauaaauacagcguuaaa

SEQ ID NO: 3854564 - RNA, 13 nt, Shigella flexneri 2a str. 2457T
gccgauaauacuc

SEQ ID NO: 3854565 - RNA, 18 nt, Shigella flexneri 2a str. 2457T
gccgaucaauuucacagu

SEQ ID NO: 3854566 - RNA, 16 nt, Shigella flexneri 2a str. 2457T
gccgaucaucauccag

SEQ ID NO: 3854567 - RNA, 17 nt, Shigella flexneri 2a str. 2457T
gccgaucauuggccgga

SEQ ID NO: 3854568 - RNA, 14 nt, Shigella flexneri 2a str. 2457T
gccgaucgucuggg

SEQ ID NO: 3854569 - RNA, 15 nt, Shigella flexneri 2a str. 2457T
gccgaucgucugggc

SEQ ID NO: 3854570 - RNA, 18 nt, Shigella flexneri 2a str. 2457T
gccgaugaacggcggcgg

SEQ ID NO: 3854571 - RNA, 17 nt, Shigella flexneri 2a str. 2457T
gccgaugccagaaagcg

SEQ ID NO: 3854572 - RNA, 17 nt, Shigella flexneri 2a str. 2457T
gccgauguugcaugauu

SEQ ID NO: 3854573 - RNA, 20 nt, Shigella flexneri 2a str. 2457T
gccgauuaaaaucagaaucg

SEQ ID NO: 3854574 - RNA, 16 nt, Shigella flexneri 2a str. 2457T
gccgauuaaucuucca

SEQ ID NO: 3854575 - RNA, 21 nt, Shigella flexneri 2a str. 2457T
gccgauuucaugaagcugaca

SEQ ID NO: 3854576 - RNA, 20 nt, Shigella flexneri 2a str. 2457T
gccgauuuugccuucauacu

SEQ ID NO: 3854577 - RNA, 20 nt, Shigella flexneri 2a str. 2457T
gccgcaaaucguauccggca

SEQ ID NO: 3854578 - RNA, 17 nt, Shigella flexneri 2a str. 2457T
gccgcaacuaccagcag

SEQ ID NO: 3854579 - RNA, 15 nt, Shigella flexneri 2a str. 2457T
gccgcaacuuuagcc

SEQ ID NO: 3854580 - RNA, 21 nt, Shigella flexneri 2a str. 2457T
gccgcaauggccguuccggca

SEQ ID NO: 3854581 - RNA, 20 nt, Shigella flexneri 2a str. 2457T
gccgcacaccugcauucgag

SEQ ID NO: 3854582 - RNA, 21 nt, Shigella flexneri 2a str. 2457T
gccgcacauuucccggccacg

SEQ ID NO: 3854583 - RNA, 19 nt, Shigella flexneri 2a str. 2457T
gccgcaccaggaucuuuug

SEQ ID NO: 3854584 - RNA, 19 nt, Shigella flexneri 2a str. 2457T
gccgcacuuaauauacgcu

SEQ ID NO: 3854585 - RNA, 18 nt, Shigella flexneri 2a str. 2457T
gccgcacuuacagcaacg

SEQ ID NO: 3854586 - RNA, 13 nt, Shigella flexneri 2a str. 2457T
gccgcagcaaccg

SEQ ID NO: 3854587 - RNA, 19 nt, Shigella flexneri 2a str. 2457T
gccgcagcacccugaguuu

SEQ ID NO: 3854588 - RNA, 13 nt, Shigella flexneri 2a str. 2457T
gccgcagccauca

SEQ ID NO: 3854589 - RNA, 15 nt, Shigella flexneri 2a str. 2457T
gccgcagccaucagc

SEQ ID NO: 3854590 - RNA, 14 nt, Shigella flexneri 2a str. 2457T
gccgcagcgauggu

SEQ ID NO: 3854591 - RNA, 15 nt, Shigella flexneri 2a str. 2457T
gccgcaggcggacug

SEQ ID NO: 3854592 - RNA, 19 nt, Shigella flexneri 2a str. 2457T
gccgcauccgacacuggca

SEQ ID NO: 3854593 - RNA, 12 nt, Shigella flexneri 2a str. 2457T
gccgcauccggc

SEQ ID NO: 3854594 - RNA, 22 nt, Shigella flexneri 2a str. 2457T
gccgcauccggcaauucucucu

SEQ ID NO: 3854595 - RNA, 20 nt, Shigella flexneri 2a str. 2457T
gccgcauccggcagccgugc

SEQ ID NO: 3854596 - RNA, 15 nt, Shigella flexneri 2a str. 2457T
gccgcauccggcauc

SEQ ID NO: 3854597 - RNA, 19 nt, Shigella flexneri 2a str. 2457T
gccgcauggaaccaguuca

SEQ ID NO: 3854598 - RNA, 11 nt, Shigella flexneri 2a str. 2457T
gccgcauugac

SEQ ID NO: 3854599 - RNA, 16 nt, Shigella flexneri 2a str. 2457T
gccgccacugccacca

SEQ ID NO: 3854600 - RNA, 22 nt, Shigella flexneri 2a str. 2457T
gccgccagaccacugcgccgcu

SEQ ID NO: 3854601 - RNA, 20 nt, Shigella flexneri 2a str. 2457T
gccgccagacguccggcgcu

SEQ ID NO: 3854602 - RNA, 16 nt, Shigella flexneri 2a str. 2457T
gccgccaguucuucca

SEQ ID NO: 3854603 - RNA, 13 nt, Shigella flexneri 2a str. 2457T
gccgccauccggc

SEQ ID NO: 3854604 - RNA, 18 nt, Shigella flexneri 2a str. 2457T
gccgccaucucuuccagc

SEQ ID NO: 3854605 - RNA, 21 nt, Shigella flexneri 2a str. 2457T
gccgccaucucuuccagcgau

SEQ ID NO: 3854606 - RNA, 22 nt, Shigella flexneri 2a str. 2457T
gccgccauugacguuccuuucu

SEQ ID NO: 3854607 - RNA, 11 nt, Shigella flexneri 2a str. 2457T
gccgcccagcc

SEQ ID NO: 3854608 - RNA, 17 nt, Shigella flexneri 2a str. 2457T
gccgccccagucaguaa

SEQ ID NO: 3854609 - RNA, 17 nt, Shigella flexneri 2a str. 2457T
gccgcccguuuucucca

SEQ ID NO: 3854610 - RNA, 19 nt, Shigella flexneri 2a str. 2457T
gccgccgcaaacaucggcu

SEQ ID NO: 3854611 - RNA, 13 nt, Shigella flexneri 2a str. 2457T
gccgccgcaaccg

SEQ ID NO: 3854612 - RNA, 11 nt, Shigella flexneri 2a str. 2457T
gccgccggaaa

SEQ ID NO: 3854613 - RNA, 20 nt, Shigella flexneri 2a str. 2457T
gccgccuaacgacaaaucau

SEQ ID NO: 3854614 - RNA, 18 nt, Shigella flexneri 2a str. 2457T
gccgccuuuuacgcauuc

SEQ ID NO: 3854615 - RNA, 16 nt, Shigella flexneri 2a str. 2457T
gccgcgacgcccccug

SEQ ID NO: 3854616 - RNA, 17 nt, Shigella flexneri 2a str. 2457T
gccgcgaucucgucagc

SEQ ID NO: 3854617 - RNA, 21 nt, Shigella flexneri 2a str. 2457T
gccgcgcaaauccacguucca

SEQ ID NO: 3854618 - RNA, 14 nt, Shigella flexneri 2a str. 2457T
gccgcgcagcgugc

SEQ ID NO: 3854619 - RNA, 14 nt, Shigella flexneri 2a str. 2457T
gccgcgcaguuucu

SEQ ID NO: 3854620 - RNA, 19 nt, Shigella flexneri 2a str. 2457T
gccgcgccaaugccugaug

SEQ ID NO: 3854621 - RNA, 14 nt, Shigella flexneri 2a str. 2457T
gccgcguaccgcag

SEQ ID NO: 3854622 - RNA, 15 nt, Shigella flexneri 2a str. 2457T
gccgcguagagaaaa

SEQ ID NO: 3854623 - RNA, 20 nt, Shigella flexneri 2a str. 2457T
gccgcgucugaauaucaucc

SEQ ID NO: 3854624 - RNA, 18 nt, Shigella flexneri 2a str. 2457T
gccgcgucuuauccggcc

SEQ ID NO: 3854625 - RNA, 21 nt, Shigella flexneri 2a str. 2457T
gccgcguggacggucaacuga

SEQ ID NO: 3854626 - RNA, 18 nt, Shigella flexneri 2a str. 2457T
gccgcguuggcaaugucg

SEQ ID NO: 3854627 - RNA, 16 nt, Shigella flexneri 2a str. 2457T
gccgcguuugcgcagc

SEQ ID NO: 3854628 - RNA, 15 nt, Shigella flexneri 2a str. 2457T
gccgcuaacagcagc

SEQ ID NO: 3854629 - RNA, 24 nt, Shigella flexneri 2a str. 2457T
gccgcuaacgucuaguaaagcaga

SEQ ID NO: 3854630 - RNA, 15 nt, Shigella flexneri 2a str. 2457T
gccgcuaccagcgcg

SEQ ID NO: 3854631 - RNA, 14 nt, Shigella flexneri 2a str. 2457T
gccgcuaccgcccu

SEQ ID NO: 3854632 - RNA, 21 nt, Shigella flexneri 2a str. 2457T
gccgcuacggaagaugaaaaa

SEQ ID NO: 3854633 - RNA, 16 nt, Shigella flexneri 2a str. 2457T
gccgcuaucgcugaua

SEQ ID NO: 3854634 - RNA, 19 nt, Shigella flexneri 2a str. 2457T
gccgcuaucgcugauauac

SEQ ID NO: 3854635 - RNA, 17 nt, Shigella flexneri 2a str. 2457T
gccgcucagucggcgcu

SEQ ID NO: 3854636 - RNA, 22 nt, Shigella flexneri 2a str. 2457T
gccgcuccaaggucuccgccca

SEQ ID NO: 3854637 - RNA, 12 nt, Shigella flexneri 2a str. 2457T
gccgcugcgcgu

SEQ ID NO: 3854638 - RNA, 17 nt, Shigella flexneri 2a str. 2457T
gccgcugcgcgugaagc

SEQ ID NO: 3854639 - RNA, 18 nt, Shigella flexneri 2a str. 2457T
gccgcuggccauuucugc

SEQ ID NO: 3854640 - RNA, 15 nt, Shigella flexneri 2a str. 2457T
gccgcuguaauacca

SEQ ID NO: 3854641 - RNA, 21 nt, Shigella flexneri 2a str. 2457T
gccgcugucuaccagcaccug

SEQ ID NO: 3854642 - RNA, 20 nt, Shigella flexneri 2a str. 2457T
gccgcuguguguaggccagc

SEQ ID NO: 3854643 - RNA, 16 nt, Shigella flexneri 2a str. 2457T
gccgcuucugcagcuu

SEQ ID NO: 3854644 - RNA, 15 nt, Shigella flexneri 2a str. 2457T
gccgcuuuccaggca

SEQ ID NO: 3854645 - RNA, 13 nt, Shigella flexneri 2a str. 2457T
gccgcuuuuucug

SEQ ID NO: 3854646 - RNA, 20 nt, Shigella flexneri 2a str. 2457T
gccgcuuuuucugcgcacac

SEQ ID NO: 3854647 - RNA, 20 nt, Shigella flexneri 2a str. 2457T
gccggaacguuaagagcugg

SEQ ID NO: 3854648 - RNA, 13 nt, Shigella flexneri 2a str. 2457T
gccggaauaauca

SEQ ID NO: 3854649 - RNA, 14 nt, Shigella flexneri 2a str. 2457T
gccggaauggugcu

SEQ ID NO: 3854650 - RNA, 14 nt, Shigella flexneri 2a str. 2457T
gccggaauuuuccu

SEQ ID NO: 3854651 - RNA, 16 nt, Shigella flexneri 2a str. 2457T
gccggaauuuuccuuc

SEQ ID NO: 3854652 - RNA, 13 nt, Shigella flexneri 2a str. 2457T
gccggacaugcug

SEQ ID NO: 3854653 - RNA, 18 nt, Shigella flexneri 2a str. 2457T
gccggaccaucuuccagu

SEQ ID NO: 3854654 - RNA, 17 nt, Shigella flexneri 2a str. 2457T
gccggacccacaccccc

SEQ ID NO: 3854655 - RNA, 13 nt, Shigella flexneri 2a str. 2457T
gccggacgucagg

SEQ ID NO: 3854656 - RNA, 18 nt, Shigella flexneri 2a str. 2457T
gccggacugggcgcgcuc

SEQ ID NO: 3854657 - RNA, 14 nt, Shigella flexneri 2a str. 2457T
gccggagccagccg

SEQ ID NO: 3854658 - RNA, 17 nt, Shigella flexneri 2a str. 2457T
gccggagccagccguug

SEQ ID NO: 3854659 - RNA, 21 nt, Shigella flexneri 2a str. 2457T
gccggagcuucccccgcaucg

SEQ ID NO: 3854660 - RNA, 18 nt, Shigella flexneri 2a str. 2457T
gccggaggcaaguuuccu

SEQ ID NO: 3854661 - RNA, 23 nt, Shigella flexneri 2a str. 2457T
gccggaggcaaguuuccuccggc

SEQ ID NO: 3854662 - RNA, 18 nt, Shigella flexneri 2a str. 2457T
gccggagucgcauuaaca

SEQ ID NO: 3854663 - RNA, 16 nt, Shigella flexneri 2a str. 2457T
gccggaguugcagauu

SEQ ID NO: 3854664 - RNA, 23 nt, Shigella flexneri 2a str. 2457T
gccggauaaacaauguuauccgg

SEQ ID NO: 3854665 - RNA, 15 nt, Shigella flexneri 2a str. 2457T
gccggauaagacgcg

SEQ ID NO: 3854666 - RNA, 17 nt, Shigella flexneri 2a str. 2457T
gccggauaaggcgcucg

SEQ ID NO: 3854667 - RNA, 24 nt, Shigella flexneri 2a str. 2457T
gccggauaaggcguuuucgccgca

SEQ ID NO: 3854668 - RNA, 14 nt, Shigella flexneri 2a str. 2457T
gccggauagacaug

SEQ ID NO: 3854669 - RNA, 22 nt, Shigella flexneri 2a str. 2457T
gccggaucagcgucgccuggug

SEQ ID NO: 3854670 - RNA, 18 nt, Shigella flexneri 2a str. 2457T
gccggaugaucauccggc

SEQ ID NO: 3854671 - RNA, 15 nt, Shigella flexneri 2a str. 2457T
gccggaugcaucaca

SEQ ID NO: 3854672 - RNA, 23 nt, Shigella flexneri 2a str. 2457T
gccggaugccucuccuguucuca

SEQ ID NO: 3854673 - RNA, 18 nt, Shigella flexneri 2a str. 2457T
gccggaugcgaugcugac

SEQ ID NO: 3854674 - RNA, 13 nt, Shigella flexneri 2a str. 2457T
gccggaugcggcg

SEQ ID NO: 3854675 - RNA, 23 nt, Shigella flexneri 2a str. 2457T
gccggaugcggcguaaaugccuu

SEQ ID NO: 3854676 - RNA, 20 nt, Shigella flexneri 2a str. 2457T
gccggauggaaacauccggc

SEQ ID NO: 3854677 - RNA, 21 nt, Shigella flexneri 2a str. 2457T
gccggaugugaugcauccggc

SEQ ID NO: 3854678 - RNA, 20 nt, Shigella flexneri 2a str. 2457T
gccggauguuugcauccggc

SEQ ID NO: 3854679 - RNA, 23 nt, Shigella flexneri 2a str. 2457T
gccggauucacgccaaccagcug

SEQ ID NO: 3854680 - RNA, 22 nt, Shigella flexneri 2a str. 2457T
gccggcauauaccucagcagac

SEQ ID NO: 3854681 - RNA, 17 nt, Shigella flexneri 2a str. 2457T
gccggccagcgccacca

SEQ ID NO: 3854682 - RNA, 15 nt, Shigella flexneri 2a str. 2457T
gccgggaacuggcaa

SEQ ID NO: 3854683 - RNA, 21 nt, Shigella flexneri 2a str. 2457T
gccgggaagcucucuuccagu

SEQ ID NO: 3854684 - RNA, 18 nt, Shigella flexneri 2a str. 2457T
gccgggauuuauucccgg

SEQ ID NO: 3854685 - RNA, 16 nt, Shigella flexneri 2a str. 2457T
gccgggcgugcugccg

SEQ ID NO: 3854686 - RNA, 19 nt, Shigella flexneri 2a str. 2457T
gccgggcgugcugccguuu

SEQ ID NO: 3854687 - RNA, 19 nt, Shigella flexneri 2a str. 2457T
gccggggagauauucccca

SEQ ID NO: 3854688 - RNA, 21 nt, Shigella flexneri 2a str. 2457T
gccggggagauauuccccaga

SEQ ID NO: 3854689 - RNA, 21 nt, Shigella flexneri 2a str. 2457T
gccgguaacgcuuucucacca

SEQ ID NO: 3854690 - RNA, 22 nt, Shigella flexneri 2a str. 2457T
gccgguaacgcuuucucaccau

SEQ ID NO: 3854691 - RNA, 14 nt, Shigella flexneri 2a str. 2457T
gccgguagaagcca

SEQ ID NO: 3854692 - RNA, 16 nt, Shigella flexneri 2a str. 2457T
gccgguagaagccagu

SEQ ID NO: 3854693 - RNA, 21 nt, Shigella flexneri 2a str. 2457T
gccgguagucaccgcccagug

SEQ ID NO: 3854694 - RNA, 23 nt, Shigella flexneri 2a str. 2457T
gccgguagucaccgcccagugca

SEQ ID NO: 3854695 - RNA, 16 nt, Shigella flexneri 2a str. 2457T
gccggugaccaucagc

SEQ ID NO: 3854696 - RNA, 19 nt, Shigella flexneri 2a str. 2457T
gccggugaccaucagcaug

SEQ ID NO: 3854697 - RNA, 14 nt, Shigella flexneri 2a str. 2457T
gccggugcaugauu

SEQ ID NO: 3854698 - RNA, 15 nt, Shigella flexneri 2a str. 2457T
gccggugcggucagg

SEQ ID NO: 3854699 - RNA, 13 nt, Shigella flexneri 2a str. 2457T
gccgguggccuug

SEQ ID NO: 3854700 - RNA, 16 nt, Shigella flexneri 2a str. 2457T
gccgguggugaccugu

SEQ ID NO: 3854701 - RNA, 14 nt, Shigella flexneri 2a str. 2457T
gccgguuaauacgc

SEQ ID NO: 3854702 - RNA, 13 nt, Shigella flexneri 2a str. 2457T
gccgguuccagcu

SEQ ID NO: 3854703 - RNA, 14 nt, Shigella flexneri 2a str. 2457T
gccgguuuaucucc

SEQ ID NO: 3854704 - RNA, 22 nt, Shigella flexneri 2a str. 2457T
gccgguuuaucuccgcuggagc

SEQ ID NO: 3854705 - RNA, 17 nt, Shigella flexneri 2a str. 2457T
gccguaaaucaccauug

SEQ ID NO: 3854706 - RNA, 20 nt, Shigella flexneri 2a str. 2457T
gccguaauauuucucggcaa

SEQ ID NO: 3854707 - RNA, 14 nt, Shigella flexneri 2a str. 2457T
gccguacaggcagc

SEQ ID NO: 3854708 - RNA, 15 nt, Shigella flexneri 2a str. 2457T
gccguacaggcagcu

SEQ ID NO: 3854709 - RNA, 18 nt, Shigella flexneri 2a str. 2457T
gccguacugcauaaugcc

SEQ ID NO: 3854710 - RNA, 22 nt, Shigella flexneri 2a str. 2457T
gccgucaccgccugcgauggug

SEQ ID NO: 3854711 - RNA, 19 nt, Shigella flexneri 2a str. 2457T
gccgucaggugacacuuca

SEQ ID NO: 3854712 - RNA, 17 nt, Shigella flexneri 2a str. 2457T
gccgucaucacaccgcg

SEQ ID NO: 3854713 - RNA, 22 nt, Shigella flexneri 2a str. 2457T
gccgucauuguuaacgccgcgc

SEQ ID NO: 3854714 - RNA, 20 nt, Shigella flexneri 2a str. 2457T
gccguccugcguuucuucua

SEQ ID NO: 3854715 - RNA, 20 nt, Shigella flexneri 2a str. 2457T
gccgucgaggaacaucugag

SEQ ID NO: 3854716 - RNA, 17 nt, Shigella flexneri 2a str. 2457T
gccgucgaugccccagu

SEQ ID NO: 3854717 - RNA, 17 nt, Shigella flexneri 2a str. 2457T
gccgucgauggcgcaga

SEQ ID NO: 3854718 - RNA, 18 nt, Shigella flexneri 2a str. 2457T
gccgucgccacaaccagc

SEQ ID NO: 3854719 - RNA, 18 nt, Shigella flexneri 2a str. 2457T
gccgugaacguggccaug

SEQ ID NO: 3854720 - RNA, 12 nt, Shigella flexneri 2a str. 2457T
gccgugcgaaua

SEQ ID NO: 3854721 - RNA, 19 nt, Shigella flexneri 2a str. 2457T
gccgugcugugugccgcga

SEQ ID NO: 3854722 - RNA, 17 nt, Shigella flexneri 2a str. 2457T
gccguuaacccgucugg

SEQ ID NO: 3854723 - RNA, 13 nt, Shigella flexneri 2a str. 2457T
gccguuagcuuca

SEQ ID NO: 3854724 - RNA, 20 nt, Shigella flexneri 2a str. 2457T
gccguuauacaucgcuuucc

SEQ ID NO: 3854725 - RNA, 21 nt, Shigella flexneri 2a str. 2457T
gccguuauccugaucaagcac

SEQ ID NO: 3854726 - RNA, 13 nt, Shigella flexneri 2a str. 2457T
gccguucuucagc

SEQ ID NO: 3854727 - RNA, 16 nt, Shigella flexneri 2a str. 2457T
gccguugaguucaaau

SEQ ID NO: 3854728 - RNA, 14 nt, Shigella flexneri 2a str. 2457T
gccguugauaaaga

SEQ ID NO: 3854729 - RNA, 15 nt, Shigella flexneri 2a str. 2457T
gccguugaucucucc

SEQ ID NO: 3854730 - RNA, 13 nt, Shigella flexneri 2a str. 2457T
gccguuggcggcg

SEQ ID NO: 3854731 - RNA, 13 nt, Shigella flexneri 2a str. 2457T
gccguugucgacg

SEQ ID NO: 3854732 - RNA, 21 nt, Shigella flexneri 2a str. 2457T
gccguuugcugcuccugcggc

SEQ ID NO: 3854733 - RNA, 14 nt, Shigella flexneri 2a str. 2457T
gccguuuucgucaa

SEQ ID NO: 3854734 - RNA, 20 nt, Shigella flexneri 2a str. 2457T
gccguuuuuacccagcagca

SEQ ID NO: 3854735 - RNA, 19 nt, Shigella flexneri 2a str. 2457T
gccuaacaauucgccaggg

SEQ ID NO: 3854736 - RNA, 14 nt, Shigella flexneri 2a str. 2457T
gccuaacaccauca

SEQ ID NO: 3854737 - RNA, 21 nt, Shigella flexneri 2a str. 2457T
gccuaauccagccuacaaauu

SEQ ID NO: 3854738 - RNA, 17 nt, Shigella flexneri 2a str. 2457T
gccuacaaaaucuauug

SEQ ID NO: 3854739 - RNA, 20 nt, Shigella flexneri 2a str. 2457T
gccuacaacuccguugaaau

SEQ ID NO: 3854740 - RNA, 20 nt, Shigella flexneri 2a str. 2457T
gccuacaaguccguugaaaa

SEQ ID NO: 3854741 - RNA, 14 nt, Shigella flexneri 2a str. 2457T
gccuacagaugauu

SEQ ID NO: 3854742 - RNA, 23 nt, Shigella flexneri 2a str. 2457T
gccuacgacuuucuccgcauccg

SEQ ID NO: 3854743 - RNA, 15 nt, Shigella flexneri 2a str. 2457T
gccuacggcauucug

SEQ ID NO: 3854744 - RNA, 19 nt, Shigella flexneri 2a str. 2457T
gccucaacccuuuuuuaaa

SEQ ID NO: 3854745 - RNA, 22 nt, Shigella flexneri 2a str. 2457T
gccucaacccuuuuuuaaacau

SEQ ID NO: 3854746 - RNA, 20 nt, Shigella flexneri 2a str. 2457T
gccucaguggcugcguuuca

SEQ ID NO: 3854747 - RNA, 23 nt, Shigella flexneri 2a str. 2457T
gccucaguggcugcguuucaugu

SEQ ID NO: 3854748 - RNA, 15 nt, Shigella flexneri 2a str. 2457T
gccucccauuuccug

SEQ ID NO: 3854749 - RNA, 15 nt, Shigella flexneri 2a str. 2457T
gccucccuucgcugc

SEQ ID NO: 3854750 - RNA, 18 nt, Shigella flexneri 2a str. 2457T
gccuccucagaaaagagu

SEQ ID NO: 3854751 - RNA, 22 nt, Shigella flexneri 2a str. 2457T
gccuccuguucugugcgccaug

SEQ ID NO: 3854752 - RNA, 15 nt, Shigella flexneri 2a str. 2457T
gccucgcaaauucca

SEQ ID NO: 3854753 - RNA, 16 nt, Shigella flexneri 2a str. 2457T
gccucgccgaaacgcu

SEQ ID NO: 3854754 - RNA, 17 nt, Shigella flexneri 2a str. 2457T
gccucgccgaaacgcuu

SEQ ID NO: 3854755 - RNA, 19 nt, Shigella flexneri 2a str. 2457T
gccucgcuggucagcgcca

SEQ ID NO: 3854756 - RNA, 18 nt, Shigella flexneri 2a str. 2457T
gccucgggcuuugcuaca

SEQ ID NO: 3854757 - RNA, 17 nt, Shigella flexneri 2a str. 2457T
gccucguucuucccucc

SEQ ID NO: 3854758 - RNA, 21 nt, Shigella flexneri 2a str. 2457T
gccucuaacagaucauccauc

SEQ ID NO: 3854759 - RNA, 19 nt, Shigella flexneri 2a str. 2457T
gccucucaaaccccgccac

SEQ ID NO: 3854760 - RNA, 20 nt, Shigella flexneri 2a str. 2457T
gccucucggaucgguggcgc

SEQ ID NO: 3854761 - RNA, 14 nt, Shigella flexneri 2a str. 2457T
gccucuuuauaaau

SEQ ID NO: 3854762 - RNA, 22 nt, Shigella flexneri 2a str. 2457T
gccucuuuuaaccucagcgaac

SEQ ID NO: 3854763 - RNA, 17 nt, Shigella flexneri 2a str. 2457T
gccugaaaaaacagcag

SEQ ID NO: 3854764 - RNA, 21 nt, Shigella flexneri 2a str. 2457T
gccugaaaacgaaaucguugu

SEQ ID NO: 3854765 - RNA, 12 nt, Shigella flexneri 2a str. 2457T
gccugaaaguau

SEQ ID NO: 3854766 - RNA, 17 nt, Shigella flexneri 2a str. 2457T
gccugaaauaaugcagc

SEQ ID NO: 3854767 - RNA, 18 nt, Shigella flexneri 2a str. 2457T
gccugaaauaaugcagcg

SEQ ID NO: 3854768 - RNA, 14 nt, Shigella flexneri 2a str. 2457T
gccugaaggaccuu

SEQ ID NO: 3854769 - RNA, 12 nt, Shigella flexneri 2a str. 2457T
gccugaaugcuu

SEQ ID NO: 3854770 - RNA, 15 nt, Shigella flexneri 2a str. 2457T
gccugacggacgcgc

SEQ ID NO: 3854771 - RNA, 15 nt, Shigella flexneri 2a str. 2457T
gccugauaagacgcg

SEQ ID NO: 3854772 - RNA, 16 nt, Shigella flexneri 2a str. 2457T
gccugauaagcguagc

SEQ ID NO: 3854773 - RNA, 20 nt, Shigella flexneri 2a str. 2457T
gccugauaagcguagcgcau

SEQ ID NO: 3854774 - RNA, 23 nt, Shigella flexneri 2a str. 2457T
gccugauaagcguagcgcaucag

SEQ ID NO: 3854775 - RNA, 22 nt, Shigella flexneri 2a str. 2457T
gccugauacagccaaaucauca

SEQ ID NO: 3854776 - RNA, 17 nt, Shigella flexneri 2a str. 2457T
gccugauacaggaaggc

SEQ ID NO: 3854777 - RNA, 21 nt, Shigella flexneri 2a str. 2457T
gccugauagcccgcacaaagc

SEQ ID NO: 3854778 - RNA, 13 nt, Shigella flexneri 2a str. 2457T
gccugaugcgacg

SEQ ID NO: 3854779 - RNA, 14 nt, Shigella flexneri 2a str. 2457T
gccugaugcgacgc

SEQ ID NO: 3854780 - RNA, 24 nt, Shigella flexneri 2a str. 2457T
gccugaugcgacgcugcgcgucuu

SEQ ID NO: 3854781 - RNA, 19 nt, Shigella flexneri 2a str. 2457T
gccugaugcgacgcuugca

SEQ ID NO: 3854782 - RNA, 23 nt, Shigella flexneri 2a str. 2457T
gccugaugcgacgcuugcagcgu

SEQ ID NO: 3854783 - RNA, 18 nt, Shigella flexneri 2a str. 2457T
gccugaugcgcugcgcuu

SEQ ID NO: 3854784 - RNA, 22 nt, Shigella flexneri 2a str. 2457T
gccugaugcgcuucgcuuauca

SEQ ID NO: 3854785 - RNA, 14 nt, Shigella flexneri 2a str. 2457T
gccugaugcggcgu

SEQ ID NO: 3854786 - RNA, 13 nt, Shigella flexneri 2a str. 2457T
gccugaugcguug

SEQ ID NO: 3854787 - RNA, 20 nt, Shigella flexneri 2a str. 2457T
gccugaugugacgcuuguca

SEQ ID NO: 3854788 - RNA, 22 nt, Shigella flexneri 2a str. 2457T
gccugauucaaugaguuauaca

SEQ ID NO: 3854789 - RNA, 13 nt, Shigella flexneri 2a str. 2457T
gccugcaaauaaa

SEQ ID NO: 3854790 - RNA, 14 nt, Shigella flexneri 2a str. 2457T
gccugcaaauaaau

SEQ ID NO: 3854791 - RNA, 19 nt, Shigella flexneri 2a str. 2457T
gccugcaccauugcugccg

SEQ ID NO: 3854792 - RNA, 13 nt, Shigella flexneri 2a str. 2457T
gccugcacugcag

SEQ ID NO: 3854793 - RNA, 17 nt, Shigella flexneri 2a str. 2457T
gccugcacugcaggccg

SEQ ID NO: 3854794 - RNA, 22 nt, Shigella flexneri 2a str. 2457T
gccugcagcugcucauuacagu

SEQ ID NO: 3854795 - RNA, 16 nt, Shigella flexneri 2a str. 2457T
gccugcaggaucagca

SEQ ID NO: 3854796 - RNA, 16 nt, Shigella flexneri 2a str. 2457T
gccugcagggcuuuca

SEQ ID NO: 3854797 - RNA, 15 nt, Shigella flexneri 2a str. 2457T
gccugcaucgauagc

SEQ ID NO: 3854798 - RNA, 16 nt, Shigella flexneri 2a str. 2457T
gccugccaucuggcag

SEQ ID NO: 3854799 - RNA, 19 nt, Shigella flexneri 2a str. 2457T
gccugccaucuggcaggcu

SEQ ID NO: 3854800 - RNA, 23 nt, Shigella flexneri 2a str. 2457T
gccugcccagccgguaaggccga

SEQ ID NO: 3854801 - RNA, 16 nt, Shigella flexneri 2a str. 2457T
gccugccgcauccggu

SEQ ID NO: 3854802 - RNA, 14 nt, Shigella flexneri 2a str. 2457T
gccugccgccagca

SEQ ID NO: 3854803 - RNA, 13 nt, Shigella flexneri 2a str. 2457T
gccugccugcagc

SEQ ID NO: 3854804 - RNA, 17 nt, Shigella flexneri 2a str. 2457T
gccugccugcagcugcu

SEQ ID NO: 3854805 - RNA, 15 nt, Shigella flexneri 2a str. 2457T
gccugcgaagcucuu

SEQ ID NO: 3854806 - RNA, 15 nt, Shigella flexneri 2a str. 2457T
gccugcgacaagaau

SEQ ID NO: 3854807 - RNA, 22 nt, Shigella flexneri 2a str. 2457T
gccugcgacgucucggcaugga

SEQ ID NO: 3854808 - RNA, 16 nt, Shigella flexneri 2a str. 2457T
gccugcgcgauacuac

SEQ ID NO: 3854809 - RNA, 18 nt, Shigella flexneri 2a str. 2457T
gccugcucaagcguuuca

SEQ ID NO: 3854810 - RNA, 21 nt, Shigella flexneri 2a str. 2457T
gccugcuccagugcauccagc

SEQ ID NO: 3854811 - RNA, 16 nt, Shigella flexneri 2a str. 2457T
gccugcuccucgguga

SEQ ID NO: 3854812 - RNA, 21 nt, Shigella flexneri 2a str. 2457T
gccugcuccucggugaucuca

SEQ ID NO: 3854813 - RNA, 14 nt, Shigella flexneri 2a str. 2457T
gccugcuucgucca

SEQ ID NO: 3854814 - RNA, 14 nt, Shigella flexneri 2a str. 2457T
gccugcuuuugcca

SEQ ID NO: 3854815 - RNA, 15 nt, Shigella flexneri 2a str. 2457T
gccuggaauuacuga

SEQ ID NO: 3854816 - RNA, 15 nt, Shigella flexneri 2a str. 2457T
gccuggauggcuugc

SEQ ID NO: 3854817 - RNA, 16 nt, Shigella flexneri 2a str. 2457T
gccuggauggcuugcu

SEQ ID NO: 3854818 - RNA, 14 nt, Shigella flexneri 2a str. 2457T
gccuggauuuucuc

SEQ ID NO: 3854819 - RNA, 15 nt, Shigella flexneri 2a str. 2457T
gccuggcaaugcgcu

SEQ ID NO: 3854820 - RNA, 18 nt, Shigella flexneri 2a str. 2457T
gccuggcccauagacagg

SEQ ID NO: 3854821 - RNA, 17 nt, Shigella flexneri 2a str. 2457T
gccuggcugcauggcaa

SEQ ID NO: 3854822 - RNA, 18 nt, Shigella flexneri 2a str. 2457T
gccugggcgauuuccuuc

SEQ ID NO: 3854823 - RNA, 19 nt, Shigella flexneri 2a str. 2457T
gccugggcgauuuccuuca

SEQ ID NO: 3854824 - RNA, 16 nt, Shigella flexneri 2a str. 2457T
gccugguaccagcacc

SEQ ID NO: 3854825 - RNA, 18 nt, Shigella flexneri 2a str. 2457T
gccugguaccagcaccgu

SEQ ID NO: 3854826 - RNA, 20 nt, Shigella flexneri 2a str. 2457T
gccugguuauagcaguaauu

SEQ ID NO: 3854827 - RNA, 15 nt, Shigella flexneri 2a str. 2457T
gccuguaacgccuuu

SEQ ID NO: 3854828 - RNA, 15 nt, Shigella flexneri 2a str. 2457T
gccuguaaugccagu

SEQ ID NO: 3854829 - RNA, 19 nt, Shigella flexneri 2a str. 2457T
gccuguaccacaaccugca

SEQ ID NO: 3854830 - RNA, 20 nt, Shigella flexneri 2a str. 2457T
gccuguaccacaaccugcac

SEQ ID NO: 3854831 - RNA, 18 nt, Shigella flexneri 2a str. 2457T
gccuguacggcagugaac

SEQ ID NO: 3854832 - RNA, 15 nt, Shigella flexneri 2a str. 2457T
gccuguacuuccugu

SEQ ID NO: 3854833 - RNA, 17 nt, Shigella flexneri 2a str. 2457T
gccuguauuacgccuuc

SEQ ID NO: 3854834 - RNA, 19 nt, Shigella flexneri 2a str. 2457T
gccuguccaccacgcugca

SEQ ID NO: 3854835 - RNA, 12 nt, Shigella flexneri 2a str. 2457T
gccugugcgcgu

SEQ ID NO: 3854836 - RNA, 16 nt, Shigella flexneri 2a str. 2457T
gccuguggugauucau

SEQ ID NO: 3854837 - RNA, 16 nt, Shigella flexneri 2a str. 2457T
gccugugucaggccgg

SEQ ID NO: 3854838 - RNA, 18 nt, Shigella flexneri 2a str. 2457T
gccuguuccagacgcugc

SEQ ID NO: 3854839 - RNA, 13 nt, Shigella flexneri 2a str. 2457T
gccuuaaaaacca

SEQ ID NO: 3854840 - RNA, 18 nt, Shigella flexneri 2a str. 2457T
gccuuaccaauaccgcgu

SEQ ID NO: 3854841 - RNA, 14 nt, Shigella flexneri 2a str. 2457T
gccuuaccacucug

SEQ ID NO: 3854842 - RNA, 22 nt, Shigella flexneri 2a str. 2457T
gccuuaccacucugaccugaca

SEQ ID NO: 3854843 - RNA, 18 nt, Shigella flexneri 2a str. 2457T
gccuuacgcugcauuuuc

SEQ ID NO: 3854844 - RNA, 14 nt, Shigella flexneri 2a str. 2457T
gccuuauccagccu

SEQ ID NO: 3854845 - RNA, 18 nt, Shigella flexneri 2a str. 2457T
gccuuauccgaugguuua

SEQ ID NO: 3854846 - RNA, 14 nt, Shigella flexneri 2a str. 2457T
gccuuauccggccu

SEQ ID NO: 3854847 - RNA, 21 nt, Shigella flexneri 2a str. 2457T
gccuuauccggcuuaccgcuc

SEQ ID NO: 3854848 - RNA, 14 nt, Shigella flexneri 2a str. 2457T
gccuuauccugccu

SEQ ID NO: 3854849 - RNA, 19 nt, Shigella flexneri 2a str. 2457T
gccuucacaggccgccagg

SEQ ID NO: 3854850 - RNA, 20 nt, Shigella flexneri 2a str. 2457T
gccuucacgguuauuguagc

SEQ ID NO: 3854851 - RNA, 20 nt, Shigella flexneri 2a str. 2457T
gccuucagugauggugauaa

SEQ ID NO: 3854852 - RNA, 21 nt, Shigella flexneri 2a str. 2457T
gccuucauucaggccaaagcc

SEQ ID NO: 3854853 - RNA, 15 nt, Shigella flexneri 2a str. 2457T
gccuucccuuucagc

SEQ ID NO: 3854854 - RNA, 18 nt, Shigella flexneri 2a str. 2457T
gccuucccuuucagcaaa

SEQ ID NO: 3854855 - RNA, 21 nt, Shigella flexneri 2a str. 2457T
gccuucgcaaaaaaccauccc

SEQ ID NO: 3854856 - RNA, 15 nt, Shigella flexneri 2a str. 2457T
gccuucgccuuucag

SEQ ID NO: 3854857 - RNA, 12 nt, Shigella flexneri 2a str. 2457T
gccuucugcggu

SEQ ID NO: 3854858 - RNA, 15 nt, Shigella flexneri 2a str. 2457T
gccuucuucauccag

SEQ ID NO: 3854859 - RNA, 16 nt, Shigella flexneri 2a str. 2457T
gccuugaacaaacaau

SEQ ID NO: 3854860 - RNA, 21 nt, Shigella flexneri 2a str. 2457T
gccuugaguaccauuugcaua

SEQ ID NO: 3854861 - RNA, 20 nt, Shigella flexneri 2a str. 2457T
gccuugcgauuacgcucggc

SEQ ID NO: 3854862 - RNA, 21 nt, Shigella flexneri 2a str. 2457T
gccuugcgauuacgcucggca

SEQ ID NO: 3854863 - RNA, 19 nt, Shigella flexneri 2a str. 2457T
gccuugucaucgucggccu

SEQ ID NO: 3854864 - RNA, 21 nt, Shigella flexneri 2a str. 2457T
gccuuuaccgcgcucgaagcg

SEQ ID NO: 3854865 - RNA, 21 nt, Shigella flexneri 2a str. 2457T
gccuuuauuaaugacauucag

SEQ ID NO: 3854866 - RNA, 23 nt, Shigella flexneri 2a str. 2457T
gccuuucacgccgggaaauuuuu

SEQ ID NO: 3854867 - RNA, 21 nt, Shigella flexneri 2a str. 2457T
gccuuuccuccugucuucccu

SEQ ID NO: 3854868 - RNA, 13 nt, Shigella flexneri 2a str. 2457T
gccuuucucagaa

SEQ ID NO: 3854869 - RNA, 22 nt, Shigella flexneri 2a str. 2457T
gccuuugaaaauaacaucgcca

SEQ ID NO: 3854870 - RNA, 23 nt, Shigella flexneri 2a str. 2457T
gccuuugaaaauaacaucgccag

SEQ ID NO: 3854871 - RNA, 13 nt, Shigella flexneri 2a str. 2457T
gccuuugaucuca

SEQ ID NO: 3854872 - RNA, 21 nt, Shigella flexneri 2a str. 2457T
gccuuuucaguuggcugacaa

SEQ ID NO: 3854873 - RNA, 13 nt, Shigella flexneri 2a str. 2457T
gccuuuuccagcg

SEQ ID NO: 3854874 - RNA, 18 nt, Shigella flexneri 2a str. 2457T
gccuuuuccuuucagagu

SEQ ID NO: 3854875 - RNA, 15 nt, Shigella flexneri 2a str. 2457T
gcgaaaaagcguuca

SEQ ID NO: 3854876 - RNA, 15 nt, Shigella flexneri 2a str. 2457T
gcgaaaaucaaccau

SEQ ID NO: 3854877 - RNA, 15 nt, Shigella flexneri 2a str. 2457T
gcgaaaccuccgcaa

SEQ ID NO: 3854878 - RNA, 11 nt, Shigella flexneri 2a str. 2457T
gcgaaagaaaa

SEQ ID NO: 3854879 - RNA, 12 nt, Shigella flexneri 2a str. 2457T
gcgaaagaaaag

SEQ ID NO: 3854880 - RNA, 14 nt, Shigella flexneri 2a str. 2457T
gcgaaaguaccauu

SEQ ID NO: 3854881 - RNA, 20 nt, Shigella flexneri 2a str. 2457T
gcgaaauguguuggcaccau

SEQ ID NO: 3854882 - RNA, 14 nt, Shigella flexneri 2a str. 2457T
gcgaaauugguaga

SEQ ID NO: 3854883 - RNA, 18 nt, Shigella flexneri 2a str. 2457T
gcgaacaacagaucaaca

SEQ ID NO: 3854884 - RNA, 21 nt, Shigella flexneri 2a str. 2457T
gcgaacauaaggaugcgggcg

SEQ ID NO: 3854885 - RNA, 20 nt, Shigella flexneri 2a str. 2457T
gcgaaccagacgguacccgc

SEQ ID NO: 3854886 - RNA, 15 nt, Shigella flexneri 2a str. 2457T
gcgaaccaggccgua

SEQ ID NO: 3854887 - RNA, 20 nt, Shigella flexneri 2a str. 2457T
gcgaacuuccauacggcguu

SEQ ID NO: 3854888 - RNA, 17 nt, Shigella flexneri 2a str. 2457T
gcgaagaaagcggguga

SEQ ID NO: 3854889 - RNA, 17 nt, Shigella flexneri 2a str. 2457T
gcgaagauacccgcgag

SEQ ID NO: 3854890 - RNA, 22 nt, Shigella flexneri 2a str. 2457T
gcgaagauacccgcgaggcgca

SEQ ID NO: 3854891 - RNA, 15 nt, Shigella flexneri 2a str. 2457T
gcgaagcuggcggcg

SEQ ID NO: 3854892 - RNA, 17 nt, Shigella flexneri 2a str. 2457T
gcgaagcuggcggcggc

SEQ ID NO: 3854893 - RNA, 15 nt, Shigella flexneri 2a str. 2457T
gcgaagcuggucagc

SEQ ID NO: 3854894 - RNA, 19 nt, Shigella flexneri 2a str. 2457T
gcgaagcuggucagcaucg

SEQ ID NO: 3854895 - RNA, 16 nt, Shigella flexneri 2a str. 2457T
gcgaaggcgcacugau

SEQ ID NO: 3854896 - RNA, 13 nt, Shigella flexneri 2a str. 2457T
gcgaagggcuguc

SEQ ID NO: 3854897 - RNA, 16 nt, Shigella flexneri 2a str. 2457T
gcgaagggcugucggu

SEQ ID NO: 3854898 - RNA, 15 nt, Shigella flexneri 2a str. 2457T
gcgaaguagacagcg

SEQ ID NO: 3854899 - RNA, 18 nt, Shigella flexneri 2a str. 2457T
gcgaaguagacagcguuu

SEQ ID NO: 3854900 - RNA, 22 nt, Shigella flexneri 2a str. 2457T
gcgaagucguucagaucuuuca

SEQ ID NO: 3854901 - RNA, 14 nt, Shigella flexneri 2a str. 2457T
gcgaaguucgccau

SEQ ID NO: 3854902 - RNA, 16 nt, Shigella flexneri 2a str. 2457T
gcgaaguucgccauca

SEQ ID NO: 3854903 - RNA, 16 nt, Shigella flexneri 2a str. 2457T
gcgaauaaaaagccua

SEQ ID NO: 3854904 - RNA, 21 nt, Shigella flexneri 2a str. 2457T
gcgaauaguuuccgcuucugc

SEQ ID NO: 3854905 - RNA, 18 nt, Shigella flexneri 2a str. 2457T
gcgaauccagcaugcuca

SEQ ID NO: 3854906 - RNA, 14 nt, Shigella flexneri 2a str. 2457T
gcgaaucgcuucau

SEQ ID NO: 3854907 - RNA, 15 nt, Shigella flexneri 2a str. 2457T
gcgaaugaggcagca

SEQ ID NO: 3854908 - RNA, 16 nt, Shigella flexneri 2a str. 2457T
gcgaauggcaugcucc

SEQ ID NO: 3854909 - RNA, 19 nt, Shigella flexneri 2a str. 2457T
gcgaauguuccaucaccag

SEQ ID NO: 3854910 - RNA, 12 nt, Shigella flexneri 2a str. 2457T
gcgaauuuuuuc

SEQ ID NO: 3854911 - RNA, 17 nt, Shigella flexneri 2a str. 2457T
gcgacaaacgccugaac

SEQ ID NO: 3854912 - RNA, 15 nt, Shigella flexneri 2a str. 2457T
gcgacaagcgucgca

SEQ ID NO: 3854913 - RNA, 14 nt, Shigella flexneri 2a str. 2457T
gcgacaaucccugc

SEQ ID NO: 3854914 - RNA, 14 nt, Shigella flexneri 2a str. 2457T
gcgacaccagccau

SEQ ID NO: 3854915 - RNA, 19 nt, Shigella flexneri 2a str. 2457T
gcgacagacgacgacgcgc

SEQ ID NO: 3854916 - RNA, 19 nt, Shigella flexneri 2a str. 2457T
gcgacagauucaggcgcag

SEQ ID NO: 3854917 - RNA, 18 nt, Shigella flexneri 2a str. 2457T
gcgacagauuuugccagc

SEQ ID NO: 3854918 - RNA, 19 nt, Shigella flexneri 2a str. 2457T
gcgacagauuuugccagca

SEQ ID NO: 3854919 - RNA, 17 nt, Shigella flexneri 2a str. 2457T
gcgacagggaucucuuc

SEQ ID NO: 3854920 - RNA, 17 nt, Shigella flexneri 2a str. 2457T
gcgacaucaccgccgga

SEQ ID NO: 3854921 - RNA, 13 nt, Shigella flexneri 2a str. 2457T
gcgacauggcgaa

SEQ ID NO: 3854922 - RNA, 13 nt, Shigella flexneri 2a str. 2457T
gcgaccaccagcg

SEQ ID NO: 3854923 - RNA, 12 nt, Shigella flexneri 2a str. 2457T
gcgaccaccggg

SEQ ID NO: 3854924 - RNA, 17 nt, Shigella flexneri 2a str. 2457T
gcgaccaggccggugau

SEQ ID NO: 3854925 - RNA, 16 nt, Shigella flexneri 2a str. 2457T
gcgaccauacagcagc

SEQ ID NO: 3854926 - RNA, 20 nt, Shigella flexneri 2a str. 2457T
gcgacccguuuacggcuaaa

SEQ ID NO: 3854927 - RNA, 14 nt, Shigella flexneri 2a str. 2457T
gcgaccgaacagau

SEQ ID NO: 3854928 - RNA, 18 nt, Shigella flexneri 2a str. 2457T
gcgaccgaacagaucacg

SEQ ID NO: 3854929 - RNA, 21 nt, Shigella flexneri 2a str. 2457T
gcgaccggcgucgcauccggc

SEQ ID NO: 3854930 - RNA, 16 nt, Shigella flexneri 2a str. 2457T
gcgaccguucgccagg

SEQ ID NO: 3854931 - RNA, 15 nt, Shigella flexneri 2a str. 2457T
gcgaccguuuucacc

SEQ ID NO: 3854932 - RNA, 20 nt, Shigella flexneri 2a str. 2457T
gcgaccuacacgccuucucc

SEQ ID NO: 3854933 - RNA, 15 nt, Shigella flexneri 2a str. 2457T
gcgacgaacagcuca

SEQ ID NO: 3854934 - RNA, 21 nt, Shigella flexneri 2a str. 2457T
gcgacgaccacccaccgcagc

SEQ ID NO: 3854935 - RNA, 22 nt, Shigella flexneri 2a str. 2457T
gcgacgaccacccaccgcagcc

SEQ ID NO: 3854936 - RNA, 18 nt, Shigella flexneri 2a str. 2457T
gcgacgccucuauuaaaa

SEQ ID NO: 3854937 - RNA, 20 nt, Shigella flexneri 2a str. 2457T
gcgacgcuggcgcgucuuau

SEQ ID NO: 3854938 - RNA, 21 nt, Shigella flexneri 2a str. 2457T
gcgacgcuggucgcgucuuau

SEQ ID NO: 3854939 - RNA, 14 nt, Shigella flexneri 2a str. 2457T
gcgacgcuguccgc

SEQ ID NO: 3854940 - RNA, 21 nt, Shigella flexneri 2a str. 2457T
gcgacgcuugacgcgucuuau

SEQ ID NO: 3854941 - RNA, 17 nt, Shigella flexneri 2a str. 2457T
gcgacgcuugccgcguc

SEQ ID NO: 3854942 - RNA, 20 nt, Shigella flexneri 2a str. 2457T
gcgacgcuugcgcgucuuau

SEQ ID NO: 3854943 - RNA, 24 nt, Shigella flexneri 2a str. 2457T
gcgacggaacuucauaugcgccag

SEQ ID NO: 3854944 - RNA, 22 nt, Shigella flexneri 2a str. 2457T
gcgacggcgaaucaaccgcgcc

SEQ ID NO: 3854945 - RNA, 12 nt, Shigella flexneri 2a str. 2457T
gcgacgguucau

SEQ ID NO: 3854946 - RNA, 14 nt, Shigella flexneri 2a str. 2457T
gcgacguagcccgg

SEQ ID NO: 3854947 - RNA, 16 nt, Shigella flexneri 2a str. 2457T
gcgacucucugagcca

SEQ ID NO: 3854948 - RNA, 15 nt, Shigella flexneri 2a str. 2457T
gcgacugccagcauc

SEQ ID NO: 3854949 - RNA, 16 nt, Shigella flexneri 2a str. 2457T
gcgacuugcucaggag

SEQ ID NO: 3854950 - RNA, 15 nt, Shigella flexneri 2a str. 2457T
gcgacuuuaaucacc

SEQ ID NO: 3854951 - RNA, 13 nt, Shigella flexneri 2a str. 2457T
gcgagaacugaac

SEQ ID NO: 3854952 - RNA, 14 nt, Shigella flexneri 2a str. 2457T
gcgagacaacaaag

SEQ ID NO: 3854953 - RNA, 23 nt, Shigella flexneri 2a str. 2457T
gcgagaucuuuaucaaucaccgc

SEQ ID NO: 3854954 - RNA, 19 nt, Shigella flexneri 2a str. 2457T
gcgagauuccgccgccauu

SEQ ID NO: 3854955 - RNA, 23 nt, Shigella flexneri 2a str. 2457T
gcgagcaaaaucguaagcaggag

SEQ ID NO: 3854956 - RNA, 21 nt, Shigella flexneri 2a str. 2457T
gcgagcauaggcauuaaacau

SEQ ID NO: 3854957 - RNA, 20 nt, Shigella flexneri 2a str. 2457T
gcgagccauaaacugagcca

SEQ ID NO: 3854958 - RNA, 23 nt, Shigella flexneri 2a str. 2457T
gcgagccuguaccacaaccugca

SEQ ID NO: 3854959 - RNA, 21 nt, Shigella flexneri 2a str. 2457T
gcgagcgccuuauccugccug

SEQ ID NO: 3854960 - RNA, 16 nt, Shigella flexneri 2a str. 2457T
gcgagcgcggcuggcu

SEQ ID NO: 3854961 - RNA, 13 nt, Shigella flexneri 2a str. 2457T
gcgagcuggcgcu

SEQ ID NO: 3854962 - RNA, 23 nt, Shigella flexneri 2a str. 2457T
gcgagcuuccuguauaacgcaaa

SEQ ID NO: 3854963 - RNA, 17 nt, Shigella flexneri 2a str. 2457T
gcgagcuuucgaccagc

SEQ ID NO: 3854964 - RNA, 19 nt, Shigella flexneri 2a str. 2457T
gcgaggcggggccaauugc

SEQ ID NO: 3854965 - RNA, 12 nt, Shigella flexneri 2a str. 2457T
gcgagggagaaa

SEQ ID NO: 3854966 - RNA, 19 nt, Shigella flexneri 2a str. 2457T
gcgaggggaccgccccugc

SEQ ID NO: 3854967 - RNA, 16 nt, Shigella flexneri 2a str. 2457T
gcgagguaggcaguca

SEQ ID NO: 3854968 - RNA, 17 nt, Shigella flexneri 2a str. 2457T
gcgagguuaccgacugc

SEQ ID NO: 3854969 - RNA, 19 nt, Shigella flexneri 2a str. 2457T
gcgagguuauccgccagcg

SEQ ID NO: 3854970 - RNA, 14 nt, Shigella flexneri 2a str. 2457T
gcgaguaaucaggc

SEQ ID NO: 3854971 - RNA, 15 nt, Shigella flexneri 2a str. 2457T
gcgagucgagauccc

SEQ ID NO: 3854972 - RNA, 13 nt, Shigella flexneri 2a str. 2457T
gcgagucgucagu

SEQ ID NO: 3854973 - RNA, 14 nt, Shigella flexneri 2a str. 2457T
gcgagucgucaguu

SEQ ID NO: 3854974 - RNA, 15 nt, Shigella flexneri 2a str. 2457T
gcgaguuugaucucg

SEQ ID NO: 3854975 - RNA, 16 nt, Shigella flexneri 2a str. 2457T
gcgaguuuuaccuuca

SEQ ID NO: 3854976 - RNA, 21 nt, Shigella flexneri 2a str. 2457T
gcgauaaaaauccuguuccau

SEQ ID NO: 3854977 - RNA, 13 nt, Shigella flexneri 2a str. 2457T
gcgauaaaucuca

SEQ ID NO: 3854978 - RNA, 22 nt, Shigella flexneri 2a str. 2457T
gcgauaaccuucaccgugaaug

SEQ ID NO: 3854979 - RNA, 22 nt, Shigella flexneri 2a str. 2457T
gcgauaacgccccaauccacgc

SEQ ID NO: 3854980 - RNA, 11 nt, Shigella flexneri 2a str. 2457T
gcgauaauauu

SEQ ID NO: 3854981 - RNA, 14 nt, Shigella flexneri 2a str. 2457T
gcgauaaucagcgc

SEQ ID NO: 3854982 - RNA, 17 nt, Shigella flexneri 2a str. 2457T
gcgauaaucagcgccag

SEQ ID NO: 3854983 - RNA, 17 nt, Shigella flexneri 2a str. 2457T
gcgauaaugcccagcaa

SEQ ID NO: 3854984 - RNA, 13 nt, Shigella flexneri 2a str. 2457T
gcgauacacugaa

SEQ ID NO: 3854985 - RNA, 15 nt, Shigella flexneri 2a str. 2457T
gcgauacuuuuucaa

SEQ ID NO: 3854986 - RNA, 18 nt, Shigella flexneri 2a str. 2457T
gcgauauaauaaaccugc

SEQ ID NO: 3854987 - RNA, 21 nt, Shigella flexneri 2a str. 2457T
gcgauaucgcgguacuucuca

SEQ ID NO: 3854988 - RNA, 20 nt, Shigella flexneri 2a str. 2457T
gcgauauuauccccugcgau

SEQ ID NO: 3854989 - RNA, 14 nt, Shigella flexneri 2a str. 2457T
gcgauauugcugca

SEQ ID NO: 3854990 - RNA, 13 nt, Shigella flexneri 2a str. 2457T
gcgaucaggcauu

SEQ ID NO: 3854991 - RNA, 21 nt, Shigella flexneri 2a str. 2457T
gcgaucccacgccgaaugccg

SEQ ID NO: 3854992 - RNA, 18 nt, Shigella flexneri 2a str. 2457T
gcgaucccagagcgggca

SEQ ID NO: 3854993 - RNA, 21 nt, Shigella flexneri 2a str. 2457T
gcgauccgguacuggcguggg

SEQ ID NO: 3854994 - RNA, 18 nt, Shigella flexneri 2a str. 2457T
gcgaucgaccugcgccug

SEQ ID NO: 3854995 - RNA, 20 nt, Shigella flexneri 2a str. 2457T
gcgaucgaccugcgccugca

SEQ ID NO: 3854996 - RNA, 16 nt, Shigella flexneri 2a str. 2457T
gcgaucgacgcgucca

SEQ ID NO: 3854997 - RNA, 17 nt, Shigella flexneri 2a str. 2457T
gcgaucgggaaccggcu

SEQ ID NO: 3854998 - RNA, 15 nt, Shigella flexneri 2a str. 2457T
gcgaucugcgcguca

SEQ ID NO: 3854999 - RNA, 12 nt, Shigella flexneri 2a str. 2457T
gcgaucuucccg

SEQ ID NO: 3855000 - RNA, 13 nt, Shigella flexneri 2a str. 2457T
gcgaugaccgcca

SEQ ID NO: 3855001 - RNA, 13 nt, Shigella flexneri 2a str. 2457T
gcgaugaugccaa

SEQ ID NO: 3855002 - RNA, 20 nt, Shigella flexneri 2a str. 2457T
gcgaugaugccaagccgaua

SEQ ID NO: 3855003 - RNA, 20 nt, Shigella flexneri 2a str. 2457T
gcgaugauuuucggcugcgc

SEQ ID NO: 3855004 - RNA, 17 nt, Shigella flexneri 2a str. 2457T
gcgaugcccccagcagc

SEQ ID NO: 3855005 - RNA, 15 nt, Shigella flexneri 2a str. 2457T
gcgaugccuggcaau

SEQ ID NO: 3855006 - RNA, 16 nt, Shigella flexneri 2a str. 2457T
gcgauggcggcagccu

SEQ ID NO: 3855007 - RNA, 20 nt, Shigella flexneri 2a str. 2457T
gcgauggguuaacaucaugu

SEQ ID NO: 3855008 - RNA, 12 nt, Shigella flexneri 2a str. 2457T
gcgaugguggug

SEQ ID NO: 3855009 - RNA, 22 nt, Shigella flexneri 2a str. 2457T
gcgaugguguuccagaauuacg

SEQ ID NO: 3855010 - RNA, 19 nt, Shigella flexneri 2a str. 2457T
gcgauguucaauaaaagca

SEQ ID NO: 3855011 - RNA, 17 nt, Shigella flexneri 2a str. 2457T
gcgauuaugaaacaaga

SEQ ID NO: 3855012 - RNA, 21 nt, Shigella flexneri 2a str. 2457T
gcgauuauuuauucccgccag

SEQ ID NO: 3855013 - RNA, 19 nt, Shigella flexneri 2a str. 2457T
gcgauucauaugcgccagc

SEQ ID NO: 3855014 - RNA, 21 nt, Shigella flexneri 2a str. 2457T
gcgauucauaugcgccagcug

SEQ ID NO: 3855015 - RNA, 22 nt, Shigella flexneri 2a str. 2457T
gcgauucauaugcgccagcugc

SEQ ID NO: 3855016 - RNA, 23 nt, Shigella flexneri 2a str. 2457T
gcgauucccguuuauggucgggu

SEQ ID NO: 3855017 - RNA, 15 nt, Shigella flexneri 2a str. 2457T
gcgauucggcuccgu

SEQ ID NO: 3855018 - RNA, 12 nt, Shigella flexneri 2a str. 2457T
gcgauugccgca

SEQ ID NO: 3855019 - RNA, 17 nt, Shigella flexneri 2a str. 2457T
gcgauuuaucggcaauu

SEQ ID NO: 3855020 - RNA, 12 nt, Shigella flexneri 2a str. 2457T
gcgauuuccuuc

SEQ ID NO: 3855021 - RNA, 13 nt, Shigella flexneri 2a str. 2457T
gcgauuuccuuca

SEQ ID NO: 3855022 - RNA, 16 nt, Shigella flexneri 2a str. 2457T
gcgcaaacuuaucgug

SEQ ID NO: 3855023 - RNA, 13 nt, Shigella flexneri 2a str. 2457T
gcgcaaaggccag

SEQ ID NO: 3855024 - RNA, 18 nt, Shigella flexneri 2a str. 2457T
gcgcaaaggccagcaauc

SEQ ID NO: 3855025 - RNA, 19 nt, Shigella flexneri 2a str. 2457T
gcgcaaaggccagcaaucc

SEQ ID NO: 3855026 - RNA, 18 nt, Shigella flexneri 2a str. 2457T
gcgcaaauccacguucca

SEQ ID NO: 3855027 - RNA, 21 nt, Shigella flexneri 2a str. 2457T
gcgcaaauccacguuccagau

SEQ ID NO: 3855028 - RNA, 17 nt, Shigella flexneri 2a str. 2457T
gcgcaacuugugcucgu

SEQ ID NO: 3855029 - RNA, 16 nt, Shigella flexneri 2a str. 2457T
gcgcaagggccgcagc

SEQ ID NO: 3855030 - RNA, 12 nt, Shigella flexneri 2a str. 2457T
gcgcaauaauca

SEQ ID NO: 3855031 - RNA, 12 nt, Shigella flexneri 2a str. 2457T
gcgcaauaccga

SEQ ID NO: 3855032 - RNA, 22 nt, Shigella flexneri 2a str. 2457T
gcgcaauaccgauaucgccauu

SEQ ID NO: 3855033 - RNA, 15 nt, Shigella flexneri 2a str. 2457T
gcgcaaucagcaccg

SEQ ID NO: 3855034 - RNA, 13 nt, Shigella flexneri 2a str. 2457T
gcgcaaugcguuu

SEQ ID NO: 3855035 - RNA, 24 nt, Shigella flexneri 2a str. 2457T
gcgcaauggcuggccccgucagca

SEQ ID NO: 3855036 - RNA, 20 nt, Shigella flexneri 2a str. 2457T
gcgcaauguugcgggggcuu

SEQ ID NO: 3855037 - RNA, 17 nt, Shigella flexneri 2a str. 2457T
gcgcaauucgcgucggc

SEQ ID NO: 3855038 - RNA, 12 nt, Shigella flexneri 2a str. 2457T
gcgcaauugcca

SEQ ID NO: 3855039 - RNA, 17 nt, Shigella flexneri 2a str. 2457T
gcgcaauuuccauugcu

SEQ ID NO: 3855040 - RNA, 18 nt, Shigella flexneri 2a str. 2457T
gcgcacacacgcccagcu

SEQ ID NO: 3855041 - RNA, 19 nt, Shigella flexneri 2a str. 2457T
gcgcacaguaaugcgccag

SEQ ID NO: 3855042 - RNA, 13 nt, Shigella flexneri 2a str. 2457T
gcgcacaucagga

SEQ ID NO: 3855043 - RNA, 18 nt, Shigella flexneri 2a str. 2457T
gcgcacauccgcgucggc

SEQ ID NO: 3855044 - RNA, 15 nt, Shigella flexneri 2a str. 2457T
gcgcaccagaauacc

SEQ ID NO: 3855045 - RNA, 12 nt, Shigella flexneri 2a str. 2457T
gcgcaccagcgu

SEQ ID NO: 3855046 - RNA, 23 nt, Shigella flexneri 2a str. 2457T
gcgcaccggccccugaucggcca

SEQ ID NO: 3855047 - RNA, 23 nt, Shigella flexneri 2a str. 2457T
gcgcacguacaucccgcgaacga

SEQ ID NO: 3855048 - RNA, 15 nt, Shigella flexneri 2a str. 2457T
gcgcacgucagccuc

SEQ ID NO: 3855049 - RNA, 18 nt, Shigella flexneri 2a str. 2457T
gcgcacuaugugccagcu

SEQ ID NO: 3855050 - RNA, 17 nt, Shigella flexneri 2a str. 2457T
gcgcacuauuccggcgu

SEQ ID NO: 3855051 - RNA, 22 nt, Shigella flexneri 2a str. 2457T
gcgcacuggcggaugugcugga

SEQ ID NO: 3855052 - RNA, 17 nt, Shigella flexneri 2a str. 2457T
gcgcacugucgccgcgg

SEQ ID NO: 3855053 - RNA, 22 nt, Shigella flexneri 2a str. 2457T
gcgcagcaagucggcaucgcca

SEQ ID NO: 3855054 - RNA, 13 nt, Shigella flexneri 2a str. 2457T
gcgcagcacccag

SEQ ID NO: 3855055 - RNA, 18 nt, Shigella flexneri 2a str. 2457T
gcgcagcauaaucggcug

SEQ ID NO: 3855056 - RNA, 23 nt, Shigella flexneri 2a str. 2457T
gcgcagcguucauaaauacagag

SEQ ID NO: 3855057 - RNA, 17 nt, Shigella flexneri 2a str. 2457T
gcgcaggagccacauag

SEQ ID NO: 3855058 - RNA, 17 nt, Shigella flexneri 2a str. 2457T
gcgcaggccaacagucu

SEQ ID NO: 3855059 - RNA, 20 nt, Shigella flexneri 2a str. 2457T
gcgcaggguuugcaucgcca

SEQ ID NO: 3855060 - RNA, 16 nt, Shigella flexneri 2a str. 2457T
gcgcaggucauccggc

SEQ ID NO: 3855061 - RNA, 14 nt, Shigella flexneri 2a str. 2457T
gcgcaguaccacgg

SEQ ID NO: 3855062 - RNA, 19 nt, Shigella flexneri 2a str. 2457T
gcgcagucacaccagcgau

SEQ ID NO: 3855063 - RNA, 16 nt, Shigella flexneri 2a str. 2457T
gcgcagucaccagcau

SEQ ID NO: 3855064 - RNA, 17 nt, Shigella flexneri 2a str. 2457T
gcgcagucaccagcauc

SEQ ID NO: 3855065 - RNA, 19 nt, Shigella flexneri 2a str. 2457T
gcgcagugccuucugguga

SEQ ID NO: 3855066 - RNA, 16 nt, Shigella flexneri 2a str. 2457T
gcgcaguucgcacacc

SEQ ID NO: 3855067 - RNA, 13 nt, Shigella flexneri 2a str. 2457T
gcgcaguugcaac

SEQ ID NO: 3855068 - RNA, 22 nt, Shigella flexneri 2a str. 2457T
gcgcaguugcaacucgacugga

SEQ ID NO: 3855069 - RNA, 20 nt, Shigella flexneri 2a str. 2457T
gcgcaguuuaaucguugaug

SEQ ID NO: 3855070 - RNA, 12 nt, Shigella flexneri 2a str. 2457T
gcgcaguuucga

SEQ ID NO: 3855071 - RNA, 21 nt, Shigella flexneri 2a str. 2457T
gcgcauaaaagcuauacaucg

SEQ ID NO: 3855072 - RNA, 12 nt, Shigella flexneri 2a str. 2457T
gcgcauauugcc

SEQ ID NO: 3855073 - RNA, 12 nt, Shigella flexneri 2a str. 2457T
gcgcaucaaagc

SEQ ID NO: 3855074 - RNA, 13 nt, Shigella flexneri 2a str. 2457T
gcgcaucaaagcc

SEQ ID NO: 3855075 - RNA, 18 nt, Shigella flexneri 2a str. 2457T
gcgcaucagcuccgguau

SEQ ID NO: 3855076 - RNA, 14 nt, Shigella flexneri 2a str. 2457T
gcgcaucaggcaau

SEQ ID NO: 3855077 - RNA, 19 nt, Shigella flexneri 2a str. 2457T
gcgcaucaggcaaugcuuc

SEQ ID NO: 3855078 - RNA, 15 nt, Shigella flexneri 2a str. 2457T
gcgcaucaugccacc

SEQ ID NO: 3855079 - RNA, 17 nt, Shigella flexneri 2a str. 2457T
gcgcaugacaugcggua

SEQ ID NO: 3855080 - RNA, 16 nt, Shigella flexneri 2a str. 2457T
gcgcauuaagccauga

SEQ ID NO: 3855081 - RNA, 19 nt, Shigella flexneri 2a str. 2457T
gcgcauuacgcucacugca

SEQ ID NO: 3855082 - RNA, 12 nt, Shigella flexneri 2a str. 2457T
gcgcauugacga

SEQ ID NO: 3855083 - RNA, 16 nt, Shigella flexneri 2a str. 2457T
gcgcauuucccagcaa

SEQ ID NO: 3855084 - RNA, 19 nt, Shigella flexneri 2a str. 2457T
gcgcauuucccagcaagaa

SEQ ID NO: 3855085 - RNA, 22 nt, Shigella flexneri 2a str. 2457T
gcgcauuucccagcaagaacca

SEQ ID NO: 3855086 - RNA, 18 nt, Shigella flexneri 2a str. 2457T
gcgccaaucagcgcagca

SEQ ID NO: 3855087 - RNA, 21 nt, Shigella flexneri 2a str. 2457T
gcgccaaucagcgcagcaccc

SEQ ID NO: 3855088 - RNA, 14 nt, Shigella flexneri 2a str. 2457T
gcgccaauugccag

SEQ ID NO: 3855089 - RNA, 15 nt, Shigella flexneri 2a str. 2457T
gcgccacaggucagc

SEQ ID NO: 3855090 - RNA, 16 nt, Shigella flexneri 2a str. 2457T
gcgccacauccggcau

SEQ ID NO: 3855091 - RNA, 15 nt, Shigella flexneri 2a str. 2457T
gcgccaccaccagca

SEQ ID NO: 3855092 - RNA, 14 nt, Shigella flexneri 2a str. 2457T
gcgccaccagcgcc

SEQ ID NO: 3855093 - RNA, 20 nt, Shigella flexneri 2a str. 2457T
gcgccaccgcggacagacuu

SEQ ID NO: 3855094 - RNA, 19 nt, Shigella flexneri 2a str. 2457T
gcgccaccucuuucaccaa

SEQ ID NO: 3855095 - RNA, 16 nt, Shigella flexneri 2a str. 2457T
gcgccacgcaacagac

SEQ ID NO: 3855096 - RNA, 18 nt, Shigella flexneri 2a str. 2457T
gcgccacucgauaccaga

SEQ ID NO: 3855097 - RNA, 20 nt, Shigella flexneri 2a str. 2457T
gcgccagaacacgcucccag

SEQ ID NO: 3855098 - RNA, 16 nt, Shigella flexneri 2a str. 2457T
gcgccagaagggacaa

SEQ ID NO: 3855099 - RNA, 19 nt, Shigella flexneri 2a str. 2457T
gcgccagagcgcggcguga

SEQ ID NO: 3855100 - RNA, 17 nt, Shigella flexneri 2a str. 2457T
gcgccagauagccgacc

SEQ ID NO: 3855101 - RNA, 13 nt, Shigella flexneri 2a str. 2457T
gcgccagauggca

SEQ ID NO: 3855102 - RNA, 11 nt, Shigella flexneri 2a str. 2457T
gcgccagcaag

SEQ ID NO: 3855103 - RNA, 19 nt, Shigella flexneri 2a str. 2457T
gcgccagcaagagcaaaua

SEQ ID NO: 3855104 - RNA, 22 nt, Shigella flexneri 2a str. 2457T
gcgccagcaagagcaaauaaaa

SEQ ID NO: 3855105 - RNA, 13 nt, Shigella flexneri 2a str. 2457T
gcgccagccagcc

SEQ ID NO: 3855106 - RNA, 21 nt, Shigella flexneri 2a str. 2457T
gcgccagccaguuuacccagc

SEQ ID NO: 3855107 - RNA, 20 nt, Shigella flexneri 2a str. 2457T
gcgccagcgaagccagcucc

SEQ ID NO: 3855108 - RNA, 13 nt, Shigella flexneri 2a str. 2457T
gcgccagcgcgga

SEQ ID NO: 3855109 - RNA, 15 nt, Shigella flexneri 2a str. 2457T
gcgccagcgucauca

SEQ ID NO: 3855110 - RNA, 17 nt, Shigella flexneri 2a str. 2457T
gcgccagcugcauuuca

SEQ ID NO: 3855111 - RNA, 16 nt, Shigella flexneri 2a str. 2457T
gcgccaggaucagaau

SEQ ID NO: 3855112 - RNA, 16 nt, Shigella flexneri 2a str. 2457T
gcgccagggcuuacaa

SEQ ID NO: 3855113 - RNA, 21 nt, Shigella flexneri 2a str. 2457T
gcgccagguguuuaaccaaca

SEQ ID NO: 3855114 - RNA, 22 nt, Shigella flexneri 2a str. 2457T
gcgccaguugcuuauccagcac

SEQ ID NO: 3855115 - RNA, 14 nt, Shigella flexneri 2a str. 2457T
gcgccauccauaau

SEQ ID NO: 3855116 - RNA, 22 nt, Shigella flexneri 2a str. 2457T
gcgccauuuuucacugcggcaa

SEQ ID NO: 3855117 - RNA, 19 nt, Shigella flexneri 2a str. 2457T
gcgcccaguggaugcgcca

SEQ ID NO: 3855118 - RNA, 21 nt, Shigella flexneri 2a str. 2457T
gcgcccggaaacgggcgcuga

SEQ ID NO: 3855119 - RNA, 12 nt, Shigella flexneri 2a str. 2457T
gcgcccuguucu

SEQ ID NO: 3855120 - RNA, 19 nt, Shigella flexneri 2a str. 2457T
gcgccgacugcgccaauac

SEQ ID NO: 3855121 - RNA, 23 nt, Shigella flexneri 2a str. 2457T
gcgccgagcaauaaaaacuccgc

SEQ ID NO: 3855122 - RNA, 16 nt, Shigella flexneri 2a str. 2457T
gcgccgaguaaaaaaa

SEQ ID NO: 3855123 - RNA, 15 nt, Shigella flexneri 2a str. 2457T
gcgccgcauccggca

SEQ ID NO: 3855124 - RNA, 16 nt, Shigella flexneri 2a str. 2457T
gcgccgcauccggcau

SEQ ID NO: 3855125 - RNA, 20 nt, Shigella flexneri 2a str. 2457T
gcgccgcaucgggggaagcu

SEQ ID NO: 3855126 - RNA, 22 nt, Shigella flexneri 2a str. 2457T
gcgccgcaucgggggaagcuga

SEQ ID NO: 3855127 - RNA, 14 nt, Shigella flexneri 2a str. 2457T
gcgccgccacugcc

SEQ ID NO: 3855128 - RNA, 20 nt, Shigella flexneri 2a str. 2457T
gcgccgccuccucagaaaag

SEQ ID NO: 3855129 - RNA, 17 nt, Shigella flexneri 2a str. 2457T
gcgccgcugagaaaaag

SEQ ID NO: 3855130 - RNA, 14 nt, Shigella flexneri 2a str. 2457T
gcgccgcuuucucu

SEQ ID NO: 3855131 - RNA, 22 nt, Shigella flexneri 2a str. 2457T
gcgccgcuuuuugugcggaagu

SEQ ID NO: 3855132 - RNA, 17 nt, Shigella flexneri 2a str. 2457T
gcgccguccacaaaccg

SEQ ID NO: 3855133 - RNA, 23 nt, Shigella flexneri 2a str. 2457T
gcgccgugaacguggccaugagc

SEQ ID NO: 3855134 - RNA, 19 nt, Shigella flexneri 2a str. 2457T
gcgccgugcaacugcggcg

SEQ ID NO: 3855135 - RNA, 20 nt, Shigella flexneri 2a str. 2457T
gcgccgugcaacugcggcgc

SEQ ID NO: 3855136 - RNA, 22 nt, Shigella flexneri 2a str. 2457T
gcgccgugucggugcucaucag

SEQ ID NO: 3855137 - RNA, 21 nt, Shigella flexneri 2a str. 2457T
gcgccucaacgccuaaugcca

SEQ ID NO: 3855138 - RNA, 17 nt, Shigella flexneri 2a str. 2457T
gcgccuuauccugccug

SEQ ID NO: 3855139 - RNA, 21 nt, Shigella flexneri 2a str. 2457T
gcgccuucauucaggccaaag

SEQ ID NO: 3855140 - RNA, 23 nt, Shigella flexneri 2a str. 2457T
gcgccuucauucaggccaaagcc

SEQ ID NO: 3855141 - RNA, 19 nt, Shigella flexneri 2a str. 2457T
gcgccuucgugcggcugca

SEQ ID NO: 3855142 - RNA, 18 nt, Shigella flexneri 2a str. 2457T
gcgccuucuacagcuuca

SEQ ID NO: 3855143 - RNA, 23 nt, Shigella flexneri 2a str. 2457T
gcgccuuuaauauuaacgccagc

SEQ ID NO: 3855144 - RNA, 21 nt, Shigella flexneri 2a str. 2457T
gcgccuuuuuucgccgcagca

SEQ ID NO: 3855145 - RNA, 18 nt, Shigella flexneri 2a str. 2457T
gcgcgaaaacaacuggca

SEQ ID NO: 3855146 - RNA, 13 nt, Shigella flexneri 2a str. 2457T
gcgcgaacagcac

SEQ ID NO: 3855147 - RNA, 15 nt, Shigella flexneri 2a str. 2457T
gcgcgaacagcacau

SEQ ID NO: 3855148 - RNA, 20 nt, Shigella flexneri 2a str. 2457T
gcgcgaacuggaugaaaaaa

SEQ ID NO: 3855149 - RNA, 17 nt, Shigella flexneri 2a str. 2457T
gcgcgaagcuggcggcg

SEQ ID NO: 3855150 - RNA, 19 nt, Shigella flexneri 2a str. 2457T
gcgcgaauauggcggcggc

SEQ ID NO: 3855151 - RNA, 20 nt, Shigella flexneri 2a str. 2457T
gcgcgaauggaaagcccgcc

SEQ ID NO: 3855152 - RNA, 21 nt, Shigella flexneri 2a str. 2457T
gcgcgaauggaaagcccgccc

SEQ ID NO: 3855153 - RNA, 22 nt, Shigella flexneri 2a str. 2457T
gcgcgaauggaaagcccgcccc

SEQ ID NO: 3855154 - RNA, 13 nt, Shigella flexneri 2a str. 2457T
gcgcgaccaaugu

SEQ ID NO: 3855155 - RNA, 19 nt, Shigella flexneri 2a str. 2457T
gcgcgaccaaugucagggc

SEQ ID NO: 3855156 - RNA, 22 nt, Shigella flexneri 2a str. 2457T
gcgcgaccaucggaucggccau

SEQ ID NO: 3855157 - RNA, 21 nt, Shigella flexneri 2a str. 2457T
gcgcgaucgcuaccuaaggaa

SEQ ID NO: 3855158 - RNA, 17 nt, Shigella flexneri 2a str. 2457T
gcgcgcaaucagcaccg

SEQ ID NO: 3855159 - RNA, 15 nt, Shigella flexneri 2a str. 2457T
gcgcgcaggcgcuga

SEQ ID NO: 3855160 - RNA, 23 nt, Shigella flexneri 2a str. 2457T
gcgcgcagugccgguggaagggc

SEQ ID NO: 3855161 - RNA, 12 nt, Shigella flexneri 2a str. 2457T
gcgcgccaggcg

SEQ ID NO: 3855162 - RNA, 13 nt, Shigella flexneri 2a str. 2457T
gcgcgcguaaauu

SEQ ID NO: 3855163 - RNA, 22 nt, Shigella flexneri 2a str. 2457T
gcgcggaaagcaccugcgcagg

SEQ ID NO: 3855164 - RNA, 21 nt, Shigella flexneri 2a str. 2457T
gcgcggcaauuagcggcuggc

SEQ ID NO: 3855165 - RNA, 14 nt, Shigella flexneri 2a str. 2457T
gcgcggcagccacc

SEQ ID NO: 3855166 - RNA, 17 nt, Shigella flexneri 2a str. 2457T
gcgcggcauuacgcccg

SEQ ID NO: 3855167 - RNA, 14 nt, Shigella flexneri 2a str. 2457T
gcgcggcccacuuc

SEQ ID NO: 3855168 - RNA, 20 nt, Shigella flexneri 2a str. 2457T
gcgcggccuuuaccuucgcc

SEQ ID NO: 3855169 - RNA, 18 nt, Shigella flexneri 2a str. 2457T
gcgcgggucaccgcggug

SEQ ID NO: 3855170 - RNA, 20 nt, Shigella flexneri 2a str. 2457T
gcgcgguaaaguuuggcugu

SEQ ID NO: 3855171 - RNA, 19 nt, Shigella flexneri 2a str. 2457T
gcgcgguaucaccacccag

SEQ ID NO: 3855172 - RNA, 15 nt, Shigella flexneri 2a str. 2457T
gcgcguaaauaccuu

SEQ ID NO: 3855173 - RNA, 22 nt, Shigella flexneri 2a str. 2457T
gcgcguaaauaccuuccggcgu

SEQ ID NO: 3855174 - RNA, 14 nt, Shigella flexneri 2a str. 2457T
gcgcguaagcguca

SEQ ID NO: 3855175 - RNA, 15 nt, Shigella flexneri 2a str. 2457T
gcgcgucccugccgc

SEQ ID NO: 3855176 - RNA, 17 nt, Shigella flexneri 2a str. 2457T
gcgcguccgcagacacu

SEQ ID NO: 3855177 - RNA, 12 nt, Shigella flexneri 2a str. 2457T
gcgcgugaagug

SEQ ID NO: 3855178 - RNA, 20 nt, Shigella flexneri 2a str. 2457T
gcgcguuaaagagcauuaca

SEQ ID NO: 3855179 - RNA, 13 nt, Shigella flexneri 2a str. 2457T
gcgcguuaacucc

SEQ ID NO: 3855180 - RNA, 22 nt, Shigella flexneri 2a str. 2457T
gcgcguuuuucuucagccccuc

SEQ ID NO: 3855181 - RNA, 19 nt, Shigella flexneri 2a str. 2457T
gcgcguuuuuuaugccgga

SEQ ID NO: 3855182 - RNA, 17 nt, Shigella flexneri 2a str. 2457T
gcgcuaaaagcauagcc

SEQ ID NO: 3855183 - RNA, 19 nt, Shigella flexneri 2a str. 2457T
gcgcuacgcuaucagaccu

SEQ ID NO: 3855184 - RNA, 23 nt, Shigella flexneri 2a str. 2457T
gcgcuacggcugauggcgccagu

SEQ ID NO: 3855185 - RNA, 14 nt, Shigella flexneri 2a str. 2457T
gcgcucagccagcc

SEQ ID NO: 3855186 - RNA, 15 nt, Shigella flexneri 2a str. 2457T
gcgcucagcgccaca

SEQ ID NO: 3855187 - RNA, 16 nt, Shigella flexneri 2a str. 2457T
gcgcucauuuucucuu

SEQ ID NO: 3855188 - RNA, 21 nt, Shigella flexneri 2a str. 2457T
gcgcucauuuucucuuucagc

SEQ ID NO: 3855189 - RNA, 14 nt, Shigella flexneri 2a str. 2457T
gcgcucccgcagga

SEQ ID NO: 3855190 - RNA, 20 nt, Shigella flexneri 2a str. 2457T
gcgcuccgcuuaucaggccu

SEQ ID NO: 3855191 - RNA, 13 nt, Shigella flexneri 2a str. 2457T
gcgcuccuguucc

SEQ ID NO: 3855192 - RNA, 15 nt, Shigella flexneri 2a str. 2457T
gcgcucgacuuuagu

SEQ ID NO: 3855193 - RNA, 22 nt, Shigella flexneri 2a str. 2457T
gcgcucgugccgcauccggcau

SEQ ID NO: 3855194 - RNA, 21 nt, Shigella flexneri 2a str. 2457T
gcgcucguugugaucgcugcc

SEQ ID NO: 3855195 - RNA, 23 nt, Shigella flexneri 2a str. 2457T
gcgcucugacugaaccuucacgc

SEQ ID NO: 3855196 - RNA, 15 nt, Shigella flexneri 2a str. 2457T
gcgcugaaagaagcg

SEQ ID NO: 3855197 - RNA, 21 nt, Shigella flexneri 2a str. 2457T
gcgcugaaagaagcggugaaa

SEQ ID NO: 3855198 - RNA, 20 nt, Shigella flexneri 2a str. 2457T
gcgcugaagaaaauggccag

SEQ ID NO: 3855199 - RNA, 16 nt, Shigella flexneri 2a str. 2457T
gcgcugaauguuugca

SEQ ID NO: 3855200 - RNA, 23 nt, Shigella flexneri 2a str. 2457T
gcgcugacguuauugaucgccag

SEQ ID NO: 3855201 - RNA, 17 nt, Shigella flexneri 2a str. 2457T
gcgcugagguuaugcaa

SEQ ID NO: 3855202 - RNA, 20 nt, Shigella flexneri 2a str. 2457T
gcgcugaguaauccuucccc

SEQ ID NO: 3855203 - RNA, 14 nt, Shigella flexneri 2a str. 2457T
gcgcugaugagcaa

SEQ ID NO: 3855204 - RNA, 14 nt, Shigella flexneri 2a str. 2457T
gcgcugcauuacua

SEQ ID NO: 3855205 - RNA, 12 nt, Shigella flexneri 2a str. 2457T
gcgcugccagaa

SEQ ID NO: 3855206 - RNA, 21 nt, Shigella flexneri 2a str. 2457T
gcgcugccucucuucgcugcu

SEQ ID NO: 3855207 - RNA, 18 nt, Shigella flexneri 2a str. 2457T
gcgcugcgcuuaucaggc

SEQ ID NO: 3855208 - RNA, 13 nt, Shigella flexneri 2a str. 2457T
gcgcugcggcgcg

SEQ ID NO: 3855209 - RNA, 23 nt, Shigella flexneri 2a str. 2457T
gcgcugcuguagcaguuccagca

SEQ ID NO: 3855210 - RNA, 22 nt, Shigella flexneri 2a str. 2457T
gcgcugcuuguuccacuucauc

SEQ ID NO: 3855211 - RNA, 11 nt, Shigella flexneri 2a str. 2457T
gcgcuggaagg

SEQ ID NO: 3855212 - RNA, 18 nt, Shigella flexneri 2a str. 2457T
gcgcuggaugucuggcag

SEQ ID NO: 3855213 - RNA, 12 nt, Shigella flexneri 2a str. 2457T
gcgcuggugguc

SEQ ID NO: 3855214 - RNA, 16 nt, Shigella flexneri 2a str. 2457T
gcgcugugagcaggcg

SEQ ID NO: 3855215 - RNA, 15 nt, Shigella flexneri 2a str. 2457T
gcgcuuaucaggccu

SEQ ID NO: 3855216 - RNA, 19 nt, Shigella flexneri 2a str. 2457T
gcgcuuaucaggccuacag

SEQ ID NO: 3855217 - RNA, 14 nt, Shigella flexneri 2a str. 2457T
gcgcuuauccggcc

SEQ ID NO: 3855218 - RNA, 15 nt, Shigella flexneri 2a str. 2457T
gcgcuuauccggccc

SEQ ID NO: 3855219 - RNA, 15 nt, Shigella flexneri 2a str. 2457T
gcgcuuaucgccagc

SEQ ID NO: 3855220 - RNA, 22 nt, Shigella flexneri 2a str. 2457T
gcgcuucacaugccacacacga

SEQ ID NO: 3855221 - RNA, 12 nt, Shigella flexneri 2a str. 2457T
gcgcuuccagcu

SEQ ID NO: 3855222 - RNA, 13 nt, Shigella flexneri 2a str. 2457T
gcgcuuccagcuc

SEQ ID NO: 3855223 - RNA, 17 nt, Shigella flexneri 2a str. 2457T
gcgcuuccugcagcuuc

SEQ ID NO: 3855224 - RNA, 20 nt, Shigella flexneri 2a str. 2457T
gcgcuucgcuuaucaggccu

SEQ ID NO: 3855225 - RNA, 12 nt, Shigella flexneri 2a str. 2457T
ggcuucucgccu

SEQ ID NO: 3855226 - RNA, 14 nt, Shigella flexneri 2a str. 2457T
ggcuucugccuuau

SEQ ID NO: 3855227 - RNA, 22 nt, Shigella flexneri 2a str. 2457T
ggcuucuucagguggacgccgu

SEQ ID NO: 3855228 - RNA, 15 nt, Shigella flexneri 2a str. 2457T
ggcuugccagcaggg

SEQ ID NO: 3855229 - RNA, 12 nt, Shigella flexneri 2a str. 2457T
ggcuugccgggc

SEQ ID NO: 3855230 - RNA, 20 nt, Shigella flexneri 2a str. 2457T
ggcuugcugaugcacgcaga

SEQ ID NO: 3855231 - RNA, 12 nt, Shigella flexneri 2a str. 2457T
ggcuuggcuggc

SEQ ID NO: 3855232 - RNA, 15 nt, Shigella flexneri 2a str. 2457T
ggcuuguacgccgcc

SEQ ID NO: 3855233 - RNA, 23 nt, Shigella flexneri 2a str. 2457T
ggcuuuaccaccgucaaaaaaac

SEQ ID NO: 3855234 - RNA, 17 nt, Shigella flexneri 2a str. 2457T
ggcuuucacgucaggau

SEQ ID NO: 3855235 - RNA, 22 nt, Shigella flexneri 2a str. 2457T
ggcuuucaucacuugauccaua

SEQ ID NO: 3855236 - RNA, 17 nt, Shigella flexneri 2a str. 2457T
ggcuuucgcaauaauca

SEQ ID NO: 3855237 - RNA, 19 nt, Shigella flexneri 2a str. 2457T
ggcuuugcuacagccuggu

SEQ ID NO: 3855238 - RNA, 17 nt, Shigella flexneri 2a str. 2457T
ggcuuugcuguuuccag

SEQ ID NO: 3855239 - RNA, 14 nt, Shigella flexneri 2a str. 2457T
ggcuuuggcaaacu

SEQ ID NO: 3855240 - RNA, 12 nt, Shigella flexneri 2a str. 2457T
ggcuuuuuaauu

SEQ ID NO: 3855241 - RNA, 19 nt, Shigella flexneri 2a str. 2457T
ggcuuuuuuacaucaucag

SEQ ID NO: 3855242 - RNA, 23 nt, Shigella flexneri 2a str. 2457T
ggcuuuuuuaccucuuuuuucaa

SEQ ID NO: 3855243 - RNA, 13 nt, Shigella flexneri 2a str. 2457T
ggcuuuuuuauug

SEQ ID NO: 3855244 - RNA, 14 nt, Shigella flexneri 2a str. 2457T
ggcuuuuuuuugcc

SEQ ID NO: 3855245 - RNA, 23 nt, Shigella flexneri 2a str. 2457T
gggaaaacagcgcaccagaaaca

SEQ ID NO: 3855246 - RNA, 13 nt, Shigella flexneri 2a str. 2457T
gggaaaacucagu

SEQ ID NO: 3855247 - RNA, 15 nt, Shigella flexneri 2a str. 2457T
gggaaaucaccacca

SEQ ID NO: 3855248 - RNA, 12 nt, Shigella flexneri 2a str. 2457T
gggaacagaggc

SEQ ID NO: 3855249 - RNA, 22 nt, Shigella flexneri 2a str. 2457T
gggaacaguacauuguuuucca

SEQ ID NO: 3855250 - RNA, 13 nt, Shigella flexneri 2a str. 2457T
gggaacaucaggc

SEQ ID NO: 3855251 - RNA, 14 nt, Shigella flexneri 2a str. 2457T
gggaagaauggaaa

SEQ ID NO: 3855252 - RNA, 22 nt, Shigella flexneri 2a str. 2457T
gggaaggcccuuucccuucucg

SEQ ID NO: 3855253 - RNA, 13 nt, Shigella flexneri 2a str. 2457T
gggaaggucaggu

SEQ ID NO: 3855254 - RNA, 17 nt, Shigella flexneri 2a str. 2457T
gggaauaaaagccagga

SEQ ID NO: 3855255 - RNA, 22 nt, Shigella flexneri 2a str. 2457T
gggaauagcguuaauggcagau

SEQ ID NO: 3855256 - RNA, 16 nt, Shigella flexneri 2a str. 2457T
gggaaugugaugaaaa

SEQ ID NO: 3855257 - RNA, 18 nt, Shigella flexneri 2a str. 2457T
gggaauucgaagcuguag

SEQ ID NO: 3855258 - RNA, 13 nt, Shigella flexneri 2a str. 2457T
gggacaugauuca

SEQ ID NO: 3855259 - RNA, 15 nt, Shigella flexneri 2a str. 2457T
gggacgcagacugga

SEQ ID NO: 3855260 - RNA, 22 nt, Shigella flexneri 2a str. 2457T
gggacgguccgugcgcuuuuua

SEQ ID NO: 3855261 - RNA, 14 nt, Shigella flexneri 2a str. 2457T
gggagagggccggg

SEQ ID NO: 3855262 - RNA, 22 nt, Shigella flexneri 2a str. 2457T
gggagauguaagggcuaaucug

SEQ ID NO: 3855263 - RNA, 17 nt, Shigella flexneri 2a str. 2457T
gggagcaggcuaguaaa

SEQ ID NO: 3855264 - RNA, 22 nt, Shigella flexneri 2a str. 2457T
gggagcaggcuaguaaaaagca

SEQ ID NO: 3855265 - RNA, 23 nt, Shigella flexneri 2a str. 2457T
gggagcgcuuuuuuccugccgcu

SEQ ID NO: 3855266 - RNA, 15 nt, Shigella flexneri 2a str. 2457T
gggauaaagcccccg

SEQ ID NO: 3855267 - RNA, 22 nt, Shigella flexneri 2a str. 2457T
gggauauaacccucgcgcgaca

SEQ ID NO: 3855268 - RNA, 15 nt, Shigella flexneri 2a str. 2457T
gggaucagcuuuuua

SEQ ID NO: 3855269 - RNA, 20 nt, Shigella flexneri 2a str. 2457T
gggaucauccacccgcagca

SEQ ID NO: 3855270 - RNA, 20 nt, Shigella flexneri 2a str. 2457T
gggaugcucuuuucuuuauc

SEQ ID NO: 3855271 - RNA, 11 nt, Shigella flexneri 2a str. 2457T
gggaugcugau

SEQ ID NO: 3855272 - RNA, 15 nt, Shigella flexneri 2a str. 2457T
gggauguuggcgaau

SEQ ID NO: 3855273 - RNA, 17 nt, Shigella flexneri 2a str. 2457T
gggauuauugccgcagc

SEQ ID NO: 3855274 - RNA, 23 nt, Shigella flexneri 2a str. 2457T
gggcaaacaccgcuucaacagcg

SEQ ID NO: 3855275 - RNA, 16 nt, Shigella flexneri 2a str. 2457T
gggcaacuggagcagg

SEQ ID NO: 3855276 - RNA, 22 nt, Shigella flexneri 2a str. 2457T
gggcacguucggcggaugcagg

SEQ ID NO: 3855277 - RNA, 18 nt, Shigella flexneri 2a str. 2457T
gggcagcaucgccaggau

SEQ ID NO: 3855278 - RNA, 16 nt, Shigella flexneri 2a str. 2457T
gggcaggaaaaucagc

SEQ ID NO: 3855279 - RNA, 21 nt, Shigella flexneri 2a str. 2457T
gggcauuuccauuuuugacua

SEQ ID NO: 3855280 - RNA, 13 nt, Shigella flexneri 2a str. 2457T
gggccaacuggca

SEQ ID NO: 3855281 - RNA, 16 nt, Shigella flexneri 2a str. 2457T
gggccaacuggcaaaa

SEQ ID NO: 3855282 - RNA, 16 nt, Shigella flexneri 2a str. 2457T
gggccauucaggcagu

SEQ ID NO: 3855283 - RNA, 15 nt, Shigella flexneri 2a str. 2457T
gggccguaauauuuc

SEQ ID NO: 3855284 - RNA, 19 nt, Shigella flexneri 2a str. 2457T
gggccgucaggugacacuu

SEQ ID NO: 3855285 - RNA, 11 nt, Shigella flexneri 2a str. 2457T
gggccgucccc

SEQ ID NO: 3855286 - RNA, 23 nt, Shigella flexneri 2a str. 2457T
gggccguuuucguuacuccgcca

SEQ ID NO: 3855287 - RNA, 15 nt, Shigella flexneri 2a str. 2457T
gggccuccugcagcg

SEQ ID NO: 3855288 - RNA, 12 nt, Shigella flexneri 2a str. 2457T
gggccugaacaa

SEQ ID NO: 3855289 - RNA, 15 nt, Shigella flexneri 2a str. 2457T
gggccugaacaagca

SEQ ID NO: 3855290 - RNA, 12 nt, Shigella flexneri 2a str. 2457T
gggccugaagga

SEQ ID NO: 3855291 - RNA, 14 nt, Shigella flexneri 2a str. 2457T
gggccugaguuacc

SEQ ID NO: 3855292 - RNA, 15 nt, Shigella flexneri 2a str. 2457T
gggcgaccaaucaaa

SEQ ID NO: 3855293 - RNA, 13 nt, Shigella flexneri 2a str. 2457T
gggcgaguaugga

SEQ ID NO: 3855294 - RNA, 14 nt, Shigella flexneri 2a str. 2457T
gggcgauuuccuuc

SEQ ID NO: 3855295 - RNA, 14 nt, Shigella flexneri 2a str. 2457T
gggcgauuuugcuu

SEQ ID NO: 3855296 - RNA, 13 nt, Shigella flexneri 2a str. 2457T
gggcgcgcucagc

SEQ ID NO: 3855297 - RNA, 18 nt, Shigella flexneri 2a str. 2457T
gggcgcggaaagcaccug

SEQ ID NO: 3855298 - RNA, 21 nt, Shigella flexneri 2a str. 2457T
gggcgcggaaagcaccugcgc

SEQ ID NO: 3855299 - RNA, 19 nt, Shigella flexneri 2a str. 2457T
gggcgcguccggcgucgcu

SEQ ID NO: 3855300 - RNA, 17 nt, Shigella flexneri 2a str. 2457T
gggcguuacagcuggag

SEQ ID NO: 3855301 - RNA, 14 nt, Shigella flexneri 2a str. 2457T
gggcuaaugccagu

SEQ ID NO: 3855302 - RNA, 20 nt, Shigella flexneri 2a str. 2457T
gggcucgggcaaauccacug

SEQ ID NO: 3855303 - RNA, 14 nt, Shigella flexneri 2a str. 2457T
gggcucuuaagcac

SEQ ID NO: 3855304 - RNA, 21 nt, Shigella flexneri 2a str. 2457T
gggcugacauuaucagacacc

SEQ ID NO: 3855305 - RNA, 21 nt, Shigella flexneri 2a str. 2457T
gggcugauaaacaagcguaca

SEQ ID NO: 3855306 - RNA, 19 nt, Shigella flexneri 2a str. 2457T
gggcuggccaauuggcugg

SEQ ID NO: 3855307 - RNA, 20 nt, Shigella flexneri 2a str. 2457T
gggcuggcguacccaucaac

SEQ ID NO: 3855308 - RNA, 12 nt, Shigella flexneri 2a str. 2457T
gggcuucaaagu

SEQ ID NO: 3855309 - RNA, 23 nt, Shigella flexneri 2a str. 2457T
gggcuuugcuacagccuggugaa

SEQ ID NO: 3855310 - RNA, 22 nt, Shigella flexneri 2a str. 2457T
gggcuuuucagaaauuuggcuc

SEQ ID NO: 3855311 - RNA, 22 nt, Shigella flexneri 2a str. 2457T
gggcuuuuuaauuccugccgcg

SEQ ID NO: 3855312 - RNA, 17 nt, Shigella flexneri 2a str. 2457T
gggcuuuuuuauuucau

SEQ ID NO: 3855313 - RNA, 21 nt, Shigella flexneri 2a str. 2457T
ggggauguguuauucagcugg

SEQ ID NO: 3855314 - RNA, 19 nt, Shigella flexneri 2a str. 2457T
ggggcacugaaagccgcag

SEQ ID NO: 3855315 - RNA, 16 nt, Shigella flexneri 2a str. 2457T
ggggccaauugcugug

SEQ ID NO: 3855316 - RNA, 12 nt, Shigella flexneri 2a str. 2457T
ggggccagcauu

SEQ ID NO: 3855317 - RNA, 15 nt, Shigella flexneri 2a str. 2457T
ggggcggcaaucgcu

SEQ ID NO: 3855318 - RNA, 12 nt, Shigella flexneri 2a str. 2457T
ggggcugaaaau

SEQ ID NO: 3855319 - RNA, 14 nt, Shigella flexneri 2a str. 2457T
ggggcuucuuccgg

SEQ ID NO: 3855320 - RNA, 14 nt, Shigella flexneri 2a str. 2457T
gggguaaagcgcgg

SEQ ID NO: 3855321 - RNA, 13 nt, Shigella flexneri 2a str. 2457T
ggggucagcaggu

SEQ ID NO: 3855322 - RNA, 20 nt, Shigella flexneri 2a str. 2457T
ggggucagggcuucaaaguu

SEQ ID NO: 3855323 - RNA, 11 nt, Shigella flexneri 2a str. 2457T
gguuauugguu

SEQ ID NO: 3855324 - RNA, 21 nt, Shigella flexneri 2a str. 2457T
gguuauuucauuauuaauuuc

SEQ ID NO: 3855325 - RNA, 22 nt, Shigella flexneri 2a str. 2457T
gguuauuuguaguuugauaauu

SEQ ID NO: 3855326 - RNA, 10 nt, Shigella flexneri 2a str. 2457T
gguucaaagu

SEQ ID NO: 3855327 - RNA, 19 nt, Shigella flexneri 2a str. 2457T
gguucaaauagcaaugucu

SEQ ID NO: 3855328 - RNA, 19 nt, Shigella flexneri 2a str. 2457T
gguucauugagcgcaaaug

SEQ ID NO: 3855329 - RNA, 20 nt, Shigella flexneri 2a str. 2457T
gguucauuggguucaucuga

SEQ ID NO: 3855330 - RNA, 20 nt, Shigella flexneri 2a str. 2457T
gguuccacuucugcggguga

SEQ ID NO: 3855331 - RNA, 21 nt, Shigella flexneri 2a str. 2457T
gguuccccccacaaucagcca

SEQ ID NO: 3855332 - RNA, 23 nt, Shigella flexneri 2a str. 2457T
gguucgacugcccgcgagcgugg

SEQ ID NO: 3855333 - RNA, 16 nt, Shigella flexneri 2a str. 2457T
gguucgcacuaaguuc

SEQ ID NO: 3855334 - RNA, 22 nt, Shigella flexneri 2a str. 2457T
gguucgggaaauugcagagcug

SEQ ID NO: 3855335 - RNA, 22 nt, Shigella flexneri 2a str. 2457T
gguucucgucauccuaaacgcu

SEQ ID NO: 3855336 - RNA, 20 nt, Shigella flexneri 2a str. 2457T
gguucucuuuuauuucugcu

SEQ ID NO: 3855337 - RNA, 11 nt, Shigella flexneri 2a str. 2457T
gguucuuuuaa

SEQ ID NO: 3855338 - RNA, 14 nt, Shigella flexneri 2a str. 2457T
gguugacgccccug

SEQ ID NO: 3855339 - RNA, 21 nt, Shigella flexneri 2a str. 2457T
gguugccccgcacgcuucauc

SEQ ID NO: 3855340 - RNA, 16 nt, Shigella flexneri 2a str. 2457T
gguugcucauaaaaug

SEQ ID NO: 3855341 - RNA, 13 nt, Shigella flexneri 2a str. 2457T
gguuggagcgcgu

SEQ ID NO: 3855342 - RNA, 21 nt, Shigella flexneri 2a str. 2457T
gguuuaaacagagauuacuuu

SEQ ID NO: 3855343 - RNA, 13 nt, Shigella flexneri 2a str. 2457T
gguuuacggcggu

SEQ ID NO: 3855344 - RNA, 14 nt, Shigella flexneri 2a str. 2457T
gguuuauccccaag

SEQ ID NO: 3855345 - RNA, 23 nt, Shigella flexneri 2a str. 2457T
gguuucaaagauuuuaccaaugg

SEQ ID NO: 3855346 - RNA, 20 nt, Shigella flexneri 2a str. 2457T
gguuucaaauuacgauccac

SEQ ID NO: 3855347 - RNA, 13 nt, Shigella flexneri 2a str. 2457T
gguuucaacugcg

SEQ ID NO: 3855348 - RNA, 14 nt, Shigella flexneri 2a str. 2457T
gguuucacccacgg

SEQ ID NO: 3855349 - RNA, 17 nt, Shigella flexneri 2a str. 2457T
gguuucacggcaccagc

SEQ ID NO: 3855350 - RNA, 18 nt, Shigella flexneri 2a str. 2457T
gguuucacguaccagaug

SEQ ID NO: 3855351 - RNA, 18 nt, Shigella flexneri 2a str. 2457T
gguuucccgccguaacug

SEQ ID NO: 3855352 - RNA, 16 nt, Shigella flexneri 2a str. 2457T
gguuuccggaucgcca

SEQ ID NO: 3855353 - RNA, 17 nt, Shigella flexneri 2a str. 2457T
gguuuccggaucgccaa

SEQ ID NO: 3855354 - RNA, 18 nt, Shigella flexneri 2a str. 2457T
gguuucgccacggcgcag

SEQ ID NO: 3855355 - RNA, 15 nt, Shigella flexneri 2a str. 2457T
gguuucgccugccag

SEQ ID NO: 3855356 - RNA, 22 nt, Shigella flexneri 2a str. 2457T
gguuucgggucgaaaauaucgg

SEQ ID NO: 3855357 - RNA, 14 nt, Shigella flexneri 2a str. 2457T
gguuugaaugaaag

SEQ ID NO: 3855358 - RNA, 19 nt, Shigella flexneri 2a str. 2457T
gguuugacauaaauuccgc

SEQ ID NO: 3855359 - RNA, 14 nt, Shigella flexneri 2a str. 2457T
gguuugcaucgcca

SEQ ID NO: 3855360 - RNA, 14 nt, Shigella flexneri 2a str. 2457T
gguuuggcggcggc

SEQ ID NO: 3855361 - RNA, 15 nt, Shigella flexneri 2a str. 2457T
gguuuggcggcggcu

SEQ ID NO: 3855362 - RNA, 18 nt, Shigella flexneri 2a str. 2457T
gguuuguaggccggauaa

SEQ ID NO: 3855363 - RNA, 16 nt, Shigella flexneri 2a str. 2457T
gguuuuauuuaacaug

SEQ ID NO: 3855364 - RNA, 21 nt, Shigella flexneri 2a str. 2457T
gguuuucaacgugucuuuuac

SEQ ID NO: 3855365 - RNA, 17 nt, Shigella flexneri 2a str. 2457T
gguuuucaaucgacuuu

SEQ ID NO: 3855366 - RNA, 23 nt, Shigella flexneri 2a str. 2457T
gguuuucaucccgagucgcugag

SEQ ID NO: 3855367 - RNA, 19 nt, Shigella flexneri 2a str. 2457T
gguuuucugucuuaacgca

SEQ ID NO: 3855368 - RNA, 21 nt, Shigella flexneri 2a str. 2457T
gguuuugaaacucgcugccag

SEQ ID NO: 3855369 - RNA, 22 nt, Shigella flexneri 2a str. 2457T
gguuuuuugaacagaccacauu

SEQ ID NO: 3855370 - RNA, 15 nt, Shigella flexneri 2a str. 2457T
guaaaaaaacaucau

SEQ ID NO: 3855371 - RNA, 18 nt, Shigella flexneri 2a str. 2457T
guaaaaacgcauuuaucu

SEQ ID NO: 3855372 - RNA, 19 nt, Shigella flexneri 2a str. 2457T
guaaaaacgcauuuaucuu

SEQ ID NO: 3855373 - RNA, 17 nt, Shigella flexneri 2a str. 2457T
guaaaaacggauuucau

SEQ ID NO: 3855374 - RNA, 19 nt, Shigella flexneri 2a str. 2457T
guaaaaccccgcguacuga

SEQ ID NO: 3855375 - RNA, 22 nt, Shigella flexneri 2a str. 2457T
guaaaacggauaugauuuaaaa

SEQ ID NO: 3855376 - RNA, 20 nt, Shigella flexneri 2a str. 2457T
guaaaaggcgccauuuucau

SEQ ID NO: 3855377 - RNA, 17 nt, Shigella flexneri 2a str. 2457T
guaaaauaacagcggca

SEQ ID NO: 3855378 - RNA, 20 nt, Shigella flexneri 2a str. 2457T
guaaaauggucagccagcgg

SEQ ID NO: 3855379 - RNA, 22 nt, Shigella flexneri 2a str. 2457T
guaaaauucuacagaaaugaaa

SEQ ID NO: 3855380 - RNA, 15 nt, Shigella flexneri 2a str. 2457T
guaaacaaacaacgc

SEQ ID NO: 3855381 - RNA, 21 nt, Shigella flexneri 2a str. 2457T
guaaacagauaggcaucagca

SEQ ID NO: 3855382 - RNA, 20 nt, Shigella flexneri 2a str. 2457T
guaaaccaccaguccuucua

SEQ ID NO: 3855383 - RNA, 19 nt, Shigella flexneri 2a str. 2457T
guaaaccgcucgucacauc

SEQ ID NO: 3855384 - RNA, 17 nt, Shigella flexneri 2a str. 2457T
guaaaccgucagcacca

SEQ ID NO: 3855385 - RNA, 17 nt, Shigella flexneri 2a str. 2457T
guaaacgaugaugcggc

SEQ ID NO: 3855386 - RNA, 16 nt, Shigella flexneri 2a str. 2457T
guaaacgcagcaucau

SEQ ID NO: 3855387 - RNA, 20 nt, Shigella flexneri 2a str. 2457T
guaaacgcccaauccggccu

SEQ ID NO: 3855388 - RNA, 14 nt, Shigella flexneri 2a str. 2457T
guaaacgccuuauc

SEQ ID NO: 3855389 - RNA, 21 nt, Shigella flexneri 2a str. 2457T
guaaacgccuuauccagccua

SEQ ID NO: 3855390 - RNA, 20 nt, Shigella flexneri 2a str. 2457T
guaaacgccuuauccggccu

SEQ ID NO: 3855391 - RNA, 14 nt, Shigella flexneri 2a str. 2457T
guaaacucaaaguc

SEQ ID NO: 3855392 - RNA, 23 nt, Shigella flexneri 2a str. 2457T
guaaacugcgucgacauagccau

SEQ ID NO: 3855393 - RNA, 12 nt, Shigella flexneri 2a str. 2457T
guaaagcaauga

SEQ ID NO: 3855394 - RNA, 20 nt, Shigella flexneri 2a str. 2457T
guaaagcccauaccacagca

SEQ ID NO: 3855395 - RNA, 20 nt, Shigella flexneri 2a str. 2457T
guaaagcggcgaguauucuu

SEQ ID NO: 3855396 - RNA, 14 nt, Shigella flexneri 2a str. 2457T
guaaaggcggcaga

SEQ ID NO: 3855397 - RNA, 22 nt, Shigella flexneri 2a str. 2457T
guaaaggcggcagaacagaaca

SEQ ID NO: 3855398 - RNA, 22 nt, Shigella flexneri 2a str. 2457T
guaaaguacaauaucccugugu

SEQ ID NO: 3855399 - RNA, 19 nt, Shigella flexneri 2a str. 2457T
guaaaguacguguggucuu

SEQ ID NO: 3855400 - RNA, 23 nt, Shigella flexneri 2a str. 2457T
guaaauauggcgaacuggucugc

SEQ ID NO: 3855401 - RNA, 14 nt, Shigella flexneri 2a str. 2457T
guaaaucaaaccaa

SEQ ID NO: 3855402 - RNA, 14 nt, Shigella flexneri 2a str. 2457T
guaaaugacagcga

SEQ ID NO: 3855403 - RNA, 14 nt, Shigella flexneri 2a str. 2457T
guaaaugagcguuu

SEQ ID NO: 3855404 - RNA, 14 nt, Shigella flexneri 2a str. 2457T
guaaaugcagauaa

SEQ ID NO: 3855405 - RNA, 22 nt, Shigella flexneri 2a str. 2457T
guaaaugccgacuuuguuuuua

SEQ ID NO: 3855406 - RNA, 19 nt, Shigella flexneri 2a str. 2457T
guaaauucucaauaucauc

SEQ ID NO: 3855407 - RNA, 21 nt, Shigella flexneri 2a str. 2457T
guaaauugaugugaaaacucu

SEQ ID NO: 3855408 - RNA, 20 nt, Shigella flexneri 2a str. 2457T
guaaauugcaaaccucagga

SEQ ID NO: 3855409 - RNA, 15 nt, Shigella flexneri 2a str. 2457T
guaaauugcagcaca

SEQ ID NO: 3855410 - RNA, 15 nt, Shigella flexneri 2a str. 2457T
guaacaaagccugca

SEQ ID NO: 3855411 - RNA, 17 nt, Shigella flexneri 2a str. 2457T
guaacaaagccugcacc

SEQ ID NO: 3855412 - RNA, 16 nt, Shigella flexneri 2a str. 2457T
guaacaauauuugcag

SEQ ID NO: 3855413 - RNA, 19 nt, Shigella flexneri 2a str. 2457T
guaacaauauuugcagagg

SEQ ID NO: 3855414 - RNA, 13 nt, Shigella flexneri 2a str. 2457T
guaacagagcauc

SEQ ID NO: 3855415 - RNA, 16 nt, Shigella flexneri 2a str. 2457T
guaacagagcaucggu

SEQ ID NO: 3855416 - RNA, 16 nt, Shigella flexneri 2a str. 2457T
guaacaggaagcagcu

SEQ ID NO: 3855417 - RNA, 16 nt, Shigella flexneri 2a str. 2457T
guaacaguuaccuuua

SEQ ID NO: 3855418 - RNA, 16 nt, Shigella flexneri 2a str. 2457T
guaacauacuccaccc

SEQ ID NO: 3855419 - RNA, 18 nt, Shigella flexneri 2a str. 2457T
guaacaugcucuuugaug

SEQ ID NO: 3855420 - RNA, 15 nt, Shigella flexneri 2a str. 2457T
guacaucaauaccau

SEQ ID NO: 3855421 - RNA, 19 nt, Shigella flexneri 2a str. 2457T
guacaucaauaccauuauc

SEQ ID NO: 3855422 - RNA, 18 nt, Shigella flexneri 2a str. 2457T
guaccaaccgcaauugcu

SEQ ID NO: 3855423 - RNA, 19 nt, Shigella flexneri 2a str. 2457T
guaccaccagaaucgccag

SEQ ID NO: 3855424 - RNA, 20 nt, Shigella flexneri 2a str. 2457T
guaccaccagaaucgccagc

SEQ ID NO: 3855425 - RNA, 11 nt, Shigella flexneri 2a str. 2457T
guaccaccgga

SEQ ID NO: 3855426 - RNA, 18 nt, Shigella flexneri 2a str. 2457T
guaccaccggacgcacac

SEQ ID NO: 3855427 - RNA, 20 nt, Shigella flexneri 2a str. 2457T
guaccacgcaaagcacgcca

SEQ ID NO: 3855428 - RNA, 20 nt, Shigella flexneri 2a str. 2457T
guaccagaccaacauaguua

SEQ ID NO: 3855429 - RNA, 17 nt, Shigella flexneri 2a str. 2457T
guaccagacgcgggcaa

SEQ ID NO: 3855430 - RNA, 18 nt, Shigella flexneri 2a str. 2457T
guaccagauacaaaaaag

SEQ ID NO: 3855431 - RNA, 13 nt, Shigella flexneri 2a str. 2457T
guaccaucgccag

SEQ ID NO: 3855432 - RNA, 14 nt, Shigella flexneri 2a str. 2457T
guaccaucgccagc

SEQ ID NO: 3855433 - RNA, 19 nt, Shigella flexneri 2a str. 2457T
guaccaucguccagcagca

SEQ ID NO: 3855434 - RNA, 16 nt, Shigella flexneri 2a str. 2457T
guaccaugauccugca

SEQ ID NO: 3855435 - RNA, 18 nt, Shigella flexneri 2a str. 2457T
guaccaugcgcaucaucg

SEQ ID NO: 3855436 - RNA, 23 nt, Shigella flexneri 2a str. 2457T
guaccauuaaucgauaaaccagc

SEQ ID NO: 3855437 - RNA, 14 nt, Shigella flexneri 2a str. 2457T
guacccaucaacaa

SEQ ID NO: 3855438 - RNA, 12 nt, Shigella flexneri 2a str. 2457T
guacccgcuggc

SEQ ID NO: 3855439 - RNA, 18 nt, Shigella flexneri 2a str. 2457T
guacccggccuguuuauc

SEQ ID NO: 3855440 - RNA, 18 nt, Shigella flexneri 2a str. 2457T
guacccguucgaugcggu

SEQ ID NO: 3855441 - RNA, 12 nt, Shigella flexneri 2a str. 2457T
guaccgcagcaa

SEQ ID NO: 3855442 - RNA, 22 nt, Shigella flexneri 2a str. 2457T
guaccgccgccauaaacagcag

SEQ ID NO: 3855443 - RNA, 21 nt, Shigella flexneri 2a str. 2457T
guaccggacaugauuacugca

SEQ ID NO: 3855444 - RNA, 18 nt, Shigella flexneri 2a str. 2457T
guaccggacccuggucag

SEQ ID NO: 3855445 - RNA, 18 nt, Shigella flexneri 2a str. 2457T
guaccggccuugccagau

SEQ ID NO: 3855446 - RNA, 15 nt, Shigella flexneri 2a str. 2457T
guaccgugcagcgca

SEQ ID NO: 3855447 - RNA, 15 nt, Shigella flexneri 2a str. 2457T
guaccgugggcggca

SEQ ID NO: 3855448 - RNA, 14 nt, Shigella flexneri 2a str. 2457T
guaccguugcugcc

SEQ ID NO: 3855449 - RNA, 22 nt, Shigella flexneri 2a str. 2457T
guaccguugcugccagugcggu

SEQ ID NO: 3855450 - RNA, 12 nt, Shigella flexneri 2a str. 2457T
guaccuccuuca

SEQ ID NO: 3855451 - RNA, 19 nt, Shigella flexneri 2a str. 2457T
guaccugugaagugaaaaa

SEQ ID NO: 3855452 - RNA, 13 nt, Shigella flexneri 2a str. 2457T
guacgaaauaacu

SEQ ID NO: 3855453 - RNA, 15 nt, Shigella flexneri 2a str. 2457T
guacgacaaaagaau

SEQ ID NO: 3855454 - RNA, 14 nt, Shigella flexneri 2a str. 2457T
guacgacuuccugg

SEQ ID NO: 3855455 - RNA, 15 nt, Shigella flexneri 2a str. 2457T
guacgcaggcggcug

SEQ ID NO: 3855456 - RNA, 14 nt, Shigella flexneri 2a str. 2457T
guacgccaaucugc

SEQ ID NO: 3855457 - RNA, 16 nt, Shigella flexneri 2a str. 2457T
guacgcccacgccagc

SEQ ID NO: 3855458 - RNA, 21 nt, Shigella flexneri 2a str. 2457T
guacgccgggugcguccuaaa

SEQ ID NO: 3855459 - RNA, 19 nt, Shigella flexneri 2a str. 2457T
guacgccuucaugugcggg

SEQ ID NO: 3855460 - RNA, 11 nt, Shigella flexneri 2a str. 2457T
guacgcuuuca

SEQ ID NO: 3855461 - RNA, 12 nt, Shigella flexneri 2a str. 2457T
guacgggaaacc

SEQ ID NO: 3855462 - RNA, 16 nt, Shigella flexneri 2a str. 2457T
guacgggacagcaggu

SEQ ID NO: 3855463 - RNA, 18 nt, Shigella flexneri 2a str. 2457T
guacguagcguuaacgcg

SEQ ID NO: 3855464 - RNA, 19 nt, Shigella flexneri 2a str. 2457T
guacguguuguuccaguaa

SEQ ID NO: 3855465 - RNA, 22 nt, Shigella flexneri 2a str. 2457T
guacucggcuacgaaccgagcg

SEQ ID NO: 3855466 - RNA, 21 nt, Shigella flexneri 2a str. 2457T
guacugacggcguucuuuaca

SEQ ID NO: 3855467 - RNA, 17 nt, Shigella flexneri 2a str. 2457T
guacuggcaaucgccag

SEQ ID NO: 3855468 - RNA, 17 nt, Shigella flexneri 2a str. 2457T
guacuucacaaucagcg

SEQ ID NO: 3855469 - RNA, 22 nt, Shigella flexneri 2a str. 2457T
guacuuccggacguucagccau

SEQ ID NO: 3855470 - RNA, 12 nt, Shigella flexneri 2a str. 2457T
guacuuucaaca

SEQ ID NO: 3855471 - RNA, 19 nt, Shigella flexneri 2a str. 2457T
guacuuuuaccuguccggc

SEQ ID NO: 3855472 - RNA, 19 nt, Shigella flexneri 2a str. 2457T
guacuuuuacugucugcuc

SEQ ID NO: 3855473 - RNA, 23 nt, Shigella flexneri 2a str. 2457T
guacuuuuuccuuaaacaccugg

SEQ ID NO: 3855474 - RNA, 16 nt, Shigella flexneri 2a str. 2457T
guagaaauuauuucuu

SEQ ID NO: 3855475 - RNA, 21 nt, Shigella flexneri 2a str. 2457T
guagaacccuaccagcugcca

SEQ ID NO: 3855476 - RNA, 18 nt, Shigella flexneri 2a str. 2457T
guagaauuucugacugag

SEQ ID NO: 3855477 - RNA, 19 nt, Shigella flexneri 2a str. 2457T
guagaccugauacauagca

SEQ ID NO: 3855478 - RNA, 13 nt, Shigella flexneri 2a str. 2457T
guagacugcagcg

SEQ ID NO: 3855479 - RNA, 21 nt, Shigella flexneri 2a str. 2457T
guagacugcagcggucacaug

SEQ ID NO: 3855480 - RNA, 22 nt, Shigella flexneri 2a str. 2457T
guagacuuuagcgcaaucgcau

SEQ ID NO: 3855481 - RNA, 13 nt, Shigella flexneri 2a str. 2457T
guagagcagcacg

SEQ ID NO: 3855482 - RNA, 19 nt, Shigella flexneri 2a str. 2457T
guagagguuauaaauaaaa

SEQ ID NO: 3855483 - RNA, 18 nt, Shigella flexneri 2a str. 2457T
guagaguuugaacucaca

SEQ ID NO: 3855484 - RNA, 19 nt, Shigella flexneri 2a str. 2457T
guagauaagcaaggcaauc

SEQ ID NO: 3855485 - RNA, 15 nt, Shigella flexneri 2a str. 2457T
guagaucuugauuua

SEQ ID NO: 3855486 - RNA, 13 nt, Shigella flexneri 2a str. 2457T
guagaugauuuuu

SEQ ID NO: 3855487 - RNA, 18 nt, Shigella flexneri 2a str. 2457T
guagauggggccaugauu

SEQ ID NO: 3855488 - RNA, 18 nt, Shigella flexneri 2a str. 2457T
guagcacgucaucugcac

SEQ ID NO: 3855489 - RNA, 15 nt, Shigella flexneri 2a str. 2457T
guagcagcuuucagc

SEQ ID NO: 3855490 - RNA, 19 nt, Shigella flexneri 2a str. 2457T
guagcagcuuucagcagcg

SEQ ID NO: 3855491 - RNA, 19 nt, Shigella flexneri 2a str. 2457T
guagcagguaaucugccau

SEQ ID NO: 3855492 - RNA, 13 nt, Shigella flexneri 2a str. 2457T
guagcaugaacca

SEQ ID NO: 3855493 - RNA, 20 nt, Shigella flexneri 2a str. 2457T
guagccaauaaaugccacca

SEQ ID NO: 3855494 - RNA, 23 nt, Shigella flexneri 2a str. 2457T
guagccaaucccggaagccacca

SEQ ID NO: 3855495 - RNA, 20 nt, Shigella flexneri 2a str. 2457T
guagccaugaugaacaaccc

SEQ ID NO: 3855496 - RNA, 14 nt, Shigella flexneri 2a str. 2457T
guagccauucccuc

SEQ ID NO: 3855497 - RNA, 19 nt, Shigella flexneri 2a str. 2457T
guagccgaugccgcugcac

SEQ ID NO: 3855498 - RNA, 15 nt, Shigella flexneri 2a str. 2457T
guagccucgccgagc

SEQ ID NO: 3855499 - RNA, 21 nt, Shigella flexneri 2a str. 2457T
guagcgaugacagucuggaag

SEQ ID NO: 3855500 - RNA, 18 nt, Shigella flexneri 2a str. 2457T
guagcgccauacugacua

SEQ ID NO: 3855501 - RNA, 17 nt, Shigella flexneri 2a str. 2457T
guagcgggaaagcguau

SEQ ID NO: 3855502 - RNA, 14 nt, Shigella flexneri 2a str. 2457T
guagcgggcaguaa

SEQ ID NO: 3855503 - RNA, 15 nt, Shigella flexneri 2a str. 2457T
guagcgucgccagca

SEQ ID NO: 3855504 - RNA, 20 nt, Shigella flexneri 2a str. 2457T
guagcuaccuugcucggcgc

SEQ ID NO: 3855505 - RNA, 14 nt, Shigella flexneri 2a str. 2457T
guagcucuggguaa

SEQ ID NO: 3855506 - RNA, 20 nt, Shigella flexneri 2a str. 2457T
guagcugcaggaauaaucag

SEQ ID NO: 3855507 - RNA, 20 nt, Shigella flexneri 2a str. 2457T
guaggagccaccuuaugagu

SEQ ID NO: 3855508 - RNA, 19 nt, Shigella flexneri 2a str. 2457T
guaggccagauaaggcguu

SEQ ID NO: 3855509 - RNA, 18 nt, Shigella flexneri 2a str. 2457T
guaggccggauaaggcgc

SEQ ID NO: 3855510 - RNA, 18 nt, Shigella flexneri 2a str. 2457T
guaggccggauaaggcgu

SEQ ID NO: 3855511 - RNA, 19 nt, Shigella flexneri 2a str. 2457T
guaggccggauaaggcguu

SEQ ID NO: 3855512 - RNA, 17 nt, Shigella flexneri 2a str. 2457T
guaggccugagaagcgc

SEQ ID NO: 3855513 - RNA, 20 nt, Shigella flexneri 2a str. 2457T
guaggccugagaagcgcaac

SEQ ID NO: 3855514 - RNA, 20 nt, Shigella flexneri 2a str. 2457T
guaggccugauaagacgcgc

SEQ ID NO: 3855515 - RNA, 20 nt, Shigella flexneri 2a str. 2457T
guaggccugauaagacgcgu

SEQ ID NO: 3855516 - RNA, 18 nt, Shigella flexneri 2a str. 2457T
guaggccugauaagcgua

SEQ ID NO: 3855517 - RNA, 16 nt, Shigella flexneri 2a str. 2457T
gucacaggccaucaca

SEQ ID NO: 3855518 - RNA, 19 nt, Shigella flexneri 2a str. 2457T
gucacagugaauggggcua

SEQ ID NO: 3855519 - RNA, 17 nt, Shigella flexneri 2a str. 2457T
gucacaucaccaacacc

SEQ ID NO: 3855520 - RNA, 13 nt, Shigella flexneri 2a str. 2457T
gucacaucagcga

SEQ ID NO: 3855521 - RNA, 15 nt, Shigella flexneri 2a str. 2457T
gucacaucaggccau

SEQ ID NO: 3855522 - RNA, 12 nt, Shigella flexneri 2a str. 2457T
gucacaucuucc

SEQ ID NO: 3855523 - RNA, 16 nt, Shigella flexneri 2a str. 2457T
gucacauguuccaggg

SEQ ID NO: 3855524 - RNA, 21 nt, Shigella flexneri 2a str. 2457T
gucaccacacgccgcaauggc

SEQ ID NO: 3855525 - RNA, 16 nt, Shigella flexneri 2a str. 2457T
gucaccacauccagcu

SEQ ID NO: 3855526 - RNA, 15 nt, Shigella flexneri 2a str. 2457T
gucaccgccagguga

SEQ ID NO: 3855527 - RNA, 18 nt, Shigella flexneri 2a str. 2457T
gucaccggaauaaugaug

SEQ ID NO: 3855528 - RNA, 16 nt, Shigella flexneri 2a str. 2457T
gucaccuucuggcgac

SEQ ID NO: 3855529 - RNA, 17 nt, Shigella flexneri 2a str. 2457T
gucaccuucuggcgacc

SEQ ID NO: 3855530 - RNA, 19 nt, Shigella flexneri 2a str. 2457T
gucacgccgaccagaccgg

SEQ ID NO: 3855531 - RNA, 15 nt, Shigella flexneri 2a str. 2457T
gucacggaaucccgu

SEQ ID NO: 3855532 - RNA, 15 nt, Shigella flexneri 2a str. 2457T
gucacgucauccccc

SEQ ID NO: 3855533 - RNA, 22 nt, Shigella flexneri 2a str. 2457T
gucacucucgacccgacagaug

SEQ ID NO: 3855534 - RNA, 14 nt, Shigella flexneri 2a str. 2457T
gucacugacuauuu

SEQ ID NO: 3855535 - RNA, 18 nt, Shigella flexneri 2a str. 2457T
gucacugauagugcugcc

SEQ ID NO: 3855536 - RNA, 18 nt, Shigella flexneri 2a str. 2457T
gucacugcgcccuacucc

SEQ ID NO: 3855537 - RNA, 23 nt, Shigella flexneri 2a str. 2457T
gucagaaaaaucaauauuuucaa

SEQ ID NO: 3855538 - RNA, 22 nt, Shigella flexneri 2a str. 2457T
gucagaaacaguuguaaaguac

SEQ ID NO: 3855539 - RNA, 23 nt, Shigella flexneri 2a str. 2457T
gucagaacgguucuugaaaauca

SEQ ID NO: 3855540 - RNA, 13 nt, Shigella flexneri 2a str. 2457T
gucagacagcgau

SEQ ID NO: 3855541 - RNA, 19 nt, Shigella flexneri 2a str. 2457T
gucagaccaaaacgcgcca

SEQ ID NO: 3855542 - RNA, 18 nt, Shigella flexneri 2a str. 2457T
gucagacgaagucaacaa

SEQ ID NO: 3855543 - RNA, 14 nt, Shigella flexneri 2a str. 2457T
gucagacuuaagcc

SEQ ID NO: 3855544 - RNA, 18 nt, Shigella flexneri 2a str. 2457T
gucagagagccagcccca

SEQ ID NO: 3855545 - RNA, 13 nt, Shigella flexneri 2a str. 2457T
gucagagcauuac

SEQ ID NO: 3855546 - RNA, 22 nt, Shigella flexneri 2a str. 2457T
gucagaucgccccggucaucaa

SEQ ID NO: 3855547 - RNA, 12 nt, Shigella flexneri 2a str. 2457T
gucagaugcggc

SEQ ID NO: 3855548 - RNA, 14 nt, Shigella flexneri 2a str. 2457T
gucagauuucaauc

SEQ ID NO: 3855549 - RNA, 19 nt, Shigella flexneri 2a str. 2457T
gucagcaacuguaacgcag

SEQ ID NO: 3855550 - RNA, 19 nt, Shigella flexneri 2a str. 2457T
gucagcaaucaccugacgu

SEQ ID NO: 3855551 - RNA, 20 nt, Shigella flexneri 2a str. 2457T
gucagcaaucaccugacguu

SEQ ID NO: 3855552 - RNA, 14 nt, Shigella flexneri 2a str. 2457T
gucagcaccagaga

SEQ ID NO: 3855553 - RNA, 18 nt, Shigella flexneri 2a str. 2457T
gucagcaccagagaacug

SEQ ID NO: 3855554 - RNA, 19 nt, Shigella flexneri 2a str. 2457T
gucagcaguucacgcagcu

SEQ ID NO: 3855555 - RNA, 21 nt, Shigella flexneri 2a str. 2457T
gucagcaucauaccuccgcaa

SEQ ID NO: 3855556 - RNA, 17 nt, Shigella flexneri 2a str. 2457T
gucagccacuucuucca

SEQ ID NO: 3855557 - RNA, 15 nt, Shigella flexneri 2a str. 2457T
gucagccagaaagaa

SEQ ID NO: 3855558 - RNA, 20 nt, Shigella flexneri 2a str. 2457T
gucagcccgugauuuuccug

SEQ ID NO: 3855559 - RNA, 13 nt, Shigella flexneri 2a str. 2457T
gucagccgcccgc

SEQ ID NO: 3855560 - RNA, 18 nt, Shigella flexneri 2a str. 2457T
gucagccucgcuggucag

SEQ ID NO: 3855561 - RNA, 19 nt, Shigella flexneri 2a str. 2457T
gucagccugcucaguugca

SEQ ID NO: 3855562 - RNA, 22 nt, Shigella flexneri 2a str. 2457T
gucagcgucgcaucuggcauaa

SEQ ID NO: 3855563 - RNA, 17 nt, Shigella flexneri 2a str. 2457T
gucagcguuccacgugc

SEQ ID NO: 3855564 - RNA, 15 nt, Shigella flexneri 2a str. 2457T
gucagcguuucaaca

SEQ ID NO: 3855565 - RNA, 14 nt, Shigella flexneri 2a str. 2457T
gucagcucacaaau

SEQ ID NO: 3855566 - RNA, 18 nt, Shigella flexneri 2a str. 2457T
gucagcucacaaauacgc

SEQ ID NO: 3855567 - RNA, 15 nt, Shigella flexneri 2a str. 2457T
gucagcucauccagc

SEQ ID NO: 3855568 - RNA, 20 nt, Shigella flexneri 2a str. 2457T
gucagcucucagccagcugg

SEQ ID NO: 3855569 - RNA, 17 nt, Shigella flexneri 2a str. 2457T
gucagcuucaccuucca

SEQ ID NO: 3855570 - RNA, 23 nt, Shigella flexneri 2a str. 2457T
gucagcuuucagagaagcaccgc

SEQ ID NO: 3855571 - RNA, 12 nt, Shigella flexneri 2a str. 2457T
gucaggaagccc

SEQ ID NO: 3855572 - RNA, 13 nt, Shigella flexneri 2a str. 2457T
gucaggagcugga

SEQ ID NO: 3855573 - RNA, 13 nt, Shigella flexneri 2a str. 2457T
gucaggaucgugc

SEQ ID NO: 3855574 - RNA, 15 nt, Shigella flexneri 2a str. 2457T
gucaggauggccggg

SEQ ID NO: 3855575 - RNA, 15 nt, Shigella flexneri 2a str. 2457T
gucaggcaaccgcug

SEQ ID NO: 3855576 - RNA, 20 nt, Shigella flexneri 2a str. 2457T
gucaggcaaccgcugagcga

SEQ ID NO: 3855577 - RNA, 20 nt, Shigella flexneri 2a str. 2457T
gucaggcaagccgcuaacag

SEQ ID NO: 3855578 - RNA, 15 nt, Shigella flexneri 2a str. 2457T
gucagguuuuaccuc

SEQ ID NO: 3855579 - RNA, 18 nt, Shigella flexneri 2a str. 2457T
gucaguaaccgcuuuuuc

SEQ ID NO: 3855580 - RNA, 20 nt, Shigella flexneri 2a str. 2457T
gucaguaaccgcuuuuucaa

SEQ ID NO: 3855581 - RNA, 12 nt, Shigella flexneri 2a str. 2457T
gucaguaaugac

SEQ ID NO: 3855582 - RNA, 16 nt, Shigella flexneri 2a str. 2457T
gucaguacgccgccgu

SEQ ID NO: 3855583 - RNA, 21 nt, Shigella flexneri 2a str. 2457T
gucaguggacgauaagcaccg

SEQ ID NO: 3855584 - RNA, 22 nt, Shigella flexneri 2a str. 2457T
gucagugucuuaucuggcauuu

SEQ ID NO: 3855585 - RNA, 13 nt, Shigella flexneri 2a str. 2457T
gucaguuaagcaa

SEQ ID NO: 3855586 - RNA, 14 nt, Shigella flexneri 2a str. 2457T
gucaguuccauaau

SEQ ID NO: 3855587 - RNA, 16 nt, Shigella flexneri 2a str. 2457T
gucaguucccagggcu

SEQ ID NO: 3855588 - RNA, 22 nt, Shigella flexneri 2a str. 2457T
gucaguuuuucacgagagauac

SEQ ID NO: 3855589 - RNA, 19 nt, Shigella flexneri 2a str. 2457T
gucauaacuggucaucaaa

SEQ ID NO: 3855590 - RNA, 20 nt, Shigella flexneri 2a str. 2457T
gucauacgagucgccuguac

SEQ ID NO: 3855591 - RNA, 21 nt, Shigella flexneri 2a str. 2457T
gucauacuccagucgcugcug

SEQ ID NO: 3855592 - RNA, 17 nt, Shigella flexneri 2a str. 2457T
gucauagguucuuuuaa

SEQ ID NO: 3855593 - RNA, 21 nt, Shigella flexneri 2a str. 2457T
gucauauagccgcgcaguuuc

SEQ ID NO: 3855594 - RNA, 13 nt, Shigella flexneri 2a str. 2457T
gucaucaaaauca

SEQ ID NO: 3855595 - RNA, 12 nt, Shigella flexneri 2a str. 2457T
gucaucaaucag

SEQ ID NO: 3855596 - RNA, 21 nt, Shigella flexneri 2a str. 2457T
gucaucaccggcuucucgccu

SEQ ID NO: 3855597 - RNA, 20 nt, Shigella flexneri 2a str. 2457T
gucaucaccuccagccugau

SEQ ID NO: 3855598 - RNA, 19 nt, Shigella flexneri 2a str. 2457T
gucaucagucugagccugc

SEQ ID NO: 3855599 - RNA, 14 nt, Shigella flexneri 2a str. 2457T
gucaucaguuucaa

SEQ ID NO: 3855600 - RNA, 14 nt, Shigella flexneri 2a str. 2457T
gucaucaucgccac

SEQ ID NO: 3855601 - RNA, 23 nt, Shigella flexneri 2a str. 2457T
gucauccaaaucgcccagcaaau

SEQ ID NO: 3855602 - RNA, 14 nt, Shigella flexneri 2a str. 2457T
gucauccagcagcg

SEQ ID NO: 3855603 - RNA, 14 nt, Shigella flexneri 2a str. 2457T
gucauccaggaacu

SEQ ID NO: 3855604 - RNA, 12 nt, Shigella flexneri 2a str. 2457T
gucauccauacc

SEQ ID NO: 3855605 - RNA, 19 nt, Shigella flexneri 2a str. 2457T
gucaucccccaguggcagc

SEQ ID NO: 3855606 - RNA, 22 nt, Shigella flexneri 2a str. 2457T
gucaucccccaguggcagcaau

SEQ ID NO: 3855607 - RNA, 20 nt, Shigella flexneri 2a str. 2457T
gucauccggcacgcuaccau

SEQ ID NO: 3855608 - RNA, 22 nt, Shigella flexneri 2a str. 2457T
gucauccggcgucauauuacug

SEQ ID NO: 3855609 - RNA, 22 nt, Shigella flexneri 2a str. 2457T
gucauccguggcgacagaggug

SEQ ID NO: 3855610 - RNA, 23 nt, Shigella flexneri 2a str. 2457T
gucauccuaaacgcuggcaggau

SEQ ID NO: 3855611 - RNA, 14 nt, Shigella flexneri 2a str. 2457T
gucaucgacaucaa

SEQ ID NO: 3855612 - RNA, 18 nt, Shigella flexneri 2a str. 2457T
gucaucggcguugcccau

SEQ ID NO: 3855613 - RNA, 19 nt, Shigella flexneri 2a str. 2457T
gucaugacgacaaggcagg

SEQ ID NO: 3855614 - RNA, 21 nt, Shigella flexneri 2a str. 2457T
gucgccaaguucgaacgccgc

SEQ ID NO: 3855615 - RNA, 15 nt, Shigella flexneri 2a str. 2457T
gucgccagacgcagc

SEQ ID NO: 3855616 - RNA, 15 nt, Shigella flexneri 2a str. 2457T
gucgccagcaacaca

SEQ ID NO: 3855617 - RNA, 13 nt, Shigella flexneri 2a str. 2457T
gucgccauccaga

SEQ ID NO: 3855618 - RNA, 15 nt, Shigella flexneri 2a str. 2457T
gucgccgccuguucc

SEQ ID NO: 3855619 - RNA, 20 nt, Shigella flexneri 2a str. 2457T
gucgccgcgacgcccccugc

SEQ ID NO: 3855620 - RNA, 15 nt, Shigella flexneri 2a str. 2457T
gucgccgggaugcug

SEQ ID NO: 3855621 - RNA, 16 nt, Shigella flexneri 2a str. 2457T
gucgccguaccgggug

SEQ ID NO: 3855622 - RNA, 17 nt, Shigella flexneri 2a str. 2457T
gucgccugcuuuaucga

SEQ ID NO: 3855623 - RNA, 19 nt, Shigella flexneri 2a str. 2457T
gucgccuguacuuccuguu

SEQ ID NO: 3855624 - RNA, 18 nt, Shigella flexneri 2a str. 2457T
gucgcgcaauugccagac

SEQ ID NO: 3855625 - RNA, 22 nt, Shigella flexneri 2a str. 2457T
gucgcgguugcugucggcggcg

SEQ ID NO: 3855626 - RNA, 18 nt, Shigella flexneri 2a str. 2457T
gucgcuccugccacauau

SEQ ID NO: 3855627 - RNA, 21 nt, Shigella flexneri 2a str. 2457T
gucgcuuaauugaccugccgg

SEQ ID NO: 3855628 - RNA, 22 nt, Shigella flexneri 2a str. 2457T
gucgcuugugguacuaucagcg

SEQ ID NO: 3855629 - RNA, 11 nt, Shigella flexneri 2a str. 2457T
gucgcuuugac

SEQ ID NO: 3855630 - RNA, 20 nt, Shigella flexneri 2a str. 2457T
gucggaaaauuauuuuaaau

SEQ ID NO: 3855631 - RNA, 21 nt, Shigella flexneri 2a str. 2457T
gucggacgcuguuccggcggc

SEQ ID NO: 3855632 - RNA, 22 nt, Shigella flexneri 2a str. 2457T
gucggaucgcugaacgcaccuu

SEQ ID NO: 3855633 - RNA, 12 nt, Shigella flexneri 2a str. 2457T
gucggaugcggc

SEQ ID NO: 3855634 - RNA, 15 nt, Shigella flexneri 2a str. 2457T
gucggcaaagcgggc

SEQ ID NO: 3855635 - RNA, 19 nt, Shigella flexneri 2a str. 2457T
gucggcaauguagcgcugc

SEQ ID NO: 3855636 - RNA, 19 nt, Shigella flexneri 2a str. 2457T
gucggcaguaccugaccag

SEQ ID NO: 3855637 - RNA, 18 nt, Shigella flexneri 2a str. 2457T
gucggcgucagcgccauc

SEQ ID NO: 3855638 - RNA, 14 nt, Shigella flexneri 2a str. 2457T
gucggcuuucucau

SEQ ID NO: 3855639 - RNA, 15 nt, Shigella flexneri 2a str. 2457T
gucgggaccagcauu

SEQ ID NO: 3855640 - RNA, 24 nt, Shigella flexneri 2a str. 2457T
gucgggcuuuuggagaucacgcca

SEQ ID NO: 3855641 - RNA, 14 nt, Shigella flexneri 2a str. 2457T
gucggguuuacgug

SEQ ID NO: 3855642 - RNA, 15 nt, Shigella flexneri 2a str. 2457T
gucgguaauuucaca

SEQ ID NO: 3855643 - RNA, 17 nt, Shigella flexneri 2a str. 2457T
gucgguguccacuuccg

SEQ ID NO: 3855644 - RNA, 14 nt, Shigella flexneri 2a str. 2457T
gucgguuucgcgca

SEQ ID NO: 3855645 - RNA, 14 nt, Shigella flexneri 2a str. 2457T
gucguaaacaacug

SEQ ID NO: 3855646 - RNA, 15 nt, Shigella flexneri 2a str. 2457T
gucguaaacaacugg

SEQ ID NO: 3855647 - RNA, 19 nt, Shigella flexneri 2a str. 2457T
gucguaaacaacuggcgcu

SEQ ID NO: 3855648 - RNA, 14 nt, Shigella flexneri 2a str. 2457T
gucguaucaccacg

SEQ ID NO: 3855649 - RNA, 21 nt, Shigella flexneri 2a str. 2457T
gucguauucucaauaaaagga

SEQ ID NO: 3855650 - RNA, 18 nt, Shigella flexneri 2a str. 2457T
gucguauuucagccccag

SEQ ID NO: 3855651 - RNA, 20 nt, Shigella flexneri 2a str. 2457T
gucgucagcaguucacgcag

SEQ ID NO: 3855652 - RNA, 16 nt, Shigella flexneri 2a str. 2457T
gucgucaguuccauaa

SEQ ID NO: 3855653 - RNA, 15 nt, Shigella flexneri 2a str. 2457T
gucguccggcagcag

SEQ ID NO: 3855654 - RNA, 21 nt, Shigella flexneri 2a str. 2457T
gucgugaaugccguaggccca

SEQ ID NO: 3855655 - RNA, 23 nt, Shigella flexneri 2a str. 2457T
gucgugauugucggugccggaac

SEQ ID NO: 3855656 - RNA, 21 nt, Shigella flexneri 2a str. 2457T
gucguggcaaucguagcccag

SEQ ID NO: 3855657 - RNA, 15 nt, Shigella flexneri 2a str. 2457T
gucguucaggcgcug

SEQ ID NO: 3855658 - RNA, 13 nt, Shigella flexneri 2a str. 2457T
gucguucaucgca

SEQ ID NO: 3855659 - RNA, 14 nt, Shigella flexneri 2a str. 2457T
gucguuuagacguu

SEQ ID NO: 3855660 - RNA, 13 nt, Shigella flexneri 2a str. 2457T
gucuaaaucuucc

SEQ ID NO: 3855661 - RNA, 14 nt, Shigella flexneri 2a str. 2457T
gucuaaaucuuccg

SEQ ID NO: 3855662 - RNA, 19 nt, Shigella flexneri 2a str. 2457T
gucuaauggugaacugaca

SEQ ID NO: 3855663 - RNA, 19 nt, Shigella flexneri 2a str. 2457T
gucuacgccuuguuucuuc

SEQ ID NO: 3855664 - RNA, 16 nt, Shigella flexneri 2a str. 2457T
gucuaguaaagcagac

SEQ ID NO: 3855665 - RNA, 22 nt, Shigella flexneri 2a str. 2457T
gucucaagggaggagucauccu

SEQ ID NO: 3855666 - RNA, 19 nt, Shigella flexneri 2a str. 2457T
gucucaauuaguaaugaua

SEQ ID NO: 3855667 - RNA, 12 nt, Shigella flexneri 2a str. 2457T
gucucaucuuua

SEQ ID NO: 3855668 - RNA, 16 nt, Shigella flexneri 2a str. 2457T
gucucccacaugcugg

SEQ ID NO: 3855669 - RNA, 17 nt, Shigella flexneri 2a str. 2457T
gucucccgucaggagcu

SEQ ID NO: 3855670 - RNA, 19 nt, Shigella flexneri 2a str. 2457T
gucucggcauggauuaugu

SEQ ID NO: 3855671 - RNA, 21 nt, Shigella flexneri 2a str. 2457T
gucucugccggguucgcacua

SEQ ID NO: 3855672 - RNA, 15 nt, Shigella flexneri 2a str. 2457T
gucucuucaugccuc

SEQ ID NO: 3855673 - RNA, 19 nt, Shigella flexneri 2a str. 2457T
gucucuugccgguuuugca

SEQ ID NO: 3855674 - RNA, 21 nt, Shigella flexneri 2a str. 2457T
gucugaaagguauuggcggca

SEQ ID NO: 3855675 - RNA, 14 nt, Shigella flexneri 2a str. 2457T
gucugaaugccgcu

SEQ ID NO: 3855676 - RNA, 16 nt, Shigella flexneri 2a str. 2457T
gucugaccgucuuuca

SEQ ID NO: 3855677 - RNA, 15 nt, Shigella flexneri 2a str. 2457T
gucugagccgaaaaa

SEQ ID NO: 3855678 - RNA, 18 nt, Shigella flexneri 2a str. 2457T
gucugagccgaaaaagag

SEQ ID NO: 3855679 - RNA, 16 nt, Shigella flexneri 2a str. 2457T
gucugauaaaaaaccc

SEQ ID NO: 3855680 - RNA, 16 nt, Shigella flexneri 2a str. 2457T
gucugaugauaaucag

SEQ ID NO: 3855681 - RNA, 14 nt, Shigella flexneri 2a str. 2457T
gucugccccgccgc

SEQ ID NO: 3855682 - RNA, 20 nt, Shigella flexneri 2a str. 2457T
gucugccgguacuucaccag

SEQ ID NO: 3855683 - RNA, 17 nt, Shigella flexneri 2a str. 2457T
gucugcuggaacaaacu

SEQ ID NO: 3855684 - RNA, 14 nt, Shigella flexneri 2a str. 2457T
gucugcuucugccu

SEQ ID NO: 3855685 - RNA, 15 nt, Shigella flexneri 2a str. 2457T
gucuggcccaugcca

SEQ ID NO: 3855686 - RNA, 14 nt, Shigella flexneri 2a str. 2457T
gucuggcgcagugg

SEQ ID NO: 3855687 - RNA, 18 nt, Shigella flexneri 2a str. 2457T
gucuggcguuuguaucga

SEQ ID NO: 3855688 - RNA, 14 nt, Shigella flexneri 2a str. 2457T
gucugggcaaaauc

SEQ ID NO: 3855689 - RNA, 14 nt, Shigella flexneri 2a str. 2457T
gucugggccgauaa

SEQ ID NO: 3855690 - RNA, 17 nt, Shigella flexneri 2a str. 2457T
gucugggcguugcaaua

SEQ ID NO: 3855691 - RNA, 18 nt, Shigella flexneri 2a str. 2457T
gucuggguuucgccaggc

SEQ ID NO: 3855692 - RNA, 20 nt, Shigella flexneri 2a str. 2457T
gucuggguuucgccaggcac

SEQ ID NO: 3855693 - RNA, 16 nt, Shigella flexneri 2a str. 2457T
gucugguaucgcgcca

SEQ ID NO: 3855694 - RNA, 18 nt, Shigella flexneri 2a str. 2457T
gucuguacggcagugaac

SEQ ID NO: 3855695 - RNA, 20 nt, Shigella flexneri 2a str. 2457T
gucuuaaaccggacaauaaa

SEQ ID NO: 3855696 - RNA, 18 nt, Shigella flexneri 2a str. 2457T
gucuuaucaggccuacaa

SEQ ID NO: 3855697 - RNA, 19 nt, Shigella flexneri 2a str. 2457T
gucuuaucuggcauuugca

SEQ ID NO: 3855698 - RNA, 20 nt, Shigella flexneri 2a str. 2457T
gucuucaucauccucuucag

SEQ ID NO: 3855699 - RNA, 14 nt, Shigella flexneri 2a str. 2457T
gucuuccagcaaau

SEQ ID NO: 3855700 - RNA, 14 nt, Shigella flexneri 2a str. 2457T
gucuucccagcccc

SEQ ID NO: 3855701 - RNA, 14 nt, Shigella flexneri 2a str. 2457T
gucuucccgcagcc

SEQ ID NO: 3855702 - RNA, 10 nt, Shigella flexneri 2a str. 2457T
gucuucccug

SEQ ID NO: 3855703 - RNA, 11 nt, Shigella flexneri 2a str. 2457T
gucuucccugc

SEQ ID NO: 3855704 - RNA, 10 nt, Shigella flexneri 2a str. 2457T
gucuuccugc

SEQ ID NO: 3855705 - RNA, 20 nt, Shigella flexneri 2a str. 2457T
gucuucgauagcaaauugcu

SEQ ID NO: 3855706 - RNA, 20 nt, Shigella flexneri 2a str. 2457T
gucuucugcagucaccugcg

SEQ ID NO: 3855707 - RNA, 13 nt, Shigella flexneri 2a str. 2457T
gucuucugguugc

SEQ ID NO: 3855708 - RNA, 21 nt, Shigella flexneri 2a str. 2457T
gucuucugguugcgaaaaaau

SEQ ID NO: 3855709 - RNA, 21 nt, Shigella flexneri 2a str. 2457T
gucuucugugauuccgccagu

SEQ ID NO: 3855710 - RNA, 14 nt, Shigella flexneri 2a str. 2457T
gucuuguacuuccg

SEQ ID NO: 3855711 - RNA, 15 nt, Shigella flexneri 2a str. 2457T
gucuuguuacuggcu

SEQ ID NO: 3855712 - RNA, 17 nt, Shigella flexneri 2a str. 2457T
gugcaagaaaugacaga

SEQ ID NO: 3855713 - RNA, 18 nt, Shigella flexneri 2a str. 2457T
gugcaagaaaugacagag

SEQ ID NO: 3855714 - RNA, 16 nt, Shigella flexneri 2a str. 2457T
gugcaaggaaauaaua

SEQ ID NO: 3855715 - RNA, 16 nt, Shigella flexneri 2a str. 2457T
gugcaauaccauggcu

SEQ ID NO: 3855716 - RNA, 22 nt, Shigella flexneri 2a str. 2457T
gugcaauaccauggcucaccag

SEQ ID NO: 3855717 - RNA, 22 nt, Shigella flexneri 2a str. 2457T
gugcaccaccaaagguuaacug

SEQ ID NO: 3855718 - RNA, 14 nt, Shigella flexneri 2a str. 2457T
gugcaccauaugag

SEQ ID NO: 3855719 - RNA, 14 nt, Shigella flexneri 2a str. 2457T
gugcacccgcuuca

SEQ ID NO: 3855720 - RNA, 22 nt, Shigella flexneri 2a str. 2457T
gugcaccggguaccagaaucac

SEQ ID NO: 3855721 - RNA, 16 nt, Shigella flexneri 2a str. 2457T
gugcacgaaccagaga

SEQ ID NO: 3855722 - RNA, 15 nt, Shigella flexneri 2a str. 2457T
gugcacgugccagau

SEQ ID NO: 3855723 - RNA, 18 nt, Shigella flexneri 2a str. 2457T
gugcacuuugucaauaau

SEQ ID NO: 3855724 - RNA, 21 nt, Shigella flexneri 2a str. 2457T
gugcagaacggugagcgugcg

SEQ ID NO: 3855725 - RNA, 19 nt, Shigella flexneri 2a str. 2457T
gugcagaaucaaucucagc

SEQ ID NO: 3855726 - RNA, 21 nt, Shigella flexneri 2a str. 2457T
gugcagacaugacgcccggca

SEQ ID NO: 3855727 - RNA, 22 nt, Shigella flexneri 2a str. 2457T
gugcagagcccguuuggugguu

SEQ ID NO: 3855728 - RNA, 17 nt, Shigella flexneri 2a str. 2457T
gugcagcaugcacccuc

SEQ ID NO: 3855729 - RNA, 23 nt, Shigella flexneri 2a str. 2457T
gugcagccggagcuucacccgca

SEQ ID NO: 3855730 - RNA, 17 nt, Shigella flexneri 2a str. 2457T
gugcaggcaccagcccc

SEQ ID NO: 3855731 - RNA, 16 nt, Shigella flexneri 2a str. 2457T
gugcaguuccugcaac

SEQ ID NO: 3855732 - RNA, 21 nt, Shigella flexneri 2a str. 2457T
gugcauaaauaccggcauguu

SEQ ID NO: 3855733 - RNA, 22 nt, Shigella flexneri 2a str. 2457T
gugcaucaggcaaacuucacgc

SEQ ID NO: 3855734 - RNA, 15 nt, Shigella flexneri 2a str. 2457T
gugcauccagcagcc

SEQ ID NO: 3855735 - RNA, 14 nt, Shigella flexneri 2a str. 2457T
gugcauugaguccc

SEQ ID NO: 3855736 - RNA, 21 nt, Shigella flexneri 2a str. 2457T
gugcauuucucacuuuucacc

SEQ ID NO: 3855737 - RNA, 16 nt, Shigella flexneri 2a str. 2457T
gugccaaaaaucgcaa

SEQ ID NO: 3855738 - RNA, 12 nt, Shigella flexneri 2a str. 2457T
gugccaggacca

SEQ ID NO: 3855739 - RNA, 16 nt, Shigella flexneri 2a str. 2457T
gugccaggaccauuca

SEQ ID NO: 3855740 - RNA, 16 nt, Shigella flexneri 2a str. 2457T
gugccaucgauaauca

SEQ ID NO: 3855741 - RNA, 19 nt, Shigella flexneri 2a str. 2457T
gugccaugccaaucagcag

SEQ ID NO: 3855742 - RNA, 23 nt, Shigella flexneri 2a str. 2457T
gugccauuaaugucggaugcggc

SEQ ID NO: 3855743 - RNA, 12 nt, Shigella flexneri 2a str. 2457T
gugccauugacc

SEQ ID NO: 3855744 - RNA, 22 nt, Shigella flexneri 2a str. 2457T
gugcccaacugccugaugcgau

SEQ ID NO: 3855745 - RNA, 14 nt, Shigella flexneri 2a str. 2457T
gugccccgagcggu

SEQ ID NO: 3855746 - RNA, 12 nt, Shigella flexneri 2a str. 2457T
gugcccgcgugg

SEQ ID NO: 3855747 - RNA, 20 nt, Shigella flexneri 2a str. 2457T
gugccgacaucgccacggca

SEQ ID NO: 3855748 - RNA, 19 nt, Shigella flexneri 2a str. 2457T
gugccgagaguaacacauu

SEQ ID NO: 3855749 - RNA, 20 nt, Shigella flexneri 2a str. 2457T
gugccgcacauagcaccacc

SEQ ID NO: 3855750 - RNA, 14 nt, Shigella flexneri 2a str. 2457T
gugccgcagcccca

SEQ ID NO: 3855751 - RNA, 21 nt, Shigella flexneri 2a str. 2457T
gugccgcagccccagagccug

SEQ ID NO: 3855752 - RNA, 15 nt, Shigella flexneri 2a str. 2457T
gugccgcauugacgc

SEQ ID NO: 3855753 - RNA, 14 nt, Shigella flexneri 2a str. 2457T
gugccgcgacagau

SEQ ID NO: 3855754 - RNA, 20 nt, Shigella flexneri 2a str. 2457T
gugccgcgauaccacccgca

SEQ ID NO: 3855755 - RNA, 19 nt, Shigella flexneri 2a str. 2457T
gugccgcuggcauacaguu

SEQ ID NO: 3855756 - RNA, 18 nt, Shigella flexneri 2a str. 2457T
gugccggaaggaagacgc

SEQ ID NO: 3855757 - RNA, 15 nt, Shigella flexneri 2a str. 2457T
gugccggaaggggcg

SEQ ID NO: 3855758 - RNA, 16 nt, Shigella flexneri 2a str. 2457T
gugccggaagucucuu

SEQ ID NO: 3855759 - RNA, 22 nt, Shigella flexneri 2a str. 2457T
gugccggauuucauauccggca

SEQ ID NO: 3855760 - RNA, 15 nt, Shigella flexneri 2a str. 2457T
gugccggcaacaaua

SEQ ID NO: 3855761 - RNA, 22 nt, Shigella flexneri 2a str. 2457T
gugccggcaacaauauuaacuc

SEQ ID NO: 3855762 - RNA, 18 nt, Shigella flexneri 2a str. 2457T
gugccgguaaagcaauga

SEQ ID NO: 3855763 - RNA, 19 nt, Shigella flexneri 2a str. 2457T
gugccggucugaauacgcc

SEQ ID NO: 3855764 - RNA, 15 nt, Shigella flexneri 2a str. 2457T
gugccgguuucacgu

SEQ ID NO: 3855765 - RNA, 23 nt, Shigella flexneri 2a str. 2457T
gugccguaaaucccagugccugc

SEQ ID NO: 3855766 - RNA, 19 nt, Shigella flexneri 2a str. 2457T
gugccgucugccccgccgc

SEQ ID NO: 3855767 - RNA, 22 nt, Shigella flexneri 2a str. 2457T
gugccuuuaauaccaucggcag

SEQ ID NO: 3855768 - RNA, 15 nt, Shigella flexneri 2a str. 2457T
gugccuuuuuuauuu

SEQ ID NO: 3855769 - RNA, 19 nt, Shigella flexneri 2a str. 2457T
gugccuuuuuuauuuaugc

SEQ ID NO: 3855770 - RNA, 20 nt, Shigella flexneri 2a str. 2457T
gugcgaaugcgauggcaaaa

SEQ ID NO: 3855771 - RNA, 14 nt, Shigella flexneri 2a str. 2457T
gugcgccacagaca

SEQ ID NO: 3855772 - RNA, 18 nt, Shigella flexneri 2a str. 2457T
gugcgccacauccggcau

SEQ ID NO: 3855773 - RNA, 13 nt, Shigella flexneri 2a str. 2457T
gugcgccagcgau

SEQ ID NO: 3855774 - RNA, 19 nt, Shigella flexneri 2a str. 2457T
gugcgcccuguucugcaag

SEQ ID NO: 3855775 - RNA, 23 nt, Shigella flexneri 2a str. 2457T
gugcgcgauagauagcguucuuu

SEQ ID NO: 3855776 - RNA, 13 nt, Shigella flexneri 2a str. 2457T
gugcgcgccagga

SEQ ID NO: 3855777 - RNA, 16 nt, Shigella flexneri 2a str. 2457T
gugcgcgcccauacgg

SEQ ID NO: 3855778 - RNA, 14 nt, Shigella flexneri 2a str. 2457T
gugcgcggcagcca

SEQ ID NO: 3855779 - RNA, 13 nt, Shigella flexneri 2a str. 2457T
gugcgcggcuuaa

SEQ ID NO: 3855780 - RNA, 16 nt, Shigella flexneri 2a str. 2457T
gugcggcacaagaaaa

SEQ ID NO: 3855781 - RNA, 15 nt, Shigella flexneri 2a str. 2457T
gugcggcaucgcugu

SEQ ID NO: 3855782 - RNA, 20 nt, Shigella flexneri 2a str. 2457T
gugcgggaguugaucgccaa

SEQ ID NO: 3855783 - RNA, 16 nt, Shigella flexneri 2a str. 2457T
gugcggguaaccagcc

SEQ ID NO: 3855784 - RNA, 15 nt, Shigella flexneri 2a str. 2457T
gugcggucaggcauc

SEQ ID NO: 3855785 - RNA, 15 nt, Shigella flexneri 2a str. 2457T
gugcgguccaugcga

SEQ ID NO: 3855786 - RNA, 19 nt, Shigella flexneri 2a str. 2457T
gugcgguuucagcucacgg

SEQ ID NO: 3855787 - RNA, 16 nt, Shigella flexneri 2a str. 2457T
gugcguggcgauacgg

SEQ ID NO: 3855788 - RNA, 22 nt, Shigella flexneri 2a str. 2457T
gugcuaguuaucuccuugcugg

SEQ ID NO: 3855789 - RNA, 16 nt, Shigella flexneri 2a str. 2457T
gugcucaaugagcacc

SEQ ID NO: 3855790 - RNA, 17 nt, Shigella flexneri 2a str. 2457T
gugcucaaugagcaccu

SEQ ID NO: 3855791 - RNA, 16 nt, Shigella flexneri 2a str. 2457T
gugcucagagcuacaa

SEQ ID NO: 3855792 - RNA, 14 nt, Shigella flexneri 2a str. 2457T
gugcucauagacca

SEQ ID NO: 3855793 - RNA, 18 nt, Shigella flexneri 2a str. 2457T
gugcucaucagcccggca

SEQ ID NO: 3855794 - RNA, 15 nt, Shigella flexneri 2a str. 2457T
gugcucauccuucag

SEQ ID NO: 3855795 - RNA, 16 nt, Shigella flexneri 2a str. 2457T
gugcuccagugcgcuu

SEQ ID NO: 3855796 - RNA, 13 nt, Shigella flexneri 2a str. 2457T
gugcuccauuguu

SEQ ID NO: 3855797 - RNA, 14 nt, Shigella flexneri 2a str. 2457T
gugcucgcuuucca

SEQ ID NO: 3855798 - RNA, 16 nt, Shigella flexneri 2a str. 2457T
gugcugaaaucacagc

SEQ ID NO: 3855799 - RNA, 20 nt, Shigella flexneri 2a str. 2457T
gugcugaaaucacagcggcg

SEQ ID NO: 3855800 - RNA, 21 nt, Shigella flexneri 2a str. 2457T
gugcugaacgaaaagcgcaca

SEQ ID NO: 3855801 - RNA, 18 nt, Shigella flexneri 2a str. 2457T
gugcugacagaaguaauc

SEQ ID NO: 3855802 - RNA, 24 nt, Shigella flexneri 2a str. 2457T
gugcugcaauaaacaagauaacag

SEQ ID NO: 3855803 - RNA, 21 nt, Shigella flexneri 2a str. 2457T
gugcugggaaaccuggauauu

SEQ ID NO: 3855804 - RNA, 14 nt, Shigella flexneri 2a str. 2457T
gugcuguacagcag

SEQ ID NO: 3855805 - RNA, 18 nt, Shigella flexneri 2a str. 2457T
gugcuuucaucaaaaaau

SEQ ID NO: 3855806 - RNA, 18 nt, Shigella flexneri 2a str. 2457T
gugcuuucauuucagcgu

SEQ ID NO: 3855807 - RNA, 19 nt, Shigella flexneri 2a str. 2457T
guggaacaaauagacacaa

SEQ ID NO: 3855808 - RNA, 15 nt, Shigella flexneri 2a str. 2457T
guggaacggugaaaa

SEQ ID NO: 3855809 - RNA, 12 nt, Shigella flexneri 2a str. 2457T
guuaagaagauc

SEQ ID NO: 3855810 - RNA, 16 nt, Shigella flexneri 2a str. 2457T
guuaagcaaaaaaaca

SEQ ID NO: 3855811 - RNA, 13 nt, Shigella flexneri 2a str. 2457T
guuaagcaauacc

SEQ ID NO: 3855812 - RNA, 18 nt, Shigella flexneri 2a str. 2457T
guuaauaaaauuuacagu

SEQ ID NO: 3855813 - RNA, 16 nt, Shigella flexneri 2a str. 2457T
guuaauaaugauuuug

SEQ ID NO: 3855814 - RNA, 19 nt, Shigella flexneri 2a str. 2457T
guuaauccgcaaauaacgu

SEQ ID NO: 3855815 - RNA, 21 nt, Shigella flexneri 2a str. 2457T
guuacaacauccuauauuccu

SEQ ID NO: 3855816 - RNA, 15 nt, Shigella flexneri 2a str. 2457T
guuacacaucauuag

SEQ ID NO: 3855817 - RNA, 16 nt, Shigella flexneri 2a str. 2457T
guuacagcagguguua

SEQ ID NO: 3855818 - RNA, 14 nt, Shigella flexneri 2a str. 2457T
guuacagcuggagu

SEQ ID NO: 3855819 - RNA, 17 nt, Shigella flexneri 2a str. 2457T
guuacauaugcgcuggc

SEQ ID NO: 3855820 - RNA, 18 nt, Shigella flexneri 2a str. 2457T
guuacauaugcgcuggca

SEQ ID NO: 3855821 - RNA, 13 nt, Shigella flexneri 2a str. 2457T
guuacccagcacg

SEQ ID NO: 3855822 - RNA, 15 nt, Shigella flexneri 2a str. 2457T
guuaccccuucaucc

SEQ ID NO: 3855823 - RNA, 16 nt, Shigella flexneri 2a str. 2457T
guuacccgacgcgcca

SEQ ID NO: 3855824 - RNA, 21 nt, Shigella flexneri 2a str. 2457T
guuaccgacugcggccugagu

SEQ ID NO: 3855825 - RNA, 16 nt, Shigella flexneri 2a str. 2457T
guuaccgaucgccagc

SEQ ID NO: 3855826 - RNA, 15 nt, Shigella flexneri 2a str. 2457T
guuaccgcuauuugc

SEQ ID NO: 3855827 - RNA, 21 nt, Shigella flexneri 2a str. 2457T
guuacgcaaaaccucuuccag

SEQ ID NO: 3855828 - RNA, 20 nt, Shigella flexneri 2a str. 2457T
guuacgcagauauucguuca

SEQ ID NO: 3855829 - RNA, 16 nt, Shigella flexneri 2a str. 2457T
guuacgcauaaaacca

SEQ ID NO: 3855830 - RNA, 22 nt, Shigella flexneri 2a str. 2457T
guuacgcauaaaaccagcaaac

SEQ ID NO: 3855831 - RNA, 17 nt, Shigella flexneri 2a str. 2457T
guuacgccccaacacaa

SEQ ID NO: 3855832 - RNA, 17 nt, Shigella flexneri 2a str. 2457T
guuacgccccgguuucu

SEQ ID NO: 3855833 - RNA, 22 nt, Shigella flexneri 2a str. 2457T
guuacgccggugauuaaaccaa

SEQ ID NO: 3855834 - RNA, 16 nt, Shigella flexneri 2a str. 2457T
guuacugccaucuucc

SEQ ID NO: 3855835 - RNA, 17 nt, Shigella flexneri 2a str. 2457T
guuacugucgcgcagca

SEQ ID NO: 3855836 - RNA, 21 nt, Shigella flexneri 2a str. 2457T
guuacuuaucgauaaacggca

SEQ ID NO: 3855837 - RNA, 14 nt, Shigella flexneri 2a str. 2457T
guuagaaaacgccu

SEQ ID NO: 3855838 - RNA, 17 nt, Shigella flexneri 2a str. 2457T
guuagaaacaaaaaaac

SEQ ID NO: 3855839 - RNA, 23 nt, Shigella flexneri 2a str. 2457T
guuagcacgaaccgucccucgcc

SEQ ID NO: 3855840 - RNA, 14 nt, Shigella flexneri 2a str. 2457T
guuagcucaacgca

SEQ ID NO: 3855841 - RNA, 19 nt, Shigella flexneri 2a str. 2457T
guuagcugcguacauugcc

SEQ ID NO: 3855842 - RNA, 14 nt, Shigella flexneri 2a str. 2457T
guuaggcacaucaa

SEQ ID NO: 3855843 - RNA, 20 nt, Shigella flexneri 2a str. 2457T
guuaguccacacgccaggcc

SEQ ID NO: 3855844 - RNA, 23 nt, Shigella flexneri 2a str. 2457T
guuagucgcuuucauucagaaca

SEQ ID NO: 3855845 - RNA, 17 nt, Shigella flexneri 2a str. 2457T
guuauagcuggauuuuc

SEQ ID NO: 3855846 - RNA, 20 nt, Shigella flexneri 2a str. 2457T
guuauaucccauuuuugaau

SEQ ID NO: 3855847 - RNA, 13 nt, Shigella flexneri 2a str. 2457T
guuaucaaauuca

SEQ ID NO: 3855848 - RNA, 19 nt, Shigella flexneri 2a str. 2457T
guuaucagcaacuggcaaa

SEQ ID NO: 3855849 - RNA, 20 nt, Shigella flexneri 2a str. 2457T
guuaucagcaacuggcaaaa

SEQ ID NO: 3855850 - RNA, 18 nt, Shigella flexneri 2a str. 2457T
guuauccgccagcgccau

SEQ ID NO: 3855851 - RNA, 16 nt, Shigella flexneri 2a str. 2457T
guuauccgccaguuug

SEQ ID NO: 3855852 - RNA, 19 nt, Shigella flexneri 2a str. 2457T
guuauccugauaaaaacca

SEQ ID NO: 3855853 - RNA, 21 nt, Shigella flexneri 2a str. 2457T
guuauccugaucaagcacaug

SEQ ID NO: 3855854 - RNA, 23 nt, Shigella flexneri 2a str. 2457T
guuaucgcucgucgcgacgacca

SEQ ID NO: 3855855 - RNA, 18 nt, Shigella flexneri 2a str. 2457T
guuaucguaccaggcgac

SEQ ID NO: 3855856 - RNA, 16 nt, Shigella flexneri 2a str. 2457T
guuaucgucugcgcca

SEQ ID NO: 3855857 - RNA, 23 nt, Shigella flexneri 2a str. 2457T
guuaucuaccgcaccuuccggaa

SEQ ID NO: 3855858 - RNA, 13 nt, Shigella flexneri 2a str. 2457T
guuaugaaacucc

SEQ ID NO: 3855859 - RNA, 22 nt, Shigella flexneri 2a str. 2457T
guuaugcaccgacaauccggua

SEQ ID NO: 3855860 - RNA, 14 nt, Shigella flexneri 2a str. 2457T
guuaugugaguuga

SEQ ID NO: 3855861 - RNA, 18 nt, Shigella flexneri 2a str. 2457T
guuauuaaaaagccugcc

SEQ ID NO: 3855862 - RNA, 16 nt, Shigella flexneri 2a str. 2457T
guuauuauucauaaau

SEQ ID NO: 3855863 - RNA, 16 nt, Shigella flexneri 2a str. 2457T
guuauuuccaggagau

SEQ ID NO: 3855864 - RNA, 18 nt, Shigella flexneri 2a str. 2457T
guuauuuguucagcaaau

SEQ ID NO: 3855865 - RNA, 17 nt, Shigella flexneri 2a str. 2457T
guucaaaguaauauuca

SEQ ID NO: 3855866 - RNA, 16 nt, Shigella flexneri 2a str. 2457T
guucaaaguuaccgga

SEQ ID NO: 3855867 - RNA, 23 nt, Shigella flexneri 2a str. 2457T
guucaacaauauuaaucccugcu

SEQ ID NO: 3855868 - RNA, 17 nt, Shigella flexneri 2a str. 2457T
guucaacagauuucgaa

SEQ ID NO: 3855869 - RNA, 12 nt, Shigella flexneri 2a str. 2457T
guucaacaguaa

SEQ ID NO: 3855870 - RNA, 13 nt, Shigella flexneri 2a str. 2457T
guucaagaugucu

SEQ ID NO: 3855871 - RNA, 18 nt, Shigella flexneri 2a str. 2457T
guucaagugcguucaccc

SEQ ID NO: 3855872 - RNA, 16 nt, Shigella flexneri 2a str. 2457T
guucaauaucuuccug

SEQ ID NO: 3855873 - RNA, 16 nt, Shigella flexneri 2a str. 2457T
guucaaugauaguuca

SEQ ID NO: 3855874 - RNA, 19 nt, Shigella flexneri 2a str. 2457T
guucaaugcgaucuacccg

SEQ ID NO: 3855875 - RNA, 20 nt, Shigella flexneri 2a str. 2457T
guucaauuuccaguuucaca

SEQ ID NO: 3855876 - RNA, 14 nt, Shigella flexneri 2a str. 2457T
guucacgcagcuuc

SEQ ID NO: 3855877 - RNA, 18 nt, Shigella flexneri 2a str. 2457T
guucacgccaucaucggc

SEQ ID NO: 3855878 - RNA, 13 nt, Shigella flexneri 2a str. 2457T
guucacugccgua

SEQ ID NO: 3855879 - RNA, 19 nt, Shigella flexneri 2a str. 2457T
guucacugccguacaggca

SEQ ID NO: 3855880 - RNA, 14 nt, Shigella flexneri 2a str. 2457T
guucacugugcugg

SEQ ID NO: 3855881 - RNA, 15 nt, Shigella flexneri 2a str. 2457T
guucacugugcuggu

SEQ ID NO: 3855882 - RNA, 18 nt, Shigella flexneri 2a str. 2457T
guucacuugcuaccgcga

SEQ ID NO: 3855883 - RNA, 19 nt, Shigella flexneri 2a str. 2457T
guucagaaagcgccagcaa

SEQ ID NO: 3855884 - RNA, 21 nt, Shigella flexneri 2a str. 2457T
guucagaaugcccacgccgca

SEQ ID NO: 3855885 - RNA, 14 nt, Shigella flexneri 2a str. 2457T
guucagauaaugcc

SEQ ID NO: 3855886 - RNA, 19 nt, Shigella flexneri 2a str. 2457T
guucagauggccaauaacc

SEQ ID NO: 3855887 - RNA, 16 nt, Shigella flexneri 2a str. 2457T
guucagauuguugauu

SEQ ID NO: 3855888 - RNA, 15 nt, Shigella flexneri 2a str. 2457T
guucagcaucuggaa

SEQ ID NO: 3855889 - RNA, 23 nt, Shigella flexneri 2a str. 2457T
guucagccagugaccuuaaucag

SEQ ID NO: 3855890 - RNA, 17 nt, Shigella flexneri 2a str. 2457T
guucagcgcaacuugca

SEQ ID NO: 3855891 - RNA, 23 nt, Shigella flexneri 2a str. 2457T
guucagcggcccguuggugcggu

SEQ ID NO: 3855892 - RNA, 20 nt, Shigella flexneri 2a str. 2457T
guucagcgucggcgucaucg

SEQ ID NO: 3855893 - RNA, 14 nt, Shigella flexneri 2a str. 2457T
guucaggcgcugca

SEQ ID NO: 3855894 - RNA, 22 nt, Shigella flexneri 2a str. 2457T
guucaggucggugugaaugacu

SEQ ID NO: 3855895 - RNA, 22 nt, Shigella flexneri 2a str. 2457T
guucauauauuccuuacucaua

SEQ ID NO: 3855896 - RNA, 21 nt, Shigella flexneri 2a str. 2457T
guucaucaagcugugccugaa

SEQ ID NO: 3855897 - RNA, 23 nt, Shigella flexneri 2a str. 2457T
guucauccucuucugccugcugg

SEQ ID NO: 3855898 - RNA, 13 nt, Shigella flexneri 2a str. 2457T
guucaucugacca

SEQ ID NO: 3855899 - RNA, 19 nt, Shigella flexneri 2a str. 2457T
guucaugaccgugaucgug

SEQ ID NO: 3855900 - RNA, 16 nt, Shigella flexneri 2a str. 2457T
guucaugguuagccug

SEQ ID NO: 3855901 - RNA, 21 nt, Shigella flexneri 2a str. 2457T
guucauuaaugccguuauaca

SEQ ID NO: 3855902 - RNA, 17 nt, Shigella flexneri 2a str. 2457T
guucauuggguucaucu

SEQ ID NO: 3855903 - RNA, 20 nt, Shigella flexneri 2a str. 2457T
guucauuggguucaucugau

SEQ ID NO: 3855904 - RNA, 19 nt, Shigella flexneri 2a str. 2457T
guuccaccacguuuuucaa

SEQ ID NO: 3855905 - RNA, 12 nt, Shigella flexneri 2a str. 2457T
guuccacccagc

SEQ ID NO: 3855906 - RNA, 12 nt, Shigella flexneri 2a str. 2457T
guugccagcgcc

SEQ ID NO: 3855907 - RNA, 19 nt, Shigella flexneri 2a str. 2457T
guugccaucaucaccagaa

SEQ ID NO: 3855908 - RNA, 22 nt, Shigella flexneri 2a str. 2457T
guugccauuguuggcaggccaa

SEQ ID NO: 3855909 - RNA, 13 nt, Shigella flexneri 2a str. 2457T
guugcccagcgca

SEQ ID NO: 3855910 - RNA, 17 nt, Shigella flexneri 2a str. 2457T
guugcccagcgcaucag

SEQ ID NO: 3855911 - RNA, 17 nt, Shigella flexneri 2a str. 2457T
guugccccucuaacucu

SEQ ID NO: 3855912 - RNA, 12 nt, Shigella flexneri 2a str. 2457T
guugcccugcug

SEQ ID NO: 3855913 - RNA, 16 nt, Shigella flexneri 2a str. 2457T
guugccgcuuuuucca

SEQ ID NO: 3855914 - RNA, 21 nt, Shigella flexneri 2a str. 2457T
guugccuuuuuuguacuccag

SEQ ID NO: 3855915 - RNA, 16 nt, Shigella flexneri 2a str. 2457T
guugcgcaugaccuuu

SEQ ID NO: 3855916 - RNA, 22 nt, Shigella flexneri 2a str. 2457T
guugcgccaguaaauuuaucaa

SEQ ID NO: 3855917 - RNA, 14 nt, Shigella flexneri 2a str. 2457T
guugcgcccaucau

SEQ ID NO: 3855918 - RNA, 11 nt, Shigella flexneri 2a str. 2457T
guugcgcguca

SEQ ID NO: 3855919 - RNA, 20 nt, Shigella flexneri 2a str. 2457T
guugcgcuucccgaaucaug

SEQ ID NO: 3855920 - RNA, 21 nt, Shigella flexneri 2a str. 2457T
guugcggcugcccaucaucgu

SEQ ID NO: 3855921 - RNA, 22 nt, Shigella flexneri 2a str. 2457T
guugcggcuuauucauuacuca

SEQ ID NO: 3855922 - RNA, 12 nt, Shigella flexneri 2a str. 2457T
guugcgguuuca

SEQ ID NO: 3855923 - RNA, 15 nt, Shigella flexneri 2a str. 2457T
guugcgguuucaacu

SEQ ID NO: 3855924 - RNA, 18 nt, Shigella flexneri 2a str. 2457T
guugcguaacugaucgua

SEQ ID NO: 3855925 - RNA, 16 nt, Shigella flexneri 2a str. 2457T
guugcgucgccgccug

SEQ ID NO: 3855926 - RNA, 16 nt, Shigella flexneri 2a str. 2457T
guugcguugaaacguu

SEQ ID NO: 3855927 - RNA, 15 nt, Shigella flexneri 2a str. 2457T
guugcuaacggccac

SEQ ID NO: 3855928 - RNA, 14 nt, Shigella flexneri 2a str. 2457T
guugcuaugcugaa

SEQ ID NO: 3855929 - RNA, 15 nt, Shigella flexneri 2a str. 2457T
guugcugaaauucca

SEQ ID NO: 3855930 - RNA, 13 nt, Shigella flexneri 2a str. 2457T
guugcugacugua

SEQ ID NO: 3855931 - RNA, 19 nt, Shigella flexneri 2a str. 2457T
guugcugagaucaaacucu

SEQ ID NO: 3855932 - RNA, 23 nt, Shigella flexneri 2a str. 2457T
guugcugccgacaaaugcaguuu

SEQ ID NO: 3855933 - RNA, 21 nt, Shigella flexneri 2a str. 2457T
guugcuggcagauaaauuacu

SEQ ID NO: 3855934 - RNA, 14 nt, Shigella flexneri 2a str. 2457T
guugcugucgacaa

SEQ ID NO: 3855935 - RNA, 12 nt, Shigella flexneri 2a str. 2457T
guugcuucaucu

SEQ ID NO: 3855936 - RNA, 18 nt, Shigella flexneri 2a str. 2457T
guuggaaaucccgugacg

SEQ ID NO: 3855937 - RNA, 22 nt, Shigella flexneri 2a str. 2457T
guuggcgcauaacucaccauca

SEQ ID NO: 3855938 - RNA, 20 nt, Shigella flexneri 2a str. 2457T
guuggcgcguguuccagaga

SEQ ID NO: 3855939 - RNA, 19 nt, Shigella flexneri 2a str. 2457T
guuggcggugccaucgaua

SEQ ID NO: 3855940 - RNA, 21 nt, Shigella flexneri 2a str. 2457T
guuggcggugccaucgauaau

SEQ ID NO: 3855941 - RNA, 17 nt, Shigella flexneri 2a str. 2457T
guuggcguguuucagcu

SEQ ID NO: 3855942 - RNA, 15 nt, Shigella flexneri 2a str. 2457T
guuggcucaucaagc

SEQ ID NO: 3855943 - RNA, 14 nt, Shigella flexneri 2a str. 2457T
guuggguuagccaa

SEQ ID NO: 3855944 - RNA, 17 nt, Shigella flexneri 2a str. 2457T
guuggguucacuuuccc

SEQ ID NO: 3855945 - RNA, 15 nt, Shigella flexneri 2a str. 2457T
guugguacuguggca

SEQ ID NO: 3855946 - RNA, 17 nt, Shigella flexneri 2a str. 2457T
guuggucucaagcaagu

SEQ ID NO: 3855947 - RNA, 12 nt, Shigella flexneri 2a str. 2457T
guugguuaaucu

SEQ ID NO: 3855948 - RNA, 22 nt, Shigella flexneri 2a str. 2457T
guugguucagugggcgcugcug

SEQ ID NO: 3855949 - RNA, 18 nt, Shigella flexneri 2a str. 2457T
guuguaaucauauuaaau

SEQ ID NO: 3855950 - RNA, 16 nt, Shigella flexneri 2a str. 2457T
guuguaugcguuucac

SEQ ID NO: 3855951 - RNA, 20 nt, Shigella flexneri 2a str. 2457T
guugucaauacuuucacaaa

SEQ ID NO: 3855952 - RNA, 17 nt, Shigella flexneri 2a str. 2457T
guugucacugcaucuuc

SEQ ID NO: 3855953 - RNA, 23 nt, Shigella flexneri 2a str. 2457T
guugucaggaagccccagcuuuu

SEQ ID NO: 3855954 - RNA, 18 nt, Shigella flexneri 2a str. 2457T
guugucaguucuuuuauu

SEQ ID NO: 3855955 - RNA, 18 nt, Shigella flexneri 2a str. 2457T
guugucaucggucagauc

SEQ ID NO: 3855956 - RNA, 15 nt, Shigella flexneri 2a str. 2457T
guugucauuacaaca

SEQ ID NO: 3855957 - RNA, 17 nt, Shigella flexneri 2a str. 2457T
guugucauuacaacaag

SEQ ID NO: 3855958 - RNA, 16 nt, Shigella flexneri 2a str. 2457T
guuguccucgccguuu

SEQ ID NO: 3855959 - RNA, 23 nt, Shigella flexneri 2a str. 2457T
guuguccuuaccacagacaaaau

SEQ ID NO: 3855960 - RNA, 12 nt, Shigella flexneri 2a str. 2457T
guugucgauaaa

SEQ ID NO: 3855961 - RNA, 22 nt, Shigella flexneri 2a str. 2457T
guugucgguaauugcgccguug

SEQ ID NO: 3855962 - RNA, 14 nt, Shigella flexneri 2a str. 2457T
guugucucagauuc

SEQ ID NO: 3855963 - RNA, 17 nt, Shigella flexneri 2a str. 2457T
guugucuuuccagacuc

SEQ ID NO: 3855964 - RNA, 11 nt, Shigella flexneri 2a str. 2457T
guugugccaga

SEQ ID NO: 3855965 - RNA, 22 nt, Shigella flexneri 2a str. 2457T
guugugccagaccaaacagcau

SEQ ID NO: 3855966 - RNA, 19 nt, Shigella flexneri 2a str. 2457T
guugugcuaacucaucacc

SEQ ID NO: 3855967 - RNA, 16 nt, Shigella flexneri 2a str. 2457T
guuguuaaccaccagu

SEQ ID NO: 3855968 - RNA, 20 nt, Shigella flexneri 2a str. 2457T
guuguuaaccaccaguaaau

SEQ ID NO: 3855969 - RNA, 21 nt, Shigella flexneri 2a str. 2457T
guuguucugcgacgcgcggug

SEQ ID NO: 3855970 - RNA, 20 nt, Shigella flexneri 2a str. 2457T
guuguugaacggcaaacgca

SEQ ID NO: 3855971 - RNA, 17 nt, Shigella flexneri 2a str. 2457T
guuguugauaagcccca

SEQ ID NO: 3855972 - RNA, 12 nt, Shigella flexneri 2a str. 2457T
guuguugcugcc

SEQ ID NO: 3855973 - RNA, 17 nt, Shigella flexneri 2a str. 2457T
guuguuuacaguaugag

SEQ ID NO: 3855974 - RNA, 15 nt, Shigella flexneri 2a str. 2457T
guuguuuucagaagc

SEQ ID NO: 3855975 - RNA, 14 nt, Shigella flexneri 2a str. 2457T
guuuaaccaacaca

SEQ ID NO: 3855976 - RNA, 22 nt, Shigella flexneri 2a str. 2457T
guuuaacuaccguguucagcgu

SEQ ID NO: 3855977 - RNA, 14 nt, Shigella flexneri 2a str. 2457T
guuuaaggaaaaac

SEQ ID NO: 3855978 - RNA, 20 nt, Shigella flexneri 2a str. 2457T
guuuaauaugcaauucacac

SEQ ID NO: 3855979 - RNA, 13 nt, Shigella flexneri 2a str. 2457T
guuuacaaccuga

SEQ ID NO: 3855980 - RNA, 12 nt, Shigella flexneri 2a str. 2457T
guuuaccagcag

SEQ ID NO: 3855981 - RNA, 14 nt, Shigella flexneri 2a str. 2457T
guuuaccagcagcc

SEQ ID NO: 3855982 - RNA, 23 nt, Shigella flexneri 2a str. 2457T
guuuaccagcagcccugccggaa

SEQ ID NO: 3855983 - RNA, 18 nt, Shigella flexneri 2a str. 2457T
guuuaccccgucaccacu

SEQ ID NO: 3855984 - RNA, 14 nt, Shigella flexneri 2a str. 2457T
guuuaccggugcca

SEQ ID NO: 3855985 - RNA, 15 nt, Shigella flexneri 2a str. 2457T
guuuacgcagcucac

SEQ ID NO: 3855986 - RNA, 14 nt, Shigella flexneri 2a str. 2457T
guuuacgccaggca

SEQ ID NO: 3855987 - RNA, 22 nt, Shigella flexneri 2a str. 2457T
guuuacgcguuuuucagaacuu

SEQ ID NO: 3855988 - RNA, 21 nt, Shigella flexneri 2a str. 2457T
guuuacugucugcuucugccu

SEQ ID NO: 3855989 - RNA, 23 nt, Shigella flexneri 2a str. 2457T
guuuacuucgcuuuacccugguu

SEQ ID NO: 3855990 - RNA, 19 nt, Shigella flexneri 2a str. 2457T
guuuagccgcuucugcagc

SEQ ID NO: 3855991 - RNA, 23 nt, Shigella flexneri 2a str. 2457T
guuuagcgcggcaauuagcggcu

SEQ ID NO: 3855992 - RNA, 16 nt, Shigella flexneri 2a str. 2457T
guuuauaacggugcug

SEQ ID NO: 3855993 - RNA, 20 nt, Shigella flexneri 2a str. 2457T
guuuauaacggugcugcaca

SEQ ID NO: 3855994 - RNA, 14 nt, Shigella flexneri 2a str. 2457T
guuuaucaggccac

SEQ ID NO: 3855995 - RNA, 21 nt, Shigella flexneri 2a str. 2457T
guuuauccauccccagagcac

SEQ ID NO: 3855996 - RNA, 13 nt, Shigella flexneri 2a str. 2457T
guuuaugccuggu

SEQ ID NO: 3855997 - RNA, 14 nt, Shigella flexneri 2a str. 2457T
guuuauuauagaca

SEQ ID NO: 3855998 - RNA, 15 nt, Shigella flexneri 2a str. 2457T
guuuauuaugccaca

SEQ ID NO: 3855999 - RNA, 15 nt, Shigella flexneri 2a str. 2457T
guuuauuucccagau

SEQ ID NO: 3856000 - RNA, 16 nt, Shigella flexneri 2a str. 2457T
guuuauuugacagccc

SEQ ID NO: 3856001 - RNA, 20 nt, Shigella flexneri 2a str. 2457T
guuucaacaucaucucccac

SEQ ID NO: 3856002 - RNA, 23 nt, Shigella flexneri 2a str. 2457T
guuucaacgacccagccagacgc

SEQ ID NO: 3856003 - RNA, 18 nt, Shigella flexneri 2a str. 2457T
guuucaauauccgguuca

SEQ ID NO: 3856004 - RNA, 19 nt, Shigella flexneri 2a str. 2457T
guuuuggugaagugagaau

SEQ ID NO: 3856005 - RNA, 13 nt, Shigella flexneri 2a str. 2457T
guuuuuacagauu

SEQ ID NO: 3856006 - RNA, 16 nt, Shigella flexneri 2a str. 2457T
guuuuuacgaaacaga

SEQ ID NO: 3856007 - RNA, 22 nt, Shigella flexneri 2a str. 2457T
guuuuucaguagacucaagcag

SEQ ID NO: 3856008 - RNA, 19 nt, Shigella flexneri 2a str. 2457T
guuuuucaguccacgguug

SEQ ID NO: 3856009 - RNA, 22 nt, Shigella flexneri 2a str. 2457T
guuuuucaucgcuaauaauaag

SEQ ID NO: 3856010 - RNA, 16 nt, Shigella flexneri 2a str. 2457T
guuuuugcuguuguuc

SEQ ID NO: 3856011 - RNA, 15 nt, Shigella flexneri 2a str. 2457T
guuuuuguugauaaa

SEQ ID NO: 3856012 - RNA, 12 nt, Shigella flexneri 2a str. 2457T
guuuuuuauucc

SEQ ID NO: 3856013 - RNA, 22 nt, Shigella flexneri 2a str. 2457T
guuuuuucugccucugccagac

SEQ ID NO: 3856014 - RNA, 20 nt, Shigella flexneri 2a str. 2457T
guuuuuuuauaucucagaua

SEQ ID NO: 3856015 - RNA, 20 nt, Shigella flexneri 2a str. 2457T
uaaaaaaacaucauaauaau

SEQ ID NO: 3856016 - RNA, 11 nt, Shigella flexneri 2a str. 2457T
uaaaaaaagaa

SEQ ID NO: 3856017 - RNA, 13 nt, Shigella flexneri 2a str. 2457T
uaaaaaaagaaac

SEQ ID NO: 3856018 - RNA, 18 nt, Shigella flexneri 2a str. 2457T
uaaaaaaagcauuuaaua

SEQ ID NO: 3856019 - RNA, 21 nt, Shigella flexneri 2a str. 2457T
uaaaaaagaaggaaaauacag

SEQ ID NO: 3856020 - RNA, 22 nt, Shigella flexneri 2a str. 2457T
uaaaaaaguaaugccugcacuu

SEQ ID NO: 3856021 - RNA, 15 nt, Shigella flexneri 2a str. 2457T
uaaaaacagcaucaa

SEQ ID NO: 3856022 - RNA, 21 nt, Shigella flexneri 2a str. 2457T
uaaaaaccagagaauauuaac

SEQ ID NO: 3856023 - RNA, 13 nt, Shigella flexneri 2a str. 2457T
uaaaaagaaaaaa

SEQ ID NO: 3856024 - RNA, 15 nt, Shigella flexneri 2a str. 2457T
uaaaaagccuaacaa

SEQ ID NO: 3856025 - RNA, 19 nt, Shigella flexneri 2a str. 2457T
uaaaaaguaagaauugaua

SEQ ID NO: 3856026 - RNA, 21 nt, Shigella flexneri 2a str. 2457T
uaaaaaguuauaaauaaaaag

SEQ ID NO: 3856027 - RNA, 22 nt, Shigella flexneri 2a str. 2457T
uaaaaauacauacgcaaaaaac

SEQ ID NO: 3856028 - RNA, 15 nt, Shigella flexneri 2a str. 2457T
uaaaaauccgccaga

SEQ ID NO: 3856029 - RNA, 17 nt, Shigella flexneri 2a str. 2457T
uaaaaauccuguuccau

SEQ ID NO: 3856030 - RNA, 22 nt, Shigella flexneri 2a str. 2457T
uaaaaauugaaucacgacaaac

SEQ ID NO: 3856031 - RNA, 19 nt, Shigella flexneri 2a str. 2457T
uaaaacaacggaacgaaaa

SEQ ID NO: 3856032 - RNA, 21 nt, Shigella flexneri 2a str. 2457T
uaaaacaacggaacgaaaaaa

SEQ ID NO: 3856033 - RNA, 22 nt, Shigella flexneri 2a str. 2457T
uaaaacaacggaacgaaaaaaa

SEQ ID NO: 3856034 - RNA, 21 nt, Shigella flexneri 2a str. 2457T
uaaaacagacgagggaaaaua

SEQ ID NO: 3856035 - RNA, 22 nt, Shigella flexneri 2a str. 2457T
uaaaacagcacuccugccacca

SEQ ID NO: 3856036 - RNA, 16 nt, Shigella flexneri 2a str. 2457T
uaaaacagccagcgcu

SEQ ID NO: 3856037 - RNA, 16 nt, Shigella flexneri 2a str. 2457T
uaaaaccaucguacag

SEQ ID NO: 3856038 - RNA, 15 nt, Shigella flexneri 2a str. 2457T
uaaaaccgacuuaaa

SEQ ID NO: 3856039 - RNA, 18 nt, Shigella flexneri 2a str. 2457T
uaaaacgcagucuuccca

SEQ ID NO: 3856040 - RNA, 22 nt, Shigella flexneri 2a str. 2457T
uaaaacgcgcccucagcccaca

SEQ ID NO: 3856041 - RNA, 23 nt, Shigella flexneri 2a str. 2457T
uaaaacgcgcuacugaaucccug

SEQ ID NO: 3856042 - RNA, 20 nt, Shigella flexneri 2a str. 2457T
uaaaacgguuuauccccaag

SEQ ID NO: 3856043 - RNA, 17 nt, Shigella flexneri 2a str. 2457T
uaaaacgugccauuaau

SEQ ID NO: 3856044 - RNA, 16 nt, Shigella flexneri 2a str. 2457T
uaaaacuaaaaacagc

SEQ ID NO: 3856045 - RNA, 18 nt, Shigella flexneri 2a str. 2457T
uaaaacuaacgccaggaa

SEQ ID NO: 3856046 - RNA, 16 nt, Shigella flexneri 2a str. 2457T
uaaaacuuuauucagu

SEQ ID NO: 3856047 - RNA, 12 nt, Shigella flexneri 2a str. 2457T
uaaaacuuucca

SEQ ID NO: 3856048 - RNA, 19 nt, Shigella flexneri 2a str. 2457T
uaaaacuuuuagcaucuua

SEQ ID NO: 3856049 - RNA, 12 nt, Shigella flexneri 2a str. 2457T
uaaaagaaaaaa

SEQ ID NO: 3856050 - RNA, 21 nt, Shigella flexneri 2a str. 2457T
uaaaagcauagccccagcgca

SEQ ID NO: 3856051 - RNA, 13 nt, Shigella flexneri 2a str. 2457T
uaaaagccaggag

SEQ ID NO: 3856052 - RNA, 14 nt, Shigella flexneri 2a str. 2457T
uaaaagccccuucg

SEQ ID NO: 3856053 - RNA, 22 nt, Shigella flexneri 2a str. 2457T
uaaaagcgugaaacaaaucacu

SEQ ID NO: 3856054 - RNA, 18 nt, Shigella flexneri 2a str. 2457T
uaaaaggaaacagcguau

SEQ ID NO: 3856055 - RNA, 20 nt, Shigella flexneri 2a str. 2457T
uaaaaggcgccauuuucaua

SEQ ID NO: 3856056 - RNA, 14 nt, Shigella flexneri 2a str. 2457T
uaaaauaucacucg

SEQ ID NO: 3856057 - RNA, 12 nt, Shigella flexneri 2a str. 2457T
uaaaauaucuuc

SEQ ID NO: 3856058 - RNA, 15 nt, Shigella flexneri 2a str. 2457T
uaaaauaucuuccac

SEQ ID NO: 3856059 - RNA, 12 nt, Shigella flexneri 2a str. 2457T
uaaaaucacagg

SEQ ID NO: 3856060 - RNA, 21 nt, Shigella flexneri 2a str. 2457T
uaaaaucaucacgcgguuacg

SEQ ID NO: 3856061 - RNA, 23 nt, Shigella flexneri 2a str. 2457T
uaaaaucuauuauuauuuuugug

SEQ ID NO: 3856062 - RNA, 18 nt, Shigella flexneri 2a str. 2457T
uaaaaugauuucgcaacg

SEQ ID NO: 3856063 - RNA, 14 nt, Shigella flexneri 2a str. 2457T
uaaaaugcgaaaaa

SEQ ID NO: 3856064 - RNA, 23 nt, Shigella flexneri 2a str. 2457T
uaaaauggaaauuguuuuugauu

SEQ ID NO: 3856065 - RNA, 19 nt, Shigella flexneri 2a str. 2457T
uaaaauggccgauaccauc

SEQ ID NO: 3856066 - RNA, 13 nt, Shigella flexneri 2a str. 2457T
uaaaauggccgua

SEQ ID NO: 3856067 - RNA, 13 nt, Shigella flexneri 2a str. 2457T
uaaaauguacaug

SEQ ID NO: 3856068 - RNA, 14 nt, Shigella flexneri 2a str. 2457T
uaaaauguacaugu

SEQ ID NO: 3856069 - RNA, 19 nt, Shigella flexneri 2a str. 2457T
uaaaauucaucaaauggca

SEQ ID NO: 3856070 - RNA, 16 nt, Shigella flexneri 2a str. 2457T
uaaaauucuacagaaa

SEQ ID NO: 3856071 - RNA, 20 nt, Shigella flexneri 2a str. 2457T
uaaaauucuacagaaaugaa

SEQ ID NO: 3856072 - RNA, 22 nt, Shigella flexneri 2a str. 2457T
uaaaauuggcuucguuauugaa

SEQ ID NO: 3856073 - RNA, 20 nt, Shigella flexneri 2a str. 2457T
uaaacaaagcgcacuuuacu

SEQ ID NO: 3856074 - RNA, 23 nt, Shigella flexneri 2a str. 2457T
uaaacaaagugcacuuugucaau

SEQ ID NO: 3856075 - RNA, 20 nt, Shigella flexneri 2a str. 2457T
uaaacaauguuauccggcua

SEQ ID NO: 3856076 - RNA, 12 nt, Shigella flexneri 2a str. 2457T
uaaacaccagca

SEQ ID NO: 3856077 - RNA, 12 nt, Shigella flexneri 2a str. 2457T
uaaacaccuuca

SEQ ID NO: 3856078 - RNA, 19 nt, Shigella flexneri 2a str. 2457T
uaaacaccuucauccagca

SEQ ID NO: 3856079 - RNA, 19 nt, Shigella flexneri 2a str. 2457T
uaaacaggaucugguauua

SEQ ID NO: 3856080 - RNA, 18 nt, Shigella flexneri 2a str. 2457T
uaaacaggaugacacuga

SEQ ID NO: 3856081 - RNA, 16 nt, Shigella flexneri 2a str. 2457T
uaaacaguuucgccag

SEQ ID NO: 3856082 - RNA, 15 nt, Shigella flexneri 2a str. 2457T
uaaacaguuuucgca

SEQ ID NO: 3856083 - RNA, 21 nt, Shigella flexneri 2a str. 2457T
uaaacaucgggacaugauaug

SEQ ID NO: 3856084 - RNA, 17 nt, Shigella flexneri 2a str. 2457T
uaaaccaacaaaacuca

SEQ ID NO: 3856085 - RNA, 19 nt, Shigella flexneri 2a str. 2457T
uaaaccaaucaccgccacu

SEQ ID NO: 3856086 - RNA, 14 nt, Shigella flexneri 2a str. 2457T
uaaaccacagaccg

SEQ ID NO: 3856087 - RNA, 23 nt, Shigella flexneri 2a str. 2457T
uaaaccacugacacaggcagcaa

SEQ ID NO: 3856088 - RNA, 19 nt, Shigella flexneri 2a str. 2457T
uaaaccaggcgagaucggc

SEQ ID NO: 3856089 - RNA, 20 nt, Shigella flexneri 2a str. 2457T
uaaaccccuuaucuggccua

SEQ ID NO: 3856090 - RNA, 18 nt, Shigella flexneri 2a str. 2457T
uaaacccuaacaucaucc

SEQ ID NO: 3856091 - RNA, 16 nt, Shigella flexneri 2a str. 2457T
uaaacccuggccgcac

SEQ ID NO: 3856092 - RNA, 17 nt, Shigella flexneri 2a str. 2457T
uaaaccgcucgucacau

SEQ ID NO: 3856093 - RNA, 16 nt, Shigella flexneri 2a str. 2457T
uaaaccgucagcacca

SEQ ID NO: 3856094 - RNA, 18 nt, Shigella flexneri 2a str. 2457T
uaaaccuaaaaagaaaau

SEQ ID NO: 3856095 - RNA, 18 nt, Shigella flexneri 2a str. 2457T
uaaaccuccagcaucaga

SEQ ID NO: 3856096 - RNA, 23 nt, Shigella flexneri 2a str. 2457T
uaaacgaaaugcgcuuaaucaau

SEQ ID NO: 3856097 - RNA, 22 nt, Shigella flexneri 2a str. 2457T
uaaacgcagagacaucaccaau

SEQ ID NO: 3856098 - RNA, 13 nt, Shigella flexneri 2a str. 2457T
uaaacgcauacau

SEQ ID NO: 3856099 - RNA, 12 nt, Shigella flexneri 2a str. 2457T
uaaacgccaggu

SEQ ID NO: 3856100 - RNA, 19 nt, Shigella flexneri 2a str. 2457T
uaaacgccggaugacacau

SEQ ID NO: 3856101 - RNA, 15 nt, Shigella flexneri 2a str. 2457T
uaaauuccuaaaguu

SEQ ID NO: 3856102 - RNA, 15 nt, Shigella flexneri 2a str. 2457T
uaaauucuucugaau

SEQ ID NO: 3856103 - RNA, 17 nt, Shigella flexneri 2a str. 2457T
uaaauugagcugcgcga

SEQ ID NO: 3856104 - RNA, 21 nt, Shigella flexneri 2a str. 2457T
uaaauugcaaaccucaggaau

SEQ ID NO: 3856105 - RNA, 22 nt, Shigella flexneri 2a str. 2457T
uaaauugcaggacuuauucauu

SEQ ID NO: 3856106 - RNA, 14 nt, Shigella flexneri 2a str. 2457T
uaaauuuaauaaua

SEQ ID NO: 3856107 - RNA, 23 nt, Shigella flexneri 2a str. 2457T
uaaauuuacguucuuacauuccg

SEQ ID NO: 3856108 - RNA, 20 nt, Shigella flexneri 2a str. 2457T
uaaauuuauagucaucggua

SEQ ID NO: 3856109 - RNA, 21 nt, Shigella flexneri 2a str. 2457T
uaaauuucacugcuuaauauu

SEQ ID NO: 3856110 - RNA, 19 nt, Shigella flexneri 2a str. 2457T
uaaauuugccaucucugca

SEQ ID NO: 3856111 - RNA, 17 nt, Shigella flexneri 2a str. 2457T
uaaauuugcuuuucaua

SEQ ID NO: 3856112 - RNA, 19 nt, Shigella flexneri 2a str. 2457T
uaaauuugcuuuucauaca

SEQ ID NO: 3856113 - RNA, 15 nt, Shigella flexneri 2a str. 2457T
uaaauuuuauucaua

SEQ ID NO: 3856114 - RNA, 20 nt, Shigella flexneri 2a str. 2457T
uaaauuuucccgucaaagag

SEQ ID NO: 3856115 - RNA, 15 nt, Shigella flexneri 2a str. 2457T
uaacaaagccugcac

SEQ ID NO: 3856116 - RNA, 20 nt, Shigella flexneri 2a str. 2457T
uaacaaaugcgcuuuauuca

SEQ ID NO: 3856117 - RNA, 15 nt, Shigella flexneri 2a str. 2457T
uaacaaccaggccag

SEQ ID NO: 3856118 - RNA, 16 nt, Shigella flexneri 2a str. 2457T
uaacaacgggcuaaac

SEQ ID NO: 3856119 - RNA, 22 nt, Shigella flexneri 2a str. 2457T
uaacaacgugugcuuuguucau

SEQ ID NO: 3856120 - RNA, 16 nt, Shigella flexneri 2a str. 2457T
uaacaauacgcccacg

SEQ ID NO: 3856121 - RNA, 23 nt, Shigella flexneri 2a str. 2457T
uaacaauagcgaacagacaaaaa

SEQ ID NO: 3856122 - RNA, 20 nt, Shigella flexneri 2a str. 2457T
uaacaauccgauaaucccuu

SEQ ID NO: 3856123 - RNA, 20 nt, Shigella flexneri 2a str. 2457T
uaacaauguugucgccagua

SEQ ID NO: 3856124 - RNA, 20 nt, Shigella flexneri 2a str. 2457T
uaacaauucccgauagucuu

SEQ ID NO: 3856125 - RNA, 18 nt, Shigella flexneri 2a str. 2457T
uaacaauuuaucagacaa

SEQ ID NO: 3856126 - RNA, 19 nt, Shigella flexneri 2a str. 2457T
uaacacagaggcagcaucu

SEQ ID NO: 3856127 - RNA, 12 nt, Shigella flexneri 2a str. 2457T
uaacacaugcaa

SEQ ID NO: 3856128 - RNA, 20 nt, Shigella flexneri 2a str. 2457T
uaacaccagccagaauuacc

SEQ ID NO: 3856129 - RNA, 13 nt, Shigella flexneri 2a str. 2457T
uaacaccaucagu

SEQ ID NO: 3856130 - RNA, 15 nt, Shigella flexneri 2a str. 2457T
uaacaccaucauauu

SEQ ID NO: 3856131 - RNA, 13 nt, Shigella flexneri 2a str. 2457T
uaacaccauccau

SEQ ID NO: 3856132 - RNA, 15 nt, Shigella flexneri 2a str. 2457T
uaacaccgauuuugu

SEQ ID NO: 3856133 - RNA, 19 nt, Shigella flexneri 2a str. 2457T
uaacacgcucuggcaggcu

SEQ ID NO: 3856134 - RNA, 13 nt, Shigella flexneri 2a str. 2457T
uaacacugauaac

SEQ ID NO: 3856135 - RNA, 18 nt, Shigella flexneri 2a str. 2457T
uaacacuucaucacuacc

SEQ ID NO: 3856136 - RNA, 21 nt, Shigella flexneri 2a str. 2457T
uaacacuuguuaugagauaau

SEQ ID NO: 3856137 - RNA, 17 nt, Shigella flexneri 2a str. 2457T
uaacagaaugcgggcga

SEQ ID NO: 3856138 - RNA, 23 nt, Shigella flexneri 2a str. 2457T
uaacagaaugcgggcgaaaacau

SEQ ID NO: 3856139 - RNA, 21 nt, Shigella flexneri 2a str. 2457T
uaacagcaacauaggcugcua

SEQ ID NO: 3856140 - RNA, 21 nt, Shigella flexneri 2a str. 2457T
uaacagcaaucccaaaauaau

SEQ ID NO: 3856141 - RNA, 11 nt, Shigella flexneri 2a str. 2457T
uaacagcagca

SEQ ID NO: 3856142 - RNA, 16 nt, Shigella flexneri 2a str. 2457T
uaacagcgaaaucgcc

SEQ ID NO: 3856143 - RNA, 18 nt, Shigella flexneri 2a str. 2457T
uaacagcgaaaucgccuu

SEQ ID NO: 3856144 - RNA, 21 nt, Shigella flexneri 2a str. 2457T
uaacagcguccacagccaaca

SEQ ID NO: 3856145 - RNA, 23 nt, Shigella flexneri 2a str. 2457T
uaacagggaaugugaugaaaaaa

SEQ ID NO: 3856146 - RNA, 21 nt, Shigella flexneri 2a str. 2457T
uaacagguuuugauuauucaa

SEQ ID NO: 3856147 - RNA, 14 nt, Shigella flexneri 2a str. 2457T
uaacagugccgcac

SEQ ID NO: 3856148 - RNA, 17 nt, Shigella flexneri 2a str. 2457T
uaacaguuguccaaacg

SEQ ID NO: 3856149 - RNA, 20 nt, Shigella flexneri 2a str. 2457T
uaacauccagaucacgcagc

SEQ ID NO: 3856150 - RNA, 19 nt, Shigella flexneri 2a str. 2457T
uaacaucgccagaaaucag

SEQ ID NO: 3856151 - RNA, 20 nt, Shigella flexneri 2a str. 2457T
uaacaucgccagaaaucagc

SEQ ID NO: 3856152 - RNA, 13 nt, Shigella flexneri 2a str. 2457T
uaacauggcggua

SEQ ID NO: 3856153 - RNA, 14 nt, Shigella flexneri 2a str. 2457T
uaacauuaggcauu

SEQ ID NO: 3856154 - RNA, 18 nt, Shigella flexneri 2a str. 2457T
uaacauuuuucucggcaa

SEQ ID NO: 3856155 - RNA, 18 nt, Shigella flexneri 2a str. 2457T
uaaccaaaagcugggaug

SEQ ID NO: 3856156 - RNA, 17 nt, Shigella flexneri 2a str. 2457T
uaaccaaauaaaauaag

SEQ ID NO: 3856157 - RNA, 17 nt, Shigella flexneri 2a str. 2457T
uaaccaacaauaaaauu

SEQ ID NO: 3856158 - RNA, 22 nt, Shigella flexneri 2a str. 2457T
uaaccaacaauugucgccacaa

SEQ ID NO: 3856159 - RNA, 12 nt, Shigella flexneri 2a str. 2457T
uaaccaaucacg

SEQ ID NO: 3856160 - RNA, 16 nt, Shigella flexneri 2a str. 2457T
uaaccaccaguaaauu

SEQ ID NO: 3856161 - RNA, 18 nt, Shigella flexneri 2a str. 2457T
uaaccaccaguaaauugu

SEQ ID NO: 3856162 - RNA, 20 nt, Shigella flexneri 2a str. 2457T
uaaccaccuccacgcccagc

SEQ ID NO: 3856163 - RNA, 16 nt, Shigella flexneri 2a str. 2457T
uaaccacgcucagcaa

SEQ ID NO: 3856164 - RNA, 12 nt, Shigella flexneri 2a str. 2457T
uaaccacuucag

SEQ ID NO: 3856165 - RNA, 20 nt, Shigella flexneri 2a str. 2457T
uaaccagagagcuuauccag

SEQ ID NO: 3856166 - RNA, 21 nt, Shigella flexneri 2a str. 2457T
uaaccagaugucgcgcacugg

SEQ ID NO: 3856167 - RNA, 22 nt, Shigella flexneri 2a str. 2457T
uaaccagcacguugaacugacu

SEQ ID NO: 3856168 - RNA, 14 nt, Shigella flexneri 2a str. 2457T
uaaccagccaaaua

SEQ ID NO: 3856169 - RNA, 15 nt, Shigella flexneri 2a str. 2457T
uaaccagcgcagaca

SEQ ID NO: 3856170 - RNA, 16 nt, Shigella flexneri 2a str. 2457T
uaaccaguccauuacc

SEQ ID NO: 3856171 - RNA, 21 nt, Shigella flexneri 2a str. 2457T
uaaccauauaugauaauuauu

SEQ ID NO: 3856172 - RNA, 12 nt, Shigella flexneri 2a str. 2457T
uaaccaucagcu

SEQ ID NO: 3856173 - RNA, 12 nt, Shigella flexneri 2a str. 2457T
uaaccaucccuu

SEQ ID NO: 3856174 - RNA, 15 nt, Shigella flexneri 2a str. 2457T
uaaccaucgcacagc

SEQ ID NO: 3856175 - RNA, 18 nt, Shigella flexneri 2a str. 2457T
uaaccaugacgccgaauc

SEQ ID NO: 3856176 - RNA, 13 nt, Shigella flexneri 2a str. 2457T
uaacccagcgaug

SEQ ID NO: 3856177 - RNA, 18 nt, Shigella flexneri 2a str. 2457T
uaacccauuuuguuuuau

SEQ ID NO: 3856178 - RNA, 13 nt, Shigella flexneri 2a str. 2457T
uaaccccagacca

SEQ ID NO: 3856179 - RNA, 15 nt, Shigella flexneri 2a str. 2457T
uaacccgcaacagca

SEQ ID NO: 3856180 - RNA, 21 nt, Shigella flexneri 2a str. 2457T
uaacccgcagcuuaaugaacu

SEQ ID NO: 3856181 - RNA, 23 nt, Shigella flexneri 2a str. 2457T
uaacccgugggacaaagacaauu

SEQ ID NO: 3856182 - RNA, 13 nt, Shigella flexneri 2a str. 2457T
uaacccuuccaga

SEQ ID NO: 3856183 - RNA, 22 nt, Shigella flexneri 2a str. 2457T
uaaccgccaguaaucuggccaa

SEQ ID NO: 3856184 - RNA, 16 nt, Shigella flexneri 2a str. 2457T
uaaccgcugcaaaaaa

SEQ ID NO: 3856185 - RNA, 17 nt, Shigella flexneri 2a str. 2457T
uaaccgcugcaaaaaau

SEQ ID NO: 3856186 - RNA, 14 nt, Shigella flexneri 2a str. 2457T
uaaccguccaguug

SEQ ID NO: 3856187 - RNA, 16 nt, Shigella flexneri 2a str. 2457T
uaaccguccaguugug

SEQ ID NO: 3856188 - RNA, 13 nt, Shigella flexneri 2a str. 2457T
uaaccguuuugug

SEQ ID NO: 3856189 - RNA, 22 nt, Shigella flexneri 2a str. 2457T
uaaccugaaaccggaaagcuuc

SEQ ID NO: 3856190 - RNA, 21 nt, Shigella flexneri 2a str. 2457T
uaaccugagagugauuaacug

SEQ ID NO: 3856191 - RNA, 14 nt, Shigella flexneri 2a str. 2457T
uaaccuucaccgug

SEQ ID NO: 3856192 - RNA, 20 nt, Shigella flexneri 2a str. 2457T
uaaccuugcaauaguuucag

SEQ ID NO: 3856193 - RNA, 22 nt, Shigella flexneri 2a str. 2457T
uaaccuuuaucgcgcagcagau

SEQ ID NO: 3856194 - RNA, 20 nt, Shigella flexneri 2a str. 2457T
uaaccuuugcgguuaaaaau

SEQ ID NO: 3856195 - RNA, 18 nt, Shigella flexneri 2a str. 2457T
uaacgaacucuuugccca

SEQ ID NO: 3856196 - RNA, 13 nt, Shigella flexneri 2a str. 2457T
uaacgaccaccac

SEQ ID NO: 3856197 - RNA, 23 nt, Shigella flexneri 2a str. 2457T
uaacgaccaccaccgcaguaauc

SEQ ID NO: 3856198 - RNA, 13 nt, Shigella flexneri 2a str. 2457T
uaagcccaguuca

SEQ ID NO: 3856199 - RNA, 21 nt, Shigella flexneri 2a str. 2457T
uaagccgccacgaccugcaga

SEQ ID NO: 3856200 - RNA, 13 nt, Shigella flexneri 2a str. 2457T
uaagccgucccua

SEQ ID NO: 3856201 - RNA, 17 nt, Shigella flexneri 2a str. 2457T
uaagccuguuuagccgc

SEQ ID NO: 3856202 - RNA, 13 nt, Shigella flexneri 2a str. 2457T
uaagcgacauccu

SEQ ID NO: 3856203 - RNA, 20 nt, Shigella flexneri 2a str. 2457T
uaagcgauaaaaauaccgag

SEQ ID NO: 3856204 - RNA, 14 nt, Shigella flexneri 2a str. 2457T
uaagcgcaaaggcc

SEQ ID NO: 3856205 - RNA, 15 nt, Shigella flexneri 2a str. 2457T
uaagcgcagcgcauc

SEQ ID NO: 3856206 - RNA, 18 nt, Shigella flexneri 2a str. 2457T
uaagcgccauaucggcau

SEQ ID NO: 3856207 - RNA, 16 nt, Shigella flexneri 2a str. 2457T
uaagcguaagcgcauc

SEQ ID NO: 3856208 - RNA, 16 nt, Shigella flexneri 2a str. 2457T
uaagcguuacgcagca

SEQ ID NO: 3856209 - RNA, 16 nt, Shigella flexneri 2a str. 2457T
uaagcguucauccaac

SEQ ID NO: 3856210 - RNA, 16 nt, Shigella flexneri 2a str. 2457T
uaagcucagaaacgcu

SEQ ID NO: 3856211 - RNA, 17 nt, Shigella flexneri 2a str. 2457T
uaagcuggguaaaugca

SEQ ID NO: 3856212 - RNA, 22 nt, Shigella flexneri 2a str. 2457T
uaagcugucacguuuugugaug

SEQ ID NO: 3856213 - RNA, 18 nt, Shigella flexneri 2a str. 2457T
uaagcugucgaaaagaua

SEQ ID NO: 3856214 - RNA, 15 nt, Shigella flexneri 2a str. 2457T
uaaggaaauucagca

SEQ ID NO: 3856215 - RNA, 22 nt, Shigella flexneri 2a str. 2457T
uaaggaacggggguuuuacuuu

SEQ ID NO: 3856216 - RNA, 13 nt, Shigella flexneri 2a str. 2457T
uaaggauaaaaaa

SEQ ID NO: 3856217 - RNA, 14 nt, Shigella flexneri 2a str. 2457T
uaaggcaagaaaau

SEQ ID NO: 3856218 - RNA, 17 nt, Shigella flexneri 2a str. 2457T
uaaggcauuuacgccgc

SEQ ID NO: 3856219 - RNA, 14 nt, Shigella flexneri 2a str. 2457T
uaaggcgcaauaau

SEQ ID NO: 3856220 - RNA, 20 nt, Shigella flexneri 2a str. 2457T
uaaggcgcaauaaucagugc

SEQ ID NO: 3856221 - RNA, 20 nt, Shigella flexneri 2a str. 2457T
uaaggcgcucgcgccgcauc

SEQ ID NO: 3856222 - RNA, 20 nt, Shigella flexneri 2a str. 2457T
uaaggcguacacgccgcauc

SEQ ID NO: 3856223 - RNA, 20 nt, Shigella flexneri 2a str. 2457T
uaaggcguucacgacgcauc

SEQ ID NO: 3856224 - RNA, 20 nt, Shigella flexneri 2a str. 2457T
uaaggcguucacgccgcauc

SEQ ID NO: 3856225 - RNA, 20 nt, Shigella flexneri 2a str. 2457T
uaaggcguuuacgccgcauc

SEQ ID NO: 3856226 - RNA, 20 nt, Shigella flexneri 2a str. 2457T
uaaggcguuuucgccacauc

SEQ ID NO: 3856227 - RNA, 18 nt, Shigella flexneri 2a str. 2457T
uaaggcugaugaagcaag

SEQ ID NO: 3856228 - RNA, 22 nt, Shigella flexneri 2a str. 2457T
uaaggcuuucgugaagcuggca

SEQ ID NO: 3856229 - RNA, 22 nt, Shigella flexneri 2a str. 2457T
uaagggcuaaucugaauggcug

SEQ ID NO: 3856230 - RNA, 14 nt, Shigella flexneri 2a str. 2457T
uaaggguaaaagga

SEQ ID NO: 3856231 - RNA, 15 nt, Shigella flexneri 2a str. 2457T
uaaggguaaaaggau

SEQ ID NO: 3856232 - RNA, 21 nt, Shigella flexneri 2a str. 2457T
uaagguaucgcgaaaaaaaga

SEQ ID NO: 3856233 - RNA, 23 nt, Shigella flexneri 2a str. 2457T
uaaggucagacgaagucaacaag

SEQ ID NO: 3856234 - RNA, 21 nt, Shigella flexneri 2a str. 2457T
uaagguuaagccucacgguuc

SEQ ID NO: 3856235 - RNA, 13 nt, Shigella flexneri 2a str. 2457T
uaaguaagcaaca

SEQ ID NO: 3856236 - RNA, 12 nt, Shigella flexneri 2a str. 2457T
uaaguaaugaca

SEQ ID NO: 3856237 - RNA, 16 nt, Shigella flexneri 2a str. 2457T
uaaguacauuaaaauu

SEQ ID NO: 3856238 - RNA, 15 nt, Shigella flexneri 2a str. 2457T
uaaguccgaacuaaa

SEQ ID NO: 3856239 - RNA, 13 nt, Shigella flexneri 2a str. 2457T
uaagucugcgcca

SEQ ID NO: 3856240 - RNA, 21 nt, Shigella flexneri 2a str. 2457T
uaagucuggcacgaccgccuu

SEQ ID NO: 3856241 - RNA, 23 nt, Shigella flexneri 2a str. 2457T
uaagugauggcgauuauaugagg

SEQ ID NO: 3856242 - RNA, 15 nt, Shigella flexneri 2a str. 2457T
uaaguguaaaauucu

SEQ ID NO: 3856243 - RNA, 22 nt, Shigella flexneri 2a str. 2457T
uaaguguccgccaauuucauca

SEQ ID NO: 3856244 - RNA, 21 nt, Shigella flexneri 2a str. 2457T
uaaguguuucacuuucaucac

SEQ ID NO: 3856245 - RNA, 22 nt, Shigella flexneri 2a str. 2457T
uaaguguuucacuuucaucacc

SEQ ID NO: 3856246 - RNA, 18 nt, Shigella flexneri 2a str. 2457T
uaaguuacauuuuaauaa

SEQ ID NO: 3856247 - RNA, 21 nt, Shigella flexneri 2a str. 2457T
uaaguuagucgcuuucauuca

SEQ ID NO: 3856248 - RNA, 21 nt, Shigella flexneri 2a str. 2457T
uaaguucaguaugaucuugcc

SEQ ID NO: 3856249 - RNA, 14 nt, Shigella flexneri 2a str. 2457T
uaaguugaaucggc

SEQ ID NO: 3856250 - RNA, 17 nt, Shigella flexneri 2a str. 2457T
uaaguugccacgcuuca

SEQ ID NO: 3856251 - RNA, 14 nt, Shigella flexneri 2a str. 2457T
uaaguuuaacugcc

SEQ ID NO: 3856252 - RNA, 18 nt, Shigella flexneri 2a str. 2457T
uaaguuugccguugaucu

SEQ ID NO: 3856253 - RNA, 19 nt, Shigella flexneri 2a str. 2457T
uaauaaaauagcgugauug

SEQ ID NO: 3856254 - RNA, 13 nt, Shigella flexneri 2a str. 2457T
uaauaaauauuaa

SEQ ID NO: 3856255 - RNA, 19 nt, Shigella flexneri 2a str. 2457T
uaauaaaugccggaagcug

SEQ ID NO: 3856256 - RNA, 13 nt, Shigella flexneri 2a str. 2457T
uaauaaauuaacu

SEQ ID NO: 3856257 - RNA, 13 nt, Shigella flexneri 2a str. 2457T
uaauaacacauau

SEQ ID NO: 3856258 - RNA, 23 nt, Shigella flexneri 2a str. 2457T
uaauaacagggaaugugaugaaa

SEQ ID NO: 3856259 - RNA, 23 nt, Shigella flexneri 2a str. 2457T
uaauaagguaauuauuguaagcu

SEQ ID NO: 3856260 - RNA, 21 nt, Shigella flexneri 2a str. 2457T
uaauaagguucauugagcgca

SEQ ID NO: 3856261 - RNA, 14 nt, Shigella flexneri 2a str. 2457T
uaauaaucagcaca

SEQ ID NO: 3856262 - RNA, 15 nt, Shigella flexneri 2a str. 2457T
uaauaaugagcagaa

SEQ ID NO: 3856263 - RNA, 22 nt, Shigella flexneri 2a str. 2457T
uaauaaugagcagaaaaaccca

SEQ ID NO: 3856264 - RNA, 22 nt, Shigella flexneri 2a str. 2457T
uaauaaugagcagaaaaaccgu

SEQ ID NO: 3856265 - RNA, 17 nt, Shigella flexneri 2a str. 2457T
uaauaauucaaaaaccu

SEQ ID NO: 3856266 - RNA, 14 nt, Shigella flexneri 2a str. 2457T
uaauaauuucugca

SEQ ID NO: 3856267 - RNA, 18 nt, Shigella flexneri 2a str. 2457T
uaauaauuucugcacauc

SEQ ID NO: 3856268 - RNA, 17 nt, Shigella flexneri 2a str. 2457T
uaauacacuaacagaac

SEQ ID NO: 3856269 - RNA, 17 nt, Shigella flexneri 2a str. 2457T
uaauacccuugcagacg

SEQ ID NO: 3856270 - RNA, 23 nt, Shigella flexneri 2a str. 2457T
uaauaccgacuucggccagugcu

SEQ ID NO: 3856271 - RNA, 12 nt, Shigella flexneri 2a str. 2457T
uaauacgccaga

SEQ ID NO: 3856272 - RNA, 20 nt, Shigella flexneri 2a str. 2457T
uaauacgccggucacgcccg

SEQ ID NO: 3856273 - RNA, 23 nt, Shigella flexneri 2a str. 2457T
uaauacguagcaccgacgucgau

SEQ ID NO: 3856274 - RNA, 15 nt, Shigella flexneri 2a str. 2457T
uaauagaacuauaau

SEQ ID NO: 3856275 - RNA, 20 nt, Shigella flexneri 2a str. 2457T
uaauagaacuauaauugcuu

SEQ ID NO: 3856276 - RNA, 19 nt, Shigella flexneri 2a str. 2457T
uaauaggcaggcaucauca

SEQ ID NO: 3856277 - RNA, 18 nt, Shigella flexneri 2a str. 2457T
uaauaguauuaagccagu

SEQ ID NO: 3856278 - RNA, 23 nt, Shigella flexneri 2a str. 2457T
uaauauccaggcccaggaaaacg

SEQ ID NO: 3856279 - RNA, 22 nt, Shigella flexneri 2a str. 2457T
uaauauccccagccuaagccau

SEQ ID NO: 3856280 - RNA, 16 nt, Shigella flexneri 2a str. 2457T
uaauaucccuuccucc

SEQ ID NO: 3856281 - RNA, 23 nt, Shigella flexneri 2a str. 2457T
uaauaucccuuccucccuuucac

SEQ ID NO: 3856282 - RNA, 17 nt, Shigella flexneri 2a str. 2457T
uaauauccugccguuuu

SEQ ID NO: 3856283 - RNA, 15 nt, Shigella flexneri 2a str. 2457T
uaauaucuccagcua

SEQ ID NO: 3856284 - RNA, 17 nt, Shigella flexneri 2a str. 2457T
uaauaucuccagcuaua

SEQ ID NO: 3856285 - RNA, 15 nt, Shigella flexneri 2a str. 2457T
uaauaugcaauucac

SEQ ID NO: 3856286 - RNA, 22 nt, Shigella flexneri 2a str. 2457T
uaauaugcugguuccugacucc

SEQ ID NO: 3856287 - RNA, 14 nt, Shigella flexneri 2a str. 2457T
uaauauuacuucgc

SEQ ID NO: 3856288 - RNA, 21 nt, Shigella flexneri 2a str. 2457T
uaauauucaacgucacugggu

SEQ ID NO: 3856289 - RNA, 16 nt, Shigella flexneri 2a str. 2457T
uaauauugauauccgc

SEQ ID NO: 3856290 - RNA, 13 nt, Shigella flexneri 2a str. 2457T
uaauauuuaucuu

SEQ ID NO: 3856291 - RNA, 21 nt, Shigella flexneri 2a str. 2457T
uaaucaacgcaccgacaaauu

SEQ ID NO: 3856292 - RNA, 14 nt, Shigella flexneri 2a str. 2457T
uaaucaagcccugg

SEQ ID NO: 3856293 - RNA, 17 nt, Shigella flexneri 2a str. 2457T
uaaucaauaaaaauaca

SEQ ID NO: 3856294 - RNA, 14 nt, Shigella flexneri 2a str. 2457T
uaaucaauuuaucg

SEQ ID NO: 3856295 - RNA, 22 nt, Shigella flexneri 2a str. 2457T
uacaucuuaaucuuagguaaug

SEQ ID NO: 3856296 - RNA, 18 nt, Shigella flexneri 2a str. 2457T
uacaugaagcacugcauc

SEQ ID NO: 3856297 - RNA, 17 nt, Shigella flexneri 2a str. 2457T
uacaugcgcgacaaaaa

SEQ ID NO: 3856298 - RNA, 20 nt, Shigella flexneri 2a str. 2457T
uacaugcgcgacaaaaauua

SEQ ID NO: 3856299 - RNA, 15 nt, Shigella flexneri 2a str. 2457T
uacauggacgaaauc

SEQ ID NO: 3856300 - RNA, 15 nt, Shigella flexneri 2a str. 2457T
uacauggugcacauu

SEQ ID NO: 3856301 - RNA, 22 nt, Shigella flexneri 2a str. 2457T
uacauuaaacgccguucuucag

SEQ ID NO: 3856302 - RNA, 20 nt, Shigella flexneri 2a str. 2457T
uacauugauauacagcccgg

SEQ ID NO: 3856303 - RNA, 17 nt, Shigella flexneri 2a str. 2457T
uacauugccgacauggc

SEQ ID NO: 3856304 - RNA, 21 nt, Shigella flexneri 2a str. 2457T
uacauugccgggcgcaucaga

SEQ ID NO: 3856305 - RNA, 19 nt, Shigella flexneri 2a str. 2457T
uacauugcguaaccaauca

SEQ ID NO: 3856306 - RNA, 16 nt, Shigella flexneri 2a str. 2457T
uacauuguuuuccaga

SEQ ID NO: 3856307 - RNA, 14 nt, Shigella flexneri 2a str. 2457T
uacauuuuaauaau

SEQ ID NO: 3856308 - RNA, 18 nt, Shigella flexneri 2a str. 2457T
uaccaaauuccagaaaag

SEQ ID NO: 3856309 - RNA, 18 nt, Shigella flexneri 2a str. 2457T
uaccaaauuggcaaaauu

SEQ ID NO: 3856310 - RNA, 17 nt, Shigella flexneri 2a str. 2457T
uaccaauaaacuucaau

SEQ ID NO: 3856311 - RNA, 22 nt, Shigella flexneri 2a str. 2457T
uaccaauaaacuucaauauauu

SEQ ID NO: 3856312 - RNA, 15 nt, Shigella flexneri 2a str. 2457T
uaccaauaaucaauu

SEQ ID NO: 3856313 - RNA, 20 nt, Shigella flexneri 2a str. 2457T
uaccacaucaacccgcccag

SEQ ID NO: 3856314 - RNA, 13 nt, Shigella flexneri 2a str. 2457T
uaccaccagugcc

SEQ ID NO: 3856315 - RNA, 22 nt, Shigella flexneri 2a str. 2457T
uaccaccuuacuuacacaucaa

SEQ ID NO: 3856316 - RNA, 15 nt, Shigella flexneri 2a str. 2457T
uaccacgauuuugac

SEQ ID NO: 3856317 - RNA, 17 nt, Shigella flexneri 2a str. 2457T
uaccacgcaaagcacgc

SEQ ID NO: 3856318 - RNA, 22 nt, Shigella flexneri 2a str. 2457T
uaccacgcacagcccgccgcca

SEQ ID NO: 3856319 - RNA, 19 nt, Shigella flexneri 2a str. 2457T
uaccacggaaaggcaacau

SEQ ID NO: 3856320 - RNA, 18 nt, Shigella flexneri 2a str. 2457T
uaccacggcauuuccgcc

SEQ ID NO: 3856321 - RNA, 20 nt, Shigella flexneri 2a str. 2457T
uaccacgguacgccagagug

SEQ ID NO: 3856322 - RNA, 13 nt, Shigella flexneri 2a str. 2457T
uaccacuucaucc

SEQ ID NO: 3856323 - RNA, 22 nt, Shigella flexneri 2a str. 2457T
uaccacuucauccggauacagc

SEQ ID NO: 3856324 - RNA, 19 nt, Shigella flexneri 2a str. 2457T
uaccacuuccagcagacca

SEQ ID NO: 3856325 - RNA, 15 nt, Shigella flexneri 2a str. 2457T
uaccagaaucaccuu

SEQ ID NO: 3856326 - RNA, 17 nt, Shigella flexneri 2a str. 2457T
uaccagaccauacagug

SEQ ID NO: 3856327 - RNA, 22 nt, Shigella flexneri 2a str. 2457T
uaccagaugcucuuuucugaag

SEQ ID NO: 3856328 - RNA, 20 nt, Shigella flexneri 2a str. 2457T
uaccagcacccauagcuuca

SEQ ID NO: 3856329 - RNA, 16 nt, Shigella flexneri 2a str. 2457T
uaccagcaccugcuug

SEQ ID NO: 3856330 - RNA, 19 nt, Shigella flexneri 2a str. 2457T
uaccagcaccugcuugaac

SEQ ID NO: 3856331 - RNA, 20 nt, Shigella flexneri 2a str. 2457T
uaccagcagcccugccggaa

SEQ ID NO: 3856332 - RNA, 22 nt, Shigella flexneri 2a str. 2457T
uaccagccccgaugccaucaug

SEQ ID NO: 3856333 - RNA, 14 nt, Shigella flexneri 2a str. 2457T
uaccagcccgucuc

SEQ ID NO: 3856334 - RNA, 19 nt, Shigella flexneri 2a str. 2457T
uaccagcgacaucaccgcc

SEQ ID NO: 3856335 - RNA, 20 nt, Shigella flexneri 2a str. 2457T
uaccagcgacaucaccgccg

SEQ ID NO: 3856336 - RNA, 18 nt, Shigella flexneri 2a str. 2457T
uaccagcgaggucaaaau

SEQ ID NO: 3856337 - RNA, 14 nt, Shigella flexneri 2a str. 2457T
uaccagcgccgcca

SEQ ID NO: 3856338 - RNA, 23 nt, Shigella flexneri 2a str. 2457T
uaccaggauaggcuucuauacca

SEQ ID NO: 3856339 - RNA, 19 nt, Shigella flexneri 2a str. 2457T
uaccaguucgcuuuccguu

SEQ ID NO: 3856340 - RNA, 13 nt, Shigella flexneri 2a str. 2457T
uaccaguugauca

SEQ ID NO: 3856341 - RNA, 11 nt, Shigella flexneri 2a str. 2457T
uaccaucaggu

SEQ ID NO: 3856342 - RNA, 17 nt, Shigella flexneri 2a str. 2457T
uaccaugcgcaucaucg

SEQ ID NO: 3856343 - RNA, 14 nt, Shigella flexneri 2a str. 2457T
uaccauuucaccgu

SEQ ID NO: 3856344 - RNA, 12 nt, Shigella flexneri 2a str. 2457T
uaccauuuguuc

SEQ ID NO: 3856345 - RNA, 15 nt, Shigella flexneri 2a str. 2457T
uacccaaucccccac

SEQ ID NO: 3856346 - RNA, 19 nt, Shigella flexneri 2a str. 2457T
uacccagcacggauaccgc

SEQ ID NO: 3856347 - RNA, 12 nt, Shigella flexneri 2a str. 2457T
uacccagcagca

SEQ ID NO: 3856348 - RNA, 22 nt, Shigella flexneri 2a str. 2457T
uacccagcguguugaggaagcg

SEQ ID NO: 3856349 - RNA, 15 nt, Shigella flexneri 2a str. 2457T
uacccauauuuaauc

SEQ ID NO: 3856350 - RNA, 19 nt, Shigella flexneri 2a str. 2457T
uaccccgucaccacuucac

SEQ ID NO: 3856351 - RNA, 20 nt, Shigella flexneri 2a str. 2457T
uaccccucuauccagcucau

SEQ ID NO: 3856352 - RNA, 14 nt, Shigella flexneri 2a str. 2457T
uaccccugauuuug

SEQ ID NO: 3856353 - RNA, 15 nt, Shigella flexneri 2a str. 2457T
uaccccuucauccac

SEQ ID NO: 3856354 - RNA, 19 nt, Shigella flexneri 2a str. 2457T
uaccccuucauccacauuc

SEQ ID NO: 3856355 - RNA, 23 nt, Shigella flexneri 2a str. 2457T
uacccgauggcgugcccggguca

SEQ ID NO: 3856356 - RNA, 17 nt, Shigella flexneri 2a str. 2457T
uacccugacccagaccg

SEQ ID NO: 3856357 - RNA, 18 nt, Shigella flexneri 2a str. 2457T
uaccgaagaguaaccaaa

SEQ ID NO: 3856358 - RNA, 24 nt, Shigella flexneri 2a str. 2457T
uaccgaauccaguaagcugugcga

SEQ ID NO: 3856359 - RNA, 17 nt, Shigella flexneri 2a str. 2457T
uaccgacauaugcuuaa

SEQ ID NO: 3856360 - RNA, 19 nt, Shigella flexneri 2a str. 2457T
uaccgauuacucagcaacu

SEQ ID NO: 3856361 - RNA, 23 nt, Shigella flexneri 2a str. 2457T
uaccgcaacucauuuacagaaac

SEQ ID NO: 3856362 - RNA, 13 nt, Shigella flexneri 2a str. 2457T
uaccgcaccacca

SEQ ID NO: 3856363 - RNA, 17 nt, Shigella flexneri 2a str. 2457T
uaccgcaccaccagcag

SEQ ID NO: 3856364 - RNA, 18 nt, Shigella flexneri 2a str. 2457T
uaccgcagugaaauuucu

SEQ ID NO: 3856365 - RNA, 16 nt, Shigella flexneri 2a str. 2457T
uaccgccagcaggaac

SEQ ID NO: 3856366 - RNA, 23 nt, Shigella flexneri 2a str. 2457T
uaccgcccgcgcgguaucaccac

SEQ ID NO: 3856367 - RNA, 20 nt, Shigella flexneri 2a str. 2457T
uaccgccgaucucaccgauc

SEQ ID NO: 3856368 - RNA, 19 nt, Shigella flexneri 2a str. 2457T
uaccgccucgcggcagcag

SEQ ID NO: 3856369 - RNA, 16 nt, Shigella flexneri 2a str. 2457T
uaccgcguaauacauc

SEQ ID NO: 3856370 - RNA, 16 nt, Shigella flexneri 2a str. 2457T
uaccgcuguccacgcc

SEQ ID NO: 3856371 - RNA, 18 nt, Shigella flexneri 2a str. 2457T
uaccggacacacuucauu

SEQ ID NO: 3856372 - RNA, 17 nt, Shigella flexneri 2a str. 2457T
uaccggacuccagacac

SEQ ID NO: 3856373 - RNA, 18 nt, Shigella flexneri 2a str. 2457T
uaccggauuuuuuuuccg

SEQ ID NO: 3856374 - RNA, 13 nt, Shigella flexneri 2a str. 2457T
uaccggcaaacuu

SEQ ID NO: 3856375 - RNA, 19 nt, Shigella flexneri 2a str. 2457T
uaccggcuggcgcauacca

SEQ ID NO: 3856376 - RNA, 20 nt, Shigella flexneri 2a str. 2457T
uaccgggccugaacaagcaa

SEQ ID NO: 3856377 - RNA, 20 nt, Shigella flexneri 2a str. 2457T
uaccgggcuguucacugugc

SEQ ID NO: 3856378 - RNA, 14 nt, Shigella flexneri 2a str. 2457T
uaccggggacaggc

SEQ ID NO: 3856379 - RNA, 16 nt, Shigella flexneri 2a str. 2457T
uaccgggucgcacugg

SEQ ID NO: 3856380 - RNA, 17 nt, Shigella flexneri 2a str. 2457T
uaccgguuucaauccag

SEQ ID NO: 3856381 - RNA, 18 nt, Shigella flexneri 2a str. 2457T
uaccgguuucaauccagg

SEQ ID NO: 3856382 - RNA, 17 nt, Shigella flexneri 2a str. 2457T
uaccguaaccauaacca

SEQ ID NO: 3856383 - RNA, 15 nt, Shigella flexneri 2a str. 2457T
uaccguaucuaccac

SEQ ID NO: 3856384 - RNA, 12 nt, Shigella flexneri 2a str. 2457T
uaccgucaccga

SEQ ID NO: 3856385 - RNA, 21 nt, Shigella flexneri 2a str. 2457T
uaccgucagcgaucagcauuu

SEQ ID NO: 3856386 - RNA, 13 nt, Shigella flexneri 2a str. 2457T
uaccgucuguaac

SEQ ID NO: 3856387 - RNA, 17 nt, Shigella flexneri 2a str. 2457T
uaccgugaaucaccaca

SEQ ID NO: 3856388 - RNA, 15 nt, Shigella flexneri 2a str. 2457T
uaccgugcugacuca

SEQ ID NO: 3856389 - RNA, 18 nt, Shigella flexneri 2a str. 2457T
uaccgugcuguacagcag

SEQ ID NO: 3856390 - RNA, 20 nt, Shigella flexneri 2a str. 2457T
uaccgugguacguuaaaguu

SEQ ID NO: 3856391 - RNA, 14 nt, Shigella flexneri 2a str. 2457T
uaccguugcggcgu

SEQ ID NO: 3856392 - RNA, 16 nt, Shigella flexneri 2a str. 2457T
uacuccaacccggcag

SEQ ID NO: 3856393 - RNA, 17 nt, Shigella flexneri 2a str. 2457T
uacuccccuuucuuauu

SEQ ID NO: 3856394 - RNA, 16 nt, Shigella flexneri 2a str. 2457T
uacucccgcauacauu

SEQ ID NO: 3856395 - RNA, 18 nt, Shigella flexneri 2a str. 2457T
uacucccgcuucagccgu

SEQ ID NO: 3856396 - RNA, 20 nt, Shigella flexneri 2a str. 2457T
uacuccuuagcaacaggcca

SEQ ID NO: 3856397 - RNA, 16 nt, Shigella flexneri 2a str. 2457T
uacucuccuccagguu

SEQ ID NO: 3856398 - RNA, 16 nt, Shigella flexneri 2a str. 2457T
uacucuccugcggcga

SEQ ID NO: 3856399 - RNA, 23 nt, Shigella flexneri 2a str. 2457T
uacucuccugcggcgacaaaugu

SEQ ID NO: 3856400 - RNA, 23 nt, Shigella flexneri 2a str. 2457T
uacucuggcgcuggaugucuggc

SEQ ID NO: 3856401 - RNA, 17 nt, Shigella flexneri 2a str. 2457T
uacucugguauuaaccg

SEQ ID NO: 3856402 - RNA, 23 nt, Shigella flexneri 2a str. 2457T
uacucuuaucaaacgacagcgug

SEQ ID NO: 3856403 - RNA, 18 nt, Shigella flexneri 2a str. 2457T
uacucuugugccaguuca

SEQ ID NO: 3856404 - RNA, 19 nt, Shigella flexneri 2a str. 2457T
uacucuuugaacagccaga

SEQ ID NO: 3856405 - RNA, 19 nt, Shigella flexneri 2a str. 2457T
uacugaaaguggaaaaaua

SEQ ID NO: 3856406 - RNA, 18 nt, Shigella flexneri 2a str. 2457T
uacugaacaacuuaacuu

SEQ ID NO: 3856407 - RNA, 15 nt, Shigella flexneri 2a str. 2457T
uacugaaggcgcauu

SEQ ID NO: 3856408 - RNA, 18 nt, Shigella flexneri 2a str. 2457T
uacugaaggcgcauugcu

SEQ ID NO: 3856409 - RNA, 13 nt, Shigella flexneri 2a str. 2457T
uacugaaucccug

SEQ ID NO: 3856410 - RNA, 16 nt, Shigella flexneri 2a str. 2457T
uacugacaaacugcgc

SEQ ID NO: 3856411 - RNA, 15 nt, Shigella flexneri 2a str. 2457T
uacugacaauuugcc

SEQ ID NO: 3856412 - RNA, 21 nt, Shigella flexneri 2a str. 2457T
uacugacaauuugcccaugua

SEQ ID NO: 3856413 - RNA, 11 nt, Shigella flexneri 2a str. 2457T
uacugacauca

SEQ ID NO: 3856414 - RNA, 13 nt, Shigella flexneri 2a str. 2457T
uacugacauuaac

SEQ ID NO: 3856415 - RNA, 21 nt, Shigella flexneri 2a str. 2457T
uacugaccccaaaaaguugga

SEQ ID NO: 3856416 - RNA, 21 nt, Shigella flexneri 2a str. 2457T
uacugaccgucgccuucaacg

SEQ ID NO: 3856417 - RNA, 21 nt, Shigella flexneri 2a str. 2457T
uacugacggaucccgccaaca

SEQ ID NO: 3856418 - RNA, 23 nt, Shigella flexneri 2a str. 2457T
uacugacuagaugugcaguuccu

SEQ ID NO: 3856419 - RNA, 14 nt, Shigella flexneri 2a str. 2457T
uacugacuggcaag

SEQ ID NO: 3856420 - RNA, 22 nt, Shigella flexneri 2a str. 2457T
uacugauaguguuuuauguuca

SEQ ID NO: 3856421 - RNA, 14 nt, Shigella flexneri 2a str. 2457T
uacugaucaucauu

SEQ ID NO: 3856422 - RNA, 16 nt, Shigella flexneri 2a str. 2457T
uacugauguuugucac

SEQ ID NO: 3856423 - RNA, 14 nt, Shigella flexneri 2a str. 2457T
uacugauugacgcg

SEQ ID NO: 3856424 - RNA, 17 nt, Shigella flexneri 2a str. 2457T
uacugccccggagaaau

SEQ ID NO: 3856425 - RNA, 14 nt, Shigella flexneri 2a str. 2457T
uacugcccgcuugc

SEQ ID NO: 3856426 - RNA, 21 nt, Shigella flexneri 2a str. 2457T
uacugcugcggaauugccggu

SEQ ID NO: 3856427 - RNA, 15 nt, Shigella flexneri 2a str. 2457T
uacuggaauuucauu

SEQ ID NO: 3856428 - RNA, 17 nt, Shigella flexneri 2a str. 2457T
uacuggaguuauucauu

SEQ ID NO: 3856429 - RNA, 23 nt, Shigella flexneri 2a str. 2457T
uacuggauagauauucuccagcu

SEQ ID NO: 3856430 - RNA, 23 nt, Shigella flexneri 2a str. 2457T
uacuggcaccgaagcccaucagu

SEQ ID NO: 3856431 - RNA, 15 nt, Shigella flexneri 2a str. 2457T
uacuggcuuucauuu

SEQ ID NO: 3856432 - RNA, 13 nt, Shigella flexneri 2a str. 2457T
uacugggaagaau

SEQ ID NO: 3856433 - RNA, 21 nt, Shigella flexneri 2a str. 2457T
uacugggaagaauggaaaaaa

SEQ ID NO: 3856434 - RNA, 14 nt, Shigella flexneri 2a str. 2457T
uacugggccgccug

SEQ ID NO: 3856435 - RNA, 18 nt, Shigella flexneri 2a str. 2457T
uacuggugcaaaaccugg

SEQ ID NO: 3856436 - RNA, 15 nt, Shigella flexneri 2a str. 2457T
uacuguacagauccg

SEQ ID NO: 3856437 - RNA, 21 nt, Shigella flexneri 2a str. 2457T
uacuguacagauccgccauuu

SEQ ID NO: 3856438 - RNA, 23 nt, Shigella flexneri 2a str. 2457T
uacuguauacgggcuuuuuaauu

SEQ ID NO: 3856439 - RNA, 20 nt, Shigella flexneri 2a str. 2457T
uacuguuuaucuucccagcg

SEQ ID NO: 3856440 - RNA, 20 nt, Shigella flexneri 2a str. 2457T
uacuuaaacaguacgagaga

SEQ ID NO: 3856441 - RNA, 14 nt, Shigella flexneri 2a str. 2457T
uacuuaucuuuuac

SEQ ID NO: 3856442 - RNA, 14 nt, Shigella flexneri 2a str. 2457T
uacuucaccuucuu

SEQ ID NO: 3856443 - RNA, 21 nt, Shigella flexneri 2a str. 2457T
uacuucagcaagcgauaauuu

SEQ ID NO: 3856444 - RNA, 23 nt, Shigella flexneri 2a str. 2457T
uacuucauaacguuuuuucguca

SEQ ID NO: 3856445 - RNA, 16 nt, Shigella flexneri 2a str. 2457T
uacuuccgggaaaacc

SEQ ID NO: 3856446 - RNA, 21 nt, Shigella flexneri 2a str. 2457T
uacuucucaccgguaaaguca

SEQ ID NO: 3856447 - RNA, 19 nt, Shigella flexneri 2a str. 2457T
uacuucucgauaaaccauc

SEQ ID NO: 3856448 - RNA, 16 nt, Shigella flexneri 2a str. 2457T
uacuucugaacccggu

SEQ ID NO: 3856449 - RNA, 14 nt, Shigella flexneri 2a str. 2457T
uacuucugaccagg

SEQ ID NO: 3856450 - RNA, 16 nt, Shigella flexneri 2a str. 2457T
uacuugcaagaucgcg

SEQ ID NO: 3856451 - RNA, 22 nt, Shigella flexneri 2a str. 2457T
uacuugcaccgauucccgggca

SEQ ID NO: 3856452 - RNA, 17 nt, Shigella flexneri 2a str. 2457T
uacuuucacaaaaauaa

SEQ ID NO: 3856453 - RNA, 12 nt, Shigella flexneri 2a str. 2457T
uacuuucaucaa

SEQ ID NO: 3856454 - RNA, 17 nt, Shigella flexneri 2a str. 2457T
uacuuucaucaaacgac

SEQ ID NO: 3856455 - RNA, 21 nt, Shigella flexneri 2a str. 2457T
uacuuuuuaugucauuaaccg

SEQ ID NO: 3856456 - RNA, 12 nt, Shigella flexneri 2a str. 2457T
uacuuuuucgcc

SEQ ID NO: 3856457 - RNA, 16 nt, Shigella flexneri 2a str. 2457T
uacuuuuuucacccac

SEQ ID NO: 3856458 - RNA, 17 nt, Shigella flexneri 2a str. 2457T
uagaaaacgaaagcgcc

SEQ ID NO: 3856459 - RNA, 13 nt, Shigella flexneri 2a str. 2457T
uagaaacaaaaaa

SEQ ID NO: 3856460 - RNA, 14 nt, Shigella flexneri 2a str. 2457T
uagaaacagaauga

SEQ ID NO: 3856461 - RNA, 21 nt, Shigella flexneri 2a str. 2457T
uagaaacgagguauguuucug

SEQ ID NO: 3856462 - RNA, 16 nt, Shigella flexneri 2a str. 2457T
uagaaagugacugcug

SEQ ID NO: 3856463 - RNA, 13 nt, Shigella flexneri 2a str. 2457T
uagaaaucauuca

SEQ ID NO: 3856464 - RNA, 14 nt, Shigella flexneri 2a str. 2457T
uagaaauuauuucu

SEQ ID NO: 3856465 - RNA, 16 nt, Shigella flexneri 2a str. 2457T
uagaaauuauuucuuu

SEQ ID NO: 3856466 - RNA, 22 nt, Shigella flexneri 2a str. 2457T
uagaacaaaagaccugaccaga

SEQ ID NO: 3856467 - RNA, 15 nt, Shigella flexneri 2a str. 2457T
uagaacaucucuucc

SEQ ID NO: 3856468 - RNA, 15 nt, Shigella flexneri 2a str. 2457T
uagaacccuaccagc

SEQ ID NO: 3856469 - RNA, 17 nt, Shigella flexneri 2a str. 2457T
uagaaccuugcuggcga

SEQ ID NO: 3856470 - RNA, 16 nt, Shigella flexneri 2a str. 2457T
uagaacggcagagaaa

SEQ ID NO: 3856471 - RNA, 22 nt, Shigella flexneri 2a str. 2457T
uagaacuaaugggccguuagga

SEQ ID NO: 3856472 - RNA, 21 nt, Shigella flexneri 2a str. 2457T
uagaagaggaacccagugaua

SEQ ID NO: 3856473 - RNA, 22 nt, Shigella flexneri 2a str. 2457T
uagaagccauuaaacaccagua

SEQ ID NO: 3856474 - RNA, 14 nt, Shigella flexneri 2a str. 2457T
uagaauauuucuau

SEQ ID NO: 3856475 - RNA, 23 nt, Shigella flexneri 2a str. 2457T
uagaaugccaaguaauagaacua

SEQ ID NO: 3856476 - RNA, 13 nt, Shigella flexneri 2a str. 2457T
uagaauuguaauc

SEQ ID NO: 3856477 - RNA, 14 nt, Shigella flexneri 2a str. 2457T
uagacaaaaauucu

SEQ ID NO: 3856478 - RNA, 18 nt, Shigella flexneri 2a str. 2457T
uagacaguucuuccuggc

SEQ ID NO: 3856479 - RNA, 23 nt, Shigella flexneri 2a str. 2457T
uagacaugcccggaaguaccaau

SEQ ID NO: 3856480 - RNA, 14 nt, Shigella flexneri 2a str. 2457T
uagacauuacgcau

SEQ ID NO: 3856481 - RNA, 23 nt, Shigella flexneri 2a str. 2457T
uagacauuacgcauuugcgcgua

SEQ ID NO: 3856482 - RNA, 12 nt, Shigella flexneri 2a str. 2457T
uagaccagagcu

SEQ ID NO: 3856483 - RNA, 16 nt, Shigella flexneri 2a str. 2457T
uagacgcuuucacccg

SEQ ID NO: 3856484 - RNA, 22 nt, Shigella flexneri 2a str. 2457T
uagagagcagucagguucagcg

SEQ ID NO: 3856485 - RNA, 22 nt, Shigella flexneri 2a str. 2457T
uagagauuuuuccccaccucau

SEQ ID NO: 3856486 - RNA, 13 nt, Shigella flexneri 2a str. 2457T
uagagcacaucac

SEQ ID NO: 3856487 - RNA, 21 nt, Shigella flexneri 2a str. 2457T
uagagcacaucacucauaaug

SEQ ID NO: 3856488 - RNA, 22 nt, Shigella flexneri 2a str. 2457T
uagagccgguuuugguuuucug

SEQ ID NO: 3856489 - RNA, 18 nt, Shigella flexneri 2a str. 2457T
uagaggcguuccugcaac

SEQ ID NO: 3856490 - RNA, 17 nt, Shigella flexneri 2a str. 2457T
uagagggaauggcagau

SEQ ID NO: 3856491 - RNA, 17 nt, Shigella flexneri 2a str. 2457T
uagagguuauaaauaaa

SEQ ID NO: 3856492 - RNA, 15 nt, Shigella flexneri 2a str. 2457T
uagaguuugaacuca

SEQ ID NO: 3856493 - RNA, 14 nt, Shigella flexneri 2a str. 2457T
uagauaucaugcuc

SEQ ID NO: 3856494 - RNA, 14 nt, Shigella flexneri 2a str. 2457T
uagauauucuccag

SEQ ID NO: 3856495 - RNA, 12 nt, Shigella flexneri 2a str. 2457T
uagauccaggaa

SEQ ID NO: 3856496 - RNA, 21 nt, Shigella flexneri 2a str. 2457T
uagaucuaaaugccacugaau

SEQ ID NO: 3856497 - RNA, 21 nt, Shigella flexneri 2a str. 2457T
uagaugaucgccgcacuuucu

SEQ ID NO: 3856498 - RNA, 22 nt, Shigella flexneri 2a str. 2457T
uagaugcccggcguauagcuga

SEQ ID NO: 3856499 - RNA, 20 nt, Shigella flexneri 2a str. 2457T
uagauggggccaugauuuga

SEQ ID NO: 3856500 - RNA, 18 nt, Shigella flexneri 2a str. 2457T
uagaugugcaguuccugc

SEQ ID NO: 3856501 - RNA, 19 nt, Shigella flexneri 2a str. 2457T
uagaugugggcaaucucac

SEQ ID NO: 3856502 - RNA, 21 nt, Shigella flexneri 2a str. 2457T
uagauuaauuucccaccacua

SEQ ID NO: 3856503 - RNA, 14 nt, Shigella flexneri 2a str. 2457T
uagauucaacauaa

SEQ ID NO: 3856504 - RNA, 23 nt, Shigella flexneri 2a str. 2457T
uagauuucguugugucgccagca

SEQ ID NO: 3856505 - RNA, 20 nt, Shigella flexneri 2a str. 2457T
uagauuuugcagaucgccaa

SEQ ID NO: 3856506 - RNA, 13 nt, Shigella flexneri 2a str. 2457T
uagauuuuuaaug

SEQ ID NO: 3856507 - RNA, 13 nt, Shigella flexneri 2a str. 2457T
uagcaaaguaaua

SEQ ID NO: 3856508 - RNA, 20 nt, Shigella flexneri 2a str. 2457T
uagcaaaguaauaaugauca

SEQ ID NO: 3856509 - RNA, 15 nt, Shigella flexneri 2a str. 2457T
uagcaacagcagcca

SEQ ID NO: 3856510 - RNA, 14 nt, Shigella flexneri 2a str. 2457T
uagcaacaggccag

SEQ ID NO: 3856511 - RNA, 19 nt, Shigella flexneri 2a str. 2457T
uagcaaccaaaaaaagaau

SEQ ID NO: 3856512 - RNA, 15 nt, Shigella flexneri 2a str. 2457T
uagcaacugauuuau

SEQ ID NO: 3856513 - RNA, 18 nt, Shigella flexneri 2a str. 2457T
uagcaauauuuuuaugcc

SEQ ID NO: 3856514 - RNA, 21 nt, Shigella flexneri 2a str. 2457T
uagcaauauuuuuaugccgga

SEQ ID NO: 3856515 - RNA, 23 nt, Shigella flexneri 2a str. 2457T
uagcaauauuuuuaugccggauc

SEQ ID NO: 3856516 - RNA, 16 nt, Shigella flexneri 2a str. 2457T
uagcacaaacccaggg

SEQ ID NO: 3856517 - RNA, 15 nt, Shigella flexneri 2a str. 2457T
uagcacaacaggcua

SEQ ID NO: 3856518 - RNA, 18 nt, Shigella flexneri 2a str. 2457T
uagcacgacguuucuuuc

SEQ ID NO: 3856519 - RNA, 19 nt, Shigella flexneri 2a str. 2457T
uagcacuguaaaccucuuu

SEQ ID NO: 3856520 - RNA, 21 nt, Shigella flexneri 2a str. 2457T
uagcacuguaaaccucuuucg

SEQ ID NO: 3856521 - RNA, 19 nt, Shigella flexneri 2a str. 2457T
uagcacuuuucgucaggau

SEQ ID NO: 3856522 - RNA, 16 nt, Shigella flexneri 2a str. 2457T
uagcagcacaccacau

SEQ ID NO: 3856523 - RNA, 16 nt, Shigella flexneri 2a str. 2457T
uagcagcuuucagcag

SEQ ID NO: 3856524 - RNA, 18 nt, Shigella flexneri 2a str. 2457T
uagcagcuuucagcagcg

SEQ ID NO: 3856525 - RNA, 16 nt, Shigella flexneri 2a str. 2457T
uagcaggaugacaaag

SEQ ID NO: 3856526 - RNA, 20 nt, Shigella flexneri 2a str. 2457T
uagcaguaauugcagcagcu

SEQ ID NO: 3856527 - RNA, 13 nt, Shigella flexneri 2a str. 2457T
uagcaguuccagc

SEQ ID NO: 3856528 - RNA, 15 nt, Shigella flexneri 2a str. 2457T
uagcauaaaaacucg

SEQ ID NO: 3856529 - RNA, 11 nt, Shigella flexneri 2a str. 2457T
uagcaucagcg

SEQ ID NO: 3856530 - RNA, 12 nt, Shigella flexneri 2a str. 2457T
uagcaucccaau

SEQ ID NO: 3856531 - RNA, 13 nt, Shigella flexneri 2a str. 2457T
uagcaucccaaua

SEQ ID NO: 3856532 - RNA, 20 nt, Shigella flexneri 2a str. 2457T
uagcaucgcaucaggcaaug

SEQ ID NO: 3856533 - RNA, 16 nt, Shigella flexneri 2a str. 2457T
uagcaucgcgauggca

SEQ ID NO: 3856534 - RNA, 21 nt, Shigella flexneri 2a str. 2457T
uagcaucuuaucacgaugcua

SEQ ID NO: 3856535 - RNA, 14 nt, Shigella flexneri 2a str. 2457T
uagcaugaaccauu

SEQ ID NO: 3856536 - RNA, 12 nt, Shigella flexneri 2a str. 2457T
uagcauuaagua

SEQ ID NO: 3856537 - RNA, 22 nt, Shigella flexneri 2a str. 2457T
uagccaaagcaccacuccucaa

SEQ ID NO: 3856538 - RNA, 16 nt, Shigella flexneri 2a str. 2457T
uagccaauaaaugcca

SEQ ID NO: 3856539 - RNA, 11 nt, Shigella flexneri 2a str. 2457T
uagccaauucc

SEQ ID NO: 3856540 - RNA, 14 nt, Shigella flexneri 2a str. 2457T
uagccagcaacuga

SEQ ID NO: 3856541 - RNA, 12 nt, Shigella flexneri 2a str. 2457T
uagccaucugcc

SEQ ID NO: 3856542 - RNA, 16 nt, Shigella flexneri 2a str. 2457T
uagccauuugauucac

SEQ ID NO: 3856543 - RNA, 15 nt, Shigella flexneri 2a str. 2457T
uagcccaccuacacc

SEQ ID NO: 3856544 - RNA, 13 nt, Shigella flexneri 2a str. 2457T
uagccccaauguu

SEQ ID NO: 3856545 - RNA, 12 nt, Shigella flexneri 2a str. 2457T
uagccccagucu

SEQ ID NO: 3856546 - RNA, 19 nt, Shigella flexneri 2a str. 2457T
uagcccuuuguaggccaga

SEQ ID NO: 3856547 - RNA, 22 nt, Shigella flexneri 2a str. 2457T
uagccgaccgcaaggaagccug

SEQ ID NO: 3856548 - RNA, 18 nt, Shigella flexneri 2a str. 2457T
uagccgcagccaucagcg

SEQ ID NO: 3856549 - RNA, 22 nt, Shigella flexneri 2a str. 2457T
uagccgcccccgacuccagcag

SEQ ID NO: 3856550 - RNA, 22 nt, Shigella flexneri 2a str. 2457T
uagccgcgcaguuucuuaccua

SEQ ID NO: 3856551 - RNA, 17 nt, Shigella flexneri 2a str. 2457T
uagccgcggaucacgcg

SEQ ID NO: 3856552 - RNA, 14 nt, Shigella flexneri 2a str. 2457T
uagccgcuucugca

SEQ ID NO: 3856553 - RNA, 17 nt, Shigella flexneri 2a str. 2457T
uagccgcuucugcagcu

SEQ ID NO: 3856554 - RNA, 19 nt, Shigella flexneri 2a str. 2457T
uagccgguaaaucaccagc

SEQ ID NO: 3856555 - RNA, 15 nt, Shigella flexneri 2a str. 2457T
uagccgguuuuucaa

SEQ ID NO: 3856556 - RNA, 22 nt, Shigella flexneri 2a str. 2457T
uagccguggcaaccuucuucuu

SEQ ID NO: 3856557 - RNA, 11 nt, Shigella flexneri 2a str. 2457T
uagccugccag

SEQ ID NO: 3856558 - RNA, 18 nt, Shigella flexneri 2a str. 2457T
uagccugccagaggagcc

SEQ ID NO: 3856559 - RNA, 14 nt, Shigella flexneri 2a str. 2457T
uagccuucaucaga

SEQ ID NO: 3856560 - RNA, 17 nt, Shigella flexneri 2a str. 2457T
uagccuuuuucagccgc

SEQ ID NO: 3856561 - RNA, 22 nt, Shigella flexneri 2a str. 2457T
uagcgaagaagacugaugacaa

SEQ ID NO: 3856562 - RNA, 21 nt, Shigella flexneri 2a str. 2457T
uagcgaaguugaucgggacuu

SEQ ID NO: 3856563 - RNA, 18 nt, Shigella flexneri 2a str. 2457T
uagcgaccgaacagauca

SEQ ID NO: 3856564 - RNA, 18 nt, Shigella flexneri 2a str. 2457T
uagcgauaaaugucggca

SEQ ID NO: 3856565 - RNA, 23 nt, Shigella flexneri 2a str. 2457T
uagcgaugacagucuggaagcca

SEQ ID NO: 3856566 - RNA, 16 nt, Shigella flexneri 2a str. 2457T
uagcgcauaagccacc

SEQ ID NO: 3856567 - RNA, 24 nt, Shigella flexneri 2a str. 2457T
uagcgcauaugcuuugccgucauc

SEQ ID NO: 3856568 - RNA, 16 nt, Shigella flexneri 2a str. 2457T
uagcgcaucacuucca

SEQ ID NO: 3856569 - RNA, 15 nt, Shigella flexneri 2a str. 2457T
uagcgcaucaggcaa

SEQ ID NO: 3856570 - RNA, 19 nt, Shigella flexneri 2a str. 2457T
uagcgcaugaccagugagg

SEQ ID NO: 3856571 - RNA, 18 nt, Shigella flexneri 2a str. 2457T
uagcgccucuuuauaaau

SEQ ID NO: 3856572 - RNA, 12 nt, Shigella flexneri 2a str. 2457T
uagcgccugcug

SEQ ID NO: 3856573 - RNA, 16 nt, Shigella flexneri 2a str. 2457T
uagcgcggugcugaaa

SEQ ID NO: 3856574 - RNA, 21 nt, Shigella flexneri 2a str. 2457T
uagcggaaaucuccagauaau

SEQ ID NO: 3856575 - RNA, 19 nt, Shigella flexneri 2a str. 2457T
uagcggcaggaaaaaagcg

SEQ ID NO: 3856576 - RNA, 23 nt, Shigella flexneri 2a str. 2457T
uagcggcgacuugcucaggagua

SEQ ID NO: 3856577 - RNA, 17 nt, Shigella flexneri 2a str. 2457T
uagcggucgaugaugau

SEQ ID NO: 3856578 - RNA, 15 nt, Shigella flexneri 2a str. 2457T
uagcguaaggauuau

SEQ ID NO: 3856579 - RNA, 22 nt, Shigella flexneri 2a str. 2457T
uagcgucaacuuuagcgaugug

SEQ ID NO: 3856580 - RNA, 15 nt, Shigella flexneri 2a str. 2457T
uagcgucguggcaaa

SEQ ID NO: 3856581 - RNA, 16 nt, Shigella flexneri 2a str. 2457T
uagcgugacaccagca

SEQ ID NO: 3856582 - RNA, 18 nt, Shigella flexneri 2a str. 2457T
uagcgugauggccagaua

SEQ ID NO: 3856583 - RNA, 18 nt, Shigella flexneri 2a str. 2457T
uagcguuaaucaucaacu

SEQ ID NO: 3856584 - RNA, 17 nt, Shigella flexneri 2a str. 2457T
uagcguuaauggcagau

SEQ ID NO: 3856585 - RNA, 21 nt, Shigella flexneri 2a str. 2457T
uagcuaaucaucuguugugcc

SEQ ID NO: 3856586 - RNA, 19 nt, Shigella flexneri 2a str. 2457T
uagcuaauuuuuguuguuu

SEQ ID NO: 3856587 - RNA, 12 nt, Shigella flexneri 2a str. 2457T
uauaauaucuuu

SEQ ID NO: 3856588 - RNA, 17 nt, Shigella flexneri 2a str. 2457T
uauaauaucuuuucuua

SEQ ID NO: 3856589 - RNA, 23 nt, Shigella flexneri 2a str. 2457T
uauaauaucuuuucuuaacaaaa

SEQ ID NO: 3856590 - RNA, 21 nt, Shigella flexneri 2a str. 2457T
uauaaucaccaaucacaacua

SEQ ID NO: 3856591 - RNA, 12 nt, Shigella flexneri 2a str. 2457T
uauaauuaaaaa

SEQ ID NO: 3856592 - RNA, 14 nt, Shigella flexneri 2a str. 2457T
uauaauuaaaaaua

SEQ ID NO: 3856593 - RNA, 15 nt, Shigella flexneri 2a str. 2457T
uauaauuaaaaauag

SEQ ID NO: 3856594 - RNA, 12 nt, Shigella flexneri 2a str. 2457T
uauaauuauugc

SEQ ID NO: 3856595 - RNA, 18 nt, Shigella flexneri 2a str. 2457T
uauaauugaccagaucuu

SEQ ID NO: 3856596 - RNA, 18 nt, Shigella flexneri 2a str. 2457T
uauaauugcuuuuuucca

SEQ ID NO: 3856597 - RNA, 16 nt, Shigella flexneri 2a str. 2457T
uauaauugguauucug

SEQ ID NO: 3856598 - RNA, 16 nt, Shigella flexneri 2a str. 2457T
uauacaccuguuccau

SEQ ID NO: 3856599 - RNA, 20 nt, Shigella flexneri 2a str. 2457T
uauacaccuguuccaugacg

SEQ ID NO: 3856600 - RNA, 22 nt, Shigella flexneri 2a str. 2457T
uauacacgaggcauauaggucu

SEQ ID NO: 3856601 - RNA, 16 nt, Shigella flexneri 2a str. 2457T
uauacagacucaaacc

SEQ ID NO: 3856602 - RNA, 17 nt, Shigella flexneri 2a str. 2457T
uauacagacucaaacca

SEQ ID NO: 3856603 - RNA, 17 nt, Shigella flexneri 2a str. 2457T
uauacaucgcuuuccag

SEQ ID NO: 3856604 - RNA, 15 nt, Shigella flexneri 2a str. 2457T
uauacccuucucagc

SEQ ID NO: 3856605 - RNA, 16 nt, Shigella flexneri 2a str. 2457T
uauacccuucucagca

SEQ ID NO: 3856606 - RNA, 22 nt, Shigella flexneri 2a str. 2457T
uauaccggaccaauaacgcuuu

SEQ ID NO: 3856607 - RNA, 14 nt, Shigella flexneri 2a str. 2457T
uauacgucggguua

SEQ ID NO: 3856608 - RNA, 14 nt, Shigella flexneri 2a str. 2457T
uauacuccugaugg

SEQ ID NO: 3856609 - RNA, 16 nt, Shigella flexneri 2a str. 2457T
uauacuccugaugguc

SEQ ID NO: 3856610 - RNA, 21 nt, Shigella flexneri 2a str. 2457T
uauagaagccauccagcagac

SEQ ID NO: 3856611 - RNA, 22 nt, Shigella flexneri 2a str. 2457T
uauagaaugccugugcgacaga

SEQ ID NO: 3856612 - RNA, 15 nt, Shigella flexneri 2a str. 2457T
uauagaucagacgac

SEQ ID NO: 3856613 - RNA, 14 nt, Shigella flexneri 2a str. 2457T
uauagauuuacuau

SEQ ID NO: 3856614 - RNA, 19 nt, Shigella flexneri 2a str. 2457T
uauagauuuacuauuauuu

SEQ ID NO: 3856615 - RNA, 13 nt, Shigella flexneri 2a str. 2457T
uauagcauagcgu

SEQ ID NO: 3856616 - RNA, 15 nt, Shigella flexneri 2a str. 2457T
uauagcaucauaaga

SEQ ID NO: 3856617 - RNA, 18 nt, Shigella flexneri 2a str. 2457T
uauagcgaccauacagca

SEQ ID NO: 3856618 - RNA, 20 nt, Shigella flexneri 2a str. 2457T
uauagcgcugaauuaguguu

SEQ ID NO: 3856619 - RNA, 17 nt, Shigella flexneri 2a str. 2457T
uauagcggggaacauca

SEQ ID NO: 3856620 - RNA, 16 nt, Shigella flexneri 2a str. 2457T
uauagcuggauuuuca

SEQ ID NO: 3856621 - RNA, 15 nt, Shigella flexneri 2a str. 2457T
uauauaauaugcauu

SEQ ID NO: 3856622 - RNA, 13 nt, Shigella flexneri 2a str. 2457T
uauauaauuaaaa

SEQ ID NO: 3856623 - RNA, 15 nt, Shigella flexneri 2a str. 2457T
uauauaauuaaaaau

SEQ ID NO: 3856624 - RNA, 14 nt, Shigella flexneri 2a str. 2457T
uauaucccauuuuu

SEQ ID NO: 3856625 - RNA, 17 nt, Shigella flexneri 2a str. 2457T
uauaucccauuuuugaa

SEQ ID NO: 3856626 - RNA, 17 nt, Shigella flexneri 2a str. 2457T
uauauccgaaaaaggau

SEQ ID NO: 3856627 - RNA, 22 nt, Shigella flexneri 2a str. 2457T
uauaucugacgccgccgguguc

SEQ ID NO: 3856628 - RNA, 17 nt, Shigella flexneri 2a str. 2457T
uauaugacgcucgcgca

SEQ ID NO: 3856629 - RNA, 18 nt, Shigella flexneri 2a str. 2457T
uauaugauaauuauuaua

SEQ ID NO: 3856630 - RNA, 17 nt, Shigella flexneri 2a str. 2457T
uauaugaugaaacugau

SEQ ID NO: 3856631 - RNA, 21 nt, Shigella flexneri 2a str. 2457T
uauauggugagcgauauuuau

SEQ ID NO: 3856632 - RNA, 19 nt, Shigella flexneri 2a str. 2457T
uauauuacaacguauuaua

SEQ ID NO: 3856633 - RNA, 22 nt, Shigella flexneri 2a str. 2457T
uauauuacgagucacaaacauc

SEQ ID NO: 3856634 - RNA, 19 nt, Shigella flexneri 2a str. 2457T
uauauuccuuacucauaaa

SEQ ID NO: 3856635 - RNA, 22 nt, Shigella flexneri 2a str. 2457T
uauauugaauuagcaauauuuu

SEQ ID NO: 3856636 - RNA, 21 nt, Shigella flexneri 2a str. 2457T
uauauuuccccuguugcaaac

SEQ ID NO: 3856637 - RNA, 15 nt, Shigella flexneri 2a str. 2457T
uaucaaacccuucca

SEQ ID NO: 3856638 - RNA, 20 nt, Shigella flexneri 2a str. 2457T
uaucaaacgugacauucuga

SEQ ID NO: 3856639 - RNA, 15 nt, Shigella flexneri 2a str. 2457T
uaucaaacugaccuu

SEQ ID NO: 3856640 - RNA, 16 nt, Shigella flexneri 2a str. 2457T
uaucaaauucauugcg

SEQ ID NO: 3856641 - RNA, 13 nt, Shigella flexneri 2a str. 2457T
uaucaacaugaug

SEQ ID NO: 3856642 - RNA, 20 nt, Shigella flexneri 2a str. 2457T
uaucaagaucaucaaacuuu

SEQ ID NO: 3856643 - RNA, 23 nt, Shigella flexneri 2a str. 2457T
uaucaccaaugauaaguuucacu

SEQ ID NO: 3856644 - RNA, 23 nt, Shigella flexneri 2a str. 2457T
uaucaccuggagccaguuggcgu

SEQ ID NO: 3856645 - RNA, 19 nt, Shigella flexneri 2a str. 2457T
uaucacgaugcuaaaaaca

SEQ ID NO: 3856646 - RNA, 22 nt, Shigella flexneri 2a str. 2457T
uaucacgaugcuaaaaacauca

SEQ ID NO: 3856647 - RNA, 21 nt, Shigella flexneri 2a str. 2457T
uaucacucggggcuuuucucu

SEQ ID NO: 3856648 - RNA, 22 nt, Shigella flexneri 2a str. 2457T
uaucagacaaucugugugggca

SEQ ID NO: 3856649 - RNA, 14 nt, Shigella flexneri 2a str. 2457T
uaucagaccgcuuc

SEQ ID NO: 3856650 - RNA, 20 nt, Shigella flexneri 2a str. 2457T
uaucagagauaaccacguuc

SEQ ID NO: 3856651 - RNA, 17 nt, Shigella flexneri 2a str. 2457T
uaucagagauucuuuuc

SEQ ID NO: 3856652 - RNA, 14 nt, Shigella flexneri 2a str. 2457T
uaucagcaacucug

SEQ ID NO: 3856653 - RNA, 16 nt, Shigella flexneri 2a str. 2457T
uaucagcaacuggcaa

SEQ ID NO: 3856654 - RNA, 22 nt, Shigella flexneri 2a str. 2457T
uaucaggcaaaaaaaugcacau

SEQ ID NO: 3856655 - RNA, 20 nt, Shigella flexneri 2a str. 2457T
uaucaggccaauugaacucu

SEQ ID NO: 3856656 - RNA, 13 nt, Shigella flexneri 2a str. 2457T
uaucaggccaggu

SEQ ID NO: 3856657 - RNA, 14 nt, Shigella flexneri 2a str. 2457T
uaucaggccuacaa

SEQ ID NO: 3856658 - RNA, 21 nt, Shigella flexneri 2a str. 2457T
uaucaggccuacaaaaucuau

SEQ ID NO: 3856659 - RNA, 22 nt, Shigella flexneri 2a str. 2457T
uaucaggccuacauuuucuccg

SEQ ID NO: 3856660 - RNA, 22 nt, Shigella flexneri 2a str. 2457T
uaucaguauacgccacaucauu

SEQ ID NO: 3856661 - RNA, 20 nt, Shigella flexneri 2a str. 2457T
uaucagugauauauuuuuaa

SEQ ID NO: 3856662 - RNA, 14 nt, Shigella flexneri 2a str. 2457T
uaucaguucagaag

SEQ ID NO: 3856663 - RNA, 21 nt, Shigella flexneri 2a str. 2457T
uaucaguuggggaaaaguugg

SEQ ID NO: 3856664 - RNA, 23 nt, Shigella flexneri 2a str. 2457T
uaucaguuucagccuuaaagaua

SEQ ID NO: 3856665 - RNA, 13 nt, Shigella flexneri 2a str. 2457T
uaucaucauuauu

SEQ ID NO: 3856666 - RNA, 15 nt, Shigella flexneri 2a str. 2457T
uaucaucauuugcau

SEQ ID NO: 3856667 - RNA, 21 nt, Shigella flexneri 2a str. 2457T
uaucaucauuugcauacccag

SEQ ID NO: 3856668 - RNA, 20 nt, Shigella flexneri 2a str. 2457T
uaucaucggucagcgcagug

SEQ ID NO: 3856669 - RNA, 19 nt, Shigella flexneri 2a str. 2457T
uaucaugcuggauggcgca

SEQ ID NO: 3856670 - RNA, 16 nt, Shigella flexneri 2a str. 2457T
uaucauucgacaacug

SEQ ID NO: 3856671 - RNA, 19 nt, Shigella flexneri 2a str. 2457T
uaucauugccgguuggcga

SEQ ID NO: 3856672 - RNA, 15 nt, Shigella flexneri 2a str. 2457T
uaucauuuugcugcc

SEQ ID NO: 3856673 - RNA, 16 nt, Shigella flexneri 2a str. 2457T
uaucauuuugcugcca

SEQ ID NO: 3856674 - RNA, 20 nt, Shigella flexneri 2a str. 2457T
uauccaccgggguaaaucca

SEQ ID NO: 3856675 - RNA, 21 nt, Shigella flexneri 2a str. 2457T
uauccacgcgauacuuuuuca

SEQ ID NO: 3856676 - RNA, 14 nt, Shigella flexneri 2a str. 2457T
uauccacugucaaa

SEQ ID NO: 3856677 - RNA, 20 nt, Shigella flexneri 2a str. 2457T
uauccaggcuaauccagucu

SEQ ID NO: 3856678 - RNA, 19 nt, Shigella flexneri 2a str. 2457T
uauccauauggcugcauuc

SEQ ID NO: 3856679 - RNA, 20 nt, Shigella flexneri 2a str. 2457T
uauccaucaaagguuuuuca

SEQ ID NO: 3856680 - RNA, 20 nt, Shigella flexneri 2a str. 2457T
uauccauuugugacauuaac

SEQ ID NO: 3856681 - RNA, 22 nt, Shigella flexneri 2a str. 2457T
uaucccauuuuugaauggaucu

SEQ ID NO: 3856682 - RNA, 19 nt, Shigella flexneri 2a str. 2457T
uaucccgcgcguuuuucuu

SEQ ID NO: 3856683 - RNA, 16 nt, Shigella flexneri 2a str. 2457T
uaucccugcuguccug

SEQ ID NO: 3856684 - RNA, 13 nt, Shigella flexneri 2a str. 2457T
uaugcgccagacu

SEQ ID NO: 3856685 - RNA, 15 nt, Shigella flexneri 2a str. 2457T
uaugcgccuuuacca

SEQ ID NO: 3856686 - RNA, 16 nt, Shigella flexneri 2a str. 2457T
uaugcgccuuucgcuu

SEQ ID NO: 3856687 - RNA, 15 nt, Shigella flexneri 2a str. 2457T
uaugcugcgccaguu

SEQ ID NO: 3856688 - RNA, 15 nt, Shigella flexneri 2a str. 2457T
uaugcuuugccguca

SEQ ID NO: 3856689 - RNA, 19 nt, Shigella flexneri 2a str. 2457T
uauggaaaaguugcuuugg

SEQ ID NO: 3856690 - RNA, 15 nt, Shigella flexneri 2a str. 2457T
uauggagcaggaaua

SEQ ID NO: 3856691 - RNA, 14 nt, Shigella flexneri 2a str. 2457T
uauggcaccuguug

SEQ ID NO: 3856692 - RNA, 17 nt, Shigella flexneri 2a str. 2457T
uauggcaccuguugcca

SEQ ID NO: 3856693 - RNA, 14 nt, Shigella flexneri 2a str. 2457T
uauggcauugucug

SEQ ID NO: 3856694 - RNA, 20 nt, Shigella flexneri 2a str. 2457T
uaugggcgaauaaaaagccu

SEQ ID NO: 3856695 - RNA, 21 nt, Shigella flexneri 2a str. 2457T
uaugggcgaauaaaaagccua

SEQ ID NO: 3856696 - RNA, 20 nt, Shigella flexneri 2a str. 2457T
uaugggguggaacggugaaa

SEQ ID NO: 3856697 - RNA, 18 nt, Shigella flexneri 2a str. 2457T
uauggugaaaguaaaaaa

SEQ ID NO: 3856698 - RNA, 17 nt, Shigella flexneri 2a str. 2457T
uaugguuagagaacaac

SEQ ID NO: 3856699 - RNA, 21 nt, Shigella flexneri 2a str. 2457T
uaugguugccgggcuggagag

SEQ ID NO: 3856700 - RNA, 13 nt, Shigella flexneri 2a str. 2457T
uauguaccgucau

SEQ ID NO: 3856701 - RNA, 14 nt, Shigella flexneri 2a str. 2457T
uaugucauuaaccg

SEQ ID NO: 3856702 - RNA, 18 nt, Shigella flexneri 2a str. 2457T
uaugucuggcgagcucca

SEQ ID NO: 3856703 - RNA, 22 nt, Shigella flexneri 2a str. 2457T
uaugugaucuuuaucacacaga

SEQ ID NO: 3856704 - RNA, 18 nt, Shigella flexneri 2a str. 2457T
uaugugcuucuaccauga

SEQ ID NO: 3856705 - RNA, 22 nt, Shigella flexneri 2a str. 2457T
uauguucagauaaugcccgaug

SEQ ID NO: 3856706 - RNA, 23 nt, Shigella flexneri 2a str. 2457T
uauguucagccgucauccaggaa

SEQ ID NO: 3856707 - RNA, 13 nt, Shigella flexneri 2a str. 2457T
uauguuccccuca

SEQ ID NO: 3856708 - RNA, 15 nt, Shigella flexneri 2a str. 2457T
uauguugugcaucgg

SEQ ID NO: 3856709 - RNA, 13 nt, Shigella flexneri 2a str. 2457T
uauguuuaucagg

SEQ ID NO: 3856710 - RNA, 15 nt, Shigella flexneri 2a str. 2457T
uauguuuauuagccc

SEQ ID NO: 3856711 - RNA, 23 nt, Shigella flexneri 2a str. 2457T
uauuaaaagcguugcggcuauau

SEQ ID NO: 3856712 - RNA, 15 nt, Shigella flexneri 2a str. 2457T
uauuaaauuugcuuu

SEQ ID NO: 3856713 - RNA, 21 nt, Shigella flexneri 2a str. 2457T
uauuaacccgcaacagcaaua

SEQ ID NO: 3856714 - RNA, 18 nt, Shigella flexneri 2a str. 2457T
uauuaaccuggucgcuga

SEQ ID NO: 3856715 - RNA, 18 nt, Shigella flexneri 2a str. 2457T
uauuaacgaacucuuugc

SEQ ID NO: 3856716 - RNA, 17 nt, Shigella flexneri 2a str. 2457T
uauuaacuuaauaaaca

SEQ ID NO: 3856717 - RNA, 22 nt, Shigella flexneri 2a str. 2457T
uauuaauccagggaucaacauu

SEQ ID NO: 3856718 - RNA, 15 nt, Shigella flexneri 2a str. 2457T
uauuaauucuaaaac

SEQ ID NO: 3856719 - RNA, 23 nt, Shigella flexneri 2a str. 2457T
uauuaccgaugugaacccugauu

SEQ ID NO: 3856720 - RNA, 16 nt, Shigella flexneri 2a str. 2457T
uauuacgaauauaaau

SEQ ID NO: 3856721 - RNA, 15 nt, Shigella flexneri 2a str. 2457T
uauuacguuccuuua

SEQ ID NO: 3856722 - RNA, 22 nt, Shigella flexneri 2a str. 2457T
uauuacugagauggcuucaucc

SEQ ID NO: 3856723 - RNA, 17 nt, Shigella flexneri 2a str. 2457T
uauuaguggcaaccaca

SEQ ID NO: 3856724 - RNA, 14 nt, Shigella flexneri 2a str. 2457T
uauuauauauaauu

SEQ ID NO: 3856725 - RNA, 15 nt, Shigella flexneri 2a str. 2457T
uauuaucggcaccau

SEQ ID NO: 3856726 - RNA, 16 nt, Shigella flexneri 2a str. 2457T
uauuaucggcaccauu

SEQ ID NO: 3856727 - RNA, 13 nt, Shigella flexneri 2a str. 2457T
uauuaucuaucgc

SEQ ID NO: 3856728 - RNA, 21 nt, Shigella flexneri 2a str. 2457T
uauuaugcgaccauaugaaua

SEQ ID NO: 3856729 - RNA, 13 nt, Shigella flexneri 2a str. 2457T
uauuauuauuuuu

SEQ ID NO: 3856730 - RNA, 18 nt, Shigella flexneri 2a str. 2457T
uauuauucauaaugccca

SEQ ID NO: 3856731 - RNA, 12 nt, Shigella flexneri 2a str. 2457T
uauuauugaaau

SEQ ID NO: 3856732 - RNA, 15 nt, Shigella flexneri 2a str. 2457T
uauucaaaggcucca

SEQ ID NO: 3856733 - RNA, 21 nt, Shigella flexneri 2a str. 2457T
uauucagcaauucucucuuca

SEQ ID NO: 3856734 - RNA, 11 nt, Shigella flexneri 2a str. 2457T
uauucagcaga

SEQ ID NO: 3856735 - RNA, 14 nt, Shigella flexneri 2a str. 2457T
uauucagcagcaga

SEQ ID NO: 3856736 - RNA, 14 nt, Shigella flexneri 2a str. 2457T
uauucagcaugcau

SEQ ID NO: 3856737 - RNA, 15 nt, Shigella flexneri 2a str. 2457T
uauucagcuggcagu

SEQ ID NO: 3856738 - RNA, 13 nt, Shigella flexneri 2a str. 2457T
uauucagcuuauu

SEQ ID NO: 3856739 - RNA, 21 nt, Shigella flexneri 2a str. 2457T
uauucaggcguugaaaaauca

SEQ ID NO: 3856740 - RNA, 23 nt, Shigella flexneri 2a str. 2457T
uauucaguggcauuuagaucuau

SEQ ID NO: 3856741 - RNA, 19 nt, Shigella flexneri 2a str. 2457T
uauucaucaauagcaacug

SEQ ID NO: 3856742 - RNA, 21 nt, Shigella flexneri 2a str. 2457T
uauucauucgcucaggaaaag

SEQ ID NO: 3856743 - RNA, 14 nt, Shigella flexneri 2a str. 2457T
uauucauugacuua

SEQ ID NO: 3856744 - RNA, 18 nt, Shigella flexneri 2a str. 2457T
uauucauuguucucccau

SEQ ID NO: 3856745 - RNA, 14 nt, Shigella flexneri 2a str. 2457T
uauuccauccugcu

SEQ ID NO: 3856746 - RNA, 12 nt, Shigella flexneri 2a str. 2457T
uauuccccagac

SEQ ID NO: 3856747 - RNA, 14 nt, Shigella flexneri 2a str. 2457T
uauucccuugcucu

SEQ ID NO: 3856748 - RNA, 12 nt, Shigella flexneri 2a str. 2457T
uauuccguuacu

SEQ ID NO: 3856749 - RNA, 17 nt, Shigella flexneri 2a str. 2457T
uauuccucguaguucuu

SEQ ID NO: 3856750 - RNA, 14 nt, Shigella flexneri 2a str. 2457T
uauuccuuaugguu

SEQ ID NO: 3856751 - RNA, 17 nt, Shigella flexneri 2a str. 2457T
uauuccuuaugguucac

SEQ ID NO: 3856752 - RNA, 16 nt, Shigella flexneri 2a str. 2457T
uauucgacaccaucuu

SEQ ID NO: 3856753 - RNA, 21 nt, Shigella flexneri 2a str. 2457T
uauucgugcggcacaagaaaa

SEQ ID NO: 3856754 - RNA, 15 nt, Shigella flexneri 2a str. 2457T
uauucucaaaauaca

SEQ ID NO: 3856755 - RNA, 17 nt, Shigella flexneri 2a str. 2457T
uauucugggaacuauau

SEQ ID NO: 3856756 - RNA, 17 nt, Shigella flexneri 2a str. 2457T
uauucuuacuucaacac

SEQ ID NO: 3856757 - RNA, 12 nt, Shigella flexneri 2a str. 2457T
uauucuuauaaa

SEQ ID NO: 3856758 - RNA, 16 nt, Shigella flexneri 2a str. 2457T
uauucuuauaaagaaa

SEQ ID NO: 3856759 - RNA, 15 nt, Shigella flexneri 2a str. 2457T
uauugaaaucacuaa

SEQ ID NO: 3856760 - RNA, 21 nt, Shigella flexneri 2a str. 2457T
uauugaagauguugccacacg

SEQ ID NO: 3856761 - RNA, 16 nt, Shigella flexneri 2a str. 2457T
uauugaagauuuugcu

SEQ ID NO: 3856762 - RNA, 12 nt, Shigella flexneri 2a str. 2457T
uauugaagcuca

SEQ ID NO: 3856763 - RNA, 19 nt, Shigella flexneri 2a str. 2457T
uauugaauuagcaauauuu

SEQ ID NO: 3856764 - RNA, 22 nt, Shigella flexneri 2a str. 2457T
uauugaauuuacgggccggaua

SEQ ID NO: 3856765 - RNA, 14 nt, Shigella flexneri 2a str. 2457T
uauugaugcucacu

SEQ ID NO: 3856766 - RNA, 21 nt, Shigella flexneri 2a str. 2457T
uauugauucaucucuucuucc

SEQ ID NO: 3856767 - RNA, 17 nt, Shigella flexneri 2a str. 2457T
uauugauuuucuuguca

SEQ ID NO: 3856768 - RNA, 21 nt, Shigella flexneri 2a str. 2457T
uauugcaucgcuugaaaaggu

SEQ ID NO: 3856769 - RNA, 22 nt, Shigella flexneri 2a str. 2457T
uauugcauuggguguaaacguu

SEQ ID NO: 3856770 - RNA, 22 nt, Shigella flexneri 2a str. 2457T
uauugccaucuaaauguauucu

SEQ ID NO: 3856771 - RNA, 13 nt, Shigella flexneri 2a str. 2457T
uauugccccacac

SEQ ID NO: 3856772 - RNA, 18 nt, Shigella flexneri 2a str. 2457T
uauugcgaaguauggaaa

SEQ ID NO: 3856773 - RNA, 16 nt, Shigella flexneri 2a str. 2457T
uauugcgcaaauguuu

SEQ ID NO: 3856774 - RNA, 21 nt, Shigella flexneri 2a str. 2457T
uauugcgcacaucaauuugcc

SEQ ID NO: 3856775 - RNA, 22 nt, Shigella flexneri 2a str. 2457T
uauugcuaugguccguucucac

SEQ ID NO: 3856776 - RNA, 17 nt, Shigella flexneri 2a str. 2457T
uauugcugaaauaacgu

SEQ ID NO: 3856777 - RNA, 15 nt, Shigella flexneri 2a str. 2457T
uauugcuucaccagc

SEQ ID NO: 3856778 - RNA, 16 nt, Shigella flexneri 2a str. 2457T
uauugcuuuaccgcau

SEQ ID NO: 3856779 - RNA, 13 nt, Shigella flexneri 2a str. 2457T
uauuguagacaac

SEQ ID NO: 3856780 - RNA, 13 nt, Shigella flexneri 2a str. 2457T
uauuguuaaauau

SEQ ID NO: 3856781 - RNA, 19 nt, Shigella flexneri 2a str. 2457T
uauuguuauucgccagacc

SEQ ID NO: 3856782 - RNA, 20 nt, Shigella flexneri 2a str. 2457T
ucaaagaugaugucacagcc

SEQ ID NO: 3856783 - RNA, 23 nt, Shigella flexneri 2a str. 2457T
ucaaagaugcaggaguagaacgg

SEQ ID NO: 3856784 - RNA, 20 nt, Shigella flexneri 2a str. 2457T
ucaaagauuguuggcaaaaa

SEQ ID NO: 3856785 - RNA, 23 nt, Shigella flexneri 2a str. 2457T
ucaaagauuguuggcaaaaaaau

SEQ ID NO: 3856786 - RNA, 15 nt, Shigella flexneri 2a str. 2457T
ucaaagccaggcaga

SEQ ID NO: 3856787 - RNA, 17 nt, Shigella flexneri 2a str. 2457T
ucaaagcgaucauguac

SEQ ID NO: 3856788 - RNA, 16 nt, Shigella flexneri 2a str. 2457T
ucaaaggccgacagca

SEQ ID NO: 3856789 - RNA, 20 nt, Shigella flexneri 2a str. 2457T
ucaaaggccuugaacaaaca

SEQ ID NO: 3856790 - RNA, 14 nt, Shigella flexneri 2a str. 2457T
ucaaaguaauauuc

SEQ ID NO: 3856791 - RNA, 19 nt, Shigella flexneri 2a str. 2457T
ucaaagucgagaugaaacu

SEQ ID NO: 3856792 - RNA, 18 nt, Shigella flexneri 2a str. 2457T
ucaaagucuccuuugcca

SEQ ID NO: 3856793 - RNA, 18 nt, Shigella flexneri 2a str. 2457T
ucaaaguguugcaggaaa

SEQ ID NO: 3856794 - RNA, 19 nt, Shigella flexneri 2a str. 2457T
ucaaaguguugcaggaaaa

SEQ ID NO: 3856795 - RNA, 22 nt, Shigella flexneri 2a str. 2457T
ucaaaguuugcaccucugcugc

SEQ ID NO: 3856796 - RNA, 16 nt, Shigella flexneri 2a str. 2457T
ucaaaguuuuuaugag

SEQ ID NO: 3856797 - RNA, 22 nt, Shigella flexneri 2a str. 2457T
ucaaauaaaaagguccuguaau

SEQ ID NO: 3856798 - RNA, 14 nt, Shigella flexneri 2a str. 2457T
ucaaauaucugccg

SEQ ID NO: 3856799 - RNA, 16 nt, Shigella flexneri 2a str. 2457T
ucaaaucacuaaaccc

SEQ ID NO: 3856800 - RNA, 21 nt, Shigella flexneri 2a str. 2457T
ucaaaucgaaaucaacauguu

SEQ ID NO: 3856801 - RNA, 23 nt, Shigella flexneri 2a str. 2457T
ucaaaucuuauaugaugaaacug

SEQ ID NO: 3856802 - RNA, 23 nt, Shigella flexneri 2a str. 2457T
ucaaauggcauccuugcuaacca

SEQ ID NO: 3856803 - RNA, 17 nt, Shigella flexneri 2a str. 2457T
ucaaauggcgcuuuaua

SEQ ID NO: 3856804 - RNA, 21 nt, Shigella flexneri 2a str. 2457T
ucaaauguugcguucaucagu

SEQ ID NO: 3856805 - RNA, 24 nt, Shigella flexneri 2a str. 2457T
ucaaauuacagcaccuuaugcggg

SEQ ID NO: 3856806 - RNA, 19 nt, Shigella flexneri 2a str. 2457T
ucaaauuacgauccaccac

SEQ ID NO: 3856807 - RNA, 13 nt, Shigella flexneri 2a str. 2457T
ucaaauucauugu

SEQ ID NO: 3856808 - RNA, 22 nt, Shigella flexneri 2a str. 2457T
ucaaauuugucgccaacuucau

SEQ ID NO: 3856809 - RNA, 23 nt, Shigella flexneri 2a str. 2457T
ucaaauuugucgccaacuucaug

SEQ ID NO: 3856810 - RNA, 18 nt, Shigella flexneri 2a str. 2457T
ucaacaaaauagaauccg

SEQ ID NO: 3856811 - RNA, 21 nt, Shigella flexneri 2a str. 2457T
ucaacaaaauagaauccgcga

SEQ ID NO: 3856812 - RNA, 13 nt, Shigella flexneri 2a str. 2457T
ucaacaaaccaaa

SEQ ID NO: 3856813 - RNA, 19 nt, Shigella flexneri 2a str. 2457T
ucaacaaaguugcacacuu

SEQ ID NO: 3856814 - RNA, 16 nt, Shigella flexneri 2a str. 2457T
ucaacaacaauuucac

SEQ ID NO: 3856815 - RNA, 13 nt, Shigella flexneri 2a str. 2457T
ucaacaacacucu

SEQ ID NO: 3856816 - RNA, 17 nt, Shigella flexneri 2a str. 2457T
ucaacaaccagaaggug

SEQ ID NO: 3856817 - RNA, 18 nt, Shigella flexneri 2a str. 2457T
ucaacaauacaaaugccu

SEQ ID NO: 3856818 - RNA, 16 nt, Shigella flexneri 2a str. 2457T
ucaacaauugaagaau

SEQ ID NO: 3856819 - RNA, 20 nt, Shigella flexneri 2a str. 2457T
ucaacacacugaauaaaaau

SEQ ID NO: 3856820 - RNA, 22 nt, Shigella flexneri 2a str. 2457T
ucaacacagugaugaaaacgaa

SEQ ID NO: 3856821 - RNA, 12 nt, Shigella flexneri 2a str. 2457T
ucaacaccacug

SEQ ID NO: 3856822 - RNA, 17 nt, Shigella flexneri 2a str. 2457T
ucaacaccaugacaaau

SEQ ID NO: 3856823 - RNA, 19 nt, Shigella flexneri 2a str. 2457T
ucaacaccgggugcagaca

SEQ ID NO: 3856824 - RNA, 20 nt, Shigella flexneri 2a str. 2457T
ucaacaccuguugcgcgucg

SEQ ID NO: 3856825 - RNA, 18 nt, Shigella flexneri 2a str. 2457T
ucaacagauuacauuaaa

SEQ ID NO: 3856826 - RNA, 15 nt, Shigella flexneri 2a str. 2457T
ucaacagcaucaucg

SEQ ID NO: 3856827 - RNA, 18 nt, Shigella flexneri 2a str. 2457T
ucaacagggcagacauuc

SEQ ID NO: 3856828 - RNA, 18 nt, Shigella flexneri 2a str. 2457T
ucaacagguuuuguugcc

SEQ ID NO: 3856829 - RNA, 13 nt, Shigella flexneri 2a str. 2457T
ucaacaguucaug

SEQ ID NO: 3856830 - RNA, 20 nt, Shigella flexneri 2a str. 2457T
ucaacauaacgcaucccguu

SEQ ID NO: 3856831 - RNA, 16 nt, Shigella flexneri 2a str. 2457T
ucaacauacaaauagc

SEQ ID NO: 3856832 - RNA, 21 nt, Shigella flexneri 2a str. 2457T
ucaacauacaaauagccaauu

SEQ ID NO: 3856833 - RNA, 12 nt, Shigella flexneri 2a str. 2457T
ucaacauacgca

SEQ ID NO: 3856834 - RNA, 12 nt, Shigella flexneri 2a str. 2457T
ucaacaucaucu

SEQ ID NO: 3856835 - RNA, 14 nt, Shigella flexneri 2a str. 2457T
ucaacaucgcguug

SEQ ID NO: 3856836 - RNA, 14 nt, Shigella flexneri 2a str. 2457T
ucaacaugaaaaua

SEQ ID NO: 3856837 - RNA, 15 nt, Shigella flexneri 2a str. 2457T
ucaacaugaaaauaa

SEQ ID NO: 3856838 - RNA, 15 nt, Shigella flexneri 2a str. 2457T
ucaacauggacgcaa

SEQ ID NO: 3856839 - RNA, 20 nt, Shigella flexneri 2a str. 2457T
ucaacauguuccugccaguc

SEQ ID NO: 3856840 - RNA, 21 nt, Shigella flexneri 2a str. 2457T
ucaacauucccugcaccggug

SEQ ID NO: 3856841 - RNA, 18 nt, Shigella flexneri 2a str. 2457T
ucaacauuucccccuucc

SEQ ID NO: 3856842 - RNA, 15 nt, Shigella flexneri 2a str. 2457T
ucaaccaacgcaccg

SEQ ID NO: 3856843 - RNA, 19 nt, Shigella flexneri 2a str. 2457T
ucaaccaccggcaccacuu

SEQ ID NO: 3856844 - RNA, 22 nt, Shigella flexneri 2a str. 2457T
ucaaccacuacgugaucgucuu

SEQ ID NO: 3856845 - RNA, 13 nt, Shigella flexneri 2a str. 2457T
ucaaccagcacuu

SEQ ID NO: 3856846 - RNA, 23 nt, Shigella flexneri 2a str. 2457T
ucaaccauaucgcauaccaucca

SEQ ID NO: 3856847 - RNA, 13 nt, Shigella flexneri 2a str. 2457T
ucaacccauuucg

SEQ ID NO: 3856848 - RNA, 17 nt, Shigella flexneri 2a str. 2457T
ucaacccgcacagucac

SEQ ID NO: 3856849 - RNA, 13 nt, Shigella flexneri 2a str. 2457T
ucaacccgcccag

SEQ ID NO: 3856850 - RNA, 19 nt, Shigella flexneri 2a str. 2457T
ucaacccuuuuuuaaacau

SEQ ID NO: 3856851 - RNA, 23 nt, Shigella flexneri 2a str. 2457T
ucaaccgagagggcuuuuucaau

SEQ ID NO: 3856852 - RNA, 17 nt, Shigella flexneri 2a str. 2457T
ucaaccgcagugauuuc

SEQ ID NO: 3856853 - RNA, 19 nt, Shigella flexneri 2a str. 2457T
ucaaccgcgccugaccauu

SEQ ID NO: 3856854 - RNA, 21 nt, Shigella flexneri 2a str. 2457T
ucaaccgugacguaugaaaau

SEQ ID NO: 3856855 - RNA, 20 nt, Shigella flexneri 2a str. 2457T
ucaaccugaucgugccagga

SEQ ID NO: 3856856 - RNA, 19 nt, Shigella flexneri 2a str. 2457T
ucaaccugugcgccaggau

SEQ ID NO: 3856857 - RNA, 14 nt, Shigella flexneri 2a str. 2457T
ucaacgaagaaaac

SEQ ID NO: 3856858 - RNA, 13 nt, Shigella flexneri 2a str. 2457T
ucaacgacagccu

SEQ ID NO: 3856859 - RNA, 22 nt, Shigella flexneri 2a str. 2457T
ucaacgacccagccagacgcca

SEQ ID NO: 3856860 - RNA, 16 nt, Shigella flexneri 2a str. 2457T
ucaacgaugccuuaug

SEQ ID NO: 3856861 - RNA, 15 nt, Shigella flexneri 2a str. 2457T
ucaacgccaucgcca

SEQ ID NO: 3856862 - RNA, 16 nt, Shigella flexneri 2a str. 2457T
ucaacgccgcuaucag

SEQ ID NO: 3856863 - RNA, 23 nt, Shigella flexneri 2a str. 2457T
ucaacgcucaggccgauuucaug

SEQ ID NO: 3856864 - RNA, 18 nt, Shigella flexneri 2a str. 2457T
ucaacggcaucguccauu

SEQ ID NO: 3856865 - RNA, 19 nt, Shigella flexneri 2a str. 2457T
ucaacguacucugccacua

SEQ ID NO: 3856866 - RNA, 18 nt, Shigella flexneri 2a str. 2457T
ucaacguaguaucguaau

SEQ ID NO: 3856867 - RNA, 18 nt, Shigella flexneri 2a str. 2457T
ucaacgucaaaagaugcg

SEQ ID NO: 3856868 - RNA, 17 nt, Shigella flexneri 2a str. 2457T
ucaacgucacuggguuc

SEQ ID NO: 3856869 - RNA, 16 nt, Shigella flexneri 2a str. 2457T
ucaacgucugcgccuu

SEQ ID NO: 3856870 - RNA, 17 nt, Shigella flexneri 2a str. 2457T
ucaacgugucuuuuacu

SEQ ID NO: 3856871 - RNA, 19 nt, Shigella flexneri 2a str. 2457T
ucaacguuauucgcuuccu

SEQ ID NO: 3856872 - RNA, 15 nt, Shigella flexneri 2a str. 2457T
ucaacguugaauuuc

SEQ ID NO: 3856873 - RNA, 18 nt, Shigella flexneri 2a str. 2457T
ucaacguugaauuucagg

SEQ ID NO: 3856874 - RNA, 22 nt, Shigella flexneri 2a str. 2457T
ucaacguuuacccaauccccca

SEQ ID NO: 3856875 - RNA, 23 nt, Shigella flexneri 2a str. 2457T
ucaacuccccgcauuuacucuca

SEQ ID NO: 3856876 - RNA, 16 nt, Shigella flexneri 2a str. 2457T
ucaacuucagcagcag

SEQ ID NO: 3856877 - RNA, 16 nt, Shigella flexneri 2a str. 2457T
ucaacuuuaccuucau

SEQ ID NO: 3856878 - RNA, 23 nt, Shigella flexneri 2a str. 2457T
ucaacuuuaccuucauccuggua

SEQ ID NO: 3856879 - RNA, 20 nt, Shigella flexneri 2a str. 2457T
ucacaauggcacaaauggca

SEQ ID NO: 3856880 - RNA, 17 nt, Shigella flexneri 2a str. 2457T
ucacaauucaucaucag

SEQ ID NO: 3856881 - RNA, 12 nt, Shigella flexneri 2a str. 2457T
ucacacacaucg

SEQ ID NO: 3856882 - RNA, 15 nt, Shigella flexneri 2a str. 2457T
ucacacagugaaucu

SEQ ID NO: 3856883 - RNA, 17 nt, Shigella flexneri 2a str. 2457T
ucacaccacagcagcca

SEQ ID NO: 3856884 - RNA, 23 nt, Shigella flexneri 2a str. 2457T
ucacaccaucaaagaagcucuuu

SEQ ID NO: 3856885 - RNA, 15 nt, Shigella flexneri 2a str. 2457T
ucacaccauugagga

SEQ ID NO: 3856886 - RNA, 20 nt, Shigella flexneri 2a str. 2457T
ucacaccauugauaauccau

SEQ ID NO: 3856887 - RNA, 21 nt, Shigella flexneri 2a str. 2457T
ucacaccauugauaauccauc

SEQ ID NO: 3856888 - RNA, 22 nt, Shigella flexneri 2a str. 2457T
ucacaccauugauaauccauca

SEQ ID NO: 3856889 - RNA, 18 nt, Shigella flexneri 2a str. 2457T
ucacacccgguaucaaac

SEQ ID NO: 3856890 - RNA, 19 nt, Shigella flexneri 2a str. 2457T
ucacacccgguaucaaacc

SEQ ID NO: 3856891 - RNA, 18 nt, Shigella flexneri 2a str. 2457T
ucacaccgcgaucuucca

SEQ ID NO: 3856892 - RNA, 18 nt, Shigella flexneri 2a str. 2457T
ucacaccgcgcgucccug

SEQ ID NO: 3856893 - RNA, 18 nt, Shigella flexneri 2a str. 2457T
ucacaccugcucagcccg

SEQ ID NO: 3856894 - RNA, 20 nt, Shigella flexneri 2a str. 2457T
ucacaccuuauuuacauccc

SEQ ID NO: 3856895 - RNA, 16 nt, Shigella flexneri 2a str. 2457T
ucacagaaggccagga

SEQ ID NO: 3856896 - RNA, 17 nt, Shigella flexneri 2a str. 2457T
ucacagaaggccaggau

SEQ ID NO: 3856897 - RNA, 18 nt, Shigella flexneri 2a str. 2457T
ucacagaggggaaguuuu

SEQ ID NO: 3856898 - RNA, 20 nt, Shigella flexneri 2a str. 2457T
ucacagcgagccuggcugga

SEQ ID NO: 3856899 - RNA, 16 nt, Shigella flexneri 2a str. 2457T
ucacagcggcuuccac

SEQ ID NO: 3856900 - RNA, 20 nt, Shigella flexneri 2a str. 2457T
ucacagcuaaucaucaucag

SEQ ID NO: 3856901 - RNA, 22 nt, Shigella flexneri 2a str. 2457T
ucacagcuaaucaucaucagug

SEQ ID NO: 3856902 - RNA, 17 nt, Shigella flexneri 2a str. 2457T
ucacaggcacaccgccg

SEQ ID NO: 3856903 - RNA, 20 nt, Shigella flexneri 2a str. 2457T
ucacaggguggcccaaaugg

SEQ ID NO: 3856904 - RNA, 22 nt, Shigella flexneri 2a str. 2457T
ucacaguaaugauuuaaaacca

SEQ ID NO: 3856905 - RNA, 10 nt, Shigella flexneri 2a str. 2457T
ucacagugaa

SEQ ID NO: 3856906 - RNA, 17 nt, Shigella flexneri 2a str. 2457T
ucacauaacggcccggc

SEQ ID NO: 3856907 - RNA, 14 nt, Shigella flexneri 2a str. 2457T
ucacauaacugccu

SEQ ID NO: 3856908 - RNA, 19 nt, Shigella flexneri 2a str. 2457T
ucacauaaucgaaaacauc

SEQ ID NO: 3856909 - RNA, 15 nt, Shigella flexneri 2a str. 2457T
ucacauauugcagcu

SEQ ID NO: 3856910 - RNA, 15 nt, Shigella flexneri 2a str. 2457T
ucacaucaaaucccc

SEQ ID NO: 3856911 - RNA, 14 nt, Shigella flexneri 2a str. 2457T
ucacaucaccaaca

SEQ ID NO: 3856912 - RNA, 15 nt, Shigella flexneri 2a str. 2457T
ucacaucaccauagc

SEQ ID NO: 3856913 - RNA, 23 nt, Shigella flexneri 2a str. 2457T
ucacaucagcgcauuuaccaggc

SEQ ID NO: 3856914 - RNA, 20 nt, Shigella flexneri 2a str. 2457T
ucacaucaucaucgccaggc

SEQ ID NO: 3856915 - RNA, 13 nt, Shigella flexneri 2a str. 2457T
ucacaucccagca

SEQ ID NO: 3856916 - RNA, 14 nt, Shigella flexneri 2a str. 2457T
ucacaucgcuaccg

SEQ ID NO: 3856917 - RNA, 17 nt, Shigella flexneri 2a str. 2457T
ucacaugaguugcugga

SEQ ID NO: 3856918 - RNA, 22 nt, Shigella flexneri 2a str. 2457T
ucacaugcuggaaccacagcgc

SEQ ID NO: 3856919 - RNA, 16 nt, Shigella flexneri 2a str. 2457T
ucacauuuaaacaauu

SEQ ID NO: 3856920 - RNA, 17 nt, Shigella flexneri 2a str. 2457T
ucacauuuuuagcagac

SEQ ID NO: 3856921 - RNA, 12 nt, Shigella flexneri 2a str. 2457T
ucaccaaaggca

SEQ ID NO: 3856922 - RNA, 16 nt, Shigella flexneri 2a str. 2457T
ucaccaaucagaaagg

SEQ ID NO: 3856923 - RNA, 19 nt, Shigella flexneri 2a str. 2457T
ucaccaaucggcagaacgg

SEQ ID NO: 3856924 - RNA, 14 nt, Shigella flexneri 2a str. 2457T
ucaccaaugaaagc

SEQ ID NO: 3856925 - RNA, 22 nt, Shigella flexneri 2a str. 2457T
ucaccaaugaaagccccaccag

SEQ ID NO: 3856926 - RNA, 23 nt, Shigella flexneri 2a str. 2457T
ucaccaaugaaagccccaccagc

SEQ ID NO: 3856927 - RNA, 21 nt, Shigella flexneri 2a str. 2457T
ucaccaaugauaaguuucacu

SEQ ID NO: 3856928 - RNA, 12 nt, Shigella flexneri 2a str. 2457T
ucaccacaucca

SEQ ID NO: 3856929 - RNA, 15 nt, Shigella flexneri 2a str. 2457T
ucaccaccagcaccg

SEQ ID NO: 3856930 - RNA, 22 nt, Shigella flexneri 2a str. 2457T
ucaccaccagcggaauaucaga

SEQ ID NO: 3856931 - RNA, 15 nt, Shigella flexneri 2a str. 2457T
ucaccaccuggguga

SEQ ID NO: 3856932 - RNA, 15 nt, Shigella flexneri 2a str. 2457T
ucaccacgaaaacag

SEQ ID NO: 3856933 - RNA, 23 nt, Shigella flexneri 2a str. 2457T
ucaccacgaaaacagcggccacu

SEQ ID NO: 3856934 - RNA, 20 nt, Shigella flexneri 2a str. 2457T
ucaccacgcugagagaagca

SEQ ID NO: 3856935 - RNA, 22 nt, Shigella flexneri 2a str. 2457T
ucaccacugacgggaaacucug

SEQ ID NO: 3856936 - RNA, 18 nt, Shigella flexneri 2a str. 2457T
ucaccacuucggcaaaaa

SEQ ID NO: 3856937 - RNA, 18 nt, Shigella flexneri 2a str. 2457T
ucaccagaaucaauccca

SEQ ID NO: 3856938 - RNA, 20 nt, Shigella flexneri 2a str. 2457T
ucaccagaaucaaucccauc

SEQ ID NO: 3856939 - RNA, 18 nt, Shigella flexneri 2a str. 2457T
ucaccagacaauggcccg

SEQ ID NO: 3856940 - RNA, 14 nt, Shigella flexneri 2a str. 2457T
ucaccagacaucaa

SEQ ID NO: 3856941 - RNA, 17 nt, Shigella flexneri 2a str. 2457T
ucaccagaugucccauc

SEQ ID NO: 3856942 - RNA, 20 nt, Shigella flexneri 2a str. 2457T
ucaccagcaaauccagcggu

SEQ ID NO: 3856943 - RNA, 12 nt, Shigella flexneri 2a str. 2457T
ucaccagcagcg

SEQ ID NO: 3856944 - RNA, 17 nt, Shigella flexneri 2a str. 2457T
ucaccagcaucagcgau

SEQ ID NO: 3856945 - RNA, 14 nt, Shigella flexneri 2a str. 2457T
ucaccagccugcaa

SEQ ID NO: 3856946 - RNA, 14 nt, Shigella flexneri 2a str. 2457T
ucaccagcgcauug

SEQ ID NO: 3856947 - RNA, 19 nt, Shigella flexneri 2a str. 2457T
ucaccagcgcauugacgau

SEQ ID NO: 3856948 - RNA, 20 nt, Shigella flexneri 2a str. 2457T
ucaccaguaaggcaucuucu

SEQ ID NO: 3856949 - RNA, 22 nt, Shigella flexneri 2a str. 2457T
ucaccaguuacaucggugccuu

SEQ ID NO: 3856950 - RNA, 23 nt, Shigella flexneri 2a str. 2457T
ucaccauaaaacgcgcuacugaa

SEQ ID NO: 3856951 - RNA, 23 nt, Shigella flexneri 2a str. 2457T
ucaccauaaagggaauaaauucg

SEQ ID NO: 3856952 - RNA, 14 nt, Shigella flexneri 2a str. 2457T
ucaccauccacgga

SEQ ID NO: 3856953 - RNA, 21 nt, Shigella flexneri 2a str. 2457T
ucaccauccacggacugaacg

SEQ ID NO: 3856954 - RNA, 14 nt, Shigella flexneri 2a str. 2457T
ucaccaucgccauu

SEQ ID NO: 3856955 - RNA, 14 nt, Shigella flexneri 2a str. 2457T
ucaccaucuucacu

SEQ ID NO: 3856956 - RNA, 20 nt, Shigella flexneri 2a str. 2457T
ucaccaucuucacuguccgc

SEQ ID NO: 3856957 - RNA, 19 nt, Shigella flexneri 2a str. 2457T
ucaccaucuugagaaaaac

SEQ ID NO: 3856958 - RNA, 23 nt, Shigella flexneri 2a str. 2457T
ucaccauucugcgcugacucuac

SEQ ID NO: 3856959 - RNA, 14 nt, Shigella flexneri 2a str. 2457T
ucaccauuggcauu

SEQ ID NO: 3856960 - RNA, 22 nt, Shigella flexneri 2a str. 2457T
ucaccauuggugauccgaggcc

SEQ ID NO: 3856961 - RNA, 13 nt, Shigella flexneri 2a str. 2457T
ucacccacacuuc

SEQ ID NO: 3856962 - RNA, 13 nt, Shigella flexneri 2a str. 2457T
ucacccacaucag

SEQ ID NO: 3856963 - RNA, 22 nt, Shigella flexneri 2a str. 2457T
ucacccacguuacgcgaucguc

SEQ ID NO: 3856964 - RNA, 20 nt, Shigella flexneri 2a str. 2457T
ucacccaucacuaccugauu

SEQ ID NO: 3856965 - RNA, 19 nt, Shigella flexneri 2a str. 2457T
ucaccccacaccaccguuu

SEQ ID NO: 3856966 - RNA, 15 nt, Shigella flexneri 2a str. 2457T
ucacccccguuaacc

SEQ ID NO: 3856967 - RNA, 22 nt, Shigella flexneri 2a str. 2457T
ucacccccguuaaccacuucag

SEQ ID NO: 3856968 - RNA, 20 nt, Shigella flexneri 2a str. 2457T
ucaccccuuucucgcccagc

SEQ ID NO: 3856969 - RNA, 13 nt, Shigella flexneri 2a str. 2457T
ucacccgcaauca

SEQ ID NO: 3856970 - RNA, 22 nt, Shigella flexneri 2a str. 2457T
ucacccggggugauaacgccug

SEQ ID NO: 3856971 - RNA, 23 nt, Shigella flexneri 2a str. 2457T
ucacccgugagaacugcugcauc

SEQ ID NO: 3856972 - RNA, 19 nt, Shigella flexneri 2a str. 2457T
ucacccugugcgccaccgc

SEQ ID NO: 3856973 - RNA, 22 nt, Shigella flexneri 2a str. 2457T
ucacccuuucguuaaauucuuc

SEQ ID NO: 3856974 - RNA, 23 nt, Shigella flexneri 2a str. 2457T
ucaccgaagacgugcgccacaac

SEQ ID NO: 3856975 - RNA, 20 nt, Shigella flexneri 2a str. 2457T
ucaccgagcagcacaaugcc

SEQ ID NO: 3856976 - RNA, 20 nt, Shigella flexneri 2a str. 2457T
ucacuggguucaaaaacuaa

SEQ ID NO: 3856977 - RNA, 18 nt, Shigella flexneri 2a str. 2457T
ucacugguagugcauccg

SEQ ID NO: 3856978 - RNA, 19 nt, Shigella flexneri 2a str. 2457T
ucacugugcuuuacaucag

SEQ ID NO: 3856979 - RNA, 21 nt, Shigella flexneri 2a str. 2457T
ucacuuaaucguucugugccg

SEQ ID NO: 3856980 - RNA, 20 nt, Shigella flexneri 2a str. 2457T
ucacuuaguagccagacaau

SEQ ID NO: 3856981 - RNA, 15 nt, Shigella flexneri 2a str. 2457T
ucacuucaaauuuaa

SEQ ID NO: 3856982 - RNA, 16 nt, Shigella flexneri 2a str. 2457T
ucacuuccggcaaggc

SEQ ID NO: 3856983 - RNA, 12 nt, Shigella flexneri 2a str. 2457T
ucacuuccucaa

SEQ ID NO: 3856984 - RNA, 18 nt, Shigella flexneri 2a str. 2457T
ucacuucgauccagugau

SEQ ID NO: 3856985 - RNA, 22 nt, Shigella flexneri 2a str. 2457T
ucacuucgauccagugauucca

SEQ ID NO: 3856986 - RNA, 23 nt, Shigella flexneri 2a str. 2457T
ucacuucgcuuacgccugccagc

SEQ ID NO: 3856987 - RNA, 23 nt, Shigella flexneri 2a str. 2457T
ucacuucugaguucggcaugggg

SEQ ID NO: 3856988 - RNA, 18 nt, Shigella flexneri 2a str. 2457T
ucacuuucgagcaauuuu

SEQ ID NO: 3856989 - RNA, 14 nt, Shigella flexneri 2a str. 2457T
ucacuuucuggcag

SEQ ID NO: 3856990 - RNA, 20 nt, Shigella flexneri 2a str. 2457T
ucacuuuuggugcuuuugcu

SEQ ID NO: 3856991 - RNA, 19 nt, Shigella flexneri 2a str. 2457T
ucagaaaaauacaauucuc

SEQ ID NO: 3856992 - RNA, 19 nt, Shigella flexneri 2a str. 2457T
ucagaaaaaucaauauuuu

SEQ ID NO: 3856993 - RNA, 17 nt, Shigella flexneri 2a str. 2457T
ucagaaacacacuuucc

SEQ ID NO: 3856994 - RNA, 21 nt, Shigella flexneri 2a str. 2457T
ucagaaagcccgaaucaguaa

SEQ ID NO: 3856995 - RNA, 19 nt, Shigella flexneri 2a str. 2457T
ucagaaaggcguuguccuu

SEQ ID NO: 3856996 - RNA, 17 nt, Shigella flexneri 2a str. 2457T
ucagaaaguaauaugug

SEQ ID NO: 3856997 - RNA, 21 nt, Shigella flexneri 2a str. 2457T
ucagaaaguaauuacacccuu

SEQ ID NO: 3856998 - RNA, 21 nt, Shigella flexneri 2a str. 2457T
ucagaaaguauauaaaaaaca

SEQ ID NO: 3856999 - RNA, 20 nt, Shigella flexneri 2a str. 2457T
ucagaaaugccaguaacuca

SEQ ID NO: 3857000 - RNA, 23 nt, Shigella flexneri 2a str. 2457T
ucagaaauuuggcuccucugacu

SEQ ID NO: 3857001 - RNA, 14 nt, Shigella flexneri 2a str. 2457T
ucagaacguaaacg

SEQ ID NO: 3857002 - RNA, 15 nt, Shigella flexneri 2a str. 2457T
ucagaagacgcucca

SEQ ID NO: 3857003 - RNA, 16 nt, Shigella flexneri 2a str. 2457T
ucagaagacgcuccag

SEQ ID NO: 3857004 - RNA, 13 nt, Shigella flexneri 2a str. 2457T
ucagaaggcagac

SEQ ID NO: 3857005 - RNA, 15 nt, Shigella flexneri 2a str. 2457T
ucagaaguugcaccc

SEQ ID NO: 3857006 - RNA, 13 nt, Shigella flexneri 2a str. 2457T
ucagaauacgcug

SEQ ID NO: 3857007 - RNA, 20 nt, Shigella flexneri 2a str. 2457T
ucagaauagacaaaaauucu

SEQ ID NO: 3857008 - RNA, 11 nt, Shigella flexneri 2a str. 2457T
ucagaaucagg

SEQ ID NO: 3857009 - RNA, 16 nt, Shigella flexneri 2a str. 2457T
ucagaaucgcgcccca

SEQ ID NO: 3857010 - RNA, 20 nt, Shigella flexneri 2a str. 2457T
ucagaaugcccacgccgcau

SEQ ID NO: 3857011 - RNA, 20 nt, Shigella flexneri 2a str. 2457T
ucagacaaaugucacugcuu

SEQ ID NO: 3857012 - RNA, 15 nt, Shigella flexneri 2a str. 2457T
ucagacacaauaauu

SEQ ID NO: 3857013 - RNA, 13 nt, Shigella flexneri 2a str. 2457T
ucagacaccaguc

SEQ ID NO: 3857014 - RNA, 16 nt, Shigella flexneri 2a str. 2457T
ucagaccaauccagcc

SEQ ID NO: 3857015 - RNA, 22 nt, Shigella flexneri 2a str. 2457T
ucagaccaauccagccggcaaa

SEQ ID NO: 3857016 - RNA, 23 nt, Shigella flexneri 2a str. 2457T
ucagaccgcuucugcguucugau

SEQ ID NO: 3857017 - RNA, 19 nt, Shigella flexneri 2a str. 2457T
ucagacggcugucuuccug

SEQ ID NO: 3857018 - RNA, 13 nt, Shigella flexneri 2a str. 2457T
ucagacguucuuc

SEQ ID NO: 3857019 - RNA, 19 nt, Shigella flexneri 2a str. 2457T
ucagacguucuuccugugg

SEQ ID NO: 3857020 - RNA, 20 nt, Shigella flexneri 2a str. 2457T
ucagacguugcauuucgucu

SEQ ID NO: 3857021 - RNA, 18 nt, Shigella flexneri 2a str. 2457T
ucagacucagucgcccag

SEQ ID NO: 3857022 - RNA, 17 nt, Shigella flexneri 2a str. 2457T
ucagacuuaagccuguu

SEQ ID NO: 3857023 - RNA, 14 nt, Shigella flexneri 2a str. 2457T
ucagagaagcaccg

SEQ ID NO: 3857024 - RNA, 13 nt, Shigella flexneri 2a str. 2457T
ucagagagccagc

SEQ ID NO: 3857025 - RNA, 17 nt, Shigella flexneri 2a str. 2457T
ucagagauucuuuuccu

SEQ ID NO: 3857026 - RNA, 18 nt, Shigella flexneri 2a str. 2457T
ucagagugccgaagaaca

SEQ ID NO: 3857027 - RNA, 12 nt, Shigella flexneri 2a str. 2457T
ucagauaaaaua

SEQ ID NO: 3857028 - RNA, 20 nt, Shigella flexneri 2a str. 2457T
ucagauaaaucacgcuucac

SEQ ID NO: 3857029 - RNA, 19 nt, Shigella flexneri 2a str. 2457T
ucagauaaaugcaaacgca

SEQ ID NO: 3857030 - RNA, 20 nt, Shigella flexneri 2a str. 2457T
ucagauaaaugcaaacgcau

SEQ ID NO: 3857031 - RNA, 18 nt, Shigella flexneri 2a str. 2457T
ucagauaauccccaauga

SEQ ID NO: 3857032 - RNA, 22 nt, Shigella flexneri 2a str. 2457T
ucagauaauccccaaugaccuu

SEQ ID NO: 3857033 - RNA, 17 nt, Shigella flexneri 2a str. 2457T
ucagaucagccacuucc

SEQ ID NO: 3857034 - RNA, 20 nt, Shigella flexneri 2a str. 2457T
ucagaucagccacuuccugc

SEQ ID NO: 3857035 - RNA, 15 nt, Shigella flexneri 2a str. 2457T
ucagaucauccugcg

SEQ ID NO: 3857036 - RNA, 20 nt, Shigella flexneri 2a str. 2457T
ucagaucccaauucauuccu

SEQ ID NO: 3857037 - RNA, 23 nt, Shigella flexneri 2a str. 2457T
ucagauccgccaguuuguagcca

SEQ ID NO: 3857038 - RNA, 17 nt, Shigella flexneri 2a str. 2457T
ucagaucguucgcacca

SEQ ID NO: 3857039 - RNA, 17 nt, Shigella flexneri 2a str. 2457T
ucagaugaugauacuga

SEQ ID NO: 3857040 - RNA, 23 nt, Shigella flexneri 2a str. 2457T
ucagaugaugauacugacauuaa

SEQ ID NO: 3857041 - RNA, 14 nt, Shigella flexneri 2a str. 2457T
ucagaugccugaug

SEQ ID NO: 3857042 - RNA, 16 nt, Shigella flexneri 2a str. 2457T
ucagaugcugcggcgg

SEQ ID NO: 3857043 - RNA, 16 nt, Shigella flexneri 2a str. 2457T
ucagauggcggcuggc

SEQ ID NO: 3857044 - RNA, 15 nt, Shigella flexneri 2a str. 2457T
ucagaugugcggugg

SEQ ID NO: 3857045 - RNA, 21 nt, Shigella flexneri 2a str. 2457T
ucagauguuccgccauuuuaa

SEQ ID NO: 3857046 - RNA, 15 nt, Shigella flexneri 2a str. 2457T
ucagauucaaauuau

SEQ ID NO: 3857047 - RNA, 16 nt, Shigella flexneri 2a str. 2457T
ucagauuguugauuaa

SEQ ID NO: 3857048 - RNA, 23 nt, Shigella flexneri 2a str. 2457T
ucagauuguugauuaacaggcug

SEQ ID NO: 3857049 - RNA, 14 nt, Shigella flexneri 2a str. 2457T
ucagcaaauccauc

SEQ ID NO: 3857050 - RNA, 20 nt, Shigella flexneri 2a str. 2457T
ucagcaacuggcaaaaacca

SEQ ID NO: 3857051 - RNA, 18 nt, Shigella flexneri 2a str. 2457T
ucagcaagugaauaaauu

SEQ ID NO: 3857052 - RNA, 24 nt, Shigella flexneri 2a str. 2457T
ucagcaauaaucagauggcggcug

SEQ ID NO: 3857053 - RNA, 18 nt, Shigella flexneri 2a str. 2457T
ucagcaaucgcgccagcc

SEQ ID NO: 3857054 - RNA, 13 nt, Shigella flexneri 2a str. 2457T
ucagcaaucucuu

SEQ ID NO: 3857055 - RNA, 19 nt, Shigella flexneri 2a str. 2457T
ucagcaaucugaagccgca

SEQ ID NO: 3857056 - RNA, 19 nt, Shigella flexneri 2a str. 2457T
ucagcacgacauaagcgca

SEQ ID NO: 3857057 - RNA, 22 nt, Shigella flexneri 2a str. 2457T
ucagcacuuaucucuuccgcau

SEQ ID NO: 3857058 - RNA, 22 nt, Shigella flexneri 2a str. 2457T
ucagcacuucacccaucgccag

SEQ ID NO: 3857059 - RNA, 21 nt, Shigella flexneri 2a str. 2457T
ucagcagacggccaaaaucuc

SEQ ID NO: 3857060 - RNA, 14 nt, Shigella flexneri 2a str. 2457T
ucagcagcaccacc

SEQ ID NO: 3857061 - RNA, 19 nt, Shigella flexneri 2a str. 2457T
ucagcagcagcaagauauu

SEQ ID NO: 3857062 - RNA, 20 nt, Shigella flexneri 2a str. 2457T
ucagcaggaauguuguccag

SEQ ID NO: 3857063 - RNA, 16 nt, Shigella flexneri 2a str. 2457T
ucagcaguucugccag

SEQ ID NO: 3857064 - RNA, 17 nt, Shigella flexneri 2a str. 2457T
ucagcauaaucaccagu

SEQ ID NO: 3857065 - RNA, 19 nt, Shigella flexneri 2a str. 2457T
ucagcauauaggaggccuc

SEQ ID NO: 3857066 - RNA, 13 nt, Shigella flexneri 2a str. 2457T
ucagcaucucauc

SEQ ID NO: 3857067 - RNA, 13 nt, Shigella flexneri 2a str. 2457T
ucagcaucuggaa

SEQ ID NO: 3857068 - RNA, 16 nt, Shigella flexneri 2a str. 2457T
ucagcaugacaaaaaa

SEQ ID NO: 3857069 - RNA, 17 nt, Shigella flexneri 2a str. 2457T
ucagcaugauucaccgu

SEQ ID NO: 3857070 - RNA, 23 nt, Shigella flexneri 2a str. 2457T
ucagcaugcauuuaagaaaaaag

SEQ ID NO: 3857071 - RNA, 15 nt, Shigella flexneri 2a str. 2457T
ucagcauuauuuuua

SEQ ID NO: 3857072 - RNA, 14 nt, Shigella flexneri 2a str. 2457T
ucagccaacgcauu

SEQ ID NO: 3857073 - RNA, 21 nt, Shigella flexneri 2a str. 2457T
ucagucacgacaaagacauca

SEQ ID NO: 3857074 - RNA, 13 nt, Shigella flexneri 2a str. 2457T
ucagucagcagug

SEQ ID NO: 3857075 - RNA, 16 nt, Shigella flexneri 2a str. 2457T
ucagucuagcccgaug

SEQ ID NO: 3857076 - RNA, 21 nt, Shigella flexneri 2a str. 2457T
ucagucucaaaccggcuccag

SEQ ID NO: 3857077 - RNA, 21 nt, Shigella flexneri 2a str. 2457T
ucagucucaagggaggaguca

SEQ ID NO: 3857078 - RNA, 14 nt, Shigella flexneri 2a str. 2457T
ucagugagcacauc

SEQ ID NO: 3857079 - RNA, 15 nt, Shigella flexneri 2a str. 2457T
ucagugagcacaucu

SEQ ID NO: 3857080 - RNA, 15 nt, Shigella flexneri 2a str. 2457T
ucagugaucgccugc

SEQ ID NO: 3857081 - RNA, 15 nt, Shigella flexneri 2a str. 2457T
ucagugcaaaugcca

SEQ ID NO: 3857082 - RNA, 17 nt, Shigella flexneri 2a str. 2457T
ucagugcaaaugccaga

SEQ ID NO: 3857083 - RNA, 22 nt, Shigella flexneri 2a str. 2457T
ucaguggaagacguugauucac

SEQ ID NO: 3857084 - RNA, 17 nt, Shigella flexneri 2a str. 2457T
ucaguggcuauuuacca

SEQ ID NO: 3857085 - RNA, 15 nt, Shigella flexneri 2a str. 2457T
ucagugggcgcugcu

SEQ ID NO: 3857086 - RNA, 18 nt, Shigella flexneri 2a str. 2457T
ucaguggguuaugaaacu

SEQ ID NO: 3857087 - RNA, 21 nt, Shigella flexneri 2a str. 2457T
ucaguggguuaugaaacucca

SEQ ID NO: 3857088 - RNA, 14 nt, Shigella flexneri 2a str. 2457T
ucagugucgcagua

SEQ ID NO: 3857089 - RNA, 13 nt, Shigella flexneri 2a str. 2457T
ucagugucuuauc

SEQ ID NO: 3857090 - RNA, 15 nt, Shigella flexneri 2a str. 2457T
ucagugucuuaucug

SEQ ID NO: 3857091 - RNA, 19 nt, Shigella flexneri 2a str. 2457T
ucaguguuggauggcggcu

SEQ ID NO: 3857092 - RNA, 20 nt, Shigella flexneri 2a str. 2457T
ucaguuaaucgcgaaauaac

SEQ ID NO: 3857093 - RNA, 14 nt, Shigella flexneri 2a str. 2457T
ucaguuaccugaau

SEQ ID NO: 3857094 - RNA, 22 nt, Shigella flexneri 2a str. 2457T
ucaguucagcgauauccagcga

SEQ ID NO: 3857095 - RNA, 14 nt, Shigella flexneri 2a str. 2457T
ucaguuccaguuca

SEQ ID NO: 3857096 - RNA, 15 nt, Shigella flexneri 2a str. 2457T
ucaguucuaccauca

SEQ ID NO: 3857097 - RNA, 16 nt, Shigella flexneri 2a str. 2457T
ucaguucuagaacuaa

SEQ ID NO: 3857098 - RNA, 21 nt, Shigella flexneri 2a str. 2457T
ucaguugcaccugauccagcu

SEQ ID NO: 3857099 - RNA, 16 nt, Shigella flexneri 2a str. 2457T
ucaguuggggaaaagu

SEQ ID NO: 3857100 - RNA, 20 nt, Shigella flexneri 2a str. 2457T
ucaguuggggaaaaguuggc

SEQ ID NO: 3857101 - RNA, 21 nt, Shigella flexneri 2a str. 2457T
ucaguuguucagaaugcccac

SEQ ID NO: 3857102 - RNA, 18 nt, Shigella flexneri 2a str. 2457T
ucaguuugcaaacccuga

SEQ ID NO: 3857103 - RNA, 16 nt, Shigella flexneri 2a str. 2457T
ucaguuuuacucuuuc

SEQ ID NO: 3857104 - RNA, 20 nt, Shigella flexneri 2a str. 2457T
ucaguuuuucacccgcaauc

SEQ ID NO: 3857105 - RNA, 21 nt, Shigella flexneri 2a str. 2457T
ucauaaacacgguuuuucauu

SEQ ID NO: 3857106 - RNA, 14 nt, Shigella flexneri 2a str. 2457T
ucauaaauacagag

SEQ ID NO: 3857107 - RNA, 18 nt, Shigella flexneri 2a str. 2457T
ucauaaauacagagcacg

SEQ ID NO: 3857108 - RNA, 17 nt, Shigella flexneri 2a str. 2457T
ucauaaauucaaagugu

SEQ ID NO: 3857109 - RNA, 15 nt, Shigella flexneri 2a str. 2457T
ucauaagacuuacca

SEQ ID NO: 3857110 - RNA, 17 nt, Shigella flexneri 2a str. 2457T
ucauaauaugaccugac

SEQ ID NO: 3857111 - RNA, 23 nt, Shigella flexneri 2a str. 2457T
ucauaaugauggggucacagguu

SEQ ID NO: 3857112 - RNA, 17 nt, Shigella flexneri 2a str. 2457T
ucauacaagcggaaacg

SEQ ID NO: 3857113 - RNA, 14 nt, Shigella flexneri 2a str. 2457T
ucauacacuucaca

SEQ ID NO: 3857114 - RNA, 21 nt, Shigella flexneri 2a str. 2457T
ucauacagaugcugcucuuca

SEQ ID NO: 3857115 - RNA, 16 nt, Shigella flexneri 2a str. 2457T
ucauacagccgguaca

SEQ ID NO: 3857116 - RNA, 18 nt, Shigella flexneri 2a str. 2457T
ucauacagcggacagcca

SEQ ID NO: 3857117 - RNA, 21 nt, Shigella flexneri 2a str. 2457T
ucauacaucgcgcuuaucgcc

SEQ ID NO: 3857118 - RNA, 14 nt, Shigella flexneri 2a str. 2457T
ucauaccugagugg

SEQ ID NO: 3857119 - RNA, 17 nt, Shigella flexneri 2a str. 2457T
ucauacgaacgccugcu

SEQ ID NO: 3857120 - RNA, 20 nt, Shigella flexneri 2a str. 2457T
ucauacgcguaaaacagcca

SEQ ID NO: 3857121 - RNA, 13 nt, Shigella flexneri 2a str. 2457T
ucauacugaacuu

SEQ ID NO: 3857122 - RNA, 24 nt, Shigella flexneri 2a str. 2457T
ucauacugccgaccaucuguucug

SEQ ID NO: 3857123 - RNA, 13 nt, Shigella flexneri 2a str. 2457T
ucauagaccauug

SEQ ID NO: 3857124 - RNA, 18 nt, Shigella flexneri 2a str. 2457T
ucauaggccgcugaugcc

SEQ ID NO: 3857125 - RNA, 22 nt, Shigella flexneri 2a str. 2457T
ucauagggugugacgacaccau

SEQ ID NO: 3857126 - RNA, 17 nt, Shigella flexneri 2a str. 2457T
ucauagguucuuuuaaa

SEQ ID NO: 3857127 - RNA, 14 nt, Shigella flexneri 2a str. 2457T
ucauaucacaaauu

SEQ ID NO: 3857128 - RNA, 16 nt, Shigella flexneri 2a str. 2457T
ucauaucacaaauucu

SEQ ID NO: 3857129 - RNA, 15 nt, Shigella flexneri 2a str. 2457T
ucauaugauucauau

SEQ ID NO: 3857130 - RNA, 14 nt, Shigella flexneri 2a str. 2457T
ucauauuaaauuuu

SEQ ID NO: 3857131 - RNA, 15 nt, Shigella flexneri 2a str. 2457T
ucauauuaucuaucg

SEQ ID NO: 3857132 - RNA, 12 nt, Shigella flexneri 2a str. 2457T
ucauauucacca

SEQ ID NO: 3857133 - RNA, 13 nt, Shigella flexneri 2a str. 2457T
ucauauucugaaa

SEQ ID NO: 3857134 - RNA, 14 nt, Shigella flexneri 2a str. 2457T
ucaucaaacgucuu

SEQ ID NO: 3857135 - RNA, 21 nt, Shigella flexneri 2a str. 2457T
ucaucaaauuacgauaaucag

SEQ ID NO: 3857136 - RNA, 13 nt, Shigella flexneri 2a str. 2457T
ucaucaacgccau

SEQ ID NO: 3857137 - RNA, 14 nt, Shigella flexneri 2a str. 2457T
ucaucaacguuuuu

SEQ ID NO: 3857138 - RNA, 22 nt, Shigella flexneri 2a str. 2457T
ucaucaacugacuauccuggac

SEQ ID NO: 3857139 - RNA, 15 nt, Shigella flexneri 2a str. 2457T
ucaucaacuggcaac

SEQ ID NO: 3857140 - RNA, 21 nt, Shigella flexneri 2a str. 2457T
ucaucaacuggcaaccagaag

SEQ ID NO: 3857141 - RNA, 19 nt, Shigella flexneri 2a str. 2457T
ucaucaagcuguucuuccc

SEQ ID NO: 3857142 - RNA, 13 nt, Shigella flexneri 2a str. 2457T
ucaucaauaccug

SEQ ID NO: 3857143 - RNA, 20 nt, Shigella flexneri 2a str. 2457T
ucaucaaucgcaaucuggca

SEQ ID NO: 3857144 - RNA, 18 nt, Shigella flexneri 2a str. 2457T
ucaucacaucccagcaga

SEQ ID NO: 3857145 - RNA, 21 nt, Shigella flexneri 2a str. 2457T
ucaucaccccgcgcucacacc

SEQ ID NO: 3857146 - RNA, 17 nt, Shigella flexneri 2a str. 2457T
ucaucaccggggauaac

SEQ ID NO: 3857147 - RNA, 18 nt, Shigella flexneri 2a str. 2457T
ucaucaccuccagccuga

SEQ ID NO: 3857148 - RNA, 21 nt, Shigella flexneri 2a str. 2457T
ucaucaccugagcuggcagac

SEQ ID NO: 3857149 - RNA, 15 nt, Shigella flexneri 2a str. 2457T
ucaucacgaaaauca

SEQ ID NO: 3857150 - RNA, 17 nt, Shigella flexneri 2a str. 2457T
ucaucacgcaggcugua

SEQ ID NO: 3857151 - RNA, 19 nt, Shigella flexneri 2a str. 2457T
ucaucacgcgguuacgcac

SEQ ID NO: 3857152 - RNA, 23 nt, Shigella flexneri 2a str. 2457T
ucaucacuccccgcaacagugaa

SEQ ID NO: 3857153 - RNA, 15 nt, Shigella flexneri 2a str. 2457T
ucaucacugaauuuc

SEQ ID NO: 3857154 - RNA, 18 nt, Shigella flexneri 2a str. 2457T
ucaucagaaaugccagua

SEQ ID NO: 3857155 - RNA, 19 nt, Shigella flexneri 2a str. 2457T
ucaucagcauaaucaccag

SEQ ID NO: 3857156 - RNA, 21 nt, Shigella flexneri 2a str. 2457T
ucaucagcauaaucaccagua

SEQ ID NO: 3857157 - RNA, 17 nt, Shigella flexneri 2a str. 2457T
ucaucaggccuacaaaa

SEQ ID NO: 3857158 - RNA, 22 nt, Shigella flexneri 2a str. 2457T
ucaucaggccuacaaaaucuau

SEQ ID NO: 3857159 - RNA, 18 nt, Shigella flexneri 2a str. 2457T
ucaucaggccuggacucu

SEQ ID NO: 3857160 - RNA, 23 nt, Shigella flexneri 2a str. 2457T
ucaucagguuggaucaacaggca

SEQ ID NO: 3857161 - RNA, 21 nt, Shigella flexneri 2a str. 2457T
ucaucaguucaggaucugaca

SEQ ID NO: 3857162 - RNA, 19 nt, Shigella flexneri 2a str. 2457T
ucaucaguuccaguucauu

SEQ ID NO: 3857163 - RNA, 12 nt, Shigella flexneri 2a str. 2457T
ucaucaucacga

SEQ ID NO: 3857164 - RNA, 19 nt, Shigella flexneri 2a str. 2457T
ucaucaucaggaacauccc

SEQ ID NO: 3857165 - RNA, 14 nt, Shigella flexneri 2a str. 2457T
ucaucaucgccacu

SEQ ID NO: 3857166 - RNA, 19 nt, Shigella flexneri 2a str. 2457T
ucaucaugggcaagguauu

SEQ ID NO: 3857167 - RNA, 16 nt, Shigella flexneri 2a str. 2457T
ucaucauguggcugga

SEQ ID NO: 3857168 - RNA, 13 nt, Shigella flexneri 2a str. 2457T
ucaucauugcagu

SEQ ID NO: 3857169 - RNA, 17 nt, Shigella flexneri 2a str. 2457T
ucauccaaaucgcccag

SEQ ID NO: 3857170 - RNA, 23 nt, Shigella flexneri 2a str. 2457T
ucauucucgcgauagaacuucug

SEQ ID NO: 3857171 - RNA, 14 nt, Shigella flexneri 2a str. 2457T
ucauugaaggcggc

SEQ ID NO: 3857172 - RNA, 17 nt, Shigella flexneri 2a str. 2457T
ucauugaaggcggcgca

SEQ ID NO: 3857173 - RNA, 19 nt, Shigella flexneri 2a str. 2457T
ucauugcggcaacaaugcu

SEQ ID NO: 3857174 - RNA, 22 nt, Shigella flexneri 2a str. 2457T
ucauugcugguauuuccagucc

SEQ ID NO: 3857175 - RNA, 19 nt, Shigella flexneri 2a str. 2457T
ucauuggccggaauaccac

SEQ ID NO: 3857176 - RNA, 21 nt, Shigella flexneri 2a str. 2457T
ucauuggccggaauaccacuu

SEQ ID NO: 3857177 - RNA, 17 nt, Shigella flexneri 2a str. 2457T
ucauugguccaucuuuu

SEQ ID NO: 3857178 - RNA, 23 nt, Shigella flexneri 2a str. 2457T
ucauugucgggccgcacgcugua

SEQ ID NO: 3857179 - RNA, 12 nt, Shigella flexneri 2a str. 2457T
ucauuguuaacg

SEQ ID NO: 3857180 - RNA, 22 nt, Shigella flexneri 2a str. 2457T
ucauuuaaaaagaaaaaacuaa

SEQ ID NO: 3857181 - RNA, 12 nt, Shigella flexneri 2a str. 2457T
ucauuucaauca

SEQ ID NO: 3857182 - RNA, 21 nt, Shigella flexneri 2a str. 2457T
ucauuucccaucucaauauua

SEQ ID NO: 3857183 - RNA, 13 nt, Shigella flexneri 2a str. 2457T
ucauuucugccau

SEQ ID NO: 3857184 - RNA, 15 nt, Shigella flexneri 2a str. 2457T
ucauuucuggaagca

SEQ ID NO: 3857185 - RNA, 15 nt, Shigella flexneri 2a str. 2457T
ucauuucuguauaau

SEQ ID NO: 3857186 - RNA, 17 nt, Shigella flexneri 2a str. 2457T
ucauuugaauaguuaau

SEQ ID NO: 3857187 - RNA, 22 nt, Shigella flexneri 2a str. 2457T
ucauuuuacguugcauuuccau

SEQ ID NO: 3857188 - RNA, 19 nt, Shigella flexneri 2a str. 2457T
ucauuuuuucccauuacca

SEQ ID NO: 3857189 - RNA, 21 nt, Shigella flexneri 2a str. 2457T
ucauuuuuucgguuuagugua

SEQ ID NO: 3857190 - RNA, 22 nt, Shigella flexneri 2a str. 2457T
ucauuuuuuuaaucgucaguuu

SEQ ID NO: 3857191 - RNA, 18 nt, Shigella flexneri 2a str. 2457T
uccaaaccgacugccugc

SEQ ID NO: 3857192 - RNA, 19 nt, Shigella flexneri 2a str. 2457T
uccaaauccuucagcaacu

SEQ ID NO: 3857193 - RNA, 13 nt, Shigella flexneri 2a str. 2457T
uccaacaggcgag

SEQ ID NO: 3857194 - RNA, 19 nt, Shigella flexneri 2a str. 2457T
uccaagcgcggcaggcauc

SEQ ID NO: 3857195 - RNA, 11 nt, Shigella flexneri 2a str. 2457T
uccacaaaccg

SEQ ID NO: 3857196 - RNA, 19 nt, Shigella flexneri 2a str. 2457T
uccacaacggcauuauuca

SEQ ID NO: 3857197 - RNA, 21 nt, Shigella flexneri 2a str. 2457T
uccacaacgugggccuggcgu

SEQ ID NO: 3857198 - RNA, 15 nt, Shigella flexneri 2a str. 2457T
uccacaagaaugccu

SEQ ID NO: 3857199 - RNA, 18 nt, Shigella flexneri 2a str. 2457T
uccacaagcuccggcuuu

SEQ ID NO: 3857200 - RNA, 19 nt, Shigella flexneri 2a str. 2457T
uccacaggguguauucaug

SEQ ID NO: 3857201 - RNA, 15 nt, Shigella flexneri 2a str. 2457T
uccacagucaggcug

SEQ ID NO: 3857202 - RNA, 15 nt, Shigella flexneri 2a str. 2457T
uccacauaaaguagc

SEQ ID NO: 3857203 - RNA, 20 nt, Shigella flexneri 2a str. 2457T
uccacauauuauugaaauca

SEQ ID NO: 3857204 - RNA, 21 nt, Shigella flexneri 2a str. 2457T
uccacaugguuggccaucgua

SEQ ID NO: 3857205 - RNA, 21 nt, Shigella flexneri 2a str. 2457T
uccacaugguuuucaauuauc

SEQ ID NO: 3857206 - RNA, 14 nt, Shigella flexneri 2a str. 2457T
uccaccacguuuuu

SEQ ID NO: 3857207 - RNA, 13 nt, Shigella flexneri 2a str. 2457T
uccaccagcgcgu

SEQ ID NO: 3857208 - RNA, 15 nt, Shigella flexneri 2a str. 2457T
uccaccagcgcguag

SEQ ID NO: 3857209 - RNA, 13 nt, Shigella flexneri 2a str. 2457T
uccaccagcggcu

SEQ ID NO: 3857210 - RNA, 17 nt, Shigella flexneri 2a str. 2457T
uccacccgcagcaagcg

SEQ ID NO: 3857211 - RNA, 16 nt, Shigella flexneri 2a str. 2457T
uccaccgaaauaauca

SEQ ID NO: 3857212 - RNA, 18 nt, Shigella flexneri 2a str. 2457T
uccaccgcguucagcagc

SEQ ID NO: 3857213 - RNA, 19 nt, Shigella flexneri 2a str. 2457T
uccaccgcguucagcagcu

SEQ ID NO: 3857214 - RNA, 19 nt, Shigella flexneri 2a str. 2457T
uccaccguuucuuuuucga

SEQ ID NO: 3857215 - RNA, 18 nt, Shigella flexneri 2a str. 2457T
uccaccuucuguaacugg

SEQ ID NO: 3857216 - RNA, 18 nt, Shigella flexneri 2a str. 2457T
uccacgacguguuccuga

SEQ ID NO: 3857217 - RNA, 17 nt, Shigella flexneri 2a str. 2457T
uccacgcccagcgcagg

SEQ ID NO: 3857218 - RNA, 22 nt, Shigella flexneri 2a str. 2457T
uccacgccguuuuuacccagca

SEQ ID NO: 3857219 - RNA, 17 nt, Shigella flexneri 2a str. 2457T
uccacgccuuuuuucac

SEQ ID NO: 3857220 - RNA, 20 nt, Shigella flexneri 2a str. 2457T
uccacgcgauacuuuuucaa

SEQ ID NO: 3857221 - RNA, 17 nt, Shigella flexneri 2a str. 2457T
uccacgcgccacgcacg

SEQ ID NO: 3857222 - RNA, 20 nt, Shigella flexneri 2a str. 2457T
uccacgcuauacagcagcca

SEQ ID NO: 3857223 - RNA, 21 nt, Shigella flexneri 2a str. 2457T
uccacggacugaacgcccacg

SEQ ID NO: 3857224 - RNA, 15 nt, Shigella flexneri 2a str. 2457T
uccacgguucuccac

SEQ ID NO: 3857225 - RNA, 19 nt, Shigella flexneri 2a str. 2457T
uccacgguugguuuuaucc

SEQ ID NO: 3857226 - RNA, 14 nt, Shigella flexneri 2a str. 2457T
uccacguuccccag

SEQ ID NO: 3857227 - RNA, 14 nt, Shigella flexneri 2a str. 2457T
uccacuaacuguuu

SEQ ID NO: 3857228 - RNA, 18 nt, Shigella flexneri 2a str. 2457T
uccacuauuucaauauga

SEQ ID NO: 3857229 - RNA, 20 nt, Shigella flexneri 2a str. 2457T
uccacuccgguguuuucucu

SEQ ID NO: 3857230 - RNA, 12 nt, Shigella flexneri 2a str. 2457T
uccacugucaaa

SEQ ID NO: 3857231 - RNA, 14 nt, Shigella flexneri 2a str. 2457T
uccacugucaaauc

SEQ ID NO: 3857232 - RNA, 15 nt, Shigella flexneri 2a str. 2457T
uccacugucaaaucc

SEQ ID NO: 3857233 - RNA, 21 nt, Shigella flexneri 2a str. 2457T
uccacuucacggcugcuaaua

SEQ ID NO: 3857234 - RNA, 17 nt, Shigella flexneri 2a str. 2457T
uccacuucauaauccag

SEQ ID NO: 3857235 - RNA, 14 nt, Shigella flexneri 2a str. 2457T
uccacuuccaccac

SEQ ID NO: 3857236 - RNA, 20 nt, Shigella flexneri 2a str. 2457T
uccacuuccgcgucaaucug

SEQ ID NO: 3857237 - RNA, 13 nt, Shigella flexneri 2a str. 2457T
uccacuugaaaau

SEQ ID NO: 3857238 - RNA, 14 nt, Shigella flexneri 2a str. 2457T
uccacuugaaaauu

SEQ ID NO: 3857239 - RNA, 16 nt, Shigella flexneri 2a str. 2457T
uccacuuucacgccca

SEQ ID NO: 3857240 - RNA, 15 nt, Shigella flexneri 2a str. 2457T
uccacuuucgcggcu

SEQ ID NO: 3857241 - RNA, 17 nt, Shigella flexneri 2a str. 2457T
uccacuuucgcggcuuu

SEQ ID NO: 3857242 - RNA, 17 nt, Shigella flexneri 2a str. 2457T
uccacuuucuuaaagcc

SEQ ID NO: 3857243 - RNA, 23 nt, Shigella flexneri 2a str. 2457T
uccagaauaucuucaaccgucac

SEQ ID NO: 3857244 - RNA, 20 nt, Shigella flexneri 2a str. 2457T
uccagacacuccagagaauu

SEQ ID NO: 3857245 - RNA, 18 nt, Shigella flexneri 2a str. 2457T
uccagaccauauuuucau

SEQ ID NO: 3857246 - RNA, 20 nt, Shigella flexneri 2a str. 2457T
uccagacgcgcagcuucacu

SEQ ID NO: 3857247 - RNA, 21 nt, Shigella flexneri 2a str. 2457T
uccagacgcgcagcuucacuu

SEQ ID NO: 3857248 - RNA, 13 nt, Shigella flexneri 2a str. 2457T
uccagacgcugca

SEQ ID NO: 3857249 - RNA, 21 nt, Shigella flexneri 2a str. 2457T
uccagacgggucauaaucaga

SEQ ID NO: 3857250 - RNA, 22 nt, Shigella flexneri 2a str. 2457T
uccagacgggucauaaucagau

SEQ ID NO: 3857251 - RNA, 17 nt, Shigella flexneri 2a str. 2457T
uccagauaauaaucaac

SEQ ID NO: 3857252 - RNA, 22 nt, Shigella flexneri 2a str. 2457T
uccagaucgaucauauuuccuu

SEQ ID NO: 3857253 - RNA, 19 nt, Shigella flexneri 2a str. 2457T
uccagaucuuuuugcgcaa

SEQ ID NO: 3857254 - RNA, 22 nt, Shigella flexneri 2a str. 2457T
uccagaugugcaccuuuuccac

SEQ ID NO: 3857255 - RNA, 18 nt, Shigella flexneri 2a str. 2457T
uccagauuaccagcgaca

SEQ ID NO: 3857256 - RNA, 19 nt, Shigella flexneri 2a str. 2457T
uccagauucaguuucaccg

SEQ ID NO: 3857257 - RNA, 14 nt, Shigella flexneri 2a str. 2457T
uccagauucucaua

SEQ ID NO: 3857258 - RNA, 21 nt, Shigella flexneri 2a str. 2457T
uccagauuuauaaaagaaaaa

SEQ ID NO: 3857259 - RNA, 21 nt, Shigella flexneri 2a str. 2457T
uccagauuuugcuuacgcgug

SEQ ID NO: 3857260 - RNA, 12 nt, Shigella flexneri 2a str. 2457T
uccagcaaaaag

SEQ ID NO: 3857261 - RNA, 14 nt, Shigella flexneri 2a str. 2457T
uccagcaacaacag

SEQ ID NO: 3857262 - RNA, 15 nt, Shigella flexneri 2a str. 2457T
uccagcaacaacagc

SEQ ID NO: 3857263 - RNA, 19 nt, Shigella flexneri 2a str. 2457T
uccagcaaccaaugccacc

SEQ ID NO: 3857264 - RNA, 17 nt, Shigella flexneri 2a str. 2457T
uccagcacacuguaagc

SEQ ID NO: 3857265 - RNA, 14 nt, Shigella flexneri 2a str. 2457T
uccagcaccaguuc

SEQ ID NO: 3857266 - RNA, 21 nt, Shigella flexneri 2a str. 2457T
uccagcaccaguucacccuca

SEQ ID NO: 3857267 - RNA, 20 nt, Shigella flexneri 2a str. 2457T
uccaugcgcauuaagccaug

SEQ ID NO: 3857268 - RNA, 14 nt, Shigella flexneri 2a str. 2457T
uccauguccagcuu

SEQ ID NO: 3857269 - RNA, 14 nt, Shigella flexneri 2a str. 2457T
uccaugugggcugc

SEQ ID NO: 3857270 - RNA, 15 nt, Shigella flexneri 2a str. 2457T
uccauuacaucacga

SEQ ID NO: 3857271 - RNA, 16 nt, Shigella flexneri 2a str. 2457T
uccauuauucaacgca

SEQ ID NO: 3857272 - RNA, 16 nt, Shigella flexneri 2a str. 2457T
uccauucaaacgugaa

SEQ ID NO: 3857273 - RNA, 18 nt, Shigella flexneri 2a str. 2457T
uccauucaucgccuuuca

SEQ ID NO: 3857274 - RNA, 14 nt, Shigella flexneri 2a str. 2457T
uccauucgaugaga

SEQ ID NO: 3857275 - RNA, 16 nt, Shigella flexneri 2a str. 2457T
uccauucgcugcugcg

SEQ ID NO: 3857276 - RNA, 20 nt, Shigella flexneri 2a str. 2457T
uccauucgcugcugcggcga

SEQ ID NO: 3857277 - RNA, 20 nt, Shigella flexneri 2a str. 2457T
uccauugccgcuuuccaggc

SEQ ID NO: 3857278 - RNA, 21 nt, Shigella flexneri 2a str. 2457T
uccauuggcggcguccuggaa

SEQ ID NO: 3857279 - RNA, 18 nt, Shigella flexneri 2a str. 2457T
uccauuucccugacaaau

SEQ ID NO: 3857280 - RNA, 12 nt, Shigella flexneri 2a str. 2457T
uccauuuuucac

SEQ ID NO: 3857281 - RNA, 17 nt, Shigella flexneri 2a str. 2457T
uccauuuuucacuuaau

SEQ ID NO: 3857282 - RNA, 17 nt, Shigella flexneri 2a str. 2457T
ucccaaagaucuccuca

SEQ ID NO: 3857283 - RNA, 18 nt, Shigella flexneri 2a str. 2457T
ucccaacaacagcgcgcu

SEQ ID NO: 3857284 - RNA, 17 nt, Shigella flexneri 2a str. 2457T
ucccaauugcacauauu

SEQ ID NO: 3857285 - RNA, 19 nt, Shigella flexneri 2a str. 2457T
ucccacgaccgcagcauug

SEQ ID NO: 3857286 - RNA, 13 nt, Shigella flexneri 2a str. 2457T
ucccacgccgaau

SEQ ID NO: 3857287 - RNA, 19 nt, Shigella flexneri 2a str. 2457T
ucccacgcggcaacggcuu

SEQ ID NO: 3857288 - RNA, 23 nt, Shigella flexneri 2a str. 2457T
ucccacugacgcucggcgcaauc

SEQ ID NO: 3857289 - RNA, 22 nt, Shigella flexneri 2a str. 2457T
ucccacugcgccacgguguugu

SEQ ID NO: 3857290 - RNA, 17 nt, Shigella flexneri 2a str. 2457T
ucccacuuuuauuucac

SEQ ID NO: 3857291 - RNA, 18 nt, Shigella flexneri 2a str. 2457T
ucccagaagguuucgccg

SEQ ID NO: 3857292 - RNA, 15 nt, Shigella flexneri 2a str. 2457T
ucccagaauguuaac

SEQ ID NO: 3857293 - RNA, 14 nt, Shigella flexneri 2a str. 2457T
ucccagaccuucau

SEQ ID NO: 3857294 - RNA, 17 nt, Shigella flexneri 2a str. 2457T
ucccagagcgggcagac

SEQ ID NO: 3857295 - RNA, 13 nt, Shigella flexneri 2a str. 2457T
ucccagcagagau

SEQ ID NO: 3857296 - RNA, 19 nt, Shigella flexneri 2a str. 2457T
ucccagcagagaucuuuca

SEQ ID NO: 3857297 - RNA, 20 nt, Shigella flexneri 2a str. 2457T
ucccagcagagaucuuucac

SEQ ID NO: 3857298 - RNA, 22 nt, Shigella flexneri 2a str. 2457T
ucccagcccccgcaauuccggu

SEQ ID NO: 3857299 - RNA, 20 nt, Shigella flexneri 2a str. 2457T
ucccagcccccuguguugau

SEQ ID NO: 3857300 - RNA, 15 nt, Shigella flexneri 2a str. 2457T
ucccagcgcaggcag

SEQ ID NO: 3857301 - RNA, 13 nt, Shigella flexneri 2a str. 2457T
ucccagcgcguuc

SEQ ID NO: 3857302 - RNA, 16 nt, Shigella flexneri 2a str. 2457T
ucccagcguggagagc

SEQ ID NO: 3857303 - RNA, 16 nt, Shigella flexneri 2a str. 2457T
ucccaggcaaauccca

SEQ ID NO: 3857304 - RNA, 11 nt, Shigella flexneri 2a str. 2457T
ucccaggcacc

SEQ ID NO: 3857305 - RNA, 20 nt, Shigella flexneri 2a str. 2457T
ucccaguaagccuaaaugua

SEQ ID NO: 3857306 - RNA, 23 nt, Shigella flexneri 2a str. 2457T
ucccagucacgcaacaugucagc

SEQ ID NO: 3857307 - RNA, 13 nt, Shigella flexneri 2a str. 2457T
ucccagucauccg

SEQ ID NO: 3857308 - RNA, 12 nt, Shigella flexneri 2a str. 2457T
ucccagucuuca

SEQ ID NO: 3857309 - RNA, 14 nt, Shigella flexneri 2a str. 2457T
ucccagucuuucca

SEQ ID NO: 3857310 - RNA, 16 nt, Shigella flexneri 2a str. 2457T
ucccauaaccaacaau

SEQ ID NO: 3857311 - RNA, 17 nt, Shigella flexneri 2a str. 2457T
ucccauaggaugagguu

SEQ ID NO: 3857312 - RNA, 23 nt, Shigella flexneri 2a str. 2457T
ucccaucugauucggguacugau

SEQ ID NO: 3857313 - RNA, 16 nt, Shigella flexneri 2a str. 2457T
ucccauuuauuuuucc

SEQ ID NO: 3857314 - RNA, 14 nt, Shigella flexneri 2a str. 2457T
ucccauuuuugaau

SEQ ID NO: 3857315 - RNA, 22 nt, Shigella flexneri 2a str. 2457T
ucccauuuuugaauggaucucc

SEQ ID NO: 3857316 - RNA, 15 nt, Shigella flexneri 2a str. 2457T
uccccaaugaccuuu

SEQ ID NO: 3857317 - RNA, 16 nt, Shigella flexneri 2a str. 2457T
uccccacaaccggcgg

SEQ ID NO: 3857318 - RNA, 20 nt, Shigella flexneri 2a str. 2457T
uccccacaggcgaugcacau

SEQ ID NO: 3857319 - RNA, 15 nt, Shigella flexneri 2a str. 2457T
uccccaccucaucag

SEQ ID NO: 3857320 - RNA, 16 nt, Shigella flexneri 2a str. 2457T
uccccaccucaucaga

SEQ ID NO: 3857321 - RNA, 23 nt, Shigella flexneri 2a str. 2457T
uccccacucgccccgagaaaaau

SEQ ID NO: 3857322 - RNA, 17 nt, Shigella flexneri 2a str. 2457T
uccccagaauccaggaa

SEQ ID NO: 3857323 - RNA, 17 nt, Shigella flexneri 2a str. 2457T
uccccagcggaaaauau

SEQ ID NO: 3857324 - RNA, 18 nt, Shigella flexneri 2a str. 2457T
uccccagcggaaaauauc

SEQ ID NO: 3857325 - RNA, 22 nt, Shigella flexneri 2a str. 2457T
uccccaguaaucgggcaacugc

SEQ ID NO: 3857326 - RNA, 13 nt, Shigella flexneri 2a str. 2457T
uccccauaucccg

SEQ ID NO: 3857327 - RNA, 15 nt, Shigella flexneri 2a str. 2457T
ucccccaccaccauc

SEQ ID NO: 3857328 - RNA, 23 nt, Shigella flexneri 2a str. 2457T
ucccccacuuuuaaaucgccaag

SEQ ID NO: 3857329 - RNA, 19 nt, Shigella flexneri 2a str. 2457T
uccccccggcaucgcauuc

SEQ ID NO: 3857330 - RNA, 16 nt, Shigella flexneri 2a str. 2457T
ucccccugccagacca

SEQ ID NO: 3857331 - RNA, 17 nt, Shigella flexneri 2a str. 2457T
uccccgaagacgugcgc

SEQ ID NO: 3857332 - RNA, 15 nt, Shigella flexneri 2a str. 2457T
uccccgccucaccgc

SEQ ID NO: 3857333 - RNA, 13 nt, Shigella flexneri 2a str. 2457T
uccccgcucuccc

SEQ ID NO: 3857334 - RNA, 17 nt, Shigella flexneri 2a str. 2457T
uccccggauucaugcua

SEQ ID NO: 3857335 - RNA, 17 nt, Shigella flexneri 2a str. 2457T
uccccggcaaccacacc

SEQ ID NO: 3857336 - RNA, 21 nt, Shigella flexneri 2a str. 2457T
uccccggcaaccacacccaca

SEQ ID NO: 3857337 - RNA, 20 nt, Shigella flexneri 2a str. 2457T
uccccggcagugcuuucauu

SEQ ID NO: 3857338 - RNA, 21 nt, Shigella flexneri 2a str. 2457T
uccccggcgcggugcuggaug

SEQ ID NO: 3857339 - RNA, 16 nt, Shigella flexneri 2a str. 2457T
uccccggucagcagca

SEQ ID NO: 3857340 - RNA, 11 nt, Shigella flexneri 2a str. 2457T
uccccggugaa

SEQ ID NO: 3857341 - RNA, 15 nt, Shigella flexneri 2a str. 2457T
uccccguaucuucau

SEQ ID NO: 3857342 - RNA, 16 nt, Shigella flexneri 2a str. 2457T
uccccucacccuaacc

SEQ ID NO: 3857343 - RNA, 13 nt, Shigella flexneri 2a str. 2457T
uccccucgcuccu

SEQ ID NO: 3857344 - RNA, 14 nt, Shigella flexneri 2a str. 2457T
uccccucgcuccuc

SEQ ID NO: 3857345 - RNA, 13 nt, Shigella flexneri 2a str. 2457T
uccccugcaauau

SEQ ID NO: 3857346 - RNA, 22 nt, Shigella flexneri 2a str. 2457T
ucccgaaaaaccugacguuguu

SEQ ID NO: 3857347 - RNA, 16 nt, Shigella flexneri 2a str. 2457T
ucccgauaaccgcaaa

SEQ ID NO: 3857348 - RNA, 19 nt, Shigella flexneri 2a str. 2457T
ucccgauaaccuucuucau

SEQ ID NO: 3857349 - RNA, 18 nt, Shigella flexneri 2a str. 2457T
ucccgauggucagcuuca

SEQ ID NO: 3857350 - RNA, 13 nt, Shigella flexneri 2a str. 2457T
ucccgcaccagcg

SEQ ID NO: 3857351 - RNA, 24 nt, Shigella flexneri 2a str. 2457T
ucccgcaccagcggaaugcaguca

SEQ ID NO: 3857352 - RNA, 16 nt, Shigella flexneri 2a str. 2457T
ucccgcagcuccagcc

SEQ ID NO: 3857353 - RNA, 22 nt, Shigella flexneri 2a str. 2457T
ucccgccagaugauauggcaaa

SEQ ID NO: 3857354 - RNA, 14 nt, Shigella flexneri 2a str. 2457T
ucccgccagcacca

SEQ ID NO: 3857355 - RNA, 21 nt, Shigella flexneri 2a str. 2457T
ucccgcgaacgagaauuucuc

SEQ ID NO: 3857356 - RNA, 20 nt, Shigella flexneri 2a str. 2457T
ucccgcgauggcccggcggu

SEQ ID NO: 3857357 - RNA, 19 nt, Shigella flexneri 2a str. 2457T
ucccgcugacggcgauaaa

SEQ ID NO: 3857358 - RNA, 20 nt, Shigella flexneri 2a str. 2457T
ucccgcuucaacgaccgcuu

SEQ ID NO: 3857359 - RNA, 22 nt, Shigella flexneri 2a str. 2457T
ucccggaccgucaucuuccacc

SEQ ID NO: 3857360 - RNA, 14 nt, Shigella flexneri 2a str. 2457T
ucccggauauccca

SEQ ID NO: 3857361 - RNA, 17 nt, Shigella flexneri 2a str. 2457T
ucccggauaucccagcu

SEQ ID NO: 3857362 - RNA, 16 nt, Shigella flexneri 2a str. 2457T
ucccggcaagauucca

SEQ ID NO: 3857363 - RNA, 16 nt, Shigella flexneri 2a str. 2457T
ucccggcauuucugau

SEQ ID NO: 3857364 - RNA, 13 nt, Shigella flexneri 2a str. 2457T
ucccggcucaucc

SEQ ID NO: 3857365 - RNA, 14 nt, Shigella flexneri 2a str. 2457T
uccggcagaagcaa

SEQ ID NO: 3857366 - RNA, 13 nt, Shigella flexneri 2a str. 2457T
uccggcagagaaa

SEQ ID NO: 3857367 - RNA, 15 nt, Shigella flexneri 2a str. 2457T
uccggcagcagaaag

SEQ ID NO: 3857368 - RNA, 16 nt, Shigella flexneri 2a str. 2457T
uccggcagcagaaagc

SEQ ID NO: 3857369 - RNA, 16 nt, Shigella flexneri 2a str. 2457T
uccggcagcaugugua

SEQ ID NO: 3857370 - RNA, 18 nt, Shigella flexneri 2a str. 2457T
uccggcaguaauaccaga

SEQ ID NO: 3857371 - RNA, 13 nt, Shigella flexneri 2a str. 2457T
uccggcagucagu

SEQ ID NO: 3857372 - RNA, 14 nt, Shigella flexneri 2a str. 2457T
uccggcaguuucau

SEQ ID NO: 3857373 - RNA, 22 nt, Shigella flexneri 2a str. 2457T
uccggcauaaacaaagugcacu

SEQ ID NO: 3857374 - RNA, 17 nt, Shigella flexneri 2a str. 2457T
uccggcauacaguaacu

SEQ ID NO: 3857375 - RNA, 23 nt, Shigella flexneri 2a str. 2457T
uccggcaucaacaaagugcacgu

SEQ ID NO: 3857376 - RNA, 20 nt, Shigella flexneri 2a str. 2457T
uccggcaugaacaaagcgca

SEQ ID NO: 3857377 - RNA, 19 nt, Shigella flexneri 2a str. 2457T
uccggcauuaucacaucag

SEQ ID NO: 3857378 - RNA, 16 nt, Shigella flexneri 2a str. 2457T
uccggccgccacacag

SEQ ID NO: 3857379 - RNA, 23 nt, Shigella flexneri 2a str. 2457T
uccggccuuccuguaucaggcug

SEQ ID NO: 3857380 - RNA, 23 nt, Shigella flexneri 2a str. 2457T
uccggcgcgauaucgacgaccug

SEQ ID NO: 3857381 - RNA, 14 nt, Shigella flexneri 2a str. 2457T
uccggcgcguugau

SEQ ID NO: 3857382 - RNA, 17 nt, Shigella flexneri 2a str. 2457T
uccggcgggcaaauucu

SEQ ID NO: 3857383 - RNA, 18 nt, Shigella flexneri 2a str. 2457T
uccggcgggucgcugccg

SEQ ID NO: 3857384 - RNA, 23 nt, Shigella flexneri 2a str. 2457T
uccggcgguaaaugcucauacca

SEQ ID NO: 3857385 - RNA, 22 nt, Shigella flexneri 2a str. 2457T
uccggcucgccuuucggcugca

SEQ ID NO: 3857386 - RNA, 20 nt, Shigella flexneri 2a str. 2457T
uccggcugccagccaggaua

SEQ ID NO: 3857387 - RNA, 13 nt, Shigella flexneri 2a str. 2457T
uccggcugggcgu

SEQ ID NO: 3857388 - RNA, 16 nt, Shigella flexneri 2a str. 2457T
uccggcuguuccagca

SEQ ID NO: 3857389 - RNA, 17 nt, Shigella flexneri 2a str. 2457T
uccggcuugaaccagcc

SEQ ID NO: 3857390 - RNA, 23 nt, Shigella flexneri 2a str. 2457T
uccgggaaaacgcuggcagcauu

SEQ ID NO: 3857391 - RNA, 23 nt, Shigella flexneri 2a str. 2457T
uccgggaauucguucagacgcuc

SEQ ID NO: 3857392 - RNA, 17 nt, Shigella flexneri 2a str. 2457T
uccgggauggucagcgg

SEQ ID NO: 3857393 - RNA, 22 nt, Shigella flexneri 2a str. 2457T
uccgggccgaacaucagauaau

SEQ ID NO: 3857394 - RNA, 17 nt, Shigella flexneri 2a str. 2457T
uccgggccgcaaaccag

SEQ ID NO: 3857395 - RNA, 20 nt, Shigella flexneri 2a str. 2457T
uccgggcuauauacccuucu

SEQ ID NO: 3857396 - RNA, 14 nt, Shigella flexneri 2a str. 2457T
uccgggucuguaaa

SEQ ID NO: 3857397 - RNA, 19 nt, Shigella flexneri 2a str. 2457T
uccggguuugccacaucac

SEQ ID NO: 3857398 - RNA, 12 nt, Shigella flexneri 2a str. 2457T
uccgguaauuuu

SEQ ID NO: 3857399 - RNA, 24 nt, Shigella flexneri 2a str. 2457T
uccgguaauuuuuauauagccagc

SEQ ID NO: 3857400 - RNA, 23 nt, Shigella flexneri 2a str. 2457T
uccgguauacgucccggugaagc

SEQ ID NO: 3857401 - RNA, 14 nt, Shigella flexneri 2a str. 2457T
uccggugccaaagu

SEQ ID NO: 3857402 - RNA, 16 nt, Shigella flexneri 2a str. 2457T
uccgguguuuucucuc

SEQ ID NO: 3857403 - RNA, 15 nt, Shigella flexneri 2a str. 2457T
uccgguucacuucac

SEQ ID NO: 3857404 - RNA, 14 nt, Shigella flexneri 2a str. 2457T
uccguaaagcccau

SEQ ID NO: 3857405 - RNA, 14 nt, Shigella flexneri 2a str. 2457T
uccguaccagccuu

SEQ ID NO: 3857406 - RNA, 14 nt, Shigella flexneri 2a str. 2457T
uccguagugaaaaa

SEQ ID NO: 3857407 - RNA, 19 nt, Shigella flexneri 2a str. 2457T
uccgucaccggaauaauga

SEQ ID NO: 3857408 - RNA, 15 nt, Shigella flexneri 2a str. 2457T
uccgucccagccuug

SEQ ID NO: 3857409 - RNA, 20 nt, Shigella flexneri 2a str. 2457T
uccgucccagccuugccaga

SEQ ID NO: 3857410 - RNA, 19 nt, Shigella flexneri 2a str. 2457T
uccguuaugucucccgccc

SEQ ID NO: 3857411 - RNA, 13 nt, Shigella flexneri 2a str. 2457T
uccguucagaucg

SEQ ID NO: 3857412 - RNA, 16 nt, Shigella flexneri 2a str. 2457T
uccguucucaccagcu

SEQ ID NO: 3857413 - RNA, 16 nt, Shigella flexneri 2a str. 2457T
uccguugaaaaugcug

SEQ ID NO: 3857414 - RNA, 19 nt, Shigella flexneri 2a str. 2457T
uccguuugcgucaugguau

SEQ ID NO: 3857415 - RNA, 19 nt, Shigella flexneri 2a str. 2457T
uccguuuuacugggaagaa

SEQ ID NO: 3857416 - RNA, 20 nt, Shigella flexneri 2a str. 2457T
uccuaaaaaagcaugaauuu

SEQ ID NO: 3857417 - RNA, 15 nt, Shigella flexneri 2a str. 2457T
uccuaaaaacaguac

SEQ ID NO: 3857418 - RNA, 20 nt, Shigella flexneri 2a str. 2457T
uccuaaaaacaguaccagac

SEQ ID NO: 3857419 - RNA, 19 nt, Shigella flexneri 2a str. 2457T
uccuaaaggcaaaaugcca

SEQ ID NO: 3857420 - RNA, 21 nt, Shigella flexneri 2a str. 2457T
uccuaaaggcaaaaugccagc

SEQ ID NO: 3857421 - RNA, 15 nt, Shigella flexneri 2a str. 2457T
uccuacaacugggac

SEQ ID NO: 3857422 - RNA, 21 nt, Shigella flexneri 2a str. 2457T
uccuacaacugggacaugauu

SEQ ID NO: 3857423 - RNA, 15 nt, Shigella flexneri 2a str. 2457T
uccuaucgugguucc

SEQ ID NO: 3857424 - RNA, 14 nt, Shigella flexneri 2a str. 2457T
uccuauuguugaua

SEQ ID NO: 3857425 - RNA, 22 nt, Shigella flexneri 2a str. 2457T
uccuauuguugauaaggaaauu

SEQ ID NO: 3857426 - RNA, 16 nt, Shigella flexneri 2a str. 2457T
uccucaacaaucguca

SEQ ID NO: 3857427 - RNA, 13 nt, Shigella flexneri 2a str. 2457T
uccuccagcuccu

SEQ ID NO: 3857428 - RNA, 13 nt, Shigella flexneri 2a str. 2457T
uccucccguuaug

SEQ ID NO: 3857429 - RNA, 20 nt, Shigella flexneri 2a str. 2457T
uccucccuuuugcaguuaaa

SEQ ID NO: 3857430 - RNA, 19 nt, Shigella flexneri 2a str. 2457T
uccuccggcuccacuucgu

SEQ ID NO: 3857431 - RNA, 16 nt, Shigella flexneri 2a str. 2457T
uccuccugucuucccu

SEQ ID NO: 3857432 - RNA, 20 nt, Shigella flexneri 2a str. 2457T
uccucgaguccuuccagguc

SEQ ID NO: 3857433 - RNA, 16 nt, Shigella flexneri 2a str. 2457T
uccucgccguuaauga

SEQ ID NO: 3857434 - RNA, 20 nt, Shigella flexneri 2a str. 2457T
uccucgccguuuucuggggc

SEQ ID NO: 3857435 - RNA, 21 nt, Shigella flexneri 2a str. 2457T
uccucguuucgcccugccuuu

SEQ ID NO: 3857436 - RNA, 23 nt, Shigella flexneri 2a str. 2457T
uccucugucaggguuauagccuu

SEQ ID NO: 3857437 - RNA, 14 nt, Shigella flexneri 2a str. 2457T
uccucuugucaggc

SEQ ID NO: 3857438 - RNA, 17 nt, Shigella flexneri 2a str. 2457T
uccucuuucaucucccg

SEQ ID NO: 3857439 - RNA, 14 nt, Shigella flexneri 2a str. 2457T
uccugaaaccauag

SEQ ID NO: 3857440 - RNA, 23 nt, Shigella flexneri 2a str. 2457T
uccugaaaccauagcaucccaau

SEQ ID NO: 3857441 - RNA, 21 nt, Shigella flexneri 2a str. 2457T
uccugaaacgcggcguaaccg

SEQ ID NO: 3857442 - RNA, 21 nt, Shigella flexneri 2a str. 2457T
uccugaaauagaauggcauca

SEQ ID NO: 3857443 - RNA, 20 nt, Shigella flexneri 2a str. 2457T
uccugaagacgccucgcauu

SEQ ID NO: 3857444 - RNA, 16 nt, Shigella flexneri 2a str. 2457T
uccugaagaugcugca

SEQ ID NO: 3857445 - RNA, 17 nt, Shigella flexneri 2a str. 2457T
uccugaauggugaccug

SEQ ID NO: 3857446 - RNA, 18 nt, Shigella flexneri 2a str. 2457T
uccugacccucucggcau

SEQ ID NO: 3857447 - RNA, 23 nt, Shigella flexneri 2a str. 2457T
uccugacggugauacagcaaaau

SEQ ID NO: 3857448 - RNA, 22 nt, Shigella flexneri 2a str. 2457T
uccugacguaacgaccaccacc

SEQ ID NO: 3857449 - RNA, 17 nt, Shigella flexneri 2a str. 2457T
uccugacuugccagaua

SEQ ID NO: 3857450 - RNA, 20 nt, Shigella flexneri 2a str. 2457T
uccugacuuugccccagcgg

SEQ ID NO: 3857451 - RNA, 15 nt, Shigella flexneri 2a str. 2457T
uccugagcacugggg

SEQ ID NO: 3857452 - RNA, 17 nt, Shigella flexneri 2a str. 2457T
uccugagcacuggggcu

SEQ ID NO: 3857453 - RNA, 19 nt, Shigella flexneri 2a str. 2457T
uccugaguuaagcaaaaaa

SEQ ID NO: 3857454 - RNA, 19 nt, Shigella flexneri 2a str. 2457T
uccugauaaccuuccagcu

SEQ ID NO: 3857455 - RNA, 23 nt, Shigella flexneri 2a str. 2457T
uccugauaaccuuccagcuucgc

SEQ ID NO: 3857456 - RNA, 19 nt, Shigella flexneri 2a str. 2457T
uccugauacagaccgcgca

SEQ ID NO: 3857457 - RNA, 17 nt, Shigella flexneri 2a str. 2457T
uccugauuuaacaucuc

SEQ ID NO: 3857458 - RNA, 21 nt, Shigella flexneri 2a str. 2457T
uccugcacggucacaucgcug

SEQ ID NO: 3857459 - RNA, 18 nt, Shigella flexneri 2a str. 2457T
uccugcagcuucacggaa

SEQ ID NO: 3857460 - RNA, 18 nt, Shigella flexneri 2a str. 2457T
uccugcauugacucgccu

SEQ ID NO: 3857461 - RNA, 19 nt, Shigella flexneri 2a str. 2457T
uccugcauugacucgccuu

SEQ ID NO: 3857462 - RNA, 20 nt, Shigella flexneri 2a str. 2457T
ucgaccacuuuaaccagucg

SEQ ID NO: 3857463 - RNA, 21 nt, Shigella flexneri 2a str. 2457T
ucgaccaggccaucagcagcg

SEQ ID NO: 3857464 - RNA, 17 nt, Shigella flexneri 2a str. 2457T
ucgacccgacagaugcu

SEQ ID NO: 3857465 - RNA, 22 nt, Shigella flexneri 2a str. 2457T
ucgaccugcgccugcaccauug

SEQ ID NO: 3857466 - RNA, 22 nt, Shigella flexneri 2a str. 2457T
ucgacgacaacgcggcacagca

SEQ ID NO: 3857467 - RNA, 18 nt, Shigella flexneri 2a str. 2457T
ucgacgagaauuuccuuc

SEQ ID NO: 3857468 - RNA, 22 nt, Shigella flexneri 2a str. 2457T
ucgacgaugaucaagcgcacaa

SEQ ID NO: 3857469 - RNA, 14 nt, Shigella flexneri 2a str. 2457T
ucgacgcugcugcg

SEQ ID NO: 3857470 - RNA, 21 nt, Shigella flexneri 2a str. 2457T
ucgacggcuggacaaaauacu

SEQ ID NO: 3857471 - RNA, 12 nt, Shigella flexneri 2a str. 2457T
ucgacgggccca

SEQ ID NO: 3857472 - RNA, 18 nt, Shigella flexneri 2a str. 2457T
ucgacggggauguuccau

SEQ ID NO: 3857473 - RNA, 18 nt, Shigella flexneri 2a str. 2457T
ucgacggugacacuuugc

SEQ ID NO: 3857474 - RNA, 17 nt, Shigella flexneri 2a str. 2457T
ucgacguccaaucagca

SEQ ID NO: 3857475 - RNA, 17 nt, Shigella flexneri 2a str. 2457T
ucgacuaaccugagagu

SEQ ID NO: 3857476 - RNA, 13 nt, Shigella flexneri 2a str. 2457T
ucgacuccuauua

SEQ ID NO: 3857477 - RNA, 15 nt, Shigella flexneri 2a str. 2457T
ucgacugcgcccuga

SEQ ID NO: 3857478 - RNA, 12 nt, Shigella flexneri 2a str. 2457T
ucgacuggagcc

SEQ ID NO: 3857479 - RNA, 20 nt, Shigella flexneri 2a str. 2457T
ucgacuucuucauucauccg

SEQ ID NO: 3857480 - RNA, 23 nt, Shigella flexneri 2a str. 2457T
ucgacuuuuuucggguuauuggu

SEQ ID NO: 3857481 - RNA, 20 nt, Shigella flexneri 2a str. 2457T
ucgagaacacgguaaugacu

SEQ ID NO: 3857482 - RNA, 19 nt, Shigella flexneri 2a str. 2457T
ucgagaagaccauuaucau

SEQ ID NO: 3857483 - RNA, 16 nt, Shigella flexneri 2a str. 2457T
ucgagaaggcgcugac

SEQ ID NO: 3857484 - RNA, 19 nt, Shigella flexneri 2a str. 2457T
ucgagaaucacgucguucg

SEQ ID NO: 3857485 - RNA, 13 nt, Shigella flexneri 2a str. 2457T
ucgagaaucagcg

SEQ ID NO: 3857486 - RNA, 20 nt, Shigella flexneri 2a str. 2457T
ucgagauucuuaaagucuuu

SEQ ID NO: 3857487 - RNA, 17 nt, Shigella flexneri 2a str. 2457T
ucgaggcaauccguaau

SEQ ID NO: 3857488 - RNA, 12 nt, Shigella flexneri 2a str. 2457T
ucgaggccaauu

SEQ ID NO: 3857489 - RNA, 23 nt, Shigella flexneri 2a str. 2457T
ucgaggccaauuuggcugccaug

SEQ ID NO: 3857490 - RNA, 16 nt, Shigella flexneri 2a str. 2457T
ucgaguaaaaauauuu

SEQ ID NO: 3857491 - RNA, 19 nt, Shigella flexneri 2a str. 2457T
ucgaguagcaaucggcuuu

SEQ ID NO: 3857492 - RNA, 17 nt, Shigella flexneri 2a str. 2457T
ucgagugcaauaacguu

SEQ ID NO: 3857493 - RNA, 23 nt, Shigella flexneri 2a str. 2457T
ucgauaaaaccuuccucaccguu

SEQ ID NO: 3857494 - RNA, 22 nt, Shigella flexneri 2a str. 2457T
ucgauaaacaguuucgccaggg

SEQ ID NO: 3857495 - RNA, 12 nt, Shigella flexneri 2a str. 2457T
ucgauaaaccau

SEQ ID NO: 3857496 - RNA, 23 nt, Shigella flexneri 2a str. 2457T
ucgauaaacgccggaugacacau

SEQ ID NO: 3857497 - RNA, 20 nt, Shigella flexneri 2a str. 2457T
ucgauaaccaucuucuucac

SEQ ID NO: 3857498 - RNA, 21 nt, Shigella flexneri 2a str. 2457T
ucgauaaccaucuucuucacu

SEQ ID NO: 3857499 - RNA, 11 nt, Shigella flexneri 2a str. 2457T
ucgauaccaga

SEQ ID NO: 3857500 - RNA, 18 nt, Shigella flexneri 2a str. 2457T
ucgauaccaucgcuucau

SEQ ID NO: 3857501 - RNA, 13 nt, Shigella flexneri 2a str. 2457T
ucgauaucaagcc

SEQ ID NO: 3857502 - RNA, 19 nt, Shigella flexneri 2a str. 2457T
ucgauaucguacuugccaa

SEQ ID NO: 3857503 - RNA, 15 nt, Shigella flexneri 2a str. 2457T
ucgauaugaccauug

SEQ ID NO: 3857504 - RNA, 22 nt, Shigella flexneri 2a str. 2457T
ucgauaugucuuuuuuccagca

SEQ ID NO: 3857505 - RNA, 22 nt, Shigella flexneri 2a str. 2457T
ucgaucguuaagcgauucagca

SEQ ID NO: 3857506 - RNA, 14 nt, Shigella flexneri 2a str. 2457T
ucgaugaucaaccg

SEQ ID NO: 3857507 - RNA, 13 nt, Shigella flexneri 2a str. 2457T
ucgaugcgcuggc

SEQ ID NO: 3857508 - RNA, 15 nt, Shigella flexneri 2a str. 2457T
ucgaugcgcuggcgg

SEQ ID NO: 3857509 - RNA, 17 nt, Shigella flexneri 2a str. 2457T
ucgaugcgcuggcggcu

SEQ ID NO: 3857510 - RNA, 18 nt, Shigella flexneri 2a str. 2457T
ucgaugcgcuggcggcug

SEQ ID NO: 3857511 - RNA, 21 nt, Shigella flexneri 2a str. 2457T
ucgaugcggcucagccagacg

SEQ ID NO: 3857512 - RNA, 21 nt, Shigella flexneri 2a str. 2457T
ucgaugguguuauugauaucu

SEQ ID NO: 3857513 - RNA, 16 nt, Shigella flexneri 2a str. 2457T
ucgauucacauuuaaa

SEQ ID NO: 3857514 - RNA, 19 nt, Shigella flexneri 2a str. 2457T
ucgauugcacaaagguuuc

SEQ ID NO: 3857515 - RNA, 20 nt, Shigella flexneri 2a str. 2457T
ucgauugcacauucccugca

SEQ ID NO: 3857516 - RNA, 15 nt, Shigella flexneri 2a str. 2457T
ucgauuuucaaaaua

SEQ ID NO: 3857517 - RNA, 15 nt, Shigella flexneri 2a str. 2457T
ucgauuuuuaaugaa

SEQ ID NO: 3857518 - RNA, 17 nt, Shigella flexneri 2a str. 2457T
ucgcaaacaguacaucu

SEQ ID NO: 3857519 - RNA, 19 nt, Shigella flexneri 2a str. 2457T
ucgcaaauccauucaucgc

SEQ ID NO: 3857520 - RNA, 19 nt, Shigella flexneri 2a str. 2457T
ucgcaaauugacuacacca

SEQ ID NO: 3857521 - RNA, 21 nt, Shigella flexneri 2a str. 2457T
ucgcaaauugacuacaccauu

SEQ ID NO: 3857522 - RNA, 12 nt, Shigella flexneri 2a str. 2457T
ucgcaaccagcg

SEQ ID NO: 3857523 - RNA, 19 nt, Shigella flexneri 2a str. 2457T
ucgcaacgccuuccgucag

SEQ ID NO: 3857524 - RNA, 20 nt, Shigella flexneri 2a str. 2457T
ucgcaagacgaaaaaugaau

SEQ ID NO: 3857525 - RNA, 18 nt, Shigella flexneri 2a str. 2457T
ucgcaagccacgccgaac

SEQ ID NO: 3857526 - RNA, 21 nt, Shigella flexneri 2a str. 2457T
ucgcaauaaucaucucuccuu

SEQ ID NO: 3857527 - RNA, 18 nt, Shigella flexneri 2a str. 2457T
ucgcaauacccugaccca

SEQ ID NO: 3857528 - RNA, 16 nt, Shigella flexneri 2a str. 2457T
ucgcaaugauuuugau

SEQ ID NO: 3857529 - RNA, 14 nt, Shigella flexneri 2a str. 2457T
ucgcacaaaaucau

SEQ ID NO: 3857530 - RNA, 20 nt, Shigella flexneri 2a str. 2457T
ucgcacaaaaucaugagguu

SEQ ID NO: 3857531 - RNA, 16 nt, Shigella flexneri 2a str. 2457T
ucgcaccaaacgggca

SEQ ID NO: 3857532 - RNA, 14 nt, Shigella flexneri 2a str. 2457T
ucgcaccuuucaac

SEQ ID NO: 3857533 - RNA, 19 nt, Shigella flexneri 2a str. 2457T
ucgcacguugucagcaacu

SEQ ID NO: 3857534 - RNA, 17 nt, Shigella flexneri 2a str. 2457T
ucgcacuaaguucugcc

SEQ ID NO: 3857535 - RNA, 18 nt, Shigella flexneri 2a str. 2457T
ucgcacuaaguucugccc

SEQ ID NO: 3857536 - RNA, 15 nt, Shigella flexneri 2a str. 2457T
ucgcagacugggcaa

SEQ ID NO: 3857537 - RNA, 22 nt, Shigella flexneri 2a str. 2457T
ucgcagagaucauacagaugcu

SEQ ID NO: 3857538 - RNA, 15 nt, Shigella flexneri 2a str. 2457T
ucgcagccagcgcgc

SEQ ID NO: 3857539 - RNA, 17 nt, Shigella flexneri 2a str. 2457T
ucgcagcgugcucucaa

SEQ ID NO: 3857540 - RNA, 15 nt, Shigella flexneri 2a str. 2457T
ucgcaggcugagaaa

SEQ ID NO: 3857541 - RNA, 16 nt, Shigella flexneri 2a str. 2457T
ucgcaguagccaugca

SEQ ID NO: 3857542 - RNA, 18 nt, Shigella flexneri 2a str. 2457T
ucgcauaaaccacagacc

SEQ ID NO: 3857543 - RNA, 15 nt, Shigella flexneri 2a str. 2457T
ucgcauaccauccag

SEQ ID NO: 3857544 - RNA, 16 nt, Shigella flexneri 2a str. 2457T
ucgcauaucuucaacg

SEQ ID NO: 3857545 - RNA, 19 nt, Shigella flexneri 2a str. 2457T
ucgcaucaggcaucaugcu

SEQ ID NO: 3857546 - RNA, 23 nt, Shigella flexneri 2a str. 2457T
ucgcaucaggcaucaugcucaga

SEQ ID NO: 3857547 - RNA, 19 nt, Shigella flexneri 2a str. 2457T
ucgcaucaggcauugugca

SEQ ID NO: 3857548 - RNA, 23 nt, Shigella flexneri 2a str. 2457T
ucgcaucaggcauuugcuccaga

SEQ ID NO: 3857549 - RNA, 23 nt, Shigella flexneri 2a str. 2457T
ucgcaucccgguaucaaagcgcc

SEQ ID NO: 3857550 - RNA, 16 nt, Shigella flexneri 2a str. 2457T
ucgcauccgacaucaa

SEQ ID NO: 3857551 - RNA, 19 nt, Shigella flexneri 2a str. 2457T
ucgcauccgacaucaaccg

SEQ ID NO: 3857552 - RNA, 13 nt, Shigella flexneri 2a str. 2457T
ucgcauccucuuu

SEQ ID NO: 3857553 - RNA, 14 nt, Shigella flexneri 2a str. 2457T
ucgcaucuggcaua

SEQ ID NO: 3857554 - RNA, 16 nt, Shigella flexneri 2a str. 2457T
ucgcauuaacagccag

SEQ ID NO: 3857555 - RNA, 21 nt, Shigella flexneri 2a str. 2457T
ucgccaaauuuggugcucagu

SEQ ID NO: 3857556 - RNA, 16 nt, Shigella flexneri 2a str. 2457T
ucgccaacaaucucuu

SEQ ID NO: 3857557 - RNA, 19 nt, Shigella flexneri 2a str. 2457T
ucgccaacaaucucuucca

SEQ ID NO: 3857558 - RNA, 20 nt, Shigella flexneri 2a str. 2457T
ucgccaacaaucucuuccag

SEQ ID NO: 3857559 - RNA, 18 nt, Shigella flexneri 2a str. 2457T
ucgcgucuaaauuuugca

SEQ ID NO: 3857560 - RNA, 19 nt, Shigella flexneri 2a str. 2457T
ucgcgucuuauccggccuu

SEQ ID NO: 3857561 - RNA, 19 nt, Shigella flexneri 2a str. 2457T
ucgcguuacuaccggcgug

SEQ ID NO: 3857562 - RNA, 18 nt, Shigella flexneri 2a str. 2457T
ucgcguuugcccgcaacg

SEQ ID NO: 3857563 - RNA, 22 nt, Shigella flexneri 2a str. 2457T
ucgcuaauuucgccgaggcgcu

SEQ ID NO: 3857564 - RNA, 18 nt, Shigella flexneri 2a str. 2457T
ucgcuacaccaaucguca

SEQ ID NO: 3857565 - RNA, 13 nt, Shigella flexneri 2a str. 2457T
ucgcuaccuuuca

SEQ ID NO: 3857566 - RNA, 14 nt, Shigella flexneri 2a str. 2457T
ucgcuacugauaau

SEQ ID NO: 3857567 - RNA, 23 nt, Shigella flexneri 2a str. 2457T
ucgcuauagacaccuugcaacuc

SEQ ID NO: 3857568 - RNA, 17 nt, Shigella flexneri 2a str. 2457T
ucgcucaauauccugac

SEQ ID NO: 3857569 - RNA, 22 nt, Shigella flexneri 2a str. 2457T
ucgcucauaugacguaucaccg

SEQ ID NO: 3857570 - RNA, 18 nt, Shigella flexneri 2a str. 2457T
ucgcuccagucaucgcuu

SEQ ID NO: 3857571 - RNA, 15 nt, Shigella flexneri 2a str. 2457T
ucgcuccugccggac

SEQ ID NO: 3857572 - RNA, 21 nt, Shigella flexneri 2a str. 2457T
ucgcucgcgccgcauccgaca

SEQ ID NO: 3857573 - RNA, 20 nt, Shigella flexneri 2a str. 2457T
ucgcugaacgggccauccau

SEQ ID NO: 3857574 - RNA, 20 nt, Shigella flexneri 2a str. 2457T
ucgcugauauacccuucauc

SEQ ID NO: 3857575 - RNA, 23 nt, Shigella flexneri 2a str. 2457T
ucgcugauccucuaucuguuugc

SEQ ID NO: 3857576 - RNA, 17 nt, Shigella flexneri 2a str. 2457T
ucgcugauuugcuucaa

SEQ ID NO: 3857577 - RNA, 14 nt, Shigella flexneri 2a str. 2457T
ucgcugccagcacu

SEQ ID NO: 3857578 - RNA, 18 nt, Shigella flexneri 2a str. 2457T
ucgcugccgauaauacuc

SEQ ID NO: 3857579 - RNA, 21 nt, Shigella flexneri 2a str. 2457T
ucgcugcgcucuaaaaucauc

SEQ ID NO: 3857580 - RNA, 23 nt, Shigella flexneri 2a str. 2457T
ucgcugcgcucuaaaaucaucac

SEQ ID NO: 3857581 - RNA, 15 nt, Shigella flexneri 2a str. 2457T
ucgcugcuggaucug

SEQ ID NO: 3857582 - RNA, 12 nt, Shigella flexneri 2a str. 2457T
ucgcuggcagac

SEQ ID NO: 3857583 - RNA, 15 nt, Shigella flexneri 2a str. 2457T
ucgcugucggcagua

SEQ ID NO: 3857584 - RNA, 19 nt, Shigella flexneri 2a str. 2457T
ucgcugucuuccugguuuc

SEQ ID NO: 3857585 - RNA, 17 nt, Shigella flexneri 2a str. 2457T
ucgcuguguaaacccag

SEQ ID NO: 3857586 - RNA, 14 nt, Shigella flexneri 2a str. 2457T
ucgcuguuaauguu

SEQ ID NO: 3857587 - RNA, 17 nt, Shigella flexneri 2a str. 2457T
ucgcuuaacgcccaugc

SEQ ID NO: 3857588 - RNA, 13 nt, Shigella flexneri 2a str. 2457T
ucgcuuaauugac

SEQ ID NO: 3857589 - RNA, 15 nt, Shigella flexneri 2a str. 2457T
ucgcuuaccaugcca

SEQ ID NO: 3857590 - RNA, 23 nt, Shigella flexneri 2a str. 2457T
ucgcuuacccuaaauccgccauc

SEQ ID NO: 3857591 - RNA, 13 nt, Shigella flexneri 2a str. 2457T
ucgcuuacgccug

SEQ ID NO: 3857592 - RNA, 12 nt, Shigella flexneri 2a str. 2457T
ucgcuucauuua

SEQ ID NO: 3857593 - RNA, 16 nt, Shigella flexneri 2a str. 2457T
ucgcuucuagugcuug

SEQ ID NO: 3857594 - RNA, 21 nt, Shigella flexneri 2a str. 2457T
ucgcuugaucuuccugauaac

SEQ ID NO: 3857595 - RNA, 18 nt, Shigella flexneri 2a str. 2457T
ucgcuugcaggaucagcu

SEQ ID NO: 3857596 - RNA, 18 nt, Shigella flexneri 2a str. 2457T
ucgcuugcucgcgcaccu

SEQ ID NO: 3857597 - RNA, 19 nt, Shigella flexneri 2a str. 2457T
ucgcuuucaggucagcgaa

SEQ ID NO: 3857598 - RNA, 21 nt, Shigella flexneri 2a str. 2457T
ucgcuuuccagucguuaugca

SEQ ID NO: 3857599 - RNA, 12 nt, Shigella flexneri 2a str. 2457T
ucgcuuucucuu

SEQ ID NO: 3857600 - RNA, 13 nt, Shigella flexneri 2a str. 2457T
ucgcuuucucuuc

SEQ ID NO: 3857601 - RNA, 14 nt, Shigella flexneri 2a str. 2457T
ucgcuuugugcugg

SEQ ID NO: 3857602 - RNA, 20 nt, Shigella flexneri 2a str. 2457T
ucggaaacaaauacaugaug

SEQ ID NO: 3857603 - RNA, 18 nt, Shigella flexneri 2a str. 2457T
ucggaacaguaaagcgca

SEQ ID NO: 3857604 - RNA, 13 nt, Shigella flexneri 2a str. 2457T
ucggaauaagacu

SEQ ID NO: 3857605 - RNA, 15 nt, Shigella flexneri 2a str. 2457T
ucggaaugcaccgcc

SEQ ID NO: 3857606 - RNA, 22 nt, Shigella flexneri 2a str. 2457T
ucggagaacugcaacucaccuu

SEQ ID NO: 3857607 - RNA, 16 nt, Shigella flexneri 2a str. 2457T
ucggagguucgaaucc

SEQ ID NO: 3857608 - RNA, 22 nt, Shigella flexneri 2a str. 2457T
ucggaguggcagccccaggauu

SEQ ID NO: 3857609 - RNA, 18 nt, Shigella flexneri 2a str. 2457T
ucggauaaccaaucacgu

SEQ ID NO: 3857610 - RNA, 21 nt, Shigella flexneri 2a str. 2457T
ucggauaaccaaucacgucgc

SEQ ID NO: 3857611 - RNA, 13 nt, Shigella flexneri 2a str. 2457T
ucggaucauucuc

SEQ ID NO: 3857612 - RNA, 17 nt, Shigella flexneri 2a str. 2457T
ucggaucggcaaugaga

SEQ ID NO: 3857613 - RNA, 22 nt, Shigella flexneri 2a str. 2457T
ucggaugcggcgugaacgccuu

SEQ ID NO: 3857614 - RNA, 22 nt, Shigella flexneri 2a str. 2457T
ucggauuggucgcucgcgccgc

SEQ ID NO: 3857615 - RNA, 14 nt, Shigella flexneri 2a str. 2457T
ucggcaaaauacau

SEQ ID NO: 3857616 - RNA, 19 nt, Shigella flexneri 2a str. 2457T
ucggcaaaauacaugaccg

SEQ ID NO: 3857617 - RNA, 15 nt, Shigella flexneri 2a str. 2457T
ucggcaaacugcuga

SEQ ID NO: 3857618 - RNA, 14 nt, Shigella flexneri 2a str. 2457T
ucggcaaagcgcug

SEQ ID NO: 3857619 - RNA, 19 nt, Shigella flexneri 2a str. 2457T
ucggcaaagcgcugaagaa

SEQ ID NO: 3857620 - RNA, 15 nt, Shigella flexneri 2a str. 2457T
ucggcaaaucgcuga

SEQ ID NO: 3857621 - RNA, 18 nt, Shigella flexneri 2a str. 2457T
ucggcaacaccucagcca

SEQ ID NO: 3857622 - RNA, 14 nt, Shigella flexneri 2a str. 2457T
ucggcaaucacauc

SEQ ID NO: 3857623 - RNA, 16 nt, Shigella flexneri 2a str. 2457T
ucggcaaucacgcccg

SEQ ID NO: 3857624 - RNA, 13 nt, Shigella flexneri 2a str. 2457T
ucggcacugacca

SEQ ID NO: 3857625 - RNA, 22 nt, Shigella flexneri 2a str. 2457T
ucggcacugaccaccaccaccu

SEQ ID NO: 3857626 - RNA, 23 nt, Shigella flexneri 2a str. 2457T
ucggcacugcgaccgaucaccac

SEQ ID NO: 3857627 - RNA, 20 nt, Shigella flexneri 2a str. 2457T
ucggcagaguugagcagucc

SEQ ID NO: 3857628 - RNA, 17 nt, Shigella flexneri 2a str. 2457T
ucggcagcgccaaucgc

SEQ ID NO: 3857629 - RNA, 17 nt, Shigella flexneri 2a str. 2457T
ucggcaguaccugacca

SEQ ID NO: 3857630 - RNA, 16 nt, Shigella flexneri 2a str. 2457T
ucggcauaaagcugcg

SEQ ID NO: 3857631 - RNA, 15 nt, Shigella flexneri 2a str. 2457T
ucggcaucagcagaa

SEQ ID NO: 3857632 - RNA, 19 nt, Shigella flexneri 2a str. 2457T
ucggcaucgccaccguuau

SEQ ID NO: 3857633 - RNA, 14 nt, Shigella flexneri 2a str. 2457T
ucggcauuggcaua

SEQ ID NO: 3857634 - RNA, 14 nt, Shigella flexneri 2a str. 2457T
ucggccagcguguu

SEQ ID NO: 3857635 - RNA, 19 nt, Shigella flexneri 2a str. 2457T
ucggcgagucgcuccugcc

SEQ ID NO: 3857636 - RNA, 16 nt, Shigella flexneri 2a str. 2457T
ucggcgcuaaucaugu

SEQ ID NO: 3857637 - RNA, 15 nt, Shigella flexneri 2a str. 2457T
ucggcgcugaaauuc

SEQ ID NO: 3857638 - RNA, 12 nt, Shigella flexneri 2a str. 2457T
ucggcggcggca

SEQ ID NO: 3857639 - RNA, 19 nt, Shigella flexneri 2a str. 2457T
ucggcguaauccugaaagc

SEQ ID NO: 3857640 - RNA, 18 nt, Shigella flexneri 2a str. 2457T
ucggcgucauuuuuucga

SEQ ID NO: 3857641 - RNA, 19 nt, Shigella flexneri 2a str. 2457T
ucggcgucuuguugaacag

SEQ ID NO: 3857642 - RNA, 20 nt, Shigella flexneri 2a str. 2457T
ucggcugacgauaccaggug

SEQ ID NO: 3857643 - RNA, 23 nt, Shigella flexneri 2a str. 2457T
ucggcuggcgaaccaggaagaug

SEQ ID NO: 3857644 - RNA, 17 nt, Shigella flexneri 2a str. 2457T
ucggcuucugccuuauc

SEQ ID NO: 3857645 - RNA, 22 nt, Shigella flexneri 2a str. 2457T
ucggcuucugccuuauccagca

SEQ ID NO: 3857646 - RNA, 22 nt, Shigella flexneri 2a str. 2457T
ucgggaaaaucugcgggaacau

SEQ ID NO: 3857647 - RNA, 13 nt, Shigella flexneri 2a str. 2457T
ucgggaaauaaca

SEQ ID NO: 3857648 - RNA, 14 nt, Shigella flexneri 2a str. 2457T
ucgggaaccggcug

SEQ ID NO: 3857649 - RNA, 22 nt, Shigella flexneri 2a str. 2457T
ucgggaaggcccuuucccuucu

SEQ ID NO: 3857650 - RNA, 17 nt, Shigella flexneri 2a str. 2457T
ucgggauugccagaugc

SEQ ID NO: 3857651 - RNA, 21 nt, Shigella flexneri 2a str. 2457T
ucgggcaacguugaccaguca

SEQ ID NO: 3857652 - RNA, 22 nt, Shigella flexneri 2a str. 2457T
ucgggcacagauuuccaagcgc

SEQ ID NO: 3857653 - RNA, 22 nt, Shigella flexneri 2a str. 2457T
ucgggcgauuuugcuuuuguca

SEQ ID NO: 3857654 - RNA, 22 nt, Shigella flexneri 2a str. 2457T
ucgggcuagacugaugacaaag

SEQ ID NO: 3857655 - RNA, 23 nt, Shigella flexneri 2a str. 2457T
ucggggcgaucgcgccaaucagc

SEQ ID NO: 3857656 - RNA, 15 nt, Shigella flexneri 2a str. 2457T
ucuaacucuucugaa

SEQ ID NO: 3857657 - RNA, 16 nt, Shigella flexneri 2a str. 2457T
ucuaacucuucugaaa

SEQ ID NO: 3857658 - RNA, 16 nt, Shigella flexneri 2a str. 2457T
ucuaauccugaagacg

SEQ ID NO: 3857659 - RNA, 12 nt, Shigella flexneri 2a str. 2457T
ucuaaugcuuuu

SEQ ID NO: 3857660 - RNA, 22 nt, Shigella flexneri 2a str. 2457T
ucuaauuuuuugcgccacuuuu

SEQ ID NO: 3857661 - RNA, 15 nt, Shigella flexneri 2a str. 2457T
ucuacaaaagauuau

SEQ ID NO: 3857662 - RNA, 21 nt, Shigella flexneri 2a str. 2457T
ucuacacagacgguuuuucaa

SEQ ID NO: 3857663 - RNA, 16 nt, Shigella flexneri 2a str. 2457T
ucuacagcgcccgcca

SEQ ID NO: 3857664 - RNA, 19 nt, Shigella flexneri 2a str. 2457T
ucuacagcuucacgcgcca

SEQ ID NO: 3857665 - RNA, 14 nt, Shigella flexneri 2a str. 2457T
ucuaccacaugauu

SEQ ID NO: 3857666 - RNA, 23 nt, Shigella flexneri 2a str. 2457T
ucuaccagaugcucuuuucugaa

SEQ ID NO: 3857667 - RNA, 18 nt, Shigella flexneri 2a str. 2457T
ucuacgacuugaaaaagu

SEQ ID NO: 3857668 - RNA, 21 nt, Shigella flexneri 2a str. 2457T
ucuacguuuccacggauaaca

SEQ ID NO: 3857669 - RNA, 22 nt, Shigella flexneri 2a str. 2457T
ucuacucguuuauuaugccaca

SEQ ID NO: 3857670 - RNA, 20 nt, Shigella flexneri 2a str. 2457T
ucuacugaaggcgcauugcu

SEQ ID NO: 3857671 - RNA, 14 nt, Shigella flexneri 2a str. 2457T
ucuacugcaccgca

SEQ ID NO: 3857672 - RNA, 14 nt, Shigella flexneri 2a str. 2457T
ucuauaccgcugaa

SEQ ID NO: 3857673 - RNA, 23 nt, Shigella flexneri 2a str. 2457T
ucuauauuacgagucacaaacau

SEQ ID NO: 3857674 - RNA, 18 nt, Shigella flexneri 2a str. 2457T
ucuaucaacaguuuguug

SEQ ID NO: 3857675 - RNA, 20 nt, Shigella flexneri 2a str. 2457T
ucuaucaggacgaaaaauca

SEQ ID NO: 3857676 - RNA, 15 nt, Shigella flexneri 2a str. 2457T
ucuaucaucagcaug

SEQ ID NO: 3857677 - RNA, 17 nt, Shigella flexneri 2a str. 2457T
ucuauccagcucaucca

SEQ ID NO: 3857678 - RNA, 14 nt, Shigella flexneri 2a str. 2457T
ucuaucucccugau

SEQ ID NO: 3857679 - RNA, 10 nt, Shigella flexneri 2a str. 2457T
ucuaucugcc

SEQ ID NO: 3857680 - RNA, 16 nt, Shigella flexneri 2a str. 2457T
ucuaucuuucagaccu

SEQ ID NO: 3857681 - RNA, 20 nt, Shigella flexneri 2a str. 2457T
ucuaugaagaacuggaacgc

SEQ ID NO: 3857682 - RNA, 20 nt, Shigella flexneri 2a str. 2457T
ucuaugguuuuuucuacaca

SEQ ID NO: 3857683 - RNA, 13 nt, Shigella flexneri 2a str. 2457T
ucuauuaaaaagc

SEQ ID NO: 3857684 - RNA, 13 nt, Shigella flexneri 2a str. 2457T
ucuauuaauuaug

SEQ ID NO: 3857685 - RNA, 15 nt, Shigella flexneri 2a str. 2457T
ucuauucaccgcauc

SEQ ID NO: 3857686 - RNA, 18 nt, Shigella flexneri 2a str. 2457T
ucuauugcaacauguuga

SEQ ID NO: 3857687 - RNA, 14 nt, Shigella flexneri 2a str. 2457T
ucucaaaccggcuc

SEQ ID NO: 3857688 - RNA, 14 nt, Shigella flexneri 2a str. 2457T
ucucaagagugaac

SEQ ID NO: 3857689 - RNA, 13 nt, Shigella flexneri 2a str. 2457T
ucucaagcaaguu

SEQ ID NO: 3857690 - RNA, 18 nt, Shigella flexneri 2a str. 2457T
ucucaauaaaaggaaaca

SEQ ID NO: 3857691 - RNA, 13 nt, Shigella flexneri 2a str. 2457T
ucucaaucaccac

SEQ ID NO: 3857692 - RNA, 18 nt, Shigella flexneri 2a str. 2457T
ucucaaucccuuucucuu

SEQ ID NO: 3857693 - RNA, 19 nt, Shigella flexneri 2a str. 2457T
ucucaaucucuuuuuccac

SEQ ID NO: 3857694 - RNA, 12 nt, Shigella flexneri 2a str. 2457T
ucucaaucuuca

SEQ ID NO: 3857695 - RNA, 13 nt, Shigella flexneri 2a str. 2457T
ucucaaucuucac

SEQ ID NO: 3857696 - RNA, 18 nt, Shigella flexneri 2a str. 2457T
ucucaauguauucccgua

SEQ ID NO: 3857697 - RNA, 15 nt, Shigella flexneri 2a str. 2457T
ucucaauuuucacuu

SEQ ID NO: 3857698 - RNA, 22 nt, Shigella flexneri 2a str. 2457T
ucucacccgcaaacaggaacac

SEQ ID NO: 3857699 - RNA, 18 nt, Shigella flexneri 2a str. 2457T
ucucacccgcuucauaac

SEQ ID NO: 3857700 - RNA, 23 nt, Shigella flexneri 2a str. 2457T
ucucaccuauguggaaacaguga

SEQ ID NO: 3857701 - RNA, 13 nt, Shigella flexneri 2a str. 2457T
ucucacucaccgc

SEQ ID NO: 3857702 - RNA, 16 nt, Shigella flexneri 2a str. 2457T
ucucacuccagccaga

SEQ ID NO: 3857703 - RNA, 19 nt, Shigella flexneri 2a str. 2457T
ucucacuccggccagagca

SEQ ID NO: 3857704 - RNA, 18 nt, Shigella flexneri 2a str. 2457T
ucucacuguucacuuuug

SEQ ID NO: 3857705 - RNA, 21 nt, Shigella flexneri 2a str. 2457T
ucucagagaacuguagacaaa

SEQ ID NO: 3857706 - RNA, 11 nt, Shigella flexneri 2a str. 2457T
ucucagcacac

SEQ ID NO: 3857707 - RNA, 18 nt, Shigella flexneri 2a str. 2457T
ucucagcacauugauggc

SEQ ID NO: 3857708 - RNA, 21 nt, Shigella flexneri 2a str. 2457T
ucucagcgccgcuuuccaggc

SEQ ID NO: 3857709 - RNA, 23 nt, Shigella flexneri 2a str. 2457T
ucucagcgccgcuuuccaggcug

SEQ ID NO: 3857710 - RNA, 23 nt, Shigella flexneri 2a str. 2457T
ucucaggccuacaaaaucuugca

SEQ ID NO: 3857711 - RNA, 23 nt, Shigella flexneri 2a str. 2457T
ucucagguagcgcauaagccacc

SEQ ID NO: 3857712 - RNA, 19 nt, Shigella flexneri 2a str. 2457T
ucucaguggcuauuuacca

SEQ ID NO: 3857713 - RNA, 13 nt, Shigella flexneri 2a str. 2457T
ucucaucaccauu

SEQ ID NO: 3857714 - RNA, 18 nt, Shigella flexneri 2a str. 2457T
ucucauccaauaacguga

SEQ ID NO: 3857715 - RNA, 19 nt, Shigella flexneri 2a str. 2457T
ucucauccauucgaugaga

SEQ ID NO: 3857716 - RNA, 21 nt, Shigella flexneri 2a str. 2457T
ucucaucgcugcgcucuaaaa

SEQ ID NO: 3857717 - RNA, 13 nt, Shigella flexneri 2a str. 2457T
ucucauuuuucag

SEQ ID NO: 3857718 - RNA, 22 nt, Shigella flexneri 2a str. 2457T
ucuccaacaucgaaaacgccac

SEQ ID NO: 3857719 - RNA, 14 nt, Shigella flexneri 2a str. 2457T
ucuccacagucagg

SEQ ID NO: 3857720 - RNA, 18 nt, Shigella flexneri 2a str. 2457T
ucuccagcaguucuacug

SEQ ID NO: 3857721 - RNA, 15 nt, Shigella flexneri 2a str. 2457T
ucuccagcuccccac

SEQ ID NO: 3857722 - RNA, 15 nt, Shigella flexneri 2a str. 2457T
ucuccauuucauuga

SEQ ID NO: 3857723 - RNA, 12 nt, Shigella flexneri 2a str. 2457T
ucuccccaaggg

SEQ ID NO: 3857724 - RNA, 12 nt, Shigella flexneri 2a str. 2457T
ucuccccggagg

SEQ ID NO: 3857725 - RNA, 20 nt, Shigella flexneri 2a str. 2457T
ucucccgaaaaaccugacgu

SEQ ID NO: 3857726 - RNA, 23 nt, Shigella flexneri 2a str. 2457T
ucucccgaaugaccgccccugcg

SEQ ID NO: 3857727 - RNA, 22 nt, Shigella flexneri 2a str. 2457T
ucucccgauaaccuucuucauu

SEQ ID NO: 3857728 - RNA, 12 nt, Shigella flexneri 2a str. 2457T
ucucccucgcuc

SEQ ID NO: 3857729 - RNA, 20 nt, Shigella flexneri 2a str. 2457T
ucucccucgcucuguaggga

SEQ ID NO: 3857730 - RNA, 22 nt, Shigella flexneri 2a str. 2457T
ucuccgcugagacgcgcuugca

SEQ ID NO: 3857731 - RNA, 20 nt, Shigella flexneri 2a str. 2457T
ucuccggcgcauccaugaua

SEQ ID NO: 3857732 - RNA, 13 nt, Shigella flexneri 2a str. 2457T
ucuccucccuugu

SEQ ID NO: 3857733 - RNA, 14 nt, Shigella flexneri 2a str. 2457T
ucuccuccgaugac

SEQ ID NO: 3857734 - RNA, 20 nt, Shigella flexneri 2a str. 2457T
ucuccugcggcgacaaaugu

SEQ ID NO: 3857735 - RNA, 23 nt, Shigella flexneri 2a str. 2457T
ucuccuggcgcaccuuuuuuuau

SEQ ID NO: 3857736 - RNA, 15 nt, Shigella flexneri 2a str. 2457T
ucuccuguuucacuu

SEQ ID NO: 3857737 - RNA, 13 nt, Shigella flexneri 2a str. 2457T
ucuccuucgcaca

SEQ ID NO: 3857738 - RNA, 24 nt, Shigella flexneri 2a str. 2457T
ucuccuuuauagugugcaaucacu

SEQ ID NO: 3857739 - RNA, 15 nt, Shigella flexneri 2a str. 2457T
ucuccuuucuuucug

SEQ ID NO: 3857740 - RNA, 18 nt, Shigella flexneri 2a str. 2457T
ucucgauaaaccauccug

SEQ ID NO: 3857741 - RNA, 22 nt, Shigella flexneri 2a str. 2457T
ucucgaucgauaggaauuaaaa

SEQ ID NO: 3857742 - RNA, 15 nt, Shigella flexneri 2a str. 2457T
ucucgcccagcagac

SEQ ID NO: 3857743 - RNA, 23 nt, Shigella flexneri 2a str. 2457T
ucucgcucaaaaauccagauuua

SEQ ID NO: 3857744 - RNA, 22 nt, Shigella flexneri 2a str. 2457T
ucucggcaauaauuuuuucgcc

SEQ ID NO: 3857745 - RNA, 15 nt, Shigella flexneri 2a str. 2457T
ucucggcccggccca

SEQ ID NO: 3857746 - RNA, 14 nt, Shigella flexneri 2a str. 2457T
ucucgggaaggccc

SEQ ID NO: 3857747 - RNA, 17 nt, Shigella flexneri 2a str. 2457T
ucucgggaaggcccuuu

SEQ ID NO: 3857748 - RNA, 22 nt, Shigella flexneri 2a str. 2457T
ucucgggcaguaaaucaauauc

SEQ ID NO: 3857749 - RNA, 21 nt, Shigella flexneri 2a str. 2457T
ucucggucggcauuuuucggc

SEQ ID NO: 3857750 - RNA, 17 nt, Shigella flexneri 2a str. 2457T
ucucggugaacgccugc

SEQ ID NO: 3857751 - RNA, 20 nt, Shigella flexneri 2a str. 2457T
ucucgucauccuaaacgcug

SEQ ID NO: 3857752 - RNA, 18 nt, Shigella flexneri 2a str. 2457T
ucucguccaguuugccuu

SEQ ID NO: 3857753 - RNA, 21 nt, Shigella flexneri 2a str. 2457T
ucugcguuagaaaacgccugc

SEQ ID NO: 3857754 - RNA, 14 nt, Shigella flexneri 2a str. 2457T
ucugcguucugauu

SEQ ID NO: 3857755 - RNA, 14 nt, Shigella flexneri 2a str. 2457T
ucugcucgcaggcu

SEQ ID NO: 3857756 - RNA, 20 nt, Shigella flexneri 2a str. 2457T
ucugcucuucuuucaucaug

SEQ ID NO: 3857757 - RNA, 15 nt, Shigella flexneri 2a str. 2457T
ucugcugauuaaccc

SEQ ID NO: 3857758 - RNA, 14 nt, Shigella flexneri 2a str. 2457T
ucugcugccugacg

SEQ ID NO: 3857759 - RNA, 21 nt, Shigella flexneri 2a str. 2457T
ucugcugcugcguuccggcau

SEQ ID NO: 3857760 - RNA, 23 nt, Shigella flexneri 2a str. 2457T
ucugcuucguuaacgugucauaa

SEQ ID NO: 3857761 - RNA, 14 nt, Shigella flexneri 2a str. 2457T
ucugcuucugccug

SEQ ID NO: 3857762 - RNA, 16 nt, Shigella flexneri 2a str. 2457T
ucugcuucugccuggg

SEQ ID NO: 3857763 - RNA, 19 nt, Shigella flexneri 2a str. 2457T
ucugcuucugccugggccu

SEQ ID NO: 3857764 - RNA, 20 nt, Shigella flexneri 2a str. 2457T
ucugcuuguggcggaaagac

SEQ ID NO: 3857765 - RNA, 17 nt, Shigella flexneri 2a str. 2457T
ucugcuuuucccuccac

SEQ ID NO: 3857766 - RNA, 16 nt, Shigella flexneri 2a str. 2457T
ucugcuuuucguucag

SEQ ID NO: 3857767 - RNA, 20 nt, Shigella flexneri 2a str. 2457T
ucuggaacuggcugccagcg

SEQ ID NO: 3857768 - RNA, 14 nt, Shigella flexneri 2a str. 2457T
ucuggaagccaguc

SEQ ID NO: 3857769 - RNA, 18 nt, Shigella flexneri 2a str. 2457T
ucuggaagccagucacau

SEQ ID NO: 3857770 - RNA, 23 nt, Shigella flexneri 2a str. 2457T
ucuggaauggaaacagcaccauc

SEQ ID NO: 3857771 - RNA, 10 nt, Shigella flexneri 2a str. 2457T
ucuggaauuc

SEQ ID NO: 3857772 - RNA, 20 nt, Shigella flexneri 2a str. 2457T
ucuggaguuauagcuggauu

SEQ ID NO: 3857773 - RNA, 18 nt, Shigella flexneri 2a str. 2457T
ucuggaguuccuggauga

SEQ ID NO: 3857774 - RNA, 20 nt, Shigella flexneri 2a str. 2457T
ucuggcacgaccuggcagca

SEQ ID NO: 3857775 - RNA, 13 nt, Shigella flexneri 2a str. 2457T
ucuggcagcgcgc

SEQ ID NO: 3857776 - RNA, 16 nt, Shigella flexneri 2a str. 2457T
ucuggcagcgcgcauu

SEQ ID NO: 3857777 - RNA, 16 nt, Shigella flexneri 2a str. 2457T
ucuggcagcugcgcuu

SEQ ID NO: 3857778 - RNA, 20 nt, Shigella flexneri 2a str. 2457T
ucuggcauaaacaaagcgca

SEQ ID NO: 3857779 - RNA, 22 nt, Shigella flexneri 2a str. 2457T
ucuggccgcuuccagcauuucu

SEQ ID NO: 3857780 - RNA, 16 nt, Shigella flexneri 2a str. 2457T
ucuggccguacccagc

SEQ ID NO: 3857781 - RNA, 18 nt, Shigella flexneri 2a str. 2457T
ucuggcgaaccgcuuugc

SEQ ID NO: 3857782 - RNA, 17 nt, Shigella flexneri 2a str. 2457T
ucuggcgagucaccaua

SEQ ID NO: 3857783 - RNA, 15 nt, Shigella flexneri 2a str. 2457T
ucuggcgauuuugaa

SEQ ID NO: 3857784 - RNA, 14 nt, Shigella flexneri 2a str. 2457T
ucuggcgcgaacag

SEQ ID NO: 3857785 - RNA, 12 nt, Shigella flexneri 2a str. 2457T
ucuggcgcugga

SEQ ID NO: 3857786 - RNA, 16 nt, Shigella flexneri 2a str. 2457T
ucuggcggaagcucca

SEQ ID NO: 3857787 - RNA, 17 nt, Shigella flexneri 2a str. 2457T
ucuggcguacagagggc

SEQ ID NO: 3857788 - RNA, 18 nt, Shigella flexneri 2a str. 2457T
ucuggcgucaaagcugcu

SEQ ID NO: 3857789 - RNA, 19 nt, Shigella flexneri 2a str. 2457T
ucuggcguugcuggaccuu

SEQ ID NO: 3857790 - RNA, 22 nt, Shigella flexneri 2a str. 2457T
ucuggcuacugaugguuuuaau

SEQ ID NO: 3857791 - RNA, 16 nt, Shigella flexneri 2a str. 2457T
ucuggcuguuucgcuu

SEQ ID NO: 3857792 - RNA, 16 nt, Shigella flexneri 2a str. 2457T
ucuggcuugccagcag

SEQ ID NO: 3857793 - RNA, 17 nt, Shigella flexneri 2a str. 2457T
ucuggcuugccagcagg

SEQ ID NO: 3857794 - RNA, 17 nt, Shigella flexneri 2a str. 2457T
ucuggggcguguuuugu

SEQ ID NO: 3857795 - RNA, 16 nt, Shigella flexneri 2a str. 2457T
ucuggguggcguucca

SEQ ID NO: 3857796 - RNA, 22 nt, Shigella flexneri 2a str. 2457T
ucuggguggugauuuucgccgc

SEQ ID NO: 3857797 - RNA, 14 nt, Shigella flexneri 2a str. 2457T
ucugguauuaaccg

SEQ ID NO: 3857798 - RNA, 17 nt, Shigella flexneri 2a str. 2457T
ucuggucaguuggcugg

SEQ ID NO: 3857799 - RNA, 15 nt, Shigella flexneri 2a str. 2457T
ucuggugaccuggga

SEQ ID NO: 3857800 - RNA, 16 nt, Shigella flexneri 2a str. 2457T
ucuggugcuuuuucaa

SEQ ID NO: 3857801 - RNA, 15 nt, Shigella flexneri 2a str. 2457T
ucugguggaaaagaa

SEQ ID NO: 3857802 - RNA, 22 nt, Shigella flexneri 2a str. 2457T
ucugguggacaaccauaaauuu

SEQ ID NO: 3857803 - RNA, 20 nt, Shigella flexneri 2a str. 2457T
ucuggugggugcuuuaaaaa

SEQ ID NO: 3857804 - RNA, 19 nt, Shigella flexneri 2a str. 2457T
ucuggugguaaucgacaac

SEQ ID NO: 3857805 - RNA, 19 nt, Shigella flexneri 2a str. 2457T
ucugguguggagugcagca

SEQ ID NO: 3857806 - RNA, 22 nt, Shigella flexneri 2a str. 2457T
ucugguucgccaaaugucacca

SEQ ID NO: 3857807 - RNA, 14 nt, Shigella flexneri 2a str. 2457T
ucugguuguggugg

SEQ ID NO: 3857808 - RNA, 14 nt, Shigella flexneri 2a str. 2457T
ucugguuucaagau

SEQ ID NO: 3857809 - RNA, 22 nt, Shigella flexneri 2a str. 2457T
ucugguuucaguaauccuuucu

SEQ ID NO: 3857810 - RNA, 21 nt, Shigella flexneri 2a str. 2457T
ucuguaauugaaggcuuauaa

SEQ ID NO: 3857811 - RNA, 15 nt, Shigella flexneri 2a str. 2457T
ucuguaccaccagaa

SEQ ID NO: 3857812 - RNA, 23 nt, Shigella flexneri 2a str. 2457T
ucuguaccaccagaaucgccagc

SEQ ID NO: 3857813 - RNA, 14 nt, Shigella flexneri 2a str. 2457T
ucuguaugacaaca

SEQ ID NO: 3857814 - RNA, 15 nt, Shigella flexneri 2a str. 2457T
ucugucagguaacaa

SEQ ID NO: 3857815 - RNA, 22 nt, Shigella flexneri 2a str. 2457T
ucugucaguggacgauaagcac

SEQ ID NO: 3857816 - RNA, 16 nt, Shigella flexneri 2a str. 2457T
ucugucaguuggcugu

SEQ ID NO: 3857817 - RNA, 20 nt, Shigella flexneri 2a str. 2457T
ucuguccaaauccuucagca

SEQ ID NO: 3857818 - RNA, 14 nt, Shigella flexneri 2a str. 2457T
ucugucgcucugcu

SEQ ID NO: 3857819 - RNA, 18 nt, Shigella flexneri 2a str. 2457T
ucugucugauaaaaaacc

SEQ ID NO: 3857820 - RNA, 14 nt, Shigella flexneri 2a str. 2457T
ucugugccgcugac

SEQ ID NO: 3857821 - RNA, 23 nt, Shigella flexneri 2a str. 2457T
ucuguguaaaugccuuucucaga

SEQ ID NO: 3857822 - RNA, 21 nt, Shigella flexneri 2a str. 2457T
ucuguuaucacuuaacccauu

SEQ ID NO: 3857823 - RNA, 18 nt, Shigella flexneri 2a str. 2457T
ucuguuccauaaucgccu

SEQ ID NO: 3857824 - RNA, 14 nt, Shigella flexneri 2a str. 2457T
ucuguuccggcgua

SEQ ID NO: 3857825 - RNA, 19 nt, Shigella flexneri 2a str. 2457T
ucuguugccgcuacaucac

SEQ ID NO: 3857826 - RNA, 18 nt, Shigella flexneri 2a str. 2457T
ucuguuguaauaguguau

SEQ ID NO: 3857827 - RNA, 16 nt, Shigella flexneri 2a str. 2457T
ucuguuuccagauuuu

SEQ ID NO: 3857828 - RNA, 22 nt, Shigella flexneri 2a str. 2457T
ucuguuugccucguucuucccu

SEQ ID NO: 3857829 - RNA, 21 nt, Shigella flexneri 2a str. 2457T
ucuguuuucguaauaauucac

SEQ ID NO: 3857830 - RNA, 19 nt, Shigella flexneri 2a str. 2457T
ucuuaaaggggugaaaaaa

SEQ ID NO: 3857831 - RNA, 13 nt, Shigella flexneri 2a str. 2457T
ucuuacauuccgu

SEQ ID NO: 3857832 - RNA, 21 nt, Shigella flexneri 2a str. 2457T
ucuuacccuuccuuagcaaaa

SEQ ID NO: 3857833 - RNA, 18 nt, Shigella flexneri 2a str. 2457T
ucuuacguaauuuauaau

SEQ ID NO: 3857834 - RNA, 20 nt, Shigella flexneri 2a str. 2457T
ucuuacuucaacacauaacc

SEQ ID NO: 3857835 - RNA, 13 nt, Shigella flexneri 2a str. 2457T
ucuuacuuuuaau

SEQ ID NO: 3857836 - RNA, 13 nt, Shigella flexneri 2a str. 2457T
ucuuauaugauga

SEQ ID NO: 3857837 - RNA, 23 nt, Shigella flexneri 2a str. 2457T
ucuuaucacgaugcuaaaaacau

SEQ ID NO: 3857838 - RNA, 16 nt, Shigella flexneri 2a str. 2457T
ucuuaucaggccaggu

SEQ ID NO: 3857839 - RNA, 13 nt, Shigella flexneri 2a str. 2457T
ucuuaucaggccu

SEQ ID NO: 3857840 - RNA, 21 nt, Shigella flexneri 2a str. 2457T
ucuuaucaggccuacaacucc

SEQ ID NO: 3857841 - RNA, 22 nt, Shigella flexneri 2a str. 2457T
ucuuaucaggccuaccuuaacc

SEQ ID NO: 3857842 - RNA, 16 nt, Shigella flexneri 2a str. 2457T
ucuuaucaggccugug

SEQ ID NO: 3857843 - RNA, 19 nt, Shigella flexneri 2a str. 2457T
ucuuaucaguauacgccac

SEQ ID NO: 3857844 - RNA, 17 nt, Shigella flexneri 2a str. 2457T
ucuuaucaugccuacau

SEQ ID NO: 3857845 - RNA, 21 nt, Shigella flexneri 2a str. 2457T
ucuuaucaugccuacauauuu

SEQ ID NO: 3857846 - RNA, 17 nt, Shigella flexneri 2a str. 2457T
ucuuauccagcaaccag

SEQ ID NO: 3857847 - RNA, 19 nt, Shigella flexneri 2a str. 2457T
ucuuauccagcugcgcgcg

SEQ ID NO: 3857848 - RNA, 22 nt, Shigella flexneri 2a str. 2457T
ucuuauccggccuacguguguu

SEQ ID NO: 3857849 - RNA, 20 nt, Shigella flexneri 2a str. 2457T
ucuuauccugcguuuguccg

SEQ ID NO: 3857850 - RNA, 14 nt, Shigella flexneri 2a str. 2457T
ucuuucaauuugua

SEQ ID NO: 3857851 - RNA, 17 nt, Shigella flexneri 2a str. 2457T
ucuuucaccucuucauu

SEQ ID NO: 3857852 - RNA, 17 nt, Shigella flexneri 2a str. 2457T
ucuuucacgcccagucc

SEQ ID NO: 3857853 - RNA, 17 nt, Shigella flexneri 2a str. 2457T
ucuuucagcaccagccc

SEQ ID NO: 3857854 - RNA, 17 nt, Shigella flexneri 2a str. 2457T
ucuuucagcaccgcgaa

SEQ ID NO: 3857855 - RNA, 11 nt, Shigella flexneri 2a str. 2457T
ucuuucaguac

SEQ ID NO: 3857856 - RNA, 15 nt, Shigella flexneri 2a str. 2457T
ucuuucccggcaauc

SEQ ID NO: 3857857 - RNA, 14 nt, Shigella flexneri 2a str. 2457T
ucuuucuaugagaa

SEQ ID NO: 3857858 - RNA, 15 nt, Shigella flexneri 2a str. 2457T
ucuuucuaugagaaa

SEQ ID NO: 3857859 - RNA, 14 nt, Shigella flexneri 2a str. 2457T
ucuuucucaaucug

SEQ ID NO: 3857860 - RNA, 20 nt, Shigella flexneri 2a str. 2457T
ucuuucucgccuuucuuaaa

SEQ ID NO: 3857861 - RNA, 18 nt, Shigella flexneri 2a str. 2457T
ucuuugaugaaacaugau

SEQ ID NO: 3857862 - RNA, 16 nt, Shigella flexneri 2a str. 2457T
ucuuugcccgcagauc

SEQ ID NO: 3857863 - RNA, 22 nt, Shigella flexneri 2a str. 2457T
ucuuugcgcccccgauccagcg

SEQ ID NO: 3857864 - RNA, 20 nt, Shigella flexneri 2a str. 2457T
ucuuugcuuccugaguaaua

SEQ ID NO: 3857865 - RNA, 14 nt, Shigella flexneri 2a str. 2457T
ucuuuggcaucaau

SEQ ID NO: 3857866 - RNA, 19 nt, Shigella flexneri 2a str. 2457T
ucuuuguauuuauuuucag

SEQ ID NO: 3857867 - RNA, 12 nt, Shigella flexneri 2a str. 2457T
ucuuugucggug

SEQ ID NO: 3857868 - RNA, 12 nt, Shigella flexneri 2a str. 2457T
ucuuuucaggcg

SEQ ID NO: 3857869 - RNA, 13 nt, Shigella flexneri 2a str. 2457T
ucuuuuccuuucg

SEQ ID NO: 3857870 - RNA, 14 nt, Shigella flexneri 2a str. 2457T
ucuuuucgcuuuac

SEQ ID NO: 3857871 - RNA, 18 nt, Shigella flexneri 2a str. 2457T
ucuuuuggcgagagacgc

SEQ ID NO: 3857872 - RNA, 15 nt, Shigella flexneri 2a str. 2457T
ucuuuuuaaugacuu

SEQ ID NO: 3857873 - RNA, 19 nt, Shigella flexneri 2a str. 2457T
ucuuuuucauuaugaucaa

SEQ ID NO: 3857874 - RNA, 19 nt, Shigella flexneri 2a str. 2457T
ucuuuuuucaacauguuga

SEQ ID NO: 3857875 - RNA, 14 nt, Shigella flexneri 2a str. 2457T
ucuuuuuuccgcuu

SEQ ID NO: 3857876 - RNA, 19 nt, Shigella flexneri 2a str. 2457T
ucuuuuuuuauuaaaugug

SEQ ID NO: 3857877 - RNA, 23 nt, Shigella flexneri 2a str. 2457T
ugaaaaaaaggcgaaaggcuggc

SEQ ID NO: 3857878 - RNA, 15 nt, Shigella flexneri 2a str. 2457T
ugaaaaaaccugcac

SEQ ID NO: 3857879 - RNA, 14 nt, Shigella flexneri 2a str. 2457T
ugaaaaaacuggcu

SEQ ID NO: 3857880 - RNA, 13 nt, Shigella flexneri 2a str. 2457T
ugaaaaaauagaa

SEQ ID NO: 3857881 - RNA, 14 nt, Shigella flexneri 2a str. 2457T
ugaaaaaaugauga

SEQ ID NO: 3857882 - RNA, 22 nt, Shigella flexneri 2a str. 2457T
ugaaaaagugccaaaaaucgca

SEQ ID NO: 3857883 - RNA, 23 nt, Shigella flexneri 2a str. 2457T
ugaaaaaguucgacuuaaaucuu

SEQ ID NO: 3857884 - RNA, 14 nt, Shigella flexneri 2a str. 2457T
ugaaaaaucaaaaa

SEQ ID NO: 3857885 - RNA, 18 nt, Shigella flexneri 2a str. 2457T
ugaaaaaucaaaaaacug

SEQ ID NO: 3857886 - RNA, 22 nt, Shigella flexneri 2a str. 2457T
ugaaaaaucaaaaaacuggaaa

SEQ ID NO: 3857887 - RNA, 21 nt, Shigella flexneri 2a str. 2457T
ugaaaaccggacugaaaguac

SEQ ID NO: 3857888 - RNA, 14 nt, Shigella flexneri 2a str. 2457T
ugaaaacgaaggcc

SEQ ID NO: 3857889 - RNA, 19 nt, Shigella flexneri 2a str. 2457T
ugaaaacgcauaccagucu

SEQ ID NO: 3857890 - RNA, 17 nt, Shigella flexneri 2a str. 2457T
ugaaaacggacaugcca

SEQ ID NO: 3857891 - RNA, 19 nt, Shigella flexneri 2a str. 2457T
ugaaaacucuuagcaaaca

SEQ ID NO: 3857892 - RNA, 18 nt, Shigella flexneri 2a str. 2457T
ugaaaaguccaggcugca

SEQ ID NO: 3857893 - RNA, 20 nt, Shigella flexneri 2a str. 2457T
ugaaaaguccaggcugcaaa

SEQ ID NO: 3857894 - RNA, 18 nt, Shigella flexneri 2a str. 2457T
ugaaaauaacaucgccag

SEQ ID NO: 3857895 - RNA, 15 nt, Shigella flexneri 2a str. 2457T
ugaaaauaaccauau

SEQ ID NO: 3857896 - RNA, 14 nt, Shigella flexneri 2a str. 2457T
ugaaaaucaccauu

SEQ ID NO: 3857897 - RNA, 14 nt, Shigella flexneri 2a str. 2457T
ugaaaaucauacau

SEQ ID NO: 3857898 - RNA, 13 nt, Shigella flexneri 2a str. 2457T
ugaaaaugcuggu

SEQ ID NO: 3857899 - RNA, 14 nt, Shigella flexneri 2a str. 2457T
ugaaaaugcugguu

SEQ ID NO: 3857900 - RNA, 14 nt, Shigella flexneri 2a str. 2457T
ugaaacaaaucacu

SEQ ID NO: 3857901 - RNA, 23 nt, Shigella flexneri 2a str. 2457T
ugaaacaagaaguuauccuggua

SEQ ID NO: 3857902 - RNA, 13 nt, Shigella flexneri 2a str. 2457T
ugaaacacauggu

SEQ ID NO: 3857903 - RNA, 17 nt, Shigella flexneri 2a str. 2457T
ugaaacaugauguggug

SEQ ID NO: 3857904 - RNA, 16 nt, Shigella flexneri 2a str. 2457T
ugaaaccgaaggcacc

SEQ ID NO: 3857905 - RNA, 14 nt, Shigella flexneri 2a str. 2457T
ugaaacgaaaucuu

SEQ ID NO: 3857906 - RNA, 22 nt, Shigella flexneri 2a str. 2457T
ugaaacgcuuuacguuccuggc

SEQ ID NO: 3857907 - RNA, 22 nt, Shigella flexneri 2a str. 2457T
ugaaacgucaaauaauuccugc

SEQ ID NO: 3857908 - RNA, 14 nt, Shigella flexneri 2a str. 2457T
ugaaacucacgcag

SEQ ID NO: 3857909 - RNA, 19 nt, Shigella flexneri 2a str. 2457T
ugaaacucagcauggaaau

SEQ ID NO: 3857910 - RNA, 18 nt, Shigella flexneri 2a str. 2457T
ugaaacucgauacgacac

SEQ ID NO: 3857911 - RNA, 17 nt, Shigella flexneri 2a str. 2457T
ugaaacucgcugccagc

SEQ ID NO: 3857912 - RNA, 14 nt, Shigella flexneri 2a str. 2457T
ugaaacuggaagau

SEQ ID NO: 3857913 - RNA, 21 nt, Shigella flexneri 2a str. 2457T
ugaaagaagcggugaaaaaau

SEQ ID NO: 3857914 - RNA, 20 nt, Shigella flexneri 2a str. 2457T
ugaaagagccgucauucugc

SEQ ID NO: 3857915 - RNA, 15 nt, Shigella flexneri 2a str. 2457T
ugaaagauaaucaca

SEQ ID NO: 3857916 - RNA, 22 nt, Shigella flexneri 2a str. 2457T
ugaaagccccaccagcaaauau

SEQ ID NO: 3857917 - RNA, 16 nt, Shigella flexneri 2a str. 2457T
ugaaagcgugucaugu

SEQ ID NO: 3857918 - RNA, 19 nt, Shigella flexneri 2a str. 2457T
ugaaagcguuguguuuuuu

SEQ ID NO: 3857919 - RNA, 17 nt, Shigella flexneri 2a str. 2457T
ugaaagcucauaacgga

SEQ ID NO: 3857920 - RNA, 23 nt, Shigella flexneri 2a str. 2457T
ugaaaggcgcgguuucugcuugu

SEQ ID NO: 3857921 - RNA, 23 nt, Shigella flexneri 2a str. 2457T
ugaaaggcgcucauuuucucuuu

SEQ ID NO: 3857922 - RNA, 15 nt, Shigella flexneri 2a str. 2457T
ugaaaggcuucccaa

SEQ ID NO: 3857923 - RNA, 15 nt, Shigella flexneri 2a str. 2457T
ugaaagggcaaauaa

SEQ ID NO: 3857924 - RNA, 15 nt, Shigella flexneri 2a str. 2457T
ugaaaguaaaaaaga

SEQ ID NO: 3857925 - RNA, 19 nt, Shigella flexneri 2a str. 2457T
ugaaauagaauggcaucag

SEQ ID NO: 3857926 - RNA, 22 nt, Shigella flexneri 2a str. 2457T
ugaaauaguugcauuccagucc

SEQ ID NO: 3857927 - RNA, 14 nt, Shigella flexneri 2a str. 2457T
ugaaauauccagcg

SEQ ID NO: 3857928 - RNA, 14 nt, Shigella flexneri 2a str. 2457T
ugaaaucacgcauc

SEQ ID NO: 3857929 - RNA, 15 nt, Shigella flexneri 2a str. 2457T
ugaaaucagcacaua

SEQ ID NO: 3857930 - RNA, 23 nt, Shigella flexneri 2a str. 2457T
ugaaaucagcacauaagucagcc

SEQ ID NO: 3857931 - RNA, 23 nt, Shigella flexneri 2a str. 2457T
ugaaauccggcaccugucagacu

SEQ ID NO: 3857932 - RNA, 16 nt, Shigella flexneri 2a str. 2457T
ugaaaucgaacagguu

SEQ ID NO: 3857933 - RNA, 22 nt, Shigella flexneri 2a str. 2457T
ugaaaugccaaauauuucuuua

SEQ ID NO: 3857934 - RNA, 22 nt, Shigella flexneri 2a str. 2457T
ugaaaugugccggaugcaucac

SEQ ID NO: 3857935 - RNA, 19 nt, Shigella flexneri 2a str. 2457T
ugaaauuacuuuccaucuu

SEQ ID NO: 3857936 - RNA, 14 nt, Shigella flexneri 2a str. 2457T
ugaacaaaaaagag

SEQ ID NO: 3857937 - RNA, 22 nt, Shigella flexneri 2a str. 2457T
ugaacaaaaaagaguaaaguua

SEQ ID NO: 3857938 - RNA, 13 nt, Shigella flexneri 2a str. 2457T
ugaacaaacaauu

SEQ ID NO: 3857939 - RNA, 12 nt, Shigella flexneri 2a str. 2457T
ugaacaaccaga

SEQ ID NO: 3857940 - RNA, 21 nt, Shigella flexneri 2a str. 2457T
ugaacaacuuaacuugcuuaa

SEQ ID NO: 3857941 - RNA, 13 nt, Shigella flexneri 2a str. 2457T
ugaacaagcaaga

SEQ ID NO: 3857942 - RNA, 19 nt, Shigella flexneri 2a str. 2457T
ugaacaagguggugaggcc

SEQ ID NO: 3857943 - RNA, 13 nt, Shigella flexneri 2a str. 2457T
ugaacaauuucag

SEQ ID NO: 3857944 - RNA, 15 nt, Shigella flexneri 2a str. 2457T
ugaacaccuucucag

SEQ ID NO: 3857945 - RNA, 18 nt, Shigella flexneri 2a str. 2457T
ugaacacguuuucucaag

SEQ ID NO: 3857946 - RNA, 22 nt, Shigella flexneri 2a str. 2457T
ugaacagcagaacaucagcugg

SEQ ID NO: 3857947 - RNA, 17 nt, Shigella flexneri 2a str. 2457T
ugaacagcuuuuuccug

SEQ ID NO: 3857948 - RNA, 23 nt, Shigella flexneri 2a str. 2457T
ugacaaaucagaggcuguuccgg

SEQ ID NO: 3857949 - RNA, 22 nt, Shigella flexneri 2a str. 2457T
ugacaaaucaugcggauauaaa

SEQ ID NO: 3857950 - RNA, 19 nt, Shigella flexneri 2a str. 2457T
ugacaaauuccgaacaaaa

SEQ ID NO: 3857951 - RNA, 19 nt, Shigella flexneri 2a str. 2457T
ugacaacauuuugcggcua

SEQ ID NO: 3857952 - RNA, 16 nt, Shigella flexneri 2a str. 2457T
ugacaacucaucacug

SEQ ID NO: 3857953 - RNA, 19 nt, Shigella flexneri 2a str. 2457T
ugacacaggcagcaaucac

SEQ ID NO: 3857954 - RNA, 17 nt, Shigella flexneri 2a str. 2457T
ugacacaucaccuccag

SEQ ID NO: 3857955 - RNA, 14 nt, Shigella flexneri 2a str. 2457T
ugacaccagcacau

SEQ ID NO: 3857956 - RNA, 15 nt, Shigella flexneri 2a str. 2457T
ugacaccagcacauc

SEQ ID NO: 3857957 - RNA, 15 nt, Shigella flexneri 2a str. 2457T
ugacaccauaacaga

SEQ ID NO: 3857958 - RNA, 16 nt, Shigella flexneri 2a str. 2457T
ugacacgaauacggga

SEQ ID NO: 3857959 - RNA, 14 nt, Shigella flexneri 2a str. 2457T
ugacacggaacaac

SEQ ID NO: 3857960 - RNA, 24 nt, Shigella flexneri 2a str. 2457T
ugacacgggaaaccaacuccagcg

SEQ ID NO: 3857961 - RNA, 14 nt, Shigella flexneri 2a str. 2457T
ugacacugauugau

SEQ ID NO: 3857962 - RNA, 17 nt, Shigella flexneri 2a str. 2457T
ugacacuucagccauca

SEQ ID NO: 3857963 - RNA, 23 nt, Shigella flexneri 2a str. 2457T
ugacagaccguugcucagaauca

SEQ ID NO: 3857964 - RNA, 16 nt, Shigella flexneri 2a str. 2457T
ugacagacuccgccuc

SEQ ID NO: 3857965 - RNA, 18 nt, Shigella flexneri 2a str. 2457T
ugacagaggcuuauauug

SEQ ID NO: 3857966 - RNA, 19 nt, Shigella flexneri 2a str. 2457T
ugacagaguuccggcccua

SEQ ID NO: 3857967 - RNA, 17 nt, Shigella flexneri 2a str. 2457T
ugacagcauaccuucac

SEQ ID NO: 3857968 - RNA, 17 nt, Shigella flexneri 2a str. 2457T
ugacagccaaagggcug

SEQ ID NO: 3857969 - RNA, 23 nt, Shigella flexneri 2a str. 2457T
ugacagccccugugccagcucgu

SEQ ID NO: 3857970 - RNA, 19 nt, Shigella flexneri 2a str. 2457T
ugacagcgcccgacaagau

SEQ ID NO: 3857971 - RNA, 23 nt, Shigella flexneri 2a str. 2457T
ugacagcgcccgacaagauccug

SEQ ID NO: 3857972 - RNA, 15 nt, Shigella flexneri 2a str. 2457T
ugacagguuuaaaca

SEQ ID NO: 3857973 - RNA, 17 nt, Shigella flexneri 2a str. 2457T
ugacagguuuaaacaga

SEQ ID NO: 3857974 - RNA, 18 nt, Shigella flexneri 2a str. 2457T
ugacagguuuaaacagag

SEQ ID NO: 3857975 - RNA, 17 nt, Shigella flexneri 2a str. 2457T
ugacaguaucgugacaa

SEQ ID NO: 3857976 - RNA, 21 nt, Shigella flexneri 2a str. 2457T
ugacagucuggaagccaguca

SEQ ID NO: 3857977 - RNA, 19 nt, Shigella flexneri 2a str. 2457T
ugacauaaacggcgcauug

SEQ ID NO: 3857978 - RNA, 19 nt, Shigella flexneri 2a str. 2457T
ugacauaguagccagccag

SEQ ID NO: 3857979 - RNA, 14 nt, Shigella flexneri 2a str. 2457T
ugacaucagcaucc

SEQ ID NO: 3857980 - RNA, 16 nt, Shigella flexneri 2a str. 2457T
ugacaucauuuuuucc

SEQ ID NO: 3857981 - RNA, 13 nt, Shigella flexneri 2a str. 2457T
ugacaucgcagca

SEQ ID NO: 3857982 - RNA, 15 nt, Shigella flexneri 2a str. 2457T
ugacaucgcccugau

SEQ ID NO: 3857983 - RNA, 17 nt, Shigella flexneri 2a str. 2457T
ugacaucuccagcgcau

SEQ ID NO: 3857984 - RNA, 13 nt, Shigella flexneri 2a str. 2457T
ugacauuaucugg

SEQ ID NO: 3857985 - RNA, 20 nt, Shigella flexneri 2a str. 2457T
ugacauucugacuggucagu

SEQ ID NO: 3857986 - RNA, 13 nt, Shigella flexneri 2a str. 2457T
ugaccaaaaacau

SEQ ID NO: 3857987 - RNA, 21 nt, Shigella flexneri 2a str. 2457T
ugaccaccaccaccugcaucu

SEQ ID NO: 3857988 - RNA, 12 nt, Shigella flexneri 2a str. 2457T
ugaccaccagca

SEQ ID NO: 3857989 - RNA, 17 nt, Shigella flexneri 2a str. 2457T
ugaccacggccacagcc

SEQ ID NO: 3857990 - RNA, 18 nt, Shigella flexneri 2a str. 2457T
ugaccacuuugcgcuccu

SEQ ID NO: 3857991 - RNA, 14 nt, Shigella flexneri 2a str. 2457T
ugaccagacuggag

SEQ ID NO: 3857992 - RNA, 23 nt, Shigella flexneri 2a str. 2457T
ugaccagaucuucaucaccgaug

SEQ ID NO: 3857993 - RNA, 20 nt, Shigella flexneri 2a str. 2457T
ugaccaggacuuugaaagcg

SEQ ID NO: 3857994 - RNA, 19 nt, Shigella flexneri 2a str. 2457T
ugaccaguaauauccccag

SEQ ID NO: 3857995 - RNA, 16 nt, Shigella flexneri 2a str. 2457T
ugaccaguccggcuuu

SEQ ID NO: 3857996 - RNA, 22 nt, Shigella flexneri 2a str. 2457T
ugaccaguugcuccagcaauaa

SEQ ID NO: 3857997 - RNA, 15 nt, Shigella flexneri 2a str. 2457T
ugaccaucagcagcg

SEQ ID NO: 3857998 - RNA, 18 nt, Shigella flexneri 2a str. 2457T
ugacccaguagacgagcc

SEQ ID NO: 3857999 - RNA, 17 nt, Shigella flexneri 2a str. 2457T
ugaccccagccaguuca

SEQ ID NO: 3858000 - RNA, 19 nt, Shigella flexneri 2a str. 2457T
ugacccgcagccagcacug

SEQ ID NO: 3858001 - RNA, 18 nt, Shigella flexneri 2a str. 2457T
ugacccucucggcauaua

SEQ ID NO: 3858002 - RNA, 19 nt, Shigella flexneri 2a str. 2457T
ugaccgaaccuguuuucac

SEQ ID NO: 3858003 - RNA, 22 nt, Shigella flexneri 2a str. 2457T
ugaccgauaugaauaauuucgg

SEQ ID NO: 3858004 - RNA, 22 nt, Shigella flexneri 2a str. 2457T
ugaccgcccgcuaugagcagau

SEQ ID NO: 3858005 - RNA, 18 nt, Shigella flexneri 2a str. 2457T
ugaccgccgcagcaaccg

SEQ ID NO: 3858006 - RNA, 19 nt, Shigella flexneri 2a str. 2457T
ugaccgcguugcagcauau

SEQ ID NO: 3858007 - RNA, 16 nt, Shigella flexneri 2a str. 2457T
ugaccgcuccgccauc

SEQ ID NO: 3858008 - RNA, 19 nt, Shigella flexneri 2a str. 2457T
ugaccgguugcuggaucaa

SEQ ID NO: 3858009 - RNA, 18 nt, Shigella flexneri 2a str. 2457T
ugaccgucgaugaaagcg

SEQ ID NO: 3858010 - RNA, 14 nt, Shigella flexneri 2a str. 2457T
ugaccgucuuucau

SEQ ID NO: 3858011 - RNA, 16 nt, Shigella flexneri 2a str. 2457T
ugaccgugaucguggc

SEQ ID NO: 3858012 - RNA, 15 nt, Shigella flexneri 2a str. 2457T
ugaccguuacugaua

SEQ ID NO: 3858013 - RNA, 23 nt, Shigella flexneri 2a str. 2457T
ugaccguuagcauauugcaggcu

SEQ ID NO: 3858014 - RNA, 13 nt, Shigella flexneri 2a str. 2457T
ugaccguuuuacu

SEQ ID NO: 3858015 - RNA, 22 nt, Shigella flexneri 2a str. 2457T
ugaccuagcaaacuaucugugu

SEQ ID NO: 3858016 - RNA, 16 nt, Shigella flexneri 2a str. 2457T
ugaccuuaccaccuua

SEQ ID NO: 3858017 - RNA, 16 nt, Shigella flexneri 2a str. 2457T
ugaccuuccagcgccg

SEQ ID NO: 3858018 - RNA, 13 nt, Shigella flexneri 2a str. 2457T
ugaccuucuucag

SEQ ID NO: 3858019 - RNA, 18 nt, Shigella flexneri 2a str. 2457T
ugaccuugucaugcagcu

SEQ ID NO: 3858020 - RNA, 14 nt, Shigella flexneri 2a str. 2457T
ugaccuuuuuucag

SEQ ID NO: 3858021 - RNA, 14 nt, Shigella flexneri 2a str. 2457T
ugacgacaccaucu

SEQ ID NO: 3858022 - RNA, 16 nt, Shigella flexneri 2a str. 2457T
ugacgacgacuggccg

SEQ ID NO: 3858023 - RNA, 17 nt, Shigella flexneri 2a str. 2457T
ugacgauagcgccgcca

SEQ ID NO: 3858024 - RNA, 20 nt, Shigella flexneri 2a str. 2457T
ugacgaucauauuguucccc

SEQ ID NO: 3858025 - RNA, 21 nt, Shigella flexneri 2a str. 2457T
ugacgaugcuccacuccugcc

SEQ ID NO: 3858026 - RNA, 20 nt, Shigella flexneri 2a str. 2457T
ugacgcacuuucgcuuuauc

SEQ ID NO: 3858027 - RNA, 20 nt, Shigella flexneri 2a str. 2457T
ugacgcagauccugauuuaa

SEQ ID NO: 3858028 - RNA, 14 nt, Shigella flexneri 2a str. 2457T
ugacgcauacagcc

SEQ ID NO: 3858029 - RNA, 16 nt, Shigella flexneri 2a str. 2457T
ugacgcauccgaucgc

SEQ ID NO: 3858030 - RNA, 20 nt, Shigella flexneri 2a str. 2457T
ugacgccaccauucaccaag

SEQ ID NO: 3858031 - RNA, 22 nt, Shigella flexneri 2a str. 2457T
ugacgccccuggcgaugccccc

SEQ ID NO: 3858032 - RNA, 20 nt, Shigella flexneri 2a str. 2457T
ugacgcccguuaaccgcucu

SEQ ID NO: 3858033 - RNA, 19 nt, Shigella flexneri 2a str. 2457T
ugacgccuuuaccgcgcau

SEQ ID NO: 3858034 - RNA, 16 nt, Shigella flexneri 2a str. 2457T
ugacgcgggcagcaga

SEQ ID NO: 3858035 - RNA, 16 nt, Shigella flexneri 2a str. 2457T
ugacgcgucuuaucag

SEQ ID NO: 3858036 - RNA, 13 nt, Shigella flexneri 2a str. 2457T
ugacgcuggcaga

SEQ ID NO: 3858037 - RNA, 19 nt, Shigella flexneri 2a str. 2457T
ugacggaaaucauccagca

SEQ ID NO: 3858038 - RNA, 18 nt, Shigella flexneri 2a str. 2457T
ugacggaucccgccaaca

SEQ ID NO: 3858039 - RNA, 15 nt, Shigella flexneri 2a str. 2457T
ugacggcugccauca

SEQ ID NO: 3858040 - RNA, 18 nt, Shigella flexneri 2a str. 2457T
ugacguaauccgccuguu

SEQ ID NO: 3858041 - RNA, 19 nt, Shigella flexneri 2a str. 2457T
ugacguagcagcuccgcca

SEQ ID NO: 3858042 - RNA, 14 nt, Shigella flexneri 2a str. 2457T
ugacguaucaccga

SEQ ID NO: 3858043 - RNA, 17 nt, Shigella flexneri 2a str. 2457T
ugacguccuguacuguu

SEQ ID NO: 3858044 - RNA, 18 nt, Shigella flexneri 2a str. 2457T
ugacgucgaaacugacau

SEQ ID NO: 3858045 - RNA, 16 nt, Shigella flexneri 2a str. 2457T
ugaggcguuaacagcg

SEQ ID NO: 3858046 - RNA, 15 nt, Shigella flexneri 2a str. 2457T
ugaggcuaccggaca

SEQ ID NO: 3858047 - RNA, 21 nt, Shigella flexneri 2a str. 2457T
ugagggcaaacaggcgcuggg

SEQ ID NO: 3858048 - RNA, 23 nt, Shigella flexneri 2a str. 2457T
ugaggguguuggaacccgcagcc

SEQ ID NO: 3858049 - RNA, 16 nt, Shigella flexneri 2a str. 2457T
ugagguccagcgagcc

SEQ ID NO: 3858050 - RNA, 17 nt, Shigella flexneri 2a str. 2457T
ugagguuagcaaugccu

SEQ ID NO: 3858051 - RNA, 12 nt, Shigella flexneri 2a str. 2457T
ugagguuaugca

SEQ ID NO: 3858052 - RNA, 23 nt, Shigella flexneri 2a str. 2457T
ugagguuguggcauuagauauuu

SEQ ID NO: 3858053 - RNA, 14 nt, Shigella flexneri 2a str. 2457T
ugagguuucccgcc

SEQ ID NO: 3858054 - RNA, 15 nt, Shigella flexneri 2a str. 2457T
ugaguaucagagaac

SEQ ID NO: 3858055 - RNA, 19 nt, Shigella flexneri 2a str. 2457T
ugaguauuacuuuguaaau

SEQ ID NO: 3858056 - RNA, 16 nt, Shigella flexneri 2a str. 2457T
ugagucgcaaaacuca

SEQ ID NO: 3858057 - RNA, 18 nt, Shigella flexneri 2a str. 2457T
ugaguggugaaaaaaagg

SEQ ID NO: 3858058 - RNA, 15 nt, Shigella flexneri 2a str. 2457T
ugaguguauuuacca

SEQ ID NO: 3858059 - RNA, 14 nt, Shigella flexneri 2a str. 2457T
ugaguuaagcaaaa

SEQ ID NO: 3858060 - RNA, 14 nt, Shigella flexneri 2a str. 2457T
ugaguucacugccg

SEQ ID NO: 3858061 - RNA, 15 nt, Shigella flexneri 2a str. 2457T
ugaguucacugccgu

SEQ ID NO: 3858062 - RNA, 22 nt, Shigella flexneri 2a str. 2457T
ugaguucccggcagggaagcuc

SEQ ID NO: 3858063 - RNA, 21 nt, Shigella flexneri 2a str. 2457T
ugaguuuacgcagcagauugc

SEQ ID NO: 3858064 - RNA, 11 nt, Shigella flexneri 2a str. 2457T
ugaguuuucag

SEQ ID NO: 3858065 - RNA, 12 nt, Shigella flexneri 2a str. 2457T
ugauaaaaaacc

SEQ ID NO: 3858066 - RNA, 14 nt, Shigella flexneri 2a str. 2457T
ugauaaaucaccug

SEQ ID NO: 3858067 - RNA, 18 nt, Shigella flexneri 2a str. 2457T
ugauaacgcggcagcagg

SEQ ID NO: 3858068 - RNA, 18 nt, Shigella flexneri 2a str. 2457T
ugauaaucagaaggcaga

SEQ ID NO: 3858069 - RNA, 16 nt, Shigella flexneri 2a str. 2457T
ugauaauguuauuuaa

SEQ ID NO: 3858070 - RNA, 17 nt, Shigella flexneri 2a str. 2457T
ugauaauuagugcugcu

SEQ ID NO: 3858071 - RNA, 15 nt, Shigella flexneri 2a str. 2457T
ugauaauuauuauaa

SEQ ID NO: 3858072 - RNA, 23 nt, Shigella flexneri 2a str. 2457T
ugauaauuguuaucguuugcauu

SEQ ID NO: 3858073 - RNA, 21 nt, Shigella flexneri 2a str. 2457T
ugauaauuuucgguaaugacu

SEQ ID NO: 3858074 - RNA, 12 nt, Shigella flexneri 2a str. 2457T
ugauacaacgac

SEQ ID NO: 3858075 - RNA, 16 nt, Shigella flexneri 2a str. 2457T
ugauacaggaacagcc

SEQ ID NO: 3858076 - RNA, 14 nt, Shigella flexneri 2a str. 2457T
ugauacccaucauc

SEQ ID NO: 3858077 - RNA, 20 nt, Shigella flexneri 2a str. 2457T
ugauaccgauuacucagcaa

SEQ ID NO: 3858078 - RNA, 19 nt, Shigella flexneri 2a str. 2457T
ugauaccgggcuguucacu

SEQ ID NO: 3858079 - RNA, 19 nt, Shigella flexneri 2a str. 2457T
ugauacgcgcaccggaaca

SEQ ID NO: 3858080 - RNA, 12 nt, Shigella flexneri 2a str. 2457T
ugauacgcgcca

SEQ ID NO: 3858081 - RNA, 20 nt, Shigella flexneri 2a str. 2457T
ugauacgcgccaaucggcaa

SEQ ID NO: 3858082 - RNA, 15 nt, Shigella flexneri 2a str. 2457T
ugauacguaaaccac

SEQ ID NO: 3858083 - RNA, 20 nt, Shigella flexneri 2a str. 2457T
ugauacugacauuaacguga

SEQ ID NO: 3858084 - RNA, 22 nt, Shigella flexneri 2a str. 2457T
ugauagcaauaccaucaccaac

SEQ ID NO: 3858085 - RNA, 14 nt, Shigella flexneri 2a str. 2457T
ugauaggcuuccac

SEQ ID NO: 3858086 - RNA, 14 nt, Shigella flexneri 2a str. 2457T
ugauaguuaaaauu

SEQ ID NO: 3858087 - RNA, 22 nt, Shigella flexneri 2a str. 2457T
ugauauacgucacuucaucguc

SEQ ID NO: 3858088 - RNA, 16 nt, Shigella flexneri 2a str. 2457T
ugauauauuuuuaaau

SEQ ID NO: 3858089 - RNA, 19 nt, Shigella flexneri 2a str. 2457T
ugauauauuuuuaaauaua

SEQ ID NO: 3858090 - RNA, 16 nt, Shigella flexneri 2a str. 2457T
ugauaucauuaaaguu

SEQ ID NO: 3858091 - RNA, 22 nt, Shigella flexneri 2a str. 2457T
ugauauccaccgcguucagcag

SEQ ID NO: 3858092 - RNA, 22 nt, Shigella flexneri 2a str. 2457T
ugauaucccgcgcguuuuucuu

SEQ ID NO: 3858093 - RNA, 16 nt, Shigella flexneri 2a str. 2457T
ugauaucgcuggcagg

SEQ ID NO: 3858094 - RNA, 17 nt, Shigella flexneri 2a str. 2457T
ugauaucggccaucugu

SEQ ID NO: 3858095 - RNA, 19 nt, Shigella flexneri 2a str. 2457T
ugauauugcccgugacucc

SEQ ID NO: 3858096 - RNA, 18 nt, Shigella flexneri 2a str. 2457T
ugauauuggcaucgccag

SEQ ID NO: 3858097 - RNA, 18 nt, Shigella flexneri 2a str. 2457T
ugauauuucgaauuuucc

SEQ ID NO: 3858098 - RNA, 18 nt, Shigella flexneri 2a str. 2457T
ugauauuucggcauuuuu

SEQ ID NO: 3858099 - RNA, 14 nt, Shigella flexneri 2a str. 2457T
ugaucaaauacuuc

SEQ ID NO: 3858100 - RNA, 13 nt, Shigella flexneri 2a str. 2457T
ugaucaacagcau

SEQ ID NO: 3858101 - RNA, 15 nt, Shigella flexneri 2a str. 2457T
ugaucaacagcauca

SEQ ID NO: 3858102 - RNA, 12 nt, Shigella flexneri 2a str. 2457T
ugaucaccagug

SEQ ID NO: 3858103 - RNA, 13 nt, Shigella flexneri 2a str. 2457T
ugaucacccacau

SEQ ID NO: 3858104 - RNA, 13 nt, Shigella flexneri 2a str. 2457T
ugaucaccugcau

SEQ ID NO: 3858105 - RNA, 22 nt, Shigella flexneri 2a str. 2457T
ugaucagcaacgccgguuccag

SEQ ID NO: 3858106 - RNA, 22 nt, Shigella flexneri 2a str. 2457T
ugaucagccccggcaaaugacg

SEQ ID NO: 3858107 - RNA, 15 nt, Shigella flexneri 2a str. 2457T
ugaucaggucagauu

SEQ ID NO: 3858108 - RNA, 17 nt, Shigella flexneri 2a str. 2457T
ugaucauaaaaauuaaa

SEQ ID NO: 3858109 - RNA, 19 nt, Shigella flexneri 2a str. 2457T
ugaucauagcgaauaaucc

SEQ ID NO: 3858110 - RNA, 13 nt, Shigella flexneri 2a str. 2457T
ugaucauccgccu

SEQ ID NO: 3858111 - RNA, 23 nt, Shigella flexneri 2a str. 2457T
ugaucauccgccucuaacagauc

SEQ ID NO: 3858112 - RNA, 14 nt, Shigella flexneri 2a str. 2457T
ugaucauucaccag

SEQ ID NO: 3858113 - RNA, 16 nt, Shigella flexneri 2a str. 2457T
ugaucauucaccagcc

SEQ ID NO: 3858114 - RNA, 18 nt, Shigella flexneri 2a str. 2457T
ugauccacgguucuccac

SEQ ID NO: 3858115 - RNA, 20 nt, Shigella flexneri 2a str. 2457T
ugauccagaugugcaccuuu

SEQ ID NO: 3858116 - RNA, 13 nt, Shigella flexneri 2a str. 2457T
ugauccaggagcu

SEQ ID NO: 3858117 - RNA, 17 nt, Shigella flexneri 2a str. 2457T
ugauccaggagcuccag

SEQ ID NO: 3858118 - RNA, 22 nt, Shigella flexneri 2a str. 2457T
ugauccaggagcuccagguccu

SEQ ID NO: 3858119 - RNA, 15 nt, Shigella flexneri 2a str. 2457T
ugauccccgcuuccu

SEQ ID NO: 3858120 - RNA, 21 nt, Shigella flexneri 2a str. 2457T
ugauccccgcuuccugcagcg

SEQ ID NO: 3858121 - RNA, 19 nt, Shigella flexneri 2a str. 2457T
ugauccccggaaucagagg

SEQ ID NO: 3858122 - RNA, 17 nt, Shigella flexneri 2a str. 2457T
ugauccgccgcgcggug

SEQ ID NO: 3858123 - RNA, 17 nt, Shigella flexneri 2a str. 2457T
ugauccugcaacagcac

SEQ ID NO: 3858124 - RNA, 14 nt, Shigella flexneri 2a str. 2457T
ugaucgaaaaugcg

SEQ ID NO: 3858125 - RNA, 16 nt, Shigella flexneri 2a str. 2457T
ugaucgaggcaaagag

SEQ ID NO: 3858126 - RNA, 17 nt, Shigella flexneri 2a str. 2457T
ugaucgccagcggaaua

SEQ ID NO: 3858127 - RNA, 20 nt, Shigella flexneri 2a str. 2457T
ugaucgccauauuucuccau

SEQ ID NO: 3858128 - RNA, 16 nt, Shigella flexneri 2a str. 2457T
ugaucgccgcacuuuc

SEQ ID NO: 3858129 - RNA, 19 nt, Shigella flexneri 2a str. 2457T
ugaucgccgcacuuucucc

SEQ ID NO: 3858130 - RNA, 14 nt, Shigella flexneri 2a str. 2457T
ugaucgcuuucagu

SEQ ID NO: 3858131 - RNA, 14 nt, Shigella flexneri 2a str. 2457T
ugaucggcgagaua

SEQ ID NO: 3858132 - RNA, 21 nt, Shigella flexneri 2a str. 2457T
ugaucggcuggcgaaccagga

SEQ ID NO: 3858133 - RNA, 23 nt, Shigella flexneri 2a str. 2457T
ugaucgugccaggaccauucaca

SEQ ID NO: 3858134 - RNA, 18 nt, Shigella flexneri 2a str. 2457T
ugaucuaccgcuucccuu

SEQ ID NO: 3858135 - RNA, 14 nt, Shigella flexneri 2a str. 2457T
ugaucuuuuuauug

SEQ ID NO: 3858136 - RNA, 13 nt, Shigella flexneri 2a str. 2457T
ugaugaaaaaacc

SEQ ID NO: 3858137 - RNA, 19 nt, Shigella flexneri 2a str. 2457T
ugaugaaaaaaguuuuauu

SEQ ID NO: 3858138 - RNA, 13 nt, Shigella flexneri 2a str. 2457T
ugaugaaaacgaa

SEQ ID NO: 3858139 - RNA, 18 nt, Shigella flexneri 2a str. 2457T
ugaugaacggugcgcagg

SEQ ID NO: 3858140 - RNA, 14 nt, Shigella flexneri 2a str. 2457T
ugaugaagacagac

SEQ ID NO: 3858141 - RNA, 16 nt, Shigella flexneri 2a str. 2457T
ugaugaaguccacgcg

SEQ ID NO: 3858142 - RNA, 11 nt, Shigella flexneri 2a str. 2457T
ugaugaaucag

SEQ ID NO: 3858143 - RNA, 17 nt, Shigella flexneri 2a str. 2457T
ugcaaaucggcaaucuc

SEQ ID NO: 3858144 - RNA, 20 nt, Shigella flexneri 2a str. 2457T
ugcaaaugccagauaagaca

SEQ ID NO: 3858145 - RNA, 14 nt, Shigella flexneri 2a str. 2457T
ugcaaauucaauau

SEQ ID NO: 3858146 - RNA, 22 nt, Shigella flexneri 2a str. 2457T
ugcaaauucucuauuucacccg

SEQ ID NO: 3858147 - RNA, 18 nt, Shigella flexneri 2a str. 2457T
ugcaacaacugaaaaaaa

SEQ ID NO: 3858148 - RNA, 20 nt, Shigella flexneri 2a str. 2457T
ugcaacaacugaaaaaaaau

SEQ ID NO: 3858149 - RNA, 22 nt, Shigella flexneri 2a str. 2457T
ugcaacaacugaaaaaaaauua

SEQ ID NO: 3858150 - RNA, 17 nt, Shigella flexneri 2a str. 2457T
ugcaacauguugaaucu

SEQ ID NO: 3858151 - RNA, 18 nt, Shigella flexneri 2a str. 2457T
ugcaacauguugaaucuu

SEQ ID NO: 3858152 - RNA, 22 nt, Shigella flexneri 2a str. 2457T
ugcaacccgccagguuucauag

SEQ ID NO: 3858153 - RNA, 14 nt, Shigella flexneri 2a str. 2457T
ugcaacgaacgcau

SEQ ID NO: 3858154 - RNA, 22 nt, Shigella flexneri 2a str. 2457T
ugcaacgaaucaaaucccugau

SEQ ID NO: 3858155 - RNA, 15 nt, Shigella flexneri 2a str. 2457T
ugcaacugcgcggca

SEQ ID NO: 3858156 - RNA, 19 nt, Shigella flexneri 2a str. 2457T
ugcaacugcucguucagcg

SEQ ID NO: 3858157 - RNA, 18 nt, Shigella flexneri 2a str. 2457T
ugcaacuucucuuucggc

SEQ ID NO: 3858158 - RNA, 14 nt, Shigella flexneri 2a str. 2457T
ugcaagaaaugaca

SEQ ID NO: 3858159 - RNA, 18 nt, Shigella flexneri 2a str. 2457T
ugcaagacgaugacauua

SEQ ID NO: 3858160 - RNA, 18 nt, Shigella flexneri 2a str. 2457T
ugcaagaggaaauaagca

SEQ ID NO: 3858161 - RNA, 15 nt, Shigella flexneri 2a str. 2457T
ugcaagaucgcgcau

SEQ ID NO: 3858162 - RNA, 23 nt, Shigella flexneri 2a str. 2457T
ugcaagaucgcgcaucagcuccg

SEQ ID NO: 3858163 - RNA, 16 nt, Shigella flexneri 2a str. 2457T
ugcaagccuguaguac

SEQ ID NO: 3858164 - RNA, 24 nt, Shigella flexneri 2a str. 2457T
ugcaaggcgagcaaucacuugcgc

SEQ ID NO: 3858165 - RNA, 13 nt, Shigella flexneri 2a str. 2457T
ugcaauaaauaug

SEQ ID NO: 3858166 - RNA, 23 nt, Shigella flexneri 2a str. 2457T
ugcaauaccauggcucaccagca

SEQ ID NO: 3858167 - RNA, 18 nt, Shigella flexneri 2a str. 2457T
ugcaauacuuccgcuucc

SEQ ID NO: 3858168 - RNA, 20 nt, Shigella flexneri 2a str. 2457T
ugcaauagcgccugcugcug

SEQ ID NO: 3858169 - RNA, 16 nt, Shigella flexneri 2a str. 2457T
ugcaauauauugaauu

SEQ ID NO: 3858170 - RNA, 15 nt, Shigella flexneri 2a str. 2457T
ugcaaucaaauauuc

SEQ ID NO: 3858171 - RNA, 21 nt, Shigella flexneri 2a str. 2457T
ugcaaucaacaccacugccag

SEQ ID NO: 3858172 - RNA, 13 nt, Shigella flexneri 2a str. 2457T
ugcaaucaguuca

SEQ ID NO: 3858173 - RNA, 15 nt, Shigella flexneri 2a str. 2457T
ugcaaucuacaaaag

SEQ ID NO: 3858174 - RNA, 24 nt, Shigella flexneri 2a str. 2457T
ugcaaucuacaaaagauuauugcu

SEQ ID NO: 3858175 - RNA, 21 nt, Shigella flexneri 2a str. 2457T
ugcaaugacgccgaggaguuu

SEQ ID NO: 3858176 - RNA, 19 nt, Shigella flexneri 2a str. 2457T
ugcaauggaauggcuggca

SEQ ID NO: 3858177 - RNA, 15 nt, Shigella flexneri 2a str. 2457T
ugcaaugucaucagc

SEQ ID NO: 3858178 - RNA, 19 nt, Shigella flexneri 2a str. 2457T
ugcaaugucaucagcauuc

SEQ ID NO: 3858179 - RNA, 22 nt, Shigella flexneri 2a str. 2457T
ugcaauuaaggucggcuuugaa

SEQ ID NO: 3858180 - RNA, 16 nt, Shigella flexneri 2a str. 2457T
ugcaauuauuaaccug

SEQ ID NO: 3858181 - RNA, 12 nt, Shigella flexneri 2a str. 2457T
ugcaauugcucc

SEQ ID NO: 3858182 - RNA, 14 nt, Shigella flexneri 2a str. 2457T
ugcaauuuauugau

SEQ ID NO: 3858183 - RNA, 22 nt, Shigella flexneri 2a str. 2457T
ugcaauuuguggugaagccacc

SEQ ID NO: 3858184 - RNA, 14 nt, Shigella flexneri 2a str. 2457T
ugcaauuuuuaccg

SEQ ID NO: 3858185 - RNA, 15 nt, Shigella flexneri 2a str. 2457T
ugcaauuuuuuauug

SEQ ID NO: 3858186 - RNA, 17 nt, Shigella flexneri 2a str. 2457T
ugcacaaagguuucgua

SEQ ID NO: 3858187 - RNA, 18 nt, Shigella flexneri 2a str. 2457T
ugcacaaauagccagcag

SEQ ID NO: 3858188 - RNA, 16 nt, Shigella flexneri 2a str. 2457T
ugcacaacaaucugca

SEQ ID NO: 3858189 - RNA, 16 nt, Shigella flexneri 2a str. 2457T
ugcacaauugccagcc

SEQ ID NO: 3858190 - RNA, 23 nt, Shigella flexneri 2a str. 2457T
ugcacaauugccggaugcggcgu

SEQ ID NO: 3858191 - RNA, 22 nt, Shigella flexneri 2a str. 2457T
ugcacaccccgcgcagcugaga

SEQ ID NO: 3858192 - RNA, 22 nt, Shigella flexneri 2a str. 2457T
ugcacaccccgcgccgcugaga

SEQ ID NO: 3858193 - RNA, 20 nt, Shigella flexneri 2a str. 2457T
ugcacaccgcggaacgcacu

SEQ ID NO: 3858194 - RNA, 15 nt, Shigella flexneri 2a str. 2457T
ugcacacuuuccaua

SEQ ID NO: 3858195 - RNA, 17 nt, Shigella flexneri 2a str. 2457T
ugcacagacuuaauauu

SEQ ID NO: 3858196 - RNA, 15 nt, Shigella flexneri 2a str. 2457T
ugcacagcacgcuuu

SEQ ID NO: 3858197 - RNA, 22 nt, Shigella flexneri 2a str. 2457T
ugcacaguauagcaucauaaga

SEQ ID NO: 3858198 - RNA, 20 nt, Shigella flexneri 2a str. 2457T
ugcacauccacgccuuuuuu

SEQ ID NO: 3858199 - RNA, 14 nt, Shigella flexneri 2a str. 2457T
ugcacaugcaacgu

SEQ ID NO: 3858200 - RNA, 23 nt, Shigella flexneri 2a str. 2457T
ugcacaugcaacgucaucaccgg

SEQ ID NO: 3858201 - RNA, 13 nt, Shigella flexneri 2a str. 2457T
ugcacaugcuuca

SEQ ID NO: 3858202 - RNA, 20 nt, Shigella flexneri 2a str. 2457T
ugcacauucccugcagucac

SEQ ID NO: 3858203 - RNA, 17 nt, Shigella flexneri 2a str. 2457T
ugcaccaacaaauagag

SEQ ID NO: 3858204 - RNA, 17 nt, Shigella flexneri 2a str. 2457T
ugcaccagcuggcuguc

SEQ ID NO: 3858205 - RNA, 15 nt, Shigella flexneri 2a str. 2457T
ugcaccauugcugcc

SEQ ID NO: 3858206 - RNA, 19 nt, Shigella flexneri 2a str. 2457T
ugcaccccgagcuuaugca

SEQ ID NO: 3858207 - RNA, 15 nt, Shigella flexneri 2a str. 2457T
ugcacccgcuucagu

SEQ ID NO: 3858208 - RNA, 17 nt, Shigella flexneri 2a str. 2457T
ugcacccgcuucaguga

SEQ ID NO: 3858209 - RNA, 23 nt, Shigella flexneri 2a str. 2457T
ugcaccgaguucuucacugacgc

SEQ ID NO: 3858210 - RNA, 15 nt, Shigella flexneri 2a str. 2457T
ugcaccgauuucgag

SEQ ID NO: 3858211 - RNA, 15 nt, Shigella flexneri 2a str. 2457T
ugcaccucugcugcu

SEQ ID NO: 3858212 - RNA, 14 nt, Shigella flexneri 2a str. 2457T
ugcacgaaaccacu

SEQ ID NO: 3858213 - RNA, 17 nt, Shigella flexneri 2a str. 2457T
ugcacgaggcuggcuuu

SEQ ID NO: 3858214 - RNA, 15 nt, Shigella flexneri 2a str. 2457T
ugcacgauauaccgu

SEQ ID NO: 3858215 - RNA, 15 nt, Shigella flexneri 2a str. 2457T
ugcacgaugccugau

SEQ ID NO: 3858216 - RNA, 16 nt, Shigella flexneri 2a str. 2457T
ugcacgaugccugaug

SEQ ID NO: 3858217 - RNA, 15 nt, Shigella flexneri 2a str. 2457T
ugcacgcagaucggu

SEQ ID NO: 3858218 - RNA, 21 nt, Shigella flexneri 2a str. 2457T
ugcacgcagaucgguugccau

SEQ ID NO: 3858219 - RNA, 12 nt, Shigella flexneri 2a str. 2457T
ugcacgcccuga

SEQ ID NO: 3858220 - RNA, 22 nt, Shigella flexneri 2a str. 2457T
ugcacgcccugauaaaucaccu

SEQ ID NO: 3858221 - RNA, 23 nt, Shigella flexneri 2a str. 2457T
ugcacgcccugauaaaucaccug

SEQ ID NO: 3858222 - RNA, 22 nt, Shigella flexneri 2a str. 2457T
ugcacguccgguggcauccgca

SEQ ID NO: 3858223 - RNA, 22 nt, Shigella flexneri 2a str. 2457T
ugcacguuaucagacaccagcc

SEQ ID NO: 3858224 - RNA, 19 nt, Shigella flexneri 2a str. 2457T
ugcacuagacgaugaaaaa

SEQ ID NO: 3858225 - RNA, 20 nt, Shigella flexneri 2a str. 2457T
ugcacuagacgaugaaaaag

SEQ ID NO: 3858226 - RNA, 16 nt, Shigella flexneri 2a str. 2457T
ugcacuagguuuucgu

SEQ ID NO: 3858227 - RNA, 17 nt, Shigella flexneri 2a str. 2457T
ugcacucgcauccucuu

SEQ ID NO: 3858228 - RNA, 19 nt, Shigella flexneri 2a str. 2457T
ugcacucgcauccucuuua

SEQ ID NO: 3858229 - RNA, 17 nt, Shigella flexneri 2a str. 2457T
ugcacuuaacaggaucu

SEQ ID NO: 3858230 - RNA, 14 nt, Shigella flexneri 2a str. 2457T
ugcagaaacauaau

SEQ ID NO: 3858231 - RNA, 19 nt, Shigella flexneri 2a str. 2457T
ugcagaaacggauaaucau

SEQ ID NO: 3858232 - RNA, 21 nt, Shigella flexneri 2a str. 2457T
ugcagaaauugucuccaccaa

SEQ ID NO: 3858233 - RNA, 12 nt, Shigella flexneri 2a str. 2457T
ugcagaaucaau

SEQ ID NO: 3858234 - RNA, 20 nt, Shigella flexneri 2a str. 2457T
ugcagacaugacgcccggca

SEQ ID NO: 3858235 - RNA, 17 nt, Shigella flexneri 2a str. 2457T
ugcagacggcucaucac

SEQ ID NO: 3858236 - RNA, 15 nt, Shigella flexneri 2a str. 2457T
ugcagacugaauacg

SEQ ID NO: 3858237 - RNA, 20 nt, Shigella flexneri 2a str. 2457T
ugcagaguauccaugcgcau

SEQ ID NO: 3858238 - RNA, 15 nt, Shigella flexneri 2a str. 2457T
ugcagauaccacauc

SEQ ID NO: 3858239 - RNA, 22 nt, Shigella flexneri 2a str. 2457T
ugcagaucgcgauagugcuuaa

SEQ ID NO: 3858240 - RNA, 16 nt, Shigella flexneri 2a str. 2457T
ugccaaaugcguggcg

SEQ ID NO: 3858241 - RNA, 23 nt, Shigella flexneri 2a str. 2457T
ugccaacgcaaacgcccguccau

SEQ ID NO: 3858242 - RNA, 21 nt, Shigella flexneri 2a str. 2457T
ugccaaucuucacaucaucau

SEQ ID NO: 3858243 - RNA, 16 nt, Shigella flexneri 2a str. 2457T
ugccaauggcaggcuc

SEQ ID NO: 3858244 - RNA, 16 nt, Shigella flexneri 2a str. 2457T
ugccacacaggccauu

SEQ ID NO: 3858245 - RNA, 19 nt, Shigella flexneri 2a str. 2457T
ugccacacgcccaacuaaa

SEQ ID NO: 3858246 - RNA, 19 nt, Shigella flexneri 2a str. 2457T
ugccacacgcucuuccagg

SEQ ID NO: 3858247 - RNA, 11 nt, Shigella flexneri 2a str. 2457T
ugccacaucac

SEQ ID NO: 3858248 - RNA, 21 nt, Shigella flexneri 2a str. 2457T
ugccacauuagauaaaaauga

SEQ ID NO: 3858249 - RNA, 13 nt, Shigella flexneri 2a str. 2457T
ugccaccacaccg

SEQ ID NO: 3858250 - RNA, 14 nt, Shigella flexneri 2a str. 2457T
ugccaccacaccgg

SEQ ID NO: 3858251 - RNA, 22 nt, Shigella flexneri 2a str. 2457T
ugccaccacaccggaccagacg

SEQ ID NO: 3858252 - RNA, 22 nt, Shigella flexneri 2a str. 2457T
ugccaccaccagcguaccgaua

SEQ ID NO: 3858253 - RNA, 14 nt, Shigella flexneri 2a str. 2457T
ugccaccagcagcg

SEQ ID NO: 3858254 - RNA, 15 nt, Shigella flexneri 2a str. 2457T
ugccaccagcagcgu

SEQ ID NO: 3858255 - RNA, 19 nt, Shigella flexneri 2a str. 2457T
ugccaccagugcaggcacc

SEQ ID NO: 3858256 - RNA, 15 nt, Shigella flexneri 2a str. 2457T
ugccaccaugcaaaa

SEQ ID NO: 3858257 - RNA, 19 nt, Shigella flexneri 2a str. 2457T
ugccaccuccaagccugau

SEQ ID NO: 3858258 - RNA, 23 nt, Shigella flexneri 2a str. 2457T
ugccacgcacaggugcaaaaaaa

SEQ ID NO: 3858259 - RNA, 16 nt, Shigella flexneri 2a str. 2457T
ugccacgccacgcugc

SEQ ID NO: 3858260 - RNA, 16 nt, Shigella flexneri 2a str. 2457T
ugccacuggccccacc

SEQ ID NO: 3858261 - RNA, 18 nt, Shigella flexneri 2a str. 2457T
ugccacuuugcaguuccu

SEQ ID NO: 3858262 - RNA, 18 nt, Shigella flexneri 2a str. 2457T
ugccagaccaaacagcau

SEQ ID NO: 3858263 - RNA, 14 nt, Shigella flexneri 2a str. 2457T
ugccagaccuccgu

SEQ ID NO: 3858264 - RNA, 19 nt, Shigella flexneri 2a str. 2457T
ugccagaccuuaucacaau

SEQ ID NO: 3858265 - RNA, 19 nt, Shigella flexneri 2a str. 2457T
ugccagacgaauaaaacag

SEQ ID NO: 3858266 - RNA, 22 nt, Shigella flexneri 2a str. 2457T
ugccagacgaauaaaacagaaa

SEQ ID NO: 3858267 - RNA, 14 nt, Shigella flexneri 2a str. 2457T
ugccagagcagcaa

SEQ ID NO: 3858268 - RNA, 16 nt, Shigella flexneri 2a str. 2457T
ugccagagcagcaaca

SEQ ID NO: 3858269 - RNA, 15 nt, Shigella flexneri 2a str. 2457T
ugccagagcccauca

SEQ ID NO: 3858270 - RNA, 19 nt, Shigella flexneri 2a str. 2457T
ugccagagcccaucacaau

SEQ ID NO: 3858271 - RNA, 18 nt, Shigella flexneri 2a str. 2457T
ugccagaggagccaucac

SEQ ID NO: 3858272 - RNA, 19 nt, Shigella flexneri 2a str. 2457T
ugccagaggagccaucacc

SEQ ID NO: 3858273 - RNA, 22 nt, Shigella flexneri 2a str. 2457T
ugccagaggagccaucaccauc

SEQ ID NO: 3858274 - RNA, 16 nt, Shigella flexneri 2a str. 2457T
ugccagauaaauauua

SEQ ID NO: 3858275 - RNA, 15 nt, Shigella flexneri 2a str. 2457T
ugccagauaagacac

SEQ ID NO: 3858276 - RNA, 16 nt, Shigella flexneri 2a str. 2457T
ugccagauaagacacu

SEQ ID NO: 3858277 - RNA, 14 nt, Shigella flexneri 2a str. 2457T
ugccagauagccag

SEQ ID NO: 3858278 - RNA, 21 nt, Shigella flexneri 2a str. 2457T
ugccagaucaucguuuccgau

SEQ ID NO: 3858279 - RNA, 16 nt, Shigella flexneri 2a str. 2457T
ugccagaugcagcggu

SEQ ID NO: 3858280 - RNA, 19 nt, Shigella flexneri 2a str. 2457T
ugccagauggcauccagag

SEQ ID NO: 3858281 - RNA, 17 nt, Shigella flexneri 2a str. 2457T
ugccagauucuccaaca

SEQ ID NO: 3858282 - RNA, 20 nt, Shigella flexneri 2a str. 2457T
ugccagauuuaacggcagca

SEQ ID NO: 3858283 - RNA, 22 nt, Shigella flexneri 2a str. 2457T
ugccagcaacggccaaauaucc

SEQ ID NO: 3858284 - RNA, 20 nt, Shigella flexneri 2a str. 2457T
ugccagcauaccgccgagga

SEQ ID NO: 3858285 - RNA, 20 nt, Shigella flexneri 2a str. 2457T
ugccagccacaccuggugca

SEQ ID NO: 3858286 - RNA, 15 nt, Shigella flexneri 2a str. 2457T
ugccagccauaaaaa

SEQ ID NO: 3858287 - RNA, 18 nt, Shigella flexneri 2a str. 2457T
ugccagccaugagacaaa

SEQ ID NO: 3858288 - RNA, 22 nt, Shigella flexneri 2a str. 2457T
ugccagcccuaaucccgugccg

SEQ ID NO: 3858289 - RNA, 15 nt, Shigella flexneri 2a str. 2457T
ugccagcgccgacgg

SEQ ID NO: 3858290 - RNA, 22 nt, Shigella flexneri 2a str. 2457T
ugccagcgguggugacugguuu

SEQ ID NO: 3858291 - RNA, 20 nt, Shigella flexneri 2a str. 2457T
ugccagcguaaauccugacg

SEQ ID NO: 3858292 - RNA, 23 nt, Shigella flexneri 2a str. 2457T
ugccagcguaccaugauccugca

SEQ ID NO: 3858293 - RNA, 13 nt, Shigella flexneri 2a str. 2457T
ugccagcguggcg

SEQ ID NO: 3858294 - RNA, 14 nt, Shigella flexneri 2a str. 2457T
ugccagcgugucga

SEQ ID NO: 3858295 - RNA, 20 nt, Shigella flexneri 2a str. 2457T
ugccagcucggauaaggcuu

SEQ ID NO: 3858296 - RNA, 22 nt, Shigella flexneri 2a str. 2457T
ugccagcucuuucgacagcgau

SEQ ID NO: 3858297 - RNA, 16 nt, Shigella flexneri 2a str. 2457T
ugccagcugcugugga

SEQ ID NO: 3858298 - RNA, 17 nt, Shigella flexneri 2a str. 2457T
ugccagcuucagcgcgu

SEQ ID NO: 3858299 - RNA, 17 nt, Shigella flexneri 2a str. 2457T
ugccagcuucccgcugg

SEQ ID NO: 3858300 - RNA, 16 nt, Shigella flexneri 2a str. 2457T
ugccagcuuuaaauua

SEQ ID NO: 3858301 - RNA, 18 nt, Shigella flexneri 2a str. 2457T
ugccagcuuucaccugcg

SEQ ID NO: 3858302 - RNA, 14 nt, Shigella flexneri 2a str. 2457T
ugccaggaccauuc

SEQ ID NO: 3858303 - RNA, 20 nt, Shigella flexneri 2a str. 2457T
ugccaggacuucaucacgau

SEQ ID NO: 3858304 - RNA, 14 nt, Shigella flexneri 2a str. 2457T
ugccaggcuuacgc

SEQ ID NO: 3858305 - RNA, 23 nt, Shigella flexneri 2a str. 2457T
ugccaggguggcucaaucgccac

SEQ ID NO: 3858306 - RNA, 15 nt, Shigella flexneri 2a str. 2457T
ugccagguagucacg

SEQ ID NO: 3858307 - RNA, 15 nt, Shigella flexneri 2a str. 2457T
ugccaguaaagcagc

SEQ ID NO: 3858308 - RNA, 19 nt, Shigella flexneri 2a str. 2457T
ugccaguacgccaaucugc

SEQ ID NO: 3858309 - RNA, 23 nt, Shigella flexneri 2a str. 2457T
ugccaguacgccaaucugcaaaa

SEQ ID NO: 3858310 - RNA, 18 nt, Shigella flexneri 2a str. 2457T
ugccagucaaucauccau

SEQ ID NO: 3858311 - RNA, 17 nt, Shigella flexneri 2a str. 2457T
ugccagucaaugaaauu

SEQ ID NO: 3858312 - RNA, 15 nt, Shigella flexneri 2a str. 2457T
ugccaguccuaaaaa

SEQ ID NO: 3858313 - RNA, 19 nt, Shigella flexneri 2a str. 2457T
ugccagucgcgccuuacgc

SEQ ID NO: 3858314 - RNA, 15 nt, Shigella flexneri 2a str. 2457T
ugccagugaugcgca

SEQ ID NO: 3858315 - RNA, 21 nt, Shigella flexneri 2a str. 2457T
ugccagugaugcgcaggguaa

SEQ ID NO: 3858316 - RNA, 21 nt, Shigella flexneri 2a str. 2457T
ugccagugcgguuuccacgcc

SEQ ID NO: 3858317 - RNA, 14 nt, Shigella flexneri 2a str. 2457T
ugccagugcugcuu

SEQ ID NO: 3858318 - RNA, 18 nt, Shigella flexneri 2a str. 2457T
ugccaguuaucgcaggua

SEQ ID NO: 3858319 - RNA, 15 nt, Shigella flexneri 2a str. 2457T
ugccaguucccccug

SEQ ID NO: 3858320 - RNA, 20 nt, Shigella flexneri 2a str. 2457T
ugccauaacgggcggcguug

SEQ ID NO: 3858321 - RNA, 23 nt, Shigella flexneri 2a str. 2457T
ugccauacgugguugccgaagau

SEQ ID NO: 3858322 - RNA, 14 nt, Shigella flexneri 2a str. 2457T
ugccauauacgcca

SEQ ID NO: 3858323 - RNA, 20 nt, Shigella flexneri 2a str. 2457T
ugccauauucgcuuucagcg

SEQ ID NO: 3858324 - RNA, 17 nt, Shigella flexneri 2a str. 2457T
ugccaucagcgccugau

SEQ ID NO: 3858325 - RNA, 19 nt, Shigella flexneri 2a str. 2457T
ugccaucauacagccggca

SEQ ID NO: 3858326 - RNA, 15 nt, Shigella flexneri 2a str. 2457T
ugccaucaucaccag

SEQ ID NO: 3858327 - RNA, 16 nt, Shigella flexneri 2a str. 2457T
ugccaucaucaccaga

SEQ ID NO: 3858328 - RNA, 21 nt, Shigella flexneri 2a str. 2457T
ugccaucauggcgaugagaau

SEQ ID NO: 3858329 - RNA, 13 nt, Shigella flexneri 2a str. 2457T
ugccauccagcuu

SEQ ID NO: 3858330 - RNA, 22 nt, Shigella flexneri 2a str. 2457T
ugccauccguaauuuuuacucc

SEQ ID NO: 3858331 - RNA, 16 nt, Shigella flexneri 2a str. 2457T
ugccauccugauuuau

SEQ ID NO: 3858332 - RNA, 19 nt, Shigella flexneri 2a str. 2457T
ugccaucgacgaaauggug

SEQ ID NO: 3858333 - RNA, 19 nt, Shigella flexneri 2a str. 2457T
ugccaucgcauagcgcaau

SEQ ID NO: 3858334 - RNA, 23 nt, Shigella flexneri 2a str. 2457T
ugccaucgcauagcgcaauaaca

SEQ ID NO: 3858335 - RNA, 16 nt, Shigella flexneri 2a str. 2457T
ugccaucgggcaaaau

SEQ ID NO: 3858336 - RNA, 15 nt, Shigella flexneri 2a str. 2457T
ugccaucgggcuaga

SEQ ID NO: 3858337 - RNA, 14 nt, Shigella flexneri 2a str. 2457T
ugccggugaugccg

SEQ ID NO: 3858338 - RNA, 13 nt, Shigella flexneri 2a str. 2457T
ugccgguuauuuu

SEQ ID NO: 3858339 - RNA, 14 nt, Shigella flexneri 2a str. 2457T
ugccgguuccugca

SEQ ID NO: 3858340 - RNA, 21 nt, Shigella flexneri 2a str. 2457T
ugccguaaaucccagugccug

SEQ ID NO: 3858341 - RNA, 14 nt, Shigella flexneri 2a str. 2457T
ugccguagcgauag

SEQ ID NO: 3858342 - RNA, 18 nt, Shigella flexneri 2a str. 2457T
ugccguauacacacuuuc

SEQ ID NO: 3858343 - RNA, 21 nt, Shigella flexneri 2a str. 2457T
ugccgucauguuacugagcgg

SEQ ID NO: 3858344 - RNA, 19 nt, Shigella flexneri 2a str. 2457T
ugccguccggcaucgcaaa

SEQ ID NO: 3858345 - RNA, 21 nt, Shigella flexneri 2a str. 2457T
ugccgucugggcaaaaucauc

SEQ ID NO: 3858346 - RNA, 19 nt, Shigella flexneri 2a str. 2457T
ugccguuauacaucgcuuu

SEQ ID NO: 3858347 - RNA, 22 nt, Shigella flexneri 2a str. 2457T
ugccguugcuugaugcacuggg

SEQ ID NO: 3858348 - RNA, 14 nt, Shigella flexneri 2a str. 2457T
ugccguuggcggcg

SEQ ID NO: 3858349 - RNA, 14 nt, Shigella flexneri 2a str. 2457T
ugccguuucuauca

SEQ ID NO: 3858350 - RNA, 19 nt, Shigella flexneri 2a str. 2457T
ugccuaauaaaucuaaaac

SEQ ID NO: 3858351 - RNA, 19 nt, Shigella flexneri 2a str. 2457T
ugccuacacaaugccugau

SEQ ID NO: 3858352 - RNA, 15 nt, Shigella flexneri 2a str. 2457T
ugccuacauauuuuu

SEQ ID NO: 3858353 - RNA, 22 nt, Shigella flexneri 2a str. 2457T
ugccuacgggaaccugaccgua

SEQ ID NO: 3858354 - RNA, 23 nt, Shigella flexneri 2a str. 2457T
ugccucguuggucagcucaaagc

SEQ ID NO: 3858355 - RNA, 16 nt, Shigella flexneri 2a str. 2457T
ugccucuccccagcgg

SEQ ID NO: 3858356 - RNA, 21 nt, Shigella flexneri 2a str. 2457T
ugccucuccccagcggaaaau

SEQ ID NO: 3858357 - RNA, 21 nt, Shigella flexneri 2a str. 2457T
ugccucuccuguucucacuaa

SEQ ID NO: 3858358 - RNA, 17 nt, Shigella flexneri 2a str. 2457T
ugccucugcgcccagca

SEQ ID NO: 3858359 - RNA, 17 nt, Shigella flexneri 2a str. 2457T
ugccugaugcgacgcug

SEQ ID NO: 3858360 - RNA, 18 nt, Shigella flexneri 2a str. 2457T
ugccugaugcgacgcuua

SEQ ID NO: 3858361 - RNA, 22 nt, Shigella flexneri 2a str. 2457T
ugccugaugcgcuacgcuuauc

SEQ ID NO: 3858362 - RNA, 17 nt, Shigella flexneri 2a str. 2457T
ugccugauggccugcuc

SEQ ID NO: 3858363 - RNA, 12 nt, Shigella flexneri 2a str. 2457T
ugccugauuacg

SEQ ID NO: 3858364 - RNA, 14 nt, Shigella flexneri 2a str. 2457T
ugccugauuuuauu

SEQ ID NO: 3858365 - RNA, 18 nt, Shigella flexneri 2a str. 2457T
ugccugcacuuuguguca

SEQ ID NO: 3858366 - RNA, 13 nt, Shigella flexneri 2a str. 2457T
ugccugcagcugc

SEQ ID NO: 3858367 - RNA, 17 nt, Shigella flexneri 2a str. 2457T
ugccugccagcuugcga

SEQ ID NO: 3858368 - RNA, 11 nt, Shigella flexneri 2a str. 2457T
ugccugcggca

SEQ ID NO: 3858369 - RNA, 23 nt, Shigella flexneri 2a str. 2457T
ugccugcuggcuagccucccugc

SEQ ID NO: 3858370 - RNA, 20 nt, Shigella flexneri 2a str. 2457T
ugccugcugugccagugcca

SEQ ID NO: 3858371 - RNA, 18 nt, Shigella flexneri 2a str. 2457T
ugccugggcgauuuccuu

SEQ ID NO: 3858372 - RNA, 21 nt, Shigella flexneri 2a str. 2457T
ugccugggcgauuuccuucag

SEQ ID NO: 3858373 - RNA, 22 nt, Shigella flexneri 2a str. 2457T
ugccugggcgauuuccuucagc

SEQ ID NO: 3858374 - RNA, 15 nt, Shigella flexneri 2a str. 2457T
ugccuguacggcagu

SEQ ID NO: 3858375 - RNA, 17 nt, Shigella flexneri 2a str. 2457T
ugccuguacggcaguga

SEQ ID NO: 3858376 - RNA, 19 nt, Shigella flexneri 2a str. 2457T
ugccuguacggcagugaac

SEQ ID NO: 3858377 - RNA, 15 nt, Shigella flexneri 2a str. 2457T
ugccugugcaggcgu

SEQ ID NO: 3858378 - RNA, 16 nt, Shigella flexneri 2a str. 2457T
ugccuguucgccgccg

SEQ ID NO: 3858379 - RNA, 12 nt, Shigella flexneri 2a str. 2457T
ugccuuaaucaa

SEQ ID NO: 3858380 - RNA, 16 nt, Shigella flexneri 2a str. 2457T
ugccuuaugcccggca

SEQ ID NO: 3858381 - RNA, 21 nt, Shigella flexneri 2a str. 2457T
ugccuucacaggccgccaggc

SEQ ID NO: 3858382 - RNA, 23 nt, Shigella flexneri 2a str. 2457T
ugccuucacggcuuugucauuaa

SEQ ID NO: 3858383 - RNA, 21 nt, Shigella flexneri 2a str. 2457T
ugccuuccaccagauggcuuu

SEQ ID NO: 3858384 - RNA, 11 nt, Shigella flexneri 2a str. 2457T
ugccuuccagc

SEQ ID NO: 3858385 - RNA, 20 nt, Shigella flexneri 2a str. 2457T
ugccuuccagcgaugcccag

SEQ ID NO: 3858386 - RNA, 13 nt, Shigella flexneri 2a str. 2457T
ugccuuccauccc

SEQ ID NO: 3858387 - RNA, 14 nt, Shigella flexneri 2a str. 2457T
ugccuuccaucccu

SEQ ID NO: 3858388 - RNA, 20 nt, Shigella flexneri 2a str. 2457T
ugccuucggcgucuccaccu

SEQ ID NO: 3858389 - RNA, 17 nt, Shigella flexneri 2a str. 2457T
ugccuugaguaccauuu

SEQ ID NO: 3858390 - RNA, 14 nt, Shigella flexneri 2a str. 2457T
ugccuuugaaaucg

SEQ ID NO: 3858391 - RNA, 22 nt, Shigella flexneri 2a str. 2457T
ugccuuugaaaucgaacagguu

SEQ ID NO: 3858392 - RNA, 22 nt, Shigella flexneri 2a str. 2457T
ugcgaaaacgauguuugcugcg

SEQ ID NO: 3858393 - RNA, 16 nt, Shigella flexneri 2a str. 2457T
ugcgaaagcgagcagu

SEQ ID NO: 3858394 - RNA, 23 nt, Shigella flexneri 2a str. 2457T
ugcgaaagcgagcaguacagccg

SEQ ID NO: 3858395 - RNA, 17 nt, Shigella flexneri 2a str. 2457T
ugcgaaagcgucagcuu

SEQ ID NO: 3858396 - RNA, 22 nt, Shigella flexneri 2a str. 2457T
ugcgaaagcgucagcuuucaga

SEQ ID NO: 3858397 - RNA, 18 nt, Shigella flexneri 2a str. 2457T
ugcgaaaguaccauuaau

SEQ ID NO: 3858398 - RNA, 17 nt, Shigella flexneri 2a str. 2457T
ugcgaaguuuuuccgcc

SEQ ID NO: 3858399 - RNA, 16 nt, Shigella flexneri 2a str. 2457T
ugcgaauaaugguauc

SEQ ID NO: 3858400 - RNA, 18 nt, Shigella flexneri 2a str. 2457T
ugcgaauggcaugcuccc

SEQ ID NO: 3858401 - RNA, 19 nt, Shigella flexneri 2a str. 2457T
ugcgacaaacaggaaguuu

SEQ ID NO: 3858402 - RNA, 22 nt, Shigella flexneri 2a str. 2457T
ugcgacagagauauucagcccg

SEQ ID NO: 3858403 - RNA, 20 nt, Shigella flexneri 2a str. 2457T
ugcgacagggaucucuucca

SEQ ID NO: 3858404 - RNA, 16 nt, Shigella flexneri 2a str. 2457T
ugcgaccguacaacca

SEQ ID NO: 3858405 - RNA, 22 nt, Shigella flexneri 2a str. 2457T
ugcgaccguacaaccaaaucug

SEQ ID NO: 3858406 - RNA, 16 nt, Shigella flexneri 2a str. 2457T
ugcgacgcuugcagcg

SEQ ID NO: 3858407 - RNA, 15 nt, Shigella flexneri 2a str. 2457T
ugcgacgcuugcgcg

SEQ ID NO: 3858408 - RNA, 15 nt, Shigella flexneri 2a str. 2457T
ugcgacucucagccg

SEQ ID NO: 3858409 - RNA, 21 nt, Shigella flexneri 2a str. 2457T
ugcgagacggcggaaagggcc

SEQ ID NO: 3858410 - RNA, 13 nt, Shigella flexneri 2a str. 2457T
ugcgagcaaaauc

SEQ ID NO: 3858411 - RNA, 14 nt, Shigella flexneri 2a str. 2457T
ugcgagcuuucgac

SEQ ID NO: 3858412 - RNA, 22 nt, Shigella flexneri 2a str. 2457T
ugcgagguuauccgccagcgcc

SEQ ID NO: 3858413 - RNA, 19 nt, Shigella flexneri 2a str. 2457T
ugcgaguuuuaccuucauc

SEQ ID NO: 3858414 - RNA, 17 nt, Shigella flexneri 2a str. 2457T
ugcgaguuuucgcaucc

SEQ ID NO: 3858415 - RNA, 22 nt, Shigella flexneri 2a str. 2457T
ugcgauaucgacggcgugcuga

SEQ ID NO: 3858416 - RNA, 14 nt, Shigella flexneri 2a str. 2457T
ugcgaucaggcauu

SEQ ID NO: 3858417 - RNA, 15 nt, Shigella flexneri 2a str. 2457T
ugcgaucaggcauuc

SEQ ID NO: 3858418 - RNA, 14 nt, Shigella flexneri 2a str. 2457T
ugcgauccugcaga

SEQ ID NO: 3858419 - RNA, 18 nt, Shigella flexneri 2a str. 2457T
ugcgaugcuugacguguc

SEQ ID NO: 3858420 - RNA, 22 nt, Shigella flexneri 2a str. 2457T
ugcgauggcaaaagacaccauc

SEQ ID NO: 3858421 - RNA, 21 nt, Shigella flexneri 2a str. 2457T
ugcgauggugguugcgccgua

SEQ ID NO: 3858422 - RNA, 17 nt, Shigella flexneri 2a str. 2457T
ugcgauguucuucaccg

SEQ ID NO: 3858423 - RNA, 22 nt, Shigella flexneri 2a str. 2457T
ugcgcaaaauucacgccacugu

SEQ ID NO: 3858424 - RNA, 20 nt, Shigella flexneri 2a str. 2457T
ugcgcaaccguaaacgauca

SEQ ID NO: 3858425 - RNA, 17 nt, Shigella flexneri 2a str. 2457T
ugcgcaacgcaaucccc

SEQ ID NO: 3858426 - RNA, 13 nt, Shigella flexneri 2a str. 2457T
ugcgcaacgccgu

SEQ ID NO: 3858427 - RNA, 20 nt, Shigella flexneri 2a str. 2457T
ugcgcaauacguugcaaaau

SEQ ID NO: 3858428 - RNA, 17 nt, Shigella flexneri 2a str. 2457T
ugcgcaaugcguuuagu

SEQ ID NO: 3858429 - RNA, 12 nt, Shigella flexneri 2a str. 2457T
ugcgcacaucaa

SEQ ID NO: 3858430 - RNA, 21 nt, Shigella flexneri 2a str. 2457T
ugcgcagcauaaucggcuggg

SEQ ID NO: 3858431 - RNA, 18 nt, Shigella flexneri 2a str. 2457T
ugcgcaguaccagcaacg

SEQ ID NO: 3858432 - RNA, 17 nt, Shigella flexneri 2a str. 2457T
ugcgcaguacugugaac

SEQ ID NO: 3858433 - RNA, 18 nt, Shigella flexneri 2a str. 2457T
ugcgcaucaucgauacca

SEQ ID NO: 3858434 - RNA, 14 nt, Shigella flexneri 2a str. 2457T
ugcguagcugagca

SEQ ID NO: 3858435 - RNA, 15 nt, Shigella flexneri 2a str. 2457T
ugcguagcugagcaa

SEQ ID NO: 3858436 - RNA, 20 nt, Shigella flexneri 2a str. 2457T
ugcguagucugaccucuucu

SEQ ID NO: 3858437 - RNA, 22 nt, Shigella flexneri 2a str. 2457T
ugcguauggcgacaaggcguug

SEQ ID NO: 3858438 - RNA, 23 nt, Shigella flexneri 2a str. 2457T
ugcgucaagcgguaaccauccau

SEQ ID NO: 3858439 - RNA, 14 nt, Shigella flexneri 2a str. 2457T
ugcgucauccagca

SEQ ID NO: 3858440 - RNA, 15 nt, Shigella flexneri 2a str. 2457T
ugcgucauuccggag

SEQ ID NO: 3858441 - RNA, 20 nt, Shigella flexneri 2a str. 2457T
ugcgucgacauagccauccc

SEQ ID NO: 3858442 - RNA, 14 nt, Shigella flexneri 2a str. 2457T
ugcgucgcacucuc

SEQ ID NO: 3858443 - RNA, 13 nt, Shigella flexneri 2a str. 2457T
ugcgucgccgccu

SEQ ID NO: 3858444 - RNA, 19 nt, Shigella flexneri 2a str. 2457T
ugcgucucugguuuuacaa

SEQ ID NO: 3858445 - RNA, 19 nt, Shigella flexneri 2a str. 2457T
ugcgucucuuguugcaaca

SEQ ID NO: 3858446 - RNA, 20 nt, Shigella flexneri 2a str. 2457T
ugcgucucuuguugcaacaa

SEQ ID NO: 3858447 - RNA, 18 nt, Shigella flexneri 2a str. 2457T
ugcgucuggguaaaccga

SEQ ID NO: 3858448 - RNA, 12 nt, Shigella flexneri 2a str. 2457T
ugcgucuuccgu

SEQ ID NO: 3858449 - RNA, 14 nt, Shigella flexneri 2a str. 2457T
ugcgugacuaaaac

SEQ ID NO: 3858450 - RNA, 21 nt, Shigella flexneri 2a str. 2457T
ugcguggcagauuaggauuaa

SEQ ID NO: 3858451 - RNA, 19 nt, Shigella flexneri 2a str. 2457T
ugcguggcaucaaacacug

SEQ ID NO: 3858452 - RNA, 13 nt, Shigella flexneri 2a str. 2457T
ugcguuaagccau

SEQ ID NO: 3858453 - RNA, 19 nt, Shigella flexneri 2a str. 2457T
ugcguuacccacaguuuca

SEQ ID NO: 3858454 - RNA, 14 nt, Shigella flexneri 2a str. 2457T
ugcguucaauaccg

SEQ ID NO: 3858455 - RNA, 19 nt, Shigella flexneri 2a str. 2457T
ugcguucaccgaagacgug

SEQ ID NO: 3858456 - RNA, 20 nt, Shigella flexneri 2a str. 2457T
ugcguucagcaguucugcca

SEQ ID NO: 3858457 - RNA, 21 nt, Shigella flexneri 2a str. 2457T
ugcguuccagcauguuauuca

SEQ ID NO: 3858458 - RNA, 19 nt, Shigella flexneri 2a str. 2457T
ugcguuccccgaagacgug

SEQ ID NO: 3858459 - RNA, 18 nt, Shigella flexneri 2a str. 2457T
ugcguuccuggggaaaau

SEQ ID NO: 3858460 - RNA, 19 nt, Shigella flexneri 2a str. 2457T
ugcguuccuggggaaaaug

SEQ ID NO: 3858461 - RNA, 23 nt, Shigella flexneri 2a str. 2457T
ugcguucgcgaccggcgauggca

SEQ ID NO: 3858462 - RNA, 19 nt, Shigella flexneri 2a str. 2457T
ugcguucucccucgucggu

SEQ ID NO: 3858463 - RNA, 22 nt, Shigella flexneri 2a str. 2457T
ugcguugucaucgaauaaauug

SEQ ID NO: 3858464 - RNA, 19 nt, Shigella flexneri 2a str. 2457T
ugcguugucgccauccaga

SEQ ID NO: 3858465 - RNA, 19 nt, Shigella flexneri 2a str. 2457T
ugcguuucauguaacgaug

SEQ ID NO: 3858466 - RNA, 18 nt, Shigella flexneri 2a str. 2457T
ugcguuuguaggccggau

SEQ ID NO: 3858467 - RNA, 15 nt, Shigella flexneri 2a str. 2457T
ugcguuuguccgccg

SEQ ID NO: 3858468 - RNA, 16 nt, Shigella flexneri 2a str. 2457T
ugcguuuuuaucuuca

SEQ ID NO: 3858469 - RNA, 18 nt, Shigella flexneri 2a str. 2457T
ugcguuuuuaucuucaca

SEQ ID NO: 3858470 - RNA, 18 nt, Shigella flexneri 2a str. 2457T
ugcuaaaaacaucaugau

SEQ ID NO: 3858471 - RNA, 13 nt, Shigella flexneri 2a str. 2457T
ugcuaaaccagcc

SEQ ID NO: 3858472 - RNA, 20 nt, Shigella flexneri 2a str. 2457T
ugcuacuaugauuuuccuga

SEQ ID NO: 3858473 - RNA, 23 nt, Shigella flexneri 2a str. 2457T
ugcuaguaaguuacauuuuaaua

SEQ ID NO: 3858474 - RNA, 23 nt, Shigella flexneri 2a str. 2457T
ugcuaguuaucuccuugcuggug

SEQ ID NO: 3858475 - RNA, 21 nt, Shigella flexneri 2a str. 2457T
ugcuaucuccuguugugaugc

SEQ ID NO: 3858476 - RNA, 23 nt, Shigella flexneri 2a str. 2457T
ugcuaucuccuguugugaugcaa

SEQ ID NO: 3858477 - RNA, 16 nt, Shigella flexneri 2a str. 2457T
ugcuaugcugaaugau

SEQ ID NO: 3858478 - RNA, 16 nt, Shigella flexneri 2a str. 2457T
ugcuauggggaaaaau

SEQ ID NO: 3858479 - RNA, 22 nt, Shigella flexneri 2a str. 2457T
ugcuaugguccguucucaccag

SEQ ID NO: 3858480 - RNA, 15 nt, Shigella flexneri 2a str. 2457T
ugcuauucaccagca

SEQ ID NO: 3858481 - RNA, 13 nt, Shigella flexneri 2a str. 2457T
ugcuauuccuuga

SEQ ID NO: 3858482 - RNA, 15 nt, Shigella flexneri 2a str. 2457T
ugcuauuccuugaaa

SEQ ID NO: 3858483 - RNA, 18 nt, Shigella flexneri 2a str. 2457T
ugcuauuuaccacuacug

SEQ ID NO: 3858484 - RNA, 19 nt, Shigella flexneri 2a str. 2457T
ugcucaaacuucgucacag

SEQ ID NO: 3858485 - RNA, 14 nt, Shigella flexneri 2a str. 2457T
ugcucaacugccag

SEQ ID NO: 3858486 - RNA, 17 nt, Shigella flexneri 2a str. 2457T
ugcucaaucaucacgau

SEQ ID NO: 3858487 - RNA, 16 nt, Shigella flexneri 2a str. 2457T
ugcucaaugagcaccu

SEQ ID NO: 3858488 - RNA, 16 nt, Shigella flexneri 2a str. 2457T
ugcucaaugccugaug

SEQ ID NO: 3858489 - RNA, 17 nt, Shigella flexneri 2a str. 2457T
ugcucaauugacaguuu

SEQ ID NO: 3858490 - RNA, 23 nt, Shigella flexneri 2a str. 2457T
ugcucaauugacaguuuauuuuc

SEQ ID NO: 3858491 - RNA, 18 nt, Shigella flexneri 2a str. 2457T
ugcucacaaccccggcaa

SEQ ID NO: 3858492 - RNA, 20 nt, Shigella flexneri 2a str. 2457T
ugcucacaaccccggcaaau

SEQ ID NO: 3858493 - RNA, 14 nt, Shigella flexneri 2a str. 2457T
ugcucacuacggcu

SEQ ID NO: 3858494 - RNA, 18 nt, Shigella flexneri 2a str. 2457T
ugcucagaaucacgccaa

SEQ ID NO: 3858495 - RNA, 21 nt, Shigella flexneri 2a str. 2457T
ugcucagaaucacgccaacaa

SEQ ID NO: 3858496 - RNA, 19 nt, Shigella flexneri 2a str. 2457T
ugcucagagcuacaaagau

SEQ ID NO: 3858497 - RNA, 15 nt, Shigella flexneri 2a str. 2457T
ugcucauaaaaugau

SEQ ID NO: 3858498 - RNA, 14 nt, Shigella flexneri 2a str. 2457T
ugcucaucagcccg

SEQ ID NO: 3858499 - RNA, 18 nt, Shigella flexneri 2a str. 2457T
ugcucaucagcccggcaa

SEQ ID NO: 3858500 - RNA, 22 nt, Shigella flexneri 2a str. 2457T
ugcucaucagcgguaaaacgcc

SEQ ID NO: 3858501 - RNA, 14 nt, Shigella flexneri 2a str. 2457T
ugcucaucgauauc

SEQ ID NO: 3858502 - RNA, 21 nt, Shigella flexneri 2a str. 2457T
ugcucaucgauaucgaccacu

SEQ ID NO: 3858503 - RNA, 23 nt, Shigella flexneri 2a str. 2457T
ugcucaucuggcguaccaaucag

SEQ ID NO: 3858504 - RNA, 19 nt, Shigella flexneri 2a str. 2457T
ugcucauuacaguagcuau

SEQ ID NO: 3858505 - RNA, 18 nt, Shigella flexneri 2a str. 2457T
ugcucauucuuccuccag

SEQ ID NO: 3858506 - RNA, 18 nt, Shigella flexneri 2a str. 2457T
ugcucauuugauugccgg

SEQ ID NO: 3858507 - RNA, 13 nt, Shigella flexneri 2a str. 2457T
ugcuccacugcuc

SEQ ID NO: 3858508 - RNA, 13 nt, Shigella flexneri 2a str. 2457T
ugcuccagcagau

SEQ ID NO: 3858509 - RNA, 18 nt, Shigella flexneri 2a str. 2457T
ugcuccagcguaccugcc

SEQ ID NO: 3858510 - RNA, 13 nt, Shigella flexneri 2a str. 2457T
ugcuccagucguu

SEQ ID NO: 3858511 - RNA, 12 nt, Shigella flexneri 2a str. 2457T
ugcuccauccau

SEQ ID NO: 3858512 - RNA, 21 nt, Shigella flexneri 2a str. 2457T
ugcuccauccauugcauaaac

SEQ ID NO: 3858513 - RNA, 22 nt, Shigella flexneri 2a str. 2457T
ugcuccauuagcccgagaucuu

SEQ ID NO: 3858514 - RNA, 22 nt, Shigella flexneri 2a str. 2457T
ugcuccggguagagguuauaaa

SEQ ID NO: 3858515 - RNA, 14 nt, Shigella flexneri 2a str. 2457T
ugcuccuccuucuc

SEQ ID NO: 3858516 - RNA, 22 nt, Shigella flexneri 2a str. 2457T
ugcucgaacauccccacagaaa

SEQ ID NO: 3858517 - RNA, 16 nt, Shigella flexneri 2a str. 2457T
ugcucgcaggcugaga

SEQ ID NO: 3858518 - RNA, 16 nt, Shigella flexneri 2a str. 2457T
ugcucgcccuggaugc

SEQ ID NO: 3858519 - RNA, 18 nt, Shigella flexneri 2a str. 2457T
ugcucgcccuggaugcag

SEQ ID NO: 3858520 - RNA, 17 nt, Shigella flexneri 2a str. 2457T
ugcucgcgagaacggcg

SEQ ID NO: 3858521 - RNA, 16 nt, Shigella flexneri 2a str. 2457T
ugcucgcuggcaggcc

SEQ ID NO: 3858522 - RNA, 16 nt, Shigella flexneri 2a str. 2457T
ugcucguaaguuaacu

SEQ ID NO: 3858523 - RNA, 14 nt, Shigella flexneri 2a str. 2457T
ugcucguucagcgg

SEQ ID NO: 3858524 - RNA, 15 nt, Shigella flexneri 2a str. 2457T
ugcucuaacccuucc

SEQ ID NO: 3858525 - RNA, 22 nt, Shigella flexneri 2a str. 2457T
ugcucuaacccuuccagauuca

SEQ ID NO: 3858526 - RNA, 21 nt, Shigella flexneri 2a str. 2457T
ugcucucaaagacguuaaaaa

SEQ ID NO: 3858527 - RNA, 20 nt, Shigella flexneri 2a str. 2457T
ugcucuccguaggccagaua

SEQ ID NO: 3858528 - RNA, 22 nt, Shigella flexneri 2a str. 2457T
ugcucugaagguuguuaaccac

SEQ ID NO: 3858529 - RNA, 20 nt, Shigella flexneri 2a str. 2457T
ugcucugaggcugaugacaa

SEQ ID NO: 3858530 - RNA, 18 nt, Shigella flexneri 2a str. 2457T
ugcucugcagcagccugc

SEQ ID NO: 3858531 - RNA, 14 nt, Shigella flexneri 2a str. 2457T
ugcuugacaacuua

SEQ ID NO: 3858532 - RNA, 18 nt, Shigella flexneri 2a str. 2457T
ugcuugacgugucuuauc

SEQ ID NO: 3858533 - RNA, 23 nt, Shigella flexneri 2a str. 2457T
ugcuugcacaaccggaaccagcg

SEQ ID NO: 3858534 - RNA, 18 nt, Shigella flexneri 2a str. 2457T
ugcuugccagauacgaug

SEQ ID NO: 3858535 - RNA, 15 nt, Shigella flexneri 2a str. 2457T
ugcuugccccuuccc

SEQ ID NO: 3858536 - RNA, 18 nt, Shigella flexneri 2a str. 2457T
ugcuugcgauauucuuca

SEQ ID NO: 3858537 - RNA, 18 nt, Shigella flexneri 2a str. 2457T
ugcuuguggcggaaagac

SEQ ID NO: 3858538 - RNA, 15 nt, Shigella flexneri 2a str. 2457T
ugcuuuaaaaaagaa

SEQ ID NO: 3858539 - RNA, 16 nt, Shigella flexneri 2a str. 2457T
ugcuuuaaaaaagaau

SEQ ID NO: 3858540 - RNA, 14 nt, Shigella flexneri 2a str. 2457T
ugcuuuaaaugcug

SEQ ID NO: 3858541 - RNA, 15 nt, Shigella flexneri 2a str. 2457T
ugcuuuaaguucagc

SEQ ID NO: 3858542 - RNA, 15 nt, Shigella flexneri 2a str. 2457T
ugcuuuaucaaucac

SEQ ID NO: 3858543 - RNA, 20 nt, Shigella flexneri 2a str. 2457T
ugcuuucagcacuuaucucu

SEQ ID NO: 3858544 - RNA, 14 nt, Shigella flexneri 2a str. 2457T
ugcuuucagcgaaa

SEQ ID NO: 3858545 - RNA, 20 nt, Shigella flexneri 2a str. 2457T
ugcuuucaucaaaaaaugaa

SEQ ID NO: 3858546 - RNA, 13 nt, Shigella flexneri 2a str. 2457T
ugcuuuugcuucu

SEQ ID NO: 3858547 - RNA, 17 nt, Shigella flexneri 2a str. 2457T
ugcuuuuguuaauugcu

SEQ ID NO: 3858548 - RNA, 14 nt, Shigella flexneri 2a str. 2457T
ugcuuuuuuccaua

SEQ ID NO: 3858549 - RNA, 19 nt, Shigella flexneri 2a str. 2457T
uggaaacggacagaccugc

SEQ ID NO: 3858550 - RNA, 19 nt, Shigella flexneri 2a str. 2457T
uggaaauuguuuuugauuu

SEQ ID NO: 3858551 - RNA, 22 nt, Shigella flexneri 2a str. 2457T
uggaacacuuugccgucagcca

SEQ ID NO: 3858552 - RNA, 13 nt, Shigella flexneri 2a str. 2457T
uggaacccgcagc

SEQ ID NO: 3858553 - RNA, 17 nt, Shigella flexneri 2a str. 2457T
uggaacgcguacagaaa

SEQ ID NO: 3858554 - RNA, 22 nt, Shigella flexneri 2a str. 2457T
uggaacgcguacagaaaacuca

SEQ ID NO: 3858555 - RNA, 18 nt, Shigella flexneri 2a str. 2457T
uggaacggcagauccaaa

SEQ ID NO: 3858556 - RNA, 20 nt, Shigella flexneri 2a str. 2457T
uggaagaccugacuguucca

SEQ ID NO: 3858557 - RNA, 23 nt, Shigella flexneri 2a str. 2457T
uggaagaccugacuguuccagca

SEQ ID NO: 3858558 - RNA, 23 nt, Shigella flexneri 2a str. 2457T
uggaaggacucgaggagcuggag

SEQ ID NO: 3858559 - RNA, 14 nt, Shigella flexneri 2a str. 2457T
uggaaggguugaaa

SEQ ID NO: 3858560 - RNA, 19 nt, Shigella flexneri 2a str. 2457T
uggaaggguugaaauauau

SEQ ID NO: 3858561 - RNA, 22 nt, Shigella flexneri 2a str. 2457T
uggaagguaaggauaaaaaagg

SEQ ID NO: 3858562 - RNA, 19 nt, Shigella flexneri 2a str. 2457T
uggaauacauauauuacaa

SEQ ID NO: 3858563 - RNA, 17 nt, Shigella flexneri 2a str. 2457T
uggaauaccuuucgauu

SEQ ID NO: 3858564 - RNA, 14 nt, Shigella flexneri 2a str. 2457T
uggaaucaauaauu

SEQ ID NO: 3858565 - RNA, 22 nt, Shigella flexneri 2a str. 2457T
uggaaucaauaauuaaucuggu

SEQ ID NO: 3858566 - RNA, 17 nt, Shigella flexneri 2a str. 2457T
uggaauuccuuucccua

SEQ ID NO: 3858567 - RNA, 15 nt, Shigella flexneri 2a str. 2457T
uggaauuuguccacc

SEQ ID NO: 3858568 - RNA, 21 nt, Shigella flexneri 2a str. 2457T
uggaauuuguccaccaauagc

SEQ ID NO: 3858569 - RNA, 14 nt, Shigella flexneri 2a str. 2457T
uggacaacauuccu

SEQ ID NO: 3858570 - RNA, 15 nt, Shigella flexneri 2a str. 2457T
uggaccagcggguug

SEQ ID NO: 3858571 - RNA, 13 nt, Shigella flexneri 2a str. 2457T
uggacgaacaguu

SEQ ID NO: 3858572 - RNA, 15 nt, Shigella flexneri 2a str. 2457T
uggacgaacuggcgc

SEQ ID NO: 3858573 - RNA, 14 nt, Shigella flexneri 2a str. 2457T
uggacgcagcucau

SEQ ID NO: 3858574 - RNA, 22 nt, Shigella flexneri 2a str. 2457T
uggacgccguauucacuuucaa

SEQ ID NO: 3858575 - RNA, 21 nt, Shigella flexneri 2a str. 2457T
uggacgcucaggcuacuuuuc

SEQ ID NO: 3858576 - RNA, 13 nt, Shigella flexneri 2a str. 2457T
uggacgguaaaaa

SEQ ID NO: 3858577 - RNA, 14 nt, Shigella flexneri 2a str. 2457T
uggacgguggagca

SEQ ID NO: 3858578 - RNA, 22 nt, Shigella flexneri 2a str. 2457T
uggacgguggagcaacagggaa

SEQ ID NO: 3858579 - RNA, 18 nt, Shigella flexneri 2a str. 2457T
uggacucccagaacaacc

SEQ ID NO: 3858580 - RNA, 15 nt, Shigella flexneri 2a str. 2457T
uggagacugaugaca

SEQ ID NO: 3858581 - RNA, 16 nt, Shigella flexneri 2a str. 2457T
uggagagcagcaucaa

SEQ ID NO: 3858582 - RNA, 20 nt, Shigella flexneri 2a str. 2457T
uggagaguugcaccagcaac

SEQ ID NO: 3858583 - RNA, 13 nt, Shigella flexneri 2a str. 2457T
uggagcaggaacu

SEQ ID NO: 3858584 - RNA, 13 nt, Shigella flexneri 2a str. 2457T
uggagcaggaaua

SEQ ID NO: 3858585 - RNA, 17 nt, Shigella flexneri 2a str. 2457T
uggagcuaaacagcgcu

SEQ ID NO: 3858586 - RNA, 19 nt, Shigella flexneri 2a str. 2457T
uggagcuaaacagcgcugc

SEQ ID NO: 3858587 - RNA, 13 nt, Shigella flexneri 2a str. 2457T
uggaguaauaauu

SEQ ID NO: 3858588 - RNA, 15 nt, Shigella flexneri 2a str. 2457T
uggaguaauaauuuc

SEQ ID NO: 3858589 - RNA, 12 nt, Shigella flexneri 2a str. 2457T
uggagugcagca

SEQ ID NO: 3858590 - RNA, 16 nt, Shigella flexneri 2a str. 2457T
uggagugcagcaugca

SEQ ID NO: 3858591 - RNA, 13 nt, Shigella flexneri 2a str. 2457T
uggaguggcccag

SEQ ID NO: 3858592 - RNA, 21 nt, Shigella flexneri 2a str. 2457T
uggaguuaaauuaauaaucac

SEQ ID NO: 3858593 - RNA, 22 nt, Shigella flexneri 2a str. 2457T
uggaguuccuggaugacccgga

SEQ ID NO: 3858594 - RNA, 21 nt, Shigella flexneri 2a str. 2457T
uggauaacguuuaucccaguc

SEQ ID NO: 3858595 - RNA, 21 nt, Shigella flexneri 2a str. 2457T
uggauaagaugcuacaacauc

SEQ ID NO: 3858596 - RNA, 20 nt, Shigella flexneri 2a str. 2457T
uggauaauccaucccgcucu

SEQ ID NO: 3858597 - RNA, 22 nt, Shigella flexneri 2a str. 2457T
uggauaaugaagucugccguug

SEQ ID NO: 3858598 - RNA, 21 nt, Shigella flexneri 2a str. 2457T
uggaucaacgaccagcgcgug

SEQ ID NO: 3858599 - RNA, 15 nt, Shigella flexneri 2a str. 2457T
uggaucaagccccag

SEQ ID NO: 3858600 - RNA, 19 nt, Shigella flexneri 2a str. 2457T
uggaucaagccccagcagg

SEQ ID NO: 3858601 - RNA, 22 nt, Shigella flexneri 2a str. 2457T
uggaucaaggauugcagcacug

SEQ ID NO: 3858602 - RNA, 18 nt, Shigella flexneri 2a str. 2457T
uggaucccagaagaauau

SEQ ID NO: 3858603 - RNA, 15 nt, Shigella flexneri 2a str. 2457T
uggaucccagaagau

SEQ ID NO: 3858604 - RNA, 18 nt, Shigella flexneri 2a str. 2457T
uggaucgagauugucggc

SEQ ID NO: 3858605 - RNA, 15 nt, Shigella flexneri 2a str. 2457T
uggaucguggugaag

SEQ ID NO: 3858606 - RNA, 21 nt, Shigella flexneri 2a str. 2457T
uggaugaacuucgcagccgug

SEQ ID NO: 3858607 - RNA, 22 nt, Shigella flexneri 2a str. 2457T
uggaugaacuucgcagccguga

SEQ ID NO: 3858608 - RNA, 20 nt, Shigella flexneri 2a str. 2457T
uggaugacauugaugcgcca

SEQ ID NO: 3858609 - RNA, 18 nt, Shigella flexneri 2a str. 2457T
uggaugagucggaccauc

SEQ ID NO: 3858610 - RNA, 23 nt, Shigella flexneri 2a str. 2457T
uggaugcagucaaaucuuauaug

SEQ ID NO: 3858611 - RNA, 21 nt, Shigella flexneri 2a str. 2457T
uggaugcgccauaccaugcac

SEQ ID NO: 3858612 - RNA, 15 nt, Shigella flexneri 2a str. 2457T
uggaugcggaaccau

SEQ ID NO: 3858613 - RNA, 14 nt, Shigella flexneri 2a str. 2457T
uggaugucuggcag

SEQ ID NO: 3858614 - RNA, 13 nt, Shigella flexneri 2a str. 2457T
uggauuaaauugc

SEQ ID NO: 3858615 - RNA, 13 nt, Shigella flexneri 2a str. 2457T
uggauuaucuuca

SEQ ID NO: 3858616 - RNA, 13 nt, Shigella flexneri 2a str. 2457T
uggauucagcacc

SEQ ID NO: 3858617 - RNA, 16 nt, Shigella flexneri 2a str. 2457T
uggauugcugaaauac

SEQ ID NO: 3858618 - RNA, 19 nt, Shigella flexneri 2a str. 2457T
uggauugcugaaauacaga

SEQ ID NO: 3858619 - RNA, 14 nt, Shigella flexneri 2a str. 2457T
uggcaaaaucaaaa

SEQ ID NO: 3858620 - RNA, 17 nt, Shigella flexneri 2a str. 2457T
uggcaaacugaguggag

SEQ ID NO: 3858621 - RNA, 21 nt, Shigella flexneri 2a str. 2457T
uggcaaagcugucaccaauca

SEQ ID NO: 3858622 - RNA, 13 nt, Shigella flexneri 2a str. 2457T
uggcaaaugacau

SEQ ID NO: 3858623 - RNA, 16 nt, Shigella flexneri 2a str. 2457T
uggcaaauuuauuauc

SEQ ID NO: 3858624 - RNA, 14 nt, Shigella flexneri 2a str. 2457T
uggcaacaauggca

SEQ ID NO: 3858625 - RNA, 15 nt, Shigella flexneri 2a str. 2457T
uggcaaccagcagau

SEQ ID NO: 3858626 - RNA, 20 nt, Shigella flexneri 2a str. 2457T
uggcaaccuucuucuuucag

SEQ ID NO: 3858627 - RNA, 19 nt, Shigella flexneri 2a str. 2457T
uggcaacgacgagcggaca

SEQ ID NO: 3858628 - RNA, 22 nt, Shigella flexneri 2a str. 2457T
uggcggacgggugaguaauguc

SEQ ID NO: 3858629 - RNA, 11 nt, Shigella flexneri 2a str. 2457T
uggcggcuggc

SEQ ID NO: 3858630 - RNA, 23 nt, Shigella flexneri 2a str. 2457T
uggcgggaucaccugcacaugca

SEQ ID NO: 3858631 - RNA, 22 nt, Shigella flexneri 2a str. 2457T
uggcggggagggaauccagcaa

SEQ ID NO: 3858632 - RNA, 16 nt, Shigella flexneri 2a str. 2457T
uggcggggaucacucc

SEQ ID NO: 3858633 - RNA, 17 nt, Shigella flexneri 2a str. 2457T
uggcguaaagccuuuua

SEQ ID NO: 3858634 - RNA, 15 nt, Shigella flexneri 2a str. 2457T
uggcguacccaucaa

SEQ ID NO: 3858635 - RNA, 16 nt, Shigella flexneri 2a str. 2457T
uggcguacccaucaac

SEQ ID NO: 3858636 - RNA, 21 nt, Shigella flexneri 2a str. 2457T
uggcguacucaauuuucaccg

SEQ ID NO: 3858637 - RNA, 21 nt, Shigella flexneri 2a str. 2457T
uggcgucacgccgaccagacc

SEQ ID NO: 3858638 - RNA, 23 nt, Shigella flexneri 2a str. 2457T
uggcgucagaccggcaaccagca

SEQ ID NO: 3858639 - RNA, 14 nt, Shigella flexneri 2a str. 2457T
uggcgucuccugcc

SEQ ID NO: 3858640 - RNA, 19 nt, Shigella flexneri 2a str. 2457T
uggcgucuccugccgagcg

SEQ ID NO: 3858641 - RNA, 22 nt, Shigella flexneri 2a str. 2457T
uggcgugagccgucaccgccug

SEQ ID NO: 3858642 - RNA, 20 nt, Shigella flexneri 2a str. 2457T
uggcguuacauuuccaggaa

SEQ ID NO: 3858643 - RNA, 17 nt, Shigella flexneri 2a str. 2457T
uggcguuaggcacauca

SEQ ID NO: 3858644 - RNA, 18 nt, Shigella flexneri 2a str. 2457T
uggcguuauggcaaucuu

SEQ ID NO: 3858645 - RNA, 16 nt, Shigella flexneri 2a str. 2457T
uggcguucagcgacgu

SEQ ID NO: 3858646 - RNA, 20 nt, Shigella flexneri 2a str. 2457T
uggcguuuccagcaguucca

SEQ ID NO: 3858647 - RNA, 22 nt, Shigella flexneri 2a str. 2457T
uggcguuugaccaacaccggua

SEQ ID NO: 3858648 - RNA, 14 nt, Shigella flexneri 2a str. 2457T
uggcguuugccacc

SEQ ID NO: 3858649 - RNA, 15 nt, Shigella flexneri 2a str. 2457T
uggcguuugccaccu

SEQ ID NO: 3858650 - RNA, 14 nt, Shigella flexneri 2a str. 2457T
uggcguuuucgccg

SEQ ID NO: 3858651 - RNA, 21 nt, Shigella flexneri 2a str. 2457T
uggcguuuuuccaaaacugga

SEQ ID NO: 3858652 - RNA, 20 nt, Shigella flexneri 2a str. 2457T
uggcuacccugguuuccgcu

SEQ ID NO: 3858653 - RNA, 23 nt, Shigella flexneri 2a str. 2457T
uggcuauaaucacucaaaauauc

SEQ ID NO: 3858654 - RNA, 13 nt, Shigella flexneri 2a str. 2457T
uggcucaccagca

SEQ ID NO: 3858655 - RNA, 16 nt, Shigella flexneri 2a str. 2457T
uggcucaucaagcaca

SEQ ID NO: 3858656 - RNA, 20 nt, Shigella flexneri 2a str. 2457T
uggcucaucgccuuccagcg

SEQ ID NO: 3858657 - RNA, 13 nt, Shigella flexneri 2a str. 2457T
uggcucuucaccu

SEQ ID NO: 3858658 - RNA, 16 nt, Shigella flexneri 2a str. 2457T
uggcucuucaccugcc

SEQ ID NO: 3858659 - RNA, 19 nt, Shigella flexneri 2a str. 2457T
uggcugaauauuuuagccg

SEQ ID NO: 3858660 - RNA, 21 nt, Shigella flexneri 2a str. 2457T
uggcugacauaaacaccagca

SEQ ID NO: 3858661 - RNA, 19 nt, Shigella flexneri 2a str. 2457T
uggcugacugucgcagcca

SEQ ID NO: 3858662 - RNA, 22 nt, Shigella flexneri 2a str. 2457T
uggcugagcaaacaguucugca

SEQ ID NO: 3858663 - RNA, 16 nt, Shigella flexneri 2a str. 2457T
uggcugcaaagcauuu

SEQ ID NO: 3858664 - RNA, 20 nt, Shigella flexneri 2a str. 2457T
uggcugcaaagcauuuuuuc

SEQ ID NO: 3858665 - RNA, 16 nt, Shigella flexneri 2a str. 2457T
uggcugccaugguuug

SEQ ID NO: 3858666 - RNA, 19 nt, Shigella flexneri 2a str. 2457T
uggcugcgcgaaaacccuc

SEQ ID NO: 3858667 - RNA, 19 nt, Shigella flexneri 2a str. 2457T
uggcuggggaauauuuaau

SEQ ID NO: 3858668 - RNA, 16 nt, Shigella flexneri 2a str. 2457T
uggcugugcguuaccc

SEQ ID NO: 3858669 - RNA, 13 nt, Shigella flexneri 2a str. 2457T
uggcugugcuauu

SEQ ID NO: 3858670 - RNA, 15 nt, Shigella flexneri 2a str. 2457T
uggcuguucugccuc

SEQ ID NO: 3858671 - RNA, 16 nt, Shigella flexneri 2a str. 2457T
uggcuguuucgcuucu

SEQ ID NO: 3858672 - RNA, 18 nt, Shigella flexneri 2a str. 2457T
uggcuguuuucagcacca

SEQ ID NO: 3858673 - RNA, 16 nt, Shigella flexneri 2a str. 2457T
uggcuuaucuuccugu

SEQ ID NO: 3858674 - RNA, 20 nt, Shigella flexneri 2a str. 2457T
uggcuucuuccccggaugag

SEQ ID NO: 3858675 - RNA, 16 nt, Shigella flexneri 2a str. 2457T
uggcuuuccgggagca

SEQ ID NO: 3858676 - RNA, 17 nt, Shigella flexneri 2a str. 2457T
uggcuuugcccuuucug

SEQ ID NO: 3858677 - RNA, 13 nt, Shigella flexneri 2a str. 2457T
ugggaaauccaac

SEQ ID NO: 3858678 - RNA, 14 nt, Shigella flexneri 2a str. 2457T
ugggaaaugacauu

SEQ ID NO: 3858679 - RNA, 13 nt, Shigella flexneri 2a str. 2457T
ugggaacaccgua

SEQ ID NO: 3858680 - RNA, 17 nt, Shigella flexneri 2a str. 2457T
ugggaagaauggaaaaa

SEQ ID NO: 3858681 - RNA, 14 nt, Shigella flexneri 2a str. 2457T
ugggaaggugcgga

SEQ ID NO: 3858682 - RNA, 15 nt, Shigella flexneri 2a str. 2457T
ugggacgcagacugg

SEQ ID NO: 3858683 - RNA, 21 nt, Shigella flexneri 2a str. 2457T
ugggauaugagcgauuuuuua

SEQ ID NO: 3858684 - RNA, 15 nt, Shigella flexneri 2a str. 2457T
ugggaucgccagguu

SEQ ID NO: 3858685 - RNA, 13 nt, Shigella flexneri 2a str. 2457T
ugggauuaaaaag

SEQ ID NO: 3858686 - RNA, 21 nt, Shigella flexneri 2a str. 2457T
ugggauuaaaaaguaagaauu

SEQ ID NO: 3858687 - RNA, 13 nt, Shigella flexneri 2a str. 2457T
ugggauugccgcu

SEQ ID NO: 3858688 - RNA, 14 nt, Shigella flexneri 2a str. 2457T
ugggauugcuucag

SEQ ID NO: 3858689 - RNA, 20 nt, Shigella flexneri 2a str. 2457T
ugggauugcuucaguugccu

SEQ ID NO: 3858690 - RNA, 20 nt, Shigella flexneri 2a str. 2457T
ugggcaaucucacuccggcc

SEQ ID NO: 3858691 - RNA, 16 nt, Shigella flexneri 2a str. 2457T
ugggcaauuucuuuug

SEQ ID NO: 3858692 - RNA, 19 nt, Shigella flexneri 2a str. 2457T
ugggcaguucgggccgauc

SEQ ID NO: 3858693 - RNA, 18 nt, Shigella flexneri 2a str. 2457T
ugggcaguugcgcgcgca

SEQ ID NO: 3858694 - RNA, 14 nt, Shigella flexneri 2a str. 2457T
ugggcaucaguaug

SEQ ID NO: 3858695 - RNA, 24 nt, Shigella flexneri 2a str. 2457T
ugggcaucgcgacagugcauaaau

SEQ ID NO: 3858696 - RNA, 17 nt, Shigella flexneri 2a str. 2457T
ugggcaucggcaaucac

SEQ ID NO: 3858697 - RNA, 21 nt, Shigella flexneri 2a str. 2457T
ugggcaucggcaaucacauca

SEQ ID NO: 3858698 - RNA, 16 nt, Shigella flexneri 2a str. 2457T
ugggccagaaaaaacg

SEQ ID NO: 3858699 - RNA, 16 nt, Shigella flexneri 2a str. 2457T
ugggccugaaagcuca

SEQ ID NO: 3858700 - RNA, 13 nt, Shigella flexneri 2a str. 2457T
ugggcgaagagaa

SEQ ID NO: 3858701 - RNA, 21 nt, Shigella flexneri 2a str. 2457T
ugggcgaagagaaagaacgag

SEQ ID NO: 3858702 - RNA, 23 nt, Shigella flexneri 2a str. 2457T
ugggcgagggcaaaccucaccgc

SEQ ID NO: 3858703 - RNA, 21 nt, Shigella flexneri 2a str. 2457T
ugggcgauacgggcucgggca

SEQ ID NO: 3858704 - RNA, 13 nt, Shigella flexneri 2a str. 2457T
ugggcgaugcugg

SEQ ID NO: 3858705 - RNA, 19 nt, Shigella flexneri 2a str. 2457T
ugggcgaugcuggcagaag

SEQ ID NO: 3858706 - RNA, 17 nt, Shigella flexneri 2a str. 2457T
ugggcgcaccugaaucg

SEQ ID NO: 3858707 - RNA, 20 nt, Shigella flexneri 2a str. 2457T
ugggcggcauaucagcgagu

SEQ ID NO: 3858708 - RNA, 15 nt, Shigella flexneri 2a str. 2457T
ugggcguagcugggu

SEQ ID NO: 3858709 - RNA, 18 nt, Shigella flexneri 2a str. 2457T
ugggcguuacagcuggag

SEQ ID NO: 3858710 - RNA, 15 nt, Shigella flexneri 2a str. 2457T
ugggcuaacacccgu

SEQ ID NO: 3858711 - RNA, 16 nt, Shigella flexneri 2a str. 2457T
ugggcucaucaauacg

SEQ ID NO: 3858712 - RNA, 20 nt, Shigella flexneri 2a str. 2457T
ugggcugacauuaucagaca

SEQ ID NO: 3858713 - RNA, 14 nt, Shigella flexneri 2a str. 2457T
ugggcuucauccag

SEQ ID NO: 3858714 - RNA, 16 nt, Shigella flexneri 2a str. 2457T
ugggcuucauccagca

SEQ ID NO: 3858715 - RNA, 17 nt, Shigella flexneri 2a str. 2457T
ugggcuucauccagcag

SEQ ID NO: 3858716 - RNA, 16 nt, Shigella flexneri 2a str. 2457T
uggggaaaaacacaaa

SEQ ID NO: 3858717 - RNA, 22 nt, Shigella flexneri 2a str. 2457T
uggggaaugauauuuucugccg

SEQ ID NO: 3858718 - RNA, 19 nt, Shigella flexneri 2a str. 2457T
uggggacaaucaccaugcc

SEQ ID NO: 3858719 - RNA, 22 nt, Shigella flexneri 2a str. 2457T
uggggauagaaacagucuggag

SEQ ID NO: 3858720 - RNA, 12 nt, Shigella flexneri 2a str. 2457T
uggggcuggcgg

SEQ ID NO: 3858721 - RNA, 19 nt, Shigella flexneri 2a str. 2457T
uggggcuugccagagcagc

SEQ ID NO: 3858722 - RNA, 13 nt, Shigella flexneri 2a str. 2457T
uggguaacggcag

SEQ ID NO: 3858723 - RNA, 20 nt, Shigella flexneri 2a str. 2457T
uggguaauaacaauacaucu

SEQ ID NO: 3858724 - RNA, 14 nt, Shigella flexneri 2a str. 2457T
uggguacgaaaagg

SEQ ID NO: 3858725 - RNA, 14 nt, Shigella flexneri 2a str. 2457T
uguaaaccucuuuc

SEQ ID NO: 3858726 - RNA, 18 nt, Shigella flexneri 2a str. 2457T
uguaaacgaagcgccauu

SEQ ID NO: 3858727 - RNA, 21 nt, Shigella flexneri 2a str. 2457T
uguaaagucaucgcauacaaa

SEQ ID NO: 3858728 - RNA, 14 nt, Shigella flexneri 2a str. 2457T
uguaaaugaacuca

SEQ ID NO: 3858729 - RNA, 19 nt, Shigella flexneri 2a str. 2457T
uguaaauucucaauaucau

SEQ ID NO: 3858730 - RNA, 15 nt, Shigella flexneri 2a str. 2457T
uguaacauaccuaaa

SEQ ID NO: 3858731 - RNA, 16 nt, Shigella flexneri 2a str. 2457T
uguaacccaccaugcc

SEQ ID NO: 3858732 - RNA, 17 nt, Shigella flexneri 2a str. 2457T
uguaaccuucacccuca

SEQ ID NO: 3858733 - RNA, 17 nt, Shigella flexneri 2a str. 2457T
uguaacgccuuuuccag

SEQ ID NO: 3858734 - RNA, 19 nt, Shigella flexneri 2a str. 2457T
uguaacgccuuuuccagcg

SEQ ID NO: 3858735 - RNA, 18 nt, Shigella flexneri 2a str. 2457T
uguaagggcuaaucugaa

SEQ ID NO: 3858736 - RNA, 16 nt, Shigella flexneri 2a str. 2457T
uguaagguggcgucaa

SEQ ID NO: 3858737 - RNA, 23 nt, Shigella flexneri 2a str. 2457T
uguaaguaaugacaaaauugcug

SEQ ID NO: 3858738 - RNA, 17 nt, Shigella flexneri 2a str. 2457T
uguaaguggaugcccgg

SEQ ID NO: 3858739 - RNA, 17 nt, Shigella flexneri 2a str. 2457T
uguaauacgcucaucug

SEQ ID NO: 3858740 - RNA, 19 nt, Shigella flexneri 2a str. 2457T
uguaauacggcucucaccu

SEQ ID NO: 3858741 - RNA, 17 nt, Shigella flexneri 2a str. 2457T
uguaauaguguauuaau

SEQ ID NO: 3858742 - RNA, 15 nt, Shigella flexneri 2a str. 2457T
uguaaucauauuaaa

SEQ ID NO: 3858743 - RNA, 22 nt, Shigella flexneri 2a str. 2457T
uguaauuaaauuaucaacuauc

SEQ ID NO: 3858744 - RNA, 13 nt, Shigella flexneri 2a str. 2457T
uguaauuaccagc

SEQ ID NO: 3858745 - RNA, 15 nt, Shigella flexneri 2a str. 2457T
uguacaaaaaaugug

SEQ ID NO: 3858746 - RNA, 15 nt, Shigella flexneri 2a str. 2457T
uguacaaacccagcc

SEQ ID NO: 3858747 - RNA, 15 nt, Shigella flexneri 2a str. 2457T
uguacaacuuucucg

SEQ ID NO: 3858748 - RNA, 16 nt, Shigella flexneri 2a str. 2457T
uguacaggauauauuu

SEQ ID NO: 3858749 - RNA, 14 nt, Shigella flexneri 2a str. 2457T
uguacaugcugcuu

SEQ ID NO: 3858750 - RNA, 21 nt, Shigella flexneri 2a str. 2457T
uguaccaccagaaucgccagc

SEQ ID NO: 3858751 - RNA, 22 nt, Shigella flexneri 2a str. 2457T
uguaccuucacgcgcuccagga

SEQ ID NO: 3858752 - RNA, 16 nt, Shigella flexneri 2a str. 2457T
uguaccuucagcggca

SEQ ID NO: 3858753 - RNA, 15 nt, Shigella flexneri 2a str. 2457T
uguacgaaaacgggc

SEQ ID NO: 3858754 - RNA, 18 nt, Shigella flexneri 2a str. 2457T
uguacgucauccguggcg

SEQ ID NO: 3858755 - RNA, 15 nt, Shigella flexneri 2a str. 2457T
uguacuccagcagac

SEQ ID NO: 3858756 - RNA, 19 nt, Shigella flexneri 2a str. 2457T
uguacuccagcagaccagc

SEQ ID NO: 3858757 - RNA, 19 nt, Shigella flexneri 2a str. 2457T
uguacuggcaauagcggac

SEQ ID NO: 3858758 - RNA, 15 nt, Shigella flexneri 2a str. 2457T
uguacuguuucacug

SEQ ID NO: 3858759 - RNA, 13 nt, Shigella flexneri 2a str. 2457T
uguacuuuccagc

SEQ ID NO: 3858760 - RNA, 13 nt, Shigella flexneri 2a str. 2457T
uguagaaaaucuc

SEQ ID NO: 3858761 - RNA, 18 nt, Shigella flexneri 2a str. 2457T
uguagaccggauaaggaa

SEQ ID NO: 3858762 - RNA, 16 nt, Shigella flexneri 2a str. 2457T
uguagauauacugcac

SEQ ID NO: 3858763 - RNA, 18 nt, Shigella flexneri 2a str. 2457T
uguagccaauaaaugcca

SEQ ID NO: 3858764 - RNA, 17 nt, Shigella flexneri 2a str. 2457T
uguagcgcugcaaacca

SEQ ID NO: 3858765 - RNA, 18 nt, Shigella flexneri 2a str. 2457T
uguagcguuaccagcaaa

SEQ ID NO: 3858766 - RNA, 20 nt, Shigella flexneri 2a str. 2457T
uguaggacggauaaggcguu

SEQ ID NO: 3858767 - RNA, 19 nt, Shigella flexneri 2a str. 2457T
uguaggcaggauaaggcgu

SEQ ID NO: 3858768 - RNA, 14 nt, Shigella flexneri 2a str. 2457T
uguaggccagauaa

SEQ ID NO: 3858769 - RNA, 19 nt, Shigella flexneri 2a str. 2457T
uguaggccggauaaggcau

SEQ ID NO: 3858770 - RNA, 23 nt, Shigella flexneri 2a str. 2457T
uguaggccggauaaggcguucac

SEQ ID NO: 3858771 - RNA, 19 nt, Shigella flexneri 2a str. 2457T
uguaggccugauaagcgua

SEQ ID NO: 3858772 - RNA, 17 nt, Shigella flexneri 2a str. 2457T
uguaggccugauaagug

SEQ ID NO: 3858773 - RNA, 19 nt, Shigella flexneri 2a str. 2457T
uguaggcuggauaaggcgu

SEQ ID NO: 3858774 - RNA, 20 nt, Shigella flexneri 2a str. 2457T
uguaggucggauaaggcguu

SEQ ID NO: 3858775 - RNA, 23 nt, Shigella flexneri 2a str. 2457T
uguaguacccggccuguuuaucc

SEQ ID NO: 3858776 - RNA, 14 nt, Shigella flexneri 2a str. 2457T
uguaguuauccgca

SEQ ID NO: 3858777 - RNA, 16 nt, Shigella flexneri 2a str. 2457T
uguaguucuggccuuu

SEQ ID NO: 3858778 - RNA, 20 nt, Shigella flexneri 2a str. 2457T
uguauacgcgccacaucaga

SEQ ID NO: 3858779 - RNA, 13 nt, Shigella flexneri 2a str. 2457T
uguauacgcuggc

SEQ ID NO: 3858780 - RNA, 19 nt, Shigella flexneri 2a str. 2457T
uguauacgggcuuuuuaau

SEQ ID NO: 3858781 - RNA, 14 nt, Shigella flexneri 2a str. 2457T
uguauaucaaacca

SEQ ID NO: 3858782 - RNA, 21 nt, Shigella flexneri 2a str. 2457T
uguaucaacaauaaaaccagu

SEQ ID NO: 3858783 - RNA, 21 nt, Shigella flexneri 2a str. 2457T
uguaucgacgcgccagcaccg

SEQ ID NO: 3858784 - RNA, 19 nt, Shigella flexneri 2a str. 2457T
uguaucugcagauuaugcc

SEQ ID NO: 3858785 - RNA, 20 nt, Shigella flexneri 2a str. 2457T
uguaugaccuuuggcgagcc

SEQ ID NO: 3858786 - RNA, 16 nt, Shigella flexneri 2a str. 2457T
uguaugccucuuucag

SEQ ID NO: 3858787 - RNA, 14 nt, Shigella flexneri 2a str. 2457T
uguauuaacauuag

SEQ ID NO: 3858788 - RNA, 22 nt, Shigella flexneri 2a str. 2457T
uguauuaacauuaggcauuauc

SEQ ID NO: 3858789 - RNA, 22 nt, Shigella flexneri 2a str. 2457T
uguauuacagagguuuuaugau

SEQ ID NO: 3858790 - RNA, 13 nt, Shigella flexneri 2a str. 2457T
uguauucaugccc

SEQ ID NO: 3858791 - RNA, 18 nt, Shigella flexneri 2a str. 2457T
uguauuuauuuucaggau

SEQ ID NO: 3858792 - RNA, 22 nt, Shigella flexneri 2a str. 2457T
uguauuucuucauacuaccugg

SEQ ID NO: 3858793 - RNA, 15 nt, Shigella flexneri 2a str. 2457T
ugucaaaaucaaaau

SEQ ID NO: 3858794 - RNA, 20 nt, Shigella flexneri 2a str. 2457T
ugucaagauugauacgggga

SEQ ID NO: 3858795 - RNA, 14 nt, Shigella flexneri 2a str. 2457T
ugucaauaaucuga

SEQ ID NO: 3858796 - RNA, 21 nt, Shigella flexneri 2a str. 2457T
ugucaauacuuucacaaaaau

SEQ ID NO: 3858797 - RNA, 16 nt, Shigella flexneri 2a str. 2457T
ugucaccacccugccc

SEQ ID NO: 3858798 - RNA, 14 nt, Shigella flexneri 2a str. 2457T
ugucaccagccgau

SEQ ID NO: 3858799 - RNA, 22 nt, Shigella flexneri 2a str. 2457T
ugucaccauuggcauugguauc

SEQ ID NO: 3858800 - RNA, 23 nt, Shigella flexneri 2a str. 2457T
ugucaccgccaggugaaauccgg

SEQ ID NO: 3858801 - RNA, 17 nt, Shigella flexneri 2a str. 2457T
ugucacgucucaucagg

SEQ ID NO: 3858802 - RNA, 21 nt, Shigella flexneri 2a str. 2457T
ugucacuaugagguagccuga

SEQ ID NO: 3858803 - RNA, 17 nt, Shigella flexneri 2a str. 2457T
ugucacugacuauuucc

SEQ ID NO: 3858804 - RNA, 15 nt, Shigella flexneri 2a str. 2457T
ugucagaugcggcgu

SEQ ID NO: 3858805 - RNA, 18 nt, Shigella flexneri 2a str. 2457T
ugucagcaaccugcuuaa

SEQ ID NO: 3858806 - RNA, 16 nt, Shigella flexneri 2a str. 2457T
ugucagcacuuccagc

SEQ ID NO: 3858807 - RNA, 16 nt, Shigella flexneri 2a str. 2457T
ugucagcgugacuggc

SEQ ID NO: 3858808 - RNA, 18 nt, Shigella flexneri 2a str. 2457T
ugucagcgugacuggcag

SEQ ID NO: 3858809 - RNA, 16 nt, Shigella flexneri 2a str. 2457T
ugucagguaacaagcc

SEQ ID NO: 3858810 - RNA, 20 nt, Shigella flexneri 2a str. 2457T
ugucaguauaacuacugaug

SEQ ID NO: 3858811 - RNA, 22 nt, Shigella flexneri 2a str. 2457T
ugucaguauaacuacugauggc

SEQ ID NO: 3858812 - RNA, 23 nt, Shigella flexneri 2a str. 2457T
ugucagucaucacuuucagaccg

SEQ ID NO: 3858813 - RNA, 13 nt, Shigella flexneri 2a str. 2457T
ugucagugcgcga

SEQ ID NO: 3858814 - RNA, 16 nt, Shigella flexneri 2a str. 2457T
ugucaguggacgauaa

SEQ ID NO: 3858815 - RNA, 14 nt, Shigella flexneri 2a str. 2457T
ugucaguuggcugu

SEQ ID NO: 3858816 - RNA, 16 nt, Shigella flexneri 2a str. 2457T
ugucauaaaucagcgu

SEQ ID NO: 3858817 - RNA, 22 nt, Shigella flexneri 2a str. 2457T
ugucauaacacagguaacuuaa

SEQ ID NO: 3858818 - RNA, 19 nt, Shigella flexneri 2a str. 2457T
ugucauacgcguaaaacag

SEQ ID NO: 3858819 - RNA, 21 nt, Shigella flexneri 2a str. 2457T
ugucauauuugaguguauuua

SEQ ID NO: 3858820 - RNA, 20 nt, Shigella flexneri 2a str. 2457T
ugucaucgaauaaauugagc

SEQ ID NO: 3858821 - RNA, 16 nt, Shigella flexneri 2a str. 2457T
ugucaugacuacacua

SEQ ID NO: 3858822 - RNA, 21 nt, Shigella flexneri 2a str. 2457T
uguguacauccuaaaggcaaa

SEQ ID NO: 3858823 - RNA, 16 nt, Shigella flexneri 2a str. 2457T
uguguaggccagcgau

SEQ ID NO: 3858824 - RNA, 14 nt, Shigella flexneri 2a str. 2457T
ugugucuuauuggc

SEQ ID NO: 3858825 - RNA, 15 nt, Shigella flexneri 2a str. 2457T
ugugugccagguucg

SEQ ID NO: 3858826 - RNA, 17 nt, Shigella flexneri 2a str. 2457T
uguguuaaauauuuaaa

SEQ ID NO: 3858827 - RNA, 23 nt, Shigella flexneri 2a str. 2457T
uguguugaggaucacaaaacgaa

SEQ ID NO: 3858828 - RNA, 20 nt, Shigella flexneri 2a str. 2457T
uguguuuacgcguuuuucag

SEQ ID NO: 3858829 - RNA, 11 nt, Shigella flexneri 2a str. 2457T
uguguuuauaa

SEQ ID NO: 3858830 - RNA, 19 nt, Shigella flexneri 2a str. 2457T
uguuaaaacgcacgcuguc

SEQ ID NO: 3858831 - RNA, 17 nt, Shigella flexneri 2a str. 2457T
uguuaacagcaacauag

SEQ ID NO: 3858832 - RNA, 12 nt, Shigella flexneri 2a str. 2457T
uguuaaccaacg

SEQ ID NO: 3858833 - RNA, 21 nt, Shigella flexneri 2a str. 2457T
uguuaacggccgaagaagaag

SEQ ID NO: 3858834 - RNA, 15 nt, Shigella flexneri 2a str. 2457T
uguuaaggaaauccu

SEQ ID NO: 3858835 - RNA, 22 nt, Shigella flexneri 2a str. 2457T
uguuaaguuuaucccaauuauc

SEQ ID NO: 3858836 - RNA, 21 nt, Shigella flexneri 2a str. 2457T
uguuacgauagaauauuucua

SEQ ID NO: 3858837 - RNA, 21 nt, Shigella flexneri 2a str. 2457T
uguuacgcaaaaccucuucca

SEQ ID NO: 3858838 - RNA, 17 nt, Shigella flexneri 2a str. 2457T
uguuacggugcgcagcc

SEQ ID NO: 3858839 - RNA, 17 nt, Shigella flexneri 2a str. 2457T
uguuacuuauuucuaua

SEQ ID NO: 3858840 - RNA, 20 nt, Shigella flexneri 2a str. 2457T
uguuagaugugggcaaucuc

SEQ ID NO: 3858841 - RNA, 22 nt, Shigella flexneri 2a str. 2457T
uguuagaugugggcaaucucac

SEQ ID NO: 3858842 - RNA, 18 nt, Shigella flexneri 2a str. 2457T
uguuagcggcgacaauaa

SEQ ID NO: 3858843 - RNA, 22 nt, Shigella flexneri 2a str. 2457T
uguuauccaccgaaauaaucag

SEQ ID NO: 3858844 - RNA, 22 nt, Shigella flexneri 2a str. 2457T
uguuauccgacuuauucuucaa

SEQ ID NO: 3858845 - RNA, 14 nt, Shigella flexneri 2a str. 2457T
uguuaucguuugca

SEQ ID NO: 3858846 - RNA, 19 nt, Shigella flexneri 2a str. 2457T
uguuaucguuugcauuauc

SEQ ID NO: 3858847 - RNA, 19 nt, Shigella flexneri 2a str. 2457T
uguuauuaguguguauaua

SEQ ID NO: 3858848 - RNA, 13 nt, Shigella flexneri 2a str. 2457T
uguuauucagaau

SEQ ID NO: 3858849 - RNA, 15 nt, Shigella flexneri 2a str. 2457T
uguucaacaauucgu

SEQ ID NO: 3858850 - RNA, 16 nt, Shigella flexneri 2a str. 2457T
uguucacgccaucauc

SEQ ID NO: 3858851 - RNA, 22 nt, Shigella flexneri 2a str. 2457T
uguucacuuuugcugcaaaauu

SEQ ID NO: 3858852 - RNA, 17 nt, Shigella flexneri 2a str. 2457T
uguucagaaagcgccag

SEQ ID NO: 3858853 - RNA, 18 nt, Shigella flexneri 2a str. 2457T
uguucagauggccaauaa

SEQ ID NO: 3858854 - RNA, 13 nt, Shigella flexneri 2a str. 2457T
uguucagcaaaug

SEQ ID NO: 3858855 - RNA, 15 nt, Shigella flexneri 2a str. 2457T
uguucagccugacag

SEQ ID NO: 3858856 - RNA, 18 nt, Shigella flexneri 2a str. 2457T
uguucagccugacagcac

SEQ ID NO: 3858857 - RNA, 18 nt, Shigella flexneri 2a str. 2457T
uguucagcgggcagggca

SEQ ID NO: 3858858 - RNA, 15 nt, Shigella flexneri 2a str. 2457T
uguucagcugcgugc

SEQ ID NO: 3858859 - RNA, 17 nt, Shigella flexneri 2a str. 2457T
uguucauagugccugau

SEQ ID NO: 3858860 - RNA, 13 nt, Shigella flexneri 2a str. 2457T
uguucaucugcau

SEQ ID NO: 3858861 - RNA, 22 nt, Shigella flexneri 2a str. 2457T
uguucaucugcauuccggugua

SEQ ID NO: 3858862 - RNA, 16 nt, Shigella flexneri 2a str. 2457T
uguuccagcaaauccc

SEQ ID NO: 3858863 - RNA, 15 nt, Shigella flexneri 2a str. 2457T
uguuccaucuuuaug

SEQ ID NO: 3858864 - RNA, 15 nt, Shigella flexneri 2a str. 2457T
uguucccuucucagc

SEQ ID NO: 3858865 - RNA, 15 nt, Shigella flexneri 2a str. 2457T
uguuccgccagcgac

SEQ ID NO: 3858866 - RNA, 23 nt, Shigella flexneri 2a str. 2457T
uguuccgcuuguugcuaauuuag

SEQ ID NO: 3858867 - RNA, 13 nt, Shigella flexneri 2a str. 2457T
uguuccgucagcc

SEQ ID NO: 3858868 - RNA, 12 nt, Shigella flexneri 2a str. 2457T
uguuccucugcu

SEQ ID NO: 3858869 - RNA, 21 nt, Shigella flexneri 2a str. 2457T
uguucgcaaccuaaccaaaca

SEQ ID NO: 3858870 - RNA, 15 nt, Shigella flexneri 2a str. 2457T
uguucgcccugcagu

SEQ ID NO: 3858871 - RNA, 21 nt, Shigella flexneri 2a str. 2457T
uguucgcucuauucauugacu

SEQ ID NO: 3858872 - RNA, 16 nt, Shigella flexneri 2a str. 2457T
uguucguaccugaauu

SEQ ID NO: 3858873 - RNA, 22 nt, Shigella flexneri 2a str. 2457T
uguucguaccugaauuaauuua

SEQ ID NO: 3858874 - RNA, 16 nt, Shigella flexneri 2a str. 2457T
uguucuacgugcgcua

SEQ ID NO: 3858875 - RNA, 13 nt, Shigella flexneri 2a str. 2457T
uguucucccauag

SEQ ID NO: 3858876 - RNA, 15 nt, Shigella flexneri 2a str. 2457T
uguucucuucauuac

SEQ ID NO: 3858877 - RNA, 21 nt, Shigella flexneri 2a str. 2457T
uguucugauaguuaaaauuca

SEQ ID NO: 3858878 - RNA, 16 nt, Shigella flexneri 2a str. 2457T
uguucuggucacucuc

SEQ ID NO: 3858879 - RNA, 19 nt, Shigella flexneri 2a str. 2457T
uguucuggucacucucgac

SEQ ID NO: 3858880 - RNA, 18 nt, Shigella flexneri 2a str. 2457T
uguugaaaagccggaaug

SEQ ID NO: 3858881 - RNA, 14 nt, Shigella flexneri 2a str. 2457T
uguugauccaggag

SEQ ID NO: 3858882 - RNA, 21 nt, Shigella flexneri 2a str. 2457T
uguugauuucccgcacguugg

SEQ ID NO: 3858883 - RNA, 13 nt, Shigella flexneri 2a str. 2457T
uguugcaaacuga

SEQ ID NO: 3858884 - RNA, 23 nt, Shigella flexneri 2a str. 2457T
uguugcaagacgaugacauuauc

SEQ ID NO: 3858885 - RNA, 19 nt, Shigella flexneri 2a str. 2457T
uguugcaccaucaggcaua

SEQ ID NO: 3858886 - RNA, 16 nt, Shigella flexneri 2a str. 2457T
uguugcaggaacagaa

SEQ ID NO: 3858887 - RNA, 23 nt, Shigella flexneri 2a str. 2457T
uguugcauccggucagacaacuu

SEQ ID NO: 3858888 - RNA, 18 nt, Shigella flexneri 2a str. 2457T
uguugccacacgcccaac

SEQ ID NO: 3858889 - RNA, 22 nt, Shigella flexneri 2a str. 2457T
uguugcccagcgcaucaggcaa

SEQ ID NO: 3858890 - RNA, 17 nt, Shigella flexneri 2a str. 2457T
uguugcccaugcuucug

SEQ ID NO: 3858891 - RNA, 13 nt, Shigella flexneri 2a str. 2457T
uguugcuaauuua

SEQ ID NO: 3858892 - RNA, 17 nt, Shigella flexneri 2a str. 2457T
uguugcuauggggaaaa

SEQ ID NO: 3858893 - RNA, 14 nt, Shigella flexneri 2a str. 2457T
uguugcugaaauuc

SEQ ID NO: 3858894 - RNA, 22 nt, Shigella flexneri 2a str. 2457T
uguugcugccgacaaaugcagu

SEQ ID NO: 3858895 - RNA, 16 nt, Shigella flexneri 2a str. 2457T
uguuggaacccgcagc

SEQ ID NO: 3858896 - RNA, 14 nt, Shigella flexneri 2a str. 2457T
uguuggauccccug

SEQ ID NO: 3858897 - RNA, 15 nt, Shigella flexneri 2a str. 2457T
uguuggcaaaaaaau

SEQ ID NO: 3858898 - RNA, 20 nt, Shigella flexneri 2a str. 2457T
uguuggcaggccaaaaaaca

SEQ ID NO: 3858899 - RNA, 21 nt, Shigella flexneri 2a str. 2457T
uguugguaaccaaaucuccag

SEQ ID NO: 3858900 - RNA, 12 nt, Shigella flexneri 2a str. 2457T
uguuggugccag

SEQ ID NO: 3858901 - RNA, 16 nt, Shigella flexneri 2a str. 2457T
uguuguaagcuugaca

SEQ ID NO: 3858902 - RNA, 18 nt, Shigella flexneri 2a str. 2457T
uguuguagacaugguaaa

SEQ ID NO: 3858903 - RNA, 21 nt, Shigella flexneri 2a str. 2457T
uguuguauccuguuuuuaagu

SEQ ID NO: 3858904 - RNA, 12 nt, Shigella flexneri 2a str. 2457T
uguuuaaauauc

SEQ ID NO: 3858905 - RNA, 18 nt, Shigella flexneri 2a str. 2457T
uguuuaaggaaaaacgaa

SEQ ID NO: 3858906 - RNA, 19 nt, Shigella flexneri 2a str. 2457T
uguuuaauggcaaaaacuu

SEQ ID NO: 3858907 - RNA, 19 nt, Shigella flexneri 2a str. 2457T
uguuuaccggugccagcaa

SEQ ID NO: 3858908 - RNA, 16 nt, Shigella flexneri 2a str. 2457T
uguuuagccacaccga

SEQ ID NO: 3858909 - RNA, 18 nt, Shigella flexneri 2a str. 2457T
uguuuagguugaacccuu

SEQ ID NO: 3858910 - RNA, 14 nt, Shigella flexneri 2a str. 2457T
uguuuaucaggcca

SEQ ID NO: 3858911 - RNA, 16 nt, Shigella flexneri 2a str. 2457T
uguuucacccgccugu

SEQ ID NO: 3858912 - RNA, 17 nt, Shigella flexneri 2a str. 2457T
uguuuccagauuuugcu

SEQ ID NO: 3858913 - RNA, 16 nt, Shigella flexneri 2a str. 2457T
uguuuccauccggcaa

SEQ ID NO: 3858914 - RNA, 15 nt, Shigella flexneri 2a str. 2457T
uguuucgaucagcaa

SEQ ID NO: 3858915 - RNA, 14 nt, Shigella flexneri 2a str. 2457T
uguuucugguggaa

SEQ ID NO: 3858916 - RNA, 22 nt, Shigella flexneri 2a str. 2457T
uguuugaaccagauaucgcgga

SEQ ID NO: 3858917 - RNA, 14 nt, Shigella flexneri 2a str. 2457T
uguuugaaucaaca

SEQ ID NO: 3858918 - RNA, 16 nt, Shigella flexneri 2a str. 2457T
uguuugaaucaacaua

SEQ ID NO: 3858919 - RNA, 19 nt, Shigella flexneri 2a str. 2457T
uuaauaugcucaacaauaa

SEQ ID NO: 3858920 - RNA, 16 nt, Shigella flexneri 2a str. 2457T
uuaauauuaacuuaau

SEQ ID NO: 3858921 - RNA, 18 nt, Shigella flexneri 2a str. 2457T
uuaauauuaacuuaauaa

SEQ ID NO: 3858922 - RNA, 13 nt, Shigella flexneri 2a str. 2457T
uuaaucaccagcg

SEQ ID NO: 3858923 - RNA, 13 nt, Shigella flexneri 2a str. 2457T
uuaaucagugcaa

SEQ ID NO: 3858924 - RNA, 16 nt, Shigella flexneri 2a str. 2457T
uuaaucagugcaauca

SEQ ID NO: 3858925 - RNA, 16 nt, Shigella flexneri 2a str. 2457T
uuaaucaucaacuggc

SEQ ID NO: 3858926 - RNA, 13 nt, Shigella flexneri 2a str. 2457T
uuaaucaucaaug

SEQ ID NO: 3858927 - RNA, 19 nt, Shigella flexneri 2a str. 2457T
uuaaucaucaaugccagca

SEQ ID NO: 3858928 - RNA, 23 nt, Shigella flexneri 2a str. 2457T
uuaauccgcaaauaacguaaaaa

SEQ ID NO: 3858929 - RNA, 21 nt, Shigella flexneri 2a str. 2457T
uuaauccugaguuaagcaaaa

SEQ ID NO: 3858930 - RNA, 15 nt, Shigella flexneri 2a str. 2457T
uuaaucgagauaccu

SEQ ID NO: 3858931 - RNA, 19 nt, Shigella flexneri 2a str. 2457T
uuaaucguugucuuacuuu

SEQ ID NO: 3858932 - RNA, 23 nt, Shigella flexneri 2a str. 2457T
uuaaugaucgcgccgccgcccau

SEQ ID NO: 3858933 - RNA, 18 nt, Shigella flexneri 2a str. 2457T
uuaaugcaccaacaaaua

SEQ ID NO: 3858934 - RNA, 19 nt, Shigella flexneri 2a str. 2457T
uuaaugccacauuagauaa

SEQ ID NO: 3858935 - RNA, 17 nt, Shigella flexneri 2a str. 2457T
uuaaugcgcuuccugca

SEQ ID NO: 3858936 - RNA, 13 nt, Shigella flexneri 2a str. 2457T
uuaaugcgcuuuu

SEQ ID NO: 3858937 - RNA, 16 nt, Shigella flexneri 2a str. 2457T
uuaauggcaaaaacuu

SEQ ID NO: 3858938 - RNA, 20 nt, Shigella flexneri 2a str. 2457T
uuaauggcagauaauccaga

SEQ ID NO: 3858939 - RNA, 19 nt, Shigella flexneri 2a str. 2457T
uuaauggcgacauaaaaua

SEQ ID NO: 3858940 - RNA, 23 nt, Shigella flexneri 2a str. 2457T
uuaauggcgauuagaaacagaau

SEQ ID NO: 3858941 - RNA, 19 nt, Shigella flexneri 2a str. 2457T
uuaauggucugaaagguau

SEQ ID NO: 3858942 - RNA, 17 nt, Shigella flexneri 2a str. 2457T
uuaaugugucugaaagc

SEQ ID NO: 3858943 - RNA, 13 nt, Shigella flexneri 2a str. 2457T
uuaauuaaaaugg

SEQ ID NO: 3858944 - RNA, 20 nt, Shigella flexneri 2a str. 2457T
uuaauuacaccaaucauuca

SEQ ID NO: 3858945 - RNA, 18 nt, Shigella flexneri 2a str. 2457T
uuaauuacugagaacgca

SEQ ID NO: 3858946 - RNA, 16 nt, Shigella flexneri 2a str. 2457T
uuaauuauuaacaaaa

SEQ ID NO: 3858947 - RNA, 16 nt, Shigella flexneri 2a str. 2457T
uuaauucauacaucgc

SEQ ID NO: 3858948 - RNA, 23 nt, Shigella flexneri 2a str. 2457T
uuaauucugagagcaugaaauga

SEQ ID NO: 3858949 - RNA, 15 nt, Shigella flexneri 2a str. 2457T
uuaauucuuugagca

SEQ ID NO: 3858950 - RNA, 20 nt, Shigella flexneri 2a str. 2457T
uuaauugcccgaagccaauu

SEQ ID NO: 3858951 - RNA, 19 nt, Shigella flexneri 2a str. 2457T
uuaauugccguuaaaacua

SEQ ID NO: 3858952 - RNA, 19 nt, Shigella flexneri 2a str. 2457T
uuacaaaaagugcuuucug

SEQ ID NO: 3858953 - RNA, 17 nt, Shigella flexneri 2a str. 2457T
uuacaaaaccugcuuaa

SEQ ID NO: 3858954 - RNA, 18 nt, Shigella flexneri 2a str. 2457T
uuacaaaaccugcuuaac

SEQ ID NO: 3858955 - RNA, 16 nt, Shigella flexneri 2a str. 2457T
uuacaacguauugaaa

SEQ ID NO: 3858956 - RNA, 16 nt, Shigella flexneri 2a str. 2457T
uuacaagcaacuugca

SEQ ID NO: 3858957 - RNA, 22 nt, Shigella flexneri 2a str. 2457T
uuacaauuuacguuuuaaaccu

SEQ ID NO: 3858958 - RNA, 20 nt, Shigella flexneri 2a str. 2457T
uuacagcuggaguacggccu

SEQ ID NO: 3858959 - RNA, 21 nt, Shigella flexneri 2a str. 2457T
uuacaguagcuauaaaccugc

SEQ ID NO: 3858960 - RNA, 19 nt, Shigella flexneri 2a str. 2457T
uuacauaugcgcuggcagu

SEQ ID NO: 3858961 - RNA, 22 nt, Shigella flexneri 2a str. 2457T
uuacauaugcgcuggcaguuuc

SEQ ID NO: 3858962 - RNA, 11 nt, Shigella flexneri 2a str. 2457T
uuacaucauca

SEQ ID NO: 3858963 - RNA, 20 nt, Shigella flexneri 2a str. 2457T
uuacaucccuauagauuauu

SEQ ID NO: 3858964 - RNA, 21 nt, Shigella flexneri 2a str. 2457T
uuacaugcgcgacaaaaauua

SEQ ID NO: 3858965 - RNA, 22 nt, Shigella flexneri 2a str. 2457T
uuacauuaucgcgucuaaauuu

SEQ ID NO: 3858966 - RNA, 17 nt, Shigella flexneri 2a str. 2457T
uuacauuuuaauaauga

SEQ ID NO: 3858967 - RNA, 18 nt, Shigella flexneri 2a str. 2457T
uuaccaaauuggcaaaau

SEQ ID NO: 3858968 - RNA, 20 nt, Shigella flexneri 2a str. 2457T
uuaccaaauuggcaaaauuu

SEQ ID NO: 3858969 - RNA, 19 nt, Shigella flexneri 2a str. 2457T
uuaccacaccggcaauaau

SEQ ID NO: 3858970 - RNA, 18 nt, Shigella flexneri 2a str. 2457T
uuaccaccgucaaaaaaa

SEQ ID NO: 3858971 - RNA, 23 nt, Shigella flexneri 2a str. 2457T
uuaccaccuuacuuacacaucaa

SEQ ID NO: 3858972 - RNA, 22 nt, Shigella flexneri 2a str. 2457T
uuaccagcaaauugaggaucug

SEQ ID NO: 3858973 - RNA, 15 nt, Shigella flexneri 2a str. 2457T
uuaccagcccuaaua

SEQ ID NO: 3858974 - RNA, 22 nt, Shigella flexneri 2a str. 2457T
uuaccagcccuaauaaaccagu

SEQ ID NO: 3858975 - RNA, 16 nt, Shigella flexneri 2a str. 2457T
uuacccaaucccccac

SEQ ID NO: 3858976 - RNA, 13 nt, Shigella flexneri 2a str. 2457T
uuacccagauaau

SEQ ID NO: 3858977 - RNA, 21 nt, Shigella flexneri 2a str. 2457T
uuaccgauccccggauucaug

SEQ ID NO: 3858978 - RNA, 22 nt, Shigella flexneri 2a str. 2457T
uuaccgauccccggauucaugc

SEQ ID NO: 3858979 - RNA, 13 nt, Shigella flexneri 2a str. 2457T
uuaccgcaccacc

SEQ ID NO: 3858980 - RNA, 20 nt, Shigella flexneri 2a str. 2457T
uuaccgcaccaccagcagcu

SEQ ID NO: 3858981 - RNA, 13 nt, Shigella flexneri 2a str. 2457T
uuaccgcaucuua

SEQ ID NO: 3858982 - RNA, 21 nt, Shigella flexneri 2a str. 2457T
uuaccgcgccauguugccugg

SEQ ID NO: 3858983 - RNA, 17 nt, Shigella flexneri 2a str. 2457T
uuaccggugccagcaac

SEQ ID NO: 3858984 - RNA, 20 nt, Shigella flexneri 2a str. 2457T
uuaccguaaccauaaccaau

SEQ ID NO: 3858985 - RNA, 19 nt, Shigella flexneri 2a str. 2457T
uuaccuagcacuguaaacc

SEQ ID NO: 3858986 - RNA, 12 nt, Shigella flexneri 2a str. 2457T
uuaccucaccgg

SEQ ID NO: 3858987 - RNA, 16 nt, Shigella flexneri 2a str. 2457T
uuaccugagugcaggc

SEQ ID NO: 3858988 - RNA, 21 nt, Shigella flexneri 2a str. 2457T
uuaccuguggcguauucggca

SEQ ID NO: 3858989 - RNA, 18 nt, Shigella flexneri 2a str. 2457T
uuacgaauauaaauauuu

SEQ ID NO: 3858990 - RNA, 19 nt, Shigella flexneri 2a str. 2457T
uuacgaauauaaauauuuu

SEQ ID NO: 3858991 - RNA, 21 nt, Shigella flexneri 2a str. 2457T
uuacgaccuacaaucaauggu

SEQ ID NO: 3858992 - RNA, 19 nt, Shigella flexneri 2a str. 2457T
uuacgagugcgcucuucaa

SEQ ID NO: 3858993 - RNA, 20 nt, Shigella flexneri 2a str. 2457T
uuacgaucaagauugauccc

SEQ ID NO: 3858994 - RNA, 19 nt, Shigella flexneri 2a str. 2457T
uuacgauccaccaccgcaa

SEQ ID NO: 3858995 - RNA, 21 nt, Shigella flexneri 2a str. 2457T
uuacgcagcauuggguaaaau

SEQ ID NO: 3858996 - RNA, 23 nt, Shigella flexneri 2a str. 2457T
uuacgcauuaccccuuccugaac

SEQ ID NO: 3858997 - RNA, 20 nt, Shigella flexneri 2a str. 2457T
uuacgccccgguuucucuuc

SEQ ID NO: 3858998 - RNA, 16 nt, Shigella flexneri 2a str. 2457T
uuacgccgagcgccag

SEQ ID NO: 3858999 - RNA, 20 nt, Shigella flexneri 2a str. 2457T
uuacgccgcaucuggcauaa

SEQ ID NO: 3859000 - RNA, 17 nt, Shigella flexneri 2a str. 2457T
uuacgccugccagcucu

SEQ ID NO: 3859001 - RNA, 16 nt, Shigella flexneri 2a str. 2457T
uuacgcucaccaaaac

SEQ ID NO: 3859002 - RNA, 16 nt, Shigella flexneri 2a str. 2457T
uuacgcucuuccacgc

SEQ ID NO: 3859003 - RNA, 23 nt, Shigella flexneri 2a str. 2457T
uuacggagcaggcguuaaaacag

SEQ ID NO: 3859004 - RNA, 23 nt, Shigella flexneri 2a str. 2457T
uuacgggcgaaguucgccaucaa

SEQ ID NO: 3859005 - RNA, 17 nt, Shigella flexneri 2a str. 2457T
uuacguuuacgcaucug

SEQ ID NO: 3859006 - RNA, 17 nt, Shigella flexneri 2a str. 2457T
uuacguuuccgcuauca

SEQ ID NO: 3859007 - RNA, 21 nt, Shigella flexneri 2a str. 2457T
uuacucauccacugccuguca

SEQ ID NO: 3859008 - RNA, 21 nt, Shigella flexneri 2a str. 2457T
uuacucauuucuguauaauca

SEQ ID NO: 3859009 - RNA, 16 nt, Shigella flexneri 2a str. 2457T
uuacuccacuuccugc

SEQ ID NO: 3859010 - RNA, 11 nt, Shigella flexneri 2a str. 2457T
uuacuccagau

SEQ ID NO: 3859011 - RNA, 20 nt, Shigella flexneri 2a str. 2457T
uuacucccgugccagagcau

SEQ ID NO: 3859012 - RNA, 17 nt, Shigella flexneri 2a str. 2457T
uuacucucgccuuugca

SEQ ID NO: 3859013 - RNA, 13 nt, Shigella flexneri 2a str. 2457T
uuacucuuaucaa

SEQ ID NO: 3859014 - RNA, 20 nt, Shigella flexneri 2a str. 2457T
uuacugacuagaugugcagu

SEQ ID NO: 3859015 - RNA, 15 nt, Shigella flexneri 2a str. 2457T
uuauccggccuggau

SEQ ID NO: 3859016 - RNA, 12 nt, Shigella flexneri 2a str. 2457T
uuauccggugag

SEQ ID NO: 3859017 - RNA, 16 nt, Shigella flexneri 2a str. 2457T
uuauccguccuacgaa

SEQ ID NO: 3859018 - RNA, 14 nt, Shigella flexneri 2a str. 2457T
uuauccucuguaaa

SEQ ID NO: 3859019 - RNA, 19 nt, Shigella flexneri 2a str. 2457T
uuaucgacugccagaguca

SEQ ID NO: 3859020 - RNA, 20 nt, Shigella flexneri 2a str. 2457T
uuaucgcauuaucaaagaug

SEQ ID NO: 3859021 - RNA, 13 nt, Shigella flexneri 2a str. 2457T
uuaucgccuacca

SEQ ID NO: 3859022 - RNA, 19 nt, Shigella flexneri 2a str. 2457T
uuaucgcgauacaccagau

SEQ ID NO: 3859023 - RNA, 15 nt, Shigella flexneri 2a str. 2457T
uuaucgcgcaaaaaa

SEQ ID NO: 3859024 - RNA, 15 nt, Shigella flexneri 2a str. 2457T
uuaucgcgccaucaa

SEQ ID NO: 3859025 - RNA, 17 nt, Shigella flexneri 2a str. 2457T
uuaucgcgcugaauaau

SEQ ID NO: 3859026 - RNA, 19 nt, Shigella flexneri 2a str. 2457T
uuaucggcucgaucuggug

SEQ ID NO: 3859027 - RNA, 15 nt, Shigella flexneri 2a str. 2457T
uuaucucaacacacg

SEQ ID NO: 3859028 - RNA, 19 nt, Shigella flexneri 2a str. 2457T
uuaucucccuguaucccag

SEQ ID NO: 3859029 - RNA, 20 nt, Shigella flexneri 2a str. 2457T
uuaucucccuguaucccagu

SEQ ID NO: 3859030 - RNA, 16 nt, Shigella flexneri 2a str. 2457T
uuaucucuugccaggc

SEQ ID NO: 3859031 - RNA, 23 nt, Shigella flexneri 2a str. 2457T
uuaucugaucaauauagauauca

SEQ ID NO: 3859032 - RNA, 15 nt, Shigella flexneri 2a str. 2457T
uuaucugcaauuacu

SEQ ID NO: 3859033 - RNA, 22 nt, Shigella flexneri 2a str. 2457T
uuaucuggaauuccuuucccua

SEQ ID NO: 3859034 - RNA, 19 nt, Shigella flexneri 2a str. 2457T
uuaucuggaguuauagcug

SEQ ID NO: 3859035 - RNA, 17 nt, Shigella flexneri 2a str. 2457T
uuaucuggauccacgau

SEQ ID NO: 3859036 - RNA, 17 nt, Shigella flexneri 2a str. 2457T
uuaucuggcauuugcac

SEQ ID NO: 3859037 - RNA, 20 nt, Shigella flexneri 2a str. 2457T
uuaucuggccuacaaagggc

SEQ ID NO: 3859038 - RNA, 19 nt, Shigella flexneri 2a str. 2457T
uuaucuggccuacagauga

SEQ ID NO: 3859039 - RNA, 16 nt, Shigella flexneri 2a str. 2457T
uuaucuuacccuuccu

SEQ ID NO: 3859040 - RNA, 11 nt, Shigella flexneri 2a str. 2457T
uuaucuucaca

SEQ ID NO: 3859041 - RNA, 15 nt, Shigella flexneri 2a str. 2457T
uuaucuucccagccc

SEQ ID NO: 3859042 - RNA, 23 nt, Shigella flexneri 2a str. 2457T
uuaucuucgagauucuuaaaguc

SEQ ID NO: 3859043 - RNA, 17 nt, Shigella flexneri 2a str. 2457T
uuaucuucgcacuuacc

SEQ ID NO: 3859044 - RNA, 19 nt, Shigella flexneri 2a str. 2457T
uuaugaaauaucuucaaua

SEQ ID NO: 3859045 - RNA, 13 nt, Shigella flexneri 2a str. 2457T
uuaugaggaugca

SEQ ID NO: 3859046 - RNA, 14 nt, Shigella flexneri 2a str. 2457T
uuaugaucaucaag

SEQ ID NO: 3859047 - RNA, 16 nt, Shigella flexneri 2a str. 2457T
uuaugaucaucaaggc

SEQ ID NO: 3859048 - RNA, 22 nt, Shigella flexneri 2a str. 2457T
uuaugaugucaaaaucaaaaua

SEQ ID NO: 3859049 - RNA, 18 nt, Shigella flexneri 2a str. 2457T
uuaugcaauagcgccugc

SEQ ID NO: 3859050 - RNA, 21 nt, Shigella flexneri 2a str. 2457T
uuaugcacaccccgcgcagcu

SEQ ID NO: 3859051 - RNA, 21 nt, Shigella flexneri 2a str. 2457T
uuaugccauguucaucaagcu

SEQ ID NO: 3859052 - RNA, 22 nt, Shigella flexneri 2a str. 2457T
uuaugccgaucaucauccagca

SEQ ID NO: 3859053 - RNA, 14 nt, Shigella flexneri 2a str. 2457T
uuauggcuauaaca

SEQ ID NO: 3859054 - RNA, 18 nt, Shigella flexneri 2a str. 2457T
uuauggcucgccauccag

SEQ ID NO: 3859055 - RNA, 23 nt, Shigella flexneri 2a str. 2457T
uuauggguaugucacugaugaca

SEQ ID NO: 3859056 - RNA, 18 nt, Shigella flexneri 2a str. 2457T
uuaugguagugccgucag

SEQ ID NO: 3859057 - RNA, 22 nt, Shigella flexneri 2a str. 2457T
uuauguaacaacuggcggucau

SEQ ID NO: 3859058 - RNA, 23 nt, Shigella flexneri 2a str. 2457T
uuaugugcuucuaccaugaugau

SEQ ID NO: 3859059 - RNA, 13 nt, Shigella flexneri 2a str. 2457T
uuauuaaacagac

SEQ ID NO: 3859060 - RNA, 16 nt, Shigella flexneri 2a str. 2457T
uuauuaaauuuaauaa

SEQ ID NO: 3859061 - RNA, 19 nt, Shigella flexneri 2a str. 2457T
uuauuaagaauuuuauacu

SEQ ID NO: 3859062 - RNA, 14 nt, Shigella flexneri 2a str. 2457T
uuauuaauucuaaa

SEQ ID NO: 3859063 - RNA, 15 nt, Shigella flexneri 2a str. 2457T
uuauucagcagacca

SEQ ID NO: 3859064 - RNA, 21 nt, Shigella flexneri 2a str. 2457T
uuauucagcuggcagugcuau

SEQ ID NO: 3859065 - RNA, 14 nt, Shigella flexneri 2a str. 2457T
uuauucggucaggu

SEQ ID NO: 3859066 - RNA, 12 nt, Shigella flexneri 2a str. 2457T
uuauugauaacc

SEQ ID NO: 3859067 - RNA, 15 nt, Shigella flexneri 2a str. 2457T
uuauugauuaaagga

SEQ ID NO: 3859068 - RNA, 16 nt, Shigella flexneri 2a str. 2457T
uuauuggugagaacua

SEQ ID NO: 3859069 - RNA, 16 nt, Shigella flexneri 2a str. 2457T
uuauuguuugucauga

SEQ ID NO: 3859070 - RNA, 16 nt, Shigella flexneri 2a str. 2457T
uuauuuacucuccugc

SEQ ID NO: 3859071 - RNA, 23 nt, Shigella flexneri 2a str. 2457T
uuauuuacuugggaaaacagcgc

SEQ ID NO: 3859072 - RNA, 23 nt, Shigella flexneri 2a str. 2457T
uuauuucaacagauuacauuaaa

SEQ ID NO: 3859073 - RNA, 14 nt, Shigella flexneri 2a str. 2457T
uuauuucauguuug

SEQ ID NO: 3859074 - RNA, 12 nt, Shigella flexneri 2a str. 2457T
uuauuucgcugc

SEQ ID NO: 3859075 - RNA, 11 nt, Shigella flexneri 2a str. 2457T
uuauuuuaaau

SEQ ID NO: 3859076 - RNA, 17 nt, Shigella flexneri 2a str. 2457T
uucaaaaaccugaccua

SEQ ID NO: 3859077 - RNA, 20 nt, Shigella flexneri 2a str. 2457T
uucaaaaauaaguugccacg

SEQ ID NO: 3859078 - RNA, 21 nt, Shigella flexneri 2a str. 2457T
uucaaaagccccggaauucuc

SEQ ID NO: 3859079 - RNA, 23 nt, Shigella flexneri 2a str. 2457T
uucaaacacccgaccaucaacua

SEQ ID NO: 3859080 - RNA, 21 nt, Shigella flexneri 2a str. 2457T
uucaaacgcugacggugccag

SEQ ID NO: 3859081 - RNA, 19 nt, Shigella flexneri 2a str. 2457T
uucaaacgugaacagcuuc

SEQ ID NO: 3859082 - RNA, 12 nt, Shigella flexneri 2a str. 2457T
uucaaagcgauu

SEQ ID NO: 3859083 - RNA, 17 nt, Shigella flexneri 2a str. 2457T
uucaaagguaaugguca

SEQ ID NO: 3859084 - RNA, 20 nt, Shigella flexneri 2a str. 2457T
uucaaaguaauauucaacgu

SEQ ID NO: 3859085 - RNA, 23 nt, Shigella flexneri 2a str. 2457T
uucaaagugauauccaccgcguu

SEQ ID NO: 3859086 - RNA, 21 nt, Shigella flexneri 2a str. 2457T
uucaaaguucugugucuuauu

SEQ ID NO: 3859087 - RNA, 18 nt, Shigella flexneri 2a str. 2457T
uucaaaucauuacaguuu

SEQ ID NO: 3859088 - RNA, 17 nt, Shigella flexneri 2a str. 2457T
uucaaauccuucagacu

SEQ ID NO: 3859089 - RNA, 15 nt, Shigella flexneri 2a str. 2457T
uucaaauuacgaucc

SEQ ID NO: 3859090 - RNA, 19 nt, Shigella flexneri 2a str. 2457T
uucaacaauugaagaauau

SEQ ID NO: 3859091 - RNA, 12 nt, Shigella flexneri 2a str. 2457T
uucaacacuggc

SEQ ID NO: 3859092 - RNA, 16 nt, Shigella flexneri 2a str. 2457T
uucaacagauuucgaa

SEQ ID NO: 3859093 - RNA, 15 nt, Shigella flexneri 2a str. 2457T
uucaacagcggcauu

SEQ ID NO: 3859094 - RNA, 21 nt, Shigella flexneri 2a str. 2457T
uucaacagguuaacucccccu

SEQ ID NO: 3859095 - RNA, 23 nt, Shigella flexneri 2a str. 2457T
uucaacagguuuuguugcccagc

SEQ ID NO: 3859096 - RNA, 16 nt, Shigella flexneri 2a str. 2457T
uucaacaguaaacucg

SEQ ID NO: 3859097 - RNA, 15 nt, Shigella flexneri 2a str. 2457T
uucaacagucgccac

SEQ ID NO: 3859098 - RNA, 18 nt, Shigella flexneri 2a str. 2457T
uucaacaucaucucccac

SEQ ID NO: 3859099 - RNA, 17 nt, Shigella flexneri 2a str. 2457T
uucaaccauucgcgcac

SEQ ID NO: 3859100 - RNA, 23 nt, Shigella flexneri 2a str. 2457T
uucaacgacccagccagacgcca

SEQ ID NO: 3859101 - RNA, 21 nt, Shigella flexneri 2a str. 2457T
uucaacgccgcuaucagauuc

SEQ ID NO: 3859102 - RNA, 23 nt, Shigella flexneri 2a str. 2457T
uucaacggacgauuugccgucuc

SEQ ID NO: 3859103 - RNA, 15 nt, Shigella flexneri 2a str. 2457T
uucaacggcggcuug

SEQ ID NO: 3859104 - RNA, 22 nt, Shigella flexneri 2a str. 2457T
uucaacgguaaguugacgagau

SEQ ID NO: 3859105 - RNA, 14 nt, Shigella flexneri 2a str. 2457T
uucaacuggauaaa

SEQ ID NO: 3859106 - RNA, 18 nt, Shigella flexneri 2a str. 2457T
uucaacuggauaaaauua

SEQ ID NO: 3859107 - RNA, 13 nt, Shigella flexneri 2a str. 2457T
uucaacuucagca

SEQ ID NO: 3859108 - RNA, 18 nt, Shigella flexneri 2a str. 2457T
uucaagaauuaaaauauc

SEQ ID NO: 3859109 - RNA, 21 nt, Shigella flexneri 2a str. 2457T
uucaagacaucaauaaacaau

SEQ ID NO: 3859110 - RNA, 23 nt, Shigella flexneri 2a str. 2457T
uucaagacgaauaccuucuuccu

SEQ ID NO: 3859111 - RNA, 17 nt, Shigella flexneri 2a str. 2457T
uucaagacgccguccau

SEQ ID NO: 3859112 - RNA, 17 nt, Shigella flexneri 2a str. 2457T
uucagcuuauucaucaa

SEQ ID NO: 3859113 - RNA, 20 nt, Shigella flexneri 2a str. 2457T
uucagcuuuuuagcgaucuc

SEQ ID NO: 3859114 - RNA, 16 nt, Shigella flexneri 2a str. 2457T
uucaggaaauaaauaa

SEQ ID NO: 3859115 - RNA, 16 nt, Shigella flexneri 2a str. 2457T
uucaggaacaccgcac

SEQ ID NO: 3859116 - RNA, 16 nt, Shigella flexneri 2a str. 2457T
uucaggaauucagaaa

SEQ ID NO: 3859117 - RNA, 19 nt, Shigella flexneri 2a str. 2457T
uucaggaauucagaaaaau

SEQ ID NO: 3859118 - RNA, 20 nt, Shigella flexneri 2a str. 2457T
uucaggagaagcaucagccc

SEQ ID NO: 3859119 - RNA, 21 nt, Shigella flexneri 2a str. 2457T
uucaggauauuuauauuuugc

SEQ ID NO: 3859120 - RNA, 13 nt, Shigella flexneri 2a str. 2457T
uucaggaugguau

SEQ ID NO: 3859121 - RNA, 23 nt, Shigella flexneri 2a str. 2457T
uucaggauggucaacgucaacuu

SEQ ID NO: 3859122 - RNA, 13 nt, Shigella flexneri 2a str. 2457T
uucaggcgcugaa

SEQ ID NO: 3859123 - RNA, 16 nt, Shigella flexneri 2a str. 2457T
uucagguuguuuucug

SEQ ID NO: 3859124 - RNA, 18 nt, Shigella flexneri 2a str. 2457T
uucaguacgaaauaacug

SEQ ID NO: 3859125 - RNA, 21 nt, Shigella flexneri 2a str. 2457T
uucaguacguucacgcagcuc

SEQ ID NO: 3859126 - RNA, 22 nt, Shigella flexneri 2a str. 2457T
uucaguauagcggggaacauca

SEQ ID NO: 3859127 - RNA, 15 nt, Shigella flexneri 2a str. 2457T
uucaguaugguauua

SEQ ID NO: 3859128 - RNA, 13 nt, Shigella flexneri 2a str. 2457T
uucagugccaggu

SEQ ID NO: 3859129 - RNA, 17 nt, Shigella flexneri 2a str. 2457T
uucagugccucguucac

SEQ ID NO: 3859130 - RNA, 19 nt, Shigella flexneri 2a str. 2457T
uucaguggcuuaucuuccu

SEQ ID NO: 3859131 - RNA, 18 nt, Shigella flexneri 2a str. 2457T
uucaguggguuaugaaac

SEQ ID NO: 3859132 - RNA, 23 nt, Shigella flexneri 2a str. 2457T
uucaguguccagcggcauaaaac

SEQ ID NO: 3859133 - RNA, 10 nt, Shigella flexneri 2a str. 2457T
uucaguuccg

SEQ ID NO: 3859134 - RNA, 19 nt, Shigella flexneri 2a str. 2457T
uucaguuugccgcucaguu

SEQ ID NO: 3859135 - RNA, 14 nt, Shigella flexneri 2a str. 2457T
uucaguuuuacucu

SEQ ID NO: 3859136 - RNA, 16 nt, Shigella flexneri 2a str. 2457T
uucauaaggaaaauaa

SEQ ID NO: 3859137 - RNA, 13 nt, Shigella flexneri 2a str. 2457T
uucauacagcgga

SEQ ID NO: 3859138 - RNA, 13 nt, Shigella flexneri 2a str. 2457T
uucauaucugcca

SEQ ID NO: 3859139 - RNA, 20 nt, Shigella flexneri 2a str. 2457T
uucauaugcgccagcugcau

SEQ ID NO: 3859140 - RNA, 12 nt, Shigella flexneri 2a str. 2457T
uucauauugccg

SEQ ID NO: 3859141 - RNA, 20 nt, Shigella flexneri 2a str. 2457T
uucauauuuuacauccggca

SEQ ID NO: 3859142 - RNA, 13 nt, Shigella flexneri 2a str. 2457T
uucaucaaaaaau

SEQ ID NO: 3859143 - RNA, 22 nt, Shigella flexneri 2a str. 2457T
uucaucaagaaaacgaauacug

SEQ ID NO: 3859144 - RNA, 14 nt, Shigella flexneri 2a str. 2457T
uucaucaccagcuc

SEQ ID NO: 3859145 - RNA, 20 nt, Shigella flexneri 2a str. 2457T
uucaucacuaccuucuuccc

SEQ ID NO: 3859146 - RNA, 23 nt, Shigella flexneri 2a str. 2457T
uucaucacugaauuucgccgcac

SEQ ID NO: 3859147 - RNA, 11 nt, Shigella flexneri 2a str. 2457T
uucauccagca

SEQ ID NO: 3859148 - RNA, 13 nt, Shigella flexneri 2a str. 2457T
uucauccagcagu

SEQ ID NO: 3859149 - RNA, 12 nt, Shigella flexneri 2a str. 2457T
uucauccagcau

SEQ ID NO: 3859150 - RNA, 18 nt, Shigella flexneri 2a str. 2457T
uucaucccgaccaaugca

SEQ ID NO: 3859151 - RNA, 20 nt, Shigella flexneri 2a str. 2457T
uucaucccgguuauuaaaac

SEQ ID NO: 3859152 - RNA, 16 nt, Shigella flexneri 2a str. 2457T
uucauccgauccucac

SEQ ID NO: 3859153 - RNA, 16 nt, Shigella flexneri 2a str. 2457T
uucauccguuucucug

SEQ ID NO: 3859154 - RNA, 17 nt, Shigella flexneri 2a str. 2457T
uucauccuggcacagca

SEQ ID NO: 3859155 - RNA, 22 nt, Shigella flexneri 2a str. 2457T
uucauccuguacgacaaaagaa

SEQ ID NO: 3859156 - RNA, 23 nt, Shigella flexneri 2a str. 2457T
uucauccuguacgacaaaagaau

SEQ ID NO: 3859157 - RNA, 16 nt, Shigella flexneri 2a str. 2457T
uucaucgcacgagaaa

SEQ ID NO: 3859158 - RNA, 20 nt, Shigella flexneri 2a str. 2457T
uucaucgcacgagaaaaaau

SEQ ID NO: 3859159 - RNA, 21 nt, Shigella flexneri 2a str. 2457T
uucaucgcaucgaugguugcc

SEQ ID NO: 3859160 - RNA, 19 nt, Shigella flexneri 2a str. 2457T
uucaucgccuucuugaacc

SEQ ID NO: 3859161 - RNA, 15 nt, Shigella flexneri 2a str. 2457T
uucaucgcuaaaaua

SEQ ID NO: 3859162 - RNA, 17 nt, Shigella flexneri 2a str. 2457T
uucaucgcuaaaauacu

SEQ ID NO: 3859163 - RNA, 22 nt, Shigella flexneri 2a str. 2457T
uucaucggauacgccacucuga

SEQ ID NO: 3859164 - RNA, 18 nt, Shigella flexneri 2a str. 2457T
uucaucucuucacgcuuu

SEQ ID NO: 3859165 - RNA, 16 nt, Shigella flexneri 2a str. 2457T
uucaucugauagcuuu

SEQ ID NO: 3859166 - RNA, 11 nt, Shigella flexneri 2a str. 2457T
uucaucugccu

SEQ ID NO: 3859167 - RNA, 13 nt, Shigella flexneri 2a str. 2457T
uucaucuucaguc

SEQ ID NO: 3859168 - RNA, 20 nt, Shigella flexneri 2a str. 2457T
uucaucuuuccaaaccucag

SEQ ID NO: 3859169 - RNA, 19 nt, Shigella flexneri 2a str. 2457T
uucaugaucuuuuuugucg

SEQ ID NO: 3859170 - RNA, 20 nt, Shigella flexneri 2a str. 2457T
uucaugauuuaaaugaagau

SEQ ID NO: 3859171 - RNA, 16 nt, Shigella flexneri 2a str. 2457T
uucaugccauccgcau

SEQ ID NO: 3859172 - RNA, 20 nt, Shigella flexneri 2a str. 2457T
uucaugccuguauugguuuc

SEQ ID NO: 3859173 - RNA, 16 nt, Shigella flexneri 2a str. 2457T
uucaugcgaauacacc

SEQ ID NO: 3859174 - RNA, 14 nt, Shigella flexneri 2a str. 2457T
uucaugcuauuccu

SEQ ID NO: 3859175 - RNA, 20 nt, Shigella flexneri 2a str. 2457T
uucaugcuuaaucaucgacu

SEQ ID NO: 3859176 - RNA, 14 nt, Shigella flexneri 2a str. 2457T
uucauggugcaaga

SEQ ID NO: 3859177 - RNA, 20 nt, Shigella flexneri 2a str. 2457T
uucauguucagauuguugau

SEQ ID NO: 3859178 - RNA, 20 nt, Shigella flexneri 2a str. 2457T
uucauuaagaacuccugaaa

SEQ ID NO: 3859179 - RNA, 13 nt, Shigella flexneri 2a str. 2457T
uucauuaauauca

SEQ ID NO: 3859180 - RNA, 16 nt, Shigella flexneri 2a str. 2457T
uucauuacaccaauac

SEQ ID NO: 3859181 - RNA, 19 nt, Shigella flexneri 2a str. 2457T
uucauuaguuuggccaaua

SEQ ID NO: 3859182 - RNA, 18 nt, Shigella flexneri 2a str. 2457T
uucauucaauuaauaaca

SEQ ID NO: 3859183 - RNA, 15 nt, Shigella flexneri 2a str. 2457T
uucauucaggccaaa

SEQ ID NO: 3859184 - RNA, 12 nt, Shigella flexneri 2a str. 2457T
uucauuccuuga

SEQ ID NO: 3859185 - RNA, 23 nt, Shigella flexneri 2a str. 2457T
uucauugaacgggugauuucccc

SEQ ID NO: 3859186 - RNA, 17 nt, Shigella flexneri 2a str. 2457T
uucauugaaugcggcag

SEQ ID NO: 3859187 - RNA, 21 nt, Shigella flexneri 2a str. 2457T
uucauugagcgcaaaugguga

SEQ ID NO: 3859188 - RNA, 15 nt, Shigella flexneri 2a str. 2457T
uucauuguucuccca

SEQ ID NO: 3859189 - RNA, 12 nt, Shigella flexneri 2a str. 2457T
uucauuguugac

SEQ ID NO: 3859190 - RNA, 18 nt, Shigella flexneri 2a str. 2457T
uucauuucaauaaauucc

SEQ ID NO: 3859191 - RNA, 19 nt, Shigella flexneri 2a str. 2457T
uucauuucacgcugacggc

SEQ ID NO: 3859192 - RNA, 21 nt, Shigella flexneri 2a str. 2457T
uucauuugccagcuucagcgc

SEQ ID NO: 3859193 - RNA, 17 nt, Shigella flexneri 2a str. 2457T
uuccacauaaaguagcc

SEQ ID NO: 3859194 - RNA, 19 nt, Shigella flexneri 2a str. 2457T
uuccaccaccacagacaau

SEQ ID NO: 3859195 - RNA, 20 nt, Shigella flexneri 2a str. 2457T
uuccaccagcggcugaauau

SEQ ID NO: 3859196 - RNA, 12 nt, Shigella flexneri 2a str. 2457T
uuccaccgccgg

SEQ ID NO: 3859197 - RNA, 13 nt, Shigella flexneri 2a str. 2457T
uuccaccgcuauu

SEQ ID NO: 3859198 - RNA, 14 nt, Shigella flexneri 2a str. 2457T
uuccaccucccccu

SEQ ID NO: 3859199 - RNA, 23 nt, Shigella flexneri 2a str. 2457T
uuccacgccguuuuuacccagca

SEQ ID NO: 3859200 - RNA, 18 nt, Shigella flexneri 2a str. 2457T
uuccacggaauauuucac

SEQ ID NO: 3859201 - RNA, 19 nt, Shigella flexneri 2a str. 2457T
uuccacucauuaauuuccu

SEQ ID NO: 3859202 - RNA, 15 nt, Shigella flexneri 2a str. 2457T
uuccacuucacggcu

SEQ ID NO: 3859203 - RNA, 13 nt, Shigella flexneri 2a str. 2457T
uuccacuucauca

SEQ ID NO: 3859204 - RNA, 17 nt, Shigella flexneri 2a str. 2457T
uuccagaaaagagacgc

SEQ ID NO: 3859205 - RNA, 15 nt, Shigella flexneri 2a str. 2457T
uuccagaauaucuuc

SEQ ID NO: 3859206 - RNA, 19 nt, Shigella flexneri 2a str. 2457T
uuccagacucaacaggccc

SEQ ID NO: 3859207 - RNA, 13 nt, Shigella flexneri 2a str. 2457T
uuccagauggaca

SEQ ID NO: 3859208 - RNA, 15 nt, Shigella flexneri 2a str. 2457T
uuccagcaagccacu

SEQ ID NO: 3859209 - RNA, 13 nt, Shigella flexneri 2a str. 2457T
uuccagcacaccc

SEQ ID NO: 3859210 - RNA, 18 nt, Shigella flexneri 2a str. 2457T
uuccugccagauuugcug

SEQ ID NO: 3859211 - RNA, 14 nt, Shigella flexneri 2a str. 2457T
uuccugcgucgcua

SEQ ID NO: 3859212 - RNA, 15 nt, Shigella flexneri 2a str. 2457T
uuccugcugcaucug

SEQ ID NO: 3859213 - RNA, 23 nt, Shigella flexneri 2a str. 2457T
uuccuggggaaaaugggcaucag

SEQ ID NO: 3859214 - RNA, 14 nt, Shigella flexneri 2a str. 2457T
uuccuuaaaaguga

SEQ ID NO: 3859215 - RNA, 15 nt, Shigella flexneri 2a str. 2457T
uuccuuaacauccau

SEQ ID NO: 3859216 - RNA, 17 nt, Shigella flexneri 2a str. 2457T
uuccuuaacauccaucg

SEQ ID NO: 3859217 - RNA, 13 nt, Shigella flexneri 2a str. 2457T
uuccuucaacccg

SEQ ID NO: 3859218 - RNA, 18 nt, Shigella flexneri 2a str. 2457T
uuccuucacgugacaaaa

SEQ ID NO: 3859219 - RNA, 20 nt, Shigella flexneri 2a str. 2457T
uuccuucgcuuccuguauau

SEQ ID NO: 3859220 - RNA, 16 nt, Shigella flexneri 2a str. 2457T
uuccuuggauauuuua

SEQ ID NO: 3859221 - RNA, 17 nt, Shigella flexneri 2a str. 2457T
uuccuuguuuaaggaaa

SEQ ID NO: 3859222 - RNA, 17 nt, Shigella flexneri 2a str. 2457T
uuccuuucccuauuuuu

SEQ ID NO: 3859223 - RNA, 14 nt, Shigella flexneri 2a str. 2457T
uucgaaaaucucau

SEQ ID NO: 3859224 - RNA, 20 nt, Shigella flexneri 2a str. 2457T
uucgaaaauggccucggcua

SEQ ID NO: 3859225 - RNA, 13 nt, Shigella flexneri 2a str. 2457T
uucgaacauuucg

SEQ ID NO: 3859226 - RNA, 11 nt, Shigella flexneri 2a str. 2457T
uucgaacugga

SEQ ID NO: 3859227 - RNA, 16 nt, Shigella flexneri 2a str. 2457T
uucgaagaaaccgaug

SEQ ID NO: 3859228 - RNA, 15 nt, Shigella flexneri 2a str. 2457T
uucgaauccuucccc

SEQ ID NO: 3859229 - RNA, 20 nt, Shigella flexneri 2a str. 2457T
uucgacgacaacgcggcaca

SEQ ID NO: 3859230 - RNA, 12 nt, Shigella flexneri 2a str. 2457T
uucgacuucauc

SEQ ID NO: 3859231 - RNA, 13 nt, Shigella flexneri 2a str. 2457T
uucgacuuuaccg

SEQ ID NO: 3859232 - RNA, 16 nt, Shigella flexneri 2a str. 2457T
uucgagcaauuuuccu

SEQ ID NO: 3859233 - RNA, 22 nt, Shigella flexneri 2a str. 2457T
uucgagcaucacaucaaauccc

SEQ ID NO: 3859234 - RNA, 18 nt, Shigella flexneri 2a str. 2457T
uucgagcuggaagccaca

SEQ ID NO: 3859235 - RNA, 17 nt, Shigella flexneri 2a str. 2457T
uucgaggcgaugggcgu

SEQ ID NO: 3859236 - RNA, 22 nt, Shigella flexneri 2a str. 2457T
uucgagucauauucugaaauau

SEQ ID NO: 3859237 - RNA, 17 nt, Shigella flexneri 2a str. 2457T
uucgauaaacucaauca

SEQ ID NO: 3859238 - RNA, 20 nt, Shigella flexneri 2a str. 2457T
uucgauagacucccagccuc

SEQ ID NO: 3859239 - RNA, 14 nt, Shigella flexneri 2a str. 2457T
uucgaugagagcgg

SEQ ID NO: 3859240 - RNA, 19 nt, Shigella flexneri 2a str. 2457T
uucgaugaugccggaauca

SEQ ID NO: 3859241 - RNA, 23 nt, Shigella flexneri 2a str. 2457T
uucgaugaugccggaaucaacca

SEQ ID NO: 3859242 - RNA, 19 nt, Shigella flexneri 2a str. 2457T
uucgcaaaaaaccaucccu

SEQ ID NO: 3859243 - RNA, 20 nt, Shigella flexneri 2a str. 2457T
uucgcacgaaccguaaaagc

SEQ ID NO: 3859244 - RNA, 20 nt, Shigella flexneri 2a str. 2457T
uucgccaaaucgcugcugcu

SEQ ID NO: 3859245 - RNA, 16 nt, Shigella flexneri 2a str. 2457T
uucgccaggacagaga

SEQ ID NO: 3859246 - RNA, 19 nt, Shigella flexneri 2a str. 2457T
uucgccaggucagagagcc

SEQ ID NO: 3859247 - RNA, 13 nt, Shigella flexneri 2a str. 2457T
uucgccaguuuuu

SEQ ID NO: 3859248 - RNA, 15 nt, Shigella flexneri 2a str. 2457T
uucgcccgccagcgu

SEQ ID NO: 3859249 - RNA, 13 nt, Shigella flexneri 2a str. 2457T
uucgcccgucgug

SEQ ID NO: 3859250 - RNA, 16 nt, Shigella flexneri 2a str. 2457T
uucgccgcacgcucaa

SEQ ID NO: 3859251 - RNA, 23 nt, Shigella flexneri 2a str. 2457T
uucgccgcugcgaucgcaaaucc

SEQ ID NO: 3859252 - RNA, 14 nt, Shigella flexneri 2a str. 2457T
uucgccgguuccag

SEQ ID NO: 3859253 - RNA, 16 nt, Shigella flexneri 2a str. 2457T
uucgccgguuccagcu

SEQ ID NO: 3859254 - RNA, 14 nt, Shigella flexneri 2a str. 2457T
uucgccguuuucuu

SEQ ID NO: 3859255 - RNA, 15 nt, Shigella flexneri 2a str. 2457T
uucgcgaaucgccac

SEQ ID NO: 3859256 - RNA, 13 nt, Shigella flexneri 2a str. 2457T
uucgcgaccgccu

SEQ ID NO: 3859257 - RNA, 16 nt, Shigella flexneri 2a str. 2457T
uucgcgccaauccaga

SEQ ID NO: 3859258 - RNA, 13 nt, Shigella flexneri 2a str. 2457T
uucgcgcgggcag

SEQ ID NO: 3859259 - RNA, 15 nt, Shigella flexneri 2a str. 2457T
uucgcguacugcuga

SEQ ID NO: 3859260 - RNA, 17 nt, Shigella flexneri 2a str. 2457T
uucgcguaguaaagccu

SEQ ID NO: 3859261 - RNA, 18 nt, Shigella flexneri 2a str. 2457T
uucgcguaguaaagccuu

SEQ ID NO: 3859262 - RNA, 19 nt, Shigella flexneri 2a str. 2457T
uucgcuaacguuuuuaaaa

SEQ ID NO: 3859263 - RNA, 15 nt, Shigella flexneri 2a str. 2457T
uucgcuaccuuucag

SEQ ID NO: 3859264 - RNA, 20 nt, Shigella flexneri 2a str. 2457T
uucgcuacgaucgauaacca

SEQ ID NO: 3859265 - RNA, 21 nt, Shigella flexneri 2a str. 2457T
uucgcuccccugcaaauuauu

SEQ ID NO: 3859266 - RNA, 17 nt, Shigella flexneri 2a str. 2457T
uucgcugaaaggcgauu

SEQ ID NO: 3859267 - RNA, 17 nt, Shigella flexneri 2a str. 2457T
uucgcugaauaccgauu

SEQ ID NO: 3859268 - RNA, 14 nt, Shigella flexneri 2a str. 2457T
uucgcugccacacc

SEQ ID NO: 3859269 - RNA, 16 nt, Shigella flexneri 2a str. 2457T
uucgcugccacaccau

SEQ ID NO: 3859270 - RNA, 21 nt, Shigella flexneri 2a str. 2457T
uucgcuuaccaugccaacgcg

SEQ ID NO: 3859271 - RNA, 13 nt, Shigella flexneri 2a str. 2457T
uucgcuucuucag

SEQ ID NO: 3859272 - RNA, 18 nt, Shigella flexneri 2a str. 2457T
uucgcuugaucuuccuga

SEQ ID NO: 3859273 - RNA, 19 nt, Shigella flexneri 2a str. 2457T
uucggcaaccgcauccaga

SEQ ID NO: 3859274 - RNA, 18 nt, Shigella flexneri 2a str. 2457T
uucggcaaguguuggcga

SEQ ID NO: 3859275 - RNA, 19 nt, Shigella flexneri 2a str. 2457T
uucggcagaaaauccacca

SEQ ID NO: 3859276 - RNA, 16 nt, Shigella flexneri 2a str. 2457T
uucggcaggcuuugcu

SEQ ID NO: 3859277 - RNA, 18 nt, Shigella flexneri 2a str. 2457T
uucggcagucacuuuuuu

SEQ ID NO: 3859278 - RNA, 15 nt, Shigella flexneri 2a str. 2457T
uucggcagugccagu

SEQ ID NO: 3859279 - RNA, 20 nt, Shigella flexneri 2a str. 2457T
uucggcaucacgaauccgca

SEQ ID NO: 3859280 - RNA, 13 nt, Shigella flexneri 2a str. 2457T
uucggcaucagca

SEQ ID NO: 3859281 - RNA, 21 nt, Shigella flexneri 2a str. 2457T
uucggcgucuuguugaacagg

SEQ ID NO: 3859282 - RNA, 18 nt, Shigella flexneri 2a str. 2457T
uucgggcacagauuucca

SEQ ID NO: 3859283 - RNA, 15 nt, Shigella flexneri 2a str. 2457T
uucggguuauugguu

SEQ ID NO: 3859284 - RNA, 21 nt, Shigella flexneri 2a str. 2457T
uucggguuauugguuaacaag

SEQ ID NO: 3859285 - RNA, 16 nt, Shigella flexneri 2a str. 2457T
uucgguaagcaaagcg

SEQ ID NO: 3859286 - RNA, 16 nt, Shigella flexneri 2a str. 2457T
uucgguaaugacucca

SEQ ID NO: 3859287 - RNA, 16 nt, Shigella flexneri 2a str. 2457T
uucgguauauaacgca

SEQ ID NO: 3859288 - RNA, 22 nt, Shigella flexneri 2a str. 2457T
uucggugauauacgucacuuca

SEQ ID NO: 3859289 - RNA, 23 nt, Shigella flexneri 2a str. 2457T
uucggugauauacgucacuucau

SEQ ID NO: 3859290 - RNA, 17 nt, Shigella flexneri 2a str. 2457T
uucggugcgacaaacau

SEQ ID NO: 3859291 - RNA, 22 nt, Shigella flexneri 2a str. 2457T
uucgguguuuuuacgaaacaga

SEQ ID NO: 3859292 - RNA, 23 nt, Shigella flexneri 2a str. 2457T
uucguaaacgacugauugaacug

SEQ ID NO: 3859293 - RNA, 19 nt, Shigella flexneri 2a str. 2457T
uucguaaguacauuaaaau

SEQ ID NO: 3859294 - RNA, 14 nt, Shigella flexneri 2a str. 2457T
uucguagcguuuuu

SEQ ID NO: 3859295 - RNA, 22 nt, Shigella flexneri 2a str. 2457T
uucgucaccugguagcggguga

SEQ ID NO: 3859296 - RNA, 16 nt, Shigella flexneri 2a str. 2457T
uucgucgcggguugcc

SEQ ID NO: 3859297 - RNA, 10 nt, Shigella flexneri 2a str. 2457T
uucgucgcua

SEQ ID NO: 3859298 - RNA, 19 nt, Shigella flexneri 2a str. 2457T
uucgucuggcgauuuugaa

SEQ ID NO: 3859299 - RNA, 15 nt, Shigella flexneri 2a str. 2457T
uucgugacaauaucu

SEQ ID NO: 3859300 - RNA, 13 nt, Shigella flexneri 2a str. 2457T
uucgugagcguuu

SEQ ID NO: 3859301 - RNA, 17 nt, Shigella flexneri 2a str. 2457T
uucgugauuguuggcga

SEQ ID NO: 3859302 - RNA, 20 nt, Shigella flexneri 2a str. 2457T
uucguguggaaaagcaguaa

SEQ ID NO: 3859303 - RNA, 22 nt, Shigella flexneri 2a str. 2457T
uucguuaacaacaacuucuaau

SEQ ID NO: 3859304 - RNA, 15 nt, Shigella flexneri 2a str. 2457T
uucguugaagucagg

SEQ ID NO: 3859305 - RNA, 14 nt, Shigella flexneri 2a str. 2457T
uucguuuucagcuu

SEQ ID NO: 3859306 - RNA, 13 nt, Shigella flexneri 2a str. 2457T
uucuaaagccuga

SEQ ID NO: 3859307 - RNA, 16 nt, Shigella flexneri 2a str. 2457T
uucuaacucauuuuuu

SEQ ID NO: 3859308 - RNA, 16 nt, Shigella flexneri 2a str. 2457T
uucuucuucugacuca

SEQ ID NO: 3859309 - RNA, 14 nt, Shigella flexneri 2a str. 2457T
uucuugccuuuccu

SEQ ID NO: 3859310 - RNA, 23 nt, Shigella flexneri 2a str. 2457T
uucuugcgauuuugucucucucu

SEQ ID NO: 3859311 - RNA, 14 nt, Shigella flexneri 2a str. 2457T
uucuuucaccucuu

SEQ ID NO: 3859312 - RNA, 13 nt, Shigella flexneri 2a str. 2457T
uucuuugacaaau

SEQ ID NO: 3859313 - RNA, 19 nt, Shigella flexneri 2a str. 2457T
uucuuugcugccguuaacc

SEQ ID NO: 3859314 - RNA, 21 nt, Shigella flexneri 2a str. 2457T
uucuuugcugccguuaacccg

SEQ ID NO: 3859315 - RNA, 23 nt, Shigella flexneri 2a str. 2457T
uucuuugcugccguuaacccguc

SEQ ID NO: 3859316 - RNA, 19 nt, Shigella flexneri 2a str. 2457T
uucuuuguagaugauuuuu

SEQ ID NO: 3859317 - RNA, 15 nt, Shigella flexneri 2a str. 2457T
uucuuuugagcgucc

SEQ ID NO: 3859318 - RNA, 19 nt, Shigella flexneri 2a str. 2457T
uucuuuugcgguuaauggu

SEQ ID NO: 3859319 - RNA, 11 nt, Shigella flexneri 2a str. 2457T
uucuuuuucaa

SEQ ID NO: 3859320 - RNA, 18 nt, Shigella flexneri 2a str. 2457T
uugaaaaaccagacgaua

SEQ ID NO: 3859321 - RNA, 21 nt, Shigella flexneri 2a str. 2457T
uugaaaaaguucgacuuaaau

SEQ ID NO: 3859322 - RNA, 20 nt, Shigella flexneri 2a str. 2457T
uugaaaaauaaagucuuagc

SEQ ID NO: 3859323 - RNA, 14 nt, Shigella flexneri 2a str. 2457T
uugaaaaaucaaaa

SEQ ID NO: 3859324 - RNA, 16 nt, Shigella flexneri 2a str. 2457T
uugaaaaaucaaaaaa

SEQ ID NO: 3859325 - RNA, 23 nt, Shigella flexneri 2a str. 2457T
uugaaaaaucaaaaaacuggaaa

SEQ ID NO: 3859326 - RNA, 23 nt, Shigella flexneri 2a str. 2457T
uugaaacgaaaucuuguuuuuuu

SEQ ID NO: 3859327 - RNA, 22 nt, Shigella flexneri 2a str. 2457T
uugaaaugugguuucacuuucu

SEQ ID NO: 3859328 - RNA, 23 nt, Shigella flexneri 2a str. 2457T
uugaacgcaccgccaccaccgau

SEQ ID NO: 3859329 - RNA, 21 nt, Shigella flexneri 2a str. 2457T
uugaacggauauuuugccagg

SEQ ID NO: 3859330 - RNA, 23 nt, Shigella flexneri 2a str. 2457T
uugaacgggugauuaaagaaaau

SEQ ID NO: 3859331 - RNA, 12 nt, Shigella flexneri 2a str. 2457T
uugaacuaucau

SEQ ID NO: 3859332 - RNA, 13 nt, Shigella flexneri 2a str. 2457T
uugaagaaaucag

SEQ ID NO: 3859333 - RNA, 17 nt, Shigella flexneri 2a str. 2457T
uugaagaagacgccauu

SEQ ID NO: 3859334 - RNA, 21 nt, Shigella flexneri 2a str. 2457T
uugaagcccaguaccgccagu

SEQ ID NO: 3859335 - RNA, 22 nt, Shigella flexneri 2a str. 2457T
uugaagcgcggaacaaauacuu

SEQ ID NO: 3859336 - RNA, 23 nt, Shigella flexneri 2a str. 2457T
uugaaggguauugccgaugaacg

SEQ ID NO: 3859337 - RNA, 20 nt, Shigella flexneri 2a str. 2457T
uugaagucuuuuuucaacuu

SEQ ID NO: 3859338 - RNA, 16 nt, Shigella flexneri 2a str. 2457T
uugaauaucuccucug

SEQ ID NO: 3859339 - RNA, 18 nt, Shigella flexneri 2a str. 2457T
uugaauuuggaagaauuu

SEQ ID NO: 3859340 - RNA, 13 nt, Shigella flexneri 2a str. 2457T
uugacaaagugcg

SEQ ID NO: 3859341 - RNA, 20 nt, Shigella flexneri 2a str. 2457T
uugacaaagugcgcguuuuu

SEQ ID NO: 3859342 - RNA, 11 nt, Shigella flexneri 2a str. 2457T
uugacaacauc

SEQ ID NO: 3859343 - RNA, 22 nt, Shigella flexneri 2a str. 2457T
uugacauauaaccggcaacaga

SEQ ID NO: 3859344 - RNA, 19 nt, Shigella flexneri 2a str. 2457T
uugacccaucugccagcgc

SEQ ID NO: 3859345 - RNA, 14 nt, Shigella flexneri 2a str. 2457T
uugaccgccagcgc

SEQ ID NO: 3859346 - RNA, 16 nt, Shigella flexneri 2a str. 2457T
uugaccgccagcgcca

SEQ ID NO: 3859347 - RNA, 16 nt, Shigella flexneri 2a str. 2457T
uugacgcccccaaacu

SEQ ID NO: 3859348 - RNA, 18 nt, Shigella flexneri 2a str. 2457T
uugacgugucuuaucagg

SEQ ID NO: 3859349 - RNA, 21 nt, Shigella flexneri 2a str. 2457T
uugacuaaaguuucuuuagga

SEQ ID NO: 3859350 - RNA, 17 nt, Shigella flexneri 2a str. 2457T
uugacucgccugaaagu

SEQ ID NO: 3859351 - RNA, 13 nt, Shigella flexneri 2a str. 2457T
uugacucggaguc

SEQ ID NO: 3859352 - RNA, 12 nt, Shigella flexneri 2a str. 2457T
uugacucucauc

SEQ ID NO: 3859353 - RNA, 15 nt, Shigella flexneri 2a str. 2457T
uugagcaucugcaaa

SEQ ID NO: 3859354 - RNA, 20 nt, Shigella flexneri 2a str. 2457T
uugagccaaaaugccugaug

SEQ ID NO: 3859355 - RNA, 16 nt, Shigella flexneri 2a str. 2457T
uugagcgaaaacgaau

SEQ ID NO: 3859356 - RNA, 16 nt, Shigella flexneri 2a str. 2457T
uugagcguauccagca

SEQ ID NO: 3859357 - RNA, 18 nt, Shigella flexneri 2a str. 2457T
uugaggaacucaaaccau

SEQ ID NO: 3859358 - RNA, 22 nt, Shigella flexneri 2a str. 2457T
uugaggaaguuauacagacuca

SEQ ID NO: 3859359 - RNA, 17 nt, Shigella flexneri 2a str. 2457T
uugaggaugcuaaggcu

SEQ ID NO: 3859360 - RNA, 17 nt, Shigella flexneri 2a str. 2457T
uugagguguacuggcaa

SEQ ID NO: 3859361 - RNA, 16 nt, Shigella flexneri 2a str. 2457T
uugaguauuuaccaga

SEQ ID NO: 3859362 - RNA, 19 nt, Shigella flexneri 2a str. 2457T
uugaguggcgcaucuucau

SEQ ID NO: 3859363 - RNA, 18 nt, Shigella flexneri 2a str. 2457T
uugaguuggcaugcguau

SEQ ID NO: 3859364 - RNA, 21 nt, Shigella flexneri 2a str. 2457T
uugaguuuuucaucccucuca

SEQ ID NO: 3859365 - RNA, 12 nt, Shigella flexneri 2a str. 2457T
uugauaaaaaaa

SEQ ID NO: 3859366 - RNA, 13 nt, Shigella flexneri 2a str. 2457T
uugauaaaaaaaa

SEQ ID NO: 3859367 - RNA, 16 nt, Shigella flexneri 2a str. 2457T
uugauaauaaagcuac

SEQ ID NO: 3859368 - RNA, 13 nt, Shigella flexneri 2a str. 2457T
uugauaauguuau

SEQ ID NO: 3859369 - RNA, 20 nt, Shigella flexneri 2a str. 2457T
uugauacaggcgcuguaugc

SEQ ID NO: 3859370 - RNA, 13 nt, Shigella flexneri 2a str. 2457T
uugauacgagagc

SEQ ID NO: 3859371 - RNA, 13 nt, Shigella flexneri 2a str. 2457T
uugauagcaauac

SEQ ID NO: 3859372 - RNA, 14 nt, Shigella flexneri 2a str. 2457T
uugauaugcaccuu

SEQ ID NO: 3859373 - RNA, 13 nt, Shigella flexneri 2a str. 2457T
uugaucaccagug

SEQ ID NO: 3859374 - RNA, 22 nt, Shigella flexneri 2a str. 2457T
uugaucacccacaucagcggca

SEQ ID NO: 3859375 - RNA, 13 nt, Shigella flexneri 2a str. 2457T
uugaucauaaaaa

SEQ ID NO: 3859376 - RNA, 21 nt, Shigella flexneri 2a str. 2457T
uugaucccggcuccaaugacu

SEQ ID NO: 3859377 - RNA, 11 nt, Shigella flexneri 2a str. 2457T
uugaucgccaa

SEQ ID NO: 3859378 - RNA, 13 nt, Shigella flexneri 2a str. 2457T
uugaucucaaacg

SEQ ID NO: 3859379 - RNA, 17 nt, Shigella flexneri 2a str. 2457T
uugaugaaaaaaccaga

SEQ ID NO: 3859380 - RNA, 19 nt, Shigella flexneri 2a str. 2457T
uugaugaaaaaaccagaaa

SEQ ID NO: 3859381 - RNA, 14 nt, Shigella flexneri 2a str. 2457T
uugaugcacaccau

SEQ ID NO: 3859382 - RNA, 21 nt, Shigella flexneri 2a str. 2457T
uugaugcacugggagaacgcu

SEQ ID NO: 3859383 - RNA, 21 nt, Shigella flexneri 2a str. 2457T
uugaugccugcaucgauagcu

SEQ ID NO: 3859384 - RNA, 22 nt, Shigella flexneri 2a str. 2457T
uugaugcgaguaaucaggcuau

SEQ ID NO: 3859385 - RNA, 22 nt, Shigella flexneri 2a str. 2457T
uugaugcguaccucacguucca

SEQ ID NO: 3859386 - RNA, 23 nt, Shigella flexneri 2a str. 2457T
uugaugcgugagguaacaauaaa

SEQ ID NO: 3859387 - RNA, 20 nt, Shigella flexneri 2a str. 2457T
uugauggaaaauuguuccgu

SEQ ID NO: 3859388 - RNA, 15 nt, Shigella flexneri 2a str. 2457T
uugauggggguccug

SEQ ID NO: 3859389 - RNA, 17 nt, Shigella flexneri 2a str. 2457T
uugauggucucgccgau

SEQ ID NO: 3859390 - RNA, 16 nt, Shigella flexneri 2a str. 2457T
uugauguccaguuccc

SEQ ID NO: 3859391 - RNA, 19 nt, Shigella flexneri 2a str. 2457T
uugauguggcggauggcga

SEQ ID NO: 3859392 - RNA, 17 nt, Shigella flexneri 2a str. 2457T
uugauuacagcuggagu

SEQ ID NO: 3859393 - RNA, 22 nt, Shigella flexneri 2a str. 2457T
uugauuaccaauaucaaauaaa

SEQ ID NO: 3859394 - RNA, 20 nt, Shigella flexneri 2a str. 2457T
uugauuauuggacgguaaaa

SEQ ID NO: 3859395 - RNA, 23 nt, Shigella flexneri 2a str. 2457T
uugauuauuggacgguaaaaaga

SEQ ID NO: 3859396 - RNA, 20 nt, Shigella flexneri 2a str. 2457T
uugauucaucucuucuuccg

SEQ ID NO: 3859397 - RNA, 14 nt, Shigella flexneri 2a str. 2457T
uugauucuguucag

SEQ ID NO: 3859398 - RNA, 16 nt, Shigella flexneri 2a str. 2457T
uugauuuucgaauagc

SEQ ID NO: 3859399 - RNA, 19 nt, Shigella flexneri 2a str. 2457T
uugauuuuuuugauaaacc

SEQ ID NO: 3859400 - RNA, 20 nt, Shigella flexneri 2a str. 2457T
uugcaaagagaacugagcga

SEQ ID NO: 3859401 - RNA, 17 nt, Shigella flexneri 2a str. 2457T
uugcaaccacacaggca

SEQ ID NO: 3859402 - RNA, 24 nt, Shigella flexneri 2a str. 2457T
uugcaacgaacgcauccgcuggcc

SEQ ID NO: 3859403 - RNA, 23 nt, Shigella flexneri 2a str. 2457T
uugcaagaucgcgcaucagcucc

SEQ ID NO: 3859404 - RNA, 22 nt, Shigella flexneri 2a str. 2457T
uugcaauacaccuccggcuggg

SEQ ID NO: 3859405 - RNA, 20 nt, Shigella flexneri 2a str. 2457T
uugcugccgccaguucuucc

SEQ ID NO: 3859406 - RNA, 22 nt, Shigella flexneri 2a str. 2457T
uugcugccgccaguucuuccag

SEQ ID NO: 3859407 - RNA, 21 nt, Shigella flexneri 2a str. 2457T
uugcugccuucacggcuuugu

SEQ ID NO: 3859408 - RNA, 20 nt, Shigella flexneri 2a str. 2457T
uugcugcgccccacaccacc

SEQ ID NO: 3859409 - RNA, 20 nt, Shigella flexneri 2a str. 2457T
uugcugcgcccgcagcggcg

SEQ ID NO: 3859410 - RNA, 20 nt, Shigella flexneri 2a str. 2457T
uugcugcggcguuccccagu

SEQ ID NO: 3859411 - RNA, 15 nt, Shigella flexneri 2a str. 2457T
uugcugcugaagcaa

SEQ ID NO: 3859412 - RNA, 20 nt, Shigella flexneri 2a str. 2457T
uugcuggauaagaugcuaca

SEQ ID NO: 3859413 - RNA, 14 nt, Shigella flexneri 2a str. 2457T
uugcugguuuugua

SEQ ID NO: 3859414 - RNA, 12 nt, Shigella flexneri 2a str. 2457T
uugcuguacaua

SEQ ID NO: 3859415 - RNA, 15 nt, Shigella flexneri 2a str. 2457T
uugcugugcuuuaca

SEQ ID NO: 3859416 - RNA, 14 nt, Shigella flexneri 2a str. 2457T
uugcuguugguuca

SEQ ID NO: 3859417 - RNA, 22 nt, Shigella flexneri 2a str. 2457T
uugcuguuuuacagcugauccu

SEQ ID NO: 3859418 - RNA, 14 nt, Shigella flexneri 2a str. 2457T
uugcuuaaaaaauc

SEQ ID NO: 3859419 - RNA, 23 nt, Shigella flexneri 2a str. 2457T
uugcuuaaauacgccucuucaua

SEQ ID NO: 3859420 - RNA, 18 nt, Shigella flexneri 2a str. 2457T
uugcuucaagaugccauu

SEQ ID NO: 3859421 - RNA, 14 nt, Shigella flexneri 2a str. 2457T
uugcuucaccagca

SEQ ID NO: 3859422 - RNA, 17 nt, Shigella flexneri 2a str. 2457T
uugcuucaccagcagcg

SEQ ID NO: 3859423 - RNA, 16 nt, Shigella flexneri 2a str. 2457T
uugcuucguuuacugu

SEQ ID NO: 3859424 - RNA, 13 nt, Shigella flexneri 2a str. 2457T
uugcuucugcuuc

SEQ ID NO: 3859425 - RNA, 15 nt, Shigella flexneri 2a str. 2457T
uugcuuguucgaugc

SEQ ID NO: 3859426 - RNA, 19 nt, Shigella flexneri 2a str. 2457T
uugcuuuuaccauacugga

SEQ ID NO: 3859427 - RNA, 13 nt, Shigella flexneri 2a str. 2457T
uuggaauacauau

SEQ ID NO: 3859428 - RNA, 12 nt, Shigella flexneri 2a str. 2457T
uuggaccggcac

SEQ ID NO: 3859429 - RNA, 23 nt, Shigella flexneri 2a str. 2457T
uuggauaggcaccgccaaagaua

SEQ ID NO: 3859430 - RNA, 18 nt, Shigella flexneri 2a str. 2457T
uuggaucuguugcuggcu

SEQ ID NO: 3859431 - RNA, 14 nt, Shigella flexneri 2a str. 2457T
uuggcaaauacaaa

SEQ ID NO: 3859432 - RNA, 22 nt, Shigella flexneri 2a str. 2457T
uuggcaaccguggugaguugug

SEQ ID NO: 3859433 - RNA, 16 nt, Shigella flexneri 2a str. 2457T
uuggcaagauaggcau

SEQ ID NO: 3859434 - RNA, 16 nt, Shigella flexneri 2a str. 2457T
uuggcaaucagcggca

SEQ ID NO: 3859435 - RNA, 15 nt, Shigella flexneri 2a str. 2457T
uuggcacccagcgcu

SEQ ID NO: 3859436 - RNA, 14 nt, Shigella flexneri 2a str. 2457T
uuggcagacaacca

SEQ ID NO: 3859437 - RNA, 23 nt, Shigella flexneri 2a str. 2457T
uuggcagagcaacauacagugga

SEQ ID NO: 3859438 - RNA, 17 nt, Shigella flexneri 2a str. 2457T
uuggcaucguauuucag

SEQ ID NO: 3859439 - RNA, 16 nt, Shigella flexneri 2a str. 2457T
uuggccugacagguga

SEQ ID NO: 3859440 - RNA, 20 nt, Shigella flexneri 2a str. 2457T
uuggcgacaucgacguagug

SEQ ID NO: 3859441 - RNA, 23 nt, Shigella flexneri 2a str. 2457T
uuggcgcgaaccaucaccucuuc

SEQ ID NO: 3859442 - RNA, 15 nt, Shigella flexneri 2a str. 2457T
uuggcguaccauuaa

SEQ ID NO: 3859443 - RNA, 18 nt, Shigella flexneri 2a str. 2457T
uuggcucuucgcuccagu

SEQ ID NO: 3859444 - RNA, 14 nt, Shigella flexneri 2a str. 2457T
uugggaucgccagg

SEQ ID NO: 3859445 - RNA, 18 nt, Shigella flexneri 2a str. 2457T
uugggcaauucaccguaa

SEQ ID NO: 3859446 - RNA, 17 nt, Shigella flexneri 2a str. 2457T
uugggcauuugcacaau

SEQ ID NO: 3859447 - RNA, 17 nt, Shigella flexneri 2a str. 2457T
uugggcgaucucccgcu

SEQ ID NO: 3859448 - RNA, 21 nt, Shigella flexneri 2a str. 2457T
uugggcguuacagcuggagua

SEQ ID NO: 3859449 - RNA, 15 nt, Shigella flexneri 2a str. 2457T
uugggcucaucaaua

SEQ ID NO: 3859450 - RNA, 13 nt, Shigella flexneri 2a str. 2457T
uuggggagacuaa

SEQ ID NO: 3859451 - RNA, 20 nt, Shigella flexneri 2a str. 2457T
uuggggcauauuaucagcaa

SEQ ID NO: 3859452 - RNA, 13 nt, Shigella flexneri 2a str. 2457T
uuggguauucauu

SEQ ID NO: 3859453 - RNA, 13 nt, Shigella flexneri 2a str. 2457T
uugguaaugacuc

SEQ ID NO: 3859454 - RNA, 16 nt, Shigella flexneri 2a str. 2457T
uugguacauaacacaa

SEQ ID NO: 3859455 - RNA, 15 nt, Shigella flexneri 2a str. 2457T
uugguauucugggaa

SEQ ID NO: 3859456 - RNA, 16 nt, Shigella flexneri 2a str. 2457T
uugguccuggucugau

SEQ ID NO: 3859457 - RNA, 21 nt, Shigella flexneri 2a str. 2457T
uuggugauaaaacgcagucuu

SEQ ID NO: 3859458 - RNA, 14 nt, Shigella flexneri 2a str. 2457T
uuggugcuuuugcu

SEQ ID NO: 3859459 - RNA, 21 nt, Shigella flexneri 2a str. 2457T
uugguggcgaccggaauguuc

SEQ ID NO: 3859460 - RNA, 14 nt, Shigella flexneri 2a str. 2457T
uugguuaacugaau

SEQ ID NO: 3859461 - RNA, 22 nt, Shigella flexneri 2a str. 2457T
uugguuaacugaauauuccagu

SEQ ID NO: 3859462 - RNA, 14 nt, Shigella flexneri 2a str. 2457T
uugguuauccagca

SEQ ID NO: 3859463 - RNA, 12 nt, Shigella flexneri 2a str. 2457T
uugguucaucgu

SEQ ID NO: 3859464 - RNA, 17 nt, Shigella flexneri 2a str. 2457T
uugguucaucgugcugu

SEQ ID NO: 3859465 - RNA, 16 nt, Shigella flexneri 2a str. 2457T
uugguuucgaggaucc

SEQ ID NO: 3859466 - RNA, 13 nt, Shigella flexneri 2a str. 2457T
uuguaaaagaagg

SEQ ID NO: 3859467 - RNA, 19 nt, Shigella flexneri 2a str. 2457T
uuguaaagaccauugaugc

SEQ ID NO: 3859468 - RNA, 14 nt, Shigella flexneri 2a str. 2457T
uuguaaagcgccaa

SEQ ID NO: 3859469 - RNA, 23 nt, Shigella flexneri 2a str. 2457T
uuguaacaauccgauaaucccuu

SEQ ID NO: 3859470 - RNA, 21 nt, Shigella flexneri 2a str. 2457T
uuguaagcugucgaaaagaua

SEQ ID NO: 3859471 - RNA, 17 nt, Shigella flexneri 2a str. 2457T
uuguaaucauauuaaau

SEQ ID NO: 3859472 - RNA, 12 nt, Shigella flexneri 2a str. 2457T
uuguacaaaaaa

SEQ ID NO: 3859473 - RNA, 13 nt, Shigella flexneri 2a str. 2457T
uuguacaaaaaau

SEQ ID NO: 3859474 - RNA, 14 nt, Shigella flexneri 2a str. 2457T
uuguacaaaccaua

SEQ ID NO: 3859475 - RNA, 15 nt, Shigella flexneri 2a str. 2457T
uuguacuuuccagcc

SEQ ID NO: 3859476 - RNA, 14 nt, Shigella flexneri 2a str. 2457T
uuguagauuuugca

SEQ ID NO: 3859477 - RNA, 21 nt, Shigella flexneri 2a str. 2457T
uuguagccaauaaaugccacc

SEQ ID NO: 3859478 - RNA, 20 nt, Shigella flexneri 2a str. 2457T
uuguaggcaggauaaggcgu

SEQ ID NO: 3859479 - RNA, 19 nt, Shigella flexneri 2a str. 2457T
uuguaggccggauaagcgu

SEQ ID NO: 3859480 - RNA, 20 nt, Shigella flexneri 2a str. 2457T
uuguaggccggauaaggcgc

SEQ ID NO: 3859481 - RNA, 19 nt, Shigella flexneri 2a str. 2457T
uuguaggcggauaaggcgu

SEQ ID NO: 3859482 - RNA, 23 nt, Shigella flexneri 2a str. 2457T
uuguaggcggauaaggcguuuuc

SEQ ID NO: 3859483 - RNA, 15 nt, Shigella flexneri 2a str. 2457T
uuguaguuugauaau

SEQ ID NO: 3859484 - RNA, 11 nt, Shigella flexneri 2a str. 2457T
uuguauuuaaa

SEQ ID NO: 3859485 - RNA, 12 nt, Shigella flexneri 2a str. 2457T
uugucaauaauc

SEQ ID NO: 3859486 - RNA, 23 nt, Shigella flexneri 2a str. 2457T
uugucacuuuuacucauuucugu

SEQ ID NO: 3859487 - RNA, 22 nt, Shigella flexneri 2a str. 2457T
uugucagcaaucugauugacau

SEQ ID NO: 3859488 - RNA, 18 nt, Shigella flexneri 2a str. 2457T
uugucagcccuuuuucac

SEQ ID NO: 3859489 - RNA, 21 nt, Shigella flexneri 2a str. 2457T
uugucaugcagcuccaccgau

SEQ ID NO: 3859490 - RNA, 14 nt, Shigella flexneri 2a str. 2457T
uuguccucaaugau

SEQ ID NO: 3859491 - RNA, 17 nt, Shigella flexneri 2a str. 2457T
uugucgaaguuaccacc

SEQ ID NO: 3859492 - RNA, 19 nt, Shigella flexneri 2a str. 2457T
uugucgcacauuucaauca

SEQ ID NO: 3859493 - RNA, 18 nt, Shigella flexneri 2a str. 2457T
uugucggcgugaacgcgc

SEQ ID NO: 3859494 - RNA, 14 nt, Shigella flexneri 2a str. 2457T
uugucgggcaggcu

SEQ ID NO: 3859495 - RNA, 19 nt, Shigella flexneri 2a str. 2457T
uugucgggcaggcuucaac

SEQ ID NO: 3859496 - RNA, 20 nt, Shigella flexneri 2a str. 2457T
uugucucccacaugcugguc

SEQ ID NO: 3859497 - RNA, 14 nt, Shigella flexneri 2a str. 2457T
uugucuguuugccu

SEQ ID NO: 3859498 - RNA, 11 nt, Shigella flexneri 2a str. 2457T
uugucuucaau

SEQ ID NO: 3859499 - RNA, 16 nt, Shigella flexneri 2a str. 2457T
uugucuuuccagacuc

SEQ ID NO: 3859500 - RNA, 20 nt, Shigella flexneri 2a str. 2457T
uugugacauuaaccaaccac

SEQ ID NO: 3859501 - RNA, 15 nt, Shigella flexneri 2a str. 2457T
uugugaucgcugccc

SEQ ID NO: 3859502 - RNA, 22 nt, Shigella flexneri 2a str. 2457T
uugugauuaaacuucaccagca

SEQ ID NO: 3859503 - RNA, 20 nt, Shigella flexneri 2a str. 2457T
uuuaucugugaacucaggcu

SEQ ID NO: 3859504 - RNA, 20 nt, Shigella flexneri 2a str. 2457T
uuuaucuucgagauucuuaa

SEQ ID NO: 3859505 - RNA, 17 nt, Shigella flexneri 2a str. 2457T
uuuaugccggaugcgga

SEQ ID NO: 3859506 - RNA, 19 nt, Shigella flexneri 2a str. 2457T
uuuaugcgccuuuaccaga

SEQ ID NO: 3859507 - RNA, 17 nt, Shigella flexneri 2a str. 2457T
uuuaugcgcuaaauguu

SEQ ID NO: 3859508 - RNA, 15 nt, Shigella flexneri 2a str. 2457T
uuuaugggagauuuu

SEQ ID NO: 3859509 - RNA, 21 nt, Shigella flexneri 2a str. 2457T
uuuaugggcacggugcggggu

SEQ ID NO: 3859510 - RNA, 14 nt, Shigella flexneri 2a str. 2457T
uuuauguucagaua

SEQ ID NO: 3859511 - RNA, 22 nt, Shigella flexneri 2a str. 2457T
uuuauuaacucagcauuauuuu

SEQ ID NO: 3859512 - RNA, 14 nt, Shigella flexneri 2a str. 2457T
uuuauuaagaauuu

SEQ ID NO: 3859513 - RNA, 20 nt, Shigella flexneri 2a str. 2457T
uuuauucggcauacauaauc

SEQ ID NO: 3859514 - RNA, 17 nt, Shigella flexneri 2a str. 2457T
uuuauucggucagguga

SEQ ID NO: 3859515 - RNA, 16 nt, Shigella flexneri 2a str. 2457T
uuuauugacauguuga

SEQ ID NO: 3859516 - RNA, 17 nt, Shigella flexneri 2a str. 2457T
uuuauugcaaaaccauc

SEQ ID NO: 3859517 - RNA, 12 nt, Shigella flexneri 2a str. 2457T
uuuauugccauc

SEQ ID NO: 3859518 - RNA, 18 nt, Shigella flexneri 2a str. 2457T
uuuauugccaucuaaaug

SEQ ID NO: 3859519 - RNA, 23 nt, Shigella flexneri 2a str. 2457T
uuuauuugugguuggcguguuuc

SEQ ID NO: 3859520 - RNA, 13 nt, Shigella flexneri 2a str. 2457T
uuuauuuuuccuc

SEQ ID NO: 3859521 - RNA, 22 nt, Shigella flexneri 2a str. 2457T
uuuauuuuuuuucaggaaauaa

SEQ ID NO: 3859522 - RNA, 12 nt, Shigella flexneri 2a str. 2457T
uuucaaaaacaa

SEQ ID NO: 3859523 - RNA, 16 nt, Shigella flexneri 2a str. 2457T
uuucaaaaacaaagaa

SEQ ID NO: 3859524 - RNA, 16 nt, Shigella flexneri 2a str. 2457T
uuucaaaacggucacg

SEQ ID NO: 3859525 - RNA, 12 nt, Shigella flexneri 2a str. 2457T
uuucaaacgcca

SEQ ID NO: 3859526 - RNA, 18 nt, Shigella flexneri 2a str. 2457T
uuucaaagguaaugguca

SEQ ID NO: 3859527 - RNA, 23 nt, Shigella flexneri 2a str. 2457T
uuucaacaaccuugcguuuuuca

SEQ ID NO: 3859528 - RNA, 18 nt, Shigella flexneri 2a str. 2457T
uuucaacaauacaaaugc

SEQ ID NO: 3859529 - RNA, 19 nt, Shigella flexneri 2a str. 2457T
uuucaaccauccuaaaaaa

SEQ ID NO: 3859530 - RNA, 19 nt, Shigella flexneri 2a str. 2457T
uuucaacguacucugccac

SEQ ID NO: 3859531 - RNA, 13 nt, Shigella flexneri 2a str. 2457T
uuucaagauuagc

SEQ ID NO: 3859532 - RNA, 22 nt, Shigella flexneri 2a str. 2457T
uuucaauaaccugcaaaauagu

SEQ ID NO: 3859533 - RNA, 18 nt, Shigella flexneri 2a str. 2457T
uuucaaucacaucaucau

SEQ ID NO: 3859534 - RNA, 16 nt, Shigella flexneri 2a str. 2457T
uuucaaucgacuuuuc

SEQ ID NO: 3859535 - RNA, 15 nt, Shigella flexneri 2a str. 2457T
uuucaaugcucugca

SEQ ID NO: 3859536 - RNA, 18 nt, Shigella flexneri 2a str. 2457T
uuucaauuaucaccgcac

SEQ ID NO: 3859537 - RNA, 23 nt, Shigella flexneri 2a str. 2457T
uuucaauucacgaauauuucccg

SEQ ID NO: 3859538 - RNA, 19 nt, Shigella flexneri 2a str. 2457T
uuucacagaagugaagcau

SEQ ID NO: 3859539 - RNA, 17 nt, Shigella flexneri 2a str. 2457T
uuucacauguucauuua

SEQ ID NO: 3859540 - RNA, 20 nt, Shigella flexneri 2a str. 2457T
uuucaccaacgaugaagaga

SEQ ID NO: 3859541 - RNA, 11 nt, Shigella flexneri 2a str. 2457T
uuucaccagcg

SEQ ID NO: 3859542 - RNA, 19 nt, Shigella flexneri 2a str. 2457T
uuucacccgcgaccaccag

SEQ ID NO: 3859543 - RNA, 17 nt, Shigella flexneri 2a str. 2457T
uuucaccgaugcacaga

SEQ ID NO: 3859544 - RNA, 13 nt, Shigella flexneri 2a str. 2457T
uuucaccugcuga

SEQ ID NO: 3859545 - RNA, 19 nt, Shigella flexneri 2a str. 2457T
uuucacgaagcucucugcu

SEQ ID NO: 3859546 - RNA, 16 nt, Shigella flexneri 2a str. 2457T
uuucacgcaauaccug

SEQ ID NO: 3859547 - RNA, 21 nt, Shigella flexneri 2a str. 2457T
uuucacgcaauaccuggcgca

SEQ ID NO: 3859548 - RNA, 21 nt, Shigella flexneri 2a str. 2457T
uuucacgccgccguuagcuuc

SEQ ID NO: 3859549 - RNA, 22 nt, Shigella flexneri 2a str. 2457T
uuucacgccgggaaauuuuucc

SEQ ID NO: 3859550 - RNA, 23 nt, Shigella flexneri 2a str. 2457T
uuucacugguagugcauccgcau

SEQ ID NO: 3859551 - RNA, 18 nt, Shigella flexneri 2a str. 2457T
uuucacugugcuuuacau

SEQ ID NO: 3859552 - RNA, 20 nt, Shigella flexneri 2a str. 2457T
uuucacuucaaccacauuca

SEQ ID NO: 3859553 - RNA, 14 nt, Shigella flexneri 2a str. 2457T
uuucacuucucauu

SEQ ID NO: 3859554 - RNA, 14 nt, Shigella flexneri 2a str. 2457T
uuucacuucugagu

SEQ ID NO: 3859555 - RNA, 16 nt, Shigella flexneri 2a str. 2457T
uuucacuuucugcaau

SEQ ID NO: 3859556 - RNA, 19 nt, Shigella flexneri 2a str. 2457T
uuucagaaaacgguugaua

SEQ ID NO: 3859557 - RNA, 18 nt, Shigella flexneri 2a str. 2457T
uuucagaaaguauauaaa

SEQ ID NO: 3859558 - RNA, 17 nt, Shigella flexneri 2a str. 2457T
uuucagaaauuuggcuc

SEQ ID NO: 3859559 - RNA, 22 nt, Shigella flexneri 2a str. 2457T
uuucagaaauuuggcuccucug

SEQ ID NO: 3859560 - RNA, 22 nt, Shigella flexneri 2a str. 2457T
uuucagaagcaugaacauugcu

SEQ ID NO: 3859561 - RNA, 22 nt, Shigella flexneri 2a str. 2457T
uuucagauguuccgccauuuua

SEQ ID NO: 3859562 - RNA, 20 nt, Shigella flexneri 2a str. 2457T
uuucagauuggugacaaagu

SEQ ID NO: 3859563 - RNA, 19 nt, Shigella flexneri 2a str. 2457T
uuucagcaccagauaauga

SEQ ID NO: 3859564 - RNA, 14 nt, Shigella flexneri 2a str. 2457T
uuucagccaucauc

SEQ ID NO: 3859565 - RNA, 17 nt, Shigella flexneri 2a str. 2457T
uuucagccuuaaagaua

SEQ ID NO: 3859566 - RNA, 18 nt, Shigella flexneri 2a str. 2457T
uuucaggaaauaaauaau

SEQ ID NO: 3859567 - RNA, 17 nt, Shigella flexneri 2a str. 2457T
uuucaggaacaccgcac

SEQ ID NO: 3859568 - RNA, 16 nt, Shigella flexneri 2a str. 2457T
uuucaggcagucgcug

SEQ ID NO: 3859569 - RNA, 20 nt, Shigella flexneri 2a str. 2457T
uuucaggcuuuuuuccagcu

SEQ ID NO: 3859570 - RNA, 17 nt, Shigella flexneri 2a str. 2457T
uuucaggucaaaagauu

SEQ ID NO: 3859571 - RNA, 15 nt, Shigella flexneri 2a str. 2457T
uuucaggucgguuuu

SEQ ID NO: 3859572 - RNA, 16 nt, Shigella flexneri 2a str. 2457T
uuucagguuacgcccu

SEQ ID NO: 3859573 - RNA, 17 nt, Shigella flexneri 2a str. 2457T
uuucagguuguuuucug

SEQ ID NO: 3859574 - RNA, 13 nt, Shigella flexneri 2a str. 2457T
uuucaguccacgg

SEQ ID NO: 3859575 - RNA, 18 nt, Shigella flexneri 2a str. 2457T
uuucaguggguuaugaaa

SEQ ID NO: 3859576 - RNA, 19 nt, Shigella flexneri 2a str. 2457T
uuucaguuggcugacaaag

SEQ ID NO: 3859577 - RNA, 13 nt, Shigella flexneri 2a str. 2457T
uuucaguuugccg

SEQ ID NO: 3859578 - RNA, 15 nt, Shigella flexneri 2a str. 2457T
uuucaguuugccgcu

SEQ ID NO: 3859579 - RNA, 20 nt, Shigella flexneri 2a str. 2457T
uuucauaccccacauaguuu

SEQ ID NO: 3859580 - RNA, 19 nt, Shigella flexneri 2a str. 2457T
uuucauagauuaauuuccc

SEQ ID NO: 3859581 - RNA, 13 nt, Shigella flexneri 2a str. 2457T
uuucaucaaaaaa

SEQ ID NO: 3859582 - RNA, 21 nt, Shigella flexneri 2a str. 2457T
uuucaucaacugacuauccug

SEQ ID NO: 3859583 - RNA, 15 nt, Shigella flexneri 2a str. 2457T
uuucaucccucucau

SEQ ID NO: 3859584 - RNA, 14 nt, Shigella flexneri 2a str. 2457T
uuucauccugccau

SEQ ID NO: 3859585 - RNA, 22 nt, Shigella flexneri 2a str. 2457T
uuucaucgcccaggcaaguagc

SEQ ID NO: 3859586 - RNA, 16 nt, Shigella flexneri 2a str. 2457T
uuucaugcuauuccuu

SEQ ID NO: 3859587 - RNA, 21 nt, Shigella flexneri 2a str. 2457T
uuucaugguuacgccggugau

SEQ ID NO: 3859588 - RNA, 21 nt, Shigella flexneri 2a str. 2457T
uuucauguuaaauuccggcuc

SEQ ID NO: 3859589 - RNA, 16 nt, Shigella flexneri 2a str. 2457T
uuucauuccaguaagg

SEQ ID NO: 3859590 - RNA, 21 nt, Shigella flexneri 2a str. 2457T
uuucauugaaugcggcaggca

SEQ ID NO: 3859591 - RNA, 19 nt, Shigella flexneri 2a str. 2457T
uuucauuuugauauuucgu

SEQ ID NO: 3859592 - RNA, 13 nt, Shigella flexneri 2a str. 2457T
uuuccaaaacugg

SEQ ID NO: 3859593 - RNA, 13 nt, Shigella flexneri 2a str. 2457T
uuuccaccgcaaa

SEQ ID NO: 3859594 - RNA, 17 nt, Shigella flexneri 2a str. 2457T
uuuccacgcugauugca

SEQ ID NO: 3859595 - RNA, 13 nt, Shigella flexneri 2a str. 2457T
uuuccacuuccac

SEQ ID NO: 3859596 - RNA, 14 nt, Shigella flexneri 2a str. 2457T
uuuccacuuccacc

SEQ ID NO: 3859597 - RNA, 21 nt, Shigella flexneri 2a str. 2457T
uuuccagacugaugugaucca

SEQ ID NO: 3859598 - RNA, 23 nt, Shigella flexneri 2a str. 2457T
uuuccagaucgaucauauuuccu

SEQ ID NO: 3859599 - RNA, 19 nt, Shigella flexneri 2a str. 2457T
uuuccagcaguuccagcau

SEQ ID NO: 3859600 - RNA, 15 nt, Shigella flexneri 2a str. 2457T
uuugcaacuuucgcu

SEQ ID NO: 3859601 - RNA, 21 nt, Shigella flexneri 2a str. 2457T
uuugcaaucagauaaaauaca

SEQ ID NO: 3859602 - RNA, 12 nt, Shigella flexneri 2a str. 2457T
uuugcacauucc

SEQ ID NO: 3859603 - RNA, 16 nt, Shigella flexneri 2a str. 2457T
uuugcacauuccagau

SEQ ID NO: 3859604 - RNA, 19 nt, Shigella flexneri 2a str. 2457T
uuugcaccgauugccggau

SEQ ID NO: 3859605 - RNA, 13 nt, Shigella flexneri 2a str. 2457T
uuugcacgcuuuc

SEQ ID NO: 3859606 - RNA, 23 nt, Shigella flexneri 2a str. 2457T
uuugcagaaacauaauauaaauu

SEQ ID NO: 3859607 - RNA, 12 nt, Shigella flexneri 2a str. 2457T
uuugcagauuca

SEQ ID NO: 3859608 - RNA, 12 nt, Shigella flexneri 2a str. 2457T
uuugcagcagcg

SEQ ID NO: 3859609 - RNA, 14 nt, Shigella flexneri 2a str. 2457T
uuugcagcuuugcu

SEQ ID NO: 3859610 - RNA, 15 nt, Shigella flexneri 2a str. 2457T
uuugcagcuuugcug

SEQ ID NO: 3859611 - RNA, 14 nt, Shigella flexneri 2a str. 2457T
uuugcaggaaaaac

SEQ ID NO: 3859612 - RNA, 18 nt, Shigella flexneri 2a str. 2457T
uuugcaggaaaaacugcc

SEQ ID NO: 3859613 - RNA, 19 nt, Shigella flexneri 2a str. 2457T
uuugcaggucguccugcaa

SEQ ID NO: 3859614 - RNA, 16 nt, Shigella flexneri 2a str. 2457T
uuugcaguuccugcca

SEQ ID NO: 3859615 - RNA, 13 nt, Shigella flexneri 2a str. 2457T
uuugcauccagcu

SEQ ID NO: 3859616 - RNA, 22 nt, Shigella flexneri 2a str. 2457T
uuugcaucccagaaaaaaagua

SEQ ID NO: 3859617 - RNA, 20 nt, Shigella flexneri 2a str. 2457T
uuugcaucguccacuugaaa

SEQ ID NO: 3859618 - RNA, 18 nt, Shigella flexneri 2a str. 2457T
uuugcauggauaaaauua

SEQ ID NO: 3859619 - RNA, 18 nt, Shigella flexneri 2a str. 2457T
uuugcauuacugcuaucu

SEQ ID NO: 3859620 - RNA, 15 nt, Shigella flexneri 2a str. 2457T
uuugccaaacgcguc

SEQ ID NO: 3859621 - RNA, 17 nt, Shigella flexneri 2a str. 2457T
uuugccagaaauccagg

SEQ ID NO: 3859622 - RNA, 21 nt, Shigella flexneri 2a str. 2457T
uuugccagucuggcuucgcug

SEQ ID NO: 3859623 - RNA, 16 nt, Shigella flexneri 2a str. 2457T
uuugccaugcauaucc

SEQ ID NO: 3859624 - RNA, 15 nt, Shigella flexneri 2a str. 2457T
uuugcccacagagcu

SEQ ID NO: 3859625 - RNA, 19 nt, Shigella flexneri 2a str. 2457T
uuugccgcagcaguugcca

SEQ ID NO: 3859626 - RNA, 15 nt, Shigella flexneri 2a str. 2457T
uuugccgccaucauc

SEQ ID NO: 3859627 - RNA, 18 nt, Shigella flexneri 2a str. 2457T
uuugccggaacauccggc

SEQ ID NO: 3859628 - RNA, 21 nt, Shigella flexneri 2a str. 2457T
uuugccugccagucaaucauc

SEQ ID NO: 3859629 - RNA, 14 nt, Shigella flexneri 2a str. 2457T
uuugcgcaaucaca

SEQ ID NO: 3859630 - RNA, 23 nt, Shigella flexneri 2a str. 2457T
uuugcgccaucgccacaccagua

SEQ ID NO: 3859631 - RNA, 13 nt, Shigella flexneri 2a str. 2457T
uuugcgccuggau

SEQ ID NO: 3859632 - RNA, 22 nt, Shigella flexneri 2a str. 2457T
uuugcgcguaacgaucgccugg

SEQ ID NO: 3859633 - RNA, 20 nt, Shigella flexneri 2a str. 2457T
uuugcgcuuuuggcaggaac

SEQ ID NO: 3859634 - RNA, 15 nt, Shigella flexneri 2a str. 2457T
uuugcgguuaaaaau

SEQ ID NO: 3859635 - RNA, 22 nt, Shigella flexneri 2a str. 2457T
uuugcguagucugaccucuucu

SEQ ID NO: 3859636 - RNA, 20 nt, Shigella flexneri 2a str. 2457T
uuugcgucauaccgcaucuu

SEQ ID NO: 3859637 - RNA, 21 nt, Shigella flexneri 2a str. 2457T
uuugcguccgguaauuuuuau

SEQ ID NO: 3859638 - RNA, 20 nt, Shigella flexneri 2a str. 2457T
uuugcguugcacgcagacac

SEQ ID NO: 3859639 - RNA, 16 nt, Shigella flexneri 2a str. 2457T
uuugcuaucgggaaua

SEQ ID NO: 3859640 - RNA, 22 nt, Shigella flexneri 2a str. 2457T
uuugcuccguuccccucaacau

SEQ ID NO: 3859641 - RNA, 16 nt, Shigella flexneri 2a str. 2457T
uuugcugauauuuauc

SEQ ID NO: 3859642 - RNA, 15 nt, Shigella flexneri 2a str. 2457T
uuugcugauucuccc

SEQ ID NO: 3859643 - RNA, 15 nt, Shigella flexneri 2a str. 2457T
uuugcuguugccgcc

SEQ ID NO: 3859644 - RNA, 13 nt, Shigella flexneri 2a str. 2457T
uuugcuuccugag

SEQ ID NO: 3859645 - RNA, 22 nt, Shigella flexneri 2a str. 2457T
uuugcuugccgguuauuuugcu

SEQ ID NO: 3859646 - RNA, 12 nt, Shigella flexneri 2a str. 2457T
uuugcuuuuguu

SEQ ID NO: 3859647 - RNA, 20 nt, Shigella flexneri 2a str. 2457T
uuuggacacccuugccggau

SEQ ID NO: 3859648 - RNA, 16 nt, Shigella flexneri 2a str. 2457T
uuuggcaaacuacaaa

SEQ ID NO: 3859649 - RNA, 21 nt, Shigella flexneri 2a str. 2457T
uuuggcaaacuacaaauccaa

SEQ ID NO: 3859650 - RNA, 21 nt, Shigella flexneri 2a str. 2457T
uuuggcaaaugcaucagugac

SEQ ID NO: 3859651 - RNA, 17 nt, Shigella flexneri 2a str. 2457T
uuuggcaucaaucaacg

SEQ ID NO: 3859652 - RNA, 18 nt, Shigella flexneri 2a str. 2457T
uuuggcuggaguggugaa

SEQ ID NO: 3859653 - RNA, 20 nt, Shigella flexneri 2a str. 2457T
uuugggaucggugcagacac

SEQ ID NO: 3859654 - RNA, 12 nt, Shigella flexneri 2a str. 2457T
uuugguaggcgu

SEQ ID NO: 3859655 - RNA, 13 nt, Shigella flexneri 2a str. 2457T
uuuggugaagacg

SEQ ID NO: 3859656 - RNA, 21 nt, Shigella flexneri 2a str. 2457T
uuuggugaagacguuuauccc

SEQ ID NO: 3859657 - RNA, 23 nt, Shigella flexneri 2a str. 2457T
uuuggugaagugagaauuuuuca

SEQ ID NO: 3859658 - RNA, 17 nt, Shigella flexneri 2a str. 2457T
uuugguucaauuuguuc

SEQ ID NO: 3859659 - RNA, 21 nt, Shigella flexneri 2a str. 2457T
uuuguacaggauauauuucau

SEQ ID NO: 3859660 - RNA, 19 nt, Shigella flexneri 2a str. 2457T
uuuguagauugcacuugcu

SEQ ID NO: 3859661 - RNA, 15 nt, Shigella flexneri 2a str. 2457T
uuuguaggccggaua

SEQ ID NO: 3859662 - RNA, 17 nt, Shigella flexneri 2a str. 2457T
uuuguaguuugauaauu

SEQ ID NO: 3859663 - RNA, 15 nt, Shigella flexneri 2a str. 2457T
uuuguaucugcagau

SEQ ID NO: 3859664 - RNA, 20 nt, Shigella flexneri 2a str. 2457T
uuuguaugccuggcauuucu

SEQ ID NO: 3859665 - RNA, 18 nt, Shigella flexneri 2a str. 2457T
uuuguauuagaugcuagu

SEQ ID NO: 3859666 - RNA, 16 nt, Shigella flexneri 2a str. 2457T
uuuguauuuauuuuca

SEQ ID NO: 3859667 - RNA, 12 nt, Shigella flexneri 2a str. 2457T
uuuguauuuuau

SEQ ID NO: 3859668 - RNA, 13 nt, Shigella flexneri 2a str. 2457T
uuugucaaaaauc

SEQ ID NO: 3859669 - RNA, 22 nt, Shigella flexneri 2a str. 2457T
uuugucaugacuacacuaaacg

SEQ ID NO: 3859670 - RNA, 20 nt, Shigella flexneri 2a str. 2457T
uuuguccaccaauagcccau

SEQ ID NO: 3859671 - RNA, 15 nt, Shigella flexneri 2a str. 2457T
uuuguccccucauca

SEQ ID NO: 3859672 - RNA, 16 nt, Shigella flexneri 2a str. 2457T
uuugucgaacagguua

SEQ ID NO: 3859673 - RNA, 21 nt, Shigella flexneri 2a str. 2457T
uuugucguugcuaacaaugga

SEQ ID NO: 3859674 - RNA, 17 nt, Shigella flexneri 2a str. 2457T
uuugucucuucaugccu

SEQ ID NO: 3859675 - RNA, 15 nt, Shigella flexneri 2a str. 2457T
uuugugaucuuuuuc

SEQ ID NO: 3859676 - RNA, 16 nt, Shigella flexneri 2a str. 2457T
uuugugcagcaugcac

SEQ ID NO: 3859677 - RNA, 21 nt, Shigella flexneri 2a str. 2457T
uuuguggcuucuauauucugg

SEQ ID NO: 3859678 - RNA, 14 nt, Shigella flexneri 2a str. 2457T
uuugugucagcgcc

SEQ ID NO: 3859679 - RNA, 18 nt, Shigella flexneri 2a str. 2457T
uuuguuacuuauuucuau

SEQ ID NO: 3859680 - RNA, 19 nt, Shigella flexneri 2a str. 2457T
uuuguuagcgaauaaagua

SEQ ID NO: 3859681 - RNA, 20 nt, Shigella flexneri 2a str. 2457T
uuuguuauccaccgaaauaa

SEQ ID NO: 3859682 - RNA, 19 nt, Shigella flexneri 2a str. 2457T
uuuguugauaaacaaacag

SEQ ID NO: 3859683 - RNA, 17 nt, Shigella flexneri 2a str. 2457T
uuuguugcccagcgcau

SEQ ID NO: 3859684 - RNA, 20 nt, Shigella flexneri 2a str. 2457T
uuuguugcgcugaaacuuua

SEQ ID NO: 3859685 - RNA, 15 nt, Shigella flexneri 2a str. 2457T
uuuguuuguucuucu

SEQ ID NO: 3859686 - RNA, 14 nt, Shigella flexneri 2a str. 2457T
uuuuaaauauaaaa

SEQ ID NO: 3859687 - RNA, 20 nt, Shigella flexneri 2a str. 2457T
uuuuaaauaucaucaaaauu

SEQ ID NO: 3859688 - RNA, 13 nt, Shigella flexneri 2a str. 2457T
uuuuaaauugaag

SEQ ID NO: 3859689 - RNA, 11 nt, Shigella flexneri 2a str. 2457T
uuuuaacuuac

SEQ ID NO: 3859690 - RNA, 16 nt, Shigella flexneri 2a str. 2457T
uuuuaagcaagugcaa

SEQ ID NO: 3859691 - RNA, 12 nt, Shigella flexneri 2a str. 2457T
uuuuaagugaug

SEQ ID NO: 3859692 - RNA, 20 nt, Shigella flexneri 2a str. 2457T
uuuuaaucgucaguuuuuca

SEQ ID NO: 3859693 - RNA, 19 nt, Shigella flexneri 2a str. 2457T
uuuuacaacguauugaaau

SEQ ID NO: 3859694 - RNA, 23 nt, Shigella flexneri 2a str. 2457T
uuuuaccggucaggauuuccagc

SEQ ID NO: 3859695 - RNA, 22 nt, Shigella flexneri 2a str. 2457T
uuuuaccucuuucucauaaaac

SEQ ID NO: 3859696 - RNA, 21 nt, Shigella flexneri 2a str. 2457T
uuuuaccucuuuuuucaacau

SEQ ID NO: 3859697 - RNA, 12 nt, Shigella flexneri 2a str. 2457T
uuuuuccugcgu

SEQ ID NO: 3859698 - RNA, 22 nt, Shigella flexneri 2a str. 2457T
uuuuucgaacgcugcacgcaac

SEQ ID NO: 3859699 - RNA, 21 nt, Shigella flexneri 2a str. 2457T
uuuuucgacaaacaccgaacc

SEQ ID NO: 3859700 - RNA, 14 nt, Shigella flexneri 2a str. 2457T
uuuuucgccaugaa

SEQ ID NO: 3859701 - RNA, 18 nt, Shigella flexneri 2a str. 2457T
uuuuucggacgauauuuu

SEQ ID NO: 3859702 - RNA, 12 nt, Shigella flexneri 2a str. 2457T
uuuuucuucagu

SEQ ID NO: 3859703 - RNA, 11 nt, Shigella flexneri 2a str. 2457T
uuuuugaagcg

SEQ ID NO: 3859704 - RNA, 16 nt, Shigella flexneri 2a str. 2457T
uuuuugacgcuuuuac

SEQ ID NO: 3859705 - RNA, 19 nt, Shigella flexneri 2a str. 2457T
uuuuugacuaaaguuucuu

SEQ ID NO: 3859706 - RNA, 22 nt, Shigella flexneri 2a str. 2457T
uuuuugcaaucagauaaaauac

SEQ ID NO: 3859707 - RNA, 17 nt, Shigella flexneri 2a str. 2457T
uuuuugcagaaacauaa

SEQ ID NO: 3859708 - RNA, 23 nt, Shigella flexneri 2a str. 2457T
uuuuugcagaaacauaauauaaa

SEQ ID NO: 3859709 - RNA, 23 nt, Shigella flexneri 2a str. 2457T
uuuuugcauaauuuccagcagug

SEQ ID NO: 3859710 - RNA, 19 nt, Shigella flexneri 2a str. 2457T
uuuuugccugccagucaau

SEQ ID NO: 3859711 - RNA, 16 nt, Shigella flexneri 2a str. 2457T
uuuuugcgcgaagaaa

SEQ ID NO: 3859712 - RNA, 20 nt, Shigella flexneri 2a str. 2457T
uuuuuggaggugaagguaag

SEQ ID NO: 3859713 - RNA, 16 nt, Shigella flexneri 2a str. 2457T
uuuuugguaaugacuc

SEQ ID NO: 3859714 - RNA, 13 nt, Shigella flexneri 2a str. 2457T
uuuuuuauuuuuu

SEQ ID NO: 3859715 - RNA, 11 nt, Shigella flexneri 2a str. 2457T
uuuuuucacau

SEQ ID NO: 3859716 - RNA, 10 nt, Shigella flexneri 2a str. 2457T
uuuuuuccug

SEQ ID NO: 3859717 - RNA, 11 nt, Shigella flexneri 2a str. 2457T
uuuuuuugcca

SEQ ID NO: 3859718 - RNA, 11 nt, Shigella flexneri 2a str. 2457T
uuuuuuuucag

SEQ ID NO: 3859719 - RNA, 13 nt, Shigella flexneri 2a str. 2457T
aaaaaaaaugccc

SEQ ID NO: 3859720 - RNA, 13 nt, Shigella flexneri 2a str. 2457T
aaaaaaagaacaa

SEQ ID NO: 3859721 - RNA, 13 nt, Shigella flexneri 2a str. 2457T
aaaaaaagcauuu

SEQ ID NO: 3859722 - RNA, 13 nt, Shigella flexneri 2a str. 2457T
aaaaaacaauaug

SEQ ID NO: 3859723 - RNA, 17 nt, Shigella flexneri 2a str. 2457T
aaaaaacguugucgccg

SEQ ID NO: 3859724 - RNA, 13 nt, Shigella flexneri 2a str. 2457T
aaaaaauagcaaa

SEQ ID NO: 3859725 - RNA, 11 nt, Shigella flexneri 2a str. 2457T
aaaaaauccca

SEQ ID NO: 3859726 - RNA, 11 nt, Shigella flexneri 2a str. 2457T
aaaaaaucgcc

SEQ ID NO: 3859727 - RNA, 17 nt, Shigella flexneri 2a str. 2457T
aaaaaaugagaauaacc

SEQ ID NO: 3859728 - RNA, 17 nt, Shigella flexneri 2a str. 2457T
aaaaacaacgagccaau

SEQ ID NO: 3859729 - RNA, 19 nt, Shigella flexneri 2a str. 2457T
aaaaacagcaucaauaauc

SEQ ID NO: 3859730 - RNA, 21 nt, Shigella flexneri 2a str. 2457T
aaaaacagcaucaauaaucaa

SEQ ID NO: 3859731 - RNA, 12 nt, Shigella flexneri 2a str. 2457T
aaaaacagccag

SEQ ID NO: 3859732 - RNA, 13 nt, Shigella flexneri 2a str. 2457T
aaaaacaucauga

SEQ ID NO: 3859733 - RNA, 14 nt, Shigella flexneri 2a str. 2457T
aaaaacaucaugau

SEQ ID NO: 3859734 - RNA, 22 nt, Shigella flexneri 2a str. 2457T
aaaaaccagaaagggaagaaca

SEQ ID NO: 3859735 - RNA, 12 nt, Shigella flexneri 2a str. 2457T
aaaaacccgccc

SEQ ID NO: 3859736 - RNA, 16 nt, Shigella flexneri 2a str. 2457T
aaaaacccgccgaagc

SEQ ID NO: 3859737 - RNA, 17 nt, Shigella flexneri 2a str. 2457T
aaaaacccugcagaaac

SEQ ID NO: 3859738 - RNA, 18 nt, Shigella flexneri 2a str. 2457T
aaaaaccgggugcagagc

SEQ ID NO: 3859739 - RNA, 22 nt, Shigella flexneri 2a str. 2457T
aaaaaccuccggcguuucagau

SEQ ID NO: 3859740 - RNA, 13 nt, Shigella flexneri 2a str. 2457T
aaaaaccugaccu

SEQ ID NO: 3859741 - RNA, 22 nt, Shigella flexneri 2a str. 2457T
aaaaacgccagcaacacauagu

SEQ ID NO: 3859742 - RNA, 13 nt, Shigella flexneri 2a str. 2457T
aaaaacuaauuca

SEQ ID NO: 3859743 - RNA, 16 nt, Shigella flexneri 2a str. 2457T
aaaaacucauaaauuc

SEQ ID NO: 3859744 - RNA, 11 nt, Shigella flexneri 2a str. 2457T
aaaagaaaguu

SEQ ID NO: 3859745 - RNA, 19 nt, Shigella flexneri 2a str. 2457T
aaaagauccguaaugccug

SEQ ID NO: 3859746 - RNA, 16 nt, Shigella flexneri 2a str. 2457T
aaaagaugagaaaaau

SEQ ID NO: 3859747 - RNA, 15 nt, Shigella flexneri 2a str. 2457T
aaaagcaaaaauaag

SEQ ID NO: 3859748 - RNA, 13 nt, Shigella flexneri 2a str. 2457T
aaaagcacagaau

SEQ ID NO: 3859749 - RNA, 21 nt, Shigella flexneri 2a str. 2457T
aaaagcacagaaucuaagauc

SEQ ID NO: 3859750 - RNA, 16 nt, Shigella flexneri 2a str. 2457T
aaaagcacgccagaca

SEQ ID NO: 3859751 - RNA, 21 nt, Shigella flexneri 2a str. 2457T
aaaagcauagccccagcgcag

SEQ ID NO: 3859752 - RNA, 22 nt, Shigella flexneri 2a str. 2457T
aaaagccgacucacuugcaguc

SEQ ID NO: 3859753 - RNA, 22 nt, Shigella flexneri 2a str. 2457T
aaaagccgcuuaacgguguuua

SEQ ID NO: 3859754 - RNA, 22 nt, Shigella flexneri 2a str. 2457T
aaaagcggcuaaccacgccgcu

SEQ ID NO: 3859755 - RNA, 18 nt, Shigella flexneri 2a str. 2457T
aaaagcucccuaaaauau

SEQ ID NO: 3859756 - RNA, 22 nt, Shigella flexneri 2a str. 2457T
aaaagcugcaaggugaaagcaa

SEQ ID NO: 3859757 - RNA, 17 nt, Shigella flexneri 2a str. 2457T
aaaaggcgcuaaaaaua

SEQ ID NO: 3859758 - RNA, 19 nt, Shigella flexneri 2a str. 2457T
aaaagggcgaucuugcgac

SEQ ID NO: 3859759 - RNA, 22 nt, Shigella flexneri 2a str. 2457T
aaaaguaaaccagagagaagcu

SEQ ID NO: 3859760 - RNA, 21 nt, Shigella flexneri 2a str. 2457T
aaaaguaagauugccugaugc

SEQ ID NO: 3859761 - RNA, 20 nt, Shigella flexneri 2a str. 2457T
aaaaguaguuccagcaugau

SEQ ID NO: 3859762 - RNA, 18 nt, Shigella flexneri 2a str. 2457T
aaaaguuauaaauaaaaa

SEQ ID NO: 3859763 - RNA, 20 nt, Shigella flexneri 2a str. 2457T
aaaaguuuuaucggagaaca

SEQ ID NO: 3859764 - RNA, 23 nt, Shigella flexneri 2a str. 2457T
aaaauaacagcggcaaccagccc

SEQ ID NO: 3859765 - RNA, 20 nt, Shigella flexneri 2a str. 2457T
aaaauaaccaaauaaaauaa

SEQ ID NO: 3859766 - RNA, 16 nt, Shigella flexneri 2a str. 2457T
aaaauaaugcgacaac

SEQ ID NO: 3859767 - RNA, 19 nt, Shigella flexneri 2a str. 2457T
aaaauaaugcgacaacaga

SEQ ID NO: 3859768 - RNA, 15 nt, Shigella flexneri 2a str. 2457T
aaaauaaugugauuu

SEQ ID NO: 3859769 - RNA, 21 nt, Shigella flexneri 2a str. 2457T
aaaauaaugugauuuugugaa

SEQ ID NO: 3859770 - RNA, 17 nt, Shigella flexneri 2a str. 2457T
aaaauacaauucucagc

SEQ ID NO: 3859771 - RNA, 12 nt, Shigella flexneri 2a str. 2457T
aaaauacaugac

SEQ ID NO: 3859772 - RNA, 15 nt, Shigella flexneri 2a str. 2457T
aaaauacguucucac

SEQ ID NO: 3859773 - RNA, 13 nt, Shigella flexneri 2a str. 2457T
aaaauagcauaau

SEQ ID NO: 3859774 - RNA, 14 nt, Shigella flexneri 2a str. 2457T
aaaauagccaauca

SEQ ID NO: 3859775 - RNA, 13 nt, Shigella flexneri 2a str. 2457T
aaaauauuucugc

SEQ ID NO: 3859776 - RNA, 14 nt, Shigella flexneri 2a str. 2457T
aaaaucaaaaaacu

SEQ ID NO: 3859777 - RNA, 13 nt, Shigella flexneri 2a str. 2457T
aaaaucaaaauaa

SEQ ID NO: 3859778 - RNA, 20 nt, Shigella flexneri 2a str. 2457T
aaaaucaaccauacggucug

SEQ ID NO: 3859779 - RNA, 17 nt, Shigella flexneri 2a str. 2457T
aaaaucacauaaauucu

SEQ ID NO: 3859780 - RNA, 14 nt, Shigella flexneri 2a str. 2457T
aaaaucaccaucac

SEQ ID NO: 3859781 - RNA, 13 nt, Shigella flexneri 2a str. 2457T
aaaaucaccauuu

SEQ ID NO: 3859782 - RNA, 22 nt, Shigella flexneri 2a str. 2457T
aaaaucaccucaucaccacaga

SEQ ID NO: 3859783 - RNA, 17 nt, Shigella flexneri 2a str. 2457T
aaaaucaucaauugcca

SEQ ID NO: 3859784 - RNA, 15 nt, Shigella flexneri 2a str. 2457T
aaaaucaugcaauaa

SEQ ID NO: 3859785 - RNA, 22 nt, Shigella flexneri 2a str. 2457T
aaaaucauucgccgguuccagc

SEQ ID NO: 3859786 - RNA, 14 nt, Shigella flexneri 2a str. 2457T
aaaauccaccagug

SEQ ID NO: 3859787 - RNA, 22 nt, Shigella flexneri 2a str. 2457T
aaaauccagauuuauaaaagaa

SEQ ID NO: 3859788 - RNA, 23 nt, Shigella flexneri 2a str. 2457T
aaaauccauuuucuauuuugcau

SEQ ID NO: 3859789 - RNA, 21 nt, Shigella flexneri 2a str. 2457T
aaaaucccggcaacaaauuca

SEQ ID NO: 3859790 - RNA, 17 nt, Shigella flexneri 2a str. 2457T
aaaauccugccagcgug

SEQ ID NO: 3859791 - RNA, 16 nt, Shigella flexneri 2a str. 2457T
aaaaucgacagcagga

SEQ ID NO: 3859792 - RNA, 23 nt, Shigella flexneri 2a str. 2457T
aaaaucgcaaauugacuacacca

SEQ ID NO: 3859793 - RNA, 17 nt, Shigella flexneri 2a str. 2457T
aaaaucgccgagcugaa

SEQ ID NO: 3859794 - RNA, 23 nt, Shigella flexneri 2a str. 2457T
aaaaucgccgagcugaacaagaa

SEQ ID NO: 3859795 - RNA, 14 nt, Shigella flexneri 2a str. 2457T
aaaaucgcuucagc

SEQ ID NO: 3859796 - RNA, 18 nt, Shigella flexneri 2a str. 2457T
aaaaucgcuucagccgga

SEQ ID NO: 3859797 - RNA, 16 nt, Shigella flexneri 2a str. 2457T
aaaaucguaagcagga

SEQ ID NO: 3859798 - RNA, 19 nt, Shigella flexneri 2a str. 2457T
aaaaucguaagcaggagau

SEQ ID NO: 3859799 - RNA, 23 nt, Shigella flexneri 2a str. 2457T
aaaaucgugaaaaaucaauauau

SEQ ID NO: 3859800 - RNA, 14 nt, Shigella flexneri 2a str. 2457T
aaaaucucaaugua

SEQ ID NO: 3859801 - RNA, 15 nt, Shigella flexneri 2a str. 2457T
aaaaucucauuugca

SEQ ID NO: 3859802 - RNA, 21 nt, Shigella flexneri 2a str. 2457T
aaaaucuccugccaauacaaa

SEQ ID NO: 3859803 - RNA, 20 nt, Shigella flexneri 2a str. 2457T
aaaaucucgacuucuucauu

SEQ ID NO: 3859804 - RNA, 14 nt, Shigella flexneri 2a str. 2457T
aaaaucuuaaagau

SEQ ID NO: 3859805 - RNA, 21 nt, Shigella flexneri 2a str. 2457T
aaaaugauguagaccugauac

SEQ ID NO: 3859806 - RNA, 21 nt, Shigella flexneri 2a str. 2457T
aaaaugcaucggcauaaucau

SEQ ID NO: 3859807 - RNA, 16 nt, Shigella flexneri 2a str. 2457T
aaaaugccgcacauca

SEQ ID NO: 3859808 - RNA, 20 nt, Shigella flexneri 2a str. 2457T
aaaaugccuuuaccgacaua

SEQ ID NO: 3859809 - RNA, 15 nt, Shigella flexneri 2a str. 2457T
aaaaugcgaaaaaaa

SEQ ID NO: 3859810 - RNA, 14 nt, Shigella flexneri 2a str. 2457T
aaaaugcgcaugau

SEQ ID NO: 3859811 - RNA, 14 nt, Shigella flexneri 2a str. 2457T
aaaauggccgauac

SEQ ID NO: 3859812 - RNA, 13 nt, Shigella flexneri 2a str. 2457T
aaaauggucagcc

SEQ ID NO: 3859813 - RNA, 19 nt, Shigella flexneri 2a str. 2457T
aaaauggucagccagcggc

SEQ ID NO: 3859814 - RNA, 15 nt, Shigella flexneri 2a str. 2457T
aaaaugugaugccua

SEQ ID NO: 3859815 - RNA, 20 nt, Shigella flexneri 2a str. 2457T
aaaaugugcccggacagucc

SEQ ID NO: 3859816 - RNA, 14 nt, Shigella flexneri 2a str. 2457T
aaaauguugucauu

SEQ ID NO: 3859817 - RNA, 21 nt, Shigella flexneri 2a str. 2457T
aaaauguugucauuacaacaa

SEQ ID NO: 3859818 - RNA, 23 nt, Shigella flexneri 2a str. 2457T
aaaauguuuaugccugguugagu

SEQ ID NO: 3859819 - RNA, 19 nt, Shigella flexneri 2a str. 2457T
aaaauuauaucuuauugcu

SEQ ID NO: 3859820 - RNA, 19 nt, Shigella flexneri 2a str. 2457T
aaaauucaagacaucaaua

SEQ ID NO: 3859821 - RNA, 15 nt, Shigella flexneri 2a str. 2457T
aaaauucaucaaaug

SEQ ID NO: 3859822 - RNA, 23 nt, Shigella flexneri 2a str. 2457T
aaaauucauucaauuaauaacac

SEQ ID NO: 3859823 - RNA, 22 nt, Shigella flexneri 2a str. 2457T
aaaauucuacagaaaugaaaaa

SEQ ID NO: 3859824 - RNA, 20 nt, Shigella flexneri 2a str. 2457T
aaaauucuggguaaugacuc

SEQ ID NO: 3859825 - RNA, 22 nt, Shigella flexneri 2a str. 2457T
aaaauucuuacguaauuuauaa

SEQ ID NO: 3859826 - RNA, 12 nt, Shigella flexneri 2a str. 2457T
aaaauuuacagu

SEQ ID NO: 3859827 - RNA, 20 nt, Shigella flexneri 2a str. 2457T
aaaauuucccccacagcucu

SEQ ID NO: 3859828 - RNA, 14 nt, Shigella flexneri 2a str. 2457T
aaacaaaucacuau

SEQ ID NO: 3859829 - RNA, 21 nt, Shigella flexneri 2a str. 2457T
aaacaacggaacgaaaaaaau

SEQ ID NO: 3859830 - RNA, 22 nt, Shigella flexneri 2a str. 2457T
aaacaagauccaguauccggau

SEQ ID NO: 3859831 - RNA, 20 nt, Shigella flexneri 2a str. 2457T
aaacaagaucgcccugaggg

SEQ ID NO: 3859832 - RNA, 18 nt, Shigella flexneri 2a str. 2457T
aaacaagccgaaacggaa

SEQ ID NO: 3859833 - RNA, 15 nt, Shigella flexneri 2a str. 2457T
aaacaagcguacaaa

SEQ ID NO: 3859834 - RNA, 22 nt, Shigella flexneri 2a str. 2457T
aaacaaguucuucgaagcacuc

SEQ ID NO: 3859835 - RNA, 21 nt, Shigella flexneri 2a str. 2457T
aaacaauaauuaucauuaaaa

SEQ ID NO: 3859836 - RNA, 12 nt, Shigella flexneri 2a str. 2457T
aaacaauaauug

SEQ ID NO: 3859837 - RNA, 18 nt, Shigella flexneri 2a str. 2457T
aaacaauguucaucugca

SEQ ID NO: 3859838 - RNA, 20 nt, Shigella flexneri 2a str. 2457T
aaacacaaaacugccugaug

SEQ ID NO: 3859839 - RNA, 14 nt, Shigella flexneri 2a str. 2457T
aaacacaaaguccu

SEQ ID NO: 3859840 - RNA, 15 nt, Shigella flexneri 2a str. 2457T
aaacacgacaugacc

SEQ ID NO: 3859841 - RNA, 17 nt, Shigella flexneri 2a str. 2457T
aaaccuccagcaucaga

SEQ ID NO: 3859842 - RNA, 21 nt, Shigella flexneri 2a str. 2457T
aaaccugaacaggucgaugcg

SEQ ID NO: 3859843 - RNA, 15 nt, Shigella flexneri 2a str. 2457T
aaaccugacaacaaa

SEQ ID NO: 3859844 - RNA, 17 nt, Shigella flexneri 2a str. 2457T
aaaccugauuacgcacc

SEQ ID NO: 3859845 - RNA, 20 nt, Shigella flexneri 2a str. 2457T
aaaccuuagguugugaucau

SEQ ID NO: 3859846 - RNA, 22 nt, Shigella flexneri 2a str. 2457T
aaaccuuagguugugaucaucc

SEQ ID NO: 3859847 - RNA, 16 nt, Shigella flexneri 2a str. 2457T
aaacgaaccauaaaau

SEQ ID NO: 3859848 - RNA, 18 nt, Shigella flexneri 2a str. 2457T
aaacgacgcagaacugaa

SEQ ID NO: 3859849 - RNA, 18 nt, Shigella flexneri 2a str. 2457T
aaacgauuaauuacacag

SEQ ID NO: 3859850 - RNA, 21 nt, Shigella flexneri 2a str. 2457T
aaacgauuuuuuuaauaauau

SEQ ID NO: 3859851 - RNA, 20 nt, Shigella flexneri 2a str. 2457T
aaacgcaaaauugccugaug

SEQ ID NO: 3859852 - RNA, 19 nt, Shigella flexneri 2a str. 2457T
aaacgcaaacaccagcgaa

SEQ ID NO: 3859853 - RNA, 19 nt, Shigella flexneri 2a str. 2457T
aaacgcaagguuguugaaa

SEQ ID NO: 3859854 - RNA, 19 nt, Shigella flexneri 2a str. 2457T
aaacgccacauccggccua

SEQ ID NO: 3859855 - RNA, 22 nt, Shigella flexneri 2a str. 2457T
aaacgccagauacaucagcgac

SEQ ID NO: 3859856 - RNA, 17 nt, Shigella flexneri 2a str. 2457T
aaacgcccaaugcccag

SEQ ID NO: 3859857 - RNA, 19 nt, Shigella flexneri 2a str. 2457T
aaacgcccaaugcccagaa

SEQ ID NO: 3859858 - RNA, 23 nt, Shigella flexneri 2a str. 2457T
aaacgcccguccaucaacaagcg

SEQ ID NO: 3859859 - RNA, 17 nt, Shigella flexneri 2a str. 2457T
aaacgccguucuucagc

SEQ ID NO: 3859860 - RNA, 14 nt, Shigella flexneri 2a str. 2457T
aaacgccugcuccu

SEQ ID NO: 3859861 - RNA, 19 nt, Shigella flexneri 2a str. 2457T
aaacgccuuauccggccua

SEQ ID NO: 3859862 - RNA, 16 nt, Shigella flexneri 2a str. 2457T
aaacgcucccugccag

SEQ ID NO: 3859863 - RNA, 22 nt, Shigella flexneri 2a str. 2457T
aaacgcucccugccaguccugc

SEQ ID NO: 3859864 - RNA, 12 nt, Shigella flexneri 2a str. 2457T
aaacgcucggca

SEQ ID NO: 3859865 - RNA, 15 nt, Shigella flexneri 2a str. 2457T
aaacgcucucucagu

SEQ ID NO: 3859866 - RNA, 12 nt, Shigella flexneri 2a str. 2457T
aaacgcugguga

SEQ ID NO: 3859867 - RNA, 21 nt, Shigella flexneri 2a str. 2457T
aaacgcuuauaguaacguuug

SEQ ID NO: 3859868 - RNA, 15 nt, Shigella flexneri 2a str. 2457T
aaacggauaaucaug

SEQ ID NO: 3859869 - RNA, 17 nt, Shigella flexneri 2a str. 2457T
aaacggauggccugaug

SEQ ID NO: 3859870 - RNA, 19 nt, Shigella flexneri 2a str. 2457T
aaacggcacgguugccauu

SEQ ID NO: 3859871 - RNA, 22 nt, Shigella flexneri 2a str. 2457T
aaacgggggcgauuuuccucca

SEQ ID NO: 3859872 - RNA, 17 nt, Shigella flexneri 2a str. 2457T
aaacggucccucaacaa

SEQ ID NO: 3859873 - RNA, 15 nt, Shigella flexneri 2a str. 2457T
aaacggugaucaaaa

SEQ ID NO: 3859874 - RNA, 18 nt, Shigella flexneri 2a str. 2457T
aaacgguugauaaaugag

SEQ ID NO: 3859875 - RNA, 15 nt, Shigella flexneri 2a str. 2457T
aaacgucucacuaac

SEQ ID NO: 3859876 - RNA, 12 nt, Shigella flexneri 2a str. 2457T
aaacgugccauu

SEQ ID NO: 3859877 - RNA, 14 nt, Shigella flexneri 2a str. 2457T
aaacgugcggcugu

SEQ ID NO: 3859878 - RNA, 20 nt, Shigella flexneri 2a str. 2457T
aaacguuagcacgaaccguc

SEQ ID NO: 3859879 - RNA, 21 nt, Shigella flexneri 2a str. 2457T
aaacguugcgcggugagcguu

SEQ ID NO: 3859880 - RNA, 22 nt, Shigella flexneri 2a str. 2457T
aaacguugucaguucuuuuauu

SEQ ID NO: 3859881 - RNA, 13 nt, Shigella flexneri 2a str. 2457T
aaacguuuaaaaa

SEQ ID NO: 3859882 - RNA, 17 nt, Shigella flexneri 2a str. 2457T
aaacguuucaaacaggc

SEQ ID NO: 3859883 - RNA, 12 nt, Shigella flexneri 2a str. 2457T
aaacuaaaaaca

SEQ ID NO: 3859884 - RNA, 14 nt, Shigella flexneri 2a str. 2457T
aaacuaaaaacagc

SEQ ID NO: 3859885 - RNA, 16 nt, Shigella flexneri 2a str. 2457T
aaacuaacaguguuuc

SEQ ID NO: 3859886 - RNA, 18 nt, Shigella flexneri 2a str. 2457T
aaacuaauaauuauccug

SEQ ID NO: 3859887 - RNA, 15 nt, Shigella flexneri 2a str. 2457T
aaacuaaucgacagu

SEQ ID NO: 3859888 - RNA, 22 nt, Shigella flexneri 2a str. 2457T
aaacuaaucgacaguugcugcg

SEQ ID NO: 3859889 - RNA, 14 nt, Shigella flexneri 2a str. 2457T
aaacuacaggcaac

SEQ ID NO: 3859890 - RNA, 20 nt, Shigella flexneri 2a str. 2457T
aaacuaucaggcaaaaaaau

SEQ ID NO: 3859891 - RNA, 23 nt, Shigella flexneri 2a str. 2457T
aaacuaucccagccuauaacgaa

SEQ ID NO: 3859892 - RNA, 13 nt, Shigella flexneri 2a str. 2457T
aaacuauccugug

SEQ ID NO: 3859893 - RNA, 14 nt, Shigella flexneri 2a str. 2457T
aaacucaaucaggc

SEQ ID NO: 3859894 - RNA, 22 nt, Shigella flexneri 2a str. 2457T
aaacucacgccagcagcgcaau

SEQ ID NO: 3859895 - RNA, 23 nt, Shigella flexneri 2a str. 2457T
aaacucgcguaaauccagcggca

SEQ ID NO: 3859896 - RNA, 20 nt, Shigella flexneri 2a str. 2457T
aaacucgcugccagcacuuu

SEQ ID NO: 3859897 - RNA, 17 nt, Shigella flexneri 2a str. 2457T
aaacucucaucuuugaa

SEQ ID NO: 3859898 - RNA, 13 nt, Shigella flexneri 2a str. 2457T
aaacucugcggca

SEQ ID NO: 3859899 - RNA, 15 nt, Shigella flexneri 2a str. 2457T
aaacugcccgugaug

SEQ ID NO: 3859900 - RNA, 22 nt, Shigella flexneri 2a str. 2457T
aaacuggaaaaauaauuuuaaa

SEQ ID NO: 3859901 - RNA, 14 nt, Shigella flexneri 2a str. 2457T
aaacuggaagauuu

SEQ ID NO: 3859902 - RNA, 15 nt, Shigella flexneri 2a str. 2457T
aaacuggauuacaaa

SEQ ID NO: 3859903 - RNA, 21 nt, Shigella flexneri 2a str. 2457T
aaacuggcguuuuuccaaaac

SEQ ID NO: 3859904 - RNA, 18 nt, Shigella flexneri 2a str. 2457T
aaacuuaugcagcugcuc

SEQ ID NO: 3859905 - RNA, 14 nt, Shigella flexneri 2a str. 2457T
aaacuucacuuccc

SEQ ID NO: 3859906 - RNA, 16 nt, Shigella flexneri 2a str. 2457T
aaacuucacuuccccg

SEQ ID NO: 3859907 - RNA, 15 nt, Shigella flexneri 2a str. 2457T
aaacuugauacugaa

SEQ ID NO: 3859908 - RNA, 21 nt, Shigella flexneri 2a str. 2457T
aaacuuuaauuuuucaauauc

SEQ ID NO: 3859909 - RNA, 16 nt, Shigella flexneri 2a str. 2457T
aaacuuucauaaacac

SEQ ID NO: 3859910 - RNA, 15 nt, Shigella flexneri 2a str. 2457T
aaagaaaauaaggcc

SEQ ID NO: 3859911 - RNA, 19 nt, Shigella flexneri 2a str. 2457T
aaagaaaaucgucaaaauu

SEQ ID NO: 3859912 - RNA, 13 nt, Shigella flexneri 2a str. 2457T
aaagaagccuccg

SEQ ID NO: 3859913 - RNA, 19 nt, Shigella flexneri 2a str. 2457T
aaagaagcggugaaaaaau

SEQ ID NO: 3859914 - RNA, 16 nt, Shigella flexneri 2a str. 2457T
aaagaaggcauaacuc

SEQ ID NO: 3859915 - RNA, 18 nt, Shigella flexneri 2a str. 2457T
aaagaagucucugaaauu

SEQ ID NO: 3859916 - RNA, 19 nt, Shigella flexneri 2a str. 2457T
aaagaagucucugaaauuc

SEQ ID NO: 3859917 - RNA, 13 nt, Shigella flexneri 2a str. 2457T
aaagaaugacacu

SEQ ID NO: 3859918 - RNA, 23 nt, Shigella flexneri 2a str. 2457T
aaagaaugacacuuucagcgcag

SEQ ID NO: 3859919 - RNA, 13 nt, Shigella flexneri 2a str. 2457T
aaagacaucaaac

SEQ ID NO: 3859920 - RNA, 23 nt, Shigella flexneri 2a str. 2457T
aaagacgacuuuaugcgucuggg

SEQ ID NO: 3859921 - RNA, 15 nt, Shigella flexneri 2a str. 2457T
aaagacgccaucaau

SEQ ID NO: 3859922 - RNA, 20 nt, Shigella flexneri 2a str. 2457T
aaagacguuaaaaaaggugc

SEQ ID NO: 3859923 - RNA, 16 nt, Shigella flexneri 2a str. 2457T
aaagagaacucuuuuu

SEQ ID NO: 3859924 - RNA, 17 nt, Shigella flexneri 2a str. 2457T
aaagagaacucuuuuuu

SEQ ID NO: 3859925 - RNA, 19 nt, Shigella flexneri 2a str. 2457T
aaagagcauuacacgcggc

SEQ ID NO: 3859926 - RNA, 18 nt, Shigella flexneri 2a str. 2457T
aaagaggcguuugcaggu

SEQ ID NO: 3859927 - RNA, 16 nt, Shigella flexneri 2a str. 2457T
aaagagggcauggcgc

SEQ ID NO: 3859928 - RNA, 19 nt, Shigella flexneri 2a str. 2457T
aaagagucggcgcugaaau

SEQ ID NO: 3859929 - RNA, 21 nt, Shigella flexneri 2a str. 2457T
aaagagucggcgcugaaauuc

SEQ ID NO: 3859930 - RNA, 18 nt, Shigella flexneri 2a str. 2457T
aaagaguucaaagccgaa

SEQ ID NO: 3859931 - RNA, 21 nt, Shigella flexneri 2a str. 2457T
aaagauaccagacauguggau

SEQ ID NO: 3859932 - RNA, 17 nt, Shigella flexneri 2a str. 2457T
aaagauaguaagauuau

SEQ ID NO: 3859933 - RNA, 23 nt, Shigella flexneri 2a str. 2457T
aaagauauuggggguaauucccu

SEQ ID NO: 3859934 - RNA, 12 nt, Shigella flexneri 2a str. 2457T
aaagaucgccac

SEQ ID NO: 3859935 - RNA, 15 nt, Shigella flexneri 2a str. 2457T
aaagaucgccacugc

SEQ ID NO: 3859936 - RNA, 16 nt, Shigella flexneri 2a str. 2457T
aaagaucgccacugcu

SEQ ID NO: 3859937 - RNA, 18 nt, Shigella flexneri 2a str. 2457T
aaagauggauugcugaaa

SEQ ID NO: 3859938 - RNA, 22 nt, Shigella flexneri 2a str. 2457T
aaagucauccuuaaagaaaaag

SEQ ID NO: 3859939 - RNA, 20 nt, Shigella flexneri 2a str. 2457T
aaagucaucgcauacaaaaa

SEQ ID NO: 3859940 - RNA, 19 nt, Shigella flexneri 2a str. 2457T
aaaguccaggcugcaaagu

SEQ ID NO: 3859941 - RNA, 15 nt, Shigella flexneri 2a str. 2457T
aaaguccucucggca

SEQ ID NO: 3859942 - RNA, 13 nt, Shigella flexneri 2a str. 2457T
aaagucuccuuug

SEQ ID NO: 3859943 - RNA, 21 nt, Shigella flexneri 2a str. 2457T
aaagucuuuguauuuauuuuc

SEQ ID NO: 3859944 - RNA, 16 nt, Shigella flexneri 2a str. 2457T
aaagugaauacagaac

SEQ ID NO: 3859945 - RNA, 17 nt, Shigella flexneri 2a str. 2457T
aaagugaauacagaaca

SEQ ID NO: 3859946 - RNA, 16 nt, Shigella flexneri 2a str. 2457T
aaagugcccccaacuu

SEQ ID NO: 3859947 - RNA, 14 nt, Shigella flexneri 2a str. 2457T
aaaguggaaaaaua

SEQ ID NO: 3859948 - RNA, 17 nt, Shigella flexneri 2a str. 2457T
aaaguggcguuguguuc

SEQ ID NO: 3859949 - RNA, 20 nt, Shigella flexneri 2a str. 2457T
aaagugggggauuuacucuc

SEQ ID NO: 3859950 - RNA, 18 nt, Shigella flexneri 2a str. 2457T
aaaguguggggauaacua

SEQ ID NO: 3859951 - RNA, 13 nt, Shigella flexneri 2a str. 2457T
aaaguuauaaaua

SEQ ID NO: 3859952 - RNA, 14 nt, Shigella flexneri 2a str. 2457T
aaaguuauaaauaa

SEQ ID NO: 3859953 - RNA, 15 nt, Shigella flexneri 2a str. 2457T
aaaguuaucgagcug

SEQ ID NO: 3859954 - RNA, 19 nt, Shigella flexneri 2a str. 2457T
aaaguucguuggauauuuu

SEQ ID NO: 3859955 - RNA, 21 nt, Shigella flexneri 2a str. 2457T
aaaguugcauuagcacaaacc

SEQ ID NO: 3859956 - RNA, 22 nt, Shigella flexneri 2a str. 2457T
aaaguugccagauaaauauuau

SEQ ID NO: 3859957 - RNA, 15 nt, Shigella flexneri 2a str. 2457T
aaaguuggcaccaaa

SEQ ID NO: 3859958 - RNA, 14 nt, Shigella flexneri 2a str. 2457T
aaaguuugcaacuu

SEQ ID NO: 3859959 - RNA, 18 nt, Shigella flexneri 2a str. 2457T
aaaguuuuucaacaccau

SEQ ID NO: 3859960 - RNA, 21 nt, Shigella flexneri 2a str. 2457T
aaauaaaaaaaguauuuuuaa

SEQ ID NO: 3859961 - RNA, 20 nt, Shigella flexneri 2a str. 2457T
aaauaaaaaacauucaagua

SEQ ID NO: 3859962 - RNA, 12 nt, Shigella flexneri 2a str. 2457T
aaauaaaauaag

SEQ ID NO: 3859963 - RNA, 18 nt, Shigella flexneri 2a str. 2457T
aaauaaacuuacugacau

SEQ ID NO: 3859964 - RNA, 15 nt, Shigella flexneri 2a str. 2457T
aaauaaauauauaaa

SEQ ID NO: 3859965 - RNA, 22 nt, Shigella flexneri 2a str. 2457T
aaauaaaucaaagucagaucaa

SEQ ID NO: 3859966 - RNA, 23 nt, Shigella flexneri 2a str. 2457T
aaauaaaugcuugacucuguagc

SEQ ID NO: 3859967 - RNA, 19 nt, Shigella flexneri 2a str. 2457T
aaauaacaucccuuaacac

SEQ ID NO: 3859968 - RNA, 14 nt, Shigella flexneri 2a str. 2457T
aaauaacaucgcca

SEQ ID NO: 3859969 - RNA, 21 nt, Shigella flexneri 2a str. 2457T
aaauaacgccggagagaaaaa

SEQ ID NO: 3859970 - RNA, 23 nt, Shigella flexneri 2a str. 2457T
aaauaacgccggagagaaaaacc

SEQ ID NO: 3859971 - RNA, 22 nt, Shigella flexneri 2a str. 2457T
aaauaacuggugcuaacagcaa

SEQ ID NO: 3859972 - RNA, 13 nt, Shigella flexneri 2a str. 2457T
aaauaagaaaagc

SEQ ID NO: 3859973 - RNA, 20 nt, Shigella flexneri 2a str. 2457T
aaauaagaugcgaguaaaca

SEQ ID NO: 3859974 - RNA, 22 nt, Shigella flexneri 2a str. 2457T
aaauaagcgacguuguuuucau

SEQ ID NO: 3859975 - RNA, 22 nt, Shigella flexneri 2a str. 2457T
aaauaauacguagcaccgacgu

SEQ ID NO: 3859976 - RNA, 16 nt, Shigella flexneri 2a str. 2457T
aaauaaucgaucgcgu

SEQ ID NO: 3859977 - RNA, 19 nt, Shigella flexneri 2a str. 2457T
aaauaaucgggaauacaga

SEQ ID NO: 3859978 - RNA, 19 nt, Shigella flexneri 2a str. 2457T
aaauaaucuauugauuuaa

SEQ ID NO: 3859979 - RNA, 13 nt, Shigella flexneri 2a str. 2457T
aaauaaugcagcg

SEQ ID NO: 3859980 - RNA, 23 nt, Shigella flexneri 2a str. 2457T
aaauaaugcgacaacagaaauaa

SEQ ID NO: 3859981 - RNA, 12 nt, Shigella flexneri 2a str. 2457T
aaauaauuuuaa

SEQ ID NO: 3859982 - RNA, 13 nt, Shigella flexneri 2a str. 2457T
aaauaauuuuaaa

SEQ ID NO: 3859983 - RNA, 12 nt, Shigella flexneri 2a str. 2457T
aaauacaccuua

SEQ ID NO: 3859984 - RNA, 14 nt, Shigella flexneri 2a str. 2457T
aaauacacuuuaau

SEQ ID NO: 3859985 - RNA, 13 nt, Shigella flexneri 2a str. 2457T
aaauacagagcac

SEQ ID NO: 3859986 - RNA, 21 nt, Shigella flexneri 2a str. 2457T
aaauacauacgcaaaaaacau

SEQ ID NO: 3859987 - RNA, 18 nt, Shigella flexneri 2a str. 2457T
aaauacauuaguaauuuc

SEQ ID NO: 3859988 - RNA, 15 nt, Shigella flexneri 2a str. 2457T
aaauacccaaaaaau

SEQ ID NO: 3859989 - RNA, 22 nt, Shigella flexneri 2a str. 2457T
aaauacccaaaaaauagcaaag

SEQ ID NO: 3859990 - RNA, 23 nt, Shigella flexneri 2a str. 2457T
aaauacgcuuuuucccugguaaa

SEQ ID NO: 3859991 - RNA, 16 nt, Shigella flexneri 2a str. 2457T
aaauacugacuggcaa

SEQ ID NO: 3859992 - RNA, 19 nt, Shigella flexneri 2a str. 2457T
aaauacuggcuaagaagcc

SEQ ID NO: 3859993 - RNA, 23 nt, Shigella flexneri 2a str. 2457T
aaauacuguuuaccggugccagc

SEQ ID NO: 3859994 - RNA, 20 nt, Shigella flexneri 2a str. 2457T
aaauacuguuuaucuuccca

SEQ ID NO: 3859995 - RNA, 21 nt, Shigella flexneri 2a str. 2457T
aaauacuguuuaucuucccag

SEQ ID NO: 3859996 - RNA, 14 nt, Shigella flexneri 2a str. 2457T
aaauacuuaaacag

SEQ ID NO: 3859997 - RNA, 17 nt, Shigella flexneri 2a str. 2457T
aaauagaauccgcgacu

SEQ ID NO: 3859998 - RNA, 20 nt, Shigella flexneri 2a str. 2457T
aaauagaauggcaucagaag

SEQ ID NO: 3859999 - RNA, 16 nt, Shigella flexneri 2a str. 2457T
aaauagacacaagaaa

SEQ ID NO: 3860000 - RNA, 12 nt, Shigella flexneri 2a str. 2457T
aaauagcaaagu

SEQ ID NO: 3860001 - RNA, 14 nt, Shigella flexneri 2a str. 2457T
aaauagcaaaguaa

SEQ ID NO: 3860002 - RNA, 20 nt, Shigella flexneri 2a str. 2457T
aaauagcaaaguaauaauga

SEQ ID NO: 3860003 - RNA, 17 nt, Shigella flexneri 2a str. 2457T
aaauagccaaucauucc

SEQ ID NO: 3860004 - RNA, 21 nt, Shigella flexneri 2a str. 2457T
aaauagccaaucauucccauu

SEQ ID NO: 3860005 - RNA, 20 nt, Shigella flexneri 2a str. 2457T
aaauagccagcagagcaaaa

SEQ ID NO: 3860006 - RNA, 23 nt, Shigella flexneri 2a str. 2457T
aaauagccagcagagcaaaaauc

SEQ ID NO: 3860007 - RNA, 17 nt, Shigella flexneri 2a str. 2457T
aaauagccccugacugg

SEQ ID NO: 3860008 - RNA, 21 nt, Shigella flexneri 2a str. 2457T
aaauagcccgauggauuuauc

SEQ ID NO: 3860009 - RNA, 22 nt, Shigella flexneri 2a str. 2457T
aaauagcgaagacuguagcagg

SEQ ID NO: 3860010 - RNA, 17 nt, Shigella flexneri 2a str. 2457T
aaauagcuguuuauuua

SEQ ID NO: 3860011 - RNA, 23 nt, Shigella flexneri 2a str. 2457T
aaauagugccuggcugcgugagg

SEQ ID NO: 3860012 - RNA, 13 nt, Shigella flexneri 2a str. 2457T
aaauauaaaacaa

SEQ ID NO: 3860013 - RNA, 22 nt, Shigella flexneri 2a str. 2457T
aaauauauuccccggucagcag

SEQ ID NO: 3860014 - RNA, 20 nt, Shigella flexneri 2a str. 2457T
aaauaucaucaaaauuaaca

SEQ ID NO: 3860015 - RNA, 17 nt, Shigella flexneri 2a str. 2457T
aaauaucgcccauauga

SEQ ID NO: 3860016 - RNA, 18 nt, Shigella flexneri 2a str. 2457T
aaauaucgcccauaugaa

SEQ ID NO: 3860017 - RNA, 13 nt, Shigella flexneri 2a str. 2457T
aaauaucuuauag

SEQ ID NO: 3860018 - RNA, 17 nt, Shigella flexneri 2a str. 2457T
aaauaucuucaauagca

SEQ ID NO: 3860019 - RNA, 17 nt, Shigella flexneri 2a str. 2457T
aaauaugaaaucucuug

SEQ ID NO: 3860020 - RNA, 16 nt, Shigella flexneri 2a str. 2457T
aaauauggcgcaccga

SEQ ID NO: 3860021 - RNA, 22 nt, Shigella flexneri 2a str. 2457T
aaauauggugaaaguaaaaaag

SEQ ID NO: 3860022 - RNA, 13 nt, Shigella flexneri 2a str. 2457T
aaauauuaauaau

SEQ ID NO: 3860023 - RNA, 17 nt, Shigella flexneri 2a str. 2457T
aaauauuauuggcaucg

SEQ ID NO: 3860024 - RNA, 15 nt, Shigella flexneri 2a str. 2457T
aaauauugagcagaa

SEQ ID NO: 3860025 - RNA, 19 nt, Shigella flexneri 2a str. 2457T
aaaucaacaugaaaauaac

SEQ ID NO: 3860026 - RNA, 22 nt, Shigella flexneri 2a str. 2457T
aaaucaacaugaaaauaaccau

SEQ ID NO: 3860027 - RNA, 13 nt, Shigella flexneri 2a str. 2457T
aaaucaacauguu

SEQ ID NO: 3860028 - RNA, 22 nt, Shigella flexneri 2a str. 2457T
aaaucaacauguuccugccagu

SEQ ID NO: 3860029 - RNA, 22 nt, Shigella flexneri 2a str. 2457T
aaaucaacuugacgauuaacgc

SEQ ID NO: 3860030 - RNA, 12 nt, Shigella flexneri 2a str. 2457T
aaaucaacuuuc

SEQ ID NO: 3860031 - RNA, 14 nt, Shigella flexneri 2a str. 2457T
aaaucaagcgccgc

SEQ ID NO: 3860032 - RNA, 12 nt, Shigella flexneri 2a str. 2457T
aaaucacaccau

SEQ ID NO: 3860033 - RNA, 21 nt, Shigella flexneri 2a str. 2457T
aaaucacagcgagccuggcug

SEQ ID NO: 3860034 - RNA, 16 nt, Shigella flexneri 2a str. 2457T
aaaucacauaaauucu

SEQ ID NO: 3860035 - RNA, 13 nt, Shigella flexneri 2a str. 2457T
aaauucaaagugu

SEQ ID NO: 3860036 - RNA, 23 nt, Shigella flexneri 2a str. 2457T
aaauucagaugaugauacugaca

SEQ ID NO: 3860037 - RNA, 18 nt, Shigella flexneri 2a str. 2457T
aaauucaggaauucagaa

SEQ ID NO: 3860038 - RNA, 17 nt, Shigella flexneri 2a str. 2457T
aaauucauuaccaaccu

SEQ ID NO: 3860039 - RNA, 19 nt, Shigella flexneri 2a str. 2457T
aaauucauucaauuaauaa

SEQ ID NO: 3860040 - RNA, 22 nt, Shigella flexneri 2a str. 2457T
aaauucauucaauuaauaacac

SEQ ID NO: 3860041 - RNA, 13 nt, Shigella flexneri 2a str. 2457T
aaauuccagaaaa

SEQ ID NO: 3860042 - RNA, 14 nt, Shigella flexneri 2a str. 2457T
aaauuccagcggca

SEQ ID NO: 3860043 - RNA, 19 nt, Shigella flexneri 2a str. 2457T
aaauucccgcagauaaaua

SEQ ID NO: 3860044 - RNA, 19 nt, Shigella flexneri 2a str. 2457T
aaauuccuaugcaacaacu

SEQ ID NO: 3860045 - RNA, 15 nt, Shigella flexneri 2a str. 2457T
aaauucgaaauagag

SEQ ID NO: 3860046 - RNA, 19 nt, Shigella flexneri 2a str. 2457T
aaauucgcuggauuuuuga

SEQ ID NO: 3860047 - RNA, 13 nt, Shigella flexneri 2a str. 2457T
aaauucgcuucau

SEQ ID NO: 3860048 - RNA, 22 nt, Shigella flexneri 2a str. 2457T
aaauucuacagaaaugaaaaaa

SEQ ID NO: 3860049 - RNA, 14 nt, Shigella flexneri 2a str. 2457T
aaauucuggcacca

SEQ ID NO: 3860050 - RNA, 17 nt, Shigella flexneri 2a str. 2457T
aaauucuggcaccaccu

SEQ ID NO: 3860051 - RNA, 18 nt, Shigella flexneri 2a str. 2457T
aaauucuggcggcaauaa

SEQ ID NO: 3860052 - RNA, 20 nt, Shigella flexneri 2a str. 2457T
aaauugacuacaccauuaac

SEQ ID NO: 3860053 - RNA, 15 nt, Shigella flexneri 2a str. 2457T
aaauugcaggaaaua

SEQ ID NO: 3860054 - RNA, 13 nt, Shigella flexneri 2a str. 2457T
aaauugccccaga

SEQ ID NO: 3860055 - RNA, 20 nt, Shigella flexneri 2a str. 2457T
aaauugcuguuacgccagaa

SEQ ID NO: 3860056 - RNA, 16 nt, Shigella flexneri 2a str. 2457T
aaauugguagaccaga

SEQ ID NO: 3860057 - RNA, 19 nt, Shigella flexneri 2a str. 2457T
aaauugucuccaccaauga

SEQ ID NO: 3860058 - RNA, 17 nt, Shigella flexneri 2a str. 2457T
aaauugugauaaaaauc

SEQ ID NO: 3860059 - RNA, 13 nt, Shigella flexneri 2a str. 2457T
aaauuuaauaaua

SEQ ID NO: 3860060 - RNA, 22 nt, Shigella flexneri 2a str. 2457T
aaauuuacaguauaaguaauga

SEQ ID NO: 3860061 - RNA, 15 nt, Shigella flexneri 2a str. 2457T
aaauuucauuaauau

SEQ ID NO: 3860062 - RNA, 14 nt, Shigella flexneri 2a str. 2457T
aaauuuccgcgaaa

SEQ ID NO: 3860063 - RNA, 21 nt, Shigella flexneri 2a str. 2457T
aaauuucugccauuuugcuuu

SEQ ID NO: 3860064 - RNA, 19 nt, Shigella flexneri 2a str. 2457T
aaauuucuuaccacugccg

SEQ ID NO: 3860065 - RNA, 21 nt, Shigella flexneri 2a str. 2457T
aaauuucuuaccacugccgca

SEQ ID NO: 3860066 - RNA, 12 nt, Shigella flexneri 2a str. 2457T
aaauuucuuccc

SEQ ID NO: 3860067 - RNA, 18 nt, Shigella flexneri 2a str. 2457T
aaauuucuuguauuaaca

SEQ ID NO: 3860068 - RNA, 23 nt, Shigella flexneri 2a str. 2457T
aaauuugcucaucgauaucgacc

SEQ ID NO: 3860069 - RNA, 16 nt, Shigella flexneri 2a str. 2457T
aaauuuggcuccucug

SEQ ID NO: 3860070 - RNA, 20 nt, Shigella flexneri 2a str. 2457T
aaauuuggcuccucugacug

SEQ ID NO: 3860071 - RNA, 21 nt, Shigella flexneri 2a str. 2457T
aaauuuucagcgugcccacgu

SEQ ID NO: 3860072 - RNA, 21 nt, Shigella flexneri 2a str. 2457T
aaauuuugugggcaggagaaa

SEQ ID NO: 3860073 - RNA, 17 nt, Shigella flexneri 2a str. 2457T
aacaaaaaaaccgccuc

SEQ ID NO: 3860074 - RNA, 13 nt, Shigella flexneri 2a str. 2457T
aacaaaaaagagu

SEQ ID NO: 3860075 - RNA, 22 nt, Shigella flexneri 2a str. 2457T
aacaaaaccuguugaaauuauu

SEQ ID NO: 3860076 - RNA, 12 nt, Shigella flexneri 2a str. 2457T
aacaaaaucgug

SEQ ID NO: 3860077 - RNA, 19 nt, Shigella flexneri 2a str. 2457T
aacaaacgauuuaucgauu

SEQ ID NO: 3860078 - RNA, 14 nt, Shigella flexneri 2a str. 2457T
aacaaacgcaaaau

SEQ ID NO: 3860079 - RNA, 19 nt, Shigella flexneri 2a str. 2457T
aacaaacgcaaaauugccu

SEQ ID NO: 3860080 - RNA, 15 nt, Shigella flexneri 2a str. 2457T
aacaaagaaauguuc

SEQ ID NO: 3860081 - RNA, 12 nt, Shigella flexneri 2a str. 2457T
aacaaagccacu

SEQ ID NO: 3860082 - RNA, 18 nt, Shigella flexneri 2a str. 2457T
aacaaagcgcacuuuguc

SEQ ID NO: 3860083 - RNA, 21 nt, Shigella flexneri 2a str. 2457T
aacaaauaaauagauccagga

SEQ ID NO: 3860084 - RNA, 13 nt, Shigella flexneri 2a str. 2457T
aacaaauccgcuu

SEQ ID NO: 3860085 - RNA, 19 nt, Shigella flexneri 2a str. 2457T
aacaaaugcgcuuuauuca

SEQ ID NO: 3860086 - RNA, 13 nt, Shigella flexneri 2a str. 2457T
aacaaauucacgc

SEQ ID NO: 3860087 - RNA, 19 nt, Shigella flexneri 2a str. 2457T
aacaacaguuuuaucucca

SEQ ID NO: 3860088 - RNA, 14 nt, Shigella flexneri 2a str. 2457T
aacaaccacaaugu

SEQ ID NO: 3860089 - RNA, 20 nt, Shigella flexneri 2a str. 2457T
aacaacccggcgaaagagcu

SEQ ID NO: 3860090 - RNA, 18 nt, Shigella flexneri 2a str. 2457T
aacaacgcaacuccagcu

SEQ ID NO: 3860091 - RNA, 19 nt, Shigella flexneri 2a str. 2457T
aacaacgcgcggaacugau

SEQ ID NO: 3860092 - RNA, 15 nt, Shigella flexneri 2a str. 2457T
aacaacgugguuuuc

SEQ ID NO: 3860093 - RNA, 16 nt, Shigella flexneri 2a str. 2457T
aacaacguuuuucuaa

SEQ ID NO: 3860094 - RNA, 22 nt, Shigella flexneri 2a str. 2457T
aacaacguuuuucuaagcuuug

SEQ ID NO: 3860095 - RNA, 17 nt, Shigella flexneri 2a str. 2457T
aacaacugaaaaaaaau

SEQ ID NO: 3860096 - RNA, 23 nt, Shigella flexneri 2a str. 2457T
aacaacuggcguuucucgccacu

SEQ ID NO: 3860097 - RNA, 16 nt, Shigella flexneri 2a str. 2457T
aacaacuuaacuugcu

SEQ ID NO: 3860098 - RNA, 17 nt, Shigella flexneri 2a str. 2457T
aacaagauugccugaug

SEQ ID NO: 3860099 - RNA, 23 nt, Shigella flexneri 2a str. 2457T
aacaagccgaaacggaaaucgcc

SEQ ID NO: 3860100 - RNA, 15 nt, Shigella flexneri 2a str. 2457T
aacaaggcaggauua

SEQ ID NO: 3860101 - RNA, 21 nt, Shigella flexneri 2a str. 2457T
aacaagguuugaaaaaaccug

SEQ ID NO: 3860102 - RNA, 15 nt, Shigella flexneri 2a str. 2457T
aacaauacaaaugcc

SEQ ID NO: 3860103 - RNA, 17 nt, Shigella flexneri 2a str. 2457T
aacaauacaucuuuuca

SEQ ID NO: 3860104 - RNA, 14 nt, Shigella flexneri 2a str. 2457T
aacaaucacaauag

SEQ ID NO: 3860105 - RNA, 19 nt, Shigella flexneri 2a str. 2457T
aacaaucacaauagaaaua

SEQ ID NO: 3860106 - RNA, 17 nt, Shigella flexneri 2a str. 2457T
aacaaucgggaaaaucu

SEQ ID NO: 3860107 - RNA, 15 nt, Shigella flexneri 2a str. 2457T
aacaaucucuuccag

SEQ ID NO: 3860108 - RNA, 22 nt, Shigella flexneri 2a str. 2457T
aacaaucugcaaaucgaucuca

SEQ ID NO: 3860109 - RNA, 17 nt, Shigella flexneri 2a str. 2457T
aacaaugcguuuagccg

SEQ ID NO: 3860110 - RNA, 19 nt, Shigella flexneri 2a str. 2457T
aacaauucguuguuuuugu

SEQ ID NO: 3860111 - RNA, 23 nt, Shigella flexneri 2a str. 2457T
aacaauugcgggccaaagaccag

SEQ ID NO: 3860112 - RNA, 15 nt, Shigella flexneri 2a str. 2457T
aacacaaaacugccu

SEQ ID NO: 3860113 - RNA, 13 nt, Shigella flexneri 2a str. 2457T
aacacaacgcuuu

SEQ ID NO: 3860114 - RNA, 21 nt, Shigella flexneri 2a str. 2457T
aacacaauaccuucugcgccc

SEQ ID NO: 3860115 - RNA, 17 nt, Shigella flexneri 2a str. 2457T
aacacaauccccgcgcc

SEQ ID NO: 3860116 - RNA, 21 nt, Shigella flexneri 2a str. 2457T
aacacacaauuaccuuccaca

SEQ ID NO: 3860117 - RNA, 13 nt, Shigella flexneri 2a str. 2457T
aacacacauuuau

SEQ ID NO: 3860118 - RNA, 20 nt, Shigella flexneri 2a str. 2457T
aacacacguaggccggauaa

SEQ ID NO: 3860119 - RNA, 13 nt, Shigella flexneri 2a str. 2457T
aacacacuuucca

SEQ ID NO: 3860120 - RNA, 20 nt, Shigella flexneri 2a str. 2457T
aacacagauugauaaaaaua

SEQ ID NO: 3860121 - RNA, 22 nt, Shigella flexneri 2a str. 2457T
aacacagauugauaaaaauagu

SEQ ID NO: 3860122 - RNA, 17 nt, Shigella flexneri 2a str. 2457T
aacacagcgauccggua

SEQ ID NO: 3860123 - RNA, 17 nt, Shigella flexneri 2a str. 2457T
aacacaggauacgcaua

SEQ ID NO: 3860124 - RNA, 17 nt, Shigella flexneri 2a str. 2457T
aacacagguaacuuaaa

SEQ ID NO: 3860125 - RNA, 16 nt, Shigella flexneri 2a str. 2457T
aacacauccaguggcg

SEQ ID NO: 3860126 - RNA, 16 nt, Shigella flexneri 2a str. 2457T
aacacauuauuaagaa

SEQ ID NO: 3860127 - RNA, 18 nt, Shigella flexneri 2a str. 2457T
aacacauucaaacgauuu

SEQ ID NO: 3860128 - RNA, 12 nt, Shigella flexneri 2a str. 2457T
aacaccaaaccc

SEQ ID NO: 3860129 - RNA, 17 nt, Shigella flexneri 2a str. 2457T
aacaccaccugccagag

SEQ ID NO: 3860130 - RNA, 15 nt, Shigella flexneri 2a str. 2457T
aacaccagcaauaau

SEQ ID NO: 3860131 - RNA, 12 nt, Shigella flexneri 2a str. 2457T
aacaccagcagu

SEQ ID NO: 3860132 - RNA, 13 nt, Shigella flexneri 2a str. 2457T
aacaucccuguaa

SEQ ID NO: 3860133 - RNA, 21 nt, Shigella flexneri 2a str. 2457T
aacauccgcuuucgguuuuuc

SEQ ID NO: 3860134 - RNA, 23 nt, Shigella flexneri 2a str. 2457T
aacaucguaucuggcaagcagga

SEQ ID NO: 3860135 - RNA, 16 nt, Shigella flexneri 2a str. 2457T
aacaucuccacaguca

SEQ ID NO: 3860136 - RNA, 16 nt, Shigella flexneri 2a str. 2457T
aacaugaaacagaaaa

SEQ ID NO: 3860137 - RNA, 18 nt, Shigella flexneri 2a str. 2457T
aacaugaaacagaaaauu

SEQ ID NO: 3860138 - RNA, 22 nt, Shigella flexneri 2a str. 2457T
aacaugacgcgcaucacgacaa

SEQ ID NO: 3860139 - RNA, 15 nt, Shigella flexneri 2a str. 2457T
aacaugagaacaguu

SEQ ID NO: 3860140 - RNA, 19 nt, Shigella flexneri 2a str. 2457T
aacaugagaacaguucagc

SEQ ID NO: 3860141 - RNA, 20 nt, Shigella flexneri 2a str. 2457T
aacaugagcgaauaaaaaaa

SEQ ID NO: 3860142 - RNA, 19 nt, Shigella flexneri 2a str. 2457T
aacauggauucgaugauca

SEQ ID NO: 3860143 - RNA, 22 nt, Shigella flexneri 2a str. 2457T
aacauggauucgaugaucaacc

SEQ ID NO: 3860144 - RNA, 22 nt, Shigella flexneri 2a str. 2457T
aacauggcacugcgaucccggc

SEQ ID NO: 3860145 - RNA, 18 nt, Shigella flexneri 2a str. 2457T
aacauguuccugccaguc

SEQ ID NO: 3860146 - RNA, 14 nt, Shigella flexneri 2a str. 2457T
aacauuacgugggc

SEQ ID NO: 3860147 - RNA, 13 nt, Shigella flexneri 2a str. 2457T
aacauuagcgcau

SEQ ID NO: 3860148 - RNA, 17 nt, Shigella flexneri 2a str. 2457T
aacauuaggaauaaugu

SEQ ID NO: 3860149 - RNA, 21 nt, Shigella flexneri 2a str. 2457T
aacauuccacuuucgcggcuu

SEQ ID NO: 3860150 - RNA, 14 nt, Shigella flexneri 2a str. 2457T
aacauugcugccag

SEQ ID NO: 3860151 - RNA, 12 nt, Shigella flexneri 2a str. 2457T
aacauugcugcu

SEQ ID NO: 3860152 - RNA, 17 nt, Shigella flexneri 2a str. 2457T
aaccaaacagcgccaga

SEQ ID NO: 3860153 - RNA, 20 nt, Shigella flexneri 2a str. 2457T
aaccaaacguggucgccagc

SEQ ID NO: 3860154 - RNA, 17 nt, Shigella flexneri 2a str. 2457T
aaccaaacuuaugcagc

SEQ ID NO: 3860155 - RNA, 11 nt, Shigella flexneri 2a str. 2457T
aaccaaagcgu

SEQ ID NO: 3860156 - RNA, 16 nt, Shigella flexneri 2a str. 2457T
aaccaacaauaaaauu

SEQ ID NO: 3860157 - RNA, 13 nt, Shigella flexneri 2a str. 2457T
aaccaacaaugca

SEQ ID NO: 3860158 - RNA, 13 nt, Shigella flexneri 2a str. 2457T
aaccaacaccugu

SEQ ID NO: 3860159 - RNA, 17 nt, Shigella flexneri 2a str. 2457T
aaccaacgccagcagca

SEQ ID NO: 3860160 - RNA, 13 nt, Shigella flexneri 2a str. 2457T
aaccaacggccuu

SEQ ID NO: 3860161 - RNA, 13 nt, Shigella flexneri 2a str. 2457T
aaccaaucuccca

SEQ ID NO: 3860162 - RNA, 14 nt, Shigella flexneri 2a str. 2457T
aaccacaaugaaga

SEQ ID NO: 3860163 - RNA, 13 nt, Shigella flexneri 2a str. 2457T
aaccacaauguca

SEQ ID NO: 3860164 - RNA, 22 nt, Shigella flexneri 2a str. 2457T
aaccacaaugucacaaauaaaa

SEQ ID NO: 3860165 - RNA, 17 nt, Shigella flexneri 2a str. 2457T
aaccacacaggcaucgu

SEQ ID NO: 3860166 - RNA, 14 nt, Shigella flexneri 2a str. 2457T
aaccacagauccgg

SEQ ID NO: 3860167 - RNA, 15 nt, Shigella flexneri 2a str. 2457T
aaccacagauccgga

SEQ ID NO: 3860168 - RNA, 14 nt, Shigella flexneri 2a str. 2457T
aaccaccaguaaau

SEQ ID NO: 3860169 - RNA, 15 nt, Shigella flexneri 2a str. 2457T
aaccaccggcaccac

SEQ ID NO: 3860170 - RNA, 14 nt, Shigella flexneri 2a str. 2457T
aaccaccuccacgc

SEQ ID NO: 3860171 - RNA, 19 nt, Shigella flexneri 2a str. 2457T
aaccacgcagcguuggcag

SEQ ID NO: 3860172 - RNA, 17 nt, Shigella flexneri 2a str. 2457T
aaccacggaaaggcagu

SEQ ID NO: 3860173 - RNA, 22 nt, Shigella flexneri 2a str. 2457T
aaccacggaaaggcaguucagg

SEQ ID NO: 3860174 - RNA, 23 nt, Shigella flexneri 2a str. 2457T
aaccacggaguugaccagcucca

SEQ ID NO: 3860175 - RNA, 23 nt, Shigella flexneri 2a str. 2457T
aaccacggcagcaacuuaaucau

SEQ ID NO: 3860176 - RNA, 18 nt, Shigella flexneri 2a str. 2457T
aaccacguucauuucaua

SEQ ID NO: 3860177 - RNA, 12 nt, Shigella flexneri 2a str. 2457T
aaccacucacga

SEQ ID NO: 3860178 - RNA, 23 nt, Shigella flexneri 2a str. 2457T
aaccacugacacaggcagcaauc

SEQ ID NO: 3860179 - RNA, 13 nt, Shigella flexneri 2a str. 2457T
aaccacugcgcca

SEQ ID NO: 3860180 - RNA, 16 nt, Shigella flexneri 2a str. 2457T
aaccacuuaauuauua

SEQ ID NO: 3860181 - RNA, 15 nt, Shigella flexneri 2a str. 2457T
aaccagaaagggaag

SEQ ID NO: 3860182 - RNA, 19 nt, Shigella flexneri 2a str. 2457T
aaccagaaagggaagaaca

SEQ ID NO: 3860183 - RNA, 14 nt, Shigella flexneri 2a str. 2457T
aaccagacugugaa

SEQ ID NO: 3860184 - RNA, 18 nt, Shigella flexneri 2a str. 2457T
aaccagcacaaaguggcg

SEQ ID NO: 3860185 - RNA, 22 nt, Shigella flexneri 2a str. 2457T
aaccagcacuucgccaucugcc

SEQ ID NO: 3860186 - RNA, 18 nt, Shigella flexneri 2a str. 2457T
aaccagccaaauaaaauc

SEQ ID NO: 3860187 - RNA, 22 nt, Shigella flexneri 2a str. 2457T
aaccagcgcggcgauaaugccc

SEQ ID NO: 3860188 - RNA, 18 nt, Shigella flexneri 2a str. 2457T
aaccagcgucagccagaa

SEQ ID NO: 3860189 - RNA, 23 nt, Shigella flexneri 2a str. 2457T
aaccaggcgagaucggcaggcag

SEQ ID NO: 3860190 - RNA, 14 nt, Shigella flexneri 2a str. 2457T
aaccaggucgcauc

SEQ ID NO: 3860191 - RNA, 19 nt, Shigella flexneri 2a str. 2457T
aaccagugaauacugcgcg

SEQ ID NO: 3860192 - RNA, 14 nt, Shigella flexneri 2a str. 2457T
aaccagugacauac

SEQ ID NO: 3860193 - RNA, 23 nt, Shigella flexneri 2a str. 2457T
aaccaguuacgugcugcgcagac

SEQ ID NO: 3860194 - RNA, 21 nt, Shigella flexneri 2a str. 2457T
aaccaguucauuuuucucaac

SEQ ID NO: 3860195 - RNA, 13 nt, Shigella flexneri 2a str. 2457T
aaccauaaaauca

SEQ ID NO: 3860196 - RNA, 13 nt, Shigella flexneri 2a str. 2457T
aaccauaaucuca

SEQ ID NO: 3860197 - RNA, 18 nt, Shigella flexneri 2a str. 2457T
aaccauauaugauaauua

SEQ ID NO: 3860198 - RNA, 21 nt, Shigella flexneri 2a str. 2457T
aaccaucaggaugacaaacuu

SEQ ID NO: 3860199 - RNA, 22 nt, Shigella flexneri 2a str. 2457T
aaccaucgagaaucagcgagac

SEQ ID NO: 3860200 - RNA, 16 nt, Shigella flexneri 2a str. 2457T
aaccaucgcauacugc

SEQ ID NO: 3860201 - RNA, 23 nt, Shigella flexneri 2a str. 2457T
aaccaugacgcacuuucgcuuua

SEQ ID NO: 3860202 - RNA, 15 nt, Shigella flexneri 2a str. 2457T
aaccaugucaucaau

SEQ ID NO: 3860203 - RNA, 13 nt, Shigella flexneri 2a str. 2457T
aacccaccaugcc

SEQ ID NO: 3860204 - RNA, 21 nt, Shigella flexneri 2a str. 2457T
aacccacuggcaaucaguggc

SEQ ID NO: 3860205 - RNA, 23 nt, Shigella flexneri 2a str. 2457T
aacccagaagaaagccggaugau

SEQ ID NO: 3860206 - RNA, 21 nt, Shigella flexneri 2a str. 2457T
aacccagcgauggacgcagac

SEQ ID NO: 3860207 - RNA, 22 nt, Shigella flexneri 2a str. 2457T
aacccagcggaugacccagcgc

SEQ ID NO: 3860208 - RNA, 20 nt, Shigella flexneri 2a str. 2457T
aacccaugccggaugcgcca

SEQ ID NO: 3860209 - RNA, 22 nt, Shigella flexneri 2a str. 2457T
aacccgaaggaauuuuacagcc

SEQ ID NO: 3860210 - RNA, 19 nt, Shigella flexneri 2a str. 2457T
aacccgcagccgccagaaa

SEQ ID NO: 3860211 - RNA, 15 nt, Shigella flexneri 2a str. 2457T
aacccgcgaauauca

SEQ ID NO: 3860212 - RNA, 15 nt, Shigella flexneri 2a str. 2457T
aacccggucccuuca

SEQ ID NO: 3860213 - RNA, 22 nt, Shigella flexneri 2a str. 2457T
aacccguauguucccaccagcc

SEQ ID NO: 3860214 - RNA, 23 nt, Shigella flexneri 2a str. 2457T
aacccgucugguuugggcaugau

SEQ ID NO: 3860215 - RNA, 22 nt, Shigella flexneri 2a str. 2457T
aacccuaaagcacccagcaauc

SEQ ID NO: 3860216 - RNA, 15 nt, Shigella flexneri 2a str. 2457T
aacccuaccagcugc

SEQ ID NO: 3860217 - RNA, 16 nt, Shigella flexneri 2a str. 2457T
aacccucuccccaagg

SEQ ID NO: 3860218 - RNA, 19 nt, Shigella flexneri 2a str. 2457T
aacccugagcgguuaacac

SEQ ID NO: 3860219 - RNA, 21 nt, Shigella flexneri 2a str. 2457T
aacccuucaagaauuaaaaua

SEQ ID NO: 3860220 - RNA, 18 nt, Shigella flexneri 2a str. 2457T
aacccuugcguuucugac

SEQ ID NO: 3860221 - RNA, 19 nt, Shigella flexneri 2a str. 2457T
aacccuuuuuuaaacauua

SEQ ID NO: 3860222 - RNA, 14 nt, Shigella flexneri 2a str. 2457T
aaccgaaggcacca

SEQ ID NO: 3860223 - RNA, 19 nt, Shigella flexneri 2a str. 2457T
aaccgaauucaaauccuuc

SEQ ID NO: 3860224 - RNA, 13 nt, Shigella flexneri 2a str. 2457T
aaccgacugccau

SEQ ID NO: 3860225 - RNA, 14 nt, Shigella flexneri 2a str. 2457T
aaccgagcagauac

SEQ ID NO: 3860226 - RNA, 18 nt, Shigella flexneri 2a str. 2457T
aaccgaguuaguccacac

SEQ ID NO: 3860227 - RNA, 15 nt, Shigella flexneri 2a str. 2457T
aaccgcaaaugauua

SEQ ID NO: 3860228 - RNA, 21 nt, Shigella flexneri 2a str. 2457T
aaccgcagugauuucaaccgg

SEQ ID NO: 3860229 - RNA, 17 nt, Shigella flexneri 2a str. 2457T
aacgcagcuccgggcuc

SEQ ID NO: 3860230 - RNA, 17 nt, Shigella flexneri 2a str. 2457T
aacgcagucuucccagc

SEQ ID NO: 3860231 - RNA, 16 nt, Shigella flexneri 2a str. 2457T
aacgcaugcacaucca

SEQ ID NO: 3860232 - RNA, 13 nt, Shigella flexneri 2a str. 2457T
aacgccaaauucu

SEQ ID NO: 3860233 - RNA, 22 nt, Shigella flexneri 2a str. 2457T
aacgccaauucauuccuugaaa

SEQ ID NO: 3860234 - RNA, 15 nt, Shigella flexneri 2a str. 2457T
aacgccacgcucacu

SEQ ID NO: 3860235 - RNA, 17 nt, Shigella flexneri 2a str. 2457T
aacgccacgcucacuca

SEQ ID NO: 3860236 - RNA, 13 nt, Shigella flexneri 2a str. 2457T
aacgccagacucg

SEQ ID NO: 3860237 - RNA, 13 nt, Shigella flexneri 2a str. 2457T
aacgccagcagca

SEQ ID NO: 3860238 - RNA, 20 nt, Shigella flexneri 2a str. 2457T
aacgccagccuguuccagac

SEQ ID NO: 3860239 - RNA, 23 nt, Shigella flexneri 2a str. 2457T
aacgccauauucugaucgugcuc

SEQ ID NO: 3860240 - RNA, 15 nt, Shigella flexneri 2a str. 2457T
aacgccaucgccagg

SEQ ID NO: 3860241 - RNA, 22 nt, Shigella flexneri 2a str. 2457T
aacgcccagcuaaucgagccga

SEQ ID NO: 3860242 - RNA, 22 nt, Shigella flexneri 2a str. 2457T
aacgcccaugcguugucgccau

SEQ ID NO: 3860243 - RNA, 23 nt, Shigella flexneri 2a str. 2457T
aacgcccaugcguugucgccauc

SEQ ID NO: 3860244 - RNA, 15 nt, Shigella flexneri 2a str. 2457T
aacgccccaauccac

SEQ ID NO: 3860245 - RNA, 18 nt, Shigella flexneri 2a str. 2457T
aacgccccuucugccgca

SEQ ID NO: 3860246 - RNA, 17 nt, Shigella flexneri 2a str. 2457T
aacgcccgcuuucacca

SEQ ID NO: 3860247 - RNA, 16 nt, Shigella flexneri 2a str. 2457T
aacgccgccaguacgc

SEQ ID NO: 3860248 - RNA, 21 nt, Shigella flexneri 2a str. 2457T
aacgccggaaaacguuucaaa

SEQ ID NO: 3860249 - RNA, 20 nt, Shigella flexneri 2a str. 2457T
aacgccggagugaaaauucu

SEQ ID NO: 3860250 - RNA, 19 nt, Shigella flexneri 2a str. 2457T
aacgccggaugacacauca

SEQ ID NO: 3860251 - RNA, 15 nt, Shigella flexneri 2a str. 2457T
aacgccggguaaaug

SEQ ID NO: 3860252 - RNA, 14 nt, Shigella flexneri 2a str. 2457T
aacgccgucaucac

SEQ ID NO: 3860253 - RNA, 20 nt, Shigella flexneri 2a str. 2457T
aacgccgucaucacaccgcg

SEQ ID NO: 3860254 - RNA, 22 nt, Shigella flexneri 2a str. 2457T
aacgccguuauuaaaaagccug

SEQ ID NO: 3860255 - RNA, 14 nt, Shigella flexneri 2a str. 2457T
aacgccuaauaaau

SEQ ID NO: 3860256 - RNA, 16 nt, Shigella flexneri 2a str. 2457T
aacgccuaauccagcc

SEQ ID NO: 3860257 - RNA, 20 nt, Shigella flexneri 2a str. 2457T
aacgccuaauccagccuaca

SEQ ID NO: 3860258 - RNA, 15 nt, Shigella flexneri 2a str. 2457T
aacgccuaaugccag

SEQ ID NO: 3860259 - RNA, 17 nt, Shigella flexneri 2a str. 2457T
aacgccugcucuuauua

SEQ ID NO: 3860260 - RNA, 12 nt, Shigella flexneri 2a str. 2457T
aacgccugggca

SEQ ID NO: 3860261 - RNA, 22 nt, Shigella flexneri 2a str. 2457T
aacgccugggcgagguggauau

SEQ ID NO: 3860262 - RNA, 14 nt, Shigella flexneri 2a str. 2457T
aacgccuguguccu

SEQ ID NO: 3860263 - RNA, 20 nt, Shigella flexneri 2a str. 2457T
aacgccuuauccagccuaca

SEQ ID NO: 3860264 - RNA, 16 nt, Shigella flexneri 2a str. 2457T
aacgccuuauccggcc

SEQ ID NO: 3860265 - RNA, 15 nt, Shigella flexneri 2a str. 2457T
aacgcgaaggccaga

SEQ ID NO: 3860266 - RNA, 17 nt, Shigella flexneri 2a str. 2457T
aacgcgcaaccagcagg

SEQ ID NO: 3860267 - RNA, 19 nt, Shigella flexneri 2a str. 2457T
aacgcgcaccgugacagua

SEQ ID NO: 3860268 - RNA, 17 nt, Shigella flexneri 2a str. 2457T
aacgcgguugccagaua

SEQ ID NO: 3860269 - RNA, 19 nt, Shigella flexneri 2a str. 2457T
aacgcgucuuaucuggccu

SEQ ID NO: 3860270 - RNA, 16 nt, Shigella flexneri 2a str. 2457T
aacgcguucacugccg

SEQ ID NO: 3860271 - RNA, 19 nt, Shigella flexneri 2a str. 2457T
aacgcuaugacgcccuaca

SEQ ID NO: 3860272 - RNA, 15 nt, Shigella flexneri 2a str. 2457T
aacgcugaauggcga

SEQ ID NO: 3860273 - RNA, 16 nt, Shigella flexneri 2a str. 2457T
aacgcugacauauuuu

SEQ ID NO: 3860274 - RNA, 12 nt, Shigella flexneri 2a str. 2457T
aacgcuggcagg

SEQ ID NO: 3860275 - RNA, 21 nt, Shigella flexneri 2a str. 2457T
aacgcugugcguaaucgccga

SEQ ID NO: 3860276 - RNA, 17 nt, Shigella flexneri 2a str. 2457T
aacgcuuaaaacgcucg

SEQ ID NO: 3860277 - RNA, 22 nt, Shigella flexneri 2a str. 2457T
aacgcuucucccagccgcccug

SEQ ID NO: 3860278 - RNA, 20 nt, Shigella flexneri 2a str. 2457T
aacgcuuuacucaacucccc

SEQ ID NO: 3860279 - RNA, 23 nt, Shigella flexneri 2a str. 2457T
aacgcuuucuuuggcaucaauca

SEQ ID NO: 3860280 - RNA, 19 nt, Shigella flexneri 2a str. 2457T
aacgcuuuuuugagcagca

SEQ ID NO: 3860281 - RNA, 15 nt, Shigella flexneri 2a str. 2457T
aacggaacgaaaaaa

SEQ ID NO: 3860282 - RNA, 17 nt, Shigella flexneri 2a str. 2457T
aacggaacgaaaaaaau

SEQ ID NO: 3860283 - RNA, 22 nt, Shigella flexneri 2a str. 2457T
aacggaacguugccugauuuua

SEQ ID NO: 3860284 - RNA, 20 nt, Shigella flexneri 2a str. 2457T
aacggaccaauaaacgccag

SEQ ID NO: 3860285 - RNA, 14 nt, Shigella flexneri 2a str. 2457T
aacggacccgcgau

SEQ ID NO: 3860286 - RNA, 17 nt, Shigella flexneri 2a str. 2457T
aacggacgagucgcuuc

SEQ ID NO: 3860287 - RNA, 20 nt, Shigella flexneri 2a str. 2457T
aacggaguugagguuuuuga

SEQ ID NO: 3860288 - RNA, 21 nt, Shigella flexneri 2a str. 2457T
aacggauaugauuuaaaaaau

SEQ ID NO: 3860289 - RNA, 16 nt, Shigella flexneri 2a str. 2457T
aacggcacgaugagca

SEQ ID NO: 3860290 - RNA, 19 nt, Shigella flexneri 2a str. 2457T
aacggcacggaaagcagca

SEQ ID NO: 3860291 - RNA, 17 nt, Shigella flexneri 2a str. 2457T
aacggcagaagcugcag

SEQ ID NO: 3860292 - RNA, 22 nt, Shigella flexneri 2a str. 2457T
aacggcagaguuguucugcgac

SEQ ID NO: 3860293 - RNA, 12 nt, Shigella flexneri 2a str. 2457T
aacggcgaaaaa

SEQ ID NO: 3860294 - RNA, 16 nt, Shigella flexneri 2a str. 2457T
aacggcgagccagcgc

SEQ ID NO: 3860295 - RNA, 21 nt, Shigella flexneri 2a str. 2457T
aacggcgaugcuuugaccucc

SEQ ID NO: 3860296 - RNA, 18 nt, Shigella flexneri 2a str. 2457T
aacggcgcaccagaauac

SEQ ID NO: 3860297 - RNA, 21 nt, Shigella flexneri 2a str. 2457T
aacggcgcauugccagagccc

SEQ ID NO: 3860298 - RNA, 12 nt, Shigella flexneri 2a str. 2457T
aacggcggauga

SEQ ID NO: 3860299 - RNA, 12 nt, Shigella flexneri 2a str. 2457T
aacggcggcuug

SEQ ID NO: 3860300 - RNA, 14 nt, Shigella flexneri 2a str. 2457T
aacggcuaaagccg

SEQ ID NO: 3860301 - RNA, 20 nt, Shigella flexneri 2a str. 2457T
aacggcucacgcccaucagc

SEQ ID NO: 3860302 - RNA, 18 nt, Shigella flexneri 2a str. 2457T
aacggcugcuucggucag

SEQ ID NO: 3860303 - RNA, 18 nt, Shigella flexneri 2a str. 2457T
aacggcugggaaaucacc

SEQ ID NO: 3860304 - RNA, 16 nt, Shigella flexneri 2a str. 2457T
aacgggaaacgauacc

SEQ ID NO: 3860305 - RNA, 21 nt, Shigella flexneri 2a str. 2457T
aacgggcauggugucaccacc

SEQ ID NO: 3860306 - RNA, 19 nt, Shigella flexneri 2a str. 2457T
aacgggcggcguugaccac

SEQ ID NO: 3860307 - RNA, 14 nt, Shigella flexneri 2a str. 2457T
aacgggugauuaaa

SEQ ID NO: 3860308 - RNA, 20 nt, Shigella flexneri 2a str. 2457T
aacggguugcgguuucaacu

SEQ ID NO: 3860309 - RNA, 14 nt, Shigella flexneri 2a str. 2457T
aacgguaaggacaa

SEQ ID NO: 3860310 - RNA, 22 nt, Shigella flexneri 2a str. 2457T
aacggucauucgacgcgcgcac

SEQ ID NO: 3860311 - RNA, 19 nt, Shigella flexneri 2a str. 2457T
aacgguccggcauccagcc

SEQ ID NO: 3860312 - RNA, 12 nt, Shigella flexneri 2a str. 2457T
aacggucgcgga

SEQ ID NO: 3860313 - RNA, 21 nt, Shigella flexneri 2a str. 2457T
aacggucgugcgagauaacca

SEQ ID NO: 3860314 - RNA, 23 nt, Shigella flexneri 2a str. 2457T
aacggugccauugaccagcugcc

SEQ ID NO: 3860315 - RNA, 14 nt, Shigella flexneri 2a str. 2457T
aacgguuaacaguu

SEQ ID NO: 3860316 - RNA, 17 nt, Shigella flexneri 2a str. 2457T
aacgguucggcaaucca

SEQ ID NO: 3860317 - RNA, 22 nt, Shigella flexneri 2a str. 2457T
aacgguucuuuggucaggcgcu

SEQ ID NO: 3860318 - RNA, 20 nt, Shigella flexneri 2a str. 2457T
aacgguuuauccccaaggau

SEQ ID NO: 3860319 - RNA, 13 nt, Shigella flexneri 2a str. 2457T
aacgguuucagca

SEQ ID NO: 3860320 - RNA, 22 nt, Shigella flexneri 2a str. 2457T
aacguaggcaauuggcgcauca

SEQ ID NO: 3860321 - RNA, 17 nt, Shigella flexneri 2a str. 2457T
aacguaucuggugucag

SEQ ID NO: 3860322 - RNA, 20 nt, Shigella flexneri 2a str. 2457T
aacgucaggugagcgucauu

SEQ ID NO: 3860323 - RNA, 17 nt, Shigella flexneri 2a str. 2457T
aacguccgguuaaaucg

SEQ ID NO: 3860324 - RNA, 22 nt, Shigella flexneri 2a str. 2457T
aacgucggaaaccgcuuugcca

SEQ ID NO: 3860325 - RNA, 16 nt, Shigella flexneri 2a str. 2457T
aacgucgguuucauca

SEQ ID NO: 3860326 - RNA, 17 nt, Shigella flexneri 2a str. 2457T
aacuggguuaucgccuu

SEQ ID NO: 3860327 - RNA, 15 nt, Shigella flexneri 2a str. 2457T
aacuggucaucaaau

SEQ ID NO: 3860328 - RNA, 22 nt, Shigella flexneri 2a str. 2457T
aacugguccagccccugaagcg

SEQ ID NO: 3860329 - RNA, 16 nt, Shigella flexneri 2a str. 2457T
aacugguguaagucgg

SEQ ID NO: 3860330 - RNA, 13 nt, Shigella flexneri 2a str. 2457T
aacuguacaggcu

SEQ ID NO: 3860331 - RNA, 15 nt, Shigella flexneri 2a str. 2457T
aacuguaccagcaac

SEQ ID NO: 3860332 - RNA, 16 nt, Shigella flexneri 2a str. 2457T
aacugucaauaaacgc

SEQ ID NO: 3860333 - RNA, 18 nt, Shigella flexneri 2a str. 2457T
aacugucaauaaacgccu

SEQ ID NO: 3860334 - RNA, 18 nt, Shigella flexneri 2a str. 2457T
aacugugcacccgcuuca

SEQ ID NO: 3860335 - RNA, 13 nt, Shigella flexneri 2a str. 2457T
aacuguuccaacu

SEQ ID NO: 3860336 - RNA, 23 nt, Shigella flexneri 2a str. 2457T
aacuguuucaccauuugugcaua

SEQ ID NO: 3860337 - RNA, 23 nt, Shigella flexneri 2a str. 2457T
aacuguuucgcgguaaacugcau

SEQ ID NO: 3860338 - RNA, 12 nt, Shigella flexneri 2a str. 2457T
aacuuaagucuc

SEQ ID NO: 3860339 - RNA, 14 nt, Shigella flexneri 2a str. 2457T
aacuuaaugucaua

SEQ ID NO: 3860340 - RNA, 15 nt, Shigella flexneri 2a str. 2457T
aacuuaucaucaggc

SEQ ID NO: 3860341 - RNA, 20 nt, Shigella flexneri 2a str. 2457T
aacuuaucaucaggcgaagg

SEQ ID NO: 3860342 - RNA, 14 nt, Shigella flexneri 2a str. 2457T
aacuuaucuguaau

SEQ ID NO: 3860343 - RNA, 17 nt, Shigella flexneri 2a str. 2457T
aacuucacaucaccaua

SEQ ID NO: 3860344 - RNA, 22 nt, Shigella flexneri 2a str. 2457T
aacuucacaucaccauagccua

SEQ ID NO: 3860345 - RNA, 14 nt, Shigella flexneri 2a str. 2457T
aacuucaccagcac

SEQ ID NO: 3860346 - RNA, 13 nt, Shigella flexneri 2a str. 2457T
aacuucaucagca

SEQ ID NO: 3860347 - RNA, 16 nt, Shigella flexneri 2a str. 2457T
aacuuccggcagaaau

SEQ ID NO: 3860348 - RNA, 16 nt, Shigella flexneri 2a str. 2457T
aacuucgcguuguaua

SEQ ID NO: 3860349 - RNA, 16 nt, Shigella flexneri 2a str. 2457T
aacuucgguuaccaca

SEQ ID NO: 3860350 - RNA, 19 nt, Shigella flexneri 2a str. 2457T
aacuucucuucuuccgcuu

SEQ ID NO: 3860351 - RNA, 21 nt, Shigella flexneri 2a str. 2457T
aacuucuuuuucgacaaacac

SEQ ID NO: 3860352 - RNA, 17 nt, Shigella flexneri 2a str. 2457T
aacuugacucgccugaa

SEQ ID NO: 3860353 - RNA, 18 nt, Shigella flexneri 2a str. 2457T
aacuugauagaacaaaag

SEQ ID NO: 3860354 - RNA, 19 nt, Shigella flexneri 2a str. 2457T
aacuugugcucguguugca

SEQ ID NO: 3860355 - RNA, 15 nt, Shigella flexneri 2a str. 2457T
aacuuuaagcugaaa

SEQ ID NO: 3860356 - RNA, 16 nt, Shigella flexneri 2a str. 2457T
aacuuuaagcugaaaa

SEQ ID NO: 3860357 - RNA, 17 nt, Shigella flexneri 2a str. 2457T
aacuuuagucgcccauu

SEQ ID NO: 3860358 - RNA, 14 nt, Shigella flexneri 2a str. 2457T
aacuuuucaacaaa

SEQ ID NO: 3860359 - RNA, 19 nt, Shigella flexneri 2a str. 2457T
aagaaaaaacuaacagugu

SEQ ID NO: 3860360 - RNA, 21 nt, Shigella flexneri 2a str. 2457T
aagaaaaaaugaccggccagc

SEQ ID NO: 3860361 - RNA, 14 nt, Shigella flexneri 2a str. 2457T
aagaaaaauauaaa

SEQ ID NO: 3860362 - RNA, 16 nt, Shigella flexneri 2a str. 2457T
aagaaaacguuucaac

SEQ ID NO: 3860363 - RNA, 17 nt, Shigella flexneri 2a str. 2457T
aagaaacgccaucugaa

SEQ ID NO: 3860364 - RNA, 19 nt, Shigella flexneri 2a str. 2457T
aagaaaguggcaggcucau

SEQ ID NO: 3860365 - RNA, 17 nt, Shigella flexneri 2a str. 2457T
aagaaauccacaaauuc

SEQ ID NO: 3860366 - RNA, 15 nt, Shigella flexneri 2a str. 2457T
aagaaauuauucaug

SEQ ID NO: 3860367 - RNA, 23 nt, Shigella flexneri 2a str. 2457T
aagaacaccagagccugccaaug

SEQ ID NO: 3860368 - RNA, 19 nt, Shigella flexneri 2a str. 2457T
aagaacagccuuaaacuca

SEQ ID NO: 3860369 - RNA, 11 nt, Shigella flexneri 2a str. 2457T
aagaaccaugc

SEQ ID NO: 3860370 - RNA, 14 nt, Shigella flexneri 2a str. 2457T
aagaacgaguaaaa

SEQ ID NO: 3860371 - RNA, 16 nt, Shigella flexneri 2a str. 2457T
aagaacgccauaaaag

SEQ ID NO: 3860372 - RNA, 18 nt, Shigella flexneri 2a str. 2457T
aagaacuauuaguuuguu

SEQ ID NO: 3860373 - RNA, 21 nt, Shigella flexneri 2a str. 2457T
aagaacuccggcgcguugaug

SEQ ID NO: 3860374 - RNA, 14 nt, Shigella flexneri 2a str. 2457T
aagaacuccugaaa

SEQ ID NO: 3860375 - RNA, 19 nt, Shigella flexneri 2a str. 2457T
aagaacucgaggauaaauu

SEQ ID NO: 3860376 - RNA, 22 nt, Shigella flexneri 2a str. 2457T
aagaacucgaggauaaauuuuc

SEQ ID NO: 3860377 - RNA, 12 nt, Shigella flexneri 2a str. 2457T
aagaacugacuu

SEQ ID NO: 3860378 - RNA, 12 nt, Shigella flexneri 2a str. 2457T
aagaagaaguuu

SEQ ID NO: 3860379 - RNA, 22 nt, Shigella flexneri 2a str. 2457T
aagaagaucguggagaacaaua

SEQ ID NO: 3860380 - RNA, 18 nt, Shigella flexneri 2a str. 2457T
aagaagccgccagaccga

SEQ ID NO: 3860381 - RNA, 19 nt, Shigella flexneri 2a str. 2457T
aagaagcggugaaaaaauu

SEQ ID NO: 3860382 - RNA, 13 nt, Shigella flexneri 2a str. 2457T
aagaaggaaaaua

SEQ ID NO: 3860383 - RNA, 14 nt, Shigella flexneri 2a str. 2457T
aagaaggaaaauac

SEQ ID NO: 3860384 - RNA, 15 nt, Shigella flexneri 2a str. 2457T
aagaaggcauaacuc

SEQ ID NO: 3860385 - RNA, 20 nt, Shigella flexneri 2a str. 2457T
aagaaguaaaacagucgcuc

SEQ ID NO: 3860386 - RNA, 14 nt, Shigella flexneri 2a str. 2457T
aagaagucucugaa

SEQ ID NO: 3860387 - RNA, 16 nt, Shigella flexneri 2a str. 2457T
aagaagucucugaaau

SEQ ID NO: 3860388 - RNA, 21 nt, Shigella flexneri 2a str. 2457T
aagaaguuccagggcagcagu

SEQ ID NO: 3860389 - RNA, 14 nt, Shigella flexneri 2a str. 2457T
aagaauacagcauu

SEQ ID NO: 3860390 - RNA, 20 nt, Shigella flexneri 2a str. 2457T
aagaauacagggaaagaagu

SEQ ID NO: 3860391 - RNA, 14 nt, Shigella flexneri 2a str. 2457T
aagaaucaugccaa

SEQ ID NO: 3860392 - RNA, 17 nt, Shigella flexneri 2a str. 2457T
aagaaucaugccaaaaa

SEQ ID NO: 3860393 - RNA, 16 nt, Shigella flexneri 2a str. 2457T
aagaaugacacuuuca

SEQ ID NO: 3860394 - RNA, 15 nt, Shigella flexneri 2a str. 2457T
aagaaugccugccag

SEQ ID NO: 3860395 - RNA, 21 nt, Shigella flexneri 2a str. 2457T
aagaauguccauuauuucaau

SEQ ID NO: 3860396 - RNA, 14 nt, Shigella flexneri 2a str. 2457T
aagaauuaaaauau

SEQ ID NO: 3860397 - RNA, 21 nt, Shigella flexneri 2a str. 2457T
aagaauuaaaauaucaggcug

SEQ ID NO: 3860398 - RNA, 17 nt, Shigella flexneri 2a str. 2457T
aagaauugauaaaaaaa

SEQ ID NO: 3860399 - RNA, 22 nt, Shigella flexneri 2a str. 2457T
aagaauugcagauaccacauca

SEQ ID NO: 3860400 - RNA, 23 nt, Shigella flexneri 2a str. 2457T
aagaauuuuauacuuuuucgcca

SEQ ID NO: 3860401 - RNA, 12 nt, Shigella flexneri 2a str. 2457T
aagaauuuuugc

SEQ ID NO: 3860402 - RNA, 14 nt, Shigella flexneri 2a str. 2457T
aagacaauuuaccg

SEQ ID NO: 3860403 - RNA, 20 nt, Shigella flexneri 2a str. 2457T
aagacacuaacgcgucuuau

SEQ ID NO: 3860404 - RNA, 20 nt, Shigella flexneri 2a str. 2457T
aagacacugacgcgucuuau

SEQ ID NO: 3860405 - RNA, 17 nt, Shigella flexneri 2a str. 2457T
aagacagcgucacauca

SEQ ID NO: 3860406 - RNA, 18 nt, Shigella flexneri 2a str. 2457T
aagacaucaauaaacaau

SEQ ID NO: 3860407 - RNA, 21 nt, Shigella flexneri 2a str. 2457T
aagacaucgcccgauucacau

SEQ ID NO: 3860408 - RNA, 22 nt, Shigella flexneri 2a str. 2457T
aagaccaauccgccagccaauu

SEQ ID NO: 3860409 - RNA, 17 nt, Shigella flexneri 2a str. 2457T
aagaccaggaaacccaa

SEQ ID NO: 3860410 - RNA, 20 nt, Shigella flexneri 2a str. 2457T
aagaccugccgggcugaugc

SEQ ID NO: 3860411 - RNA, 14 nt, Shigella flexneri 2a str. 2457T
aagacgaaaaauga

SEQ ID NO: 3860412 - RNA, 21 nt, Shigella flexneri 2a str. 2457T
aagacgcgaccagcgucgcau

SEQ ID NO: 3860413 - RNA, 19 nt, Shigella flexneri 2a str. 2457T
aagacgcgcagcgucgcau

SEQ ID NO: 3860414 - RNA, 20 nt, Shigella flexneri 2a str. 2457T
aagacgcgccagcgucgcau

SEQ ID NO: 3860415 - RNA, 20 nt, Shigella flexneri 2a str. 2457T
aagacgcggcagcgucgcau

SEQ ID NO: 3860416 - RNA, 21 nt, Shigella flexneri 2a str. 2457T
aagacgcguaaagcgucgcau

SEQ ID NO: 3860417 - RNA, 14 nt, Shigella flexneri 2a str. 2457T
aagacgcgucaagc

SEQ ID NO: 3860418 - RNA, 17 nt, Shigella flexneri 2a str. 2457T
aagacgugcgccacaac

SEQ ID NO: 3860419 - RNA, 18 nt, Shigella flexneri 2a str. 2457T
aagacguuaaaaaaggug

SEQ ID NO: 3860420 - RNA, 18 nt, Shigella flexneri 2a str. 2457T
aagacguucacgucgcau

SEQ ID NO: 3860421 - RNA, 17 nt, Shigella flexneri 2a str. 2457T
aagacguugauucacuu

SEQ ID NO: 3860422 - RNA, 14 nt, Shigella flexneri 2a str. 2457T
aagacugaugacaa

SEQ ID NO: 3860423 - RNA, 15 nt, Shigella flexneri 2a str. 2457T
aagacuguaaauacu

SEQ ID NO: 3860424 - RNA, 16 nt, Shigella flexneri 2a str. 2457T
aagccaagcgccgccu

SEQ ID NO: 3860425 - RNA, 18 nt, Shigella flexneri 2a str. 2457T
aagccaagcgccgccuca

SEQ ID NO: 3860426 - RNA, 19 nt, Shigella flexneri 2a str. 2457T
aagccacaaucgcagcgca

SEQ ID NO: 3860427 - RNA, 20 nt, Shigella flexneri 2a str. 2457T
aagccacaaucgcagcgcaa

SEQ ID NO: 3860428 - RNA, 20 nt, Shigella flexneri 2a str. 2457T
aagccaccgaacaaaacagc

SEQ ID NO: 3860429 - RNA, 13 nt, Shigella flexneri 2a str. 2457T
aagccacgccgaa

SEQ ID NO: 3860430 - RNA, 21 nt, Shigella flexneri 2a str. 2457T
aagccacgcuugcuaacgccc

SEQ ID NO: 3860431 - RNA, 14 nt, Shigella flexneri 2a str. 2457T
aagccagaauuaau

SEQ ID NO: 3860432 - RNA, 15 nt, Shigella flexneri 2a str. 2457T
aagccagcauacagc

SEQ ID NO: 3860433 - RNA, 14 nt, Shigella flexneri 2a str. 2457T
aagccagguuuuga

SEQ ID NO: 3860434 - RNA, 21 nt, Shigella flexneri 2a str. 2457T
aagccagucacaucagcgauc

SEQ ID NO: 3860435 - RNA, 14 nt, Shigella flexneri 2a str. 2457T
aagccaucccugua

SEQ ID NO: 3860436 - RNA, 13 nt, Shigella flexneri 2a str. 2457T
aagccaugcccgu

SEQ ID NO: 3860437 - RNA, 21 nt, Shigella flexneri 2a str. 2457T
aagccaugcccgugcugacag

SEQ ID NO: 3860438 - RNA, 20 nt, Shigella flexneri 2a str. 2457T
aagccauguuuaacuccuuc

SEQ ID NO: 3860439 - RNA, 18 nt, Shigella flexneri 2a str. 2457T
aagcccacgccgcccaga

SEQ ID NO: 3860440 - RNA, 11 nt, Shigella flexneri 2a str. 2457T
aagcccagaac

SEQ ID NO: 3860441 - RNA, 14 nt, Shigella flexneri 2a str. 2457T
aagcccagcgacug

SEQ ID NO: 3860442 - RNA, 15 nt, Shigella flexneri 2a str. 2457T
aagcccauaccacag

SEQ ID NO: 3860443 - RNA, 18 nt, Shigella flexneri 2a str. 2457T
aagcccauaccacagcaa

SEQ ID NO: 3860444 - RNA, 21 nt, Shigella flexneri 2a str. 2457T
aagcccaucaguacaccaccu

SEQ ID NO: 3860445 - RNA, 19 nt, Shigella flexneri 2a str. 2457T
aagcccccgcaacauugcg

SEQ ID NO: 3860446 - RNA, 15 nt, Shigella flexneri 2a str. 2457T
aagccccguagccau

SEQ ID NO: 3860447 - RNA, 17 nt, Shigella flexneri 2a str. 2457T
aagccccguagccauga

SEQ ID NO: 3860448 - RNA, 12 nt, Shigella flexneri 2a str. 2457T
aagcccgccauc

SEQ ID NO: 3860449 - RNA, 14 nt, Shigella flexneri 2a str. 2457T
aagcccgccaucgc

SEQ ID NO: 3860450 - RNA, 18 nt, Shigella flexneri 2a str. 2457T
aagcccgccaucgcccau

SEQ ID NO: 3860451 - RNA, 18 nt, Shigella flexneri 2a str. 2457T
aagccgaagcugucagaa

SEQ ID NO: 3860452 - RNA, 13 nt, Shigella flexneri 2a str. 2457T
aagccgccaaacg

SEQ ID NO: 3860453 - RNA, 23 nt, Shigella flexneri 2a str. 2457T
aagccgccacgaccugcagaaaa

SEQ ID NO: 3860454 - RNA, 22 nt, Shigella flexneri 2a str. 2457T
aagccgccagaccgacauuaau

SEQ ID NO: 3860455 - RNA, 20 nt, Shigella flexneri 2a str. 2457T
aagccgccgguagucaccgc

SEQ ID NO: 3860456 - RNA, 17 nt, Shigella flexneri 2a str. 2457T
aagccgcuaacagcagc

SEQ ID NO: 3860457 - RNA, 18 nt, Shigella flexneri 2a str. 2457T
aagccgcuaacagcagca

SEQ ID NO: 3860458 - RNA, 23 nt, Shigella flexneri 2a str. 2457T
aagccgcuaacagcagcagcgca

SEQ ID NO: 3860459 - RNA, 16 nt, Shigella flexneri 2a str. 2457T
aagccggaauuuuccu

SEQ ID NO: 3860460 - RNA, 17 nt, Shigella flexneri 2a str. 2457T
aagccggaugaucaucc

SEQ ID NO: 3860461 - RNA, 14 nt, Shigella flexneri 2a str. 2457T
aagccggugaacgu

SEQ ID NO: 3860462 - RNA, 18 nt, Shigella flexneri 2a str. 2457T
aagccgucccuaccggua

SEQ ID NO: 3860463 - RNA, 18 nt, Shigella flexneri 2a str. 2457T
aagccgucgagggccuga

SEQ ID NO: 3860464 - RNA, 18 nt, Shigella flexneri 2a str. 2457T
aagccguuagucaucauc

SEQ ID NO: 3860465 - RNA, 22 nt, Shigella flexneri 2a str. 2457T
aagccguuagucaucaucagga

SEQ ID NO: 3860466 - RNA, 17 nt, Shigella flexneri 2a str. 2457T
aagccuaagaagucauu

SEQ ID NO: 3860467 - RNA, 12 nt, Shigella flexneri 2a str. 2457T
aagccugacagg

SEQ ID NO: 3860468 - RNA, 23 nt, Shigella flexneri 2a str. 2457T
aagccugagcucuaguuaaccaa

SEQ ID NO: 3860469 - RNA, 15 nt, Shigella flexneri 2a str. 2457T
aagccugauaagcgu

SEQ ID NO: 3860470 - RNA, 23 nt, Shigella flexneri 2a str. 2457T
aagccugcccgugggcaggccug

SEQ ID NO: 3860471 - RNA, 18 nt, Shigella flexneri 2a str. 2457T
aagccuuccgcaaacagg

SEQ ID NO: 3860472 - RNA, 22 nt, Shigella flexneri 2a str. 2457T
aagccuucgccuuucaguucaa

SEQ ID NO: 3860473 - RNA, 16 nt, Shigella flexneri 2a str. 2457T
aagccuuuuaccgccu

SEQ ID NO: 3860474 - RNA, 19 nt, Shigella flexneri 2a str. 2457T
aagcgagaguuacagcucu

SEQ ID NO: 3860475 - RNA, 22 nt, Shigella flexneri 2a str. 2457T
aagcgagcaguacagccgccag

SEQ ID NO: 3860476 - RNA, 21 nt, Shigella flexneri 2a str. 2457T
aagcgaggcuuauccggcaug

SEQ ID NO: 3860477 - RNA, 21 nt, Shigella flexneri 2a str. 2457T
aagcgagguauuuucugaaac

SEQ ID NO: 3860478 - RNA, 17 nt, Shigella flexneri 2a str. 2457T
aagcgauaaaaauaccg

SEQ ID NO: 3860479 - RNA, 15 nt, Shigella flexneri 2a str. 2457T
aagcgauaaccuuca

SEQ ID NO: 3860480 - RNA, 21 nt, Shigella flexneri 2a str. 2457T
aagcgauaacgcuggcagcaa

SEQ ID NO: 3860481 - RNA, 14 nt, Shigella flexneri 2a str. 2457T
aagcgaugcugaug

SEQ ID NO: 3860482 - RNA, 17 nt, Shigella flexneri 2a str. 2457T
aagcgauucagcaccuu

SEQ ID NO: 3860483 - RNA, 16 nt, Shigella flexneri 2a str. 2457T
aagcgcaaaauaccag

SEQ ID NO: 3860484 - RNA, 15 nt, Shigella flexneri 2a str. 2457T
aagcgcacaauggcg

SEQ ID NO: 3860485 - RNA, 20 nt, Shigella flexneri 2a str. 2457T
aagcgcaccugaucagcaau

SEQ ID NO: 3860486 - RNA, 20 nt, Shigella flexneri 2a str. 2457T
aagcgcacuuuacuggucug

SEQ ID NO: 3860487 - RNA, 18 nt, Shigella flexneri 2a str. 2457T
aagcgcacuuugccagaa

SEQ ID NO: 3860488 - RNA, 22 nt, Shigella flexneri 2a str. 2457T
aagcgcacuuugucaaaaaucu

SEQ ID NO: 3860489 - RNA, 13 nt, Shigella flexneri 2a str. 2457T
aagcgcagcgcau

SEQ ID NO: 3860490 - RNA, 15 nt, Shigella flexneri 2a str. 2457T
aagcgcagcgcauca

SEQ ID NO: 3860491 - RNA, 17 nt, Shigella flexneri 2a str. 2457T
aagcgcauccggcacca

SEQ ID NO: 3860492 - RNA, 23 nt, Shigella flexneri 2a str. 2457T
aagcgccagauaugaucgaaaau

SEQ ID NO: 3860493 - RNA, 17 nt, Shigella flexneri 2a str. 2457T
aagcgccgaguaaaaaa

SEQ ID NO: 3860494 - RNA, 19 nt, Shigella flexneri 2a str. 2457T
aagcgccgaguaaaaaaac

SEQ ID NO: 3860495 - RNA, 19 nt, Shigella flexneri 2a str. 2457T
aagcgccgccucagccaga

SEQ ID NO: 3860496 - RNA, 20 nt, Shigella flexneri 2a str. 2457T
aagcgccggacauugcguuu

SEQ ID NO: 3860497 - RNA, 15 nt, Shigella flexneri 2a str. 2457T
aagcgccucaagcuc

SEQ ID NO: 3860498 - RNA, 16 nt, Shigella flexneri 2a str. 2457T
aagcgcuggggaaaau

SEQ ID NO: 3860499 - RNA, 13 nt, Shigella flexneri 2a str. 2457T
aagcggcacugcu

SEQ ID NO: 3860500 - RNA, 21 nt, Shigella flexneri 2a str. 2457T
aagcggcacugcucuuuaaca

SEQ ID NO: 3860501 - RNA, 19 nt, Shigella flexneri 2a str. 2457T
aagcggccgucagaucgcc

SEQ ID NO: 3860502 - RNA, 15 nt, Shigella flexneri 2a str. 2457T
aagcggcgcucugcc

SEQ ID NO: 3860503 - RNA, 23 nt, Shigella flexneri 2a str. 2457T
aagcggcggugucuaacgaugcc

SEQ ID NO: 3860504 - RNA, 21 nt, Shigella flexneri 2a str. 2457T
aagcggcguugcucuucuccg

SEQ ID NO: 3860505 - RNA, 15 nt, Shigella flexneri 2a str. 2457T
aagcggcguuuucag

SEQ ID NO: 3860506 - RNA, 15 nt, Shigella flexneri 2a str. 2457T
aagcggugauaaacc

SEQ ID NO: 3860507 - RNA, 18 nt, Shigella flexneri 2a str. 2457T
aagcguaauugauccgcg

SEQ ID NO: 3860508 - RNA, 22 nt, Shigella flexneri 2a str. 2457T
aagcgucaaguugacucucauc

SEQ ID NO: 3860509 - RNA, 15 nt, Shigella flexneri 2a str. 2457T
aagcgucagaaaaau

SEQ ID NO: 3860510 - RNA, 17 nt, Shigella flexneri 2a str. 2457T
aagcgucagcuuucaga

SEQ ID NO: 3860511 - RNA, 14 nt, Shigella flexneri 2a str. 2457T
aagcgucgcaucag

SEQ ID NO: 3860512 - RNA, 18 nt, Shigella flexneri 2a str. 2457T
aagcgucgcaucaggcau

SEQ ID NO: 3860513 - RNA, 15 nt, Shigella flexneri 2a str. 2457T
aagcgugcaaauaua

SEQ ID NO: 3860514 - RNA, 16 nt, Shigella flexneri 2a str. 2457T
aagcgugcaaauauac

SEQ ID NO: 3860515 - RNA, 15 nt, Shigella flexneri 2a str. 2457T
aagcguuucaucuuc

SEQ ID NO: 3860516 - RNA, 14 nt, Shigella flexneri 2a str. 2457T
aagcuccaccaguu

SEQ ID NO: 3860517 - RNA, 12 nt, Shigella flexneri 2a str. 2457T
aagcuccagcau

SEQ ID NO: 3860518 - RNA, 14 nt, Shigella flexneri 2a str. 2457T
aagcucguuguuua

SEQ ID NO: 3860519 - RNA, 18 nt, Shigella flexneri 2a str. 2457T
aagcucucuuccaguucg

SEQ ID NO: 3860520 - RNA, 23 nt, Shigella flexneri 2a str. 2457T
aagcucugguguggagugcagca

SEQ ID NO: 3860521 - RNA, 13 nt, Shigella flexneri 2a str. 2457T
aaguagccaguac

SEQ ID NO: 3860522 - RNA, 14 nt, Shigella flexneri 2a str. 2457T
aaguagccuucauc

SEQ ID NO: 3860523 - RNA, 20 nt, Shigella flexneri 2a str. 2457T
aaguagccuucaucagauga

SEQ ID NO: 3860524 - RNA, 15 nt, Shigella flexneri 2a str. 2457T
aaguagcugaaaauc

SEQ ID NO: 3860525 - RNA, 18 nt, Shigella flexneri 2a str. 2457T
aaguauggaaaucaccca

SEQ ID NO: 3860526 - RNA, 16 nt, Shigella flexneri 2a str. 2457T
aaguauguaauaacag

SEQ ID NO: 3860527 - RNA, 21 nt, Shigella flexneri 2a str. 2457T
aaguauucuuuuaauggcugg

SEQ ID NO: 3860528 - RNA, 20 nt, Shigella flexneri 2a str. 2457T
aaguauugcgcaaauguuug

SEQ ID NO: 3860529 - RNA, 15 nt, Shigella flexneri 2a str. 2457T
aaguauuugacuguu

SEQ ID NO: 3860530 - RNA, 17 nt, Shigella flexneri 2a str. 2457T
aaguauuugacuguucu

SEQ ID NO: 3860531 - RNA, 18 nt, Shigella flexneri 2a str. 2457T
aaguauuugacuguucua

SEQ ID NO: 3860532 - RNA, 18 nt, Shigella flexneri 2a str. 2457T
aagucagauaaaaaguuu

SEQ ID NO: 3860533 - RNA, 16 nt, Shigella flexneri 2a str. 2457T
aagucauuaccagcga

SEQ ID NO: 3860534 - RNA, 18 nt, Shigella flexneri 2a str. 2457T
aagucauuaccagcgagg

SEQ ID NO: 3860535 - RNA, 16 nt, Shigella flexneri 2a str. 2457T
aaguccaaaagguccu

SEQ ID NO: 3860536 - RNA, 20 nt, Shigella flexneri 2a str. 2457T
aaguccaaaagguccuucag

SEQ ID NO: 3860537 - RNA, 22 nt, Shigella flexneri 2a str. 2457T
aaguccgaggaaggcacguaca

SEQ ID NO: 3860538 - RNA, 18 nt, Shigella flexneri 2a str. 2457T
aaguccguugaaaaugcu

SEQ ID NO: 3860539 - RNA, 14 nt, Shigella flexneri 2a str. 2457T
aagucggucacagu

SEQ ID NO: 3860540 - RNA, 16 nt, Shigella flexneri 2a str. 2457T
aagucggucacagucu

SEQ ID NO: 3860541 - RNA, 15 nt, Shigella flexneri 2a str. 2457T
aagucucagaaagua

SEQ ID NO: 3860542 - RNA, 16 nt, Shigella flexneri 2a str. 2457T
aagucucagaaaguaa

SEQ ID NO: 3860543 - RNA, 15 nt, Shigella flexneri 2a str. 2457T
aagucugaaugaugu

SEQ ID NO: 3860544 - RNA, 23 nt, Shigella flexneri 2a str. 2457T
aagucuuccggugcaucaacaua

SEQ ID NO: 3860545 - RNA, 13 nt, Shigella flexneri 2a str. 2457T
aagucuuuguauu

SEQ ID NO: 3860546 - RNA, 19 nt, Shigella flexneri 2a str. 2457T
aagucuuuuuucaacuuua

SEQ ID NO: 3860547 - RNA, 20 nt, Shigella flexneri 2a str. 2457T
aagucuuuuuucaacuuuau

SEQ ID NO: 3860548 - RNA, 21 nt, Shigella flexneri 2a str. 2457T
aagucuuuuuucaacuuuauc

SEQ ID NO: 3860549 - RNA, 22 nt, Shigella flexneri 2a str. 2457T
aagucuuuuuucaacuuuaucu

SEQ ID NO: 3860550 - RNA, 19 nt, Shigella flexneri 2a str. 2457T
aagugaaaaacaccccauu

SEQ ID NO: 3860551 - RNA, 14 nt, Shigella flexneri 2a str. 2457T
aagugaagaugaau

SEQ ID NO: 3860552 - RNA, 18 nt, Shigella flexneri 2a str. 2457T
aagugagaauuuuucacu

SEQ ID NO: 3860553 - RNA, 20 nt, Shigella flexneri 2a str. 2457T
aagugagguguacuggcaau

SEQ ID NO: 3860554 - RNA, 19 nt, Shigella flexneri 2a str. 2457T
aagugauacccaucaucgc

SEQ ID NO: 3860555 - RNA, 19 nt, Shigella flexneri 2a str. 2457T
aaguggacgaacaguucaa

SEQ ID NO: 3860556 - RNA, 23 nt, Shigella flexneri 2a str. 2457T
aaguggcgcagagccugaauaaa

SEQ ID NO: 3860557 - RNA, 23 nt, Shigella flexneri 2a str. 2457T
aaguggcggggucgugcagaacg

SEQ ID NO: 3860558 - RNA, 20 nt, Shigella flexneri 2a str. 2457T
aaguggggguuuuauuuaac

SEQ ID NO: 3860559 - RNA, 18 nt, Shigella flexneri 2a str. 2457T
aagugugaugguauucau

SEQ ID NO: 3860560 - RNA, 17 nt, Shigella flexneri 2a str. 2457T
aagugugcaaacgauaa

SEQ ID NO: 3860561 - RNA, 15 nt, Shigella flexneri 2a str. 2457T
aaguguggccgccag

SEQ ID NO: 3860562 - RNA, 16 nt, Shigella flexneri 2a str. 2457T
aaguguugcaggaaaa

SEQ ID NO: 3860563 - RNA, 16 nt, Shigella flexneri 2a str. 2457T
aaguuaauccacagca

SEQ ID NO: 3860564 - RNA, 22 nt, Shigella flexneri 2a str. 2457T
aaguuauaaauaaaaagagauu

SEQ ID NO: 3860565 - RNA, 15 nt, Shigella flexneri 2a str. 2457T
aaguuaucaaguauu

SEQ ID NO: 3860566 - RNA, 20 nt, Shigella flexneri 2a str. 2457T
aaguuaucaaguauuuuuaa

SEQ ID NO: 3860567 - RNA, 23 nt, Shigella flexneri 2a str. 2457T
aaguuaucaaguauuuuuaauua

SEQ ID NO: 3860568 - RNA, 21 nt, Shigella flexneri 2a str. 2457T
aaguuauccugguacucgacu

SEQ ID NO: 3860569 - RNA, 21 nt, Shigella flexneri 2a str. 2457T
aaguucugcccugaauggugc

SEQ ID NO: 3860570 - RNA, 23 nt, Shigella flexneri 2a str. 2457T
aaguugcauuagcacaaacccag

SEQ ID NO: 3860571 - RNA, 19 nt, Shigella flexneri 2a str. 2457T
aaguugccggauguguugc

SEQ ID NO: 3860572 - RNA, 15 nt, Shigella flexneri 2a str. 2457T
aaguugcucaagcug

SEQ ID NO: 3860573 - RNA, 23 nt, Shigella flexneri 2a str. 2457T
aaguugcucaagcugaacauuuu

SEQ ID NO: 3860574 - RNA, 11 nt, Shigella flexneri 2a str. 2457T
aaguuuaaccu

SEQ ID NO: 3860575 - RNA, 22 nt, Shigella flexneri 2a str. 2457T
aaguuuaauugccauuucuggc

SEQ ID NO: 3860576 - RNA, 17 nt, Shigella flexneri 2a str. 2457T
aaguuugcuucagaaua

SEQ ID NO: 3860577 - RNA, 16 nt, Shigella flexneri 2a str. 2457T
aaguuuuuaugaguuu

SEQ ID NO: 3860578 - RNA, 18 nt, Shigella flexneri 2a str. 2457T
aaguuuuuaugaguuugg

SEQ ID NO: 3860579 - RNA, 14 nt, Shigella flexneri 2a str. 2457T
aaguuuuuucuucc

SEQ ID NO: 3860580 - RNA, 13 nt, Shigella flexneri 2a str. 2457T
aauaaaaaaagaa

SEQ ID NO: 3860581 - RNA, 14 nt, Shigella flexneri 2a str. 2457T
aauaaaaauacaua

SEQ ID NO: 3860582 - RNA, 14 nt, Shigella flexneri 2a str. 2457T
aauaaaaauugaau

SEQ ID NO: 3860583 - RNA, 14 nt, Shigella flexneri 2a str. 2457T
aauaaaacagaaac

SEQ ID NO: 3860584 - RNA, 11 nt, Shigella flexneri 2a str. 2457T
aauaaaacagg

SEQ ID NO: 3860585 - RNA, 16 nt, Shigella flexneri 2a str. 2457T
aauaaaacaggcagcu

SEQ ID NO: 3860586 - RNA, 14 nt, Shigella flexneri 2a str. 2457T
aauaaaacagggcg

SEQ ID NO: 3860587 - RNA, 14 nt, Shigella flexneri 2a str. 2457T
aauaaaacaucacc

SEQ ID NO: 3860588 - RNA, 17 nt, Shigella flexneri 2a str. 2457T
aauaaaagcauaccgga

SEQ ID NO: 3860589 - RNA, 14 nt, Shigella flexneri 2a str. 2457T
aauaaaauaucuuc

SEQ ID NO: 3860590 - RNA, 14 nt, Shigella flexneri 2a str. 2457T
aauaaaaucuauua

SEQ ID NO: 3860591 - RNA, 21 nt, Shigella flexneri 2a str. 2457T
aauaaacaaugagauauuuaa

SEQ ID NO: 3860592 - RNA, 22 nt, Shigella flexneri 2a str. 2457T
aauaaacaaugagauauuuaaa

SEQ ID NO: 3860593 - RNA, 21 nt, Shigella flexneri 2a str. 2457T
aauaaacaucagcuauucuua

SEQ ID NO: 3860594 - RNA, 22 nt, Shigella flexneri 2a str. 2457T
aauaaaccugccuuacauauca

SEQ ID NO: 3860595 - RNA, 20 nt, Shigella flexneri 2a str. 2457T
aauaaauaugggugcaauga

SEQ ID NO: 3860596 - RNA, 15 nt, Shigella flexneri 2a str. 2457T
aauaaauauuaauac

SEQ ID NO: 3860597 - RNA, 18 nt, Shigella flexneri 2a str. 2457T
aauaaauauuaauacaac

SEQ ID NO: 3860598 - RNA, 23 nt, Shigella flexneri 2a str. 2457T
aauaaauccccggcggcguucag

SEQ ID NO: 3860599 - RNA, 15 nt, Shigella flexneri 2a str. 2457T
aauaaaucuaaaaga

SEQ ID NO: 3860600 - RNA, 16 nt, Shigella flexneri 2a str. 2457T
aauaaaucuaaaagau

SEQ ID NO: 3860601 - RNA, 18 nt, Shigella flexneri 2a str. 2457T
aauaaauuugguucaauu

SEQ ID NO: 3860602 - RNA, 13 nt, Shigella flexneri 2a str. 2457T
aauaacagcgcaa

SEQ ID NO: 3860603 - RNA, 16 nt, Shigella flexneri 2a str. 2457T
aauaacaucgccagaa

SEQ ID NO: 3860604 - RNA, 15 nt, Shigella flexneri 2a str. 2457T
aauaaccaaauaaaa

SEQ ID NO: 3860605 - RNA, 20 nt, Shigella flexneri 2a str. 2457T
aauaaccaacggcgagccag

SEQ ID NO: 3860606 - RNA, 24 nt, Shigella flexneri 2a str. 2457T
aauaaccagcguuuccagcaccag

SEQ ID NO: 3860607 - RNA, 14 nt, Shigella flexneri 2a str. 2457T
aauaaccaucagcu

SEQ ID NO: 3860608 - RNA, 16 nt, Shigella flexneri 2a str. 2457T
aauaacccgcuguaaa

SEQ ID NO: 3860609 - RNA, 20 nt, Shigella flexneri 2a str. 2457T
aauaacccgcuguaaaugcu

SEQ ID NO: 3860610 - RNA, 16 nt, Shigella flexneri 2a str. 2457T
aauaaccggcacuuca

SEQ ID NO: 3860611 - RNA, 16 nt, Shigella flexneri 2a str. 2457T
aauaaccucuucgaau

SEQ ID NO: 3860612 - RNA, 18 nt, Shigella flexneri 2a str. 2457T
aauaaccugcaaaauagu

SEQ ID NO: 3860613 - RNA, 20 nt, Shigella flexneri 2a str. 2457T
aauaacgccggagagaaaaa

SEQ ID NO: 3860614 - RNA, 19 nt, Shigella flexneri 2a str. 2457T
aauaacggcucaaacugcu

SEQ ID NO: 3860615 - RNA, 21 nt, Shigella flexneri 2a str. 2457T
aauaacucuuugaugaaacau

SEQ ID NO: 3860616 - RNA, 18 nt, Shigella flexneri 2a str. 2457T
aauaacuuccugagugaa

SEQ ID NO: 3860617 - RNA, 18 nt, Shigella flexneri 2a str. 2457T
aauaagcauggacuggcu

SEQ ID NO: 3860618 - RNA, 16 nt, Shigella flexneri 2a str. 2457T
aauagcgcaaaauuau

SEQ ID NO: 3860619 - RNA, 19 nt, Shigella flexneri 2a str. 2457T
aauagcggacacuaccauu

SEQ ID NO: 3860620 - RNA, 20 nt, Shigella flexneri 2a str. 2457T
aauagcgucuacuaacgcuu

SEQ ID NO: 3860621 - RNA, 21 nt, Shigella flexneri 2a str. 2457T
aauagcgugauuguggcaauc

SEQ ID NO: 3860622 - RNA, 19 nt, Shigella flexneri 2a str. 2457T
aauagcguuaauggcagau

SEQ ID NO: 3860623 - RNA, 14 nt, Shigella flexneri 2a str. 2457T
aauagcucaaugaa

SEQ ID NO: 3860624 - RNA, 15 nt, Shigella flexneri 2a str. 2457T
aauagcuucuucaac

SEQ ID NO: 3860625 - RNA, 13 nt, Shigella flexneri 2a str. 2457T
aauagcuuuaccc

SEQ ID NO: 3860626 - RNA, 15 nt, Shigella flexneri 2a str. 2457T
aauaguaauuuugaa

SEQ ID NO: 3860627 - RNA, 21 nt, Shigella flexneri 2a str. 2457T
aauagugacagauuugauuau

SEQ ID NO: 3860628 - RNA, 14 nt, Shigella flexneri 2a str. 2457T
aauagugccgcacu

SEQ ID NO: 3860629 - RNA, 22 nt, Shigella flexneri 2a str. 2457T
aauagugccuggcugcgugagg

SEQ ID NO: 3860630 - RNA, 22 nt, Shigella flexneri 2a str. 2457T
aauaguuaucaagugcuuucau

SEQ ID NO: 3860631 - RNA, 22 nt, Shigella flexneri 2a str. 2457T
aauaguuccacuauuucaauau

SEQ ID NO: 3860632 - RNA, 20 nt, Shigella flexneri 2a str. 2457T
aauaguuuccgcuucugcuu

SEQ ID NO: 3860633 - RNA, 12 nt, Shigella flexneri 2a str. 2457T
aauauacaggcg

SEQ ID NO: 3860634 - RNA, 22 nt, Shigella flexneri 2a str. 2457T
aauauaccauggaagaaaaaua

SEQ ID NO: 3860635 - RNA, 17 nt, Shigella flexneri 2a str. 2457T
aauauauaaaaaaacaa

SEQ ID NO: 3860636 - RNA, 13 nt, Shigella flexneri 2a str. 2457T
aauauauaaagau

SEQ ID NO: 3860637 - RNA, 19 nt, Shigella flexneri 2a str. 2457T
aauauauccgaaaaaggau

SEQ ID NO: 3860638 - RNA, 22 nt, Shigella flexneri 2a str. 2457T
aauauauuccccggucagcagc

SEQ ID NO: 3860639 - RNA, 15 nt, Shigella flexneri 2a str. 2457T
aauauauucucuuuu

SEQ ID NO: 3860640 - RNA, 21 nt, Shigella flexneri 2a str. 2457T
aauauauugcaaucaucuugu

SEQ ID NO: 3860641 - RNA, 15 nt, Shigella flexneri 2a str. 2457T
aauaucaaauaaaaa

SEQ ID NO: 3860642 - RNA, 19 nt, Shigella flexneri 2a str. 2457T
aauaucaggcauucuuuuu

SEQ ID NO: 3860643 - RNA, 13 nt, Shigella flexneri 2a str. 2457T
aauaucaucauuu

SEQ ID NO: 3860644 - RNA, 14 nt, Shigella flexneri 2a str. 2457T
aauaucaucccccu

SEQ ID NO: 3860645 - RNA, 22 nt, Shigella flexneri 2a str. 2457T
aauauccaccgggguaaaucca

SEQ ID NO: 3860646 - RNA, 16 nt, Shigella flexneri 2a str. 2457T
aauauccgucacuuca

SEQ ID NO: 3860647 - RNA, 20 nt, Shigella flexneri 2a str. 2457T
aauauccgucgaaaaugauc

SEQ ID NO: 3860648 - RNA, 13 nt, Shigella flexneri 2a str. 2457T
aauauccugcgcu

SEQ ID NO: 3860649 - RNA, 16 nt, Shigella flexneri 2a str. 2457T
aauaucgacauucaau

SEQ ID NO: 3860650 - RNA, 23 nt, Shigella flexneri 2a str. 2457T
aauaucgagacgggcgaggaaau

SEQ ID NO: 3860651 - RNA, 15 nt, Shigella flexneri 2a str. 2457T
aauaucgauaucgua

SEQ ID NO: 3860652 - RNA, 18 nt, Shigella flexneri 2a str. 2457T
aauaucgcggcacagaaa

SEQ ID NO: 3860653 - RNA, 19 nt, Shigella flexneri 2a str. 2457T
aauaucgcggcacagaaac

SEQ ID NO: 3860654 - RNA, 13 nt, Shigella flexneri 2a str. 2457T
aauaucguugauu

SEQ ID NO: 3860655 - RNA, 12 nt, Shigella flexneri 2a str. 2457T
aauaucuccucu

SEQ ID NO: 3860656 - RNA, 19 nt, Shigella flexneri 2a str. 2457T
aauaucugccggaagacac

SEQ ID NO: 3860657 - RNA, 17 nt, Shigella flexneri 2a str. 2457T
aauaucuguauaaccug

SEQ ID NO: 3860658 - RNA, 23 nt, Shigella flexneri 2a str. 2457T
aauaucuuauagacuaaauuuca

SEQ ID NO: 3860659 - RNA, 12 nt, Shigella flexneri 2a str. 2457T
aauaucuuuucu

SEQ ID NO: 3860660 - RNA, 15 nt, Shigella flexneri 2a str. 2457T
aauaucuuuucuuaa

SEQ ID NO: 3860661 - RNA, 20 nt, Shigella flexneri 2a str. 2457T
aauaucuuuucuuaacaaaa

SEQ ID NO: 3860662 - RNA, 13 nt, Shigella flexneri 2a str. 2457T
aauaugaacauga

SEQ ID NO: 3860663 - RNA, 14 nt, Shigella flexneri 2a str. 2457T
aauaugcauaaacc

SEQ ID NO: 3860664 - RNA, 19 nt, Shigella flexneri 2a str. 2457T
aauaugcauaaaccggguc

SEQ ID NO: 3860665 - RNA, 14 nt, Shigella flexneri 2a str. 2457T
aauaugcauuauau

SEQ ID NO: 3860666 - RNA, 17 nt, Shigella flexneri 2a str. 2457T
aauaugcccauguucgc

SEQ ID NO: 3860667 - RNA, 23 nt, Shigella flexneri 2a str. 2457T
aauaugcggugccauuaaaccaa

SEQ ID NO: 3860668 - RNA, 20 nt, Shigella flexneri 2a str. 2457T
aauaugcugguuccugacuc

SEQ ID NO: 3860669 - RNA, 22 nt, Shigella flexneri 2a str. 2457T
aauauggugaaaguaaaaaaga

SEQ ID NO: 3860670 - RNA, 23 nt, Shigella flexneri 2a str. 2457T
aauauggugaaaguaaaaaagaa

SEQ ID NO: 3860671 - RNA, 16 nt, Shigella flexneri 2a str. 2457T
aauaugguuagagaac

SEQ ID NO: 3860672 - RNA, 21 nt, Shigella flexneri 2a str. 2457T
aauaugugaucgaauauauca

SEQ ID NO: 3860673 - RNA, 20 nt, Shigella flexneri 2a str. 2457T
aauauuaacuuaauaaacau

SEQ ID NO: 3860674 - RNA, 20 nt, Shigella flexneri 2a str. 2457T
aauauuaaggguaaaaggau

SEQ ID NO: 3860675 - RNA, 13 nt, Shigella flexneri 2a str. 2457T
aauauuaaugcug

SEQ ID NO: 3860676 - RNA, 14 nt, Shigella flexneri 2a str. 2457T
aauauuacuucaga

SEQ ID NO: 3860677 - RNA, 22 nt, Shigella flexneri 2a str. 2457T
aauauucacccgaauaccuuuc

SEQ ID NO: 3860678 - RNA, 18 nt, Shigella flexneri 2a str. 2457T
aauauucauuaaaacuga

SEQ ID NO: 3860679 - RNA, 23 nt, Shigella flexneri 2a str. 2457T
aauauucuggguaguccaugacc

SEQ ID NO: 3860680 - RNA, 21 nt, Shigella flexneri 2a str. 2457T
aauauugcacaguauagcauc

SEQ ID NO: 3860681 - RNA, 18 nt, Shigella flexneri 2a str. 2457T
aauauuguuauucgccag

SEQ ID NO: 3860682 - RNA, 14 nt, Shigella flexneri 2a str. 2457T
aauauuuaggucag

SEQ ID NO: 3860683 - RNA, 22 nt, Shigella flexneri 2a str. 2457T
aauauuucccggccagucguag

SEQ ID NO: 3860684 - RNA, 21 nt, Shigella flexneri 2a str. 2457T
aauauuuuuaucccucauauu

SEQ ID NO: 3860685 - RNA, 13 nt, Shigella flexneri 2a str. 2457T
aauauuuuuaugc

SEQ ID NO: 3860686 - RNA, 14 nt, Shigella flexneri 2a str. 2457T
aauauuuuuaugcc

SEQ ID NO: 3860687 - RNA, 22 nt, Shigella flexneri 2a str. 2457T
aaucaaaaaacuggaaaaauaa

SEQ ID NO: 3860688 - RNA, 19 nt, Shigella flexneri 2a str. 2457T
aaucaaaaaaggcugacaa

SEQ ID NO: 3860689 - RNA, 15 nt, Shigella flexneri 2a str. 2457T
aaucaaaaauggcuu

SEQ ID NO: 3860690 - RNA, 16 nt, Shigella flexneri 2a str. 2457T
aaucaaaauaauguga

SEQ ID NO: 3860691 - RNA, 14 nt, Shigella flexneri 2a str. 2457T
aaucaaagucagau

SEQ ID NO: 3860692 - RNA, 15 nt, Shigella flexneri 2a str. 2457T
aaucaaauaaaaaua

SEQ ID NO: 3860693 - RNA, 13 nt, Shigella flexneri 2a str. 2457T
aaucaaauacccu

SEQ ID NO: 3860694 - RNA, 21 nt, Shigella flexneri 2a str. 2457T
aaucaaauacccuugcagaua

SEQ ID NO: 3860695 - RNA, 19 nt, Shigella flexneri 2a str. 2457T
aaucaaauagccugccaga

SEQ ID NO: 3860696 - RNA, 18 nt, Shigella flexneri 2a str. 2457T
aaucaaaucaaugccuuu

SEQ ID NO: 3860697 - RNA, 14 nt, Shigella flexneri 2a str. 2457T
aaucaacaaaccaa

SEQ ID NO: 3860698 - RNA, 20 nt, Shigella flexneri 2a str. 2457T
aaucaacaccacugccagau

SEQ ID NO: 3860699 - RNA, 21 nt, Shigella flexneri 2a str. 2457T
aaucaaccgcgccugaccauu

SEQ ID NO: 3860700 - RNA, 16 nt, Shigella flexneri 2a str. 2457T
aaucaacgaugucaau

SEQ ID NO: 3860701 - RNA, 14 nt, Shigella flexneri 2a str. 2457T
aaucaacgccgcau

SEQ ID NO: 3860702 - RNA, 18 nt, Shigella flexneri 2a str. 2457T
aaucaacgcgauauaaua

SEQ ID NO: 3860703 - RNA, 21 nt, Shigella flexneri 2a str. 2457T
aaucaacuuauugguaaacuc

SEQ ID NO: 3860704 - RNA, 22 nt, Shigella flexneri 2a str. 2457T
aaucaacuuauugguaaacuca

SEQ ID NO: 3860705 - RNA, 22 nt, Shigella flexneri 2a str. 2457T
aaucaagcgccgccagucgaau

SEQ ID NO: 3860706 - RNA, 14 nt, Shigella flexneri 2a str. 2457T
aaucaaggugauug

SEQ ID NO: 3860707 - RNA, 15 nt, Shigella flexneri 2a str. 2457T
aaucaagucuauuug

SEQ ID NO: 3860708 - RNA, 20 nt, Shigella flexneri 2a str. 2457T
aaucaauaaguuacacauca

SEQ ID NO: 3860709 - RNA, 16 nt, Shigella flexneri 2a str. 2457T
aaucaauaugcauaaa

SEQ ID NO: 3860710 - RNA, 20 nt, Shigella flexneri 2a str. 2457T
aaucaauccaguguaaaaca

SEQ ID NO: 3860711 - RNA, 15 nt, Shigella flexneri 2a str. 2457T
aaucaaucgccccuu

SEQ ID NO: 3860712 - RNA, 23 nt, Shigella flexneri 2a str. 2457T
aaucacaaaaaguaguuccagca

SEQ ID NO: 3860713 - RNA, 17 nt, Shigella flexneri 2a str. 2457T
aaucacaauagaaauau

SEQ ID NO: 3860714 - RNA, 17 nt, Shigella flexneri 2a str. 2457T
aaucacagcggcgaaug

SEQ ID NO: 3860715 - RNA, 15 nt, Shigella flexneri 2a str. 2457T
aauccugccagcgug

SEQ ID NO: 3860716 - RNA, 12 nt, Shigella flexneri 2a str. 2457T
aauccugccgca

SEQ ID NO: 3860717 - RNA, 20 nt, Shigella flexneri 2a str. 2457T
aauccugccgcaguuucuga

SEQ ID NO: 3860718 - RNA, 17 nt, Shigella flexneri 2a str. 2457T
aauccuucacuuuugcc

SEQ ID NO: 3860719 - RNA, 14 nt, Shigella flexneri 2a str. 2457T
aauccuucuuguuc

SEQ ID NO: 3860720 - RNA, 13 nt, Shigella flexneri 2a str. 2457T
aaucgaaaucaac

SEQ ID NO: 3860721 - RNA, 17 nt, Shigella flexneri 2a str. 2457T
aaucgaaaucaacaugu

SEQ ID NO: 3860722 - RNA, 21 nt, Shigella flexneri 2a str. 2457T
aaucgaaccaaacagcgccag

SEQ ID NO: 3860723 - RNA, 14 nt, Shigella flexneri 2a str. 2457T
aaucgaacuucccg

SEQ ID NO: 3860724 - RNA, 23 nt, Shigella flexneri 2a str. 2457T
aaucgaccaggccaucagcagcg

SEQ ID NO: 3860725 - RNA, 17 nt, Shigella flexneri 2a str. 2457T
aaucgacgcugcugcgu

SEQ ID NO: 3860726 - RNA, 20 nt, Shigella flexneri 2a str. 2457T
aaucgacggggugcgguaaa

SEQ ID NO: 3860727 - RNA, 13 nt, Shigella flexneri 2a str. 2457T
aaucgagcccaga

SEQ ID NO: 3860728 - RNA, 22 nt, Shigella flexneri 2a str. 2457T
aaucgagcccagaugccggaug

SEQ ID NO: 3860729 - RNA, 19 nt, Shigella flexneri 2a str. 2457T
aaucgagccgauuaaaauc

SEQ ID NO: 3860730 - RNA, 16 nt, Shigella flexneri 2a str. 2457T
aaucgauaaaacuucc

SEQ ID NO: 3860731 - RNA, 18 nt, Shigella flexneri 2a str. 2457T
aaucgauaaaacuucccg

SEQ ID NO: 3860732 - RNA, 20 nt, Shigella flexneri 2a str. 2457T
aaucgaucgcguaauaaaau

SEQ ID NO: 3860733 - RNA, 19 nt, Shigella flexneri 2a str. 2457T
aaucgcaacgccuuccguc

SEQ ID NO: 3860734 - RNA, 15 nt, Shigella flexneri 2a str. 2457T
aaucgcaagaucuca

SEQ ID NO: 3860735 - RNA, 20 nt, Shigella flexneri 2a str. 2457T
aaucgcacguugucagcaac

SEQ ID NO: 3860736 - RNA, 13 nt, Shigella flexneri 2a str. 2457T
aaucgcagcgcaa

SEQ ID NO: 3860737 - RNA, 21 nt, Shigella flexneri 2a str. 2457T
aaucgcauugacgccaaaaua

SEQ ID NO: 3860738 - RNA, 22 nt, Shigella flexneri 2a str. 2457T
aaucgcauugacgccaaaauaa

SEQ ID NO: 3860739 - RNA, 21 nt, Shigella flexneri 2a str. 2457T
aaucgccagcaaaaucaccau

SEQ ID NO: 3860740 - RNA, 15 nt, Shigella flexneri 2a str. 2457T
aaucgccagcggcag

SEQ ID NO: 3860741 - RNA, 17 nt, Shigella flexneri 2a str. 2457T
aaucgccaguaguaacc

SEQ ID NO: 3860742 - RNA, 19 nt, Shigella flexneri 2a str. 2457T
aaucgcccagcgcguaaau

SEQ ID NO: 3860743 - RNA, 20 nt, Shigella flexneri 2a str. 2457T
aaucgcccgcuguuuauguu

SEQ ID NO: 3860744 - RNA, 20 nt, Shigella flexneri 2a str. 2457T
aaucgccguauaauaucuuu

SEQ ID NO: 3860745 - RNA, 23 nt, Shigella flexneri 2a str. 2457T
aaucgccuuacccggaccgucuu

SEQ ID NO: 3860746 - RNA, 17 nt, Shigella flexneri 2a str. 2457T
aaucgcgaaauaacugc

SEQ ID NO: 3860747 - RNA, 18 nt, Shigella flexneri 2a str. 2457T
aaucgcgaaauaacugcu

SEQ ID NO: 3860748 - RNA, 24 nt, Shigella flexneri 2a str. 2457T
aaucgcgaaauaacugcuauucac

SEQ ID NO: 3860749 - RNA, 16 nt, Shigella flexneri 2a str. 2457T
aaucgcuacugauaau

SEQ ID NO: 3860750 - RNA, 17 nt, Shigella flexneri 2a str. 2457T
aaucgcuacugauaaua

SEQ ID NO: 3860751 - RNA, 18 nt, Shigella flexneri 2a str. 2457T
aaucgcugcggcaauaau

SEQ ID NO: 3860752 - RNA, 22 nt, Shigella flexneri 2a str. 2457T
aaucgcuucaucgcccacauca

SEQ ID NO: 3860753 - RNA, 14 nt, Shigella flexneri 2a str. 2457T
aaucgcuucauuua

SEQ ID NO: 3860754 - RNA, 15 nt, Shigella flexneri 2a str. 2457T
aaucggcgaucccau

SEQ ID NO: 3860755 - RNA, 18 nt, Shigella flexneri 2a str. 2457T
aaucggcugaacgugcuc

SEQ ID NO: 3860756 - RNA, 22 nt, Shigella flexneri 2a str. 2457T
aaucggcuuucaccgccugauc

SEQ ID NO: 3860757 - RNA, 18 nt, Shigella flexneri 2a str. 2457T
aaucggggauaagaauau

SEQ ID NO: 3860758 - RNA, 20 nt, Shigella flexneri 2a str. 2457T
aaucggugcaaaugccagau

SEQ ID NO: 3860759 - RNA, 15 nt, Shigella flexneri 2a str. 2457T
aaucguaaucagcau

SEQ ID NO: 3860760 - RNA, 17 nt, Shigella flexneri 2a str. 2457T
aaucguacucaccagac

SEQ ID NO: 3860761 - RNA, 18 nt, Shigella flexneri 2a str. 2457T
aaucguacucaccagaca

SEQ ID NO: 3860762 - RNA, 22 nt, Shigella flexneri 2a str. 2457T
aaucgucaaugccgucaccagc

SEQ ID NO: 3860763 - RNA, 13 nt, Shigella flexneri 2a str. 2457T
aaucgucaucagc

SEQ ID NO: 3860764 - RNA, 16 nt, Shigella flexneri 2a str. 2457T
aaucuaaaacccggua

SEQ ID NO: 3860765 - RNA, 20 nt, Shigella flexneri 2a str. 2457T
aaucuaccgucaugcugacc

SEQ ID NO: 3860766 - RNA, 15 nt, Shigella flexneri 2a str. 2457T
aaucuauucauuuau

SEQ ID NO: 3860767 - RNA, 22 nt, Shigella flexneri 2a str. 2457T
aaucuauucauuuauguucagc

SEQ ID NO: 3860768 - RNA, 13 nt, Shigella flexneri 2a str. 2457T
aaucuauugcaac

SEQ ID NO: 3860769 - RNA, 21 nt, Shigella flexneri 2a str. 2457T
aaucuauugcaacauguugaa

SEQ ID NO: 3860770 - RNA, 15 nt, Shigella flexneri 2a str. 2457T
aaucucaauguauuc

SEQ ID NO: 3860771 - RNA, 14 nt, Shigella flexneri 2a str. 2457T
aaucucacccgcuu

SEQ ID NO: 3860772 - RNA, 21 nt, Shigella flexneri 2a str. 2457T
aaucucacccgguacaucaau

SEQ ID NO: 3860773 - RNA, 24 nt, Shigella flexneri 2a str. 2457T
aaucucacccgguacaucaauacc

SEQ ID NO: 3860774 - RNA, 12 nt, Shigella flexneri 2a str. 2457T
aaucucacuccg

SEQ ID NO: 3860775 - RNA, 15 nt, Shigella flexneri 2a str. 2457T
aaucucagcccgaug

SEQ ID NO: 3860776 - RNA, 15 nt, Shigella flexneri 2a str. 2457T
aaucuccauuucauu

SEQ ID NO: 3860777 - RNA, 22 nt, Shigella flexneri 2a str. 2457T
aaucucgucgaugcgcaauuaa

SEQ ID NO: 3860778 - RNA, 14 nt, Shigella flexneri 2a str. 2457T
aaucucuacaccaa

SEQ ID NO: 3860779 - RNA, 22 nt, Shigella flexneri 2a str. 2457T
aaucucugguuuguuuucagau

SEQ ID NO: 3860780 - RNA, 13 nt, Shigella flexneri 2a str. 2457T
aaucucuuccaga

SEQ ID NO: 3860781 - RNA, 13 nt, Shigella flexneri 2a str. 2457T
aaucugaagaaaa

SEQ ID NO: 3860782 - RNA, 22 nt, Shigella flexneri 2a str. 2457T
aaucugaauuguuuuucguugc

SEQ ID NO: 3860783 - RNA, 20 nt, Shigella flexneri 2a str. 2457T
aaucugauagugauccauca

SEQ ID NO: 3860784 - RNA, 14 nt, Shigella flexneri 2a str. 2457T
aaucugauauuuag

SEQ ID NO: 3860785 - RNA, 11 nt, Shigella flexneri 2a str. 2457T
aaucugcaaau

SEQ ID NO: 3860786 - RNA, 12 nt, Shigella flexneri 2a str. 2457T
aaucugccagaa

SEQ ID NO: 3860787 - RNA, 13 nt, Shigella flexneri 2a str. 2457T
aaucugccugaug

SEQ ID NO: 3860788 - RNA, 12 nt, Shigella flexneri 2a str. 2457T
aaucuguaaauu

SEQ ID NO: 3860789 - RNA, 21 nt, Shigella flexneri 2a str. 2457T
aaucuguaacaaggugaauca

SEQ ID NO: 3860790 - RNA, 17 nt, Shigella flexneri 2a str. 2457T
aaucugucagguaacaa

SEQ ID NO: 3860791 - RNA, 13 nt, Shigella flexneri 2a str. 2457T
aaucuguugaaau

SEQ ID NO: 3860792 - RNA, 12 nt, Shigella flexneri 2a str. 2457T
aaucuuccagaa

SEQ ID NO: 3860793 - RNA, 20 nt, Shigella flexneri 2a str. 2457T
aaucuuccagaucaccgcag

SEQ ID NO: 3860794 - RNA, 15 nt, Shigella flexneri 2a str. 2457T
aaucuucuucucagc

SEQ ID NO: 3860795 - RNA, 13 nt, Shigella flexneri 2a str. 2457T
aaucuugaaacca

SEQ ID NO: 3860796 - RNA, 22 nt, Shigella flexneri 2a str. 2457T
aaugaaacgcaaauacugacug

SEQ ID NO: 3860797 - RNA, 13 nt, Shigella flexneri 2a str. 2457T
aaugaacaccaaa

SEQ ID NO: 3860798 - RNA, 15 nt, Shigella flexneri 2a str. 2457T
aaugaacaccaaacc

SEQ ID NO: 3860799 - RNA, 18 nt, Shigella flexneri 2a str. 2457T
aaugaagaaccgcaccag

SEQ ID NO: 3860800 - RNA, 23 nt, Shigella flexneri 2a str. 2457T
aaugaagaugcggaauuugauga

SEQ ID NO: 3860801 - RNA, 13 nt, Shigella flexneri 2a str. 2457T
aaugaaugaugcg

SEQ ID NO: 3860802 - RNA, 14 nt, Shigella flexneri 2a str. 2457T
aaugacccacccca

SEQ ID NO: 3860803 - RNA, 20 nt, Shigella flexneri 2a str. 2457T
aaugacccaccccagcagca

SEQ ID NO: 3860804 - RNA, 12 nt, Shigella flexneri 2a str. 2457T
aaugaccgcgcc

SEQ ID NO: 3860805 - RNA, 14 nt, Shigella flexneri 2a str. 2457T
aaugacgaugcacc

SEQ ID NO: 3860806 - RNA, 17 nt, Shigella flexneri 2a str. 2457T
aaugacguuaauaaaau

SEQ ID NO: 3860807 - RNA, 15 nt, Shigella flexneri 2a str. 2457T
aaugacuagcgccau

SEQ ID NO: 3860808 - RNA, 23 nt, Shigella flexneri 2a str. 2457T
aaugacuucgcuuucgccagauc

SEQ ID NO: 3860809 - RNA, 19 nt, Shigella flexneri 2a str. 2457T
aaugagaaagccgacugca

SEQ ID NO: 3860810 - RNA, 15 nt, Shigella flexneri 2a str. 2457T
aaugagacacuuuau

SEQ ID NO: 3860811 - RNA, 17 nt, Shigella flexneri 2a str. 2457T
aaugagagggcgauaaa

SEQ ID NO: 3860812 - RNA, 15 nt, Shigella flexneri 2a str. 2457T
aaugagauauuuaau

SEQ ID NO: 3860813 - RNA, 12 nt, Shigella flexneri 2a str. 2457T
aauggcgcuaac

SEQ ID NO: 3860814 - RNA, 17 nt, Shigella flexneri 2a str. 2457T
aauggcggugaucccaa

SEQ ID NO: 3860815 - RNA, 15 nt, Shigella flexneri 2a str. 2457T
aauggcgucaacaac

SEQ ID NO: 3860816 - RNA, 17 nt, Shigella flexneri 2a str. 2457T
aauggcgucaacaacac

SEQ ID NO: 3860817 - RNA, 21 nt, Shigella flexneri 2a str. 2457T
aauggcgucaacaacacucuc

SEQ ID NO: 3860818 - RNA, 21 nt, Shigella flexneri 2a str. 2457T
aauggcugcgggcgaccaauc

SEQ ID NO: 3860819 - RNA, 17 nt, Shigella flexneri 2a str. 2457T
aauggcuggcacaaaaa

SEQ ID NO: 3860820 - RNA, 14 nt, Shigella flexneri 2a str. 2457T
aauggcuggcuaua

SEQ ID NO: 3860821 - RNA, 15 nt, Shigella flexneri 2a str. 2457T
aauggucccgacaac

SEQ ID NO: 3860822 - RNA, 15 nt, Shigella flexneri 2a str. 2457T
aauggugagauggcc

SEQ ID NO: 3860823 - RNA, 21 nt, Shigella flexneri 2a str. 2457T
aauguacucuuuauugcaaac

SEQ ID NO: 3860824 - RNA, 10 nt, Shigella flexneri 2a str. 2457T
aauguagccg

SEQ ID NO: 3860825 - RNA, 16 nt, Shigella flexneri 2a str. 2457T
aaugugaagaggaaca

SEQ ID NO: 3860826 - RNA, 21 nt, Shigella flexneri 2a str. 2457T
aaugugacagagccauugccc

SEQ ID NO: 3860827 - RNA, 17 nt, Shigella flexneri 2a str. 2457T
aaugugaugaaaaaagu

SEQ ID NO: 3860828 - RNA, 16 nt, Shigella flexneri 2a str. 2457T
aaugugccguaaccaa

SEQ ID NO: 3860829 - RNA, 15 nt, Shigella flexneri 2a str. 2457T
aaugugcugagaaca

SEQ ID NO: 3860830 - RNA, 23 nt, Shigella flexneri 2a str. 2457T
aauguguuuacgcguuuuucaga

SEQ ID NO: 3860831 - RNA, 13 nt, Shigella flexneri 2a str. 2457T
aauguuaaagaga

SEQ ID NO: 3860832 - RNA, 15 nt, Shigella flexneri 2a str. 2457T
aauguuaccgaucgc

SEQ ID NO: 3860833 - RNA, 23 nt, Shigella flexneri 2a str. 2457T
aauguuauuuaauuacugagaac

SEQ ID NO: 3860834 - RNA, 15 nt, Shigella flexneri 2a str. 2457T
aauguuccagugcgu

SEQ ID NO: 3860835 - RNA, 13 nt, Shigella flexneri 2a str. 2457T
aauguucgucaua

SEQ ID NO: 3860836 - RNA, 22 nt, Shigella flexneri 2a str. 2457T
aauguugccguuuaccgccauc

SEQ ID NO: 3860837 - RNA, 23 nt, Shigella flexneri 2a str. 2457T
aauguuuaucuacagcauuuccu

SEQ ID NO: 3860838 - RNA, 11 nt, Shigella flexneri 2a str. 2457T
aauguuugcca

SEQ ID NO: 3860839 - RNA, 19 nt, Shigella flexneri 2a str. 2457T
aauuaaaccuaaaaagaaa

SEQ ID NO: 3860840 - RNA, 15 nt, Shigella flexneri 2a str. 2457T
aauuaaauuaucaac

SEQ ID NO: 3860841 - RNA, 17 nt, Shigella flexneri 2a str. 2457T
aauuaacgguaauaauu

SEQ ID NO: 3860842 - RNA, 20 nt, Shigella flexneri 2a str. 2457T
aauuaagcccggucaucagu

SEQ ID NO: 3860843 - RNA, 13 nt, Shigella flexneri 2a str. 2457T
aauuaauugugaa

SEQ ID NO: 3860844 - RNA, 22 nt, Shigella flexneri 2a str. 2457T
aauuacaaaaagugcuuucuga

SEQ ID NO: 3860845 - RNA, 17 nt, Shigella flexneri 2a str. 2457T
aauuacagcgcauugcu

SEQ ID NO: 3860846 - RNA, 22 nt, Shigella flexneri 2a str. 2457T
aauuaccgcaccaccagcagcu

SEQ ID NO: 3860847 - RNA, 17 nt, Shigella flexneri 2a str. 2457T
aauuaccuguaaaguag

SEQ ID NO: 3860848 - RNA, 18 nt, Shigella flexneri 2a str. 2457T
aauuacgcuguucauccc

SEQ ID NO: 3860849 - RNA, 13 nt, Shigella flexneri 2a str. 2457T
aauuacugagcaa

SEQ ID NO: 3860850 - RNA, 20 nt, Shigella flexneri 2a str. 2457T
aauuacugccgcuguugcaa

SEQ ID NO: 3860851 - RNA, 18 nt, Shigella flexneri 2a str. 2457T
aauuacugccuuaaucaa

SEQ ID NO: 3860852 - RNA, 18 nt, Shigella flexneri 2a str. 2457T
aauuacugccuugaugaa

SEQ ID NO: 3860853 - RNA, 21 nt, Shigella flexneri 2a str. 2457T
aauuacugccuugaugaaaaa

SEQ ID NO: 3860854 - RNA, 22 nt, Shigella flexneri 2a str. 2457T
aauuacugccuugaugaaaaaa

SEQ ID NO: 3860855 - RNA, 15 nt, Shigella flexneri 2a str. 2457T
aauuacugcuuaaau

SEQ ID NO: 3860856 - RNA, 20 nt, Shigella flexneri 2a str. 2457T
aauuacuggcggcaaaacug

SEQ ID NO: 3860857 - RNA, 23 nt, Shigella flexneri 2a str. 2457T
aauuacuuacaucugucugauaa

SEQ ID NO: 3860858 - RNA, 15 nt, Shigella flexneri 2a str. 2457T
aauuacuucucuuuc

SEQ ID NO: 3860859 - RNA, 17 nt, Shigella flexneri 2a str. 2457T
aauuauagggaugcaga

SEQ ID NO: 3860860 - RNA, 18 nt, Shigella flexneri 2a str. 2457T
aauuauagggaugcagaa

SEQ ID NO: 3860861 - RNA, 12 nt, Shigella flexneri 2a str. 2457T
aauuaugaauaa

SEQ ID NO: 3860862 - RNA, 12 nt, Shigella flexneri 2a str. 2457T
aauuaugcagcc

SEQ ID NO: 3860863 - RNA, 14 nt, Shigella flexneri 2a str. 2457T
aauuauuaacaaaa

SEQ ID NO: 3860864 - RNA, 13 nt, Shigella flexneri 2a str. 2457T
aauuauuaccauc

SEQ ID NO: 3860865 - RNA, 22 nt, Shigella flexneri 2a str. 2457T
aauuauuguaagcugucgaaaa

SEQ ID NO: 3860866 - RNA, 18 nt, Shigella flexneri 2a str. 2457T
aauucaacgcguuuuuuc

SEQ ID NO: 3860867 - RNA, 16 nt, Shigella flexneri 2a str. 2457T
aauucaagacaucaau

SEQ ID NO: 3860868 - RNA, 11 nt, Shigella flexneri 2a str. 2457T
aauucaaugaa

SEQ ID NO: 3860869 - RNA, 22 nt, Shigella flexneri 2a str. 2457T
aauucaaugacaguaucgccaa

SEQ ID NO: 3860870 - RNA, 22 nt, Shigella flexneri 2a str. 2457T
aauucaccguaauaguuucuga

SEQ ID NO: 3860871 - RNA, 23 nt, Shigella flexneri 2a str. 2457T
aauucacgccacugucauauuug

SEQ ID NO: 3860872 - RNA, 14 nt, Shigella flexneri 2a str. 2457T
aauucacgccgcau

SEQ ID NO: 3860873 - RNA, 18 nt, Shigella flexneri 2a str. 2457T
aauucagaccauuccucu

SEQ ID NO: 3860874 - RNA, 17 nt, Shigella flexneri 2a str. 2457T
aauucagccgcgcgcuu

SEQ ID NO: 3860875 - RNA, 12 nt, Shigella flexneri 2a str. 2457T
aauucaggaaau

SEQ ID NO: 3860876 - RNA, 16 nt, Shigella flexneri 2a str. 2457T
aauucaucaucagcau

SEQ ID NO: 3860877 - RNA, 21 nt, Shigella flexneri 2a str. 2457T
aauucauucaauuaauaacac

SEQ ID NO: 3860878 - RNA, 22 nt, Shigella flexneri 2a str. 2457T
aauucauucaauuaauaacaca

SEQ ID NO: 3860879 - RNA, 19 nt, Shigella flexneri 2a str. 2457T
aauuccacgcgccacgcac

SEQ ID NO: 3860880 - RNA, 13 nt, Shigella flexneri 2a str. 2457T
aauuccagcggca

SEQ ID NO: 3860881 - RNA, 20 nt, Shigella flexneri 2a str. 2457T
aauuccauuucccugacaaa

SEQ ID NO: 3860882 - RNA, 16 nt, Shigella flexneri 2a str. 2457T
aauucccgcagauaaa

SEQ ID NO: 3860883 - RNA, 20 nt, Shigella flexneri 2a str. 2457T
aauucccgcagauaaauauc

SEQ ID NO: 3860884 - RNA, 19 nt, Shigella flexneri 2a str. 2457T
aauucccgcuucuucugcc

SEQ ID NO: 3860885 - RNA, 14 nt, Shigella flexneri 2a str. 2457T
aauucccugcgcca

SEQ ID NO: 3860886 - RNA, 20 nt, Shigella flexneri 2a str. 2457T
aauucccugcgccagcggca

SEQ ID NO: 3860887 - RNA, 18 nt, Shigella flexneri 2a str. 2457T
aauuccgaauuucauccu

SEQ ID NO: 3860888 - RNA, 17 nt, Shigella flexneri 2a str. 2457T
aauuccgcuucucuuuc

SEQ ID NO: 3860889 - RNA, 21 nt, Shigella flexneri 2a str. 2457T
aauuccuaugcaacaacugaa

SEQ ID NO: 3860890 - RNA, 18 nt, Shigella flexneri 2a str. 2457T
aauuccucccguuaugau

SEQ ID NO: 3860891 - RNA, 19 nt, Shigella flexneri 2a str. 2457T
aauucgaaauagagaaagu

SEQ ID NO: 3860892 - RNA, 14 nt, Shigella flexneri 2a str. 2457T
aauucgaagcugua

SEQ ID NO: 3860893 - RNA, 18 nt, Shigella flexneri 2a str. 2457T
aauucgacuuucucuggc

SEQ ID NO: 3860894 - RNA, 23 nt, Shigella flexneri 2a str. 2457T
aauucgcccuucggcaucacgaa

SEQ ID NO: 3860895 - RNA, 23 nt, Shigella flexneri 2a str. 2457T
aauucgcggauguugcugcacca

SEQ ID NO: 3860896 - RNA, 23 nt, Shigella flexneri 2a str. 2457T
aauucgcgucggcgucagcgcca

SEQ ID NO: 3860897 - RNA, 23 nt, Shigella flexneri 2a str. 2457T
aauucggauggcgauacucugcc

SEQ ID NO: 3860898 - RNA, 13 nt, Shigella flexneri 2a str. 2457T
aauucuaaaacgg

SEQ ID NO: 3860899 - RNA, 12 nt, Shigella flexneri 2a str. 2457T
aauucuacagaa

SEQ ID NO: 3860900 - RNA, 14 nt, Shigella flexneri 2a str. 2457T
aauucuacagaaau

SEQ ID NO: 3860901 - RNA, 18 nt, Shigella flexneri 2a str. 2457T
aauucuacagaaaugaaa

SEQ ID NO: 3860902 - RNA, 15 nt, Shigella flexneri 2a str. 2457T
aauucuaucaugcaa

SEQ ID NO: 3860903 - RNA, 14 nt, Shigella flexneri 2a str. 2457T
aauucucccagcca

SEQ ID NO: 3860904 - RNA, 23 nt, Shigella flexneri 2a str. 2457T
aauucugagagcaugaaaugaaa

SEQ ID NO: 3860905 - RNA, 15 nt, Shigella flexneri 2a str. 2457T
aauucuguaauccuc

SEQ ID NO: 3860906 - RNA, 12 nt, Shigella flexneri 2a str. 2457T
aauucuucugaa

SEQ ID NO: 3860907 - RNA, 20 nt, Shigella flexneri 2a str. 2457T
aauugaaaaguccaggcugc

SEQ ID NO: 3860908 - RNA, 15 nt, Shigella flexneri 2a str. 2457T
aauugaagguuuaau

SEQ ID NO: 3860909 - RNA, 14 nt, Shigella flexneri 2a str. 2457T
aauugacaguuuau

SEQ ID NO: 3860910 - RNA, 16 nt, Shigella flexneri 2a str. 2457T
acaaacgccagauaca

SEQ ID NO: 3860911 - RNA, 19 nt, Shigella flexneri 2a str. 2457T
acaaacgcuguaauuacca

SEQ ID NO: 3860912 - RNA, 14 nt, Shigella flexneri 2a str. 2457T
acaaacggaaaaca

SEQ ID NO: 3860913 - RNA, 18 nt, Shigella flexneri 2a str. 2457T
acaaacguugcugacugu

SEQ ID NO: 3860914 - RNA, 13 nt, Shigella flexneri 2a str. 2457T
acaaacucuuuuc

SEQ ID NO: 3860915 - RNA, 14 nt, Shigella flexneri 2a str. 2457T
acaaagacaucaaa

SEQ ID NO: 3860916 - RNA, 14 nt, Shigella flexneri 2a str. 2457T
acaaagagcuuuca

SEQ ID NO: 3860917 - RNA, 12 nt, Shigella flexneri 2a str. 2457T
acaaagcaugau

SEQ ID NO: 3860918 - RNA, 16 nt, Shigella flexneri 2a str. 2457T
acaaaggcuugcugca

SEQ ID NO: 3860919 - RNA, 15 nt, Shigella flexneri 2a str. 2457T
acaaagggcuaacgu

SEQ ID NO: 3860920 - RNA, 21 nt, Shigella flexneri 2a str. 2457T
acaaagugcacuuugucaaua

SEQ ID NO: 3860921 - RNA, 18 nt, Shigella flexneri 2a str. 2457T
acaaauaaaagcaaaaau

SEQ ID NO: 3860922 - RNA, 19 nt, Shigella flexneri 2a str. 2457T
acaaauaaauagauccagg

SEQ ID NO: 3860923 - RNA, 19 nt, Shigella flexneri 2a str. 2457T
acaaauacgcuuuuucccu

SEQ ID NO: 3860924 - RNA, 20 nt, Shigella flexneri 2a str. 2457T
acaaauacgcuuuuucccug

SEQ ID NO: 3860925 - RNA, 13 nt, Shigella flexneri 2a str. 2457T
acaaauagacaca

SEQ ID NO: 3860926 - RNA, 19 nt, Shigella flexneri 2a str. 2457T
acaaauagagauagaaugc

SEQ ID NO: 3860927 - RNA, 19 nt, Shigella flexneri 2a str. 2457T
acaaauagccaauucccag

SEQ ID NO: 3860928 - RNA, 16 nt, Shigella flexneri 2a str. 2457T
acaaauagccagcaga

SEQ ID NO: 3860929 - RNA, 17 nt, Shigella flexneri 2a str. 2457T
acaaauagccagcagag

SEQ ID NO: 3860930 - RNA, 16 nt, Shigella flexneri 2a str. 2457T
acaaaugaacaccaaa

SEQ ID NO: 3860931 - RNA, 21 nt, Shigella flexneri 2a str. 2457T
acaaaugaccgacguuaugcu

SEQ ID NO: 3860932 - RNA, 18 nt, Shigella flexneri 2a str. 2457T
acaaaugcaguuuuuaau

SEQ ID NO: 3860933 - RNA, 18 nt, Shigella flexneri 2a str. 2457T
acaaauggcaaugacuag

SEQ ID NO: 3860934 - RNA, 14 nt, Shigella flexneri 2a str. 2457T
acaaaugucacugc

SEQ ID NO: 3860935 - RNA, 23 nt, Shigella flexneri 2a str. 2457T
acaaaugucacugcuuuggcucu

SEQ ID NO: 3860936 - RNA, 14 nt, Shigella flexneri 2a str. 2457T
acaaaugugccauu

SEQ ID NO: 3860937 - RNA, 18 nt, Shigella flexneri 2a str. 2457T
acaaauuccgaacaaaac

SEQ ID NO: 3860938 - RNA, 21 nt, Shigella flexneri 2a str. 2457T
acaaauucuggcggcaauaac

SEQ ID NO: 3860939 - RNA, 22 nt, Shigella flexneri 2a str. 2457T
acaaauuucaucgcuacaccaa

SEQ ID NO: 3860940 - RNA, 22 nt, Shigella flexneri 2a str. 2457T
acaaauuugugcaaauucaaua

SEQ ID NO: 3860941 - RNA, 15 nt, Shigella flexneri 2a str. 2457T
acaacaaacgcaaac

SEQ ID NO: 3860942 - RNA, 15 nt, Shigella flexneri 2a str. 2457T
acaacaacaucagcg

SEQ ID NO: 3860943 - RNA, 18 nt, Shigella flexneri 2a str. 2457T
acaacaacuucuaauuuu

SEQ ID NO: 3860944 - RNA, 15 nt, Shigella flexneri 2a str. 2457T
acaacacccggucag

SEQ ID NO: 3860945 - RNA, 22 nt, Shigella flexneri 2a str. 2457T
acaacacccggucagccauugc

SEQ ID NO: 3860946 - RNA, 23 nt, Shigella flexneri 2a str. 2457T
acaacacgccgaucgaagagacg

SEQ ID NO: 3860947 - RNA, 16 nt, Shigella flexneri 2a str. 2457T
acaacacucucugaag

SEQ ID NO: 3860948 - RNA, 19 nt, Shigella flexneri 2a str. 2457T
acaacagaaauaaucgcaa

SEQ ID NO: 3860949 - RNA, 20 nt, Shigella flexneri 2a str. 2457T
acaacaucacaccugcucag

SEQ ID NO: 3860950 - RNA, 17 nt, Shigella flexneri 2a str. 2457T
acaacaucaucugccac

SEQ ID NO: 3860951 - RNA, 18 nt, Shigella flexneri 2a str. 2457T
acaacaugagaacaguuc

SEQ ID NO: 3860952 - RNA, 23 nt, Shigella flexneri 2a str. 2457T
acaacaugccgaauccgggaagg

SEQ ID NO: 3860953 - RNA, 22 nt, Shigella flexneri 2a str. 2457T
acaacauuccugcugacggcac

SEQ ID NO: 3860954 - RNA, 17 nt, Shigella flexneri 2a str. 2457T
acaacauuuugcggcua

SEQ ID NO: 3860955 - RNA, 13 nt, Shigella flexneri 2a str. 2457T
acaacccacacau

SEQ ID NO: 3860956 - RNA, 14 nt, Shigella flexneri 2a str. 2457T
acaacccacacauu

SEQ ID NO: 3860957 - RNA, 13 nt, Shigella flexneri 2a str. 2457T
acaacccagcgga

SEQ ID NO: 3860958 - RNA, 16 nt, Shigella flexneri 2a str. 2457T
acaacccuaaagcacc

SEQ ID NO: 3860959 - RNA, 18 nt, Shigella flexneri 2a str. 2457T
acaaccugaccuuuuuuc

SEQ ID NO: 3860960 - RNA, 20 nt, Shigella flexneri 2a str. 2457T
acaaccugcuggaaaggccg

SEQ ID NO: 3860961 - RNA, 19 nt, Shigella flexneri 2a str. 2457T
acaacgcgcacuuugucuu

SEQ ID NO: 3860962 - RNA, 21 nt, Shigella flexneri 2a str. 2457T
acaacgcgcacuuugucuuca

SEQ ID NO: 3860963 - RNA, 17 nt, Shigella flexneri 2a str. 2457T
acaacgcuuucaacaac

SEQ ID NO: 3860964 - RNA, 19 nt, Shigella flexneri 2a str. 2457T
acaacgcuuuuugguucau

SEQ ID NO: 3860965 - RNA, 17 nt, Shigella flexneri 2a str. 2457T
acaacggaacgaaaaaa

SEQ ID NO: 3860966 - RNA, 16 nt, Shigella flexneri 2a str. 2457T
acaacggguuuggccg

SEQ ID NO: 3860967 - RNA, 16 nt, Shigella flexneri 2a str. 2457T
acaacgucgccagucc

SEQ ID NO: 3860968 - RNA, 14 nt, Shigella flexneri 2a str. 2457T
acaacguuuuucua

SEQ ID NO: 3860969 - RNA, 15 nt, Shigella flexneri 2a str. 2457T
acaacguuuuucuaa

SEQ ID NO: 3860970 - RNA, 12 nt, Shigella flexneri 2a str. 2457T
acaacucaucac

SEQ ID NO: 3860971 - RNA, 19 nt, Shigella flexneri 2a str. 2457T
acaacucaucacuguaggc

SEQ ID NO: 3860972 - RNA, 21 nt, Shigella flexneri 2a str. 2457T
acaacucaucacuguaggcca

SEQ ID NO: 3860973 - RNA, 20 nt, Shigella flexneri 2a str. 2457T
acaacuccguugaaauugcu

SEQ ID NO: 3860974 - RNA, 22 nt, Shigella flexneri 2a str. 2457T
acaacucgcuuaagccaucauc

SEQ ID NO: 3860975 - RNA, 14 nt, Shigella flexneri 2a str. 2457T
acaacugaaaaaaa

SEQ ID NO: 3860976 - RNA, 16 nt, Shigella flexneri 2a str. 2457T
acaacugaaaaaaaau

SEQ ID NO: 3860977 - RNA, 18 nt, Shigella flexneri 2a str. 2457T
acaacugaaaaaaaauua

SEQ ID NO: 3860978 - RNA, 15 nt, Shigella flexneri 2a str. 2457T
acaacugcugacgca

SEQ ID NO: 3860979 - RNA, 20 nt, Shigella flexneri 2a str. 2457T
acaagaaauauacaggcggg

SEQ ID NO: 3860980 - RNA, 21 nt, Shigella flexneri 2a str. 2457T
acaagaauacagggaaagaag

SEQ ID NO: 3860981 - RNA, 16 nt, Shigella flexneri 2a str. 2457T
acaagaaucaugccaa

SEQ ID NO: 3860982 - RNA, 13 nt, Shigella flexneri 2a str. 2457T
acaagacuguaaa

SEQ ID NO: 3860983 - RNA, 14 nt, Shigella flexneri 2a str. 2457T
acaagccaccaucc

SEQ ID NO: 3860984 - RNA, 20 nt, Shigella flexneri 2a str. 2457T
acaagcccgcugccgcagau

SEQ ID NO: 3860985 - RNA, 19 nt, Shigella flexneri 2a str. 2457T
acaagcgauaacucgcuuu

SEQ ID NO: 3860986 - RNA, 15 nt, Shigella flexneri 2a str. 2457T
acaagcguaagagaa

SEQ ID NO: 3860987 - RNA, 21 nt, Shigella flexneri 2a str. 2457T
acaagcuuacguuacccagca

SEQ ID NO: 3860988 - RNA, 22 nt, Shigella flexneri 2a str. 2457T
acaagggcauauuucgucagca

SEQ ID NO: 3860989 - RNA, 20 nt, Shigella flexneri 2a str. 2457T
acaagguuugaaaaaaccug

SEQ ID NO: 3860990 - RNA, 23 nt, Shigella flexneri 2a str. 2457T
acaaguccgggauuaucccgcag

SEQ ID NO: 3860991 - RNA, 17 nt, Shigella flexneri 2a str. 2457T
acaagucuuuuuugguu

SEQ ID NO: 3860992 - RNA, 17 nt, Shigella flexneri 2a str. 2457T
acaagugggugcuucac

SEQ ID NO: 3860993 - RNA, 13 nt, Shigella flexneri 2a str. 2457T
acaaguucuucga

SEQ ID NO: 3860994 - RNA, 16 nt, Shigella flexneri 2a str. 2457T
acaauaaacuggcugu

SEQ ID NO: 3860995 - RNA, 12 nt, Shigella flexneri 2a str. 2457T
acaauaauaucu

SEQ ID NO: 3860996 - RNA, 17 nt, Shigella flexneri 2a str. 2457T
acaauaaucaccacaca

SEQ ID NO: 3860997 - RNA, 15 nt, Shigella flexneri 2a str. 2457T
acaauacgcccacgu

SEQ ID NO: 3860998 - RNA, 22 nt, Shigella flexneri 2a str. 2457T
acaauacgucggcaucgggcag

SEQ ID NO: 3860999 - RNA, 16 nt, Shigella flexneri 2a str. 2457T
acaauacugaucauca

SEQ ID NO: 3861000 - RNA, 14 nt, Shigella flexneri 2a str. 2457T
acaauagaaauauu

SEQ ID NO: 3861001 - RNA, 19 nt, Shigella flexneri 2a str. 2457T
acaauagccacauugcugc

SEQ ID NO: 3861002 - RNA, 19 nt, Shigella flexneri 2a str. 2457T
acaauagcgaacagacaaa

SEQ ID NO: 3861003 - RNA, 12 nt, Shigella flexneri 2a str. 2457T
acaauaucaaau

SEQ ID NO: 3861004 - RNA, 16 nt, Shigella flexneri 2a str. 2457T
acaauaugcucuccac

SEQ ID NO: 3861005 - RNA, 17 nt, Shigella flexneri 2a str. 2457T
acaauaugcucuccacc

SEQ ID NO: 3861006 - RNA, 18 nt, Shigella flexneri 2a str. 2457T
acaauauuuuuaucccuc

SEQ ID NO: 3861007 - RNA, 23 nt, Shigella flexneri 2a str. 2457T
acaccuguugcgcgucgcccagu

SEQ ID NO: 3861008 - RNA, 13 nt, Shigella flexneri 2a str. 2457T
acaccuuaaggcu

SEQ ID NO: 3861009 - RNA, 19 nt, Shigella flexneri 2a str. 2457T
acaccuucagcgaagccca

SEQ ID NO: 3861010 - RNA, 20 nt, Shigella flexneri 2a str. 2457T
acaccuucagcgaagcccac

SEQ ID NO: 3861011 - RNA, 19 nt, Shigella flexneri 2a str. 2457T
acaccuucauccagcauca

SEQ ID NO: 3861012 - RNA, 20 nt, Shigella flexneri 2a str. 2457T
acaccuucucaggccuacaa

SEQ ID NO: 3861013 - RNA, 18 nt, Shigella flexneri 2a str. 2457T
acacgacauacaccgcag

SEQ ID NO: 3861014 - RNA, 15 nt, Shigella flexneri 2a str. 2457T
acacgagucauuccg

SEQ ID NO: 3861015 - RNA, 19 nt, Shigella flexneri 2a str. 2457T
acacgccaggccacgcuuu

SEQ ID NO: 3861016 - RNA, 17 nt, Shigella flexneri 2a str. 2457T
acacgccgaucgaagag

SEQ ID NO: 3861017 - RNA, 20 nt, Shigella flexneri 2a str. 2457T
acacgccgccagaccaauag

SEQ ID NO: 3861018 - RNA, 20 nt, Shigella flexneri 2a str. 2457T
acacgcuaccaaaaaaucaa

SEQ ID NO: 3861019 - RNA, 20 nt, Shigella flexneri 2a str. 2457T
acacgcuaccacaagccacc

SEQ ID NO: 3861020 - RNA, 20 nt, Shigella flexneri 2a str. 2457T
acacgcucuggcaggcuuca

SEQ ID NO: 3861021 - RNA, 21 nt, Shigella flexneri 2a str. 2457T
acacgcugcgguuuacgccag

SEQ ID NO: 3861022 - RNA, 22 nt, Shigella flexneri 2a str. 2457T
acacgcugcgguuuacgccagg

SEQ ID NO: 3861023 - RNA, 19 nt, Shigella flexneri 2a str. 2457T
acacggcagcaaccgcuuc

SEQ ID NO: 3861024 - RNA, 14 nt, Shigella flexneri 2a str. 2457T
acacuaacagaaca

SEQ ID NO: 3861025 - RNA, 16 nt, Shigella flexneri 2a str. 2457T
acacuaacagaacaau

SEQ ID NO: 3861026 - RNA, 18 nt, Shigella flexneri 2a str. 2457T
acacuaacgcgucuuauc

SEQ ID NO: 3861027 - RNA, 20 nt, Shigella flexneri 2a str. 2457T
acacuaacgcgucuuaucug

SEQ ID NO: 3861028 - RNA, 14 nt, Shigella flexneri 2a str. 2457T
acacuaauccguaa

SEQ ID NO: 3861029 - RNA, 22 nt, Shigella flexneri 2a str. 2457T
acacuauuuccccggaaccuga

SEQ ID NO: 3861030 - RNA, 17 nt, Shigella flexneri 2a str. 2457T
acacucgcugacugaua

SEQ ID NO: 3861031 - RNA, 19 nt, Shigella flexneri 2a str. 2457T
acacucggcgucaaacggc

SEQ ID NO: 3861032 - RNA, 21 nt, Shigella flexneri 2a str. 2457T
acacugaaccgaaauggcugc

SEQ ID NO: 3861033 - RNA, 17 nt, Shigella flexneri 2a str. 2457T
acacugaauaaaaaugu

SEQ ID NO: 3861034 - RNA, 18 nt, Shigella flexneri 2a str. 2457T
acacugacgcgucuuauc

SEQ ID NO: 3861035 - RNA, 14 nt, Shigella flexneri 2a str. 2457T
acacugaugacagg

SEQ ID NO: 3861036 - RNA, 17 nt, Shigella flexneri 2a str. 2457T
acacugauugauucaau

SEQ ID NO: 3861037 - RNA, 12 nt, Shigella flexneri 2a str. 2457T
acacugcugaua

SEQ ID NO: 3861038 - RNA, 13 nt, Shigella flexneri 2a str. 2457T
acacugcuuacag

SEQ ID NO: 3861039 - RNA, 18 nt, Shigella flexneri 2a str. 2457T
acacugcuuacaggcugg

SEQ ID NO: 3861040 - RNA, 17 nt, Shigella flexneri 2a str. 2457T
acacuggcaaaaucaaa

SEQ ID NO: 3861041 - RNA, 22 nt, Shigella flexneri 2a str. 2457T
acacuggcauccccgcccuucc

SEQ ID NO: 3861042 - RNA, 19 nt, Shigella flexneri 2a str. 2457T
acacugggaugaaagugau

SEQ ID NO: 3861043 - RNA, 20 nt, Shigella flexneri 2a str. 2457T
acacugguucccaacaacag

SEQ ID NO: 3861044 - RNA, 18 nt, Shigella flexneri 2a str. 2457T
acacuguuaccgcugcug

SEQ ID NO: 3861045 - RNA, 19 nt, Shigella flexneri 2a str. 2457T
acacuucaauauuaaugcu

SEQ ID NO: 3861046 - RNA, 20 nt, Shigella flexneri 2a str. 2457T
acacuucagccaucaaagau

SEQ ID NO: 3861047 - RNA, 18 nt, Shigella flexneri 2a str. 2457T
acacuucuucagccaguu

SEQ ID NO: 3861048 - RNA, 20 nt, Shigella flexneri 2a str. 2457T
acacuuuccaguuccggcau

SEQ ID NO: 3861049 - RNA, 14 nt, Shigella flexneri 2a str. 2457T
acagaaaacucacg

SEQ ID NO: 3861050 - RNA, 22 nt, Shigella flexneri 2a str. 2457T
acagaaacgccauccagccggg

SEQ ID NO: 3861051 - RNA, 16 nt, Shigella flexneri 2a str. 2457T
acagaaaugaaaaaau

SEQ ID NO: 3861052 - RNA, 19 nt, Shigella flexneri 2a str. 2457T
acagaaaugaaaaaauaga

SEQ ID NO: 3861053 - RNA, 15 nt, Shigella flexneri 2a str. 2457T
acagaaauucagcgu

SEQ ID NO: 3861054 - RNA, 14 nt, Shigella flexneri 2a str. 2457T
acagaacagugcca

SEQ ID NO: 3861055 - RNA, 19 nt, Shigella flexneri 2a str. 2457T
acagaagaaagcaaugaaa

SEQ ID NO: 3861056 - RNA, 17 nt, Shigella flexneri 2a str. 2457T
acagaagugaagcaugg

SEQ ID NO: 3861057 - RNA, 19 nt, Shigella flexneri 2a str. 2457T
acagaaugcgggcgaaaac

SEQ ID NO: 3861058 - RNA, 15 nt, Shigella flexneri 2a str. 2457T
acagaauggcaucug

SEQ ID NO: 3861059 - RNA, 14 nt, Shigella flexneri 2a str. 2457T
acagaauuacuggc

SEQ ID NO: 3861060 - RNA, 13 nt, Shigella flexneri 2a str. 2457T
acagacaguaaua

SEQ ID NO: 3861061 - RNA, 18 nt, Shigella flexneri 2a str. 2457T
acagacauaaagccugcu

SEQ ID NO: 3861062 - RNA, 24 nt, Shigella flexneri 2a str. 2457T
acagaccaaaacgugcagcugccu

SEQ ID NO: 3861063 - RNA, 19 nt, Shigella flexneri 2a str. 2457T
acagaccacauuccaggcc

SEQ ID NO: 3861064 - RNA, 15 nt, Shigella flexneri 2a str. 2457T
acagaccagcaccgg

SEQ ID NO: 3861065 - RNA, 17 nt, Shigella flexneri 2a str. 2457T
acagaccaguaaagugc

SEQ ID NO: 3861066 - RNA, 12 nt, Shigella flexneri 2a str. 2457T
acagaccaucaa

SEQ ID NO: 3861067 - RNA, 11 nt, Shigella flexneri 2a str. 2457T
acagacccagg

SEQ ID NO: 3861068 - RNA, 15 nt, Shigella flexneri 2a str. 2457T
acagaccgacuuuca

SEQ ID NO: 3861069 - RNA, 18 nt, Shigella flexneri 2a str. 2457T
acagaccgcgcaguacca

SEQ ID NO: 3861070 - RNA, 20 nt, Shigella flexneri 2a str. 2457T
acagaccugcgucaccacau

SEQ ID NO: 3861071 - RNA, 20 nt, Shigella flexneri 2a str. 2457T
acagaccuuucgaacccaac

SEQ ID NO: 3861072 - RNA, 11 nt, Shigella flexneri 2a str. 2457T
acagacgacga

SEQ ID NO: 3861073 - RNA, 13 nt, Shigella flexneri 2a str. 2457T
acagacgacgaac

SEQ ID NO: 3861074 - RNA, 17 nt, Shigella flexneri 2a str. 2457T
acagacgagggaaaaua

SEQ ID NO: 3861075 - RNA, 19 nt, Shigella flexneri 2a str. 2457T
acagacgagggaaaauaaa

SEQ ID NO: 3861076 - RNA, 19 nt, Shigella flexneri 2a str. 2457T
acagacucaaaccaauggc

SEQ ID NO: 3861077 - RNA, 19 nt, Shigella flexneri 2a str. 2457T
acagacuugacgccuuuac

SEQ ID NO: 3861078 - RNA, 14 nt, Shigella flexneri 2a str. 2457T
acagagaaagcaaa

SEQ ID NO: 3861079 - RNA, 20 nt, Shigella flexneri 2a str. 2457T
acagagaacaucaauccaaa

SEQ ID NO: 3861080 - RNA, 23 nt, Shigella flexneri 2a str. 2457T
acagagaaucgggaaauaacauc

SEQ ID NO: 3861081 - RNA, 16 nt, Shigella flexneri 2a str. 2457T
acagagacgcacugcu

SEQ ID NO: 3861082 - RNA, 21 nt, Shigella flexneri 2a str. 2457T
acagagauuacuuuauuuaua

SEQ ID NO: 3861083 - RNA, 23 nt, Shigella flexneri 2a str. 2457T
acagagcacuguuacugucggca

SEQ ID NO: 3861084 - RNA, 16 nt, Shigella flexneri 2a str. 2457T
acagagcgagggagaa

SEQ ID NO: 3861085 - RNA, 16 nt, Shigella flexneri 2a str. 2457T
acagaggucuuuucuc

SEQ ID NO: 3861086 - RNA, 17 nt, Shigella flexneri 2a str. 2457T
acagagguuuuaugaua

SEQ ID NO: 3861087 - RNA, 14 nt, Shigella flexneri 2a str. 2457T
acagauaggcauca

SEQ ID NO: 3861088 - RNA, 20 nt, Shigella flexneri 2a str. 2457T
acagauaggcaucagcaauu

SEQ ID NO: 3861089 - RNA, 22 nt, Shigella flexneri 2a str. 2457T
acagaucugccuguccggcaua

SEQ ID NO: 3861090 - RNA, 22 nt, Shigella flexneri 2a str. 2457T
acagaugcaggauuucuucacc

SEQ ID NO: 3861091 - RNA, 22 nt, Shigella flexneri 2a str. 2457T
acagaugcgacggcaccacauu

SEQ ID NO: 3861092 - RNA, 12 nt, Shigella flexneri 2a str. 2457T
acagauucaggc

SEQ ID NO: 3861093 - RNA, 15 nt, Shigella flexneri 2a str. 2457T
acagauucaugcugc

SEQ ID NO: 3861094 - RNA, 16 nt, Shigella flexneri 2a str. 2457T
acagauuuugccagca

SEQ ID NO: 3861095 - RNA, 17 nt, Shigella flexneri 2a str. 2457T
acagauuuugccagcau

SEQ ID NO: 3861096 - RNA, 22 nt, Shigella flexneri 2a str. 2457T
acagauuuugccagcaugacua

SEQ ID NO: 3861097 - RNA, 20 nt, Shigella flexneri 2a str. 2457T
acagcaaagcgugcaaauau

SEQ ID NO: 3861098 - RNA, 21 nt, Shigella flexneri 2a str. 2457T
acagcaaagcgugcaaauaua

SEQ ID NO: 3861099 - RNA, 19 nt, Shigella flexneri 2a str. 2457T
acagcaaagugcccccaac

SEQ ID NO: 3861100 - RNA, 18 nt, Shigella flexneri 2a str. 2457T
acagcacauuucagaaag

SEQ ID NO: 3861101 - RNA, 16 nt, Shigella flexneri 2a str. 2457T
acagcaccauccgccc

SEQ ID NO: 3861102 - RNA, 23 nt, Shigella flexneri 2a str. 2457T
acagcaccauccgcccacaccag

SEQ ID NO: 3861103 - RNA, 17 nt, Shigella flexneri 2a str. 2457T
acagcacgccccggcug

SEQ ID NO: 3861104 - RNA, 20 nt, Shigella flexneri 2a str. 2457T
acagucaguuaucgcauuau

SEQ ID NO: 3861105 - RNA, 15 nt, Shigella flexneri 2a str. 2457T
acagucgcucggcga

SEQ ID NO: 3861106 - RNA, 15 nt, Shigella flexneri 2a str. 2457T
acagugacccgcagc

SEQ ID NO: 3861107 - RNA, 14 nt, Shigella flexneri 2a str. 2457T
acagugcaccggac

SEQ ID NO: 3861108 - RNA, 22 nt, Shigella flexneri 2a str. 2457T
acagugcugauuuugcaacaac

SEQ ID NO: 3861109 - RNA, 20 nt, Shigella flexneri 2a str. 2457T
acagugggauuaaaaaguaa

SEQ ID NO: 3861110 - RNA, 20 nt, Shigella flexneri 2a str. 2457T
acaguguaauuaggcuaaau

SEQ ID NO: 3861111 - RNA, 16 nt, Shigella flexneri 2a str. 2457T
acaguuauaaaaugau

SEQ ID NO: 3861112 - RNA, 12 nt, Shigella flexneri 2a str. 2457T
acaguucaaucu

SEQ ID NO: 3861113 - RNA, 16 nt, Shigella flexneri 2a str. 2457T
acaguucuucaaaaau

SEQ ID NO: 3861114 - RNA, 19 nt, Shigella flexneri 2a str. 2457T
acaguucuucaaaaauaau

SEQ ID NO: 3861115 - RNA, 12 nt, Shigella flexneri 2a str. 2457T
acaguucuuccu

SEQ ID NO: 3861116 - RNA, 14 nt, Shigella flexneri 2a str. 2457T
acaguuucaccugc

SEQ ID NO: 3861117 - RNA, 15 nt, Shigella flexneri 2a str. 2457T
acaguuucaccugcu

SEQ ID NO: 3861118 - RNA, 19 nt, Shigella flexneri 2a str. 2457T
acaguuucugcagcuccag

SEQ ID NO: 3861119 - RNA, 22 nt, Shigella flexneri 2a str. 2457T
acaguuuuaucuccauccggga

SEQ ID NO: 3861120 - RNA, 17 nt, Shigella flexneri 2a str. 2457T
acauaaacagguaaaga

SEQ ID NO: 3861121 - RNA, 18 nt, Shigella flexneri 2a str. 2457T
acauaaggaaacuccagc

SEQ ID NO: 3861122 - RNA, 13 nt, Shigella flexneri 2a str. 2457T
acauaauauaaau

SEQ ID NO: 3861123 - RNA, 14 nt, Shigella flexneri 2a str. 2457T
acauaauccagaca

SEQ ID NO: 3861124 - RNA, 16 nt, Shigella flexneri 2a str. 2457T
acauaaugaugccguc

SEQ ID NO: 3861125 - RNA, 12 nt, Shigella flexneri 2a str. 2457T
acauaauggccg

SEQ ID NO: 3861126 - RNA, 19 nt, Shigella flexneri 2a str. 2457T
acauacccuugaucaccgu

SEQ ID NO: 3861127 - RNA, 15 nt, Shigella flexneri 2a str. 2457T
acauaccuaaaagca

SEQ ID NO: 3861128 - RNA, 22 nt, Shigella flexneri 2a str. 2457T
acauaccuaaaagcacgccaga

SEQ ID NO: 3861129 - RNA, 18 nt, Shigella flexneri 2a str. 2457T
acauagaucuaaaugcca

SEQ ID NO: 3861130 - RNA, 15 nt, Shigella flexneri 2a str. 2457T
acauagcacaacagg

SEQ ID NO: 3861131 - RNA, 14 nt, Shigella flexneri 2a str. 2457T
acauagccaucccu

SEQ ID NO: 3861132 - RNA, 16 nt, Shigella flexneri 2a str. 2457T
acauagcgugacacca

SEQ ID NO: 3861133 - RNA, 18 nt, Shigella flexneri 2a str. 2457T
acauaguagccagccaga

SEQ ID NO: 3861134 - RNA, 20 nt, Shigella flexneri 2a str. 2457T
acauauaucgaaaaaucgac

SEQ ID NO: 3861135 - RNA, 16 nt, Shigella flexneri 2a str. 2457T
acauauccuucacaca

SEQ ID NO: 3861136 - RNA, 12 nt, Shigella flexneri 2a str. 2457T
acauaugcacau

SEQ ID NO: 3861137 - RNA, 12 nt, Shigella flexneri 2a str. 2457T
acauauucacca

SEQ ID NO: 3861138 - RNA, 19 nt, Shigella flexneri 2a str. 2457T
acauauuuuuguugaaaua

SEQ ID NO: 3861139 - RNA, 22 nt, Shigella flexneri 2a str. 2457T
acauauuuuuguugaaauaaua

SEQ ID NO: 3861140 - RNA, 14 nt, Shigella flexneri 2a str. 2457T
acaucaacccgccc

SEQ ID NO: 3861141 - RNA, 15 nt, Shigella flexneri 2a str. 2457T
acaucaagauaacua

SEQ ID NO: 3861142 - RNA, 13 nt, Shigella flexneri 2a str. 2457T
acaucaccaacac

SEQ ID NO: 3861143 - RNA, 18 nt, Shigella flexneri 2a str. 2457T
acaucaccaauacgcaua

SEQ ID NO: 3861144 - RNA, 21 nt, Shigella flexneri 2a str. 2457T
acaucaccaaugaaagcccca

SEQ ID NO: 3861145 - RNA, 18 nt, Shigella flexneri 2a str. 2457T
acaucaccaguaccgcca

SEQ ID NO: 3861146 - RNA, 13 nt, Shigella flexneri 2a str. 2457T
acaucaccgccac

SEQ ID NO: 3861147 - RNA, 21 nt, Shigella flexneri 2a str. 2457T
acaucaccguucagcuugcgu

SEQ ID NO: 3861148 - RNA, 14 nt, Shigella flexneri 2a str. 2457T
acaucacgcagcug

SEQ ID NO: 3861149 - RNA, 19 nt, Shigella flexneri 2a str. 2457T
acaucacuccauccagcaa

SEQ ID NO: 3861150 - RNA, 22 nt, Shigella flexneri 2a str. 2457T
acaucacuccauccagcaacaa

SEQ ID NO: 3861151 - RNA, 15 nt, Shigella flexneri 2a str. 2457T
acaucacuguuugac

SEQ ID NO: 3861152 - RNA, 22 nt, Shigella flexneri 2a str. 2457T
acaucagauaaucgccauccug

SEQ ID NO: 3861153 - RNA, 19 nt, Shigella flexneri 2a str. 2457T
acaucagccagaugcaccg

SEQ ID NO: 3861154 - RNA, 21 nt, Shigella flexneri 2a str. 2457T
acaucagcuaaaucacaccau

SEQ ID NO: 3861155 - RNA, 16 nt, Shigella flexneri 2a str. 2457T
acaucaucaucgccag

SEQ ID NO: 3861156 - RNA, 15 nt, Shigella flexneri 2a str. 2457T
acaucaucugccacu

SEQ ID NO: 3861157 - RNA, 20 nt, Shigella flexneri 2a str. 2457T
acaucaugguuugcauccac

SEQ ID NO: 3861158 - RNA, 14 nt, Shigella flexneri 2a str. 2457T
acaucauucccgcc

SEQ ID NO: 3861159 - RNA, 13 nt, Shigella flexneri 2a str. 2457T
acaucauuucaau

SEQ ID NO: 3861160 - RNA, 16 nt, Shigella flexneri 2a str. 2457T
acaucauuuugguuac

SEQ ID NO: 3861161 - RNA, 18 nt, Shigella flexneri 2a str. 2457T
acauccacgccuuuuuuc

SEQ ID NO: 3861162 - RNA, 14 nt, Shigella flexneri 2a str. 2457T
acauccaucugcuu

SEQ ID NO: 3861163 - RNA, 23 nt, Shigella flexneri 2a str. 2457T
acaucccagcagagaucuuucac

SEQ ID NO: 3861164 - RNA, 15 nt, Shigella flexneri 2a str. 2457T
acauccgccaucgac

SEQ ID NO: 3861165 - RNA, 11 nt, Shigella flexneri 2a str. 2457T
acauccggcaa

SEQ ID NO: 3861166 - RNA, 17 nt, Shigella flexneri 2a str. 2457T
acauccggcaauauuca

SEQ ID NO: 3861167 - RNA, 11 nt, Shigella flexneri 2a str. 2457T
acauccggcau

SEQ ID NO: 3861168 - RNA, 11 nt, Shigella flexneri 2a str. 2457T
acauccggcuu

SEQ ID NO: 3861169 - RNA, 20 nt, Shigella flexneri 2a str. 2457T
acauccugcguuaaucgccg

SEQ ID NO: 3861170 - RNA, 19 nt, Shigella flexneri 2a str. 2457T
acaucgacucaagcguugc

SEQ ID NO: 3861171 - RNA, 13 nt, Shigella flexneri 2a str. 2457T
acaucgauaaggu

SEQ ID NO: 3861172 - RNA, 14 nt, Shigella flexneri 2a str. 2457T
acaucgcaauccuu

SEQ ID NO: 3861173 - RNA, 18 nt, Shigella flexneri 2a str. 2457T
acaucgcagggaucaucc

SEQ ID NO: 3861174 - RNA, 14 nt, Shigella flexneri 2a str. 2457T
acaucgccagaaau

SEQ ID NO: 3861175 - RNA, 17 nt, Shigella flexneri 2a str. 2457T
acaucgcuaccgcgcag

SEQ ID NO: 3861176 - RNA, 13 nt, Shigella flexneri 2a str. 2457T
acaucgcugugcu

SEQ ID NO: 3861177 - RNA, 13 nt, Shigella flexneri 2a str. 2457T
acaucgcuuucca

SEQ ID NO: 3861178 - RNA, 16 nt, Shigella flexneri 2a str. 2457T
acaucguaucuggcaa

SEQ ID NO: 3861179 - RNA, 14 nt, Shigella flexneri 2a str. 2457T
acaucgucgccaga

SEQ ID NO: 3861180 - RNA, 16 nt, Shigella flexneri 2a str. 2457T
acaucguuccugcaau

SEQ ID NO: 3861181 - RNA, 20 nt, Shigella flexneri 2a str. 2457T
acaucguugacauuugcuuu

SEQ ID NO: 3861182 - RNA, 17 nt, Shigella flexneri 2a str. 2457T
acaucuaaccauuauua

SEQ ID NO: 3861183 - RNA, 18 nt, Shigella flexneri 2a str. 2457T
acaucuaaccauuauuaa

SEQ ID NO: 3861184 - RNA, 13 nt, Shigella flexneri 2a str. 2457T
acaucucaacaac

SEQ ID NO: 3861185 - RNA, 15 nt, Shigella flexneri 2a str. 2457T
acaucuccagcgcau

SEQ ID NO: 3861186 - RNA, 21 nt, Shigella flexneri 2a str. 2457T
acaucugaguugccaucauca

SEQ ID NO: 3861187 - RNA, 19 nt, Shigella flexneri 2a str. 2457T
acaucuggcgagucaccau

SEQ ID NO: 3861188 - RNA, 20 nt, Shigella flexneri 2a str. 2457T
acaucugucugauaaaaaac

SEQ ID NO: 3861189 - RNA, 14 nt, Shigella flexneri 2a str. 2457T
acaucuucaucauc

SEQ ID NO: 3861190 - RNA, 14 nt, Shigella flexneri 2a str. 2457T
acaucuuccagaau

SEQ ID NO: 3861191 - RNA, 15 nt, Shigella flexneri 2a str. 2457T
acaucuuuauaugca

SEQ ID NO: 3861192 - RNA, 22 nt, Shigella flexneri 2a str. 2457T
acaucuuucugcgcaucuuccc

SEQ ID NO: 3861193 - RNA, 18 nt, Shigella flexneri 2a str. 2457T
acaugaaaauaaccauau

SEQ ID NO: 3861194 - RNA, 24 nt, Shigella flexneri 2a str. 2457T
acaugaaaauaaccauauaugaua

SEQ ID NO: 3861195 - RNA, 15 nt, Shigella flexneri 2a str. 2457T
acaugaaacagaaaa

SEQ ID NO: 3861196 - RNA, 21 nt, Shigella flexneri 2a str. 2457T
acaugaaccgugucgccauca

SEQ ID NO: 3861197 - RNA, 16 nt, Shigella flexneri 2a str. 2457T
acaugaagcacugcau

SEQ ID NO: 3861198 - RNA, 19 nt, Shigella flexneri 2a str. 2457T
acaugagaacaguucagca

SEQ ID NO: 3861199 - RNA, 12 nt, Shigella flexneri 2a str. 2457T
acaugagagaaa

SEQ ID NO: 3861200 - RNA, 14 nt, Shigella flexneri 2a str. 2457T
acaugagagaaaau

SEQ ID NO: 3861201 - RNA, 17 nt, Shigella flexneri 2a str. 2457T
acaugagcgaauaaaaa

SEQ ID NO: 3861202 - RNA, 22 nt, Shigella flexneri 2a str. 2457T
accaauguuacgaccuuccuga

SEQ ID NO: 3861203 - RNA, 21 nt, Shigella flexneri 2a str. 2457T
accaauucuccaaugccguuc

SEQ ID NO: 3861204 - RNA, 17 nt, Shigella flexneri 2a str. 2457T
accaauuuugcauucac

SEQ ID NO: 3861205 - RNA, 22 nt, Shigella flexneri 2a str. 2457T
accacaaacucuuuuccggaac

SEQ ID NO: 3861206 - RNA, 14 nt, Shigella flexneri 2a str. 2457T
accacaaccgccgu

SEQ ID NO: 3861207 - RNA, 15 nt, Shigella flexneri 2a str. 2457T
accacaauugaccag

SEQ ID NO: 3861208 - RNA, 16 nt, Shigella flexneri 2a str. 2457T
accacacccgcaagac

SEQ ID NO: 3861209 - RNA, 20 nt, Shigella flexneri 2a str. 2457T
accacacccgcaagacgaac

SEQ ID NO: 3861210 - RNA, 16 nt, Shigella flexneri 2a str. 2457T
accacacggucuauca

SEQ ID NO: 3861211 - RNA, 14 nt, Shigella flexneri 2a str. 2457T
accacacuucuuca

SEQ ID NO: 3861212 - RNA, 14 nt, Shigella flexneri 2a str. 2457T
accacagacaaaca

SEQ ID NO: 3861213 - RNA, 21 nt, Shigella flexneri 2a str. 2457T
accacagaccggacugacucc

SEQ ID NO: 3861214 - RNA, 15 nt, Shigella flexneri 2a str. 2457T
accacagcaaaacac

SEQ ID NO: 3861215 - RNA, 20 nt, Shigella flexneri 2a str. 2457T
accacaggccggagccagcc

SEQ ID NO: 3861216 - RNA, 15 nt, Shigella flexneri 2a str. 2457T
accacaucaaucccu

SEQ ID NO: 3861217 - RNA, 22 nt, Shigella flexneri 2a str. 2457T
accacaugaucauucaccagcc

SEQ ID NO: 3861218 - RNA, 17 nt, Shigella flexneri 2a str. 2457T
accaccaaaaacgccau

SEQ ID NO: 3861219 - RNA, 14 nt, Shigella flexneri 2a str. 2457T
accaccaaaaccac

SEQ ID NO: 3861220 - RNA, 13 nt, Shigella flexneri 2a str. 2457T
accaccaccgcag

SEQ ID NO: 3861221 - RNA, 20 nt, Shigella flexneri 2a str. 2457T
accaccagacgcaacagaaa

SEQ ID NO: 3861222 - RNA, 14 nt, Shigella flexneri 2a str. 2457T
accaccagcacacu

SEQ ID NO: 3861223 - RNA, 14 nt, Shigella flexneri 2a str. 2457T
accaccagcaccgc

SEQ ID NO: 3861224 - RNA, 15 nt, Shigella flexneri 2a str. 2457T
accaccagcaccgcg

SEQ ID NO: 3861225 - RNA, 12 nt, Shigella flexneri 2a str. 2457T
accaccagcacg

SEQ ID NO: 3861226 - RNA, 18 nt, Shigella flexneri 2a str. 2457T
accaccagcggaauauca

SEQ ID NO: 3861227 - RNA, 11 nt, Shigella flexneri 2a str. 2457T
accaccaugcu

SEQ ID NO: 3861228 - RNA, 14 nt, Shigella flexneri 2a str. 2457T
accacccaccagcg

SEQ ID NO: 3861229 - RNA, 17 nt, Shigella flexneri 2a str. 2457T
accacccaccagcgccg

SEQ ID NO: 3861230 - RNA, 15 nt, Shigella flexneri 2a str. 2457T
accacccaccgcagc

SEQ ID NO: 3861231 - RNA, 17 nt, Shigella flexneri 2a str. 2457T
accacccauuuuaaugu

SEQ ID NO: 3861232 - RNA, 15 nt, Shigella flexneri 2a str. 2457T
accacccgcagugau

SEQ ID NO: 3861233 - RNA, 21 nt, Shigella flexneri 2a str. 2457T
accaccgacgugguuaacgac

SEQ ID NO: 3861234 - RNA, 21 nt, Shigella flexneri 2a str. 2457T
accaccgaugcacagcacgcu

SEQ ID NO: 3861235 - RNA, 18 nt, Shigella flexneri 2a str. 2457T
accaccgcaaucgccagu

SEQ ID NO: 3861236 - RNA, 17 nt, Shigella flexneri 2a str. 2457T
accaccggacgcacacg

SEQ ID NO: 3861237 - RNA, 23 nt, Shigella flexneri 2a str. 2457T
accaccggauguagcaacggagg

SEQ ID NO: 3861238 - RNA, 13 nt, Shigella flexneri 2a str. 2457T
accaccggcacca

SEQ ID NO: 3861239 - RNA, 18 nt, Shigella flexneri 2a str. 2457T
accaccggcaccacuugc

SEQ ID NO: 3861240 - RNA, 12 nt, Shigella flexneri 2a str. 2457T
accaccuccacg

SEQ ID NO: 3861241 - RNA, 15 nt, Shigella flexneri 2a str. 2457T
accaccuccacgccc

SEQ ID NO: 3861242 - RNA, 14 nt, Shigella flexneri 2a str. 2457T
accaccugcaauac

SEQ ID NO: 3861243 - RNA, 14 nt, Shigella flexneri 2a str. 2457T
accacgaaaacagc

SEQ ID NO: 3861244 - RNA, 15 nt, Shigella flexneri 2a str. 2457T
accacgaagcaaugg

SEQ ID NO: 3861245 - RNA, 18 nt, Shigella flexneri 2a str. 2457T
accacgacaccuuucacg

SEQ ID NO: 3861246 - RNA, 17 nt, Shigella flexneri 2a str. 2457T
accacgacgaagcgccu

SEQ ID NO: 3861247 - RNA, 14 nt, Shigella flexneri 2a str. 2457T
accacgauauguuc

SEQ ID NO: 3861248 - RNA, 17 nt, Shigella flexneri 2a str. 2457T
accacgcagcguuggca

SEQ ID NO: 3861249 - RNA, 17 nt, Shigella flexneri 2a str. 2457T
accacgccaagaaacac

SEQ ID NO: 3861250 - RNA, 17 nt, Shigella flexneri 2a str. 2457T
accacgccugccgccag

SEQ ID NO: 3861251 - RNA, 18 nt, Shigella flexneri 2a str. 2457T
accacgccugccgccagc

SEQ ID NO: 3861252 - RNA, 13 nt, Shigella flexneri 2a str. 2457T
accacgcgggcca

SEQ ID NO: 3861253 - RNA, 18 nt, Shigella flexneri 2a str. 2457T
accacgcuccaucauguc

SEQ ID NO: 3861254 - RNA, 20 nt, Shigella flexneri 2a str. 2457T
accacggaguugaccagcuc

SEQ ID NO: 3861255 - RNA, 15 nt, Shigella flexneri 2a str. 2457T
accacggcagcaacu

SEQ ID NO: 3861256 - RNA, 16 nt, Shigella flexneri 2a str. 2457T
accacggcagcaacuu

SEQ ID NO: 3861257 - RNA, 16 nt, Shigella flexneri 2a str. 2457T
accacggccuuccucg

SEQ ID NO: 3861258 - RNA, 16 nt, Shigella flexneri 2a str. 2457T
accacggcgugccguc

SEQ ID NO: 3861259 - RNA, 18 nt, Shigella flexneri 2a str. 2457T
accacguaccacggcauu

SEQ ID NO: 3861260 - RNA, 15 nt, Shigella flexneri 2a str. 2457T
accacguucauuuca

SEQ ID NO: 3861261 - RNA, 14 nt, Shigella flexneri 2a str. 2457T
accacguugacaaa

SEQ ID NO: 3861262 - RNA, 13 nt, Shigella flexneri 2a str. 2457T
accacguuuuuca

SEQ ID NO: 3861263 - RNA, 15 nt, Shigella flexneri 2a str. 2457T
accacucaccgccgu

SEQ ID NO: 3861264 - RNA, 14 nt, Shigella flexneri 2a str. 2457T
accacuccggcaug

SEQ ID NO: 3861265 - RNA, 18 nt, Shigella flexneri 2a str. 2457T
accacucugaccugacaa

SEQ ID NO: 3861266 - RNA, 18 nt, Shigella flexneri 2a str. 2457T
accacugacacggaacaa

SEQ ID NO: 3861267 - RNA, 12 nt, Shigella flexneri 2a str. 2457T
accacugauaag

SEQ ID NO: 3861268 - RNA, 19 nt, Shigella flexneri 2a str. 2457T
accacugccagauucucca

SEQ ID NO: 3861269 - RNA, 14 nt, Shigella flexneri 2a str. 2457T
accacugcgcauaa

SEQ ID NO: 3861270 - RNA, 20 nt, Shigella flexneri 2a str. 2457T
accacugcgcauaauccacu

SEQ ID NO: 3861271 - RNA, 14 nt, Shigella flexneri 2a str. 2457T
accacugcgccagc

SEQ ID NO: 3861272 - RNA, 15 nt, Shigella flexneri 2a str. 2457T
accacugcgccagcg

SEQ ID NO: 3861273 - RNA, 15 nt, Shigella flexneri 2a str. 2457T
accacuuaauuauua

SEQ ID NO: 3861274 - RNA, 16 nt, Shigella flexneri 2a str. 2457T
accacuuaauuauuaa

SEQ ID NO: 3861275 - RNA, 13 nt, Shigella flexneri 2a str. 2457T
accacuucacccg

SEQ ID NO: 3861276 - RNA, 20 nt, Shigella flexneri 2a str. 2457T
accacuuccagcagaccagc

SEQ ID NO: 3861277 - RNA, 13 nt, Shigella flexneri 2a str. 2457T
accacuuuaacca

SEQ ID NO: 3861278 - RNA, 14 nt, Shigella flexneri 2a str. 2457T
accagaaacaauaa

SEQ ID NO: 3861279 - RNA, 19 nt, Shigella flexneri 2a str. 2457T
accagaaagggaagaacau

SEQ ID NO: 3861280 - RNA, 12 nt, Shigella flexneri 2a str. 2457T
accagaagagaa

SEQ ID NO: 3861281 - RNA, 13 nt, Shigella flexneri 2a str. 2457T
accagaaucaauc

SEQ ID NO: 3861282 - RNA, 18 nt, Shigella flexneri 2a str. 2457T
accagaaucgccagcauc

SEQ ID NO: 3861283 - RNA, 18 nt, Shigella flexneri 2a str. 2457T
accagacaucccagugca

SEQ ID NO: 3861284 - RNA, 17 nt, Shigella flexneri 2a str. 2457T
accagaccaauggcuuu

SEQ ID NO: 3861285 - RNA, 21 nt, Shigella flexneri 2a str. 2457T
accagaccggcaaucgcgcca

SEQ ID NO: 3861286 - RNA, 23 nt, Shigella flexneri 2a str. 2457T
accagaccggcaaucgcgccaga

SEQ ID NO: 3861287 - RNA, 17 nt, Shigella flexneri 2a str. 2457T
accagacgcaacagaaa

SEQ ID NO: 3861288 - RNA, 21 nt, Shigella flexneri 2a str. 2457T
accagacgcgcguccccugcc

SEQ ID NO: 3861289 - RNA, 14 nt, Shigella flexneri 2a str. 2457T
accagacgcgggca

SEQ ID NO: 3861290 - RNA, 16 nt, Shigella flexneri 2a str. 2457T
accagacggcguaauc

SEQ ID NO: 3861291 - RNA, 18 nt, Shigella flexneri 2a str. 2457T
accagacugugaaucaug

SEQ ID NO: 3861292 - RNA, 22 nt, Shigella flexneri 2a str. 2457T
accagacugugaaucauggaug

SEQ ID NO: 3861293 - RNA, 23 nt, Shigella flexneri 2a str. 2457T
accagagauguugaagaagucga

SEQ ID NO: 3861294 - RNA, 20 nt, Shigella flexneri 2a str. 2457T
accagagcugauacgggagg

SEQ ID NO: 3861295 - RNA, 12 nt, Shigella flexneri 2a str. 2457T
accagauacaaa

SEQ ID NO: 3861296 - RNA, 21 nt, Shigella flexneri 2a str. 2457T
accagaucuggcgauuauuuu

SEQ ID NO: 3861297 - RNA, 19 nt, Shigella flexneri 2a str. 2457T
accagaucuucaucaccga

SEQ ID NO: 3861298 - RNA, 20 nt, Shigella flexneri 2a str. 2457T
accagaugcucuuuucugaa

SEQ ID NO: 3861299 - RNA, 19 nt, Shigella flexneri 2a str. 2457T
accagauuaaucagcagau

SEQ ID NO: 3861300 - RNA, 16 nt, Shigella flexneri 2a str. 2457T
accaucgccauuuaac

SEQ ID NO: 3861301 - RNA, 23 nt, Shigella flexneri 2a str. 2457T
accaucgccauuuaacgcaucac

SEQ ID NO: 3861302 - RNA, 21 nt, Shigella flexneri 2a str. 2457T
accaucgcuacauaacgcagc

SEQ ID NO: 3861303 - RNA, 17 nt, Shigella flexneri 2a str. 2457T
accaucggcaccaccaa

SEQ ID NO: 3861304 - RNA, 21 nt, Shigella flexneri 2a str. 2457T
accaucggcaccaccaaaaac

SEQ ID NO: 3861305 - RNA, 16 nt, Shigella flexneri 2a str. 2457T
accaucggcagcgcca

SEQ ID NO: 3861306 - RNA, 14 nt, Shigella flexneri 2a str. 2457T
accaucggcgcuac

SEQ ID NO: 3861307 - RNA, 17 nt, Shigella flexneri 2a str. 2457T
accaucguaagcgccag

SEQ ID NO: 3861308 - RNA, 20 nt, Shigella flexneri 2a str. 2457T
accaucguccagcagcaaug

SEQ ID NO: 3861309 - RNA, 13 nt, Shigella flexneri 2a str. 2457T
accaucuuugcug

SEQ ID NO: 3861310 - RNA, 13 nt, Shigella flexneri 2a str. 2457T
accaucuuuuuug

SEQ ID NO: 3861311 - RNA, 21 nt, Shigella flexneri 2a str. 2457T
accaugacacuucagccauca

SEQ ID NO: 3861312 - RNA, 14 nt, Shigella flexneri 2a str. 2457T
accaugacgccgaa

SEQ ID NO: 3861313 - RNA, 20 nt, Shigella flexneri 2a str. 2457T
accaugcaaaaugguuccug

SEQ ID NO: 3861314 - RNA, 23 nt, Shigella flexneri 2a str. 2457T
accaugcaauuaccgccaccagg

SEQ ID NO: 3861315 - RNA, 14 nt, Shigella flexneri 2a str. 2457T
accaugcaccaacc

SEQ ID NO: 3861316 - RNA, 15 nt, Shigella flexneri 2a str. 2457T
accaugcgcaucauc

SEQ ID NO: 3861317 - RNA, 16 nt, Shigella flexneri 2a str. 2457T
accauggaagaaaaau

SEQ ID NO: 3861318 - RNA, 18 nt, Shigella flexneri 2a str. 2457T
accauggcucaccagcag

SEQ ID NO: 3861319 - RNA, 15 nt, Shigella flexneri 2a str. 2457T
accauguucacugcc

SEQ ID NO: 3861320 - RNA, 19 nt, Shigella flexneri 2a str. 2457T
accauuaaucgauaaacca

SEQ ID NO: 3861321 - RNA, 21 nt, Shigella flexneri 2a str. 2457T
accauuacuguauacgggcuu

SEQ ID NO: 3861322 - RNA, 14 nt, Shigella flexneri 2a str. 2457T
accauuauuaaauu

SEQ ID NO: 3861323 - RNA, 16 nt, Shigella flexneri 2a str. 2457T
accauugaagcaaucc

SEQ ID NO: 3861324 - RNA, 17 nt, Shigella flexneri 2a str. 2457T
accauugaggauugcgc

SEQ ID NO: 3861325 - RNA, 17 nt, Shigella flexneri 2a str. 2457T
accauugcugccgccag

SEQ ID NO: 3861326 - RNA, 14 nt, Shigella flexneri 2a str. 2457T
accauuucugcgag

SEQ ID NO: 3861327 - RNA, 23 nt, Shigella flexneri 2a str. 2457T
accauuuuuguaagguggcguca

SEQ ID NO: 3861328 - RNA, 14 nt, Shigella flexneri 2a str. 2457T
acccaaccgguaau

SEQ ID NO: 3861329 - RNA, 21 nt, Shigella flexneri 2a str. 2457T
acccaacgcaaagagagaagc

SEQ ID NO: 3861330 - RNA, 18 nt, Shigella flexneri 2a str. 2457T
acccaacguaacaaaacu

SEQ ID NO: 3861331 - RNA, 11 nt, Shigella flexneri 2a str. 2457T
acccaauccag

SEQ ID NO: 3861332 - RNA, 14 nt, Shigella flexneri 2a str. 2457T
acccaaucccccac

SEQ ID NO: 3861333 - RNA, 20 nt, Shigella flexneri 2a str. 2457T
acccaaucccccacuuuuaa

SEQ ID NO: 3861334 - RNA, 14 nt, Shigella flexneri 2a str. 2457T
acccacacuucaau

SEQ ID NO: 3861335 - RNA, 16 nt, Shigella flexneri 2a str. 2457T
acccacauguugcgcu

SEQ ID NO: 3861336 - RNA, 22 nt, Shigella flexneri 2a str. 2457T
acccacauguugcgcuucacca

SEQ ID NO: 3861337 - RNA, 22 nt, Shigella flexneri 2a str. 2457T
acccaccaugccgauggcaaaa

SEQ ID NO: 3861338 - RNA, 20 nt, Shigella flexneri 2a str. 2457T
acccaccgauuuucagccau

SEQ ID NO: 3861339 - RNA, 13 nt, Shigella flexneri 2a str. 2457T
acccaccgcagcc

SEQ ID NO: 3861340 - RNA, 22 nt, Shigella flexneri 2a str. 2457T
acccaccgggcagacgugacca

SEQ ID NO: 3861341 - RNA, 21 nt, Shigella flexneri 2a str. 2457T
acccaccgguccuaacaacca

SEQ ID NO: 3861342 - RNA, 17 nt, Shigella flexneri 2a str. 2457T
acccacggauagauuuu

SEQ ID NO: 3861343 - RNA, 20 nt, Shigella flexneri 2a str. 2457T
acccacggauagauuuuuaa

SEQ ID NO: 3861344 - RNA, 20 nt, Shigella flexneri 2a str. 2457T
acccacgguacucaucacgu

SEQ ID NO: 3861345 - RNA, 15 nt, Shigella flexneri 2a str. 2457T
acccacugcgcagug

SEQ ID NO: 3861346 - RNA, 12 nt, Shigella flexneri 2a str. 2457T
acccagaacuau

SEQ ID NO: 3861347 - RNA, 23 nt, Shigella flexneri 2a str. 2457T
acccagaagaaagccggaugauc

SEQ ID NO: 3861348 - RNA, 19 nt, Shigella flexneri 2a str. 2457T
acccagaaucucuuuuguu

SEQ ID NO: 3861349 - RNA, 16 nt, Shigella flexneri 2a str. 2457T
acccagcaauccugca

SEQ ID NO: 3861350 - RNA, 18 nt, Shigella flexneri 2a str. 2457T
acccagcaccaguaccau

SEQ ID NO: 3861351 - RNA, 13 nt, Shigella flexneri 2a str. 2457T
acccagcagcagc

SEQ ID NO: 3861352 - RNA, 15 nt, Shigella flexneri 2a str. 2457T
acccagcagcgccac

SEQ ID NO: 3861353 - RNA, 21 nt, Shigella flexneri 2a str. 2457T
acccagcagguccccgagcac

SEQ ID NO: 3861354 - RNA, 23 nt, Shigella flexneri 2a str. 2457T
acccagcagguccccgagcacau

SEQ ID NO: 3861355 - RNA, 20 nt, Shigella flexneri 2a str. 2457T
acccagcguguugaggaagc

SEQ ID NO: 3861356 - RNA, 14 nt, Shigella flexneri 2a str. 2457T
acccaggccugccc

SEQ ID NO: 3861357 - RNA, 16 nt, Shigella flexneri 2a str. 2457T
acccaggccugcccac

SEQ ID NO: 3861358 - RNA, 20 nt, Shigella flexneri 2a str. 2457T
acccagggaaaggauugcga

SEQ ID NO: 3861359 - RNA, 23 nt, Shigella flexneri 2a str. 2457T
acccaguuucggcaucagcagaa

SEQ ID NO: 3861360 - RNA, 14 nt, Shigella flexneri 2a str. 2457T
acccauaaucagac

SEQ ID NO: 3861361 - RNA, 18 nt, Shigella flexneri 2a str. 2457T
acccaucaacaacuggcg

SEQ ID NO: 3861362 - RNA, 19 nt, Shigella flexneri 2a str. 2457T
acccaucaagcgaaaaugc

SEQ ID NO: 3861363 - RNA, 17 nt, Shigella flexneri 2a str. 2457T
acccaucgccagauaga

SEQ ID NO: 3861364 - RNA, 17 nt, Shigella flexneri 2a str. 2457T
acccaucugccagcgcc

SEQ ID NO: 3861365 - RNA, 15 nt, Shigella flexneri 2a str. 2457T
acccaugaacaaaau

SEQ ID NO: 3861366 - RNA, 24 nt, Shigella flexneri 2a str. 2457T
acccaugacuuugaucugaccgaa

SEQ ID NO: 3861367 - RNA, 22 nt, Shigella flexneri 2a str. 2457T
acccauguuuaauucacgcagg

SEQ ID NO: 3861368 - RNA, 19 nt, Shigella flexneri 2a str. 2457T
acccauuuauccagcggca

SEQ ID NO: 3861369 - RNA, 21 nt, Shigella flexneri 2a str. 2457T
acccauuuauccagcggcagc

SEQ ID NO: 3861370 - RNA, 14 nt, Shigella flexneri 2a str. 2457T
accccacgucaucu

SEQ ID NO: 3861371 - RNA, 22 nt, Shigella flexneri 2a str. 2457T
accccaggccgcguaccgcagc

SEQ ID NO: 3861372 - RNA, 16 nt, Shigella flexneri 2a str. 2457T
accccaggcugugcgc

SEQ ID NO: 3861373 - RNA, 22 nt, Shigella flexneri 2a str. 2457T
accccagugguuucgccagcac

SEQ ID NO: 3861374 - RNA, 19 nt, Shigella flexneri 2a str. 2457T
accccauggagaaaaugug

SEQ ID NO: 3861375 - RNA, 15 nt, Shigella flexneri 2a str. 2457T
accccauugaagaau

SEQ ID NO: 3861376 - RNA, 21 nt, Shigella flexneri 2a str. 2457T
accccgcaauuucauuauuca

SEQ ID NO: 3861377 - RNA, 22 nt, Shigella flexneri 2a str. 2457T
accccgcacggugcaccgcauc

SEQ ID NO: 3861378 - RNA, 15 nt, Shigella flexneri 2a str. 2457T
accccgcagcaaccg

SEQ ID NO: 3861379 - RNA, 22 nt, Shigella flexneri 2a str. 2457T
accccggcggccggaugacaga

SEQ ID NO: 3861380 - RNA, 15 nt, Shigella flexneri 2a str. 2457T
accccuuccugaaua

SEQ ID NO: 3861381 - RNA, 19 nt, Shigella flexneri 2a str. 2457T
accccuuucucgcccagca

SEQ ID NO: 3861382 - RNA, 20 nt, Shigella flexneri 2a str. 2457T
accccuuucucgcccagcag

SEQ ID NO: 3861383 - RNA, 21 nt, Shigella flexneri 2a str. 2457T
accccuuucucgcccagcaga

SEQ ID NO: 3861384 - RNA, 22 nt, Shigella flexneri 2a str. 2457T
accccuuucucgcccagcagac

SEQ ID NO: 3861385 - RNA, 14 nt, Shigella flexneri 2a str. 2457T
acccgaccacuucc

SEQ ID NO: 3861386 - RNA, 16 nt, Shigella flexneri 2a str. 2457T
acccgacgugcagcau

SEQ ID NO: 3861387 - RNA, 14 nt, Shigella flexneri 2a str. 2457T
acccgaugcgcuuu

SEQ ID NO: 3861388 - RNA, 17 nt, Shigella flexneri 2a str. 2457T
acccgauggcgugcccg

SEQ ID NO: 3861389 - RNA, 18 nt, Shigella flexneri 2a str. 2457T
acccgcaaacaggaacac

SEQ ID NO: 3861390 - RNA, 21 nt, Shigella flexneri 2a str. 2457T
acccgcaaacaggaacaccag

SEQ ID NO: 3861391 - RNA, 18 nt, Shigella flexneri 2a str. 2457T
acccgcaacaaugccgau

SEQ ID NO: 3861392 - RNA, 14 nt, Shigella flexneri 2a str. 2457T
acccgcagccagca

SEQ ID NO: 3861393 - RNA, 15 nt, Shigella flexneri 2a str. 2457T
acccgcagccaucac

SEQ ID NO: 3861394 - RNA, 21 nt, Shigella flexneri 2a str. 2457T
acccgcagugauugccgcaac

SEQ ID NO: 3861395 - RNA, 22 nt, Shigella flexneri 2a str. 2457T
acccgcccaccauguucacugc

SEQ ID NO: 3861396 - RNA, 15 nt, Shigella flexneri 2a str. 2457T
acccgcgaccaccag

SEQ ID NO: 3861397 - RNA, 22 nt, Shigella flexneri 2a str. 2457T
accgccaggugaaauccggcau

SEQ ID NO: 3861398 - RNA, 15 nt, Shigella flexneri 2a str. 2457T
accgccagugcagcg

SEQ ID NO: 3861399 - RNA, 19 nt, Shigella flexneri 2a str. 2457T
accgccaguguggcggcua

SEQ ID NO: 3861400 - RNA, 20 nt, Shigella flexneri 2a str. 2457T
accgccaguguggcggcuaa

SEQ ID NO: 3861401 - RNA, 13 nt, Shigella flexneri 2a str. 2457T
accgccaucaugg

SEQ ID NO: 3861402 - RNA, 19 nt, Shigella flexneri 2a str. 2457T
accgccauuaaacgcagua

SEQ ID NO: 3861403 - RNA, 22 nt, Shigella flexneri 2a str. 2457T
accgcccagugcggugccgcga

SEQ ID NO: 3861404 - RNA, 12 nt, Shigella flexneri 2a str. 2457T
accgccccugca

SEQ ID NO: 3861405 - RNA, 12 nt, Shigella flexneri 2a str. 2457T
accgccgauacc

SEQ ID NO: 3861406 - RNA, 22 nt, Shigella flexneri 2a str. 2457T
accgccgccaugcuugaagggc

SEQ ID NO: 3861407 - RNA, 21 nt, Shigella flexneri 2a str. 2457T
accgccgcuccagaaucucaa

SEQ ID NO: 3861408 - RNA, 19 nt, Shigella flexneri 2a str. 2457T
accgccgucgauggcgcag

SEQ ID NO: 3861409 - RNA, 16 nt, Shigella flexneri 2a str. 2457T
accgccguugccuuua

SEQ ID NO: 3861410 - RNA, 22 nt, Shigella flexneri 2a str. 2457T
accgccugaaauacccgcucau

SEQ ID NO: 3861411 - RNA, 14 nt, Shigella flexneri 2a str. 2457T
accgccuggcgcug

SEQ ID NO: 3861412 - RNA, 16 nt, Shigella flexneri 2a str. 2457T
accgccuggcgcugcu

SEQ ID NO: 3861413 - RNA, 13 nt, Shigella flexneri 2a str. 2457T
accgccuugcugu

SEQ ID NO: 3861414 - RNA, 15 nt, Shigella flexneri 2a str. 2457T
accgcgacaguauca

SEQ ID NO: 3861415 - RNA, 22 nt, Shigella flexneri 2a str. 2457T
accgcgaggccuaacaccauca

SEQ ID NO: 3861416 - RNA, 20 nt, Shigella flexneri 2a str. 2457T
accgcgaguaaucacaucaa

SEQ ID NO: 3861417 - RNA, 15 nt, Shigella flexneri 2a str. 2457T
accgcgaucuuccac

SEQ ID NO: 3861418 - RNA, 14 nt, Shigella flexneri 2a str. 2457T
accgcgcaguacca

SEQ ID NO: 3861419 - RNA, 12 nt, Shigella flexneri 2a str. 2457T
accgcgcauacg

SEQ ID NO: 3861420 - RNA, 17 nt, Shigella flexneri 2a str. 2457T
accgcgccauguugccu

SEQ ID NO: 3861421 - RNA, 18 nt, Shigella flexneri 2a str. 2457T
accgcgguguauaccagc

SEQ ID NO: 3861422 - RNA, 16 nt, Shigella flexneri 2a str. 2457T
accgcguaauacauca

SEQ ID NO: 3861423 - RNA, 21 nt, Shigella flexneri 2a str. 2457T
accgcguaugcccagcgcaga

SEQ ID NO: 3861424 - RNA, 12 nt, Shigella flexneri 2a str. 2457T
accgcgucgauc

SEQ ID NO: 3861425 - RNA, 13 nt, Shigella flexneri 2a str. 2457T
accgcguuuucca

SEQ ID NO: 3861426 - RNA, 14 nt, Shigella flexneri 2a str. 2457T
accgcucagcuccu

SEQ ID NO: 3861427 - RNA, 15 nt, Shigella flexneri 2a str. 2457T
accgcucaucgcccg

SEQ ID NO: 3861428 - RNA, 22 nt, Shigella flexneri 2a str. 2457T
accgcuccgccaucuucuugca

SEQ ID NO: 3861429 - RNA, 13 nt, Shigella flexneri 2a str. 2457T
accgcucgcgcuu

SEQ ID NO: 3861430 - RNA, 22 nt, Shigella flexneri 2a str. 2457T
accgcucuucauacgcggcaga

SEQ ID NO: 3861431 - RNA, 15 nt, Shigella flexneri 2a str. 2457T
accgcugacuuucaa

SEQ ID NO: 3861432 - RNA, 23 nt, Shigella flexneri 2a str. 2457T
accgcugacuuucaaacgccaca

SEQ ID NO: 3861433 - RNA, 23 nt, Shigella flexneri 2a str. 2457T
accgcugcuuaauuacugccuua

SEQ ID NO: 3861434 - RNA, 23 nt, Shigella flexneri 2a str. 2457T
accgcuguccacgccuuaugcca

SEQ ID NO: 3861435 - RNA, 21 nt, Shigella flexneri 2a str. 2457T
accgcuguccagucgcaaacc

SEQ ID NO: 3861436 - RNA, 20 nt, Shigella flexneri 2a str. 2457T
accgcuucaacagcggcauu

SEQ ID NO: 3861437 - RNA, 19 nt, Shigella flexneri 2a str. 2457T
accgcuuuacgccaccgca

SEQ ID NO: 3861438 - RNA, 12 nt, Shigella flexneri 2a str. 2457T
accgcuuuucca

SEQ ID NO: 3861439 - RNA, 17 nt, Shigella flexneri 2a str. 2457T
accgcuuuugucggcac

SEQ ID NO: 3861440 - RNA, 22 nt, Shigella flexneri 2a str. 2457T
accggaaaaggcguucacgccg

SEQ ID NO: 3861441 - RNA, 14 nt, Shigella flexneri 2a str. 2457T
accggaaaaggugu

SEQ ID NO: 3861442 - RNA, 12 nt, Shigella flexneri 2a str. 2457T
accggaaccagc

SEQ ID NO: 3861443 - RNA, 12 nt, Shigella flexneri 2a str. 2457T
accggaacccac

SEQ ID NO: 3861444 - RNA, 14 nt, Shigella flexneri 2a str. 2457T
accggaacccaccg

SEQ ID NO: 3861445 - RNA, 17 nt, Shigella flexneri 2a str. 2457T
accggaauucagguacg

SEQ ID NO: 3861446 - RNA, 13 nt, Shigella flexneri 2a str. 2457T
accggacaauaaa

SEQ ID NO: 3861447 - RNA, 19 nt, Shigella flexneri 2a str. 2457T
accggacaguuugaucagu

SEQ ID NO: 3861448 - RNA, 16 nt, Shigella flexneri 2a str. 2457T
accggacgacggcauc

SEQ ID NO: 3861449 - RNA, 22 nt, Shigella flexneri 2a str. 2457T
accggagaauuagcguccggcu

SEQ ID NO: 3861450 - RNA, 14 nt, Shigella flexneri 2a str. 2457T
accggagagaauau

SEQ ID NO: 3861451 - RNA, 16 nt, Shigella flexneri 2a str. 2457T
accggauaaaggcggc

SEQ ID NO: 3861452 - RNA, 20 nt, Shigella flexneri 2a str. 2457T
accggauuuccgaaaaaagc

SEQ ID NO: 3861453 - RNA, 14 nt, Shigella flexneri 2a str. 2457T
accggauuuucacc

SEQ ID NO: 3861454 - RNA, 18 nt, Shigella flexneri 2a str. 2457T
accggauuuucaccaucg

SEQ ID NO: 3861455 - RNA, 17 nt, Shigella flexneri 2a str. 2457T
accggauuuuuuuuccg

SEQ ID NO: 3861456 - RNA, 16 nt, Shigella flexneri 2a str. 2457T
accggcaaacuucguc

SEQ ID NO: 3861457 - RNA, 15 nt, Shigella flexneri 2a str. 2457T
accggcaaccagcac

SEQ ID NO: 3861458 - RNA, 16 nt, Shigella flexneri 2a str. 2457T
accggcaaccagcacc

SEQ ID NO: 3861459 - RNA, 16 nt, Shigella flexneri 2a str. 2457T
accggcaauaauuaac

SEQ ID NO: 3861460 - RNA, 14 nt, Shigella flexneri 2a str. 2457T
accggcaaucugcu

SEQ ID NO: 3861461 - RNA, 13 nt, Shigella flexneri 2a str. 2457T
accggcacccaau

SEQ ID NO: 3861462 - RNA, 23 nt, Shigella flexneri 2a str. 2457T
accggcauguuuaauucugcggc

SEQ ID NO: 3861463 - RNA, 22 nt, Shigella flexneri 2a str. 2457T
accggcauuuuuuagcgccagc

SEQ ID NO: 3861464 - RNA, 18 nt, Shigella flexneri 2a str. 2457T
accggcguaacggccacg

SEQ ID NO: 3861465 - RNA, 13 nt, Shigella flexneri 2a str. 2457T
accggcuccagau

SEQ ID NO: 3861466 - RNA, 18 nt, Shigella flexneri 2a str. 2457T
accggcuucucgccuacc

SEQ ID NO: 3861467 - RNA, 21 nt, Shigella flexneri 2a str. 2457T
accgggcgcaaggugugggca

SEQ ID NO: 3861468 - RNA, 19 nt, Shigella flexneri 2a str. 2457T
accgggcucuuuucgaaaa

SEQ ID NO: 3861469 - RNA, 14 nt, Shigella flexneri 2a str. 2457T
accgggcuguucac

SEQ ID NO: 3861470 - RNA, 16 nt, Shigella flexneri 2a str. 2457T
accggggacaggcggc

SEQ ID NO: 3861471 - RNA, 17 nt, Shigella flexneri 2a str. 2457T
accgggugcagagcccg

SEQ ID NO: 3861472 - RNA, 17 nt, Shigella flexneri 2a str. 2457T
accggguuuucaaugau

SEQ ID NO: 3861473 - RNA, 19 nt, Shigella flexneri 2a str. 2457T
accgguaaagaagagcggc

SEQ ID NO: 3861474 - RNA, 16 nt, Shigella flexneri 2a str. 2457T
accgguagugccuguu

SEQ ID NO: 3861475 - RNA, 21 nt, Shigella flexneri 2a str. 2457T
accgguucggccauauccagc

SEQ ID NO: 3861476 - RNA, 15 nt, Shigella flexneri 2a str. 2457T
accgguucugccgcg

SEQ ID NO: 3861477 - RNA, 13 nt, Shigella flexneri 2a str. 2457T
accguaaacagau

SEQ ID NO: 3861478 - RNA, 17 nt, Shigella flexneri 2a str. 2457T
accguacaaccaaaucu

SEQ ID NO: 3861479 - RNA, 18 nt, Shigella flexneri 2a str. 2457T
accguacauugccgggcg

SEQ ID NO: 3861480 - RNA, 14 nt, Shigella flexneri 2a str. 2457T
accguaccggcacc

SEQ ID NO: 3861481 - RNA, 12 nt, Shigella flexneri 2a str. 2457T
accguacgcauc

SEQ ID NO: 3861482 - RNA, 19 nt, Shigella flexneri 2a str. 2457T
accguacgcaucaccagac

SEQ ID NO: 3861483 - RNA, 15 nt, Shigella flexneri 2a str. 2457T
accguagacuuuagc

SEQ ID NO: 3861484 - RNA, 21 nt, Shigella flexneri 2a str. 2457T
accguaguccauacccagcau

SEQ ID NO: 3861485 - RNA, 11 nt, Shigella flexneri 2a str. 2457T
accguauuuug

SEQ ID NO: 3861486 - RNA, 17 nt, Shigella flexneri 2a str. 2457T
accgucaaaaaaacggc

SEQ ID NO: 3861487 - RNA, 18 nt, Shigella flexneri 2a str. 2457T
accgucaaacacagcacu

SEQ ID NO: 3861488 - RNA, 20 nt, Shigella flexneri 2a str. 2457T
accgucaccccauugaagaa

SEQ ID NO: 3861489 - RNA, 14 nt, Shigella flexneri 2a str. 2457T
accgucacuucuuc

SEQ ID NO: 3861490 - RNA, 18 nt, Shigella flexneri 2a str. 2457T
accgucaucuuccaccug

SEQ ID NO: 3861491 - RNA, 13 nt, Shigella flexneri 2a str. 2457T
accguccucacug

SEQ ID NO: 3861492 - RNA, 22 nt, Shigella flexneri 2a str. 2457T
accgucgggcuuuuggagauca

SEQ ID NO: 3861493 - RNA, 16 nt, Shigella flexneri 2a str. 2457T
accgucugcgccgagg

SEQ ID NO: 3861494 - RNA, 18 nt, Shigella flexneri 2a str. 2457T
accgucugugugccuguc

SEQ ID NO: 3861495 - RNA, 22 nt, Shigella flexneri 2a str. 2457T
accuucagcgaagcccacgccg

SEQ ID NO: 3861496 - RNA, 14 nt, Shigella flexneri 2a str. 2457T
accuucauuugcca

SEQ ID NO: 3861497 - RNA, 22 nt, Shigella flexneri 2a str. 2457T
accuuccggcguaccuuugccu

SEQ ID NO: 3861498 - RNA, 16 nt, Shigella flexneri 2a str. 2457T
accuuccgguuucaaa

SEQ ID NO: 3861499 - RNA, 19 nt, Shigella flexneri 2a str. 2457T
accuucgaaugccgcagca

SEQ ID NO: 3861500 - RNA, 19 nt, Shigella flexneri 2a str. 2457T
accuucgccgcccagccag

SEQ ID NO: 3861501 - RNA, 23 nt, Shigella flexneri 2a str. 2457T
accuucgccucccguuuauuuac

SEQ ID NO: 3861502 - RNA, 16 nt, Shigella flexneri 2a str. 2457T
accuucgcggcacugg

SEQ ID NO: 3861503 - RNA, 22 nt, Shigella flexneri 2a str. 2457T
accuugccagugaaaguuuuca

SEQ ID NO: 3861504 - RNA, 21 nt, Shigella flexneri 2a str. 2457T
accuugcgccucaacccauuu

SEQ ID NO: 3861505 - RNA, 19 nt, Shigella flexneri 2a str. 2457T
accuugcggaaacugucaa

SEQ ID NO: 3861506 - RNA, 21 nt, Shigella flexneri 2a str. 2457T
accuugcgguggugcuugcuc

SEQ ID NO: 3861507 - RNA, 15 nt, Shigella flexneri 2a str. 2457T
accuugcuuauccuc

SEQ ID NO: 3861508 - RNA, 20 nt, Shigella flexneri 2a str. 2457T
accuugcuuauccucuguaa

SEQ ID NO: 3861509 - RNA, 15 nt, Shigella flexneri 2a str. 2457T
accuugcuuugcaac

SEQ ID NO: 3861510 - RNA, 17 nt, Shigella flexneri 2a str. 2457T
accuugcuuugcaacug

SEQ ID NO: 3861511 - RNA, 13 nt, Shigella flexneri 2a str. 2457T
accuugucaugca

SEQ ID NO: 3861512 - RNA, 15 nt, Shigella flexneri 2a str. 2457T
accuuuaaucaggcu

SEQ ID NO: 3861513 - RNA, 18 nt, Shigella flexneri 2a str. 2457T
accuuuaaucaggcuggu

SEQ ID NO: 3861514 - RNA, 16 nt, Shigella flexneri 2a str. 2457T
accuuucagaacggca

SEQ ID NO: 3861515 - RNA, 18 nt, Shigella flexneri 2a str. 2457T
acgaaaaaaauuacucau

SEQ ID NO: 3861516 - RNA, 14 nt, Shigella flexneri 2a str. 2457T
acgaaaccgggcaa

SEQ ID NO: 3861517 - RNA, 19 nt, Shigella flexneri 2a str. 2457T
acgaaaccgggcaauuuaa

SEQ ID NO: 3861518 - RNA, 21 nt, Shigella flexneri 2a str. 2457T
acgaaacgccggugaccauca

SEQ ID NO: 3861519 - RNA, 17 nt, Shigella flexneri 2a str. 2457T
acgaaagcgcaguaagc

SEQ ID NO: 3861520 - RNA, 16 nt, Shigella flexneri 2a str. 2457T
acgaaauugaggaugc

SEQ ID NO: 3861521 - RNA, 12 nt, Shigella flexneri 2a str. 2457T
acgaaccagaga

SEQ ID NO: 3861522 - RNA, 14 nt, Shigella flexneri 2a str. 2457T
acgaaccgagcggu

SEQ ID NO: 3861523 - RNA, 23 nt, Shigella flexneri 2a str. 2457T
acgaacuaccgugcuguacagca

SEQ ID NO: 3861524 - RNA, 13 nt, Shigella flexneri 2a str. 2457T
acgaagauuuuac

SEQ ID NO: 3861525 - RNA, 23 nt, Shigella flexneri 2a str. 2457T
acgaaggucgaggcaauccguaa

SEQ ID NO: 3861526 - RNA, 14 nt, Shigella flexneri 2a str. 2457T
acgaauaaaacaga

SEQ ID NO: 3861527 - RNA, 14 nt, Shigella flexneri 2a str. 2457T
acgaauaguuucag

SEQ ID NO: 3861528 - RNA, 17 nt, Shigella flexneri 2a str. 2457T
acgaaucaaucgccccu

SEQ ID NO: 3861529 - RNA, 16 nt, Shigella flexneri 2a str. 2457T
acgaaucgccgcauag

SEQ ID NO: 3861530 - RNA, 16 nt, Shigella flexneri 2a str. 2457T
acgaaucugcaaucaa

SEQ ID NO: 3861531 - RNA, 19 nt, Shigella flexneri 2a str. 2457T
acgaaucugcaaucaaaua

SEQ ID NO: 3861532 - RNA, 22 nt, Shigella flexneri 2a str. 2457T
acgacaaggcaggcaucaauga

SEQ ID NO: 3861533 - RNA, 11 nt, Shigella flexneri 2a str. 2457T
acgacaaucuc

SEQ ID NO: 3861534 - RNA, 18 nt, Shigella flexneri 2a str. 2457T
acgacacucucuucaaca

SEQ ID NO: 3861535 - RNA, 12 nt, Shigella flexneri 2a str. 2457T
acgacaggcaag

SEQ ID NO: 3861536 - RNA, 13 nt, Shigella flexneri 2a str. 2457T
acgaccaccaccg

SEQ ID NO: 3861537 - RNA, 14 nt, Shigella flexneri 2a str. 2457T
acgaccaccuucaa

SEQ ID NO: 3861538 - RNA, 19 nt, Shigella flexneri 2a str. 2457T
acgaccgauugauucccaa

SEQ ID NO: 3861539 - RNA, 18 nt, Shigella flexneri 2a str. 2457T
acgaccgcaugcgguuua

SEQ ID NO: 3861540 - RNA, 18 nt, Shigella flexneri 2a str. 2457T
acgaccuccacucucgaa

SEQ ID NO: 3861541 - RNA, 14 nt, Shigella flexneri 2a str. 2457T
acgacgacaggcaa

SEQ ID NO: 3861542 - RNA, 15 nt, Shigella flexneri 2a str. 2457T
acgacgacaggcaag

SEQ ID NO: 3861543 - RNA, 15 nt, Shigella flexneri 2a str. 2457T
acgacgcagaacuga

SEQ ID NO: 3861544 - RNA, 15 nt, Shigella flexneri 2a str. 2457T
acgacggccaguugc

SEQ ID NO: 3861545 - RNA, 17 nt, Shigella flexneri 2a str. 2457T
acgacguaacggaucaa

SEQ ID NO: 3861546 - RNA, 17 nt, Shigella flexneri 2a str. 2457T
acgacguaccagcgucg

SEQ ID NO: 3861547 - RNA, 18 nt, Shigella flexneri 2a str. 2457T
acgacgugguaaaagccg

SEQ ID NO: 3861548 - RNA, 17 nt, Shigella flexneri 2a str. 2457T
acgacugccgcucaccu

SEQ ID NO: 3861549 - RNA, 18 nt, Shigella flexneri 2a str. 2457T
acgacugccgcucaccug

SEQ ID NO: 3861550 - RNA, 17 nt, Shigella flexneri 2a str. 2457T
acgacugcgagcaaaau

SEQ ID NO: 3861551 - RNA, 20 nt, Shigella flexneri 2a str. 2457T
acgacuggccgaaaaaggau

SEQ ID NO: 3861552 - RNA, 19 nt, Shigella flexneri 2a str. 2457T
acgagaauuucucgugcca

SEQ ID NO: 3861553 - RNA, 19 nt, Shigella flexneri 2a str. 2457T
acgagacgguuaaaaacag

SEQ ID NO: 3861554 - RNA, 22 nt, Shigella flexneri 2a str. 2457T
acgagagugacgacgcugacga

SEQ ID NO: 3861555 - RNA, 13 nt, Shigella flexneri 2a str. 2457T
acgagauaaaauu

SEQ ID NO: 3861556 - RNA, 20 nt, Shigella flexneri 2a str. 2457T
acgagauagcgaaguagaca

SEQ ID NO: 3861557 - RNA, 12 nt, Shigella flexneri 2a str. 2457T
acgagaucguca

SEQ ID NO: 3861558 - RNA, 13 nt, Shigella flexneri 2a str. 2457T
acgaggagacugc

SEQ ID NO: 3861559 - RNA, 15 nt, Shigella flexneri 2a str. 2457T
acgaggggagaccuc

SEQ ID NO: 3861560 - RNA, 19 nt, Shigella flexneri 2a str. 2457T
acgagguccuuuugccgcc

SEQ ID NO: 3861561 - RNA, 17 nt, Shigella flexneri 2a str. 2457T
acgagucaacgcuucag

SEQ ID NO: 3861562 - RNA, 18 nt, Shigella flexneri 2a str. 2457T
acgaguggcggacgggug

SEQ ID NO: 3861563 - RNA, 13 nt, Shigella flexneri 2a str. 2457T
acgauaagcaccg

SEQ ID NO: 3861564 - RNA, 12 nt, Shigella flexneri 2a str. 2457T
acgauaccgccg

SEQ ID NO: 3861565 - RNA, 22 nt, Shigella flexneri 2a str. 2457T
acgauagauagagaaguaaccg

SEQ ID NO: 3861566 - RNA, 14 nt, Shigella flexneri 2a str. 2457T
acgauagccagaag

SEQ ID NO: 3861567 - RNA, 22 nt, Shigella flexneri 2a str. 2457T
acgauauguucaggauauuuau

SEQ ID NO: 3861568 - RNA, 18 nt, Shigella flexneri 2a str. 2457T
acgaucgccugguaccag

SEQ ID NO: 3861569 - RNA, 19 nt, Shigella flexneri 2a str. 2457T
acgaucuucggcgucagaa

SEQ ID NO: 3861570 - RNA, 20 nt, Shigella flexneri 2a str. 2457T
acgaugaaagaaaaaacgau

SEQ ID NO: 3861571 - RNA, 21 nt, Shigella flexneri 2a str. 2457T
acgaugaccgcaucaaugacc

SEQ ID NO: 3861572 - RNA, 19 nt, Shigella flexneri 2a str. 2457T
acgaugacugaacaggcaa

SEQ ID NO: 3861573 - RNA, 19 nt, Shigella flexneri 2a str. 2457T
acgaugccagcaccgucag

SEQ ID NO: 3861574 - RNA, 21 nt, Shigella flexneri 2a str. 2457T
acgaugccugaugcgacgcuu

SEQ ID NO: 3861575 - RNA, 18 nt, Shigella flexneri 2a str. 2457T
acgaugccugcaaugccg

SEQ ID NO: 3861576 - RNA, 19 nt, Shigella flexneri 2a str. 2457T
acgaugcuaaaaacaucau

SEQ ID NO: 3861577 - RNA, 19 nt, Shigella flexneri 2a str. 2457T
acgauggaaccguacagca

SEQ ID NO: 3861578 - RNA, 17 nt, Shigella flexneri 2a str. 2457T
acgauggcaauuuucac

SEQ ID NO: 3861579 - RNA, 18 nt, Shigella flexneri 2a str. 2457T
acgauggcaauuuucacu

SEQ ID NO: 3861580 - RNA, 13 nt, Shigella flexneri 2a str. 2457T
acgaugguuuuug

SEQ ID NO: 3861581 - RNA, 15 nt, Shigella flexneri 2a str. 2457T
acgauguucugagcg

SEQ ID NO: 3861582 - RNA, 15 nt, Shigella flexneri 2a str. 2457T
acgauguuugcugcg

SEQ ID NO: 3861583 - RNA, 18 nt, Shigella flexneri 2a str. 2457T
acgauucggcaaucacca

SEQ ID NO: 3861584 - RNA, 13 nt, Shigella flexneri 2a str. 2457T
acgauugccggau

SEQ ID NO: 3861585 - RNA, 18 nt, Shigella flexneri 2a str. 2457T
acgauuuuuuuaauaaua

SEQ ID NO: 3861586 - RNA, 16 nt, Shigella flexneri 2a str. 2457T
acgcaaaacugccuga

SEQ ID NO: 3861587 - RNA, 13 nt, Shigella flexneri 2a str. 2457T
acgcaaacaccag

SEQ ID NO: 3861588 - RNA, 18 nt, Shigella flexneri 2a str. 2457T
acgcaaacaccagcgaau

SEQ ID NO: 3861589 - RNA, 14 nt, Shigella flexneri 2a str. 2457T
acgcaaacgugggg

SEQ ID NO: 3861590 - RNA, 15 nt, Shigella flexneri 2a str. 2457T
acgcaaacuucgguu

SEQ ID NO: 3861591 - RNA, 19 nt, Shigella flexneri 2a str. 2457T
acgcaaagagagaagccag

SEQ ID NO: 3861592 - RNA, 14 nt, Shigella flexneri 2a str. 2457T
acgcaaauacugac

SEQ ID NO: 3861593 - RNA, 23 nt, Shigella flexneri 2a str. 2457T
acgccguuggcguaaaucaaacc

SEQ ID NO: 3861594 - RNA, 20 nt, Shigella flexneri 2a str. 2457T
acgccuaauccagccuacaa

SEQ ID NO: 3861595 - RNA, 23 nt, Shigella flexneri 2a str. 2457T
acgccucgggaaggucagguuug

SEQ ID NO: 3861596 - RNA, 22 nt, Shigella flexneri 2a str. 2457T
acgccucguaaugcuccggcuc

SEQ ID NO: 3861597 - RNA, 15 nt, Shigella flexneri 2a str. 2457T
acgccugccagcucu

SEQ ID NO: 3861598 - RNA, 16 nt, Shigella flexneri 2a str. 2457T
acgccugcuucgucca

SEQ ID NO: 3861599 - RNA, 20 nt, Shigella flexneri 2a str. 2457T
acgccuggcagucacggcgc

SEQ ID NO: 3861600 - RNA, 20 nt, Shigella flexneri 2a str. 2457T
acgccugggcgagguggaua

SEQ ID NO: 3861601 - RNA, 22 nt, Shigella flexneri 2a str. 2457T
acgccuguaccagcggcuucca

SEQ ID NO: 3861602 - RNA, 19 nt, Shigella flexneri 2a str. 2457T
acgccuuauccagccuaca

SEQ ID NO: 3861603 - RNA, 17 nt, Shigella flexneri 2a str. 2457T
acgccuuccgucagcaa

SEQ ID NO: 3861604 - RNA, 20 nt, Shigella flexneri 2a str. 2457T
acgccuucuccggcuuacaa

SEQ ID NO: 3861605 - RNA, 22 nt, Shigella flexneri 2a str. 2457T
acgccuuguuccugcuuggcgc

SEQ ID NO: 3861606 - RNA, 16 nt, Shigella flexneri 2a str. 2457T
acgccuuuuuucacua

SEQ ID NO: 3861607 - RNA, 13 nt, Shigella flexneri 2a str. 2457T
acgcgaacaacag

SEQ ID NO: 3861608 - RNA, 21 nt, Shigella flexneri 2a str. 2457T
acgcgaauaguuuccgcuucu

SEQ ID NO: 3861609 - RNA, 21 nt, Shigella flexneri 2a str. 2457T
acgcgaccagcgucgcaucag

SEQ ID NO: 3861610 - RNA, 15 nt, Shigella flexneri 2a str. 2457T
acgcgaccaucaagg

SEQ ID NO: 3861611 - RNA, 13 nt, Shigella flexneri 2a str. 2457T
acgcgaccgccgc

SEQ ID NO: 3861612 - RNA, 16 nt, Shigella flexneri 2a str. 2457T
acgcgaccggcgucgc

SEQ ID NO: 3861613 - RNA, 19 nt, Shigella flexneri 2a str. 2457T
acgcgaccggcgucgcauc

SEQ ID NO: 3861614 - RNA, 14 nt, Shigella flexneri 2a str. 2457T
acgcgaggcgcuaa

SEQ ID NO: 3861615 - RNA, 19 nt, Shigella flexneri 2a str. 2457T
acgcgauucccagucgcgc

SEQ ID NO: 3861616 - RNA, 19 nt, Shigella flexneri 2a str. 2457T
acgcgcagcgucgcaucag

SEQ ID NO: 3861617 - RNA, 14 nt, Shigella flexneri 2a str. 2457T
acgcgcagcguuca

SEQ ID NO: 3861618 - RNA, 18 nt, Shigella flexneri 2a str. 2457T
acgcgcagcguucauaaa

SEQ ID NO: 3861619 - RNA, 22 nt, Shigella flexneri 2a str. 2457T
acgcgcagggugcagaaucaau

SEQ ID NO: 3861620 - RNA, 17 nt, Shigella flexneri 2a str. 2457T
acgcgccacgcacgccu

SEQ ID NO: 3861621 - RNA, 13 nt, Shigella flexneri 2a str. 2457T
acgcgccagcacc

SEQ ID NO: 3861622 - RNA, 14 nt, Shigella flexneri 2a str. 2457T
acgcgccuuaaaaa

SEQ ID NO: 3861623 - RNA, 18 nt, Shigella flexneri 2a str. 2457T
acgcggcaacggcuucgc

SEQ ID NO: 3861624 - RNA, 13 nt, Shigella flexneri 2a str. 2457T
acgcggcacagca

SEQ ID NO: 3861625 - RNA, 20 nt, Shigella flexneri 2a str. 2457T
acgcggcagcgucgcaucag

SEQ ID NO: 3861626 - RNA, 20 nt, Shigella flexneri 2a str. 2457T
acgcggcauuuuuacugcgc

SEQ ID NO: 3861627 - RNA, 16 nt, Shigella flexneri 2a str. 2457T
acgcggcccaggcggc

SEQ ID NO: 3861628 - RNA, 14 nt, Shigella flexneri 2a str. 2457T
acgcgggcagcaga

SEQ ID NO: 3861629 - RNA, 17 nt, Shigella flexneri 2a str. 2457T
acgcggggguaaaaccc

SEQ ID NO: 3861630 - RNA, 15 nt, Shigella flexneri 2a str. 2457T
acgcgguagcgggca

SEQ ID NO: 3861631 - RNA, 17 nt, Shigella flexneri 2a str. 2457T
acgcgguauuggugaaa

SEQ ID NO: 3861632 - RNA, 22 nt, Shigella flexneri 2a str. 2457T
acgcggucaauggucagcgcca

SEQ ID NO: 3861633 - RNA, 13 nt, Shigella flexneri 2a str. 2457T
acgcgguuacgca

SEQ ID NO: 3861634 - RNA, 16 nt, Shigella flexneri 2a str. 2457T
acgcgguuaucccaaa

SEQ ID NO: 3861635 - RNA, 20 nt, Shigella flexneri 2a str. 2457T
acgcgguuaucccaaaucgc

SEQ ID NO: 3861636 - RNA, 15 nt, Shigella flexneri 2a str. 2457T
acgcgguugccagau

SEQ ID NO: 3861637 - RNA, 17 nt, Shigella flexneri 2a str. 2457T
acgcguaaaacagccag

SEQ ID NO: 3861638 - RNA, 15 nt, Shigella flexneri 2a str. 2457T
acgcguaaagcgucg

SEQ ID NO: 3861639 - RNA, 16 nt, Shigella flexneri 2a str. 2457T
acgcguagagaaucca

SEQ ID NO: 3861640 - RNA, 15 nt, Shigella flexneri 2a str. 2457T
acgcguaugucgauc

SEQ ID NO: 3861641 - RNA, 21 nt, Shigella flexneri 2a str. 2457T
acgcgucaagcgucgcaucag

SEQ ID NO: 3861642 - RNA, 20 nt, Shigella flexneri 2a str. 2457T
acgcgucagcgucgcaucug

SEQ ID NO: 3861643 - RNA, 16 nt, Shigella flexneri 2a str. 2457T
acgcgucugaccgucu

SEQ ID NO: 3861644 - RNA, 17 nt, Shigella flexneri 2a str. 2457T
acgcgucuuaucaggcc

SEQ ID NO: 3861645 - RNA, 19 nt, Shigella flexneri 2a str. 2457T
acgcgucuuaucaggccag

SEQ ID NO: 3861646 - RNA, 20 nt, Shigella flexneri 2a str. 2457T
acgcgucuugagagugcgaa

SEQ ID NO: 3861647 - RNA, 17 nt, Shigella flexneri 2a str. 2457T
acgcguggacuggcugc

SEQ ID NO: 3861648 - RNA, 14 nt, Shigella flexneri 2a str. 2457T
acgcguuacucugg

SEQ ID NO: 3861649 - RNA, 19 nt, Shigella flexneri 2a str. 2457T
acgcguuagcaucgcauca

SEQ ID NO: 3861650 - RNA, 20 nt, Shigella flexneri 2a str. 2457T
acgcguuagcaucgcaucag

SEQ ID NO: 3861651 - RNA, 15 nt, Shigella flexneri 2a str. 2457T
acgcguucacugccg

SEQ ID NO: 3861652 - RNA, 18 nt, Shigella flexneri 2a str. 2457T
acgcguucauacuuuuca

SEQ ID NO: 3861653 - RNA, 19 nt, Shigella flexneri 2a str. 2457T
acgcguugcgcaugaccuu

SEQ ID NO: 3861654 - RNA, 15 nt, Shigella flexneri 2a str. 2457T
acgcguuuuucagaa

SEQ ID NO: 3861655 - RNA, 23 nt, Shigella flexneri 2a str. 2457T
acgcguuuuuucgauaucaagcc

SEQ ID NO: 3861656 - RNA, 18 nt, Shigella flexneri 2a str. 2457T
acgcuaccaaaaaaucaa

SEQ ID NO: 3861657 - RNA, 15 nt, Shigella flexneri 2a str. 2457T
acgcuauacagcagc

SEQ ID NO: 3861658 - RNA, 14 nt, Shigella flexneri 2a str. 2457T
acgcucaacguuua

SEQ ID NO: 3861659 - RNA, 21 nt, Shigella flexneri 2a str. 2457T
acgcucaauauuugcaccuaa

SEQ ID NO: 3861660 - RNA, 16 nt, Shigella flexneri 2a str. 2457T
acgcucacgcgucuua

SEQ ID NO: 3861661 - RNA, 18 nt, Shigella flexneri 2a str. 2457T
acgcucaggcuacuuuuc

SEQ ID NO: 3861662 - RNA, 15 nt, Shigella flexneri 2a str. 2457T
acgcucaggguuuuc

SEQ ID NO: 3861663 - RNA, 14 nt, Shigella flexneri 2a str. 2457T
acgcucaucaggcc

SEQ ID NO: 3861664 - RNA, 18 nt, Shigella flexneri 2a str. 2457T
acgcucaucaggccuaca

SEQ ID NO: 3861665 - RNA, 19 nt, Shigella flexneri 2a str. 2457T
acgcucaucaggccuacaa

SEQ ID NO: 3861666 - RNA, 13 nt, Shigella flexneri 2a str. 2457T
acgcuccagcagg

SEQ ID NO: 3861667 - RNA, 21 nt, Shigella flexneri 2a str. 2457T
acgcuccaguguggccagagu

SEQ ID NO: 3861668 - RNA, 18 nt, Shigella flexneri 2a str. 2457T
acgcuccccggcacuuaa

SEQ ID NO: 3861669 - RNA, 19 nt, Shigella flexneri 2a str. 2457T
acgcuccgcaccugaguaa

SEQ ID NO: 3861670 - RNA, 17 nt, Shigella flexneri 2a str. 2457T
acgcucgaacagcuggu

SEQ ID NO: 3861671 - RNA, 17 nt, Shigella flexneri 2a str. 2457T
acgcucuguucugcgcu

SEQ ID NO: 3861672 - RNA, 16 nt, Shigella flexneri 2a str. 2457T
acgcucuuccagggua

SEQ ID NO: 3861673 - RNA, 22 nt, Shigella flexneri 2a str. 2457T
acgcugaaaagcgucucuuuuc

SEQ ID NO: 3861674 - RNA, 19 nt, Shigella flexneri 2a str. 2457T
acgcugaauacgcaccgcu

SEQ ID NO: 3861675 - RNA, 20 nt, Shigella flexneri 2a str. 2457T
acgcugaauacgcaccgcuc

SEQ ID NO: 3861676 - RNA, 19 nt, Shigella flexneri 2a str. 2457T
acgcugaugucagcacuuc

SEQ ID NO: 3861677 - RNA, 13 nt, Shigella flexneri 2a str. 2457T
acgcugauugcau

SEQ ID NO: 3861678 - RNA, 23 nt, Shigella flexneri 2a str. 2457T
acgcugcaaggcucuauacgcau

SEQ ID NO: 3861679 - RNA, 15 nt, Shigella flexneri 2a str. 2457T
acgcugcaucgccaa

SEQ ID NO: 3861680 - RNA, 19 nt, Shigella flexneri 2a str. 2457T
acgcugcauggcaacuuua

SEQ ID NO: 3861681 - RNA, 22 nt, Shigella flexneri 2a str. 2457T
acgcugcauggcaacuuuaaua

SEQ ID NO: 3861682 - RNA, 20 nt, Shigella flexneri 2a str. 2457T
acgcugcggucgaacauaca

SEQ ID NO: 3861683 - RNA, 14 nt, Shigella flexneri 2a str. 2457T
acgcugcucaaugg

SEQ ID NO: 3861684 - RNA, 18 nt, Shigella flexneri 2a str. 2457T
acgcuggcgcgccgccuc

SEQ ID NO: 3861685 - RNA, 21 nt, Shigella flexneri 2a str. 2457T
acgcuggcuuugcccuggcgc

SEQ ID NO: 3861686 - RNA, 23 nt, Shigella flexneri 2a str. 2457T
acgcuggguuucgccugccagau

SEQ ID NO: 3861687 - RNA, 12 nt, Shigella flexneri 2a str. 2457T
acgcuggugagu

SEQ ID NO: 3861688 - RNA, 22 nt, Shigella flexneri 2a str. 2457T
acgcuguccggcgcacuggugc

SEQ ID NO: 3861689 - RNA, 13 nt, Shigella flexneri 2a str. 2457T
acgcugucggcaa

SEQ ID NO: 3861690 - RNA, 23 nt, Shigella flexneri 2a str. 2457T
acgguccgguugcagaguaucca

SEQ ID NO: 3861691 - RNA, 14 nt, Shigella flexneri 2a str. 2457T
acggucuaucauca

SEQ ID NO: 3861692 - RNA, 23 nt, Shigella flexneri 2a str. 2457T
acggugaaaaaccaaucucccag

SEQ ID NO: 3861693 - RNA, 21 nt, Shigella flexneri 2a str. 2457T
acggugaaaaucaaucugcug

SEQ ID NO: 3861694 - RNA, 15 nt, Shigella flexneri 2a str. 2457T
acggugaacucacac

SEQ ID NO: 3861695 - RNA, 19 nt, Shigella flexneri 2a str. 2457T
acggugaacucacacagcg

SEQ ID NO: 3861696 - RNA, 15 nt, Shigella flexneri 2a str. 2457T
acggugaccagaacu

SEQ ID NO: 3861697 - RNA, 15 nt, Shigella flexneri 2a str. 2457T
acggugaugcuccac

SEQ ID NO: 3861698 - RNA, 18 nt, Shigella flexneri 2a str. 2457T
acggugcaacccgccagg

SEQ ID NO: 3861699 - RNA, 20 nt, Shigella flexneri 2a str. 2457T
acggugccauugaccagcug

SEQ ID NO: 3861700 - RNA, 22 nt, Shigella flexneri 2a str. 2457T
acggugccauugaccagcugcc

SEQ ID NO: 3861701 - RNA, 15 nt, Shigella flexneri 2a str. 2457T
acggugguaaagccg

SEQ ID NO: 3861702 - RNA, 22 nt, Shigella flexneri 2a str. 2457T
acggugguuaucgucaaccugu

SEQ ID NO: 3861703 - RNA, 18 nt, Shigella flexneri 2a str. 2457T
acggugucacggugucgg

SEQ ID NO: 3861704 - RNA, 15 nt, Shigella flexneri 2a str. 2457T
acggugugcggcagg

SEQ ID NO: 3861705 - RNA, 19 nt, Shigella flexneri 2a str. 2457T
acgguguuaguaaacgcgu

SEQ ID NO: 3861706 - RNA, 15 nt, Shigella flexneri 2a str. 2457T
acgguuaaaaacagc

SEQ ID NO: 3861707 - RNA, 18 nt, Shigella flexneri 2a str. 2457T
acgguuaaaaacagccag

SEQ ID NO: 3861708 - RNA, 19 nt, Shigella flexneri 2a str. 2457T
acgguuaaaaacagccagc

SEQ ID NO: 3861709 - RNA, 21 nt, Shigella flexneri 2a str. 2457T
acgguuaaaaacagccagcag

SEQ ID NO: 3861710 - RNA, 15 nt, Shigella flexneri 2a str. 2457T
acgguucuugaaaau

SEQ ID NO: 3861711 - RNA, 17 nt, Shigella flexneri 2a str. 2457T
acgguugaugccguucc

SEQ ID NO: 3861712 - RNA, 20 nt, Shigella flexneri 2a str. 2457T
acgguuuaucucaucuucca

SEQ ID NO: 3861713 - RNA, 14 nt, Shigella flexneri 2a str. 2457T
acgguuucagcagc

SEQ ID NO: 3861714 - RNA, 13 nt, Shigella flexneri 2a str. 2457T
acgguuucagugg

SEQ ID NO: 3861715 - RNA, 16 nt, Shigella flexneri 2a str. 2457T
acgguuugcggcacag

SEQ ID NO: 3861716 - RNA, 14 nt, Shigella flexneri 2a str. 2457T
acguaaaaaacacu

SEQ ID NO: 3861717 - RNA, 13 nt, Shigella flexneri 2a str. 2457T
acguaaaaacccg

SEQ ID NO: 3861718 - RNA, 14 nt, Shigella flexneri 2a str. 2457T
acguaaagaagaug

SEQ ID NO: 3861719 - RNA, 16 nt, Shigella flexneri 2a str. 2457T
acguaacaaaacucag

SEQ ID NO: 3861720 - RNA, 17 nt, Shigella flexneri 2a str. 2457T
acguaaccguugaccag

SEQ ID NO: 3861721 - RNA, 17 nt, Shigella flexneri 2a str. 2457T
acguaacgaccaccacc

SEQ ID NO: 3861722 - RNA, 17 nt, Shigella flexneri 2a str. 2457T
acguaaguacugauuga

SEQ ID NO: 3861723 - RNA, 16 nt, Shigella flexneri 2a str. 2457T
acguaaugauguaaaa

SEQ ID NO: 3861724 - RNA, 17 nt, Shigella flexneri 2a str. 2457T
acguaauggaugcccgc

SEQ ID NO: 3861725 - RNA, 20 nt, Shigella flexneri 2a str. 2457T
acguaauuauaugccagccc

SEQ ID NO: 3861726 - RNA, 13 nt, Shigella flexneri 2a str. 2457T
acguaauuucaau

SEQ ID NO: 3861727 - RNA, 20 nt, Shigella flexneri 2a str. 2457T
acguacaaacgcuuuacuca

SEQ ID NO: 3861728 - RNA, 16 nt, Shigella flexneri 2a str. 2457T
acguagcaauucggau

SEQ ID NO: 3861729 - RNA, 20 nt, Shigella flexneri 2a str. 2457T
acguagcguaaggauuauuu

SEQ ID NO: 3861730 - RNA, 15 nt, Shigella flexneri 2a str. 2457T
acguagcuauauuuu

SEQ ID NO: 3861731 - RNA, 15 nt, Shigella flexneri 2a str. 2457T
acguaggccugauaa

SEQ ID NO: 3861732 - RNA, 24 nt, Shigella flexneri 2a str. 2457T
acguagugaaaucgccaacaaucu

SEQ ID NO: 3861733 - RNA, 16 nt, Shigella flexneri 2a str. 2457T
acguauugagaucacc

SEQ ID NO: 3861734 - RNA, 19 nt, Shigella flexneri 2a str. 2457T
acgucaaaagaugcgcuga

SEQ ID NO: 3861735 - RNA, 22 nt, Shigella flexneri 2a str. 2457T
acgucacaggccaucacauccu

SEQ ID NO: 3861736 - RNA, 12 nt, Shigella flexneri 2a str. 2457T
acgucaccaucc

SEQ ID NO: 3861737 - RNA, 16 nt, Shigella flexneri 2a str. 2457T
acgucacucuuuauga

SEQ ID NO: 3861738 - RNA, 18 nt, Shigella flexneri 2a str. 2457T
acgucacuggugugucau

SEQ ID NO: 3861739 - RNA, 23 nt, Shigella flexneri 2a str. 2457T
acgucaguaaccgcuuuuucaau

SEQ ID NO: 3861740 - RNA, 19 nt, Shigella flexneri 2a str. 2457T
acgucaucugucauaacac

SEQ ID NO: 3861741 - RNA, 16 nt, Shigella flexneri 2a str. 2457T
acgucauuaccgcgaa

SEQ ID NO: 3861742 - RNA, 17 nt, Shigella flexneri 2a str. 2457T
acgucauuaccgcgaag

SEQ ID NO: 3861743 - RNA, 21 nt, Shigella flexneri 2a str. 2457T
acgucauugcuaucuccuguu

SEQ ID NO: 3861744 - RNA, 12 nt, Shigella flexneri 2a str. 2457T
acguccagccag

SEQ ID NO: 3861745 - RNA, 23 nt, Shigella flexneri 2a str. 2457T
acguccagcgauuugcggaagua

SEQ ID NO: 3861746 - RNA, 19 nt, Shigella flexneri 2a str. 2457T
acguccggcaauauagaua

SEQ ID NO: 3861747 - RNA, 17 nt, Shigella flexneri 2a str. 2457T
acguccuguacuguuuc

SEQ ID NO: 3861748 - RNA, 20 nt, Shigella flexneri 2a str. 2457T
acgucgauuuuuaaugaacg

SEQ ID NO: 3861749 - RNA, 20 nt, Shigella flexneri 2a str. 2457T
acgucgcaacuccaccagca

SEQ ID NO: 3861750 - RNA, 16 nt, Shigella flexneri 2a str. 2457T
acgucgcaagacgaaa

SEQ ID NO: 3861751 - RNA, 13 nt, Shigella flexneri 2a str. 2457T
acgucgcccaccg

SEQ ID NO: 3861752 - RNA, 14 nt, Shigella flexneri 2a str. 2457T
acgucgcuuuauag

SEQ ID NO: 3861753 - RNA, 14 nt, Shigella flexneri 2a str. 2457T
acgucuacaguacg

SEQ ID NO: 3861754 - RNA, 17 nt, Shigella flexneri 2a str. 2457T
acgucucaaucaccacc

SEQ ID NO: 3861755 - RNA, 18 nt, Shigella flexneri 2a str. 2457T
acgucucaaucaccacca

SEQ ID NO: 3861756 - RNA, 12 nt, Shigella flexneri 2a str. 2457T
acgucucaucag

SEQ ID NO: 3861757 - RNA, 13 nt, Shigella flexneri 2a str. 2457T
acgucucaucagg

SEQ ID NO: 3861758 - RNA, 17 nt, Shigella flexneri 2a str. 2457T
acgucuccaucaauaca

SEQ ID NO: 3861759 - RNA, 23 nt, Shigella flexneri 2a str. 2457T
acgucuuccauugccgcuuucca

SEQ ID NO: 3861760 - RNA, 20 nt, Shigella flexneri 2a str. 2457T
acgucuuugcguuccaucag

SEQ ID NO: 3861761 - RNA, 18 nt, Shigella flexneri 2a str. 2457T
acgugaacggcuucgccu

SEQ ID NO: 3861762 - RNA, 15 nt, Shigella flexneri 2a str. 2457T
acgugaccaguacca

SEQ ID NO: 3861763 - RNA, 18 nt, Shigella flexneri 2a str. 2457T
acgugaucgaacaucugc

SEQ ID NO: 3861764 - RNA, 17 nt, Shigella flexneri 2a str. 2457T
acgugauuuagcaccga

SEQ ID NO: 3861765 - RNA, 15 nt, Shigella flexneri 2a str. 2457T
acgugcaaaaucaaa

SEQ ID NO: 3861766 - RNA, 20 nt, Shigella flexneri 2a str. 2457T
acgugcaaaaucaaacagaa

SEQ ID NO: 3861767 - RNA, 14 nt, Shigella flexneri 2a str. 2457T
acgugcacaggcaa

SEQ ID NO: 3861768 - RNA, 16 nt, Shigella flexneri 2a str. 2457T
acgugcaccgucacuu

SEQ ID NO: 3861769 - RNA, 18 nt, Shigella flexneri 2a str. 2457T
acgugccagauguuugaa

SEQ ID NO: 3861770 - RNA, 22 nt, Shigella flexneri 2a str. 2457T
acgugcguaccauuaucaccaa

SEQ ID NO: 3861771 - RNA, 16 nt, Shigella flexneri 2a str. 2457T
acguggcacauucuga

SEQ ID NO: 3861772 - RNA, 22 nt, Shigella flexneri 2a str. 2457T
acguguggucuuuucaacaguu

SEQ ID NO: 3861773 - RNA, 18 nt, Shigella flexneri 2a str. 2457T
acguguguugagauaaug

SEQ ID NO: 3861774 - RNA, 21 nt, Shigella flexneri 2a str. 2457T
acguuaacaauguugucgcca

SEQ ID NO: 3861775 - RNA, 22 nt, Shigella flexneri 2a str. 2457T
acguuaauaaaauuuacaguau

SEQ ID NO: 3861776 - RNA, 20 nt, Shigella flexneri 2a str. 2457T
acguuaaugcaaucaaaaau

SEQ ID NO: 3861777 - RNA, 15 nt, Shigella flexneri 2a str. 2457T
acguuacccagcacg

SEQ ID NO: 3861778 - RNA, 22 nt, Shigella flexneri 2a str. 2457T
acguuacucuaaagaguucaaa

SEQ ID NO: 3861779 - RNA, 14 nt, Shigella flexneri 2a str. 2457T
acguuagaaacaaa

SEQ ID NO: 3861780 - RNA, 16 nt, Shigella flexneri 2a str. 2457T
acguuagaaacaaaaa

SEQ ID NO: 3861781 - RNA, 16 nt, Shigella flexneri 2a str. 2457T
acguuagcccuuugua

SEQ ID NO: 3861782 - RNA, 22 nt, Shigella flexneri 2a str. 2457T
acguuaguucgcguaacugcug

SEQ ID NO: 3861783 - RNA, 21 nt, Shigella flexneri 2a str. 2457T
acguuaugcaccgacaauccg

SEQ ID NO: 3861784 - RNA, 13 nt, Shigella flexneri 2a str. 2457T
acguucaguucac

SEQ ID NO: 3861785 - RNA, 15 nt, Shigella flexneri 2a str. 2457T
acguucaugccgguc

SEQ ID NO: 3861786 - RNA, 15 nt, Shigella flexneri 2a str. 2457T
acguuccauggcagg

SEQ ID NO: 3861787 - RNA, 22 nt, Shigella flexneri 2a str. 2457T
acuccagaauaccgccaauauc

SEQ ID NO: 3861788 - RNA, 11 nt, Shigella flexneri 2a str. 2457T
acuccagcaga

SEQ ID NO: 3861789 - RNA, 15 nt, Shigella flexneri 2a str. 2457T
acuccagcagugccg

SEQ ID NO: 3861790 - RNA, 15 nt, Shigella flexneri 2a str. 2457T
acuccagccagagcc

SEQ ID NO: 3861791 - RNA, 12 nt, Shigella flexneri 2a str. 2457T
acuccagcgcca

SEQ ID NO: 3861792 - RNA, 16 nt, Shigella flexneri 2a str. 2457T
acuccagucccaguuc

SEQ ID NO: 3861793 - RNA, 21 nt, Shigella flexneri 2a str. 2457T
acuccaguuuguucagcugcg

SEQ ID NO: 3861794 - RNA, 17 nt, Shigella flexneri 2a str. 2457T
acuccauccagcaacaa

SEQ ID NO: 3861795 - RNA, 20 nt, Shigella flexneri 2a str. 2457T
acuccauccagcaacaacag

SEQ ID NO: 3861796 - RNA, 21 nt, Shigella flexneri 2a str. 2457T
acuccauccagcaacaacagc

SEQ ID NO: 3861797 - RNA, 12 nt, Shigella flexneri 2a str. 2457T
acucccagccuc

SEQ ID NO: 3861798 - RNA, 16 nt, Shigella flexneri 2a str. 2457T
acuccccgcacaacgg

SEQ ID NO: 3861799 - RNA, 14 nt, Shigella flexneri 2a str. 2457T
acucccgugccaga

SEQ ID NO: 3861800 - RNA, 16 nt, Shigella flexneri 2a str. 2457T
acucccugccccaucu

SEQ ID NO: 3861801 - RNA, 22 nt, Shigella flexneri 2a str. 2457T
acuccgcauuuguaggcaggau

SEQ ID NO: 3861802 - RNA, 19 nt, Shigella flexneri 2a str. 2457T
acuccgccccggcaauaaa

SEQ ID NO: 3861803 - RNA, 18 nt, Shigella flexneri 2a str. 2457T
acuccgccgcaucuuccc

SEQ ID NO: 3861804 - RNA, 19 nt, Shigella flexneri 2a str. 2457T
acuccgcgaccacacucaa

SEQ ID NO: 3861805 - RNA, 23 nt, Shigella flexneri 2a str. 2457T
acuccggaaaaacggaggcccgc

SEQ ID NO: 3861806 - RNA, 23 nt, Shigella flexneri 2a str. 2457T
acuccugguaucuuuacagcgcu

SEQ ID NO: 3861807 - RNA, 20 nt, Shigella flexneri 2a str. 2457T
acuccuucuaaagccugagc

SEQ ID NO: 3861808 - RNA, 21 nt, Shigella flexneri 2a str. 2457T
acuccuuucugagcaucacau

SEQ ID NO: 3861809 - RNA, 23 nt, Shigella flexneri 2a str. 2457T
acucgagaacacgguaaugacuc

SEQ ID NO: 3861810 - RNA, 16 nt, Shigella flexneri 2a str. 2457T
acucgaggagcuggag

SEQ ID NO: 3861811 - RNA, 19 nt, Shigella flexneri 2a str. 2457T
acucgaggauaaauuuucu

SEQ ID NO: 3861812 - RNA, 18 nt, Shigella flexneri 2a str. 2457T
acucgauaauaaagcggc

SEQ ID NO: 3861813 - RNA, 20 nt, Shigella flexneri 2a str. 2457T
acucgauaauaaagcggcuc

SEQ ID NO: 3861814 - RNA, 23 nt, Shigella flexneri 2a str. 2457T
acucgcacguucaguuuugggga

SEQ ID NO: 3861815 - RNA, 16 nt, Shigella flexneri 2a str. 2457T
acucgccgcuguggau

SEQ ID NO: 3861816 - RNA, 18 nt, Shigella flexneri 2a str. 2457T
acucgcguucuguugccg

SEQ ID NO: 3861817 - RNA, 14 nt, Shigella flexneri 2a str. 2457T
acucggcaguauca

SEQ ID NO: 3861818 - RNA, 16 nt, Shigella flexneri 2a str. 2457T
acucggggcuuuucuc

SEQ ID NO: 3861819 - RNA, 21 nt, Shigella flexneri 2a str. 2457T
acucgguugauucgcucugcg

SEQ ID NO: 3861820 - RNA, 21 nt, Shigella flexneri 2a str. 2457T
acucgugcgucgcauccggca

SEQ ID NO: 3861821 - RNA, 14 nt, Shigella flexneri 2a str. 2457T
acucguucagcgca

SEQ ID NO: 3861822 - RNA, 18 nt, Shigella flexneri 2a str. 2457T
acucuacaaccagcuuau

SEQ ID NO: 3861823 - RNA, 17 nt, Shigella flexneri 2a str. 2457T
acucuaccguuaaaaua

SEQ ID NO: 3861824 - RNA, 17 nt, Shigella flexneri 2a str. 2457T
acucuacgcaagucaua

SEQ ID NO: 3861825 - RNA, 13 nt, Shigella flexneri 2a str. 2457T
acucuacuucuuc

SEQ ID NO: 3861826 - RNA, 17 nt, Shigella flexneri 2a str. 2457T
acucucaccacgcucca

SEQ ID NO: 3861827 - RNA, 13 nt, Shigella flexneri 2a str. 2457T
acucucagccgca

SEQ ID NO: 3861828 - RNA, 22 nt, Shigella flexneri 2a str. 2457T
acucucagccgcacaccugcau

SEQ ID NO: 3861829 - RNA, 20 nt, Shigella flexneri 2a str. 2457T
acucucaucuuugaaaucac

SEQ ID NO: 3861830 - RNA, 14 nt, Shigella flexneri 2a str. 2457T
acucucgaaaucca

SEQ ID NO: 3861831 - RNA, 20 nt, Shigella flexneri 2a str. 2457T
acucucgacccgacagaugc

SEQ ID NO: 3861832 - RNA, 21 nt, Shigella flexneri 2a str. 2457T
acucucgggaaggcccuuucc

SEQ ID NO: 3861833 - RNA, 19 nt, Shigella flexneri 2a str. 2457T
acucugaccugacaaccgg

SEQ ID NO: 3861834 - RNA, 19 nt, Shigella flexneri 2a str. 2457T
acucugccguaccaucgcc

SEQ ID NO: 3861835 - RNA, 16 nt, Shigella flexneri 2a str. 2457T
acucugguauuaaccg

SEQ ID NO: 3861836 - RNA, 18 nt, Shigella flexneri 2a str. 2457T
acucuuaagguucacuua

SEQ ID NO: 3861837 - RNA, 21 nt, Shigella flexneri 2a str. 2457T
acucuuaagguucacuuaauc

SEQ ID NO: 3861838 - RNA, 19 nt, Shigella flexneri 2a str. 2457T
acucuuagcaaacaggaua

SEQ ID NO: 3861839 - RNA, 17 nt, Shigella flexneri 2a str. 2457T
acucuuccccgcuucag

SEQ ID NO: 3861840 - RNA, 23 nt, Shigella flexneri 2a str. 2457T
acucuuucgacggcaucagaaac

SEQ ID NO: 3861841 - RNA, 23 nt, Shigella flexneri 2a str. 2457T
acucuuuggcaaccguggugagu

SEQ ID NO: 3861842 - RNA, 12 nt, Shigella flexneri 2a str. 2457T
acucuuuuuccu

SEQ ID NO: 3861843 - RNA, 13 nt, Shigella flexneri 2a str. 2457T
acucuuuuuuccg

SEQ ID NO: 3861844 - RNA, 18 nt, Shigella flexneri 2a str. 2457T
acugaaauuuuaugauaa

SEQ ID NO: 3861845 - RNA, 23 nt, Shigella flexneri 2a str. 2457T
acugaacaaaaaagaguaaaguu

SEQ ID NO: 3861846 - RNA, 14 nt, Shigella flexneri 2a str. 2457T
acugaaggcgcauu

SEQ ID NO: 3861847 - RNA, 12 nt, Shigella flexneri 2a str. 2457T
acugaauacgcu

SEQ ID NO: 3861848 - RNA, 20 nt, Shigella flexneri 2a str. 2457T
acugaaugacgacguaccag

SEQ ID NO: 3861849 - RNA, 15 nt, Shigella flexneri 2a str. 2457T
acugaaugaucacuu

SEQ ID NO: 3861850 - RNA, 14 nt, Shigella flexneri 2a str. 2457T
acugaaugccggau

SEQ ID NO: 3861851 - RNA, 13 nt, Shigella flexneri 2a str. 2457T
acugaauugugau

SEQ ID NO: 3861852 - RNA, 18 nt, Shigella flexneri 2a str. 2457T
acugaauugugaugguuu

SEQ ID NO: 3861853 - RNA, 19 nt, Shigella flexneri 2a str. 2457T
acugacacaggcagcaauc

SEQ ID NO: 3861854 - RNA, 16 nt, Shigella flexneri 2a str. 2457T
acugacauacagaucg

SEQ ID NO: 3861855 - RNA, 15 nt, Shigella flexneri 2a str. 2457T
acugaccaccaccac

SEQ ID NO: 3861856 - RNA, 17 nt, Shigella flexneri 2a str. 2457T
acugaccccaaaaaguu

SEQ ID NO: 3861857 - RNA, 18 nt, Shigella flexneri 2a str. 2457T
acugacgaaucaaauaaa

SEQ ID NO: 3861858 - RNA, 16 nt, Shigella flexneri 2a str. 2457T
acugacgcgucuuauc

SEQ ID NO: 3861859 - RNA, 22 nt, Shigella flexneri 2a str. 2457T
acugacggaucccgccaacagg

SEQ ID NO: 3861860 - RNA, 16 nt, Shigella flexneri 2a str. 2457T
acugaguucucauggu

SEQ ID NO: 3861861 - RNA, 17 nt, Shigella flexneri 2a str. 2457T
acugaguucucaugguu

SEQ ID NO: 3861862 - RNA, 18 nt, Shigella flexneri 2a str. 2457T
acugauaacgcauuucau

SEQ ID NO: 3861863 - RNA, 18 nt, Shigella flexneri 2a str. 2457T
acugauaagcugagcaca

SEQ ID NO: 3861864 - RNA, 18 nt, Shigella flexneri 2a str. 2457T
acugauaauaaauaacag

SEQ ID NO: 3861865 - RNA, 23 nt, Shigella flexneri 2a str. 2457T
acugauaguguuuuauguucaga

SEQ ID NO: 3861866 - RNA, 12 nt, Shigella flexneri 2a str. 2457T
acugaucaucau

SEQ ID NO: 3861867 - RNA, 22 nt, Shigella flexneri 2a str. 2457T
acugaucccgauggucagcuuc

SEQ ID NO: 3861868 - RNA, 14 nt, Shigella flexneri 2a str. 2457T
acugauccugacaa

SEQ ID NO: 3861869 - RNA, 15 nt, Shigella flexneri 2a str. 2457T
acugaugacaaacgc

SEQ ID NO: 3861870 - RNA, 13 nt, Shigella flexneri 2a str. 2457T
acugauugaacug

SEQ ID NO: 3861871 - RNA, 13 nt, Shigella flexneri 2a str. 2457T
acugcaaaccaug

SEQ ID NO: 3861872 - RNA, 17 nt, Shigella flexneri 2a str. 2457T
acugcaaaccaugacgc

SEQ ID NO: 3861873 - RNA, 15 nt, Shigella flexneri 2a str. 2457T
acugcaaaucaccac

SEQ ID NO: 3861874 - RNA, 16 nt, Shigella flexneri 2a str. 2457T
acugcaaaucaccaca

SEQ ID NO: 3861875 - RNA, 19 nt, Shigella flexneri 2a str. 2457T
acugcaacagcuguugaaa

SEQ ID NO: 3861876 - RNA, 15 nt, Shigella flexneri 2a str. 2457T
acugcaacucaccuu

SEQ ID NO: 3861877 - RNA, 18 nt, Shigella flexneri 2a str. 2457T
acugcaacugcgcggcaa

SEQ ID NO: 3861878 - RNA, 14 nt, Shigella flexneri 2a str. 2457T
acugcaaugaccau

SEQ ID NO: 3861879 - RNA, 16 nt, Shigella flexneri 2a str. 2457T
acugcacaccgcggaa

SEQ ID NO: 3861880 - RNA, 23 nt, Shigella flexneri 2a str. 2457T
acugcauaaucgcaacgccuucc

SEQ ID NO: 3861881 - RNA, 23 nt, Shigella flexneri 2a str. 2457T
acugcauaaugccgguggugacc

SEQ ID NO: 3861882 - RNA, 22 nt, Shigella flexneri 2a str. 2457T
acugcaucagcgccuuaccaau

SEQ ID NO: 3861883 - RNA, 16 nt, Shigella flexneri 2a str. 2457T
acugccacaagggcau

SEQ ID NO: 3861884 - RNA, 19 nt, Shigella flexneri 2a str. 2457T
acuguagugaucaaacaca

SEQ ID NO: 3861885 - RNA, 12 nt, Shigella flexneri 2a str. 2457T
acugucagaugc

SEQ ID NO: 3861886 - RNA, 18 nt, Shigella flexneri 2a str. 2457T
acugucgaacuggcagga

SEQ ID NO: 3861887 - RNA, 15 nt, Shigella flexneri 2a str. 2457T
acugucgcagccagc

SEQ ID NO: 3861888 - RNA, 18 nt, Shigella flexneri 2a str. 2457T
acugucgucgcuuucacu

SEQ ID NO: 3861889 - RNA, 21 nt, Shigella flexneri 2a str. 2457T
acugucguuaaauccagaucc

SEQ ID NO: 3861890 - RNA, 23 nt, Shigella flexneri 2a str. 2457T
acugucguuaaauccagauccug

SEQ ID NO: 3861891 - RNA, 18 nt, Shigella flexneri 2a str. 2457T
acugucugcuucugccug

SEQ ID NO: 3861892 - RNA, 22 nt, Shigella flexneri 2a str. 2457T
acugucugcuucugccugggcc

SEQ ID NO: 3861893 - RNA, 14 nt, Shigella flexneri 2a str. 2457T
acugucuucaccau

SEQ ID NO: 3861894 - RNA, 23 nt, Shigella flexneri 2a str. 2457T
acugugaaccucgaucagagugg

SEQ ID NO: 3861895 - RNA, 13 nt, Shigella flexneri 2a str. 2457T
acugugcacccgc

SEQ ID NO: 3861896 - RNA, 23 nt, Shigella flexneri 2a str. 2457T
acugugcacccgcuucagugacu

SEQ ID NO: 3861897 - RNA, 17 nt, Shigella flexneri 2a str. 2457T
acugugggauugcuuca

SEQ ID NO: 3861898 - RNA, 19 nt, Shigella flexneri 2a str. 2457T
acuguuaacggccgaagaa

SEQ ID NO: 3861899 - RNA, 13 nt, Shigella flexneri 2a str. 2457T
acuguuccagcac

SEQ ID NO: 3861900 - RNA, 17 nt, Shigella flexneri 2a str. 2457T
acuguucuaguaccgau

SEQ ID NO: 3861901 - RNA, 18 nt, Shigella flexneri 2a str. 2457T
acuguucugauaguuaaa

SEQ ID NO: 3861902 - RNA, 16 nt, Shigella flexneri 2a str. 2457T
acuguugauccaggag

SEQ ID NO: 3861903 - RNA, 16 nt, Shigella flexneri 2a str. 2457T
acuguuuaucuuccca

SEQ ID NO: 3861904 - RNA, 22 nt, Shigella flexneri 2a str. 2457T
acuguuuuaccaaauuggcaaa

SEQ ID NO: 3861905 - RNA, 15 nt, Shigella flexneri 2a str. 2457T
acuuaaauaaugcuu

SEQ ID NO: 3861906 - RNA, 15 nt, Shigella flexneri 2a str. 2457T
acuuaacccauuaca

SEQ ID NO: 3861907 - RNA, 15 nt, Shigella flexneri 2a str. 2457T
acuuaacuguaaauc

SEQ ID NO: 3861908 - RNA, 20 nt, Shigella flexneri 2a str. 2457T
acuuaacuguaaaucgccau

SEQ ID NO: 3861909 - RNA, 16 nt, Shigella flexneri 2a str. 2457T
acuuaaggucacagaa

SEQ ID NO: 3861910 - RNA, 16 nt, Shigella flexneri 2a str. 2457T
acuuaauaaacaucag

SEQ ID NO: 3861911 - RNA, 21 nt, Shigella flexneri 2a str. 2457T
acuuaauauugccguccggca

SEQ ID NO: 3861912 - RNA, 19 nt, Shigella flexneri 2a str. 2457T
acuuaaucaucaaugccag

SEQ ID NO: 3861913 - RNA, 14 nt, Shigella flexneri 2a str. 2457T
acuuaaugaaucau

SEQ ID NO: 3861914 - RNA, 12 nt, Shigella flexneri 2a str. 2457T
acuuaauggucu

SEQ ID NO: 3861915 - RNA, 20 nt, Shigella flexneri 2a str. 2457T
acuuaaugucauacacuuca

SEQ ID NO: 3861916 - RNA, 14 nt, Shigella flexneri 2a str. 2457T
acuuaauugguugc

SEQ ID NO: 3861917 - RNA, 19 nt, Shigella flexneri 2a str. 2457T
acuuacugaugcacacacg

SEQ ID NO: 3861918 - RNA, 11 nt, Shigella flexneri 2a str. 2457T
acuuaucauca

SEQ ID NO: 3861919 - RNA, 13 nt, Shigella flexneri 2a str. 2457T
acuuaucggaaca

SEQ ID NO: 3861920 - RNA, 17 nt, Shigella flexneri 2a str. 2457T
acuuaucgugccuacac

SEQ ID NO: 3861921 - RNA, 19 nt, Shigella flexneri 2a str. 2457T
acuuaucuuuuacaagcaa

SEQ ID NO: 3861922 - RNA, 15 nt, Shigella flexneri 2a str. 2457T
acuuaugcagcugcu

SEQ ID NO: 3861923 - RNA, 16 nt, Shigella flexneri 2a str. 2457T
acuuaugcucugcgau

SEQ ID NO: 3861924 - RNA, 16 nt, Shigella flexneri 2a str. 2457T
acuuauggcuggcugg

SEQ ID NO: 3861925 - RNA, 13 nt, Shigella flexneri 2a str. 2457T
acuuauuaaaauu

SEQ ID NO: 3861926 - RNA, 12 nt, Shigella flexneri 2a str. 2457T
acuucaaacaaa

SEQ ID NO: 3861927 - RNA, 13 nt, Shigella flexneri 2a str. 2457T
acuucaaccacau

SEQ ID NO: 3861928 - RNA, 14 nt, Shigella flexneri 2a str. 2457T
acuucaaccacauu

SEQ ID NO: 3861929 - RNA, 22 nt, Shigella flexneri 2a str. 2457T
acuucaacgcaagaacgugccg

SEQ ID NO: 3861930 - RNA, 16 nt, Shigella flexneri 2a str. 2457T
acuucacacacuuuua

SEQ ID NO: 3861931 - RNA, 15 nt, Shigella flexneri 2a str. 2457T
acuucacaucaccau

SEQ ID NO: 3861932 - RNA, 15 nt, Shigella flexneri 2a str. 2457T
acuucacggcugcua

SEQ ID NO: 3861933 - RNA, 13 nt, Shigella flexneri 2a str. 2457T
acuucacuucccc

SEQ ID NO: 3861934 - RNA, 14 nt, Shigella flexneri 2a str. 2457T
acuucacuucuucu

SEQ ID NO: 3861935 - RNA, 22 nt, Shigella flexneri 2a str. 2457T
acuucagauaaaucacgcuuca

SEQ ID NO: 3861936 - RNA, 12 nt, Shigella flexneri 2a str. 2457T
acuucagcagca

SEQ ID NO: 3861937 - RNA, 17 nt, Shigella flexneri 2a str. 2457T
acuucaucacgaugcaa

SEQ ID NO: 3861938 - RNA, 13 nt, Shigella flexneri 2a str. 2457T
acuucaucagcaa

SEQ ID NO: 3861939 - RNA, 23 nt, Shigella flexneri 2a str. 2457T
acuucaucaucguugaucuguaa

SEQ ID NO: 3861940 - RNA, 22 nt, Shigella flexneri 2a str. 2457T
acuucauccggauacagcccca

SEQ ID NO: 3861941 - RNA, 11 nt, Shigella flexneri 2a str. 2457T
acuucaugacc

SEQ ID NO: 3861942 - RNA, 12 nt, Shigella flexneri 2a str. 2457T
acuucaugcccc

SEQ ID NO: 3861943 - RNA, 16 nt, Shigella flexneri 2a str. 2457T
acuucauuaaccacga

SEQ ID NO: 3861944 - RNA, 16 nt, Shigella flexneri 2a str. 2457T
acuuccaccagcggcu

SEQ ID NO: 3861945 - RNA, 17 nt, Shigella flexneri 2a str. 2457T
acuuccacguuccccag

SEQ ID NO: 3861946 - RNA, 20 nt, Shigella flexneri 2a str. 2457T
acuuccagcaguucgcccgc

SEQ ID NO: 3861947 - RNA, 14 nt, Shigella flexneri 2a str. 2457T
acuuccccucugcg

SEQ ID NO: 3861948 - RNA, 18 nt, Shigella flexneri 2a str. 2457T
acuuccgaacaguacugg

SEQ ID NO: 3861949 - RNA, 16 nt, Shigella flexneri 2a str. 2457T
acuuccguaccagccu

SEQ ID NO: 3861950 - RNA, 21 nt, Shigella flexneri 2a str. 2457T
acuuccguaccagccuugcca

SEQ ID NO: 3861951 - RNA, 15 nt, Shigella flexneri 2a str. 2457T
acuuccugcggagca

SEQ ID NO: 3861952 - RNA, 18 nt, Shigella flexneri 2a str. 2457T
acuucgauguccgcucca

SEQ ID NO: 3861953 - RNA, 18 nt, Shigella flexneri 2a str. 2457T
acuucgauuucgccaccc

SEQ ID NO: 3861954 - RNA, 20 nt, Shigella flexneri 2a str. 2457T
acuucgcuaaaucuggugcu

SEQ ID NO: 3861955 - RNA, 17 nt, Shigella flexneri 2a str. 2457T
acuucgcuuacgccugc

SEQ ID NO: 3861956 - RNA, 19 nt, Shigella flexneri 2a str. 2457T
acuucgcuuacgccugcca

SEQ ID NO: 3861957 - RNA, 16 nt, Shigella flexneri 2a str. 2457T
acuucggucaccguca

SEQ ID NO: 3861958 - RNA, 16 nt, Shigella flexneri 2a str. 2457T
acuucuauaaugagau

SEQ ID NO: 3861959 - RNA, 19 nt, Shigella flexneri 2a str. 2457T
acuucuauaaugagauauu

SEQ ID NO: 3861960 - RNA, 16 nt, Shigella flexneri 2a str. 2457T
acuucugccagcugcu

SEQ ID NO: 3861961 - RNA, 23 nt, Shigella flexneri 2a str. 2457T
acuucugcucgcgguuaaguucc

SEQ ID NO: 3861962 - RNA, 20 nt, Shigella flexneri 2a str. 2457T
acuucuuaaugcccaucucu

SEQ ID NO: 3861963 - RNA, 16 nt, Shigella flexneri 2a str. 2457T
acuucuuaccgcuuca

SEQ ID NO: 3861964 - RNA, 22 nt, Shigella flexneri 2a str. 2457T
acuucuucguagcguuuuuuca

SEQ ID NO: 3861965 - RNA, 14 nt, Shigella flexneri 2a str. 2457T
acuucuucuucgcu

SEQ ID NO: 3861966 - RNA, 18 nt, Shigella flexneri 2a str. 2457T
acuucuucuucgcugcag

SEQ ID NO: 3861967 - RNA, 16 nt, Shigella flexneri 2a str. 2457T
acuucuucuuguucau

SEQ ID NO: 3861968 - RNA, 16 nt, Shigella flexneri 2a str. 2457T
acuucuuuuaccuuca

SEQ ID NO: 3861969 - RNA, 13 nt, Shigella flexneri 2a str. 2457T
acuugaaaauuau

SEQ ID NO: 3861970 - RNA, 17 nt, Shigella flexneri 2a str. 2457T
acuugaacgcgagaaaa

SEQ ID NO: 3861971 - RNA, 14 nt, Shigella flexneri 2a str. 2457T
acuugcggcaccca

SEQ ID NO: 3861972 - RNA, 22 nt, Shigella flexneri 2a str. 2457T
acuugggcgauuuuugcagcaa

SEQ ID NO: 3861973 - RNA, 21 nt, Shigella flexneri 2a str. 2457T
acuuguuuuucaucgcuaaua

SEQ ID NO: 3861974 - RNA, 13 nt, Shigella flexneri 2a str. 2457T
acuuuaaucaccu

SEQ ID NO: 3861975 - RNA, 16 nt, Shigella flexneri 2a str. 2457T
acuuuaaucaccugcc

SEQ ID NO: 3861976 - RNA, 15 nt, Shigella flexneri 2a str. 2457T
acuuuaauuuuucaa

SEQ ID NO: 3861977 - RNA, 16 nt, Shigella flexneri 2a str. 2457T
acuuuaccgguuucaa

SEQ ID NO: 3861978 - RNA, 21 nt, Shigella flexneri 2a str. 2457T
acuuuaccgguuucaauccag

SEQ ID NO: 3861979 - RNA, 18 nt, Shigella flexneri 2a str. 2457T
acuuuagccgguuuuuca

SEQ ID NO: 3861980 - RNA, 17 nt, Shigella flexneri 2a str. 2457T
acuuuagcgcaaucgca

SEQ ID NO: 3861981 - RNA, 17 nt, Shigella flexneri 2a str. 2457T
acuuucacaaaaauaau

SEQ ID NO: 3861982 - RNA, 16 nt, Shigella flexneri 2a str. 2457T
agacaaauuuugaaca

SEQ ID NO: 3861983 - RNA, 19 nt, Shigella flexneri 2a str. 2457T
agacaaauuuugaacagaa

SEQ ID NO: 3861984 - RNA, 13 nt, Shigella flexneri 2a str. 2457T
agacaacccacac

SEQ ID NO: 3861985 - RNA, 14 nt, Shigella flexneri 2a str. 2457T
agacaacccacaca

SEQ ID NO: 3861986 - RNA, 16 nt, Shigella flexneri 2a str. 2457T
agacaacccacacauu

SEQ ID NO: 3861987 - RNA, 12 nt, Shigella flexneri 2a str. 2457T
agacaacuuccc

SEQ ID NO: 3861988 - RNA, 14 nt, Shigella flexneri 2a str. 2457T
agacaacuucccug

SEQ ID NO: 3861989 - RNA, 15 nt, Shigella flexneri 2a str. 2457T
agacaauauaacugc

SEQ ID NO: 3861990 - RNA, 17 nt, Shigella flexneri 2a str. 2457T
agacaauauaacugcgg

SEQ ID NO: 3861991 - RNA, 13 nt, Shigella flexneri 2a str. 2457T
agacaaucgccag

SEQ ID NO: 3861992 - RNA, 13 nt, Shigella flexneri 2a str. 2457T
agacaccaaggaa

SEQ ID NO: 3861993 - RNA, 17 nt, Shigella flexneri 2a str. 2457T
agacaccgcccaacaga

SEQ ID NO: 3861994 - RNA, 18 nt, Shigella flexneri 2a str. 2457T
agacaccuugcaacuccg

SEQ ID NO: 3861995 - RNA, 21 nt, Shigella flexneri 2a str. 2457T
agacacgccgccagaccaaua

SEQ ID NO: 3861996 - RNA, 16 nt, Shigella flexneri 2a str. 2457T
agacacgcugccccug

SEQ ID NO: 3861997 - RNA, 19 nt, Shigella flexneri 2a str. 2457T
agacacuccagagaauuua

SEQ ID NO: 3861998 - RNA, 13 nt, Shigella flexneri 2a str. 2457T
agacacuggaaac

SEQ ID NO: 3861999 - RNA, 20 nt, Shigella flexneri 2a str. 2457T
agacacuuuaucuaucagga

SEQ ID NO: 3862000 - RNA, 13 nt, Shigella flexneri 2a str. 2457T
agacagaaucagg

SEQ ID NO: 3862001 - RNA, 15 nt, Shigella flexneri 2a str. 2457T
agacagaccuggcgc

SEQ ID NO: 3862002 - RNA, 15 nt, Shigella flexneri 2a str. 2457T
agacagccuaccaga

SEQ ID NO: 3862003 - RNA, 16 nt, Shigella flexneri 2a str. 2457T
agacagccuaccagac

SEQ ID NO: 3862004 - RNA, 17 nt, Shigella flexneri 2a str. 2457T
agacagcgucacaucag

SEQ ID NO: 3862005 - RNA, 16 nt, Shigella flexneri 2a str. 2457T
agacaguucuuccugg

SEQ ID NO: 3862006 - RNA, 14 nt, Shigella flexneri 2a str. 2457T
agacauaacccagc

SEQ ID NO: 3862007 - RNA, 15 nt, Shigella flexneri 2a str. 2457T
agacauagcacauaa

SEQ ID NO: 3862008 - RNA, 12 nt, Shigella flexneri 2a str. 2457T
agacaucaaacc

SEQ ID NO: 3862009 - RNA, 14 nt, Shigella flexneri 2a str. 2457T
agacaucaccaaua

SEQ ID NO: 3862010 - RNA, 14 nt, Shigella flexneri 2a str. 2457T
agacaucgcaggga

SEQ ID NO: 3862011 - RNA, 22 nt, Shigella flexneri 2a str. 2457T
agacaucgcccgauucacauaa

SEQ ID NO: 3862012 - RNA, 14 nt, Shigella flexneri 2a str. 2457T
agacaucuguuauc

SEQ ID NO: 3862013 - RNA, 18 nt, Shigella flexneri 2a str. 2457T
agacaucuuuauaugcaa

SEQ ID NO: 3862014 - RNA, 14 nt, Shigella flexneri 2a str. 2457T
agacaugguaaaac

SEQ ID NO: 3862015 - RNA, 18 nt, Shigella flexneri 2a str. 2457T
agacauguggauuaaauu

SEQ ID NO: 3862016 - RNA, 19 nt, Shigella flexneri 2a str. 2457T
agacauuccuuuacuuaga

SEQ ID NO: 3862017 - RNA, 21 nt, Shigella flexneri 2a str. 2457T
agaccaaaacgugcagcugcc

SEQ ID NO: 3862018 - RNA, 22 nt, Shigella flexneri 2a str. 2457T
agaccaauccagccggcaaagu

SEQ ID NO: 3862019 - RNA, 17 nt, Shigella flexneri 2a str. 2457T
agaccaaucccgccaua

SEQ ID NO: 3862020 - RNA, 23 nt, Shigella flexneri 2a str. 2457T
agaccaaucccgccauaacggcu

SEQ ID NO: 3862021 - RNA, 16 nt, Shigella flexneri 2a str. 2457T
agaccaauccgccagc

SEQ ID NO: 3862022 - RNA, 18 nt, Shigella flexneri 2a str. 2457T
agaccaauggcuuuugcc

SEQ ID NO: 3862023 - RNA, 12 nt, Shigella flexneri 2a str. 2457T
agaccagacugc

SEQ ID NO: 3862024 - RNA, 19 nt, Shigella flexneri 2a str. 2457T
agaccagauuaaucagcag

SEQ ID NO: 3862025 - RNA, 12 nt, Shigella flexneri 2a str. 2457T
agaccagcaaaa

SEQ ID NO: 3862026 - RNA, 11 nt, Shigella flexneri 2a str. 2457T
agaccagcacc

SEQ ID NO: 3862027 - RNA, 20 nt, Shigella flexneri 2a str. 2457T
agaccaguaaagugcgcuuu

SEQ ID NO: 3862028 - RNA, 22 nt, Shigella flexneri 2a str. 2457T
agaccaucaauuggaucugaug

SEQ ID NO: 3862029 - RNA, 21 nt, Shigella flexneri 2a str. 2457T
agacccaguuucggcaucagc

SEQ ID NO: 3862030 - RNA, 23 nt, Shigella flexneri 2a str. 2457T
agacccaguuucggcaucagcag

SEQ ID NO: 3862031 - RNA, 19 nt, Shigella flexneri 2a str. 2457T
agacccugcucuuucagca

SEQ ID NO: 3862032 - RNA, 13 nt, Shigella flexneri 2a str. 2457T
agaccgcaucacg

SEQ ID NO: 3862033 - RNA, 20 nt, Shigella flexneri 2a str. 2457T
agaccgcaucacgacagcac

SEQ ID NO: 3862034 - RNA, 14 nt, Shigella flexneri 2a str. 2457T
agaccgcuucugcg

SEQ ID NO: 3862035 - RNA, 13 nt, Shigella flexneri 2a str. 2457T
agaccggcaacca

SEQ ID NO: 3862036 - RNA, 18 nt, Shigella flexneri 2a str. 2457T
agaccggcaaccagcacc

SEQ ID NO: 3862037 - RNA, 17 nt, Shigella flexneri 2a str. 2457T
agaccguugcucagaau

SEQ ID NO: 3862038 - RNA, 20 nt, Shigella flexneri 2a str. 2457T
agaccuaacuuggcaaagcu

SEQ ID NO: 3862039 - RNA, 17 nt, Shigella flexneri 2a str. 2457T
agaccugauacauagca

SEQ ID NO: 3862040 - RNA, 17 nt, Shigella flexneri 2a str. 2457T
agaccuggcgcuucacu

SEQ ID NO: 3862041 - RNA, 17 nt, Shigella flexneri 2a str. 2457T
agaccugggcgaugcug

SEQ ID NO: 3862042 - RNA, 14 nt, Shigella flexneri 2a str. 2457T
agaccuuaauugcu

SEQ ID NO: 3862043 - RNA, 18 nt, Shigella flexneri 2a str. 2457T
agaccuuucgaacccaac

SEQ ID NO: 3862044 - RNA, 21 nt, Shigella flexneri 2a str. 2457T
agacgacggaagaucguugcc

SEQ ID NO: 3862045 - RNA, 15 nt, Shigella flexneri 2a str. 2457T
agacgaugaaaaaga

SEQ ID NO: 3862046 - RNA, 23 nt, Shigella flexneri 2a str. 2457T
agacgauuacucgccuuucacac

SEQ ID NO: 3862047 - RNA, 18 nt, Shigella flexneri 2a str. 2457T
agacgcaaaguagcggcc

SEQ ID NO: 3862048 - RNA, 17 nt, Shigella flexneri 2a str. 2457T
agacgcacccucaaaau

SEQ ID NO: 3862049 - RNA, 20 nt, Shigella flexneri 2a str. 2457T
agacgcacccucaaaauuuc

SEQ ID NO: 3862050 - RNA, 21 nt, Shigella flexneri 2a str. 2457T
agacgcgacaagcgucgcauc

SEQ ID NO: 3862051 - RNA, 21 nt, Shigella flexneri 2a str. 2457T
agacgcgaccagcgucgcauc

SEQ ID NO: 3862052 - RNA, 14 nt, Shigella flexneri 2a str. 2457T
agacgcgaccggcg

SEQ ID NO: 3862053 - RNA, 21 nt, Shigella flexneri 2a str. 2457T
agacgcgaccggcgucgcauc

SEQ ID NO: 3862054 - RNA, 19 nt, Shigella flexneri 2a str. 2457T
agacgcgcagcgucgcauc

SEQ ID NO: 3862055 - RNA, 16 nt, Shigella flexneri 2a str. 2457T
agacgcgcagcuucac

SEQ ID NO: 3862056 - RNA, 20 nt, Shigella flexneri 2a str. 2457T
agacgcgcagcuucacuucu

SEQ ID NO: 3862057 - RNA, 19 nt, Shigella flexneri 2a str. 2457T
agacgcguuaauaccugau

SEQ ID NO: 3862058 - RNA, 17 nt, Shigella flexneri 2a str. 2457T
agacgcguuagcaucgc

SEQ ID NO: 3862059 - RNA, 20 nt, Shigella flexneri 2a str. 2457T
agacgcguuagcaucgcauc

SEQ ID NO: 3862060 - RNA, 21 nt, Shigella flexneri 2a str. 2457T
agacgcuacuuuuuucaccca

SEQ ID NO: 3862061 - RNA, 19 nt, Shigella flexneri 2a str. 2457T
agacgcucgccauuuuuca

SEQ ID NO: 3862062 - RNA, 20 nt, Shigella flexneri 2a str. 2457T
agacgcucuucaauggucag

SEQ ID NO: 3862063 - RNA, 17 nt, Shigella flexneri 2a str. 2457T
agacgcugcauugacaa

SEQ ID NO: 3862064 - RNA, 13 nt, Shigella flexneri 2a str. 2457T
agacgcuggaagc

SEQ ID NO: 3862065 - RNA, 20 nt, Shigella flexneri 2a str. 2457T
agacggcgcaacauccgcuu

SEQ ID NO: 3862066 - RNA, 18 nt, Shigella flexneri 2a str. 2457T
agacggcgcuuacucaug

SEQ ID NO: 3862067 - RNA, 17 nt, Shigella flexneri 2a str. 2457T
agacggcggaaagggcc

SEQ ID NO: 3862068 - RNA, 20 nt, Shigella flexneri 2a str. 2457T
agacggcugucauccagcag

SEQ ID NO: 3862069 - RNA, 14 nt, Shigella flexneri 2a str. 2457T
agacggugaccaga

SEQ ID NO: 3862070 - RNA, 16 nt, Shigella flexneri 2a str. 2457T
agacgguuaaaaacag

SEQ ID NO: 3862071 - RNA, 22 nt, Shigella flexneri 2a str. 2457T
agacgguuaaaaacagccagca

SEQ ID NO: 3862072 - RNA, 22 nt, Shigella flexneri 2a str. 2457T
agacgguuuaucucaucuucca

SEQ ID NO: 3862073 - RNA, 18 nt, Shigella flexneri 2a str. 2457T
agacguccggcgcugcaa

SEQ ID NO: 3862074 - RNA, 21 nt, Shigella flexneri 2a str. 2457T
agacguguugucagcucaucc

SEQ ID NO: 3862075 - RNA, 15 nt, Shigella flexneri 2a str. 2457T
agacguucuuccugu

SEQ ID NO: 3862076 - RNA, 16 nt, Shigella flexneri 2a str. 2457T
agacguugauucacuu

SEQ ID NO: 3862077 - RNA, 22 nt, Shigella flexneri 2a str. 2457T
agacucauauaaaaaccggugc

SEQ ID NO: 3862078 - RNA, 14 nt, Shigella flexneri 2a str. 2457T
agacucccagccuc

SEQ ID NO: 3862079 - RNA, 20 nt, Shigella flexneri 2a str. 2457T
agacucccagccucccauuu

SEQ ID NO: 3862080 - RNA, 23 nt, Shigella flexneri 2a str. 2457T
agauaaccccgcuugcuguuccu

SEQ ID NO: 3862081 - RNA, 21 nt, Shigella flexneri 2a str. 2457T
agauaacgccuggcaguggug

SEQ ID NO: 3862082 - RNA, 17 nt, Shigella flexneri 2a str. 2457T
agauaagauaaauuccu

SEQ ID NO: 3862083 - RNA, 12 nt, Shigella flexneri 2a str. 2457T
agauaagcaagg

SEQ ID NO: 3862084 - RNA, 22 nt, Shigella flexneri 2a str. 2457T
agauaagcagcguguugcggag

SEQ ID NO: 3862085 - RNA, 16 nt, Shigella flexneri 2a str. 2457T
agauaauaauguguuc

SEQ ID NO: 3862086 - RNA, 12 nt, Shigella flexneri 2a str. 2457T
agauaauaggua

SEQ ID NO: 3862087 - RNA, 20 nt, Shigella flexneri 2a str. 2457T
agauaaugcccgaugaccuu

SEQ ID NO: 3862088 - RNA, 22 nt, Shigella flexneri 2a str. 2457T
agauaauuaugccgaucaucau

SEQ ID NO: 3862089 - RNA, 15 nt, Shigella flexneri 2a str. 2457T
agauaauuuuuucuu

SEQ ID NO: 3862090 - RNA, 19 nt, Shigella flexneri 2a str. 2457T
agauacaguuuuugcgcuu

SEQ ID NO: 3862091 - RNA, 12 nt, Shigella flexneri 2a str. 2457T
agauacaucagc

SEQ ID NO: 3862092 - RNA, 15 nt, Shigella flexneri 2a str. 2457T
agauacaucagcgac

SEQ ID NO: 3862093 - RNA, 15 nt, Shigella flexneri 2a str. 2457T
agauaccccagcgca

SEQ ID NO: 3862094 - RNA, 19 nt, Shigella flexneri 2a str. 2457T
agauaccgccgccaugcuu

SEQ ID NO: 3862095 - RNA, 13 nt, Shigella flexneri 2a str. 2457T
agauaccuucuug

SEQ ID NO: 3862096 - RNA, 18 nt, Shigella flexneri 2a str. 2457T
agauacguuugccagugc

SEQ ID NO: 3862097 - RNA, 11 nt, Shigella flexneri 2a str. 2457T
agauacugcau

SEQ ID NO: 3862098 - RNA, 20 nt, Shigella flexneri 2a str. 2457T
agauacugcauucccaucgc

SEQ ID NO: 3862099 - RNA, 17 nt, Shigella flexneri 2a str. 2457T
agauagcaacagcagcc

SEQ ID NO: 3862100 - RNA, 22 nt, Shigella flexneri 2a str. 2457T
agauagccagguuuaccagcag

SEQ ID NO: 3862101 - RNA, 22 nt, Shigella flexneri 2a str. 2457T
agauagcugucccagucuuucc

SEQ ID NO: 3862102 - RNA, 18 nt, Shigella flexneri 2a str. 2457T
agauaguaagauuauaua

SEQ ID NO: 3862103 - RNA, 22 nt, Shigella flexneri 2a str. 2457T
agauaguaagauuauauaauau

SEQ ID NO: 3862104 - RNA, 20 nt, Shigella flexneri 2a str. 2457T
agauaguugauuaauuucau

SEQ ID NO: 3862105 - RNA, 16 nt, Shigella flexneri 2a str. 2457T
agauaguuuacugacu

SEQ ID NO: 3862106 - RNA, 21 nt, Shigella flexneri 2a str. 2457T
agauaucccgccagcaccagc

SEQ ID NO: 3862107 - RNA, 23 nt, Shigella flexneri 2a str. 2457T
agauaucccgccagcaccagcaa

SEQ ID NO: 3862108 - RNA, 23 nt, Shigella flexneri 2a str. 2457T
agauauuggggguaauucccugc

SEQ ID NO: 3862109 - RNA, 15 nt, Shigella flexneri 2a str. 2457T
agauauuuaaaugau

SEQ ID NO: 3862110 - RNA, 23 nt, Shigella flexneri 2a str. 2457T
agauauuuaauggcgacauaaaa

SEQ ID NO: 3862111 - RNA, 14 nt, Shigella flexneri 2a str. 2457T
agauauuucaccag

SEQ ID NO: 3862112 - RNA, 16 nt, Shigella flexneri 2a str. 2457T
agauauuucaccagcg

SEQ ID NO: 3862113 - RNA, 15 nt, Shigella flexneri 2a str. 2457T
agauauuucagagcu

SEQ ID NO: 3862114 - RNA, 21 nt, Shigella flexneri 2a str. 2457T
agauauuuuuaugcaugaccu

SEQ ID NO: 3862115 - RNA, 14 nt, Shigella flexneri 2a str. 2457T
agaucaaacucuuu

SEQ ID NO: 3862116 - RNA, 22 nt, Shigella flexneri 2a str. 2457T
agaucaccgcagaagcgauaac

SEQ ID NO: 3862117 - RNA, 14 nt, Shigella flexneri 2a str. 2457T
agaucacgcaucac

SEQ ID NO: 3862118 - RNA, 12 nt, Shigella flexneri 2a str. 2457T
agaucagaccaa

SEQ ID NO: 3862119 - RNA, 22 nt, Shigella flexneri 2a str. 2457T
agaucauccugcggcagcucca

SEQ ID NO: 3862120 - RNA, 20 nt, Shigella flexneri 2a str. 2457T
agauccagcaccuuuugcug

SEQ ID NO: 3862121 - RNA, 23 nt, Shigella flexneri 2a str. 2457T
agauccagugcguaucaauagca

SEQ ID NO: 3862122 - RNA, 15 nt, Shigella flexneri 2a str. 2457T
agauccauaaggucc

SEQ ID NO: 3862123 - RNA, 16 nt, Shigella flexneri 2a str. 2457T
agauccauaagguccu

SEQ ID NO: 3862124 - RNA, 17 nt, Shigella flexneri 2a str. 2457T
agauccauaagguccuc

SEQ ID NO: 3862125 - RNA, 20 nt, Shigella flexneri 2a str. 2457T
agauccauaagguccuccag

SEQ ID NO: 3862126 - RNA, 23 nt, Shigella flexneri 2a str. 2457T
agauccauaagguccuccagcuc

SEQ ID NO: 3862127 - RNA, 17 nt, Shigella flexneri 2a str. 2457T
agaucccauaaccaaca

SEQ ID NO: 3862128 - RNA, 17 nt, Shigella flexneri 2a str. 2457T
agauccggauugauauc

SEQ ID NO: 3862129 - RNA, 17 nt, Shigella flexneri 2a str. 2457T
agauccgggcauauuuc

SEQ ID NO: 3862130 - RNA, 23 nt, Shigella flexneri 2a str. 2457T
agauccugauccugcaacagcac

SEQ ID NO: 3862131 - RNA, 21 nt, Shigella flexneri 2a str. 2457T
agauccuggcgaaaacgcccg

SEQ ID NO: 3862132 - RNA, 14 nt, Shigella flexneri 2a str. 2457T
agaucgaucauauu

SEQ ID NO: 3862133 - RNA, 17 nt, Shigella flexneri 2a str. 2457T
agaucgccccggcaaga

SEQ ID NO: 3862134 - RNA, 12 nt, Shigella flexneri 2a str. 2457T
agaucgccgcug

SEQ ID NO: 3862135 - RNA, 20 nt, Shigella flexneri 2a str. 2457T
agaucgcgaugggucgccgc

SEQ ID NO: 3862136 - RNA, 19 nt, Shigella flexneri 2a str. 2457T
agaucgcggcaauuuuuac

SEQ ID NO: 3862137 - RNA, 14 nt, Shigella flexneri 2a str. 2457T
agaucggaugacgc

SEQ ID NO: 3862138 - RNA, 15 nt, Shigella flexneri 2a str. 2457T
agaucgguugccaua

SEQ ID NO: 3862139 - RNA, 16 nt, Shigella flexneri 2a str. 2457T
agaucgguugccauaa

SEQ ID NO: 3862140 - RNA, 18 nt, Shigella flexneri 2a str. 2457T
agaucgguuuuuuucgaa

SEQ ID NO: 3862141 - RNA, 18 nt, Shigella flexneri 2a str. 2457T
agaucguucgcaccaaau

SEQ ID NO: 3862142 - RNA, 22 nt, Shigella flexneri 2a str. 2457T
agaucguucgcaccaaauccaa

SEQ ID NO: 3862143 - RNA, 16 nt, Shigella flexneri 2a str. 2457T
agaucuaugucgcauc

SEQ ID NO: 3862144 - RNA, 14 nt, Shigella flexneri 2a str. 2457T
agaucuugauuuac

SEQ ID NO: 3862145 - RNA, 23 nt, Shigella flexneri 2a str. 2457T
agaugaaauaguugcauuccagu

SEQ ID NO: 3862146 - RNA, 15 nt, Shigella flexneri 2a str. 2457T
agaugaagcuggcaa

SEQ ID NO: 3862147 - RNA, 13 nt, Shigella flexneri 2a str. 2457T
agaugauaacccc

SEQ ID NO: 3862148 - RNA, 15 nt, Shigella flexneri 2a str. 2457T
agaugaugauacuga

SEQ ID NO: 3862149 - RNA, 16 nt, Shigella flexneri 2a str. 2457T
agaugaugauacugac

SEQ ID NO: 3862150 - RNA, 21 nt, Shigella flexneri 2a str. 2457T
agaugauggcauucucacucc

SEQ ID NO: 3862151 - RNA, 19 nt, Shigella flexneri 2a str. 2457T
agaugaugucacagccgca

SEQ ID NO: 3862152 - RNA, 12 nt, Shigella flexneri 2a str. 2457T
agaugcauuuau

SEQ ID NO: 3862153 - RNA, 12 nt, Shigella flexneri 2a str. 2457T
agaugccggaug

SEQ ID NO: 3862154 - RNA, 19 nt, Shigella flexneri 2a str. 2457T
agaugcgacggcaccacau

SEQ ID NO: 3862155 - RNA, 20 nt, Shigella flexneri 2a str. 2457T
agaugcgccagcaucgcauc

SEQ ID NO: 3862156 - RNA, 19 nt, Shigella flexneri 2a str. 2457T
agaugcggcgugaacgccu

SEQ ID NO: 3862157 - RNA, 12 nt, Shigella flexneri 2a str. 2457T
agaugcguucac

SEQ ID NO: 3862158 - RNA, 23 nt, Shigella flexneri 2a str. 2457T
agaugcucuuuucugaaguacac

SEQ ID NO: 3862159 - RNA, 17 nt, Shigella flexneri 2a str. 2457T
agaugcugcaaggugau

SEQ ID NO: 3862160 - RNA, 14 nt, Shigella flexneri 2a str. 2457T
agaugcugcggcgg

SEQ ID NO: 3862161 - RNA, 15 nt, Shigella flexneri 2a str. 2457T
agaugcuuucagcac

SEQ ID NO: 3862162 - RNA, 20 nt, Shigella flexneri 2a str. 2457T
agauggauugcugaaauaca

SEQ ID NO: 3862163 - RNA, 17 nt, Shigella flexneri 2a str. 2457T
agauggcuuugcccuuu

SEQ ID NO: 3862164 - RNA, 13 nt, Shigella flexneri 2a str. 2457T
agauggguuuuuc

SEQ ID NO: 3862165 - RNA, 23 nt, Shigella flexneri 2a str. 2457T
agauggguuuuucugcguuccug

SEQ ID NO: 3862166 - RNA, 13 nt, Shigella flexneri 2a str. 2457T
agaugguggucau

SEQ ID NO: 3862167 - RNA, 20 nt, Shigella flexneri 2a str. 2457T
agaugguuacgcauaaaacc

SEQ ID NO: 3862168 - RNA, 23 nt, Shigella flexneri 2a str. 2457T
agaugguuacuuuuuaugucauu

SEQ ID NO: 3862169 - RNA, 19 nt, Shigella flexneri 2a str. 2457T
agauguaaugagaacguuc

SEQ ID NO: 3862170 - RNA, 20 nt, Shigella flexneri 2a str. 2457T
agaugugagcgauacccauu

SEQ ID NO: 3862171 - RNA, 15 nt, Shigella flexneri 2a str. 2457T
agaugugauaacgcu

SEQ ID NO: 3862172 - RNA, 16 nt, Shigella flexneri 2a str. 2457T
agaugugcaguuccug

SEQ ID NO: 3862173 - RNA, 19 nt, Shigella flexneri 2a str. 2457T
agaugugggcaaucucacu

SEQ ID NO: 3862174 - RNA, 19 nt, Shigella flexneri 2a str. 2457T
agauguucuaucuuucaga

SEQ ID NO: 3862175 - RNA, 17 nt, Shigella flexneri 2a str. 2457T
agauguugucucagauu

SEQ ID NO: 3862176 - RNA, 13 nt, Shigella flexneri 2a str. 2457T
agauuaaaaguga

SEQ ID NO: 3862177 - RNA, 20 nt, Shigella flexneri 2a str. 2457T
agcaaucucuucaagcugcu

SEQ ID NO: 3862178 - RNA, 15 nt, Shigella flexneri 2a str. 2457T
agcaaugaucucaau

SEQ ID NO: 3862179 - RNA, 19 nt, Shigella flexneri 2a str. 2457T
agcaaugaucucaauaguu

SEQ ID NO: 3862180 - RNA, 18 nt, Shigella flexneri 2a str. 2457T
agcaaugcaggcaccugc

SEQ ID NO: 3862181 - RNA, 17 nt, Shigella flexneri 2a str. 2457T
agcaaugcgcaucaaag

SEQ ID NO: 3862182 - RNA, 16 nt, Shigella flexneri 2a str. 2457T
agcaauggcacugucg

SEQ ID NO: 3862183 - RNA, 20 nt, Shigella flexneri 2a str. 2457T
agcaauggcacugucgagau

SEQ ID NO: 3862184 - RNA, 14 nt, Shigella flexneri 2a str. 2457T
agcaauuaacagug

SEQ ID NO: 3862185 - RNA, 13 nt, Shigella flexneri 2a str. 2457T
agcaauuucuccg

SEQ ID NO: 3862186 - RNA, 15 nt, Shigella flexneri 2a str. 2457T
agcaauuucuccgcc

SEQ ID NO: 3862187 - RNA, 21 nt, Shigella flexneri 2a str. 2457T
agcaauuugcgcucaauaauc

SEQ ID NO: 3862188 - RNA, 12 nt, Shigella flexneri 2a str. 2457T
agcaauuuugcc

SEQ ID NO: 3862189 - RNA, 19 nt, Shigella flexneri 2a str. 2457T
agcacaaacccagggccaa

SEQ ID NO: 3862190 - RNA, 16 nt, Shigella flexneri 2a str. 2457T
agcacaauaaucagcc

SEQ ID NO: 3862191 - RNA, 20 nt, Shigella flexneri 2a str. 2457T
agcacaauaaucagcccaac

SEQ ID NO: 3862192 - RNA, 23 nt, Shigella flexneri 2a str. 2457T
agcacacauuauaggccugauaa

SEQ ID NO: 3862193 - RNA, 22 nt, Shigella flexneri 2a str. 2457T
agcacacugguucccaacaaca

SEQ ID NO: 3862194 - RNA, 23 nt, Shigella flexneri 2a str. 2457T
agcacacugguucccaacaacag

SEQ ID NO: 3862195 - RNA, 12 nt, Shigella flexneri 2a str. 2457T
agcacagcauca

SEQ ID NO: 3862196 - RNA, 13 nt, Shigella flexneri 2a str. 2457T
agcacaucacuca

SEQ ID NO: 3862197 - RNA, 21 nt, Shigella flexneri 2a str. 2457T
agcacaucagccagaugcacc

SEQ ID NO: 3862198 - RNA, 16 nt, Shigella flexneri 2a str. 2457T
agcacaucaucaaagc

SEQ ID NO: 3862199 - RNA, 18 nt, Shigella flexneri 2a str. 2457T
agcacaucaucaaagcca

SEQ ID NO: 3862200 - RNA, 14 nt, Shigella flexneri 2a str. 2457T
agcacaugcugaca

SEQ ID NO: 3862201 - RNA, 15 nt, Shigella flexneri 2a str. 2457T
agcacaugcugacau

SEQ ID NO: 3862202 - RNA, 13 nt, Shigella flexneri 2a str. 2457T
agcacauuucaga

SEQ ID NO: 3862203 - RNA, 14 nt, Shigella flexneri 2a str. 2457T
agcaccaccgcccg

SEQ ID NO: 3862204 - RNA, 13 nt, Shigella flexneri 2a str. 2457T
agcaccagauaau

SEQ ID NO: 3862205 - RNA, 12 nt, Shigella flexneri 2a str. 2457T
agcaccagcaac

SEQ ID NO: 3862206 - RNA, 18 nt, Shigella flexneri 2a str. 2457T
agcaccaggguaaaugca

SEQ ID NO: 3862207 - RNA, 19 nt, Shigella flexneri 2a str. 2457T
agcacccagaacgccgaau

SEQ ID NO: 3862208 - RNA, 14 nt, Shigella flexneri 2a str. 2457T
agcacccagcaauc

SEQ ID NO: 3862209 - RNA, 15 nt, Shigella flexneri 2a str. 2457T
agcacccagcaaucc

SEQ ID NO: 3862210 - RNA, 14 nt, Shigella flexneri 2a str. 2457T
agcacccgccagcg

SEQ ID NO: 3862211 - RNA, 20 nt, Shigella flexneri 2a str. 2457T
agcacccugaguuuucagua

SEQ ID NO: 3862212 - RNA, 18 nt, Shigella flexneri 2a str. 2457T
agcaccgcgaauuuuuuc

SEQ ID NO: 3862213 - RNA, 17 nt, Shigella flexneri 2a str. 2457T
agcaccgcgacaaucag

SEQ ID NO: 3862214 - RNA, 21 nt, Shigella flexneri 2a str. 2457T
agcaccugcuugaacgcaccg

SEQ ID NO: 3862215 - RNA, 14 nt, Shigella flexneri 2a str. 2457T
agcacgaccgccau

SEQ ID NO: 3862216 - RNA, 18 nt, Shigella flexneri 2a str. 2457T
agcacgauuuuguaggcc

SEQ ID NO: 3862217 - RNA, 16 nt, Shigella flexneri 2a str. 2457T
agcacgccuggaaagu

SEQ ID NO: 3862218 - RNA, 17 nt, Shigella flexneri 2a str. 2457T
agcacgcuuuucagugc

SEQ ID NO: 3862219 - RNA, 15 nt, Shigella flexneri 2a str. 2457T
agcacggcagcaacg

SEQ ID NO: 3862220 - RNA, 15 nt, Shigella flexneri 2a str. 2457T
agcacggcgcugacg

SEQ ID NO: 3862221 - RNA, 16 nt, Shigella flexneri 2a str. 2457T
agcacgucaucugcac

SEQ ID NO: 3862222 - RNA, 21 nt, Shigella flexneri 2a str. 2457T
agcacguugggcgcuggcggc

SEQ ID NO: 3862223 - RNA, 21 nt, Shigella flexneri 2a str. 2457T
agcacguuuagcuuuggugcc

SEQ ID NO: 3862224 - RNA, 21 nt, Shigella flexneri 2a str. 2457T
agcacuauccgacaucccgcc

SEQ ID NO: 3862225 - RNA, 15 nt, Shigella flexneri 2a str. 2457T
agcacuccugccacc

SEQ ID NO: 3862226 - RNA, 13 nt, Shigella flexneri 2a str. 2457T
agcacugcaucaa

SEQ ID NO: 3862227 - RNA, 15 nt, Shigella flexneri 2a str. 2457T
agcacugcaucaaug

SEQ ID NO: 3862228 - RNA, 18 nt, Shigella flexneri 2a str. 2457T
agcacugcgcccgccagc

SEQ ID NO: 3862229 - RNA, 18 nt, Shigella flexneri 2a str. 2457T
agcacuggcggcagcagg

SEQ ID NO: 3862230 - RNA, 12 nt, Shigella flexneri 2a str. 2457T
agcacuggggcu

SEQ ID NO: 3862231 - RNA, 15 nt, Shigella flexneri 2a str. 2457T
agcacuguaaaccuc

SEQ ID NO: 3862232 - RNA, 19 nt, Shigella flexneri 2a str. 2457T
agcacuguaaaccucuuuc

SEQ ID NO: 3862233 - RNA, 18 nt, Shigella flexneri 2a str. 2457T
agcacuucacccaucgcc

SEQ ID NO: 3862234 - RNA, 17 nt, Shigella flexneri 2a str. 2457T
agcacuucacugacauu

SEQ ID NO: 3862235 - RNA, 17 nt, Shigella flexneri 2a str. 2457T
agcacuugcaggaacag

SEQ ID NO: 3862236 - RNA, 20 nt, Shigella flexneri 2a str. 2457T
agcacuugcaggaacagugc

SEQ ID NO: 3862237 - RNA, 14 nt, Shigella flexneri 2a str. 2457T
agcacuugcaggcg

SEQ ID NO: 3862238 - RNA, 13 nt, Shigella flexneri 2a str. 2457T
agcagaaagcgac

SEQ ID NO: 3862239 - RNA, 13 nt, Shigella flexneri 2a str. 2457T
agcagaacaucag

SEQ ID NO: 3862240 - RNA, 14 nt, Shigella flexneri 2a str. 2457T
agcagaaccgccau

SEQ ID NO: 3862241 - RNA, 13 nt, Shigella flexneri 2a str. 2457T
agcagacaaccca

SEQ ID NO: 3862242 - RNA, 17 nt, Shigella flexneri 2a str. 2457T
agcagacaacccacaca

SEQ ID NO: 3862243 - RNA, 20 nt, Shigella flexneri 2a str. 2457T
agcagaccaauguuacgacc

SEQ ID NO: 3862244 - RNA, 16 nt, Shigella flexneri 2a str. 2457T
agcagaccagcaaaaa

SEQ ID NO: 3862245 - RNA, 15 nt, Shigella flexneri 2a str. 2457T
agcagaccagcaaua

SEQ ID NO: 3862246 - RNA, 23 nt, Shigella flexneri 2a str. 2457T
agcagacgcuccauugcccgccc

SEQ ID NO: 3862247 - RNA, 13 nt, Shigella flexneri 2a str. 2457T
agcagagagacaa

SEQ ID NO: 3862248 - RNA, 14 nt, Shigella flexneri 2a str. 2457T
agcagagaucuuuc

SEQ ID NO: 3862249 - RNA, 15 nt, Shigella flexneri 2a str. 2457T
agcagagcaaucacc

SEQ ID NO: 3862250 - RNA, 14 nt, Shigella flexneri 2a str. 2457T
agcagaguugcuga

SEQ ID NO: 3862251 - RNA, 16 nt, Shigella flexneri 2a str. 2457T
agcagauaucccgcca

SEQ ID NO: 3862252 - RNA, 22 nt, Shigella flexneri 2a str. 2457T
agcagauauugccccacaccgc

SEQ ID NO: 3862253 - RNA, 22 nt, Shigella flexneri 2a str. 2457T
agcagcaaugcaggcaccugcc

SEQ ID NO: 3862254 - RNA, 14 nt, Shigella flexneri 2a str. 2457T
agcagcacaccaca

SEQ ID NO: 3862255 - RNA, 17 nt, Shigella flexneri 2a str. 2457T
agcagcaccaccgcccg

SEQ ID NO: 3862256 - RNA, 13 nt, Shigella flexneri 2a str. 2457T
agcagcagagcaa

SEQ ID NO: 3862257 - RNA, 15 nt, Shigella flexneri 2a str. 2457T
agcagcagagcaauc

SEQ ID NO: 3862258 - RNA, 13 nt, Shigella flexneri 2a str. 2457T
agcagcagcaaga

SEQ ID NO: 3862259 - RNA, 15 nt, Shigella flexneri 2a str. 2457T
agcagcagcaagaua

SEQ ID NO: 3862260 - RNA, 21 nt, Shigella flexneri 2a str. 2457T
agcagcagcgguugagagaag

SEQ ID NO: 3862261 - RNA, 16 nt, Shigella flexneri 2a str. 2457T
agcagcagucaggcgc

SEQ ID NO: 3862262 - RNA, 17 nt, Shigella flexneri 2a str. 2457T
agcagccacaccaauca

SEQ ID NO: 3862263 - RNA, 15 nt, Shigella flexneri 2a str. 2457T
agcagccacugcggc

SEQ ID NO: 3862264 - RNA, 13 nt, Shigella flexneri 2a str. 2457T
agcagccgguauc

SEQ ID NO: 3862265 - RNA, 16 nt, Shigella flexneri 2a str. 2457T
agcagcgaagcauuca

SEQ ID NO: 3862266 - RNA, 19 nt, Shigella flexneri 2a str. 2457T
agcagcgaaucagcccagc

SEQ ID NO: 3862267 - RNA, 15 nt, Shigella flexneri 2a str. 2457T
agcagcggagaaaug

SEQ ID NO: 3862268 - RNA, 20 nt, Shigella flexneri 2a str. 2457T
agcagcggucggcuucccug

SEQ ID NO: 3862269 - RNA, 22 nt, Shigella flexneri 2a str. 2457T
agcagcguaacggcucacgccc

SEQ ID NO: 3862270 - RNA, 16 nt, Shigella flexneri 2a str. 2457T
agcagcguuaaugaua

SEQ ID NO: 3862271 - RNA, 16 nt, Shigella flexneri 2a str. 2457T
agcagcugaccgccgu

SEQ ID NO: 3862272 - RNA, 16 nt, Shigella flexneri 2a str. 2457T
agcagcugcucccagc

SEQ ID NO: 3862273 - RNA, 16 nt, Shigella flexneri 2a str. 2457T
agcagcuuucagcagc

SEQ ID NO: 3862274 - RNA, 17 nt, Shigella flexneri 2a str. 2457T
agcagcuuucagcagcg

SEQ ID NO: 3862275 - RNA, 19 nt, Shigella flexneri 2a str. 2457T
agccaaauccagcgccaca

SEQ ID NO: 3862276 - RNA, 22 nt, Shigella flexneri 2a str. 2457T
agccaaaucccgugaugcgguc

SEQ ID NO: 3862277 - RNA, 12 nt, Shigella flexneri 2a str. 2457T
agccaacagcag

SEQ ID NO: 3862278 - RNA, 19 nt, Shigella flexneri 2a str. 2457T
agccaacagcagccacacc

SEQ ID NO: 3862279 - RNA, 23 nt, Shigella flexneri 2a str. 2457T
agccaacguuucuggaaguaauc

SEQ ID NO: 3862280 - RNA, 12 nt, Shigella flexneri 2a str. 2457T
agccaagcaugu

SEQ ID NO: 3862281 - RNA, 19 nt, Shigella flexneri 2a str. 2457T
agccaagcgccgccucagc

SEQ ID NO: 3862282 - RNA, 22 nt, Shigella flexneri 2a str. 2457T
agccaagcgccgccucagccag

SEQ ID NO: 3862283 - RNA, 13 nt, Shigella flexneri 2a str. 2457T
agccaaucccgga

SEQ ID NO: 3862284 - RNA, 12 nt, Shigella flexneri 2a str. 2457T
agccacaauaaa

SEQ ID NO: 3862285 - RNA, 17 nt, Shigella flexneri 2a str. 2457T
agccacaauaaacgcgc

SEQ ID NO: 3862286 - RNA, 18 nt, Shigella flexneri 2a str. 2457T
agccacaaucgcagcgca

SEQ ID NO: 3862287 - RNA, 14 nt, Shigella flexneri 2a str. 2457T
agccacaccacuuu

SEQ ID NO: 3862288 - RNA, 20 nt, Shigella flexneri 2a str. 2457T
agccacagggugaucaccag

SEQ ID NO: 3862289 - RNA, 22 nt, Shigella flexneri 2a str. 2457T
agccacauuugcggcgaacugc

SEQ ID NO: 3862290 - RNA, 18 nt, Shigella flexneri 2a str. 2457T
agccaccacaauugacca

SEQ ID NO: 3862291 - RNA, 16 nt, Shigella flexneri 2a str. 2457T
agccaccacgccaaga

SEQ ID NO: 3862292 - RNA, 17 nt, Shigella flexneri 2a str. 2457T
agccaccacgccaagaa

SEQ ID NO: 3862293 - RNA, 20 nt, Shigella flexneri 2a str. 2457T
agccaccacgccaagaaaca

SEQ ID NO: 3862294 - RNA, 16 nt, Shigella flexneri 2a str. 2457T
agccaccacuugcagc

SEQ ID NO: 3862295 - RNA, 13 nt, Shigella flexneri 2a str. 2457T
agccaccagcacc

SEQ ID NO: 3862296 - RNA, 12 nt, Shigella flexneri 2a str. 2457T
agccaccgccag

SEQ ID NO: 3862297 - RNA, 18 nt, Shigella flexneri 2a str. 2457T
agccaccgcccagagaau

SEQ ID NO: 3862298 - RNA, 20 nt, Shigella flexneri 2a str. 2457T
agccaccuggcugcguuuuc

SEQ ID NO: 3862299 - RNA, 16 nt, Shigella flexneri 2a str. 2457T
agccacggcuccagca

SEQ ID NO: 3862300 - RNA, 14 nt, Shigella flexneri 2a str. 2457T
agccagaaagaacc

SEQ ID NO: 3862301 - RNA, 18 nt, Shigella flexneri 2a str. 2457T
agccagaacagcggugca

SEQ ID NO: 3862302 - RNA, 13 nt, Shigella flexneri 2a str. 2457T
agccagaccaccc

SEQ ID NO: 3862303 - RNA, 19 nt, Shigella flexneri 2a str. 2457T
agccagaccacccguaauc

SEQ ID NO: 3862304 - RNA, 16 nt, Shigella flexneri 2a str. 2457T
agccagacgccagcca

SEQ ID NO: 3862305 - RNA, 20 nt, Shigella flexneri 2a str. 2457T
agccagagaagcgacuugug

SEQ ID NO: 3862306 - RNA, 16 nt, Shigella flexneri 2a str. 2457T
agccagcaccaggcuu

SEQ ID NO: 3862307 - RNA, 15 nt, Shigella flexneri 2a str. 2457T
agccagcagcgaauc

SEQ ID NO: 3862308 - RNA, 12 nt, Shigella flexneri 2a str. 2457T
agccagccaacg

SEQ ID NO: 3862309 - RNA, 12 nt, Shigella flexneri 2a str. 2457T
agccagccagaa

SEQ ID NO: 3862310 - RNA, 14 nt, Shigella flexneri 2a str. 2457T
agccagccagaauc

SEQ ID NO: 3862311 - RNA, 15 nt, Shigella flexneri 2a str. 2457T
agccagccccacagc

SEQ ID NO: 3862312 - RNA, 18 nt, Shigella flexneri 2a str. 2457T
agccagccguugcccgua

SEQ ID NO: 3862313 - RNA, 16 nt, Shigella flexneri 2a str. 2457T
agccagcggcggcaca

SEQ ID NO: 3862314 - RNA, 15 nt, Shigella flexneri 2a str. 2457T
agccagcucgcgcca

SEQ ID NO: 3862315 - RNA, 24 nt, Shigella flexneri 2a str. 2457T
agccaggaaauacgcuggcugaac

SEQ ID NO: 3862316 - RNA, 18 nt, Shigella flexneri 2a str. 2457T
agccagguuuaccagcag

SEQ ID NO: 3862317 - RNA, 20 nt, Shigella flexneri 2a str. 2457T
agccaguaccacccccagau

SEQ ID NO: 3862318 - RNA, 15 nt, Shigella flexneri 2a str. 2457T
agccagucaguaacg

SEQ ID NO: 3862319 - RNA, 17 nt, Shigella flexneri 2a str. 2457T
agccaguucgagaaaaa

SEQ ID NO: 3862320 - RNA, 18 nt, Shigella flexneri 2a str. 2457T
agccaguucucaccaaag

SEQ ID NO: 3862321 - RNA, 21 nt, Shigella flexneri 2a str. 2457T
agccaguuuacccagcgaauc

SEQ ID NO: 3862322 - RNA, 16 nt, Shigella flexneri 2a str. 2457T
agccaguuuuucuuuu

SEQ ID NO: 3862323 - RNA, 17 nt, Shigella flexneri 2a str. 2457T
agccaguuuuucuuuuu

SEQ ID NO: 3862324 - RNA, 20 nt, Shigella flexneri 2a str. 2457T
agccaguuuuucuuuuucaa

SEQ ID NO: 3862325 - RNA, 22 nt, Shigella flexneri 2a str. 2457T
agccauaaagaaaucaccugcc

SEQ ID NO: 3862326 - RNA, 22 nt, Shigella flexneri 2a str. 2457T
agccauaaucacucuuccccgc

SEQ ID NO: 3862327 - RNA, 12 nt, Shigella flexneri 2a str. 2457T
agccaucaaaga

SEQ ID NO: 3862328 - RNA, 15 nt, Shigella flexneri 2a str. 2457T
agccaucaaucccau

SEQ ID NO: 3862329 - RNA, 19 nt, Shigella flexneri 2a str. 2457T
agccaugcccgugcugaca

SEQ ID NO: 3862330 - RNA, 20 nt, Shigella flexneri 2a str. 2457T
agccaugcccgugcugacag

SEQ ID NO: 3862331 - RNA, 19 nt, Shigella flexneri 2a str. 2457T
agccaugcggcaucuucuc

SEQ ID NO: 3862332 - RNA, 15 nt, Shigella flexneri 2a str. 2457T
agccauuaaacacca

SEQ ID NO: 3862333 - RNA, 12 nt, Shigella flexneri 2a str. 2457T
agccauucccuc

SEQ ID NO: 3862334 - RNA, 23 nt, Shigella flexneri 2a str. 2457T
agccauuuggugaagacguuuau

SEQ ID NO: 3862335 - RNA, 19 nt, Shigella flexneri 2a str. 2457T
agccauuuugcacauucca

SEQ ID NO: 3862336 - RNA, 18 nt, Shigella flexneri 2a str. 2457T
agcccaaagcagaguugc

SEQ ID NO: 3862337 - RNA, 20 nt, Shigella flexneri 2a str. 2457T
agcccaaagcagaguugcug

SEQ ID NO: 3862338 - RNA, 14 nt, Shigella flexneri 2a str. 2457T
agcccaaccaaagc

SEQ ID NO: 3862339 - RNA, 13 nt, Shigella flexneri 2a str. 2457T
agcccaauaauca

SEQ ID NO: 3862340 - RNA, 23 nt, Shigella flexneri 2a str. 2457T
agcccacauccaugugggcugcc

SEQ ID NO: 3862341 - RNA, 16 nt, Shigella flexneri 2a str. 2457T
agcccacaugccugca

SEQ ID NO: 3862342 - RNA, 17 nt, Shigella flexneri 2a str. 2457T
agcccacgccgcccaga

SEQ ID NO: 3862343 - RNA, 19 nt, Shigella flexneri 2a str. 2457T
agcccacgccgcccagaga

SEQ ID NO: 3862344 - RNA, 23 nt, Shigella flexneri 2a str. 2457T
agcccagacaaaugaacaccaaa

SEQ ID NO: 3862345 - RNA, 13 nt, Shigella flexneri 2a str. 2457T
agcccagccccca

SEQ ID NO: 3862346 - RNA, 20 nt, Shigella flexneri 2a str. 2457T
agcccaguaccgccagugca

SEQ ID NO: 3862347 - RNA, 22 nt, Shigella flexneri 2a str. 2457T
agcccaguaccgccagugcagc

SEQ ID NO: 3862348 - RNA, 19 nt, Shigella flexneri 2a str. 2457T
agcccaguucagcggcuga

SEQ ID NO: 3862349 - RNA, 16 nt, Shigella flexneri 2a str. 2457T
agccccaccagcaaau

SEQ ID NO: 3862350 - RNA, 12 nt, Shigella flexneri 2a str. 2457T
agccccagcacu

SEQ ID NO: 3862351 - RNA, 12 nt, Shigella flexneri 2a str. 2457T
agccccaguucc

SEQ ID NO: 3862352 - RNA, 22 nt, Shigella flexneri 2a str. 2457T
agccccgcgaacggggcugcca

SEQ ID NO: 3862353 - RNA, 18 nt, Shigella flexneri 2a str. 2457T
agccccggaauucucaaa

SEQ ID NO: 3862354 - RNA, 20 nt, Shigella flexneri 2a str. 2457T
agccccggaauucucaaacg

SEQ ID NO: 3862355 - RNA, 12 nt, Shigella flexneri 2a str. 2457T
agccccuccaca

SEQ ID NO: 3862356 - RNA, 17 nt, Shigella flexneri 2a str. 2457T
agcccgauggcaucacc

SEQ ID NO: 3862357 - RNA, 15 nt, Shigella flexneri 2a str. 2457T
agcccgccaucgccc

SEQ ID NO: 3862358 - RNA, 14 nt, Shigella flexneri 2a str. 2457T
agcccgccgccauc

SEQ ID NO: 3862359 - RNA, 16 nt, Shigella flexneri 2a str. 2457T
agcccguguuucugau

SEQ ID NO: 3862360 - RNA, 20 nt, Shigella flexneri 2a str. 2457T
agcccguguuucugauacag

SEQ ID NO: 3862361 - RNA, 12 nt, Shigella flexneri 2a str. 2457T
agcccuaauaaa

SEQ ID NO: 3862362 - RNA, 14 nt, Shigella flexneri 2a str. 2457T
agcccucaaacaac

SEQ ID NO: 3862363 - RNA, 19 nt, Shigella flexneri 2a str. 2457T
agcccucaccgaagcgagg

SEQ ID NO: 3862364 - RNA, 15 nt, Shigella flexneri 2a str. 2457T
agcccugaacgacgu

SEQ ID NO: 3862365 - RNA, 18 nt, Shigella flexneri 2a str. 2457T
agcccuggcucugcacua

SEQ ID NO: 3862366 - RNA, 11 nt, Shigella flexneri 2a str. 2457T
agcccuucuuu

SEQ ID NO: 3862367 - RNA, 12 nt, Shigella flexneri 2a str. 2457T
agcccuuucuuu

SEQ ID NO: 3862368 - RNA, 17 nt, Shigella flexneri 2a str. 2457T
agccgacaaugccacaa

SEQ ID NO: 3862369 - RNA, 14 nt, Shigella flexneri 2a str. 2457T
agccgaccgcaagg

SEQ ID NO: 3862370 - RNA, 17 nt, Shigella flexneri 2a str. 2457T
agccgagguagaacccu

SEQ ID NO: 3862371 - RNA, 16 nt, Shigella flexneri 2a str. 2457T
agccgaguagaucaac

SEQ ID NO: 3862372 - RNA, 18 nt, Shigella flexneri 2a str. 2457T
agccgaugaguuaagaag

SEQ ID NO: 3862373 - RNA, 19 nt, Shigella flexneri 2a str. 2457T
agcggccaaagggagcaga

SEQ ID NO: 3862374 - RNA, 20 nt, Shigella flexneri 2a str. 2457T
agcggccagccauccgucau

SEQ ID NO: 3862375 - RNA, 18 nt, Shigella flexneri 2a str. 2457T
agcggccuuuuccuuuca

SEQ ID NO: 3862376 - RNA, 22 nt, Shigella flexneri 2a str. 2457T
agcggcgcgcauucuggagcug

SEQ ID NO: 3862377 - RNA, 15 nt, Shigella flexneri 2a str. 2457T
agcggcguuugcucc

SEQ ID NO: 3862378 - RNA, 15 nt, Shigella flexneri 2a str. 2457T
agcggcugaauaucc

SEQ ID NO: 3862379 - RNA, 16 nt, Shigella flexneri 2a str. 2457T
agcggcuuccaccgcc

SEQ ID NO: 3862380 - RNA, 19 nt, Shigella flexneri 2a str. 2457T
agcggcuucguagacgcuu

SEQ ID NO: 3862381 - RNA, 17 nt, Shigella flexneri 2a str. 2457T
agcgggguguauuucac

SEQ ID NO: 3862382 - RNA, 21 nt, Shigella flexneri 2a str. 2457T
agcggguuuuuacguuauuug

SEQ ID NO: 3862383 - RNA, 13 nt, Shigella flexneri 2a str. 2457T
agcgguugcaggc

SEQ ID NO: 3862384 - RNA, 14 nt, Shigella flexneri 2a str. 2457T
agcgguuuugccag

SEQ ID NO: 3862385 - RNA, 20 nt, Shigella flexneri 2a str. 2457T
agcguaaaggcggcagaaca

SEQ ID NO: 3862386 - RNA, 22 nt, Shigella flexneri 2a str. 2457T
agcguaacggcucacgcccauc

SEQ ID NO: 3862387 - RNA, 17 nt, Shigella flexneri 2a str. 2457T
agcguaauugauccgcg

SEQ ID NO: 3862388 - RNA, 23 nt, Shigella flexneri 2a str. 2457T
agcguaccaugauccugcaauac

SEQ ID NO: 3862389 - RNA, 16 nt, Shigella flexneri 2a str. 2457T
agcguagcgcaucagg

SEQ ID NO: 3862390 - RNA, 22 nt, Shigella flexneri 2a str. 2457T
agcguagcgcaucaggcaguuu

SEQ ID NO: 3862391 - RNA, 16 nt, Shigella flexneri 2a str. 2457T
agcguauccagcauac

SEQ ID NO: 3862392 - RNA, 13 nt, Shigella flexneri 2a str. 2457T
agcguauccauca

SEQ ID NO: 3862393 - RNA, 13 nt, Shigella flexneri 2a str. 2457T
agcguauucagca

SEQ ID NO: 3862394 - RNA, 14 nt, Shigella flexneri 2a str. 2457T
agcguauucagcaa

SEQ ID NO: 3862395 - RNA, 18 nt, Shigella flexneri 2a str. 2457T
agcguauucgugacaaua

SEQ ID NO: 3862396 - RNA, 18 nt, Shigella flexneri 2a str. 2457T
agcgucaaggucaacagu

SEQ ID NO: 3862397 - RNA, 13 nt, Shigella flexneri 2a str. 2457T
agcgucagccaga

SEQ ID NO: 3862398 - RNA, 12 nt, Shigella flexneri 2a str. 2457T
agcgucagccug

SEQ ID NO: 3862399 - RNA, 17 nt, Shigella flexneri 2a str. 2457T
agcgucagcuuucagag

SEQ ID NO: 3862400 - RNA, 16 nt, Shigella flexneri 2a str. 2457T
agcguccagcccuccg

SEQ ID NO: 3862401 - RNA, 15 nt, Shigella flexneri 2a str. 2457T
agcgucccacgaccg

SEQ ID NO: 3862402 - RNA, 19 nt, Shigella flexneri 2a str. 2457T
agcgucccacgaccgcagc

SEQ ID NO: 3862403 - RNA, 15 nt, Shigella flexneri 2a str. 2457T
agcguccggcugcca

SEQ ID NO: 3862404 - RNA, 17 nt, Shigella flexneri 2a str. 2457T
agcgucgugaaacgcgu

SEQ ID NO: 3862405 - RNA, 13 nt, Shigella flexneri 2a str. 2457T
agcgucguggcaa

SEQ ID NO: 3862406 - RNA, 20 nt, Shigella flexneri 2a str. 2457T
agcgucguggcaaaaugcau

SEQ ID NO: 3862407 - RNA, 16 nt, Shigella flexneri 2a str. 2457T
agcgucugagcaggcg

SEQ ID NO: 3862408 - RNA, 15 nt, Shigella flexneri 2a str. 2457T
agcgugacaccagca

SEQ ID NO: 3862409 - RNA, 12 nt, Shigella flexneri 2a str. 2457T
agcgugagggaa

SEQ ID NO: 3862410 - RNA, 21 nt, Shigella flexneri 2a str. 2457T
agcgugauuguggcaaucaua

SEQ ID NO: 3862411 - RNA, 15 nt, Shigella flexneri 2a str. 2457T
agcgugcaaauauac

SEQ ID NO: 3862412 - RNA, 11 nt, Shigella flexneri 2a str. 2457T
agcgugcuggu

SEQ ID NO: 3862413 - RNA, 23 nt, Shigella flexneri 2a str. 2457T
agcguggaacuugacgaucugcu

SEQ ID NO: 3862414 - RNA, 19 nt, Shigella flexneri 2a str. 2457T
agcguguaaaaagauaaac

SEQ ID NO: 3862415 - RNA, 20 nt, Shigella flexneri 2a str. 2457T
agcguguuaaugcccaucag

SEQ ID NO: 3862416 - RNA, 14 nt, Shigella flexneri 2a str. 2457T
agcguguugcggag

SEQ ID NO: 3862417 - RNA, 14 nt, Shigella flexneri 2a str. 2457T
agcguuaaaacuuu

SEQ ID NO: 3862418 - RNA, 21 nt, Shigella flexneri 2a str. 2457T
agcguuaaugauaucccugcu

SEQ ID NO: 3862419 - RNA, 20 nt, Shigella flexneri 2a str. 2457T
agcguuaauggcgauaaucg

SEQ ID NO: 3862420 - RNA, 13 nt, Shigella flexneri 2a str. 2457T
agcguuaccggcu

SEQ ID NO: 3862421 - RNA, 17 nt, Shigella flexneri 2a str. 2457T
agcguucaaaacggcug

SEQ ID NO: 3862422 - RNA, 23 nt, Shigella flexneri 2a str. 2457T
agcguucagugaucgccugcaug

SEQ ID NO: 3862423 - RNA, 19 nt, Shigella flexneri 2a str. 2457T
agcguuccacgugcggccg

SEQ ID NO: 3862424 - RNA, 18 nt, Shigella flexneri 2a str. 2457T
agcguucuuuaacugccg

SEQ ID NO: 3862425 - RNA, 21 nt, Shigella flexneri 2a str. 2457T
agcguugcccgauugguucag

SEQ ID NO: 3862426 - RNA, 14 nt, Shigella flexneri 2a str. 2457T
agcguugcgccugu

SEQ ID NO: 3862427 - RNA, 15 nt, Shigella flexneri 2a str. 2457T
agcguuguaacaauc

SEQ ID NO: 3862428 - RNA, 12 nt, Shigella flexneri 2a str. 2457T
agcguuucaaca

SEQ ID NO: 3862429 - RNA, 18 nt, Shigella flexneri 2a str. 2457T
agcguuucaacaaacgau

SEQ ID NO: 3862430 - RNA, 13 nt, Shigella flexneri 2a str. 2457T
agcguuucaagug

SEQ ID NO: 3862431 - RNA, 22 nt, Shigella flexneri 2a str. 2457T
agcguuuccagcaccaguucac

SEQ ID NO: 3862432 - RNA, 15 nt, Shigella flexneri 2a str. 2457T
agcguuuccagccag

SEQ ID NO: 3862433 - RNA, 13 nt, Shigella flexneri 2a str. 2457T
agcguuuucucaa

SEQ ID NO: 3862434 - RNA, 22 nt, Shigella flexneri 2a str. 2457T
agcguuuuuucaucggcaguuu

SEQ ID NO: 3862435 - RNA, 15 nt, Shigella flexneri 2a str. 2457T
agcuaaacagcccaa

SEQ ID NO: 3862436 - RNA, 20 nt, Shigella flexneri 2a str. 2457T
agcuaaacagcccaaucauc

SEQ ID NO: 3862437 - RNA, 13 nt, Shigella flexneri 2a str. 2457T
agcuaaaucacac

SEQ ID NO: 3862438 - RNA, 18 nt, Shigella flexneri 2a str. 2457T
agcuaacucuaaucccuu

SEQ ID NO: 3862439 - RNA, 14 nt, Shigella flexneri 2a str. 2457T
agcuaaucaucauc

SEQ ID NO: 3862440 - RNA, 20 nt, Shigella flexneri 2a str. 2457T
agcuaauccccuccagcgag

SEQ ID NO: 3862441 - RNA, 21 nt, Shigella flexneri 2a str. 2457T
agcuaaugcaaaucacgcugc

SEQ ID NO: 3862442 - RNA, 12 nt, Shigella flexneri 2a str. 2457T
agcuaauuuuug

SEQ ID NO: 3862443 - RNA, 23 nt, Shigella flexneri 2a str. 2457T
agcuaauuuuuguuguuuaaaug

SEQ ID NO: 3862444 - RNA, 15 nt, Shigella flexneri 2a str. 2457T
agcuaccacgccgau

SEQ ID NO: 3862445 - RNA, 19 nt, Shigella flexneri 2a str. 2457T
agcuauaaaccugcuggcg

SEQ ID NO: 3862446 - RNA, 20 nt, Shigella flexneri 2a str. 2457T
agcuauauuuugccggacgc

SEQ ID NO: 3862447 - RNA, 21 nt, Shigella flexneri 2a str. 2457T
agcuauguuugaaccagauau

SEQ ID NO: 3862448 - RNA, 17 nt, Shigella flexneri 2a str. 2457T
agcuauucuuauaaaga

SEQ ID NO: 3862449 - RNA, 19 nt, Shigella flexneri 2a str. 2457T
agcucaaacgaaugcaggc

SEQ ID NO: 3862450 - RNA, 16 nt, Shigella flexneri 2a str. 2457T
agcucaauacaaccca

SEQ ID NO: 3862451 - RNA, 17 nt, Shigella flexneri 2a str. 2457T
agcucaaucaacuccau

SEQ ID NO: 3862452 - RNA, 19 nt, Shigella flexneri 2a str. 2457T
agcucacggccggucauuu

SEQ ID NO: 3862453 - RNA, 23 nt, Shigella flexneri 2a str. 2457T
agcucaguugguuagagcacauc

SEQ ID NO: 3862454 - RNA, 16 nt, Shigella flexneri 2a str. 2457T
agcucauauuugcugg

SEQ ID NO: 3862455 - RNA, 22 nt, Shigella flexneri 2a str. 2457T
agcucauccagcguuucgugaa

SEQ ID NO: 3862456 - RNA, 18 nt, Shigella flexneri 2a str. 2457T
agcucaucguuacgccca

SEQ ID NO: 3862457 - RNA, 16 nt, Shigella flexneri 2a str. 2457T
agcucauuaaaaauau

SEQ ID NO: 3862458 - RNA, 15 nt, Shigella flexneri 2a str. 2457T
agcuccaccaguucg

SEQ ID NO: 3862459 - RNA, 14 nt, Shigella flexneri 2a str. 2457T
agcuccagcaaaaa

SEQ ID NO: 3862460 - RNA, 14 nt, Shigella flexneri 2a str. 2457T
agcuccagguccuc

SEQ ID NO: 3862461 - RNA, 22 nt, Shigella flexneri 2a str. 2457T
agcucccacaguuucagcccca

SEQ ID NO: 3862462 - RNA, 20 nt, Shigella flexneri 2a str. 2457T
agcucccggagggguuuuug

SEQ ID NO: 3862463 - RNA, 19 nt, Shigella flexneri 2a str. 2457T
agcuccguccagccaccgc

SEQ ID NO: 3862464 - RNA, 23 nt, Shigella flexneri 2a str. 2457T
agcuccucgaguccuuccagguc

SEQ ID NO: 3862465 - RNA, 17 nt, Shigella flexneri 2a str. 2457T
agcucgacaccaaacag

SEQ ID NO: 3862466 - RNA, 16 nt, Shigella flexneri 2a str. 2457T
agcucgaccgcugccg

SEQ ID NO: 3862467 - RNA, 16 nt, Shigella flexneri 2a str. 2457T
agcucgacuccugacu

SEQ ID NO: 3862468 - RNA, 18 nt, Shigella flexneri 2a str. 2457T
agcucgcaagccacgccg

SEQ ID NO: 3862469 - RNA, 20 nt, Shigella flexneri 2a str. 2457T
agcucgcaagccacgccgaa

SEQ ID NO: 3862470 - RNA, 17 nt, Shigella flexneri 2a str. 2457T
aggaacuguuucaccau

SEQ ID NO: 3862471 - RNA, 12 nt, Shigella flexneri 2a str. 2457T
aggaagacgcag

SEQ ID NO: 3862472 - RNA, 15 nt, Shigella flexneri 2a str. 2457T
aggaagcagcuugcu

SEQ ID NO: 3862473 - RNA, 21 nt, Shigella flexneri 2a str. 2457T
aggaagcgacccgguucaauu

SEQ ID NO: 3862474 - RNA, 20 nt, Shigella flexneri 2a str. 2457T
aggaagcuuucgcaguagau

SEQ ID NO: 3862475 - RNA, 21 nt, Shigella flexneri 2a str. 2457T
aggaagcuuucgcaguagauc

SEQ ID NO: 3862476 - RNA, 19 nt, Shigella flexneri 2a str. 2457T
aggaaguuaagaucagaag

SEQ ID NO: 3862477 - RNA, 24 nt, Shigella flexneri 2a str. 2457T
aggaaguuucagcgccagaucguu

SEQ ID NO: 3862478 - RNA, 21 nt, Shigella flexneri 2a str. 2457T
aggaaucaggcaggucuuuca

SEQ ID NO: 3862479 - RNA, 19 nt, Shigella flexneri 2a str. 2457T
aggaaucugauuacuuccu

SEQ ID NO: 3862480 - RNA, 16 nt, Shigella flexneri 2a str. 2457T
aggaauguggcaauga

SEQ ID NO: 3862481 - RNA, 14 nt, Shigella flexneri 2a str. 2457T
aggacaaaaauuca

SEQ ID NO: 3862482 - RNA, 13 nt, Shigella flexneri 2a str. 2457T
aggacacagaaug

SEQ ID NO: 3862483 - RNA, 19 nt, Shigella flexneri 2a str. 2457T
aggacaucccggcagagaa

SEQ ID NO: 3862484 - RNA, 18 nt, Shigella flexneri 2a str. 2457T
aggaccgguuucaaaacu

SEQ ID NO: 3862485 - RNA, 20 nt, Shigella flexneri 2a str. 2457T
aggacgaaaaaucaauaaac

SEQ ID NO: 3862486 - RNA, 16 nt, Shigella flexneri 2a str. 2457T
aggacgaaaaaucaca

SEQ ID NO: 3862487 - RNA, 20 nt, Shigella flexneri 2a str. 2457T
aggacucgaggagcuggagg

SEQ ID NO: 3862488 - RNA, 15 nt, Shigella flexneri 2a str. 2457T
aggacugaaauuaca

SEQ ID NO: 3862489 - RNA, 16 nt, Shigella flexneri 2a str. 2457T
aggacuucuuugcgcc

SEQ ID NO: 3862490 - RNA, 16 nt, Shigella flexneri 2a str. 2457T
aggagaaugggauggu

SEQ ID NO: 3862491 - RNA, 20 nt, Shigella flexneri 2a str. 2457T
aggagcacgccuggaaagug

SEQ ID NO: 3862492 - RNA, 20 nt, Shigella flexneri 2a str. 2457T
aggagccaacacuuucacua

SEQ ID NO: 3862493 - RNA, 17 nt, Shigella flexneri 2a str. 2457T
aggagccaucaccaucg

SEQ ID NO: 3862494 - RNA, 23 nt, Shigella flexneri 2a str. 2457T
aggagcuaauaaugagcagaaaa

SEQ ID NO: 3862495 - RNA, 19 nt, Shigella flexneri 2a str. 2457T
aggagcuccagguccuccu

SEQ ID NO: 3862496 - RNA, 13 nt, Shigella flexneri 2a str. 2457T
aggagcuggagga

SEQ ID NO: 3862497 - RNA, 13 nt, Shigella flexneri 2a str. 2457T
aggagcuggaugc

SEQ ID NO: 3862498 - RNA, 18 nt, Shigella flexneri 2a str. 2457T
aggaggcguaauuuccac

SEQ ID NO: 3862499 - RNA, 23 nt, Shigella flexneri 2a str. 2457T
aggagucauccucccuuacccuu

SEQ ID NO: 3862500 - RNA, 14 nt, Shigella flexneri 2a str. 2457T
aggaguucgucaac

SEQ ID NO: 3862501 - RNA, 21 nt, Shigella flexneri 2a str. 2457T
aggauaaaaaagggugcugca

SEQ ID NO: 3862502 - RNA, 16 nt, Shigella flexneri 2a str. 2457T
aggauaaacuccugca

SEQ ID NO: 3862503 - RNA, 19 nt, Shigella flexneri 2a str. 2457T
aggauaaacuccugcacgc

SEQ ID NO: 3862504 - RNA, 22 nt, Shigella flexneri 2a str. 2457T
aggauaggcuucuauaccaaug

SEQ ID NO: 3862505 - RNA, 22 nt, Shigella flexneri 2a str. 2457T
aggaucuuugccagaucgccug

SEQ ID NO: 3862506 - RNA, 21 nt, Shigella flexneri 2a str. 2457T
aggaugcgggucaggccagga

SEQ ID NO: 3862507 - RNA, 16 nt, Shigella flexneri 2a str. 2457T
aggauguuccggcaaa

SEQ ID NO: 3862508 - RNA, 22 nt, Shigella flexneri 2a str. 2457T
aggcaaacuucucgccaucaaa

SEQ ID NO: 3862509 - RNA, 19 nt, Shigella flexneri 2a str. 2457T
aggcaaagaguugccccuc

SEQ ID NO: 3862510 - RNA, 21 nt, Shigella flexneri 2a str. 2457T
aggcaacaugaaacagaaaau

SEQ ID NO: 3862511 - RNA, 15 nt, Shigella flexneri 2a str. 2457T
aggcaaccagcacgc

SEQ ID NO: 3862512 - RNA, 13 nt, Shigella flexneri 2a str. 2457T
aggcaagccacaa

SEQ ID NO: 3862513 - RNA, 20 nt, Shigella flexneri 2a str. 2457T
aggcaagccgcuaacagcag

SEQ ID NO: 3862514 - RNA, 22 nt, Shigella flexneri 2a str. 2457T
aggcaagccgcuaacagcagca

SEQ ID NO: 3862515 - RNA, 18 nt, Shigella flexneri 2a str. 2457T
aggcaaguagcgccauac

SEQ ID NO: 3862516 - RNA, 18 nt, Shigella flexneri 2a str. 2457T
aggcaauuggcgcaucau

SEQ ID NO: 3862517 - RNA, 14 nt, Shigella flexneri 2a str. 2457T
aggcacaacugcga

SEQ ID NO: 3862518 - RNA, 14 nt, Shigella flexneri 2a str. 2457T
aggcacaccgccgc

SEQ ID NO: 3862519 - RNA, 18 nt, Shigella flexneri 2a str. 2457T
aggcacagcaggccaaga

SEQ ID NO: 3862520 - RNA, 14 nt, Shigella flexneri 2a str. 2457T
aggcaccagccccu

SEQ ID NO: 3862521 - RNA, 21 nt, Shigella flexneri 2a str. 2457T
aggcaccauuaaggcugauga

SEQ ID NO: 3862522 - RNA, 15 nt, Shigella flexneri 2a str. 2457T
aggcaccuggaaauu

SEQ ID NO: 3862523 - RNA, 11 nt, Shigella flexneri 2a str. 2457T
aggcaccuucg

SEQ ID NO: 3862524 - RNA, 22 nt, Shigella flexneri 2a str. 2457T
aggcacgauaaguuugcgcauc

SEQ ID NO: 3862525 - RNA, 19 nt, Shigella flexneri 2a str. 2457T
aggcagcaaucacugccag

SEQ ID NO: 3862526 - RNA, 12 nt, Shigella flexneri 2a str. 2457T
aggcagcuuaga

SEQ ID NO: 3862527 - RNA, 16 nt, Shigella flexneri 2a str. 2457T
aggcagcuuagaaauu

SEQ ID NO: 3862528 - RNA, 15 nt, Shigella flexneri 2a str. 2457T
aggcaggcaucaaug

SEQ ID NO: 3862529 - RNA, 19 nt, Shigella flexneri 2a str. 2457T
aggcaggcaucaaugaaag

SEQ ID NO: 3862530 - RNA, 16 nt, Shigella flexneri 2a str. 2457T
aggcaggcaucaucag

SEQ ID NO: 3862531 - RNA, 17 nt, Shigella flexneri 2a str. 2457T
aggcagggccaccagcg

SEQ ID NO: 3862532 - RNA, 19 nt, Shigella flexneri 2a str. 2457T
aggcaguuuauccagccac

SEQ ID NO: 3862533 - RNA, 14 nt, Shigella flexneri 2a str. 2457T
aggcauagaaaaag

SEQ ID NO: 3862534 - RNA, 14 nt, Shigella flexneri 2a str. 2457T
aggcaucagacaaa

SEQ ID NO: 3862535 - RNA, 16 nt, Shigella flexneri 2a str. 2457T
aggcaucccgcaccag

SEQ ID NO: 3862536 - RNA, 17 nt, Shigella flexneri 2a str. 2457T
aggcaucccgcaccagc

SEQ ID NO: 3862537 - RNA, 20 nt, Shigella flexneri 2a str. 2457T
aggcaucggugcuggccuau

SEQ ID NO: 3862538 - RNA, 15 nt, Shigella flexneri 2a str. 2457T
aggcaucgugcacca

SEQ ID NO: 3862539 - RNA, 16 nt, Shigella flexneri 2a str. 2457T
aggcaucugcgcauaa

SEQ ID NO: 3862540 - RNA, 13 nt, Shigella flexneri 2a str. 2457T
aggcaugaucagc

SEQ ID NO: 3862541 - RNA, 18 nt, Shigella flexneri 2a str. 2457T
aggcauuaaauccugaaa

SEQ ID NO: 3862542 - RNA, 20 nt, Shigella flexneri 2a str. 2457T
aggcauuaucucuugccagg

SEQ ID NO: 3862543 - RNA, 17 nt, Shigella flexneri 2a str. 2457T
aggcauucucgccgugg

SEQ ID NO: 3862544 - RNA, 19 nt, Shigella flexneri 2a str. 2457T
aggcauucuuuuucauuau

SEQ ID NO: 3862545 - RNA, 15 nt, Shigella flexneri 2a str. 2457T
aggcauuuuuaucac

SEQ ID NO: 3862546 - RNA, 20 nt, Shigella flexneri 2a str. 2457T
aggccaaaaaacagccccug

SEQ ID NO: 3862547 - RNA, 12 nt, Shigella flexneri 2a str. 2457T
aggccaaagccg

SEQ ID NO: 3862548 - RNA, 21 nt, Shigella flexneri 2a str. 2457T
aggccaaccgucagauccgcc

SEQ ID NO: 3862549 - RNA, 14 nt, Shigella flexneri 2a str. 2457T
aggccaauccagcc

SEQ ID NO: 3862550 - RNA, 21 nt, Shigella flexneri 2a str. 2457T
aggccaauccagcccugccag

SEQ ID NO: 3862551 - RNA, 17 nt, Shigella flexneri 2a str. 2457T
aggccacccuguacgaa

SEQ ID NO: 3862552 - RNA, 15 nt, Shigella flexneri 2a str. 2457T
aggccagcagcagag

SEQ ID NO: 3862553 - RNA, 12 nt, Shigella flexneri 2a str. 2457T
aggccagccaga

SEQ ID NO: 3862554 - RNA, 19 nt, Shigella flexneri 2a str. 2457T
aggccagcggcuucgacga

SEQ ID NO: 3862555 - RNA, 21 nt, Shigella flexneri 2a str. 2457T
aggccagguaaucugucuuuu

SEQ ID NO: 3862556 - RNA, 16 nt, Shigella flexneri 2a str. 2457T
aggcccgcccccgggc

SEQ ID NO: 3862557 - RNA, 22 nt, Shigella flexneri 2a str. 2457T
aggcccgcccccgggccucccc

SEQ ID NO: 3862558 - RNA, 16 nt, Shigella flexneri 2a str. 2457T
aggcccgcgugccgga

SEQ ID NO: 3862559 - RNA, 14 nt, Shigella flexneri 2a str. 2457T
aggccgacagcagg

SEQ ID NO: 3862560 - RNA, 16 nt, Shigella flexneri 2a str. 2457T
aggccgacagcaggcu

SEQ ID NO: 3862561 - RNA, 17 nt, Shigella flexneri 2a str. 2457T
aggccgaggcacagcag

SEQ ID NO: 3862562 - RNA, 22 nt, Shigella flexneri 2a str. 2457T
aggccgccgucaucacgcaggc

SEQ ID NO: 3862563 - RNA, 19 nt, Shigella flexneri 2a str. 2457T
aggccgcguaccgcagcaa

SEQ ID NO: 3862564 - RNA, 14 nt, Shigella flexneri 2a str. 2457T
aggccgcuuucuga

SEQ ID NO: 3862565 - RNA, 14 nt, Shigella flexneri 2a str. 2457T
aggccggagcaugc

SEQ ID NO: 3862566 - RNA, 14 nt, Shigella flexneri 2a str. 2457T
aggccggagccagc

SEQ ID NO: 3862567 - RNA, 15 nt, Shigella flexneri 2a str. 2457T
aggccggagccagcc

SEQ ID NO: 3862568 - RNA, 16 nt, Shigella flexneri 2a str. 2457T
aggccggcauauaccu

SEQ ID NO: 3862569 - RNA, 15 nt, Shigella flexneri 2a str. 2457T
aggccguggaucaca

SEQ ID NO: 3862570 - RNA, 21 nt, Shigella flexneri 2a str. 2457T
aggccuaacaccaucaguggc

SEQ ID NO: 3862571 - RNA, 19 nt, Shigella flexneri 2a str. 2457T
aggccuacaaaaucuauug

SEQ ID NO: 3862572 - RNA, 14 nt, Shigella flexneri 2a str. 2457T
aggccuacaacucc

SEQ ID NO: 3862573 - RNA, 19 nt, Shigella flexneri 2a str. 2457T
aggccuacaaguccguuga

SEQ ID NO: 3862574 - RNA, 20 nt, Shigella flexneri 2a str. 2457T
aggccuacauuggugccgga

SEQ ID NO: 3862575 - RNA, 23 nt, Shigella flexneri 2a str. 2457T
aggccuacgcguccccugcaaua

SEQ ID NO: 3862576 - RNA, 21 nt, Shigella flexneri 2a str. 2457T
aggccuacgugguuuaugcaa

SEQ ID NO: 3862577 - RNA, 14 nt, Shigella flexneri 2a str. 2457T
aggccugauaagcg

SEQ ID NO: 3862578 - RNA, 22 nt, Shigella flexneri 2a str. 2457T
aggccugauaagcgcagcgcau

SEQ ID NO: 3862579 - RNA, 17 nt, Shigella flexneri 2a str. 2457T
aggccugauaagcguag

SEQ ID NO: 3862580 - RNA, 14 nt, Shigella flexneri 2a str. 2457T
aggccugauaagug

SEQ ID NO: 3862581 - RNA, 17 nt, Shigella flexneri 2a str. 2457T
aggccugcccacgggca

SEQ ID NO: 3862582 - RNA, 20 nt, Shigella flexneri 2a str. 2457T
aggccugcccacgggcaggc

SEQ ID NO: 3862583 - RNA, 16 nt, Shigella flexneri 2a str. 2457T
aggccugggcgaugau

SEQ ID NO: 3862584 - RNA, 17 nt, Shigella flexneri 2a str. 2457T
aggccuuaguagaagag

SEQ ID NO: 3862585 - RNA, 13 nt, Shigella flexneri 2a str. 2457T
aggcgaacaugcg

SEQ ID NO: 3862586 - RNA, 19 nt, Shigella flexneri 2a str. 2457T
aggcgaacaugcgcuggug

SEQ ID NO: 3862587 - RNA, 19 nt, Shigella flexneri 2a str. 2457T
aggcgaacauuccgguuau

SEQ ID NO: 3862588 - RNA, 17 nt, Shigella flexneri 2a str. 2457T
aggcgaccguuuucacc

SEQ ID NO: 3862589 - RNA, 16 nt, Shigella flexneri 2a str. 2457T
aggcgacgaauagcau

SEQ ID NO: 3862590 - RNA, 18 nt, Shigella flexneri 2a str. 2457T
aggcgagaucggcaggca

SEQ ID NO: 3862591 - RNA, 15 nt, Shigella flexneri 2a str. 2457T
aggcgagcgcggcug

SEQ ID NO: 3862592 - RNA, 14 nt, Shigella flexneri 2a str. 2457T
aggcgaucuucccg

SEQ ID NO: 3862593 - RNA, 16 nt, Shigella flexneri 2a str. 2457T
aggcgaugaaauucac

SEQ ID NO: 3862594 - RNA, 13 nt, Shigella flexneri 2a str. 2457T
aggcgcaauggcg

SEQ ID NO: 3862595 - RNA, 21 nt, Shigella flexneri 2a str. 2457T
aggcgcaauguugcgggggcu

SEQ ID NO: 3862596 - RNA, 15 nt, Shigella flexneri 2a str. 2457T
aggcgcacgccgaca

SEQ ID NO: 3862597 - RNA, 13 nt, Shigella flexneri 2a str. 2457T
aggcgcagaacuu

SEQ ID NO: 3862598 - RNA, 20 nt, Shigella flexneri 2a str. 2457T
aggcgcagcaagucggcauc

SEQ ID NO: 3862599 - RNA, 22 nt, Shigella flexneri 2a str. 2457T
aggcgcaggguuugcaucgcca

SEQ ID NO: 3862600 - RNA, 13 nt, Shigella flexneri 2a str. 2457T
aggcgcgcgguga

SEQ ID NO: 3862601 - RNA, 23 nt, Shigella flexneri 2a str. 2457T
aggcgcucgcgccgcauccgaca

SEQ ID NO: 3862602 - RNA, 20 nt, Shigella flexneri 2a str. 2457T
aggcgcugaaagaagcggug

SEQ ID NO: 3862603 - RNA, 21 nt, Shigella flexneri 2a str. 2457T
aggcgcugaaagaagcgguga

SEQ ID NO: 3862604 - RNA, 11 nt, Shigella flexneri 2a str. 2457T
aggcgcugauu

SEQ ID NO: 3862605 - RNA, 13 nt, Shigella flexneri 2a str. 2457T
aggcgcuggcaga

SEQ ID NO: 3862606 - RNA, 21 nt, Shigella flexneri 2a str. 2457T
aggcgcugguaaucaccaccc

SEQ ID NO: 3862607 - RNA, 17 nt, Shigella flexneri 2a str. 2457T
aggcgcuggucagugaa

SEQ ID NO: 3862608 - RNA, 21 nt, Shigella flexneri 2a str. 2457T
aggcgcuugucgucccaggca

SEQ ID NO: 3862609 - RNA, 18 nt, Shigella flexneri 2a str. 2457T
aggcggacugaauacgcu

SEQ ID NO: 3862610 - RNA, 15 nt, Shigella flexneri 2a str. 2457T
aggcggcgcaucggu

SEQ ID NO: 3862611 - RNA, 15 nt, Shigella flexneri 2a str. 2457T
aggcggcucaccugc

SEQ ID NO: 3862612 - RNA, 19 nt, Shigella flexneri 2a str. 2457T
aggcguaauuuccacgcca

SEQ ID NO: 3862613 - RNA, 22 nt, Shigella flexneri 2a str. 2457T
aggcgucaauuuguuccgccag

SEQ ID NO: 3862614 - RNA, 18 nt, Shigella flexneri 2a str. 2457T
aggcgucgggaagaccug

SEQ ID NO: 3862615 - RNA, 17 nt, Shigella flexneri 2a str. 2457T
aggcguuaacagcgcau

SEQ ID NO: 3862616 - RNA, 18 nt, Shigella flexneri 2a str. 2457T
aggcguuaacgccgcauc

SEQ ID NO: 3862617 - RNA, 20 nt, Shigella flexneri 2a str. 2457T
aggcguuaacgccgcauccg

SEQ ID NO: 3862618 - RNA, 23 nt, Shigella flexneri 2a str. 2457T
aggcguucacgccgcauccgaca

SEQ ID NO: 3862619 - RNA, 23 nt, Shigella flexneri 2a str. 2457T
aggcguucacgccgcauccggca

SEQ ID NO: 3862620 - RNA, 20 nt, Shigella flexneri 2a str. 2457T
aggcguucacgccgcaucug

SEQ ID NO: 3862621 - RNA, 18 nt, Shigella flexneri 2a str. 2457T
aggcguucauaucuacac

SEQ ID NO: 3862622 - RNA, 19 nt, Shigella flexneri 2a str. 2457T
aggcguugauuggcgcagg

SEQ ID NO: 3862623 - RNA, 19 nt, Shigella flexneri 2a str. 2457T
aggcguuuacccuucgcac

SEQ ID NO: 3862624 - RNA, 18 nt, Shigella flexneri 2a str. 2457T
aggcguuuacgccgcauc

SEQ ID NO: 3862625 - RNA, 22 nt, Shigella flexneri 2a str. 2457T
aggcguuuacgccgcauccggc

SEQ ID NO: 3862626 - RNA, 13 nt, Shigella flexneri 2a str. 2457T
aggcguuucaacu

SEQ ID NO: 3862627 - RNA, 19 nt, Shigella flexneri 2a str. 2457T
aggcguuugaaaaagccaa

SEQ ID NO: 3862628 - RNA, 21 nt, Shigella flexneri 2a str. 2457T
aggcguuuguaacccaccaug

SEQ ID NO: 3862629 - RNA, 20 nt, Shigella flexneri 2a str. 2457T
aggcguuuucgccacaucag

SEQ ID NO: 3862630 - RNA, 23 nt, Shigella flexneri 2a str. 2457T
aggcguuuugcagauucagccac

SEQ ID NO: 3862631 - RNA, 22 nt, Shigella flexneri 2a str. 2457T
aggcuaaagaaaacgaauugca

SEQ ID NO: 3862632 - RNA, 19 nt, Shigella flexneri 2a str. 2457T
aggcuaaauaaccagcaua

SEQ ID NO: 3862633 - RNA, 14 nt, Shigella flexneri 2a str. 2457T
aggcuaccggacau

SEQ ID NO: 3862634 - RNA, 19 nt, Shigella flexneri 2a str. 2457T
aggcuauuccacgcaucaa

SEQ ID NO: 3862635 - RNA, 16 nt, Shigella flexneri 2a str. 2457T
aggcucgccgccgcug

SEQ ID NO: 3862636 - RNA, 16 nt, Shigella flexneri 2a str. 2457T
aggcucucauuuuuca

SEQ ID NO: 3862637 - RNA, 20 nt, Shigella flexneri 2a str. 2457T
aggcucugauugccuuccac

SEQ ID NO: 3862638 - RNA, 16 nt, Shigella flexneri 2a str. 2457T
aggcugagaaaugcca

SEQ ID NO: 3862639 - RNA, 13 nt, Shigella flexneri 2a str. 2457T
aggcugaugacaa

SEQ ID NO: 3862640 - RNA, 15 nt, Shigella flexneri 2a str. 2457T
aggcugcauaaugcg

SEQ ID NO: 3862641 - RNA, 16 nt, Shigella flexneri 2a str. 2457T
aggcugcgaguccugu

SEQ ID NO: 3862642 - RNA, 19 nt, Shigella flexneri 2a str. 2457T
aggcuggaucagacgcagc

SEQ ID NO: 3862643 - RNA, 18 nt, Shigella flexneri 2a str. 2457T
aggcuggcguguucugaa

SEQ ID NO: 3862644 - RNA, 23 nt, Shigella flexneri 2a str. 2457T
aggcuggcguguucugaauaaac

SEQ ID NO: 3862645 - RNA, 20 nt, Shigella flexneri 2a str. 2457T
aggcuggcuuuaucacugag

SEQ ID NO: 3862646 - RNA, 21 nt, Shigella flexneri 2a str. 2457T
aggcuggcuuuaucacugagu

SEQ ID NO: 3862647 - RNA, 15 nt, Shigella flexneri 2a str. 2457T
aggcugguuucucuu

SEQ ID NO: 3862648 - RNA, 21 nt, Shigella flexneri 2a str. 2457T
aggcugugaaccgcacagguu

SEQ ID NO: 3862649 - RNA, 16 nt, Shigella flexneri 2a str. 2457T
aggcuguucccacgca

SEQ ID NO: 3862650 - RNA, 16 nt, Shigella flexneri 2a str. 2457T
aggcuuauccggcaug

SEQ ID NO: 3862651 - RNA, 20 nt, Shigella flexneri 2a str. 2457T
aggcuucaacacaggccggc

SEQ ID NO: 3862652 - RNA, 15 nt, Shigella flexneri 2a str. 2457T
aggcuucaaucaaua

SEQ ID NO: 3862653 - RNA, 18 nt, Shigella flexneri 2a str. 2457T
aggcuucaaucaauaaca

SEQ ID NO: 3862654 - RNA, 13 nt, Shigella flexneri 2a str. 2457T
aggcuucaggugc

SEQ ID NO: 3862655 - RNA, 13 nt, Shigella flexneri 2a str. 2457T
aggcuugcugcau

SEQ ID NO: 3862656 - RNA, 19 nt, Shigella flexneri 2a str. 2457T
aggcuuuaauauccggugc

SEQ ID NO: 3862657 - RNA, 17 nt, Shigella flexneri 2a str. 2457T
aggcuuuccugauaauc

SEQ ID NO: 3862658 - RNA, 20 nt, Shigella flexneri 2a str. 2457T
aggcuuuuacgcauugcuca

SEQ ID NO: 3862659 - RNA, 23 nt, Shigella flexneri 2a str. 2457T
aggcuuuuuuaccucuuuuuuca

SEQ ID NO: 3862660 - RNA, 19 nt, Shigella flexneri 2a str. 2457T
agggaaauaaucgggaaua

SEQ ID NO: 3862661 - RNA, 17 nt, Shigella flexneri 2a str. 2457T
agggaaaugaggaauua

SEQ ID NO: 3862662 - RNA, 15 nt, Shigella flexneri 2a str. 2457T
agggaagcgaguuac

SEQ ID NO: 3862663 - RNA, 13 nt, Shigella flexneri 2a str. 2457T
agggaauccagca

SEQ ID NO: 3862664 - RNA, 20 nt, Shigella flexneri 2a str. 2457T
agguucucucagucuuuccc

SEQ ID NO: 3862665 - RNA, 12 nt, Shigella flexneri 2a str. 2457T
agguucuuugcu

SEQ ID NO: 3862666 - RNA, 15 nt, Shigella flexneri 2a str. 2457T
agguucuuuuaaaug

SEQ ID NO: 3862667 - RNA, 15 nt, Shigella flexneri 2a str. 2457T
agguugacgcugcaa

SEQ ID NO: 3862668 - RNA, 17 nt, Shigella flexneri 2a str. 2457T
agguugcugcgccccac

SEQ ID NO: 3862669 - RNA, 20 nt, Shigella flexneri 2a str. 2457T
agguuguagauuuugcagau

SEQ ID NO: 3862670 - RNA, 17 nt, Shigella flexneri 2a str. 2457T
agguuguuaaccaccag

SEQ ID NO: 3862671 - RNA, 22 nt, Shigella flexneri 2a str. 2457T
agguuguucacggcacucgcug

SEQ ID NO: 3862672 - RNA, 14 nt, Shigella flexneri 2a str. 2457T
agguuuaaacagag

SEQ ID NO: 3862673 - RNA, 17 nt, Shigella flexneri 2a str. 2457T
agguuuaaccaucaggc

SEQ ID NO: 3862674 - RNA, 16 nt, Shigella flexneri 2a str. 2457T
agguuuaccagcagcc

SEQ ID NO: 3862675 - RNA, 13 nt, Shigella flexneri 2a str. 2457T
agguuuccggguc

SEQ ID NO: 3862676 - RNA, 19 nt, Shigella flexneri 2a str. 2457T
agguuucuuuuuaaagaga

SEQ ID NO: 3862677 - RNA, 16 nt, Shigella flexneri 2a str. 2457T
agguuuuaguuucgcc

SEQ ID NO: 3862678 - RNA, 13 nt, Shigella flexneri 2a str. 2457T
agguuuuccuuca

SEQ ID NO: 3862679 - RNA, 14 nt, Shigella flexneri 2a str. 2457T
agguuuuccuucag

SEQ ID NO: 3862680 - RNA, 19 nt, Shigella flexneri 2a str. 2457T
agguuuucuuucaccucuu

SEQ ID NO: 3862681 - RNA, 22 nt, Shigella flexneri 2a str. 2457T
agguuuuguugcccagcgcauc

SEQ ID NO: 3862682 - RNA, 12 nt, Shigella flexneri 2a str. 2457T
aguaaaaaaaca

SEQ ID NO: 3862683 - RNA, 16 nt, Shigella flexneri 2a str. 2457T
aguaaaaaaacaucau

SEQ ID NO: 3862684 - RNA, 12 nt, Shigella flexneri 2a str. 2457T
aguaaaaaagaa

SEQ ID NO: 3862685 - RNA, 23 nt, Shigella flexneri 2a str. 2457T
aguaaaaaagaaggaaaauacag

SEQ ID NO: 3862686 - RNA, 22 nt, Shigella flexneri 2a str. 2457T
aguaaaacggauaugauuuaaa

SEQ ID NO: 3862687 - RNA, 18 nt, Shigella flexneri 2a str. 2457T
aguaaaccgucagcacca

SEQ ID NO: 3862688 - RNA, 20 nt, Shigella flexneri 2a str. 2457T
aguaaacgaccaugacacuu

SEQ ID NO: 3862689 - RNA, 15 nt, Shigella flexneri 2a str. 2457T
aguaaacgcuuuuuu

SEQ ID NO: 3862690 - RNA, 18 nt, Shigella flexneri 2a str. 2457T
aguaaagcgcgucaccac

SEQ ID NO: 3862691 - RNA, 13 nt, Shigella flexneri 2a str. 2457T
aguaaauaaccau

SEQ ID NO: 3862692 - RNA, 16 nt, Shigella flexneri 2a str. 2457T
aguaaauauugucgau

SEQ ID NO: 3862693 - RNA, 13 nt, Shigella flexneri 2a str. 2457T
aguaaaugacagc

SEQ ID NO: 3862694 - RNA, 10 nt, Shigella flexneri 2a str. 2457T
aguaaauggu

SEQ ID NO: 3862695 - RNA, 17 nt, Shigella flexneri 2a str. 2457T
aguaaauggugauauca

SEQ ID NO: 3862696 - RNA, 11 nt, Shigella flexneri 2a str. 2457T
aguaacaauau

SEQ ID NO: 3862697 - RNA, 15 nt, Shigella flexneri 2a str. 2457T
aguaacaccauccau

SEQ ID NO: 3862698 - RNA, 21 nt, Shigella flexneri 2a str. 2457T
aguaacagauuguggugccga

SEQ ID NO: 3862699 - RNA, 19 nt, Shigella flexneri 2a str. 2457T
aguaaccacggcagcaacu

SEQ ID NO: 3862700 - RNA, 15 nt, Shigella flexneri 2a str. 2457T
aguaacccggcacca

SEQ ID NO: 3862701 - RNA, 22 nt, Shigella flexneri 2a str. 2457T
aguaaccgcuuuuucaauuucc

SEQ ID NO: 3862702 - RNA, 15 nt, Shigella flexneri 2a str. 2457T
aguaaccuuucagau

SEQ ID NO: 3862703 - RNA, 15 nt, Shigella flexneri 2a str. 2457T
aguaaccuuugaaca

SEQ ID NO: 3862704 - RNA, 22 nt, Shigella flexneri 2a str. 2457T
aguaacguaaccguugaccagc

SEQ ID NO: 3862705 - RNA, 23 nt, Shigella flexneri 2a str. 2457T
aguaacguucugucuccggcauc

SEQ ID NO: 3862706 - RNA, 17 nt, Shigella flexneri 2a str. 2457T
aguaacguuugauuaac

SEQ ID NO: 3862707 - RNA, 14 nt, Shigella flexneri 2a str. 2457T
aguaacuucuccac

SEQ ID NO: 3862708 - RNA, 17 nt, Shigella flexneri 2a str. 2457T
aguaagcacucugacgg

SEQ ID NO: 3862709 - RNA, 21 nt, Shigella flexneri 2a str. 2457T
aguaagucuuccggugcauca

SEQ ID NO: 3862710 - RNA, 11 nt, Shigella flexneri 2a str. 2457T
aguaauaacuu

SEQ ID NO: 3862711 - RNA, 14 nt, Shigella flexneri 2a str. 2457T
aguaauaacuuccu

SEQ ID NO: 3862712 - RNA, 12 nt, Shigella flexneri 2a str. 2457T
aguaauaaugcc

SEQ ID NO: 3862713 - RNA, 18 nt, Shigella flexneri 2a str. 2457T
aguaauauccccagccua

SEQ ID NO: 3862714 - RNA, 13 nt, Shigella flexneri 2a str. 2457T
aguaaucacgaau

SEQ ID NO: 3862715 - RNA, 14 nt, Shigella flexneri 2a str. 2457T
aguaaucaggcuau

SEQ ID NO: 3862716 - RNA, 21 nt, Shigella flexneri 2a str. 2457T
aguaauccuuucucaauuaac

SEQ ID NO: 3862717 - RNA, 17 nt, Shigella flexneri 2a str. 2457T
aguaaucgccagcaaaa

SEQ ID NO: 3862718 - RNA, 18 nt, Shigella flexneri 2a str. 2457T
aguaaucgggcaacugcu

SEQ ID NO: 3862719 - RNA, 19 nt, Shigella flexneri 2a str. 2457T
aguaaucgggcaacugcug

SEQ ID NO: 3862720 - RNA, 21 nt, Shigella flexneri 2a str. 2457T
aguaaucuacugcaccgcagg

SEQ ID NO: 3862721 - RNA, 14 nt, Shigella flexneri 2a str. 2457T
aguaaugagcacag

SEQ ID NO: 3862722 - RNA, 12 nt, Shigella flexneri 2a str. 2457T
aguaaugccagu

SEQ ID NO: 3862723 - RNA, 16 nt, Shigella flexneri 2a str. 2457T
aguaaugcggcaaggg

SEQ ID NO: 3862724 - RNA, 21 nt, Shigella flexneri 2a str. 2457T
aguacaucguagugaugccau

SEQ ID NO: 3862725 - RNA, 19 nt, Shigella flexneri 2a str. 2457T
aguacauuaaaauuggcuu

SEQ ID NO: 3862726 - RNA, 16 nt, Shigella flexneri 2a str. 2457T
aguacauuguuuucca

SEQ ID NO: 3862727 - RNA, 15 nt, Shigella flexneri 2a str. 2457T
aguaccaauggcaau

SEQ ID NO: 3862728 - RNA, 19 nt, Shigella flexneri 2a str. 2457T
aguaccacgguacgccaga

SEQ ID NO: 3862729 - RNA, 21 nt, Shigella flexneri 2a str. 2457T
aguaccacgguacgccagagu

SEQ ID NO: 3862730 - RNA, 13 nt, Shigella flexneri 2a str. 2457T
aguaccagcagcg

SEQ ID NO: 3862731 - RNA, 23 nt, Shigella flexneri 2a str. 2457T
aguaccaucguccagcagcaaug

SEQ ID NO: 3862732 - RNA, 14 nt, Shigella flexneri 2a str. 2457T
aguaccauuugcau

SEQ ID NO: 3862733 - RNA, 20 nt, Shigella flexneri 2a str. 2457T
aguacccggccuguuuaucc

SEQ ID NO: 3862734 - RNA, 20 nt, Shigella flexneri 2a str. 2457T
aguaccuccuucacaguggc

SEQ ID NO: 3862735 - RNA, 18 nt, Shigella flexneri 2a str. 2457T
aguaccucuucgcuggca

SEQ ID NO: 3862736 - RNA, 14 nt, Shigella flexneri 2a str. 2457T
aguaccugaccagu

SEQ ID NO: 3862737 - RNA, 21 nt, Shigella flexneri 2a str. 2457T
aguaccugaccagugaauuuc

SEQ ID NO: 3862738 - RNA, 22 nt, Shigella flexneri 2a str. 2457T
aguaccuguauaaacuauccug

SEQ ID NO: 3862739 - RNA, 15 nt, Shigella flexneri 2a str. 2457T
aguacgaaauaacug

SEQ ID NO: 3862740 - RNA, 20 nt, Shigella flexneri 2a str. 2457T
aguacgcccacgccagccug

SEQ ID NO: 3862741 - RNA, 21 nt, Shigella flexneri 2a str. 2457T
aguacgcccacgccagccugc

SEQ ID NO: 3862742 - RNA, 15 nt, Shigella flexneri 2a str. 2457T
aguacgcuuucccuu

SEQ ID NO: 3862743 - RNA, 16 nt, Shigella flexneri 2a str. 2457T
aguacgggcagcgcau

SEQ ID NO: 3862744 - RNA, 14 nt, Shigella flexneri 2a str. 2457T
aguacguucacgca

SEQ ID NO: 3862745 - RNA, 14 nt, Shigella flexneri 2a str. 2457T
aguacuucacaauc

SEQ ID NO: 3862746 - RNA, 15 nt, Shigella flexneri 2a str. 2457T
aguagaaacgaggua

SEQ ID NO: 3862747 - RNA, 15 nt, Shigella flexneri 2a str. 2457T
aguagaaauuauuuc

SEQ ID NO: 3862748 - RNA, 22 nt, Shigella flexneri 2a str. 2457T
aguagaauaaucuguuuuucau

SEQ ID NO: 3862749 - RNA, 22 nt, Shigella flexneri 2a str. 2457T
aguagauacccggauacaacuc

SEQ ID NO: 3862750 - RNA, 17 nt, Shigella flexneri 2a str. 2457T
aguagaucuugauuuac

SEQ ID NO: 3862751 - RNA, 16 nt, Shigella flexneri 2a str. 2457T
aguagcaaucggcuuu

SEQ ID NO: 3862752 - RNA, 22 nt, Shigella flexneri 2a str. 2457T
aguagccucgccgagcaguugc

SEQ ID NO: 3862753 - RNA, 12 nt, Shigella flexneri 2a str. 2457T
aguagcggguga

SEQ ID NO: 3862754 - RNA, 16 nt, Shigella flexneri 2a str. 2457T
aguagcgucgccagca

SEQ ID NO: 3862755 - RNA, 16 nt, Shigella flexneri 2a str. 2457T
aguagggcugauaaac

SEQ ID NO: 3862756 - RNA, 17 nt, Shigella flexneri 2a str. 2457T
aguagguagaauauuuu

SEQ ID NO: 3862757 - RNA, 14 nt, Shigella flexneri 2a str. 2457T
aguagucuuaguug

SEQ ID NO: 3862758 - RNA, 23 nt, Shigella flexneri 2a str. 2457T
aguagugauuuuaauaaaucacg

SEQ ID NO: 3862759 - RNA, 15 nt, Shigella flexneri 2a str. 2457T
aguaguuccagcaug

SEQ ID NO: 3862760 - RNA, 14 nt, Shigella flexneri 2a str. 2457T
aguauaaguaauga

SEQ ID NO: 3862761 - RNA, 16 nt, Shigella flexneri 2a str. 2457T
aguauacgccacauca

SEQ ID NO: 3862762 - RNA, 15 nt, Shigella flexneri 2a str. 2457T
agucuggcuucgcug

SEQ ID NO: 3862763 - RNA, 18 nt, Shigella flexneri 2a str. 2457T
agucuuaguugugcugaa

SEQ ID NO: 3862764 - RNA, 12 nt, Shigella flexneri 2a str. 2457T
agucuucccagc

SEQ ID NO: 3862765 - RNA, 11 nt, Shigella flexneri 2a str. 2457T
agucuuccugc

SEQ ID NO: 3862766 - RNA, 16 nt, Shigella flexneri 2a str. 2457T
agucuucgccgacuuc

SEQ ID NO: 3862767 - RNA, 16 nt, Shigella flexneri 2a str. 2457T
agucuuuccccguuga

SEQ ID NO: 3862768 - RNA, 18 nt, Shigella flexneri 2a str. 2457T
agugaaaaccggacugaa

SEQ ID NO: 3862769 - RNA, 17 nt, Shigella flexneri 2a str. 2457T
agugaaacacaugguuu

SEQ ID NO: 3862770 - RNA, 21 nt, Shigella flexneri 2a str. 2457T
agugaaagaggcggagguuuu

SEQ ID NO: 3862771 - RNA, 13 nt, Shigella flexneri 2a str. 2457T
agugaaauuaaac

SEQ ID NO: 3862772 - RNA, 15 nt, Shigella flexneri 2a str. 2457T
agugaauacagaaca

SEQ ID NO: 3862773 - RNA, 16 nt, Shigella flexneri 2a str. 2457T
agugaauacagaacag

SEQ ID NO: 3862774 - RNA, 19 nt, Shigella flexneri 2a str. 2457T
agugaauagcgcccggaaa

SEQ ID NO: 3862775 - RNA, 18 nt, Shigella flexneri 2a str. 2457T
agugaauauuuaaccuga

SEQ ID NO: 3862776 - RNA, 21 nt, Shigella flexneri 2a str. 2457T
agugacaguguuauucccaac

SEQ ID NO: 3862777 - RNA, 12 nt, Shigella flexneri 2a str. 2457T
agugaccaauca

SEQ ID NO: 3862778 - RNA, 22 nt, Shigella flexneri 2a str. 2457T
agugaccaaucauuggcgcuug

SEQ ID NO: 3862779 - RNA, 22 nt, Shigella flexneri 2a str. 2457T
agugaccgaaccuguuuucacc

SEQ ID NO: 3862780 - RNA, 14 nt, Shigella flexneri 2a str. 2457T
agugacucacgaau

SEQ ID NO: 3862781 - RNA, 13 nt, Shigella flexneri 2a str. 2457T
agugacugggugc

SEQ ID NO: 3862782 - RNA, 15 nt, Shigella flexneri 2a str. 2457T
agugagaauuuuuca

SEQ ID NO: 3862783 - RNA, 17 nt, Shigella flexneri 2a str. 2457T
agugagauaccaguuga

SEQ ID NO: 3862784 - RNA, 22 nt, Shigella flexneri 2a str. 2457T
agugagcuuuguucaugccgga

SEQ ID NO: 3862785 - RNA, 18 nt, Shigella flexneri 2a str. 2457T
agugaggcuauuccacgc

SEQ ID NO: 3862786 - RNA, 23 nt, Shigella flexneri 2a str. 2457T
agugaguguggcguggcgcucca

SEQ ID NO: 3862787 - RNA, 20 nt, Shigella flexneri 2a str. 2457T
agugaguuuugcauucggau

SEQ ID NO: 3862788 - RNA, 15 nt, Shigella flexneri 2a str. 2457T
agugauccagggcaa

SEQ ID NO: 3862789 - RNA, 22 nt, Shigella flexneri 2a str. 2457T
agugauccagggcaaauugcau

SEQ ID NO: 3862790 - RNA, 18 nt, Shigella flexneri 2a str. 2457T
agugaugaaaacgaaggc

SEQ ID NO: 3862791 - RNA, 13 nt, Shigella flexneri 2a str. 2457T
agugaugcgcagg

SEQ ID NO: 3862792 - RNA, 17 nt, Shigella flexneri 2a str. 2457T
agugauugcuugccccu

SEQ ID NO: 3862793 - RNA, 13 nt, Shigella flexneri 2a str. 2457T
agugcaaauccac

SEQ ID NO: 3862794 - RNA, 22 nt, Shigella flexneri 2a str. 2457T
agugcaaaugccagauaagaca

SEQ ID NO: 3862795 - RNA, 18 nt, Shigella flexneri 2a str. 2457T
agugcaaucaguggugua

SEQ ID NO: 3862796 - RNA, 19 nt, Shigella flexneri 2a str. 2457T
agugcauaaauaccggcau

SEQ ID NO: 3862797 - RNA, 20 nt, Shigella flexneri 2a str. 2457T
agugcauaaauaccggcaug

SEQ ID NO: 3862798 - RNA, 17 nt, Shigella flexneri 2a str. 2457T
agugcauugagucccau

SEQ ID NO: 3862799 - RNA, 19 nt, Shigella flexneri 2a str. 2457T
agugcauugagucccaucu

SEQ ID NO: 3862800 - RNA, 22 nt, Shigella flexneri 2a str. 2457T
agugccaugccaaucagcagaa

SEQ ID NO: 3862801 - RNA, 19 nt, Shigella flexneri 2a str. 2457T
agugcccgaccacuucaug

SEQ ID NO: 3862802 - RNA, 14 nt, Shigella flexneri 2a str. 2457T
agugccgaagaaca

SEQ ID NO: 3862803 - RNA, 14 nt, Shigella flexneri 2a str. 2457T
agugccgcccacca

SEQ ID NO: 3862804 - RNA, 21 nt, Shigella flexneri 2a str. 2457T
agugccggauaugaaauccgg

SEQ ID NO: 3862805 - RNA, 18 nt, Shigella flexneri 2a str. 2457T
agugccgguggaagggcu

SEQ ID NO: 3862806 - RNA, 14 nt, Shigella flexneri 2a str. 2457T
agugccgucagcag

SEQ ID NO: 3862807 - RNA, 15 nt, Shigella flexneri 2a str. 2457T
agugccguuccagcc

SEQ ID NO: 3862808 - RNA, 18 nt, Shigella flexneri 2a str. 2457T
agugcgcgcagcugcgca

SEQ ID NO: 3862809 - RNA, 20 nt, Shigella flexneri 2a str. 2457T
agugcggcgcaccagcaggc

SEQ ID NO: 3862810 - RNA, 16 nt, Shigella flexneri 2a str. 2457T
agugcgguaaauuuuu

SEQ ID NO: 3862811 - RNA, 17 nt, Shigella flexneri 2a str. 2457T
agugcgguaaauuuuuu

SEQ ID NO: 3862812 - RNA, 15 nt, Shigella flexneri 2a str. 2457T
agugcguaucaauag

SEQ ID NO: 3862813 - RNA, 17 nt, Shigella flexneri 2a str. 2457T
agugcguuauucaccuc

SEQ ID NO: 3862814 - RNA, 11 nt, Shigella flexneri 2a str. 2457T
agugcguucac

SEQ ID NO: 3862815 - RNA, 23 nt, Shigella flexneri 2a str. 2457T
agugcguucaccccuuucucgcc

SEQ ID NO: 3862816 - RNA, 13 nt, Shigella flexneri 2a str. 2457T
agugcugaagguu

SEQ ID NO: 3862817 - RNA, 17 nt, Shigella flexneri 2a str. 2457T
agugcuuucagcgaaaa

SEQ ID NO: 3862818 - RNA, 24 nt, Shigella flexneri 2a str. 2457T
agugcuuucaucaaaaaaugaaac

SEQ ID NO: 3862819 - RNA, 18 nt, Shigella flexneri 2a str. 2457T
agugcuuucugaacugaa

SEQ ID NO: 3862820 - RNA, 19 nt, Shigella flexneri 2a str. 2457T
aguggaagacguugauuca

SEQ ID NO: 3862821 - RNA, 19 nt, Shigella flexneri 2a str. 2457T
aguggaguccagcgccuga

SEQ ID NO: 3862822 - RNA, 16 nt, Shigella flexneri 2a str. 2457T
aguggaucagcaaauc

SEQ ID NO: 3862823 - RNA, 15 nt, Shigella flexneri 2a str. 2457T
aguggcaaauucuug

SEQ ID NO: 3862824 - RNA, 15 nt, Shigella flexneri 2a str. 2457T
aguggcaaccagcag

SEQ ID NO: 3862825 - RNA, 13 nt, Shigella flexneri 2a str. 2457T
aguggcagcaauu

SEQ ID NO: 3862826 - RNA, 17 nt, Shigella flexneri 2a str. 2457T
aguggcgcagagccuga

SEQ ID NO: 3862827 - RNA, 11 nt, Shigella flexneri 2a str. 2457T
aguggcgcauc

SEQ ID NO: 3862828 - RNA, 17 nt, Shigella flexneri 2a str. 2457T
aguggcucaggcucuca

SEQ ID NO: 3862829 - RNA, 19 nt, Shigella flexneri 2a str. 2457T
aguggcugcguuucaugua

SEQ ID NO: 3862830 - RNA, 14 nt, Shigella flexneri 2a str. 2457T
aguggugaaaaaaa

SEQ ID NO: 3862831 - RNA, 15 nt, Shigella flexneri 2a str. 2457T
aguggugauaccacc

SEQ ID NO: 3862832 - RNA, 21 nt, Shigella flexneri 2a str. 2457T
agugguuagccggauaaacaa

SEQ ID NO: 3862833 - RNA, 19 nt, Shigella flexneri 2a str. 2457T
agugguucugcaagaggaa

SEQ ID NO: 3862834 - RNA, 18 nt, Shigella flexneri 2a str. 2457T
agugguuucgccagcacc

SEQ ID NO: 3862835 - RNA, 20 nt, Shigella flexneri 2a str. 2457T
aguguaaaacagcacuccug

SEQ ID NO: 3862836 - RNA, 22 nt, Shigella flexneri 2a str. 2457T
aguguaccggaacgggaaacga

SEQ ID NO: 3862837 - RNA, 21 nt, Shigella flexneri 2a str. 2457T
aguguccgccaauuucaucac

SEQ ID NO: 3862838 - RNA, 16 nt, Shigella flexneri 2a str. 2457T
agugucggugaggccu

SEQ ID NO: 3862839 - RNA, 21 nt, Shigella flexneri 2a str. 2457T
agugucggugaggccuaugcg

SEQ ID NO: 3862840 - RNA, 17 nt, Shigella flexneri 2a str. 2457T
agugugaauauucagaa

SEQ ID NO: 3862841 - RNA, 13 nt, Shigella flexneri 2a str. 2457T
aguguggccagag

SEQ ID NO: 3862842 - RNA, 16 nt, Shigella flexneri 2a str. 2457T
aguguggccagagugc

SEQ ID NO: 3862843 - RNA, 22 nt, Shigella flexneri 2a str. 2457T
aguguggccagagugcguucac

SEQ ID NO: 3862844 - RNA, 19 nt, Shigella flexneri 2a str. 2457T
agugugggaaaaauuguuu

SEQ ID NO: 3862845 - RNA, 21 nt, Shigella flexneri 2a str. 2457T
agugugggaucacaucuucaa

SEQ ID NO: 3862846 - RNA, 17 nt, Shigella flexneri 2a str. 2457T
aguguguauacggcaac

SEQ ID NO: 3862847 - RNA, 21 nt, Shigella flexneri 2a str. 2457T
aguguguauggcauugucuga

SEQ ID NO: 3862848 - RNA, 17 nt, Shigella flexneri 2a str. 2457T
aguguuauucccaacgc

SEQ ID NO: 3862849 - RNA, 17 nt, Shigella flexneri 2a str. 2457T
aguguuggauggcggcu

SEQ ID NO: 3862850 - RNA, 16 nt, Shigella flexneri 2a str. 2457T
aguguuucggucugau

SEQ ID NO: 3862851 - RNA, 20 nt, Shigella flexneri 2a str. 2457T
aguguuuuauguucagauaa

SEQ ID NO: 3862852 - RNA, 16 nt, Shigella flexneri 2a str. 2457T
aguguuuugaggugua

SEQ ID NO: 3862853 - RNA, 15 nt, Shigella flexneri 2a str. 2457T
aguuaaaaaaacaag

SEQ ID NO: 3862854 - RNA, 20 nt, Shigella flexneri 2a str. 2457T
aguuaaccaaaaauuuccac

SEQ ID NO: 3862855 - RNA, 22 nt, Shigella flexneri 2a str. 2457T
aguuaaccaaaaauuuccacaa

SEQ ID NO: 3862856 - RNA, 17 nt, Shigella flexneri 2a str. 2457T
aguuacagcucucacuu

SEQ ID NO: 3862857 - RNA, 16 nt, Shigella flexneri 2a str. 2457T
aguuacccagccugca

SEQ ID NO: 3862858 - RNA, 16 nt, Shigella flexneri 2a str. 2457T
aguuacgugcugcgca

SEQ ID NO: 3862859 - RNA, 16 nt, Shigella flexneri 2a str. 2457T
auaaccuauaaaagau

SEQ ID NO: 3862860 - RNA, 18 nt, Shigella flexneri 2a str. 2457T
auaaccugaauauuagua

SEQ ID NO: 3862861 - RNA, 17 nt, Shigella flexneri 2a str. 2457T
auaaccugcaaaauagu

SEQ ID NO: 3862862 - RNA, 17 nt, Shigella flexneri 2a str. 2457T
auaaccugugcaccaga

SEQ ID NO: 3862863 - RNA, 18 nt, Shigella flexneri 2a str. 2457T
auaaccugugcaccagaa

SEQ ID NO: 3862864 - RNA, 16 nt, Shigella flexneri 2a str. 2457T
auaaccuuccagcuuc

SEQ ID NO: 3862865 - RNA, 22 nt, Shigella flexneri 2a str. 2457T
auaacgccaauucauuccuuga

SEQ ID NO: 3862866 - RNA, 22 nt, Shigella flexneri 2a str. 2457T
auaacgcgaucgcgaaaccacg

SEQ ID NO: 3862867 - RNA, 18 nt, Shigella flexneri 2a str. 2457T
auaacgcggcagcaggau

SEQ ID NO: 3862868 - RNA, 13 nt, Shigella flexneri 2a str. 2457T
auaacgcuggcag

SEQ ID NO: 3862869 - RNA, 10 nt, Shigella flexneri 2a str. 2457T
auaacgcuua

SEQ ID NO: 3862870 - RNA, 13 nt, Shigella flexneri 2a str. 2457T
auaacgcuuuucu

SEQ ID NO: 3862871 - RNA, 22 nt, Shigella flexneri 2a str. 2457T
auaacggaggacuuauggcugg

SEQ ID NO: 3862872 - RNA, 15 nt, Shigella flexneri 2a str. 2457T
auaacggcagaagcu

SEQ ID NO: 3862873 - RNA, 14 nt, Shigella flexneri 2a str. 2457T
auaacggcucaaac

SEQ ID NO: 3862874 - RNA, 19 nt, Shigella flexneri 2a str. 2457T
auaacguugaugcaggcag

SEQ ID NO: 3862875 - RNA, 13 nt, Shigella flexneri 2a str. 2457T
auaacuacugaug

SEQ ID NO: 3862876 - RNA, 22 nt, Shigella flexneri 2a str. 2457T
auaacuauuguuuugaugaauc

SEQ ID NO: 3862877 - RNA, 14 nt, Shigella flexneri 2a str. 2457T
auaacucaccauca

SEQ ID NO: 3862878 - RNA, 18 nt, Shigella flexneri 2a str. 2457T
auaacucaccaucaagua

SEQ ID NO: 3862879 - RNA, 22 nt, Shigella flexneri 2a str. 2457T
auaacuccccgagaaauacugg

SEQ ID NO: 3862880 - RNA, 17 nt, Shigella flexneri 2a str. 2457T
auaacucccuauaaugc

SEQ ID NO: 3862881 - RNA, 19 nt, Shigella flexneri 2a str. 2457T
auaacucgcacguucaguu

SEQ ID NO: 3862882 - RNA, 21 nt, Shigella flexneri 2a str. 2457T
auaacucucuuuugcuugaca

SEQ ID NO: 3862883 - RNA, 14 nt, Shigella flexneri 2a str. 2457T
auaacugccggaug

SEQ ID NO: 3862884 - RNA, 12 nt, Shigella flexneri 2a str. 2457T
auaacugcuauu

SEQ ID NO: 3862885 - RNA, 14 nt, Shigella flexneri 2a str. 2457T
auaacugcuauuca

SEQ ID NO: 3862886 - RNA, 20 nt, Shigella flexneri 2a str. 2457T
auaacugcuauucaccagca

SEQ ID NO: 3862887 - RNA, 22 nt, Shigella flexneri 2a str. 2457T
auaagaacugacuuccacuucc

SEQ ID NO: 3862888 - RNA, 19 nt, Shigella flexneri 2a str. 2457T
auaagacagcgucacauca

SEQ ID NO: 3862889 - RNA, 22 nt, Shigella flexneri 2a str. 2457T
auaagacgcguuagcaucgcau

SEQ ID NO: 3862890 - RNA, 21 nt, Shigella flexneri 2a str. 2457T
auaagacguaucaggcaaaau

SEQ ID NO: 3862891 - RNA, 19 nt, Shigella flexneri 2a str. 2457T
auaagacuggcaaaugaca

SEQ ID NO: 3862892 - RNA, 20 nt, Shigella flexneri 2a str. 2457T
auaagacuggcaaaugacau

SEQ ID NO: 3862893 - RNA, 19 nt, Shigella flexneri 2a str. 2457T
auaagagcgggacaacaaa

SEQ ID NO: 3862894 - RNA, 17 nt, Shigella flexneri 2a str. 2457T
auaagaugcuacaacau

SEQ ID NO: 3862895 - RNA, 14 nt, Shigella flexneri 2a str. 2457T
auaagcacuacucu

SEQ ID NO: 3862896 - RNA, 17 nt, Shigella flexneri 2a str. 2457T
auaagcaucuauuauug

SEQ ID NO: 3862897 - RNA, 16 nt, Shigella flexneri 2a str. 2457T
auaagccaaauccagc

SEQ ID NO: 3862898 - RNA, 17 nt, Shigella flexneri 2a str. 2457T
auaagccaaauccagcg

SEQ ID NO: 3862899 - RNA, 15 nt, Shigella flexneri 2a str. 2457T
auaagccaccucaac

SEQ ID NO: 3862900 - RNA, 19 nt, Shigella flexneri 2a str. 2457T
auaagcccagaacaaauaa

SEQ ID NO: 3862901 - RNA, 22 nt, Shigella flexneri 2a str. 2457T
auaagcccagaacaaauaaaua

SEQ ID NO: 3862902 - RNA, 13 nt, Shigella flexneri 2a str. 2457T
auaagcgcagcgc

SEQ ID NO: 3862903 - RNA, 16 nt, Shigella flexneri 2a str. 2457T
auaagcguuacgcagc

SEQ ID NO: 3862904 - RNA, 17 nt, Shigella flexneri 2a str. 2457T
auaagcguuacgcagca

SEQ ID NO: 3862905 - RNA, 19 nt, Shigella flexneri 2a str. 2457T
auaaggccaugcugcuuug

SEQ ID NO: 3862906 - RNA, 15 nt, Shigella flexneri 2a str. 2457T
auaaggcgcaauaau

SEQ ID NO: 3862907 - RNA, 13 nt, Shigella flexneri 2a str. 2457T
auaaggcuuuaac

SEQ ID NO: 3862908 - RNA, 22 nt, Shigella flexneri 2a str. 2457T
auaaggucacguccccugggga

SEQ ID NO: 3862909 - RNA, 14 nt, Shigella flexneri 2a str. 2457T
auaaguaaugaacu

SEQ ID NO: 3862910 - RNA, 14 nt, Shigella flexneri 2a str. 2457T
auaaguacgauaca

SEQ ID NO: 3862911 - RNA, 12 nt, Shigella flexneri 2a str. 2457T
auaagucucaga

SEQ ID NO: 3862912 - RNA, 14 nt, Shigella flexneri 2a str. 2457T
auaaguguaaaauu

SEQ ID NO: 3862913 - RNA, 13 nt, Shigella flexneri 2a str. 2457T
auaauaaucauca

SEQ ID NO: 3862914 - RNA, 14 nt, Shigella flexneri 2a str. 2457T
auaauaaucaucac

SEQ ID NO: 3862915 - RNA, 21 nt, Shigella flexneri 2a str. 2457T
auaauacacuaacagaacaau

SEQ ID NO: 3862916 - RNA, 19 nt, Shigella flexneri 2a str. 2457T
auaauagguaaacauccgu

SEQ ID NO: 3862917 - RNA, 15 nt, Shigella flexneri 2a str. 2457T
auaauaucuuuucuu

SEQ ID NO: 3862918 - RNA, 15 nt, Shigella flexneri 2a str. 2457T
auaauauuuuugcgu

SEQ ID NO: 3862919 - RNA, 23 nt, Shigella flexneri 2a str. 2457T
auaauauuuuugcguccuggcaa

SEQ ID NO: 3862920 - RNA, 19 nt, Shigella flexneri 2a str. 2457T
auaaucaacgcaccgacaa

SEQ ID NO: 3862921 - RNA, 15 nt, Shigella flexneri 2a str. 2457T
auaaucaauaaaaau

SEQ ID NO: 3862922 - RNA, 16 nt, Shigella flexneri 2a str. 2457T
auaaucaauaaaaaua

SEQ ID NO: 3862923 - RNA, 14 nt, Shigella flexneri 2a str. 2457T
auaaucacaauggu

SEQ ID NO: 3862924 - RNA, 15 nt, Shigella flexneri 2a str. 2457T
auaaucacaaugguc

SEQ ID NO: 3862925 - RNA, 20 nt, Shigella flexneri 2a str. 2457T
auaaucacaauggucaacau

SEQ ID NO: 3862926 - RNA, 14 nt, Shigella flexneri 2a str. 2457T
auaaucacauaauc

SEQ ID NO: 3862927 - RNA, 14 nt, Shigella flexneri 2a str. 2457T
auaaucaccacaca

SEQ ID NO: 3862928 - RNA, 16 nt, Shigella flexneri 2a str. 2457T
auaaucaccaucagca

SEQ ID NO: 3862929 - RNA, 15 nt, Shigella flexneri 2a str. 2457T
auaaucagacgacga

SEQ ID NO: 3862930 - RNA, 19 nt, Shigella flexneri 2a str. 2457T
auaaucagacgacgauuaa

SEQ ID NO: 3862931 - RNA, 23 nt, Shigella flexneri 2a str. 2457T
auaaucagauugugguugcgcag

SEQ ID NO: 3862932 - RNA, 13 nt, Shigella flexneri 2a str. 2457T
auaaucagugccg

SEQ ID NO: 3862933 - RNA, 13 nt, Shigella flexneri 2a str. 2457T
auaaucaucccac

SEQ ID NO: 3862934 - RNA, 22 nt, Shigella flexneri 2a str. 2457T
auaauccaguacgcguacacuu

SEQ ID NO: 3862935 - RNA, 17 nt, Shigella flexneri 2a str. 2457T
auaauccaucacuucau

SEQ ID NO: 3862936 - RNA, 19 nt, Shigella flexneri 2a str. 2457T
auaauccaucacuucauca

SEQ ID NO: 3862937 - RNA, 19 nt, Shigella flexneri 2a str. 2457T
auaaucccgcgcaacaaau

SEQ ID NO: 3862938 - RNA, 21 nt, Shigella flexneri 2a str. 2457T
auaaucccgcgcaacaaauaa

SEQ ID NO: 3862939 - RNA, 15 nt, Shigella flexneri 2a str. 2457T
auaaucccggcacca

SEQ ID NO: 3862940 - RNA, 16 nt, Shigella flexneri 2a str. 2457T
auaaucccggcaccaa

SEQ ID NO: 3862941 - RNA, 14 nt, Shigella flexneri 2a str. 2457T
auaaucgaaaacau

SEQ ID NO: 3862942 - RNA, 20 nt, Shigella flexneri 2a str. 2457T
auaaucgaaaacaucauggu

SEQ ID NO: 3862943 - RNA, 16 nt, Shigella flexneri 2a str. 2457T
auaaucgaucgcguaa

SEQ ID NO: 3862944 - RNA, 21 nt, Shigella flexneri 2a str. 2457T
auaaucgaucgcguaauaaaa

SEQ ID NO: 3862945 - RNA, 16 nt, Shigella flexneri 2a str. 2457T
auaaucgcaauuaccc

SEQ ID NO: 3862946 - RNA, 19 nt, Shigella flexneri 2a str. 2457T
auaaucgcgaauagcuuca

SEQ ID NO: 3862947 - RNA, 20 nt, Shigella flexneri 2a str. 2457T
auaaucgcgaauagcuucaa

SEQ ID NO: 3862948 - RNA, 18 nt, Shigella flexneri 2a str. 2457T
auaaucgggaauacagaa

SEQ ID NO: 3862949 - RNA, 16 nt, Shigella flexneri 2a str. 2457T
auaaucguaaucagca

SEQ ID NO: 3862950 - RNA, 23 nt, Shigella flexneri 2a str. 2457T
auaaucuauugauuuaacagcaa

SEQ ID NO: 3862951 - RNA, 19 nt, Shigella flexneri 2a str. 2457T
auaaucucccguuccuggu

SEQ ID NO: 3862952 - RNA, 15 nt, Shigella flexneri 2a str. 2457T
auaaucucuacacca

SEQ ID NO: 3862953 - RNA, 20 nt, Shigella flexneri 2a str. 2457T
auaaucucuacaccauuacc

SEQ ID NO: 3862954 - RNA, 14 nt, Shigella flexneri 2a str. 2457T
auaaugaaggauga

SEQ ID NO: 3862955 - RNA, 20 nt, Shigella flexneri 2a str. 2457T
auaaugagcaccgcaccuaa

SEQ ID NO: 3862956 - RNA, 17 nt, Shigella flexneri 2a str. 2457T
auaaugagcagaaaaac

SEQ ID NO: 3862957 - RNA, 21 nt, Shigella flexneri 2a str. 2457T
auacgccggucacgcccggaa

SEQ ID NO: 3862958 - RNA, 14 nt, Shigella flexneri 2a str. 2457T
auacgccucacagg

SEQ ID NO: 3862959 - RNA, 21 nt, Shigella flexneri 2a str. 2457T
auacgcgccacaucagacuca

SEQ ID NO: 3862960 - RNA, 14 nt, Shigella flexneri 2a str. 2457T
auacgcgcuaauca

SEQ ID NO: 3862961 - RNA, 15 nt, Shigella flexneri 2a str. 2457T
auacgcucgaacagc

SEQ ID NO: 3862962 - RNA, 14 nt, Shigella flexneri 2a str. 2457T
auacgcugaaaguu

SEQ ID NO: 3862963 - RNA, 14 nt, Shigella flexneri 2a str. 2457T
auacgcuggcugaa

SEQ ID NO: 3862964 - RNA, 16 nt, Shigella flexneri 2a str. 2457T
auacggaauaucgcug

SEQ ID NO: 3862965 - RNA, 19 nt, Shigella flexneri 2a str. 2457T
auacggacaguauaacgaa

SEQ ID NO: 3862966 - RNA, 20 nt, Shigella flexneri 2a str. 2457T
auacgggcuuuuuaauuccu

SEQ ID NO: 3862967 - RNA, 18 nt, Shigella flexneri 2a str. 2457T
auacggugucacgguguc

SEQ ID NO: 3862968 - RNA, 18 nt, Shigella flexneri 2a str. 2457T
auacguaaaaucgauaac

SEQ ID NO: 3862969 - RNA, 15 nt, Shigella flexneri 2a str. 2457T
auacguacaaacgcu

SEQ ID NO: 3862970 - RNA, 16 nt, Shigella flexneri 2a str. 2457T
auacguaggccugaua

SEQ ID NO: 3862971 - RNA, 14 nt, Shigella flexneri 2a str. 2457T
auacguuucaccag

SEQ ID NO: 3862972 - RNA, 13 nt, Shigella flexneri 2a str. 2457T
auacguuugccag

SEQ ID NO: 3862973 - RNA, 20 nt, Shigella flexneri 2a str. 2457T
auacguuuggucagaucagc

SEQ ID NO: 3862974 - RNA, 16 nt, Shigella flexneri 2a str. 2457T
auacucaagcagccag

SEQ ID NO: 3862975 - RNA, 17 nt, Shigella flexneri 2a str. 2457T
auacucaagcagccagg

SEQ ID NO: 3862976 - RNA, 17 nt, Shigella flexneri 2a str. 2457T
auacucagcgccugcug

SEQ ID NO: 3862977 - RNA, 18 nt, Shigella flexneri 2a str. 2457T
auacuccccuuucuuauu

SEQ ID NO: 3862978 - RNA, 19 nt, Shigella flexneri 2a str. 2457T
auacucuuugacaacauca

SEQ ID NO: 3862979 - RNA, 17 nt, Shigella flexneri 2a str. 2457T
auacucuuugguauuca

SEQ ID NO: 3862980 - RNA, 21 nt, Shigella flexneri 2a str. 2457T
auacucuuugguauucaaccg

SEQ ID NO: 3862981 - RNA, 16 nt, Shigella flexneri 2a str. 2457T
auacugaacaacuuaa

SEQ ID NO: 3862982 - RNA, 14 nt, Shigella flexneri 2a str. 2457T
auacugacaucagc

SEQ ID NO: 3862983 - RNA, 14 nt, Shigella flexneri 2a str. 2457T
auacugaucaucau

SEQ ID NO: 3862984 - RNA, 20 nt, Shigella flexneri 2a str. 2457T
auacugaucgucaucaaacg

SEQ ID NO: 3862985 - RNA, 22 nt, Shigella flexneri 2a str. 2457T
auacugaucgucaucaaacggc

SEQ ID NO: 3862986 - RNA, 22 nt, Shigella flexneri 2a str. 2457T
auacugccgauuacguaauuca

SEQ ID NO: 3862987 - RNA, 13 nt, Shigella flexneri 2a str. 2457T
auacugcucagac

SEQ ID NO: 3862988 - RNA, 22 nt, Shigella flexneri 2a str. 2457T
auacuggauagauauucuccag

SEQ ID NO: 3862989 - RNA, 23 nt, Shigella flexneri 2a str. 2457T
auacuggauagauauucuccagc

SEQ ID NO: 3862990 - RNA, 18 nt, Shigella flexneri 2a str. 2457T
auacuggcuaagaagccu

SEQ ID NO: 3862991 - RNA, 13 nt, Shigella flexneri 2a str. 2457T
auacugguuucug

SEQ ID NO: 3862992 - RNA, 23 nt, Shigella flexneri 2a str. 2457T
auacuguuuaccggugccagcaa

SEQ ID NO: 3862993 - RNA, 22 nt, Shigella flexneri 2a str. 2457T
auacuguuuaucuucccagcgc

SEQ ID NO: 3862994 - RNA, 21 nt, Shigella flexneri 2a str. 2457T
auacuuaaccccagaccaauc

SEQ ID NO: 3862995 - RNA, 13 nt, Shigella flexneri 2a str. 2457T
auacuuauuauga

SEQ ID NO: 3862996 - RNA, 18 nt, Shigella flexneri 2a str. 2457T
auacuuauuaugaaugau

SEQ ID NO: 3862997 - RNA, 22 nt, Shigella flexneri 2a str. 2457T
auacuucauaacguuuuuucgu

SEQ ID NO: 3862998 - RNA, 15 nt, Shigella flexneri 2a str. 2457T
auacuuucacaaaaa

SEQ ID NO: 3862999 - RNA, 23 nt, Shigella flexneri 2a str. 2457T
auacuuucaucaaacgaccaauc

SEQ ID NO: 3863000 - RNA, 13 nt, Shigella flexneri 2a str. 2457T
auacuuuucagga

SEQ ID NO: 3863001 - RNA, 21 nt, Shigella flexneri 2a str. 2457T
auacuuuuucgccaugaagac

SEQ ID NO: 3863002 - RNA, 17 nt, Shigella flexneri 2a str. 2457T
auagaaagugacagccc

SEQ ID NO: 3863003 - RNA, 18 nt, Shigella flexneri 2a str. 2457T
auagaacaguuacgcaga

SEQ ID NO: 3863004 - RNA, 22 nt, Shigella flexneri 2a str. 2457T
auagaaccuuccauguugguau

SEQ ID NO: 3863005 - RNA, 13 nt, Shigella flexneri 2a str. 2457T
auagaacggcaga

SEQ ID NO: 3863006 - RNA, 20 nt, Shigella flexneri 2a str. 2457T
auagaauggcaucagaagga

SEQ ID NO: 3863007 - RNA, 13 nt, Shigella flexneri 2a str. 2457T
auagaauggcguu

SEQ ID NO: 3863008 - RNA, 19 nt, Shigella flexneri 2a str. 2457T
auagaauggcguugggugc

SEQ ID NO: 3863009 - RNA, 12 nt, Shigella flexneri 2a str. 2457T
auagaccauugc

SEQ ID NO: 3863010 - RNA, 13 nt, Shigella flexneri 2a str. 2457T
auagacuucccuc

SEQ ID NO: 3863011 - RNA, 18 nt, Shigella flexneri 2a str. 2457T
auagagaaaguaaaccac

SEQ ID NO: 3863012 - RNA, 16 nt, Shigella flexneri 2a str. 2457T
auagagcgccugcaga

SEQ ID NO: 3863013 - RNA, 20 nt, Shigella flexneri 2a str. 2457T
auagagcgcggcgcaggcaa

SEQ ID NO: 3863014 - RNA, 17 nt, Shigella flexneri 2a str. 2457T
auagauaucaugcucug

SEQ ID NO: 3863015 - RNA, 20 nt, Shigella flexneri 2a str. 2457T
auagaucagacgacaaucaa

SEQ ID NO: 3863016 - RNA, 12 nt, Shigella flexneri 2a str. 2457T
auagauuauuug

SEQ ID NO: 3863017 - RNA, 19 nt, Shigella flexneri 2a str. 2457T
auagcaaaguaauaaugau

SEQ ID NO: 3863018 - RNA, 21 nt, Shigella flexneri 2a str. 2457T
auagcaaucuguaacaaggug

SEQ ID NO: 3863019 - RNA, 15 nt, Shigella flexneri 2a str. 2457T
auagcacacuuucgc

SEQ ID NO: 3863020 - RNA, 20 nt, Shigella flexneri 2a str. 2457T
auagcacauaaaauggccgu

SEQ ID NO: 3863021 - RNA, 17 nt, Shigella flexneri 2a str. 2457T
auagcacgacguuucuu

SEQ ID NO: 3863022 - RNA, 21 nt, Shigella flexneri 2a str. 2457T
auagcagcacaccacaucgcc

SEQ ID NO: 3863023 - RNA, 21 nt, Shigella flexneri 2a str. 2457T
auagcaguaauugcagcagcu

SEQ ID NO: 3863024 - RNA, 18 nt, Shigella flexneri 2a str. 2457T
auagcauaauauaacagc

SEQ ID NO: 3863025 - RNA, 19 nt, Shigella flexneri 2a str. 2457T
auagcauuggagacugaug

SEQ ID NO: 3863026 - RNA, 15 nt, Shigella flexneri 2a str. 2457T
auagccaaagcacca

SEQ ID NO: 3863027 - RNA, 18 nt, Shigella flexneri 2a str. 2457T
auagccagccucauccau

SEQ ID NO: 3863028 - RNA, 21 nt, Shigella flexneri 2a str. 2457T
auagccagccucauccauacg

SEQ ID NO: 3863029 - RNA, 15 nt, Shigella flexneri 2a str. 2457T
auagcccaugcaucg

SEQ ID NO: 3863030 - RNA, 16 nt, Shigella flexneri 2a str. 2457T
auagccccagcgcaga

SEQ ID NO: 3863031 - RNA, 23 nt, Shigella flexneri 2a str. 2457T
auagccgcccccgacuccagcag

SEQ ID NO: 3863032 - RNA, 17 nt, Shigella flexneri 2a str. 2457T
auagcgaaguagacagc

SEQ ID NO: 3863033 - RNA, 18 nt, Shigella flexneri 2a str. 2457T
auagcgacaggcuuucuu

SEQ ID NO: 3863034 - RNA, 14 nt, Shigella flexneri 2a str. 2457T
auagcgauaagaac

SEQ ID NO: 3863035 - RNA, 15 nt, Shigella flexneri 2a str. 2457T
auagcgccugcugcu

SEQ ID NO: 3863036 - RNA, 15 nt, Shigella flexneri 2a str. 2457T
auagcggcugacggu

SEQ ID NO: 3863037 - RNA, 16 nt, Shigella flexneri 2a str. 2457T
auagcgggaaauacug

SEQ ID NO: 3863038 - RNA, 21 nt, Shigella flexneri 2a str. 2457T
auagcgguaagcaugaauauc

SEQ ID NO: 3863039 - RNA, 12 nt, Shigella flexneri 2a str. 2457T
auagcgucaaga

SEQ ID NO: 3863040 - RNA, 15 nt, Shigella flexneri 2a str. 2457T
auagcgucauuucua

SEQ ID NO: 3863041 - RNA, 14 nt, Shigella flexneri 2a str. 2457T
auagcuaaucaucu

SEQ ID NO: 3863042 - RNA, 23 nt, Shigella flexneri 2a str. 2457T
auagcuaaucaucuguugugcca

SEQ ID NO: 3863043 - RNA, 12 nt, Shigella flexneri 2a str. 2457T
auagcuaauccc

SEQ ID NO: 3863044 - RNA, 18 nt, Shigella flexneri 2a str. 2457T
auagcugcgacaucauuu

SEQ ID NO: 3863045 - RNA, 13 nt, Shigella flexneri 2a str. 2457T
auagcuucaaaua

SEQ ID NO: 3863046 - RNA, 15 nt, Shigella flexneri 2a str. 2457T
auaggaauccggguc

SEQ ID NO: 3863047 - RNA, 18 nt, Shigella flexneri 2a str. 2457T
auaggcaaaaaaaaugcc

SEQ ID NO: 3863048 - RNA, 21 nt, Shigella flexneri 2a str. 2457T
auaggcaaaaaaaaugcccgc

SEQ ID NO: 3863049 - RNA, 20 nt, Shigella flexneri 2a str. 2457T
auaggcaggcaucaucagau

SEQ ID NO: 3863050 - RNA, 21 nt, Shigella flexneri 2a str. 2457T
auaggcaggcaucaucagauu

SEQ ID NO: 3863051 - RNA, 19 nt, Shigella flexneri 2a str. 2457T
auaggcuuccaccguuucu

SEQ ID NO: 3863052 - RNA, 13 nt, Shigella flexneri 2a str. 2457T
auagggacacauu

SEQ ID NO: 3863053 - RNA, 19 nt, Shigella flexneri 2a str. 2457T
auagguaaacaucacauau

SEQ ID NO: 3863054 - RNA, 21 nt, Shigella flexneri 2a str. 2457T
auaugcgccgacggcgcuacc

SEQ ID NO: 3863055 - RNA, 22 nt, Shigella flexneri 2a str. 2457T
auaugcgggcguuuugcuuuuu

SEQ ID NO: 3863056 - RNA, 22 nt, Shigella flexneri 2a str. 2457T
auaugcggugccauuaaaccaa

SEQ ID NO: 3863057 - RNA, 14 nt, Shigella flexneri 2a str. 2457T
auaugcuuaauguu

SEQ ID NO: 3863058 - RNA, 21 nt, Shigella flexneri 2a str. 2457T
auauggaaaaauauucaccaa

SEQ ID NO: 3863059 - RNA, 22 nt, Shigella flexneri 2a str. 2457T
auauggaacggaugcagcauca

SEQ ID NO: 3863060 - RNA, 18 nt, Shigella flexneri 2a str. 2457T
auauggaagaaacgcuua

SEQ ID NO: 3863061 - RNA, 16 nt, Shigella flexneri 2a str. 2457T
auauggcgcugcggcg

SEQ ID NO: 3863062 - RNA, 15 nt, Shigella flexneri 2a str. 2457T
auauggcggcggcuu

SEQ ID NO: 3863063 - RNA, 16 nt, Shigella flexneri 2a str. 2457T
auauggggauccccau

SEQ ID NO: 3863064 - RNA, 13 nt, Shigella flexneri 2a str. 2457T
auaugggugcaau

SEQ ID NO: 3863065 - RNA, 14 nt, Shigella flexneri 2a str. 2457T
auauggugaaagua

SEQ ID NO: 3863066 - RNA, 20 nt, Shigella flexneri 2a str. 2457T
auauggugagcgauauuuau

SEQ ID NO: 3863067 - RNA, 15 nt, Shigella flexneri 2a str. 2457T
auaugucguuauaua

SEQ ID NO: 3863068 - RNA, 21 nt, Shigella flexneri 2a str. 2457T
auaugucuuuuuuccagcaca

SEQ ID NO: 3863069 - RNA, 14 nt, Shigella flexneri 2a str. 2457T
auaugugaaauuua

SEQ ID NO: 3863070 - RNA, 15 nt, Shigella flexneri 2a str. 2457T
auaugugaaauuuau

SEQ ID NO: 3863071 - RNA, 18 nt, Shigella flexneri 2a str. 2457T
auaugugaucgaauauau

SEQ ID NO: 3863072 - RNA, 16 nt, Shigella flexneri 2a str. 2457T
auauguucccgcgccu

SEQ ID NO: 3863073 - RNA, 13 nt, Shigella flexneri 2a str. 2457T
auauguuuuaaag

SEQ ID NO: 3863074 - RNA, 17 nt, Shigella flexneri 2a str. 2457T
auauguuuuugcaguag

SEQ ID NO: 3863075 - RNA, 16 nt, Shigella flexneri 2a str. 2457T
auauuaaauuuuuuca

SEQ ID NO: 3863076 - RNA, 12 nt, Shigella flexneri 2a str. 2457T
auauuaauacaa

SEQ ID NO: 3863077 - RNA, 16 nt, Shigella flexneri 2a str. 2457T
auauuacguuccuuua

SEQ ID NO: 3863078 - RNA, 20 nt, Shigella flexneri 2a str. 2457T
auauuauccccugcgauggu

SEQ ID NO: 3863079 - RNA, 15 nt, Shigella flexneri 2a str. 2457T
auauuauugaaauca

SEQ ID NO: 3863080 - RNA, 24 nt, Shigella flexneri 2a str. 2457T
auauuauuggcaucguauuucaga

SEQ ID NO: 3863081 - RNA, 11 nt, Shigella flexneri 2a str. 2457T
auauuccccag

SEQ ID NO: 3863082 - RNA, 15 nt, Shigella flexneri 2a str. 2457T
auauuccccagacga

SEQ ID NO: 3863083 - RNA, 18 nt, Shigella flexneri 2a str. 2457T
auauuccgcaccugccag

SEQ ID NO: 3863084 - RNA, 16 nt, Shigella flexneri 2a str. 2457T
auauuccugacccagc

SEQ ID NO: 3863085 - RNA, 11 nt, Shigella flexneri 2a str. 2457T
auauuccugca

SEQ ID NO: 3863086 - RNA, 20 nt, Shigella flexneri 2a str. 2457T
auauucgacaccaucuuccu

SEQ ID NO: 3863087 - RNA, 21 nt, Shigella flexneri 2a str. 2457T
auauucgacaccaucuuccuc

SEQ ID NO: 3863088 - RNA, 23 nt, Shigella flexneri 2a str. 2457T
auauucgacaccaucuuccucac

SEQ ID NO: 3863089 - RNA, 16 nt, Shigella flexneri 2a str. 2457T
auauucuccagcuuca

SEQ ID NO: 3863090 - RNA, 14 nt, Shigella flexneri 2a str. 2457T
auauucuucaguau

SEQ ID NO: 3863091 - RNA, 18 nt, Shigella flexneri 2a str. 2457T
auauugagccaacguuuc

SEQ ID NO: 3863092 - RNA, 19 nt, Shigella flexneri 2a str. 2457T
auauugcacaguauagcau

SEQ ID NO: 3863093 - RNA, 22 nt, Shigella flexneri 2a str. 2457T
auauugcacaguauagcaucau

SEQ ID NO: 3863094 - RNA, 21 nt, Shigella flexneri 2a str. 2457T
auauugccccacaccgcgacg

SEQ ID NO: 3863095 - RNA, 21 nt, Shigella flexneri 2a str. 2457T
auauugcccgugacucccacu

SEQ ID NO: 3863096 - RNA, 17 nt, Shigella flexneri 2a str. 2457T
auauugccguccggcau

SEQ ID NO: 3863097 - RNA, 14 nt, Shigella flexneri 2a str. 2457T
auauugcuguacuu

SEQ ID NO: 3863098 - RNA, 21 nt, Shigella flexneri 2a str. 2457T
auauuggagaguugcaccagc

SEQ ID NO: 3863099 - RNA, 16 nt, Shigella flexneri 2a str. 2457T
auauugguguugugaa

SEQ ID NO: 3863100 - RNA, 18 nt, Shigella flexneri 2a str. 2457T
auauugguguugugaagu

SEQ ID NO: 3863101 - RNA, 12 nt, Shigella flexneri 2a str. 2457T
auauuguuuuaa

SEQ ID NO: 3863102 - RNA, 21 nt, Shigella flexneri 2a str. 2457T
auauuuacaaaucuuuauaau

SEQ ID NO: 3863103 - RNA, 22 nt, Shigella flexneri 2a str. 2457T
auauuuauaggguaaauuaccu

SEQ ID NO: 3863104 - RNA, 14 nt, Shigella flexneri 2a str. 2457T
auauuuauuuccuu

SEQ ID NO: 3863105 - RNA, 13 nt, Shigella flexneri 2a str. 2457T
auauuucuauauc

SEQ ID NO: 3863106 - RNA, 15 nt, Shigella flexneri 2a str. 2457T
auauuucuauauccu

SEQ ID NO: 3863107 - RNA, 15 nt, Shigella flexneri 2a str. 2457T
auauuuuaaucagcg

SEQ ID NO: 3863108 - RNA, 12 nt, Shigella flexneri 2a str. 2457T
auauuuuaccgu

SEQ ID NO: 3863109 - RNA, 17 nt, Shigella flexneri 2a str. 2457T
auauuuucugaaaauca

SEQ ID NO: 3863110 - RNA, 15 nt, Shigella flexneri 2a str. 2457T
auauuuuuaaauaua

SEQ ID NO: 3863111 - RNA, 11 nt, Shigella flexneri 2a str. 2457T
auauuuuuccg

SEQ ID NO: 3863112 - RNA, 13 nt, Shigella flexneri 2a str. 2457T
auauuuuuuuagu

SEQ ID NO: 3863113 - RNA, 20 nt, Shigella flexneri 2a str. 2457T
auauuuuuuuccuaaacccu

SEQ ID NO: 3863114 - RNA, 19 nt, Shigella flexneri 2a str. 2457T
aucaaaaaaggcugacaaa

SEQ ID NO: 3863115 - RNA, 21 nt, Shigella flexneri 2a str. 2457T
aucaaaaaaggcugacaaauc

SEQ ID NO: 3863116 - RNA, 14 nt, Shigella flexneri 2a str. 2457T
aucaaaaauggcuu

SEQ ID NO: 3863117 - RNA, 13 nt, Shigella flexneri 2a str. 2457T
aucaaaacgcugg

SEQ ID NO: 3863118 - RNA, 22 nt, Shigella flexneri 2a str. 2457T
aucaaacagaauauugugcuca

SEQ ID NO: 3863119 - RNA, 15 nt, Shigella flexneri 2a str. 2457T
aucaaaccacuuaau

SEQ ID NO: 3863120 - RNA, 22 nt, Shigella flexneri 2a str. 2457T
aucaaacgccugaccguugauu

SEQ ID NO: 3863121 - RNA, 19 nt, Shigella flexneri 2a str. 2457T
aucaaacgugacauucuga

SEQ ID NO: 3863122 - RNA, 20 nt, Shigella flexneri 2a str. 2457T
aucaaacgugacauucugac

SEQ ID NO: 3863123 - RNA, 22 nt, Shigella flexneri 2a str. 2457T
aucaaagaugaugucacagccg

SEQ ID NO: 3863124 - RNA, 15 nt, Shigella flexneri 2a str. 2457T
aucaaagguuuuuca

SEQ ID NO: 3863125 - RNA, 16 nt, Shigella flexneri 2a str. 2457T
aucaaaguuuuuauga

SEQ ID NO: 3863126 - RNA, 21 nt, Shigella flexneri 2a str. 2457T
aucaaauacuucaauauaugc

SEQ ID NO: 3863127 - RNA, 15 nt, Shigella flexneri 2a str. 2457T
aucaaaucaaugccu

SEQ ID NO: 3863128 - RNA, 13 nt, Shigella flexneri 2a str. 2457T
aucaaaucaccau

SEQ ID NO: 3863129 - RNA, 11 nt, Shigella flexneri 2a str. 2457T
aucaaaucucg

SEQ ID NO: 3863130 - RNA, 15 nt, Shigella flexneri 2a str. 2457T
aucaaaucucgccgu

SEQ ID NO: 3863131 - RNA, 18 nt, Shigella flexneri 2a str. 2457T
aucaaaugcguuaucggc

SEQ ID NO: 3863132 - RNA, 16 nt, Shigella flexneri 2a str. 2457T
aucaaauuauuaccau

SEQ ID NO: 3863133 - RNA, 14 nt, Shigella flexneri 2a str. 2457T
aucaaauucaagau

SEQ ID NO: 3863134 - RNA, 14 nt, Shigella flexneri 2a str. 2457T
aucaacaaagugca

SEQ ID NO: 3863135 - RNA, 23 nt, Shigella flexneri 2a str. 2457T
aucaacaauugcgggccaaagac

SEQ ID NO: 3863136 - RNA, 13 nt, Shigella flexneri 2a str. 2457T
aucaacacaucca

SEQ ID NO: 3863137 - RNA, 14 nt, Shigella flexneri 2a str. 2457T
aucaacacauccag

SEQ ID NO: 3863138 - RNA, 17 nt, Shigella flexneri 2a str. 2457T
aucaacaccacugccag

SEQ ID NO: 3863139 - RNA, 18 nt, Shigella flexneri 2a str. 2457T
aucaacaguuuguugcau

SEQ ID NO: 3863140 - RNA, 19 nt, Shigella flexneri 2a str. 2457T
aucaacaguuuguugcauu

SEQ ID NO: 3863141 - RNA, 17 nt, Shigella flexneri 2a str. 2457T
aucaacauauuccccug

SEQ ID NO: 3863142 - RNA, 17 nt, Shigella flexneri 2a str. 2457T
aucaacaugaaaauaac

SEQ ID NO: 3863143 - RNA, 20 nt, Shigella flexneri 2a str. 2457T
aucaacaugaaaauaaccau

SEQ ID NO: 3863144 - RNA, 18 nt, Shigella flexneri 2a str. 2457T
aucaacauguuccugcca

SEQ ID NO: 3863145 - RNA, 14 nt, Shigella flexneri 2a str. 2457T
aucaacauucagau

SEQ ID NO: 3863146 - RNA, 18 nt, Shigella flexneri 2a str. 2457T
aucaacauucagaucggu

SEQ ID NO: 3863147 - RNA, 21 nt, Shigella flexneri 2a str. 2457T
aucaaccgcacucuacuucuu

SEQ ID NO: 3863148 - RNA, 19 nt, Shigella flexneri 2a str. 2457T
aucaaccgcuacauacuua

SEQ ID NO: 3863149 - RNA, 21 nt, Shigella flexneri 2a str. 2457T
aucaaccgcuauaccgccgau

SEQ ID NO: 3863150 - RNA, 19 nt, Shigella flexneri 2a str. 2457T
aucaacgacaaaaauacca

SEQ ID NO: 3863151 - RNA, 23 nt, Shigella flexneri 2a str. 2457T
aucaacgagauaaaauuaacgac

SEQ ID NO: 3863152 - RNA, 17 nt, Shigella flexneri 2a str. 2457T
aucacgcgaccaucgcg

SEQ ID NO: 3863153 - RNA, 21 nt, Shigella flexneri 2a str. 2457T
aucacgcgguuacgcaccggu

SEQ ID NO: 3863154 - RNA, 18 nt, Shigella flexneri 2a str. 2457T
aucacgcuauacaaccac

SEQ ID NO: 3863155 - RNA, 14 nt, Shigella flexneri 2a str. 2457T
aucacgcugcugau

SEQ ID NO: 3863156 - RNA, 17 nt, Shigella flexneri 2a str. 2457T
aucacgcuuaucgcccu

SEQ ID NO: 3863157 - RNA, 13 nt, Shigella flexneri 2a str. 2457T
aucacgucgccuu

SEQ ID NO: 3863158 - RNA, 14 nt, Shigella flexneri 2a str. 2457T
aucacuaucgccau

SEQ ID NO: 3863159 - RNA, 13 nt, Shigella flexneri 2a str. 2457T
aucacucacccgc

SEQ ID NO: 3863160 - RNA, 17 nt, Shigella flexneri 2a str. 2457T
aucacuccauccagcaa

SEQ ID NO: 3863161 - RNA, 16 nt, Shigella flexneri 2a str. 2457T
aucacuccccgccguu

SEQ ID NO: 3863162 - RNA, 22 nt, Shigella flexneri 2a str. 2457T
aucacucccuuucugccacgcc

SEQ ID NO: 3863163 - RNA, 13 nt, Shigella flexneri 2a str. 2457T
aucacugacugcg

SEQ ID NO: 3863164 - RNA, 20 nt, Shigella flexneri 2a str. 2457T
aucacugaugugauggccgc

SEQ ID NO: 3863165 - RNA, 23 nt, Shigella flexneri 2a str. 2457T
aucacugccagaauagccgcagc

SEQ ID NO: 3863166 - RNA, 21 nt, Shigella flexneri 2a str. 2457T
aucacuguuugacaacucauc

SEQ ID NO: 3863167 - RNA, 13 nt, Shigella flexneri 2a str. 2457T
aucacuuaaccca

SEQ ID NO: 3863168 - RNA, 15 nt, Shigella flexneri 2a str. 2457T
aucacuuccagcagu

SEQ ID NO: 3863169 - RNA, 19 nt, Shigella flexneri 2a str. 2457T
aucacuuccagcaguucgc

SEQ ID NO: 3863170 - RNA, 12 nt, Shigella flexneri 2a str. 2457T
aucacuuucaaa

SEQ ID NO: 3863171 - RNA, 15 nt, Shigella flexneri 2a str. 2457T
aucacuuucaaaagc

SEQ ID NO: 3863172 - RNA, 13 nt, Shigella flexneri 2a str. 2457T
aucacuuucagac

SEQ ID NO: 3863173 - RNA, 17 nt, Shigella flexneri 2a str. 2457T
aucagaaacacacuuuc

SEQ ID NO: 3863174 - RNA, 14 nt, Shigella flexneri 2a str. 2457T
aucagaaaugccag

SEQ ID NO: 3863175 - RNA, 19 nt, Shigella flexneri 2a str. 2457T
aucagaaggagcuaauaau

SEQ ID NO: 3863176 - RNA, 13 nt, Shigella flexneri 2a str. 2457T
aucagaaggguug

SEQ ID NO: 3863177 - RNA, 17 nt, Shigella flexneri 2a str. 2457T
aucagaauugcgagccu

SEQ ID NO: 3863178 - RNA, 21 nt, Shigella flexneri 2a str. 2457T
aucagacaaaugucacugcuu

SEQ ID NO: 3863179 - RNA, 16 nt, Shigella flexneri 2a str. 2457T
aucagacaccagccag

SEQ ID NO: 3863180 - RNA, 21 nt, Shigella flexneri 2a str. 2457T
aucagacaccgauugccccug

SEQ ID NO: 3863181 - RNA, 18 nt, Shigella flexneri 2a str. 2457T
aucagaccuucgcuauca

SEQ ID NO: 3863182 - RNA, 18 nt, Shigella flexneri 2a str. 2457T
aucagacgacgauuaaca

SEQ ID NO: 3863183 - RNA, 23 nt, Shigella flexneri 2a str. 2457T
aucagagcuggaaguuacucaaa

SEQ ID NO: 3863184 - RNA, 16 nt, Shigella flexneri 2a str. 2457T
aucagaguugaaaaac

SEQ ID NO: 3863185 - RNA, 13 nt, Shigella flexneri 2a str. 2457T
aucagauaaaaua

SEQ ID NO: 3863186 - RNA, 23 nt, Shigella flexneri 2a str. 2457T
aucagauaauauuuaucuuccca

SEQ ID NO: 3863187 - RNA, 13 nt, Shigella flexneri 2a str. 2457T
aucagauccgcac

SEQ ID NO: 3863188 - RNA, 17 nt, Shigella flexneri 2a str. 2457T
aucagaucgacgccgau

SEQ ID NO: 3863189 - RNA, 18 nt, Shigella flexneri 2a str. 2457T
aucagaucguugaacccg

SEQ ID NO: 3863190 - RNA, 15 nt, Shigella flexneri 2a str. 2457T
aucagauucagcagc

SEQ ID NO: 3863191 - RNA, 20 nt, Shigella flexneri 2a str. 2457T
aucagauucgauagagaacg

SEQ ID NO: 3863192 - RNA, 16 nt, Shigella flexneri 2a str. 2457T
aucagcaaacuauccc

SEQ ID NO: 3863193 - RNA, 19 nt, Shigella flexneri 2a str. 2457T
aucagcaaacuaucccagc

SEQ ID NO: 3863194 - RNA, 20 nt, Shigella flexneri 2a str. 2457T
aucagcaaacuaucccagcc

SEQ ID NO: 3863195 - RNA, 19 nt, Shigella flexneri 2a str. 2457T
aucagcaaauccaucgccu

SEQ ID NO: 3863196 - RNA, 24 nt, Shigella flexneri 2a str. 2457T
aucagcaaauuuggcaucgaggau

SEQ ID NO: 3863197 - RNA, 17 nt, Shigella flexneri 2a str. 2457T
aucagcaacacgcugcu

SEQ ID NO: 3863198 - RNA, 17 nt, Shigella flexneri 2a str. 2457T
aucagcaauuucuccgc

SEQ ID NO: 3863199 - RNA, 18 nt, Shigella flexneri 2a str. 2457T
aucagcagauaucccgcc

SEQ ID NO: 3863200 - RNA, 15 nt, Shigella flexneri 2a str. 2457T
aucagcagcaacaaa

SEQ ID NO: 3863201 - RNA, 16 nt, Shigella flexneri 2a str. 2457T
aucagcagcggagaaa

SEQ ID NO: 3863202 - RNA, 19 nt, Shigella flexneri 2a str. 2457T
aucagcagcggagaaaugu

SEQ ID NO: 3863203 - RNA, 13 nt, Shigella flexneri 2a str. 2457T
aucagcaguucag

SEQ ID NO: 3863204 - RNA, 16 nt, Shigella flexneri 2a str. 2457T
aucagcauaaucacca

SEQ ID NO: 3863205 - RNA, 17 nt, Shigella flexneri 2a str. 2457T
aucagcauaaucaccag

SEQ ID NO: 3863206 - RNA, 15 nt, Shigella flexneri 2a str. 2457T
aucagcauccgcacg

SEQ ID NO: 3863207 - RNA, 19 nt, Shigella flexneri 2a str. 2457T
aucagcaucucauccauca

SEQ ID NO: 3863208 - RNA, 17 nt, Shigella flexneri 2a str. 2457T
aucagcaugacaaaaaa

SEQ ID NO: 3863209 - RNA, 15 nt, Shigella flexneri 2a str. 2457T
aucagcauucucauc

SEQ ID NO: 3863210 - RNA, 20 nt, Shigella flexneri 2a str. 2457T
aucagcauucucaucaccau

SEQ ID NO: 3863211 - RNA, 14 nt, Shigella flexneri 2a str. 2457T
aucagccacuuccu

SEQ ID NO: 3863212 - RNA, 22 nt, Shigella flexneri 2a str. 2457T
aucagccauuuugcacauucca

SEQ ID NO: 3863213 - RNA, 22 nt, Shigella flexneri 2a str. 2457T
aucagcccaaagcagaguugcu

SEQ ID NO: 3863214 - RNA, 16 nt, Shigella flexneri 2a str. 2457T
aucagccugcaaacgc

SEQ ID NO: 3863215 - RNA, 14 nt, Shigella flexneri 2a str. 2457T
aucagcgcaaagag

SEQ ID NO: 3863216 - RNA, 16 nt, Shigella flexneri 2a str. 2457T
aucagcggacgcugcu

SEQ ID NO: 3863217 - RNA, 22 nt, Shigella flexneri 2a str. 2457T
aucagcggugccgcgauaccac

SEQ ID NO: 3863218 - RNA, 23 nt, Shigella flexneri 2a str. 2457T
aucagcguaggacacagaauguu

SEQ ID NO: 3863219 - RNA, 15 nt, Shigella flexneri 2a str. 2457T
aucagcguccagccc

SEQ ID NO: 3863220 - RNA, 19 nt, Shigella flexneri 2a str. 2457T
aucagcguccagcccuccg

SEQ ID NO: 3863221 - RNA, 19 nt, Shigella flexneri 2a str. 2457T
aucagcgugaccaguugcu

SEQ ID NO: 3863222 - RNA, 15 nt, Shigella flexneri 2a str. 2457T
aucagcuccggcagc

SEQ ID NO: 3863223 - RNA, 19 nt, Shigella flexneri 2a str. 2457T
aucagcuccggcagcugcu

SEQ ID NO: 3863224 - RNA, 19 nt, Shigella flexneri 2a str. 2457T
aucagcugguuauuuucug

SEQ ID NO: 3863225 - RNA, 23 nt, Shigella flexneri 2a str. 2457T
aucagcuuuuccauaucaagcau

SEQ ID NO: 3863226 - RNA, 10 nt, Shigella flexneri 2a str. 2457T
aucaggaaac

SEQ ID NO: 3863227 - RNA, 13 nt, Shigella flexneri 2a str. 2457T
aucaggacgaaaa

SEQ ID NO: 3863228 - RNA, 15 nt, Shigella flexneri 2a str. 2457T
aucaggacgaaaaau

SEQ ID NO: 3863229 - RNA, 12 nt, Shigella flexneri 2a str. 2457T
aucaggcaaaaa

SEQ ID NO: 3863230 - RNA, 14 nt, Shigella flexneri 2a str. 2457T
aucaggcaaaaaaa

SEQ ID NO: 3863231 - RNA, 21 nt, Shigella flexneri 2a str. 2457T
aucaggcaaugcuuccugcuu

SEQ ID NO: 3863232 - RNA, 20 nt, Shigella flexneri 2a str. 2457T
aucaggcaauguugcguuug

SEQ ID NO: 3863233 - RNA, 22 nt, Shigella flexneri 2a str. 2457T
aucaggcagauacaaccaaucg

SEQ ID NO: 3863234 - RNA, 16 nt, Shigella flexneri 2a str. 2457T
aucaggcaucgugcac

SEQ ID NO: 3863235 - RNA, 21 nt, Shigella flexneri 2a str. 2457T
aucaggcaucugagcaugaug

SEQ ID NO: 3863236 - RNA, 15 nt, Shigella flexneri 2a str. 2457T
aucaggcauucuuuu

SEQ ID NO: 3863237 - RNA, 14 nt, Shigella flexneri 2a str. 2457T
aucaggccagccag

SEQ ID NO: 3863238 - RNA, 12 nt, Shigella flexneri 2a str. 2457T
aucaggccaggu

SEQ ID NO: 3863239 - RNA, 20 nt, Shigella flexneri 2a str. 2457T
aucaggccuacaaaaugugc

SEQ ID NO: 3863240 - RNA, 17 nt, Shigella flexneri 2a str. 2457T
aucaggccuacagcaua

SEQ ID NO: 3863241 - RNA, 15 nt, Shigella flexneri 2a str. 2457T
aucaggcguucgcgg

SEQ ID NO: 3863242 - RNA, 17 nt, Shigella flexneri 2a str. 2457T
aucaggcuaaagguauu

SEQ ID NO: 3863243 - RNA, 17 nt, Shigella flexneri 2a str. 2457T
aucaggcuaaucgccag

SEQ ID NO: 3863244 - RNA, 20 nt, Shigella flexneri 2a str. 2457T
aucaggcuaucuucgauaaa

SEQ ID NO: 3863245 - RNA, 21 nt, Shigella flexneri 2a str. 2457T
aucaggcugaaaaucuucucu

SEQ ID NO: 3863246 - RNA, 18 nt, Shigella flexneri 2a str. 2457T
aucaggcuguguuuaaga

SEQ ID NO: 3863247 - RNA, 23 nt, Shigella flexneri 2a str. 2457T
aucaggcuuuuuuauugccaucu

SEQ ID NO: 3863248 - RNA, 18 nt, Shigella flexneri 2a str. 2457T
aucagggagucuugcugg

SEQ ID NO: 3863249 - RNA, 15 nt, Shigella flexneri 2a str. 2457T
auccacagcaaugca

SEQ ID NO: 3863250 - RNA, 22 nt, Shigella flexneri 2a str. 2457T
auccacaggguguauucaugcc

SEQ ID NO: 3863251 - RNA, 13 nt, Shigella flexneri 2a str. 2457T
auccacccgcagc

SEQ ID NO: 3863252 - RNA, 16 nt, Shigella flexneri 2a str. 2457T
auccacccgcagccau

SEQ ID NO: 3863253 - RNA, 14 nt, Shigella flexneri 2a str. 2457T
auccaccgcguuca

SEQ ID NO: 3863254 - RNA, 19 nt, Shigella flexneri 2a str. 2457T
auccacgauacgcugcaca

SEQ ID NO: 3863255 - RNA, 18 nt, Shigella flexneri 2a str. 2457T
auccacgccuuuuuucac

SEQ ID NO: 3863256 - RNA, 22 nt, Shigella flexneri 2a str. 2457T
auccacguugugguaaagcggc

SEQ ID NO: 3863257 - RNA, 19 nt, Shigella flexneri 2a str. 2457T
auccacugucaaauccaga

SEQ ID NO: 3863258 - RNA, 23 nt, Shigella flexneri 2a str. 2457T
auccacuuuuggcccgacgauga

SEQ ID NO: 3863259 - RNA, 15 nt, Shigella flexneri 2a str. 2457T
auccagauagaacau

SEQ ID NO: 3863260 - RNA, 14 nt, Shigella flexneri 2a str. 2457T
auccagauggcuau

SEQ ID NO: 3863261 - RNA, 23 nt, Shigella flexneri 2a str. 2457T
auccagauggcuauaaucacuca

SEQ ID NO: 3863262 - RNA, 20 nt, Shigella flexneri 2a str. 2457T
auccagauuuauaaaagaaa

SEQ ID NO: 3863263 - RNA, 14 nt, Shigella flexneri 2a str. 2457T
auccagcaacaaca

SEQ ID NO: 3863264 - RNA, 15 nt, Shigella flexneri 2a str. 2457T
auccagcaacaacag

SEQ ID NO: 3863265 - RNA, 18 nt, Shigella flexneri 2a str. 2457T
auccagcaacaacagcgc

SEQ ID NO: 3863266 - RNA, 23 nt, Shigella flexneri 2a str. 2457T
auccagcacggugaagaagcgga

SEQ ID NO: 3863267 - RNA, 22 nt, Shigella flexneri 2a str. 2457T
auccagcagcggaucgaacucc

SEQ ID NO: 3863268 - RNA, 16 nt, Shigella flexneri 2a str. 2457T
auccagcagugacuca

SEQ ID NO: 3863269 - RNA, 19 nt, Shigella flexneri 2a str. 2457T
auccagcagugacucacga

SEQ ID NO: 3863270 - RNA, 15 nt, Shigella flexneri 2a str. 2457T
auccagcauaccuuc

SEQ ID NO: 3863271 - RNA, 14 nt, Shigella flexneri 2a str. 2457T
auccagccaaacau

SEQ ID NO: 3863272 - RNA, 14 nt, Shigella flexneri 2a str. 2457T
auccagccacggcu

SEQ ID NO: 3863273 - RNA, 18 nt, Shigella flexneri 2a str. 2457T
auccagccacggcuccag

SEQ ID NO: 3863274 - RNA, 15 nt, Shigella flexneri 2a str. 2457T
auccagcccugccag

SEQ ID NO: 3863275 - RNA, 20 nt, Shigella flexneri 2a str. 2457T
auccagcgacugacgugccu

SEQ ID NO: 3863276 - RNA, 21 nt, Shigella flexneri 2a str. 2457T
auccagcggaucaagaaaguu

SEQ ID NO: 3863277 - RNA, 18 nt, Shigella flexneri 2a str. 2457T
auccagcucuucuucacu

SEQ ID NO: 3863278 - RNA, 23 nt, Shigella flexneri 2a str. 2457T
auccagcucuuuuccagccauca

SEQ ID NO: 3863279 - RNA, 13 nt, Shigella flexneri 2a str. 2457T
auccaggaacucc

SEQ ID NO: 3863280 - RNA, 14 nt, Shigella flexneri 2a str. 2457T
auccaggaacucca

SEQ ID NO: 3863281 - RNA, 19 nt, Shigella flexneri 2a str. 2457T
auccagggaucaacauuca

SEQ ID NO: 3863282 - RNA, 15 nt, Shigella flexneri 2a str. 2457T
auccaggguuuuauu

SEQ ID NO: 3863283 - RNA, 21 nt, Shigella flexneri 2a str. 2457T
auccaggguuuuauuauucca

SEQ ID NO: 3863284 - RNA, 22 nt, Shigella flexneri 2a str. 2457T
auccaggguuuuauuauuccau

SEQ ID NO: 3863285 - RNA, 14 nt, Shigella flexneri 2a str. 2457T
auccagguacgcag

SEQ ID NO: 3863286 - RNA, 18 nt, Shigella flexneri 2a str. 2457T
auccagguuacgcaccag

SEQ ID NO: 3863287 - RNA, 14 nt, Shigella flexneri 2a str. 2457T
auccaguacaugaa

SEQ ID NO: 3863288 - RNA, 16 nt, Shigella flexneri 2a str. 2457T
auccagugauuccagu

SEQ ID NO: 3863289 - RNA, 20 nt, Shigella flexneri 2a str. 2457T
auccagugcguaucaauagc

SEQ ID NO: 3863290 - RNA, 17 nt, Shigella flexneri 2a str. 2457T
auccaguguaaaacagc

SEQ ID NO: 3863291 - RNA, 15 nt, Shigella flexneri 2a str. 2457T
auccaguuccuucaa

SEQ ID NO: 3863292 - RNA, 13 nt, Shigella flexneri 2a str. 2457T
auccaguuucugc

SEQ ID NO: 3863293 - RNA, 18 nt, Shigella flexneri 2a str. 2457T
auccauacccggcguuac

SEQ ID NO: 3863294 - RNA, 15 nt, Shigella flexneri 2a str. 2457T
auccauacucuuucc

SEQ ID NO: 3863295 - RNA, 22 nt, Shigella flexneri 2a str. 2457T
auccauaguguguuccucugcu

SEQ ID NO: 3863296 - RNA, 18 nt, Shigella flexneri 2a str. 2457T
auccauaucgauuucuac

SEQ ID NO: 3863297 - RNA, 19 nt, Shigella flexneri 2a str. 2457T
auccauaucgauuucuaca

SEQ ID NO: 3863298 - RNA, 14 nt, Shigella flexneri 2a str. 2457T
auccauaucgccau

SEQ ID NO: 3863299 - RNA, 23 nt, Shigella flexneri 2a str. 2457T
auccauauuuucagcagugggua

SEQ ID NO: 3863300 - RNA, 15 nt, Shigella flexneri 2a str. 2457T
auccaucaacgccag

SEQ ID NO: 3863301 - RNA, 18 nt, Shigella flexneri 2a str. 2457T
auccaucacuucaucauc

SEQ ID NO: 3863302 - RNA, 19 nt, Shigella flexneri 2a str. 2457T
auccaucagacuuugcgcc

SEQ ID NO: 3863303 - RNA, 21 nt, Shigella flexneri 2a str. 2457T
auccaucagacuuugcgccau

SEQ ID NO: 3863304 - RNA, 16 nt, Shigella flexneri 2a str. 2457T
auccaucgccagcuca

SEQ ID NO: 3863305 - RNA, 18 nt, Shigella flexneri 2a str. 2457T
auccaucgccagcucaaa

SEQ ID NO: 3863306 - RNA, 18 nt, Shigella flexneri 2a str. 2457T
auccaugacaucuccagc

SEQ ID NO: 3863307 - RNA, 20 nt, Shigella flexneri 2a str. 2457T
auccaugcgcauuaagccau

SEQ ID NO: 3863308 - RNA, 22 nt, Shigella flexneri 2a str. 2457T
auccaugcgcauuaagccauga

SEQ ID NO: 3863309 - RNA, 21 nt, Shigella flexneri 2a str. 2457T
auccauuccggccaucgccug

SEQ ID NO: 3863310 - RNA, 22 nt, Shigella flexneri 2a str. 2457T
auccauuccggccaucgccuga

SEQ ID NO: 3863311 - RNA, 13 nt, Shigella flexneri 2a str. 2457T
auccauuuucuau

SEQ ID NO: 3863312 - RNA, 11 nt, Shigella flexneri 2a str. 2457T
aucccaaagcu

SEQ ID NO: 3863313 - RNA, 16 nt, Shigella flexneri 2a str. 2457T
aucccaaccuaaaaag

SEQ ID NO: 3863314 - RNA, 16 nt, Shigella flexneri 2a str. 2457T
aucccacauccuacca

SEQ ID NO: 3863315 - RNA, 15 nt, Shigella flexneri 2a str. 2457T
aucccagaagaauau

SEQ ID NO: 3863316 - RNA, 21 nt, Shigella flexneri 2a str. 2457T
aucccagaagguuucgccgcu

SEQ ID NO: 3863317 - RNA, 21 nt, Shigella flexneri 2a str. 2457T
aucccagcugccgccaggcuu

SEQ ID NO: 3863318 - RNA, 16 nt, Shigella flexneri 2a str. 2457T
aucccaggccaaaucc

SEQ ID NO: 3863319 - RNA, 16 nt, Shigella flexneri 2a str. 2457T
aucccagugccugcau

SEQ ID NO: 3863320 - RNA, 16 nt, Shigella flexneri 2a str. 2457T
aucccagugcggcauc

SEQ ID NO: 3863321 - RNA, 19 nt, Shigella flexneri 2a str. 2457T
aucccaguucgauuuccca

SEQ ID NO: 3863322 - RNA, 17 nt, Shigella flexneri 2a str. 2457T
aucccaucgccgguaau

SEQ ID NO: 3863323 - RNA, 19 nt, Shigella flexneri 2a str. 2457T
auccccaccaaaacagcga

SEQ ID NO: 3863324 - RNA, 20 nt, Shigella flexneri 2a str. 2457T
auccccaccaaaacagcgac

SEQ ID NO: 3863325 - RNA, 13 nt, Shigella flexneri 2a str. 2457T
auccccagccuaa

SEQ ID NO: 3863326 - RNA, 18 nt, Shigella flexneri 2a str. 2457T
auccccagccuaagccau

SEQ ID NO: 3863327 - RNA, 17 nt, Shigella flexneri 2a str. 2457T
auccccauaucccggaa

SEQ ID NO: 3863328 - RNA, 17 nt, Shigella flexneri 2a str. 2457T
aucccccacuuuuaaau

SEQ ID NO: 3863329 - RNA, 15 nt, Shigella flexneri 2a str. 2457T
auccccgccagcacg

SEQ ID NO: 3863330 - RNA, 21 nt, Shigella flexneri 2a str. 2457T
auccccgcucucccaguaacc

SEQ ID NO: 3863331 - RNA, 15 nt, Shigella flexneri 2a str. 2457T
auccccgcuuccugc

SEQ ID NO: 3863332 - RNA, 14 nt, Shigella flexneri 2a str. 2457T
auccccgggcggcc

SEQ ID NO: 3863333 - RNA, 14 nt, Shigella flexneri 2a str. 2457T
auccccguaucuuc

SEQ ID NO: 3863334 - RNA, 17 nt, Shigella flexneri 2a str. 2457T
auccccucuucagccgc

SEQ ID NO: 3863335 - RNA, 12 nt, Shigella flexneri 2a str. 2457T
auccccugcgcg

SEQ ID NO: 3863336 - RNA, 15 nt, Shigella flexneri 2a str. 2457T
aucccgauuaaucag

SEQ ID NO: 3863337 - RNA, 14 nt, Shigella flexneri 2a str. 2457T
aucccgccagcacc

SEQ ID NO: 3863338 - RNA, 14 nt, Shigella flexneri 2a str. 2457T
aucccgccgcuuca

SEQ ID NO: 3863339 - RNA, 17 nt, Shigella flexneri 2a str. 2457T
aucccggauaucaccac

SEQ ID NO: 3863340 - RNA, 14 nt, Shigella flexneri 2a str. 2457T
aucccggcacccgc

SEQ ID NO: 3863341 - RNA, 14 nt, Shigella flexneri 2a str. 2457T
aucccucucaucca

SEQ ID NO: 3863342 - RNA, 11 nt, Shigella flexneri 2a str. 2457T
aucccucuuuc

SEQ ID NO: 3863343 - RNA, 15 nt, Shigella flexneri 2a str. 2457T
aucccugcuguccug

SEQ ID NO: 3863344 - RNA, 14 nt, Shigella flexneri 2a str. 2457T
aucccuuagcuaau

SEQ ID NO: 3863345 - RNA, 15 nt, Shigella flexneri 2a str. 2457T
auccgaagaaccaca

SEQ ID NO: 3863346 - RNA, 20 nt, Shigella flexneri 2a str. 2457T
auccgacauuucugcugccu

SEQ ID NO: 3863347 - RNA, 23 nt, Shigella flexneri 2a str. 2457T
aucgagagaauggggucagcagg

SEQ ID NO: 3863348 - RNA, 16 nt, Shigella flexneri 2a str. 2457T
aucgagccgauuaaaa

SEQ ID NO: 3863349 - RNA, 13 nt, Shigella flexneri 2a str. 2457T
aucgagcgccguu

SEQ ID NO: 3863350 - RNA, 19 nt, Shigella flexneri 2a str. 2457T
aucgaggccauauuucaca

SEQ ID NO: 3863351 - RNA, 15 nt, Shigella flexneri 2a str. 2457T
aucgauaaucaguaa

SEQ ID NO: 3863352 - RNA, 20 nt, Shigella flexneri 2a str. 2457T
aucgaugacgcgguagcacg

SEQ ID NO: 3863353 - RNA, 17 nt, Shigella flexneri 2a str. 2457T
aucgauugcacauuccc

SEQ ID NO: 3863354 - RNA, 17 nt, Shigella flexneri 2a str. 2457T
aucgauuuucaaaauau

SEQ ID NO: 3863355 - RNA, 18 nt, Shigella flexneri 2a str. 2457T
aucgcaaauugacuacac

SEQ ID NO: 3863356 - RNA, 21 nt, Shigella flexneri 2a str. 2457T
aucgcaaauugacuacaccau

SEQ ID NO: 3863357 - RNA, 14 nt, Shigella flexneri 2a str. 2457T
aucgcacagaugcg

SEQ ID NO: 3863358 - RNA, 16 nt, Shigella flexneri 2a str. 2457T
aucgcacagaugcgac

SEQ ID NO: 3863359 - RNA, 16 nt, Shigella flexneri 2a str. 2457T
aucgcacccgccauca

SEQ ID NO: 3863360 - RNA, 14 nt, Shigella flexneri 2a str. 2457T
aucgcagaaaaaac

SEQ ID NO: 3863361 - RNA, 12 nt, Shigella flexneri 2a str. 2457T
aucgcagaugaa

SEQ ID NO: 3863362 - RNA, 12 nt, Shigella flexneri 2a str. 2457T
aucgcagcgcaa

SEQ ID NO: 3863363 - RNA, 23 nt, Shigella flexneri 2a str. 2457T
aucgcaucgaugguugcccugcu

SEQ ID NO: 3863364 - RNA, 21 nt, Shigella flexneri 2a str. 2457T
aucgcauggcugcgaaucgcu

SEQ ID NO: 3863365 - RNA, 16 nt, Shigella flexneri 2a str. 2457T
aucgccaaagcggcag

SEQ ID NO: 3863366 - RNA, 18 nt, Shigella flexneri 2a str. 2457T
aucgccaauaucaaucuu

SEQ ID NO: 3863367 - RNA, 22 nt, Shigella flexneri 2a str. 2457T
aucgccaccguuauccugauaa

SEQ ID NO: 3863368 - RNA, 21 nt, Shigella flexneri 2a str. 2457T
aucgccacggcaugaaagcga

SEQ ID NO: 3863369 - RNA, 20 nt, Shigella flexneri 2a str. 2457T
aucgccagcaaaaucaccau

SEQ ID NO: 3863370 - RNA, 15 nt, Shigella flexneri 2a str. 2457T
aucgccagcagccau

SEQ ID NO: 3863371 - RNA, 14 nt, Shigella flexneri 2a str. 2457T
aucgccagcucaag

SEQ ID NO: 3863372 - RNA, 20 nt, Shigella flexneri 2a str. 2457T
aucgccaggaacaacgacaa

SEQ ID NO: 3863373 - RNA, 13 nt, Shigella flexneri 2a str. 2457T
aucgccagugccg

SEQ ID NO: 3863374 - RNA, 19 nt, Shigella flexneri 2a str. 2457T
aucgccagugccgcccacc

SEQ ID NO: 3863375 - RNA, 16 nt, Shigella flexneri 2a str. 2457T
aucgccaucaggcaga

SEQ ID NO: 3863376 - RNA, 23 nt, Shigella flexneri 2a str. 2457T
aucgccauggucggcagagaguu

SEQ ID NO: 3863377 - RNA, 17 nt, Shigella flexneri 2a str. 2457T
aucgccauugccgguga

SEQ ID NO: 3863378 - RNA, 18 nt, Shigella flexneri 2a str. 2457T
aucgccauuuaacgcauc

SEQ ID NO: 3863379 - RNA, 22 nt, Shigella flexneri 2a str. 2457T
aucgcccgccaagcaguuggca

SEQ ID NO: 3863380 - RNA, 12 nt, Shigella flexneri 2a str. 2457T
aucgcccgcuuc

SEQ ID NO: 3863381 - RNA, 16 nt, Shigella flexneri 2a str. 2457T
aucgcccugcuccagc

SEQ ID NO: 3863382 - RNA, 18 nt, Shigella flexneri 2a str. 2457T
aucgcccuggauuucaau

SEQ ID NO: 3863383 - RNA, 22 nt, Shigella flexneri 2a str. 2457T
aucgccgcacuuucuccucccu

SEQ ID NO: 3863384 - RNA, 15 nt, Shigella flexneri 2a str. 2457T
aucgccgcgguauca

SEQ ID NO: 3863385 - RNA, 14 nt, Shigella flexneri 2a str. 2457T
aucgccgcuggcca

SEQ ID NO: 3863386 - RNA, 17 nt, Shigella flexneri 2a str. 2457T
aucgccgguaaugacuc

SEQ ID NO: 3863387 - RNA, 23 nt, Shigella flexneri 2a str. 2457T
aucgccucgcauaaucugaagaa

SEQ ID NO: 3863388 - RNA, 19 nt, Shigella flexneri 2a str. 2457T
aucgccucgccgaaacgcu

SEQ ID NO: 3863389 - RNA, 16 nt, Shigella flexneri 2a str. 2457T
aucgccugccgcagga

SEQ ID NO: 3863390 - RNA, 22 nt, Shigella flexneri 2a str. 2457T
aucgccugcgcgauacuacguu

SEQ ID NO: 3863391 - RNA, 15 nt, Shigella flexneri 2a str. 2457T
aucgccugguaccag

SEQ ID NO: 3863392 - RNA, 14 nt, Shigella flexneri 2a str. 2457T
aucgccuggugacc

SEQ ID NO: 3863393 - RNA, 18 nt, Shigella flexneri 2a str. 2457T
aucgccuuaauaacccac

SEQ ID NO: 3863394 - RNA, 21 nt, Shigella flexneri 2a str. 2457T
aucgccuucgcaaaaaaccau

SEQ ID NO: 3863395 - RNA, 23 nt, Shigella flexneri 2a str. 2457T
aucgccuuuugcccggcaacaac

SEQ ID NO: 3863396 - RNA, 16 nt, Shigella flexneri 2a str. 2457T
aucgcgaaaccacggu

SEQ ID NO: 3863397 - RNA, 16 nt, Shigella flexneri 2a str. 2457T
aucgcgaagaaagcgg

SEQ ID NO: 3863398 - RNA, 15 nt, Shigella flexneri 2a str. 2457T
aucgcgaccuguucu

SEQ ID NO: 3863399 - RNA, 17 nt, Shigella flexneri 2a str. 2457T
aucgcgauacaccagau

SEQ ID NO: 3863400 - RNA, 19 nt, Shigella flexneri 2a str. 2457T
aucgcgauggcaagcggug

SEQ ID NO: 3863401 - RNA, 14 nt, Shigella flexneri 2a str. 2457T
aucgcgcagcagau

SEQ ID NO: 3863402 - RNA, 12 nt, Shigella flexneri 2a str. 2457T
aucgcgcaucag

SEQ ID NO: 3863403 - RNA, 14 nt, Shigella flexneri 2a str. 2457T
aucgcgcaucagca

SEQ ID NO: 3863404 - RNA, 19 nt, Shigella flexneri 2a str. 2457T
aucgcgccaaucagcgcag

SEQ ID NO: 3863405 - RNA, 20 nt, Shigella flexneri 2a str. 2457T
aucgcgccagaaagcagcau

SEQ ID NO: 3863406 - RNA, 16 nt, Shigella flexneri 2a str. 2457T
aucgcgcccaaaccac

SEQ ID NO: 3863407 - RNA, 22 nt, Shigella flexneri 2a str. 2457T
aucgcgcccaaaccacccagca

SEQ ID NO: 3863408 - RNA, 18 nt, Shigella flexneri 2a str. 2457T
aucgcgcccgccgccauu

SEQ ID NO: 3863409 - RNA, 20 nt, Shigella flexneri 2a str. 2457T
aucgcggaucagcuuaucca

SEQ ID NO: 3863410 - RNA, 14 nt, Shigella flexneri 2a str. 2457T
aucgcggcacagaa

SEQ ID NO: 3863411 - RNA, 24 nt, Shigella flexneri 2a str. 2457T
aucgcggcgauauccagcgcggcg

SEQ ID NO: 3863412 - RNA, 18 nt, Shigella flexneri 2a str. 2457T
aucgcgggauugcgaugg

SEQ ID NO: 3863413 - RNA, 17 nt, Shigella flexneri 2a str. 2457T
aucgcggggaguucuga

SEQ ID NO: 3863414 - RNA, 20 nt, Shigella flexneri 2a str. 2457T
aucgcgguaaucacgcaugg

SEQ ID NO: 3863415 - RNA, 14 nt, Shigella flexneri 2a str. 2457T
aucgcguaaugcuu

SEQ ID NO: 3863416 - RNA, 13 nt, Shigella flexneri 2a str. 2457T
aucgcgugcggca

SEQ ID NO: 3863417 - RNA, 15 nt, Shigella flexneri 2a str. 2457T
aucgcgugcggcauc

SEQ ID NO: 3863418 - RNA, 15 nt, Shigella flexneri 2a str. 2457T
aucgcguuguuuagc

SEQ ID NO: 3863419 - RNA, 14 nt, Shigella flexneri 2a str. 2457T
aucgcuaaaauacu

SEQ ID NO: 3863420 - RNA, 13 nt, Shigella flexneri 2a str. 2457T
aucgcuacaccaa

SEQ ID NO: 3863421 - RNA, 14 nt, Shigella flexneri 2a str. 2457T
aucgcucagcgcau

SEQ ID NO: 3863422 - RNA, 17 nt, Shigella flexneri 2a str. 2457T
aucgcucucagagagaa

SEQ ID NO: 3863423 - RNA, 20 nt, Shigella flexneri 2a str. 2457T
aucgcugaacgggccaucca

SEQ ID NO: 3863424 - RNA, 15 nt, Shigella flexneri 2a str. 2457T
aucgcugcuaauuua

SEQ ID NO: 3863425 - RNA, 17 nt, Shigella flexneri 2a str. 2457T
aucgcuguuaauguuga

SEQ ID NO: 3863426 - RNA, 23 nt, Shigella flexneri 2a str. 2457T
aucgcuguuaauguugauccagu

SEQ ID NO: 3863427 - RNA, 22 nt, Shigella flexneri 2a str. 2457T
aucgcuuacccuaaauccgcca

SEQ ID NO: 3863428 - RNA, 15 nt, Shigella flexneri 2a str. 2457T
aucgcuucauuuaca

SEQ ID NO: 3863429 - RNA, 18 nt, Shigella flexneri 2a str. 2457T
aucgcuucggucugcgga

SEQ ID NO: 3863430 - RNA, 13 nt, Shigella flexneri 2a str. 2457T
aucgcuuucagug

SEQ ID NO: 3863431 - RNA, 22 nt, Shigella flexneri 2a str. 2457T
aucgcuuucgcuacuucaaaca

SEQ ID NO: 3863432 - RNA, 19 nt, Shigella flexneri 2a str. 2457T
aucgcuuucgcuuucucuu

SEQ ID NO: 3863433 - RNA, 23 nt, Shigella flexneri 2a str. 2457T
aucgcuuucggaaagaucgccac

SEQ ID NO: 3863434 - RNA, 22 nt, Shigella flexneri 2a str. 2457T
aucggagaacugcaacucaccu

SEQ ID NO: 3863435 - RNA, 15 nt, Shigella flexneri 2a str. 2457T
aucggauugcuccug

SEQ ID NO: 3863436 - RNA, 16 nt, Shigella flexneri 2a str. 2457T
aucggcaaaaugggua

SEQ ID NO: 3863437 - RNA, 14 nt, Shigella flexneri 2a str. 2457T
aucggcaaucgccu

SEQ ID NO: 3863438 - RNA, 13 nt, Shigella flexneri 2a str. 2457T
aucggcaccacca

SEQ ID NO: 3863439 - RNA, 21 nt, Shigella flexneri 2a str. 2457T
aucggcaccauuuaaaucaau

SEQ ID NO: 3863440 - RNA, 23 nt, Shigella flexneri 2a str. 2457T
aucggcagagugaagguuucugc

SEQ ID NO: 3863441 - RNA, 19 nt, Shigella flexneri 2a str. 2457T
aucggcauacagcgacaga

SEQ ID NO: 3863442 - RNA, 15 nt, Shigella flexneri 2a str. 2457T
aucggcaucacccca

SEQ ID NO: 3863443 - RNA, 22 nt, Shigella flexneri 2a str. 2457T
aucggccaucucaacuuucuug

SEQ ID NO: 3863444 - RNA, 23 nt, Shigella flexneri 2a str. 2457T
aucucugcgcuauccagcgcaua

SEQ ID NO: 3863445 - RNA, 20 nt, Shigella flexneri 2a str. 2457T
aucucuguuuugcauggggu

SEQ ID NO: 3863446 - RNA, 22 nt, Shigella flexneri 2a str. 2457T
aucucuucacgcuuugcaggcu

SEQ ID NO: 3863447 - RNA, 13 nt, Shigella flexneri 2a str. 2457T
aucucuuccagaa

SEQ ID NO: 3863448 - RNA, 18 nt, Shigella flexneri 2a str. 2457T
aucucuuccagaauaucu

SEQ ID NO: 3863449 - RNA, 22 nt, Shigella flexneri 2a str. 2457T
aucucuuccagugccucaagaa

SEQ ID NO: 3863450 - RNA, 12 nt, Shigella flexneri 2a str. 2457T
aucucuucccau

SEQ ID NO: 3863451 - RNA, 13 nt, Shigella flexneri 2a str. 2457T
aucucuucgccug

SEQ ID NO: 3863452 - RNA, 18 nt, Shigella flexneri 2a str. 2457T
aucucuucgccugccugc

SEQ ID NO: 3863453 - RNA, 23 nt, Shigella flexneri 2a str. 2457T
aucucuucgccugccugcagcug

SEQ ID NO: 3863454 - RNA, 13 nt, Shigella flexneri 2a str. 2457T
aucucuucuuccg

SEQ ID NO: 3863455 - RNA, 14 nt, Shigella flexneri 2a str. 2457T
aucucuucuucgcu

SEQ ID NO: 3863456 - RNA, 17 nt, Shigella flexneri 2a str. 2457T
aucucuuuccacaaugu

SEQ ID NO: 3863457 - RNA, 11 nt, Shigella flexneri 2a str. 2457T
aucugaauauu

SEQ ID NO: 3863458 - RNA, 17 nt, Shigella flexneri 2a str. 2457T
aucugaaucauucaggu

SEQ ID NO: 3863459 - RNA, 24 nt, Shigella flexneri 2a str. 2457T
aucugaauggcugcauuccuuguu

SEQ ID NO: 3863460 - RNA, 15 nt, Shigella flexneri 2a str. 2457T
aucugacagcaaaua

SEQ ID NO: 3863461 - RNA, 17 nt, Shigella flexneri 2a str. 2457T
aucugaccgaaugcagu

SEQ ID NO: 3863462 - RNA, 18 nt, Shigella flexneri 2a str. 2457T
aucugaugauauuuuucc

SEQ ID NO: 3863463 - RNA, 16 nt, Shigella flexneri 2a str. 2457T
aucugauuugauaaug

SEQ ID NO: 3863464 - RNA, 19 nt, Shigella flexneri 2a str. 2457T
aucugcaaaucgaucucaa

SEQ ID NO: 3863465 - RNA, 15 nt, Shigella flexneri 2a str. 2457T
aucugcaauuacugc

SEQ ID NO: 3863466 - RNA, 22 nt, Shigella flexneri 2a str. 2457T
aucugcauucaacuggauaaaa

SEQ ID NO: 3863467 - RNA, 14 nt, Shigella flexneri 2a str. 2457T
aucugccagaccca

SEQ ID NO: 3863468 - RNA, 18 nt, Shigella flexneri 2a str. 2457T
aucugccagauaauggcu

SEQ ID NO: 3863469 - RNA, 18 nt, Shigella flexneri 2a str. 2457T
aucugccagcaagcgcac

SEQ ID NO: 3863470 - RNA, 17 nt, Shigella flexneri 2a str. 2457T
aucugccuguccggcau

SEQ ID NO: 3863471 - RNA, 19 nt, Shigella flexneri 2a str. 2457T
aucugccuuauugaagcuc

SEQ ID NO: 3863472 - RNA, 20 nt, Shigella flexneri 2a str. 2457T
aucugcggguuagucugcau

SEQ ID NO: 3863473 - RNA, 16 nt, Shigella flexneri 2a str. 2457T
aucugcguaucgcccu

SEQ ID NO: 3863474 - RNA, 19 nt, Shigella flexneri 2a str. 2457T
aucugcguaucgcccugcc

SEQ ID NO: 3863475 - RNA, 16 nt, Shigella flexneri 2a str. 2457T
aucugcgucgcuuucc

SEQ ID NO: 3863476 - RNA, 23 nt, Shigella flexneri 2a str. 2457T
aucugcuugcgauguucuucacc

SEQ ID NO: 3863477 - RNA, 12 nt, Shigella flexneri 2a str. 2457T
aucuggaaaguc

SEQ ID NO: 3863478 - RNA, 18 nt, Shigella flexneri 2a str. 2457T
aucuggaauggaaacagc

SEQ ID NO: 3863479 - RNA, 16 nt, Shigella flexneri 2a str. 2457T
aucuggaguuccugga

SEQ ID NO: 3863480 - RNA, 24 nt, Shigella flexneri 2a str. 2457T
aucuggaucaacgaccagcgcgug

SEQ ID NO: 3863481 - RNA, 16 nt, Shigella flexneri 2a str. 2457T
aucuggcauuugcacc

SEQ ID NO: 3863482 - RNA, 18 nt, Shigella flexneri 2a str. 2457T
aucuggccuacaaagggc

SEQ ID NO: 3863483 - RNA, 20 nt, Shigella flexneri 2a str. 2457T
aucuggcugugauccauucc

SEQ ID NO: 3863484 - RNA, 21 nt, Shigella flexneri 2a str. 2457T
aucugguaucgaguggcgcag

SEQ ID NO: 3863485 - RNA, 13 nt, Shigella flexneri 2a str. 2457T
aucuggugucagc

SEQ ID NO: 3863486 - RNA, 22 nt, Shigella flexneri 2a str. 2457T
aucuguaaauugaugugaaaac

SEQ ID NO: 3863487 - RNA, 23 nt, Shigella flexneri 2a str. 2457T
aucuguaacggagguacaaccgc

SEQ ID NO: 3863488 - RNA, 21 nt, Shigella flexneri 2a str. 2457T
aucuguaggccagauaagacg

SEQ ID NO: 3863489 - RNA, 21 nt, Shigella flexneri 2a str. 2457T
aucuguauaaccugaauauua

SEQ ID NO: 3863490 - RNA, 22 nt, Shigella flexneri 2a str. 2457T
aucugucaguggacgauaagca

SEQ ID NO: 3863491 - RNA, 15 nt, Shigella flexneri 2a str. 2457T
aucugucauaacaca

SEQ ID NO: 3863492 - RNA, 19 nt, Shigella flexneri 2a str. 2457T
aucugucugauaaaaaacc

SEQ ID NO: 3863493 - RNA, 18 nt, Shigella flexneri 2a str. 2457T
aucugucuguacggcagu

SEQ ID NO: 3863494 - RNA, 14 nt, Shigella flexneri 2a str. 2457T
aucuguuaucacuu

SEQ ID NO: 3863495 - RNA, 16 nt, Shigella flexneri 2a str. 2457T
aucuguugugccacau

SEQ ID NO: 3863496 - RNA, 21 nt, Shigella flexneri 2a str. 2457T
aucuguuugccagucuggcuu

SEQ ID NO: 3863497 - RNA, 11 nt, Shigella flexneri 2a str. 2457T
aucuguuuuag

SEQ ID NO: 3863498 - RNA, 22 nt, Shigella flexneri 2a str. 2457T
aucuguuuuccgaugagcgaca

SEQ ID NO: 3863499 - RNA, 12 nt, Shigella flexneri 2a str. 2457T
aucuguuuuuug

SEQ ID NO: 3863500 - RNA, 15 nt, Shigella flexneri 2a str. 2457T
aucuuaagucugcgc

SEQ ID NO: 3863501 - RNA, 15 nt, Shigella flexneri 2a str. 2457T
aucuuaauggcgauu

SEQ ID NO: 3863502 - RNA, 22 nt, Shigella flexneri 2a str. 2457T
aucuuaauggcgauuagaaaca

SEQ ID NO: 3863503 - RNA, 11 nt, Shigella flexneri 2a str. 2457T
aucuuacccuu

SEQ ID NO: 3863504 - RNA, 13 nt, Shigella flexneri 2a str. 2457T
aucuuaucacgau

SEQ ID NO: 3863505 - RNA, 18 nt, Shigella flexneri 2a str. 2457T
aucuuaucacgaugcuaa

SEQ ID NO: 3863506 - RNA, 20 nt, Shigella flexneri 2a str. 2457T
aucuuauugcucgaccuaaa

SEQ ID NO: 3863507 - RNA, 20 nt, Shigella flexneri 2a str. 2457T
aucuucaaccgucaccagcc

SEQ ID NO: 3863508 - RNA, 18 nt, Shigella flexneri 2a str. 2457T
aucuucacuguccgccag

SEQ ID NO: 3863509 - RNA, 13 nt, Shigella flexneri 2a str. 2457T
aucuucagcugca

SEQ ID NO: 3863510 - RNA, 15 nt, Shigella flexneri 2a str. 2457T
aucuucauccggcug

SEQ ID NO: 3863511 - RNA, 19 nt, Shigella flexneri 2a str. 2457T
aucuucaugcuccagcaga

SEQ ID NO: 3863512 - RNA, 20 nt, Shigella flexneri 2a str. 2457T
aucuucauugugcgguccau

SEQ ID NO: 3863513 - RNA, 17 nt, Shigella flexneri 2a str. 2457T
aucuuccaccuggaacc

SEQ ID NO: 3863514 - RNA, 14 nt, Shigella flexneri 2a str. 2457T
aucuuccagaucac

SEQ ID NO: 3863515 - RNA, 21 nt, Shigella flexneri 2a str. 2457T
aucuuccagaucaccgcagaa

SEQ ID NO: 3863516 - RNA, 11 nt, Shigella flexneri 2a str. 2457T
aucuucccagc

SEQ ID NO: 3863517 - RNA, 13 nt, Shigella flexneri 2a str. 2457T
aucuucccagccc

SEQ ID NO: 3863518 - RNA, 15 nt, Shigella flexneri 2a str. 2457T
aucuucccagcgcag

SEQ ID NO: 3863519 - RNA, 20 nt, Shigella flexneri 2a str. 2457T
aucuuccggcgggcaaacgg

SEQ ID NO: 3863520 - RNA, 18 nt, Shigella flexneri 2a str. 2457T
aucuuccucacacccuug

SEQ ID NO: 3863521 - RNA, 15 nt, Shigella flexneri 2a str. 2457T
aucuuccugauaacc

SEQ ID NO: 3863522 - RNA, 16 nt, Shigella flexneri 2a str. 2457T
aucuucgagauucuua

SEQ ID NO: 3863523 - RNA, 20 nt, Shigella flexneri 2a str. 2457T
aucuucgagauucuuaaagu

SEQ ID NO: 3863524 - RNA, 22 nt, Shigella flexneri 2a str. 2457T
aucuucgauaaacucaaucagg

SEQ ID NO: 3863525 - RNA, 19 nt, Shigella flexneri 2a str. 2457T
aucuucggcgucagaaaua

SEQ ID NO: 3863526 - RNA, 14 nt, Shigella flexneri 2a str. 2457T
aucuucuccacgcc

SEQ ID NO: 3863527 - RNA, 16 nt, Shigella flexneri 2a str. 2457T
aucuucuguugcaggg

SEQ ID NO: 3863528 - RNA, 20 nt, Shigella flexneri 2a str. 2457T
aucuucuugcagcuuaauca

SEQ ID NO: 3863529 - RNA, 16 nt, Shigella flexneri 2a str. 2457T
aucuugaaaccagaca

SEQ ID NO: 3863530 - RNA, 14 nt, Shigella flexneri 2a str. 2457T
aucuugagaaaaac

SEQ ID NO: 3863531 - RNA, 17 nt, Shigella flexneri 2a str. 2457T
aucuugagaaaaaccuc

SEQ ID NO: 3863532 - RNA, 15 nt, Shigella flexneri 2a str. 2457T
aucuugcgaccgcuc

SEQ ID NO: 3863533 - RNA, 16 nt, Shigella flexneri 2a str. 2457T
aucuuguucauagugc

SEQ ID NO: 3863534 - RNA, 20 nt, Shigella flexneri 2a str. 2457T
aucuuuaaaaaaagcauuua

SEQ ID NO: 3863535 - RNA, 21 nt, Shigella flexneri 2a str. 2457T
aucuuuaaaaaaagcauuuaa

SEQ ID NO: 3863536 - RNA, 24 nt, Shigella flexneri 2a str. 2457T
aucuuuacugauaauuuuuucacu

SEQ ID NO: 3863537 - RNA, 16 nt, Shigella flexneri 2a str. 2457T
aucuuuaucaaucacc

SEQ ID NO: 3863538 - RNA, 17 nt, Shigella flexneri 2a str. 2457T
aucuuuaucacacagau

SEQ ID NO: 3863539 - RNA, 18 nt, Shigella flexneri 2a str. 2457T
aucuuuaucacacagaug

SEQ ID NO: 3863540 - RNA, 15 nt, Shigella flexneri 2a str. 2457T
aucuuuaugaaauau

SEQ ID NO: 3863541 - RNA, 21 nt, Shigella flexneri 2a str. 2457T
augauacagccgacaaugcca

SEQ ID NO: 3863542 - RNA, 16 nt, Shigella flexneri 2a str. 2457T
augauaccgauuacuc

SEQ ID NO: 3863543 - RNA, 16 nt, Shigella flexneri 2a str. 2457T
augauaggucauauca

SEQ ID NO: 3863544 - RNA, 18 nt, Shigella flexneri 2a str. 2457T
augauaggucauaucaca

SEQ ID NO: 3863545 - RNA, 22 nt, Shigella flexneri 2a str. 2457T
augauaucagccugcaaacgcu

SEQ ID NO: 3863546 - RNA, 14 nt, Shigella flexneri 2a str. 2457T
augauaucccugcu

SEQ ID NO: 3863547 - RNA, 21 nt, Shigella flexneri 2a str. 2457T
augauaucccugcuguccuga

SEQ ID NO: 3863548 - RNA, 17 nt, Shigella flexneri 2a str. 2457T
augauauggucaaugau

SEQ ID NO: 3863549 - RNA, 15 nt, Shigella flexneri 2a str. 2457T
augaucaaaaucaua

SEQ ID NO: 3863550 - RNA, 17 nt, Shigella flexneri 2a str. 2457T
augaucaaaaucauaua

SEQ ID NO: 3863551 - RNA, 15 nt, Shigella flexneri 2a str. 2457T
augaucaagcgcaca

SEQ ID NO: 3863552 - RNA, 20 nt, Shigella flexneri 2a str. 2457T
augaucaccugcauacaaau

SEQ ID NO: 3863553 - RNA, 23 nt, Shigella flexneri 2a str. 2457T
augaucaccugcauacaaauaag

SEQ ID NO: 3863554 - RNA, 19 nt, Shigella flexneri 2a str. 2457T
augaucagcgguuuugcca

SEQ ID NO: 3863555 - RNA, 13 nt, Shigella flexneri 2a str. 2457T
augaucaucaagg

SEQ ID NO: 3863556 - RNA, 15 nt, Shigella flexneri 2a str. 2457T
augaucaucaaggcu

SEQ ID NO: 3863557 - RNA, 23 nt, Shigella flexneri 2a str. 2457T
augauccugcaauaccgccguua

SEQ ID NO: 3863558 - RNA, 19 nt, Shigella flexneri 2a str. 2457T
augaucgaggcaaagaguu

SEQ ID NO: 3863559 - RNA, 21 nt, Shigella flexneri 2a str. 2457T
augaucgccaucagugccagu

SEQ ID NO: 3863560 - RNA, 12 nt, Shigella flexneri 2a str. 2457T
augaucgccgua

SEQ ID NO: 3863561 - RNA, 17 nt, Shigella flexneri 2a str. 2457T
augaugaaacugauaau

SEQ ID NO: 3863562 - RNA, 16 nt, Shigella flexneri 2a str. 2457T
augaugauacugacau

SEQ ID NO: 3863563 - RNA, 17 nt, Shigella flexneri 2a str. 2457T
augaugauacugacauu

SEQ ID NO: 3863564 - RNA, 23 nt, Shigella flexneri 2a str. 2457T
augaugaugccuacacgccagau

SEQ ID NO: 3863565 - RNA, 19 nt, Shigella flexneri 2a str. 2457T
augaugccgccagaaaugg

SEQ ID NO: 3863566 - RNA, 14 nt, Shigella flexneri 2a str. 2457T
augaugccggaauc

SEQ ID NO: 3863567 - RNA, 21 nt, Shigella flexneri 2a str. 2457T
augaugccugaugcgacgcug

SEQ ID NO: 3863568 - RNA, 19 nt, Shigella flexneri 2a str. 2457T
augaugcgacuugucauca

SEQ ID NO: 3863569 - RNA, 15 nt, Shigella flexneri 2a str. 2457T
augaugcugauggcu

SEQ ID NO: 3863570 - RNA, 18 nt, Shigella flexneri 2a str. 2457T
augauggcauucucacuc

SEQ ID NO: 3863571 - RNA, 19 nt, Shigella flexneri 2a str. 2457T
augauggcauucucacucc

SEQ ID NO: 3863572 - RNA, 16 nt, Shigella flexneri 2a str. 2457T
augauggcgauaaucu

SEQ ID NO: 3863573 - RNA, 14 nt, Shigella flexneri 2a str. 2457T
augauguaaaaaua

SEQ ID NO: 3863574 - RNA, 16 nt, Shigella flexneri 2a str. 2457T
augauguaaaaauacu

SEQ ID NO: 3863575 - RNA, 14 nt, Shigella flexneri 2a str. 2457T
augaugucgcuguc

SEQ ID NO: 3863576 - RNA, 15 nt, Shigella flexneri 2a str. 2457T
augauuacucguauu

SEQ ID NO: 3863577 - RNA, 20 nt, Shigella flexneri 2a str. 2457T
augauuagucuuuaucugcc

SEQ ID NO: 3863578 - RNA, 13 nt, Shigella flexneri 2a str. 2457T
augauuagugcca

SEQ ID NO: 3863579 - RNA, 18 nt, Shigella flexneri 2a str. 2457T
augauucccuugucgcag

SEQ ID NO: 3863580 - RNA, 15 nt, Shigella flexneri 2a str. 2457T
augauuuaaaaaaug

SEQ ID NO: 3863581 - RNA, 15 nt, Shigella flexneri 2a str. 2457T
augauuucugccagc

SEQ ID NO: 3863582 - RNA, 15 nt, Shigella flexneri 2a str. 2457T
augauuuuccugagg

SEQ ID NO: 3863583 - RNA, 19 nt, Shigella flexneri 2a str. 2457T
augauuuugauggaagaaa

SEQ ID NO: 3863584 - RNA, 21 nt, Shigella flexneri 2a str. 2457T
augauuuuuuugaugccguug

SEQ ID NO: 3863585 - RNA, 14 nt, Shigella flexneri 2a str. 2457T
augcaaaaaggcau

SEQ ID NO: 3863586 - RNA, 18 nt, Shigella flexneri 2a str. 2457T
augcaacaacugaaaaaa

SEQ ID NO: 3863587 - RNA, 16 nt, Shigella flexneri 2a str. 2457T
augcaaccgagcgccc

SEQ ID NO: 3863588 - RNA, 21 nt, Shigella flexneri 2a str. 2457T
augcaacguuaccguaaccau

SEQ ID NO: 3863589 - RNA, 20 nt, Shigella flexneri 2a str. 2457T
augcaacuguuuuaccaaau

SEQ ID NO: 3863590 - RNA, 18 nt, Shigella flexneri 2a str. 2457T
augcaagaggguuauuug

SEQ ID NO: 3863591 - RNA, 18 nt, Shigella flexneri 2a str. 2457T
augcaauaaauauguuac

SEQ ID NO: 3863592 - RNA, 22 nt, Shigella flexneri 2a str. 2457T
augcaauagcgccugcugcugu

SEQ ID NO: 3863593 - RNA, 19 nt, Shigella flexneri 2a str. 2457T
augcaauuaccgccaccag

SEQ ID NO: 3863594 - RNA, 15 nt, Shigella flexneri 2a str. 2457T
augcaccaucucuua

SEQ ID NO: 3863595 - RNA, 18 nt, Shigella flexneri 2a str. 2457T
augcaccgacaauccggu

SEQ ID NO: 3863596 - RNA, 17 nt, Shigella flexneri 2a str. 2457T
augcaccuucaacuugc

SEQ ID NO: 3863597 - RNA, 21 nt, Shigella flexneri 2a str. 2457T
augcacgauauaccgugcuga

SEQ ID NO: 3863598 - RNA, 20 nt, Shigella flexneri 2a str. 2457T
augcacgcaagaacgcauac

SEQ ID NO: 3863599 - RNA, 20 nt, Shigella flexneri 2a str. 2457T
augcacucgcauccucuuua

SEQ ID NO: 3863600 - RNA, 18 nt, Shigella flexneri 2a str. 2457T
augcacugcaacgccuuu

SEQ ID NO: 3863601 - RNA, 13 nt, Shigella flexneri 2a str. 2457T
augcagauaaucg

SEQ ID NO: 3863602 - RNA, 20 nt, Shigella flexneri 2a str. 2457T
augcagcauggucagguauu

SEQ ID NO: 3863603 - RNA, 22 nt, Shigella flexneri 2a str. 2457T
augcagcauugccugaugcgcu

SEQ ID NO: 3863604 - RNA, 14 nt, Shigella flexneri 2a str. 2457T
augcagcggguuaa

SEQ ID NO: 3863605 - RNA, 16 nt, Shigella flexneri 2a str. 2457T
augcagcguuuccagc

SEQ ID NO: 3863606 - RNA, 15 nt, Shigella flexneri 2a str. 2457T
augcaggcagcacug

SEQ ID NO: 3863607 - RNA, 22 nt, Shigella flexneri 2a str. 2457T
augcaggcaucggugaugcucu

SEQ ID NO: 3863608 - RNA, 14 nt, Shigella flexneri 2a str. 2457T
augcaggccaccag

SEQ ID NO: 3863609 - RNA, 18 nt, Shigella flexneri 2a str. 2457T
augcaggcguuuuuggca

SEQ ID NO: 3863610 - RNA, 15 nt, Shigella flexneri 2a str. 2457T
augcagggcaaacuc

SEQ ID NO: 3863611 - RNA, 19 nt, Shigella flexneri 2a str. 2457T
augcagggcaaacucugag

SEQ ID NO: 3863612 - RNA, 15 nt, Shigella flexneri 2a str. 2457T
augcaguaccagaua

SEQ ID NO: 3863613 - RNA, 15 nt, Shigella flexneri 2a str. 2457T
augcagugcauccag

SEQ ID NO: 3863614 - RNA, 20 nt, Shigella flexneri 2a str. 2457T
augcagugcauccagcagcc

SEQ ID NO: 3863615 - RNA, 23 nt, Shigella flexneri 2a str. 2457T
augcagugcggcuguagagcuac

SEQ ID NO: 3863616 - RNA, 18 nt, Shigella flexneri 2a str. 2457T
augcaguuuuuaauuuuc

SEQ ID NO: 3863617 - RNA, 15 nt, Shigella flexneri 2a str. 2457T
augcauaauccgccg

SEQ ID NO: 3863618 - RNA, 14 nt, Shigella flexneri 2a str. 2457T
augcauaaugcagc

SEQ ID NO: 3863619 - RNA, 16 nt, Shigella flexneri 2a str. 2457T
augcauauccaggcua

SEQ ID NO: 3863620 - RNA, 11 nt, Shigella flexneri 2a str. 2457T
augcaucagug

SEQ ID NO: 3863621 - RNA, 22 nt, Shigella flexneri 2a str. 2457T
augcaucauaaccugcucugcc

SEQ ID NO: 3863622 - RNA, 16 nt, Shigella flexneri 2a str. 2457T
augcauccggcaguca

SEQ ID NO: 3863623 - RNA, 23 nt, Shigella flexneri 2a str. 2457T
augcaucgcauccgacaucaacc

SEQ ID NO: 3863624 - RNA, 14 nt, Shigella flexneri 2a str. 2457T
augcaucgccgguu

SEQ ID NO: 3863625 - RNA, 14 nt, Shigella flexneri 2a str. 2457T
augcaucggcauaa

SEQ ID NO: 3863626 - RNA, 13 nt, Shigella flexneri 2a str. 2457T
augccaaaaggga

SEQ ID NO: 3863627 - RNA, 22 nt, Shigella flexneri 2a str. 2457T
augccaaauauuucuuuaucac

SEQ ID NO: 3863628 - RNA, 24 nt, Shigella flexneri 2a str. 2457T
augccaaauauuucuuuaucacca

SEQ ID NO: 3863629 - RNA, 20 nt, Shigella flexneri 2a str. 2457T
augccaauaaauccuuugua

SEQ ID NO: 3863630 - RNA, 16 nt, Shigella flexneri 2a str. 2457T
augccaaucagcagaa

SEQ ID NO: 3863631 - RNA, 22 nt, Shigella flexneri 2a str. 2457T
augccaaucuucacaucaucau

SEQ ID NO: 3863632 - RNA, 17 nt, Shigella flexneri 2a str. 2457T
augccacauuagauaaa

SEQ ID NO: 3863633 - RNA, 20 nt, Shigella flexneri 2a str. 2457T
augccacauuagauaaaaau

SEQ ID NO: 3863634 - RNA, 14 nt, Shigella flexneri 2a str. 2457T
augccaccacaccg

SEQ ID NO: 3863635 - RNA, 13 nt, Shigella flexneri 2a str. 2457T
augccacccaggu

SEQ ID NO: 3863636 - RNA, 17 nt, Shigella flexneri 2a str. 2457T
augccacgccacagccg

SEQ ID NO: 3863637 - RNA, 22 nt, Shigella flexneri 2a str. 2457T
augccagaaagcguauccauca

SEQ ID NO: 3863638 - RNA, 16 nt, Shigella flexneri 2a str. 2457T
augcuccagcagaugg

SEQ ID NO: 3863639 - RNA, 16 nt, Shigella flexneri 2a str. 2457T
augcucgcuggcaggc

SEQ ID NO: 3863640 - RNA, 15 nt, Shigella flexneri 2a str. 2457T
augcucucccaaaua

SEQ ID NO: 3863641 - RNA, 14 nt, Shigella flexneri 2a str. 2457T
augcucugccagcg

SEQ ID NO: 3863642 - RNA, 20 nt, Shigella flexneri 2a str. 2457T
augcugaaauuacgcggugc

SEQ ID NO: 3863643 - RNA, 19 nt, Shigella flexneri 2a str. 2457T
augcugacgcaucuucucc

SEQ ID NO: 3863644 - RNA, 14 nt, Shigella flexneri 2a str. 2457T
augcugcaauaaaa

SEQ ID NO: 3863645 - RNA, 19 nt, Shigella flexneri 2a str. 2457T
augcugcaauugcggcagg

SEQ ID NO: 3863646 - RNA, 13 nt, Shigella flexneri 2a str. 2457T
augcugcagccag

SEQ ID NO: 3863647 - RNA, 20 nt, Shigella flexneri 2a str. 2457T
augcugcgccaguugcuuau

SEQ ID NO: 3863648 - RNA, 21 nt, Shigella flexneri 2a str. 2457T
augcugcggcggcggaaaaag

SEQ ID NO: 3863649 - RNA, 21 nt, Shigella flexneri 2a str. 2457T
augcugcuuuaucagaucacg

SEQ ID NO: 3863650 - RNA, 22 nt, Shigella flexneri 2a str. 2457T
augcugcuuuaucagaucacgc

SEQ ID NO: 3863651 - RNA, 12 nt, Shigella flexneri 2a str. 2457T
augcuggaagcg

SEQ ID NO: 3863652 - RNA, 18 nt, Shigella flexneri 2a str. 2457T
augcuggccuuuuuggca

SEQ ID NO: 3863653 - RNA, 22 nt, Shigella flexneri 2a str. 2457T
augcuggcggcgcgauaaaaau

SEQ ID NO: 3863654 - RNA, 18 nt, Shigella flexneri 2a str. 2457T
augcugguaauccgagaa

SEQ ID NO: 3863655 - RNA, 20 nt, Shigella flexneri 2a str. 2457T
augcuggucacugacaccau

SEQ ID NO: 3863656 - RNA, 14 nt, Shigella flexneri 2a str. 2457T
augcugguuuugug

SEQ ID NO: 3863657 - RNA, 17 nt, Shigella flexneri 2a str. 2457T
augcuguaaccagcgca

SEQ ID NO: 3863658 - RNA, 15 nt, Shigella flexneri 2a str. 2457T
augcuguauucuuca

SEQ ID NO: 3863659 - RNA, 20 nt, Shigella flexneri 2a str. 2457T
augcugucggcugccagcca

SEQ ID NO: 3863660 - RNA, 16 nt, Shigella flexneri 2a str. 2457T
augcugugaagauggc

SEQ ID NO: 3863661 - RNA, 19 nt, Shigella flexneri 2a str. 2457T
augcugugcgccacagaca

SEQ ID NO: 3863662 - RNA, 17 nt, Shigella flexneri 2a str. 2457T
augcuuaagaaauuauu

SEQ ID NO: 3863663 - RNA, 17 nt, Shigella flexneri 2a str. 2457T
augcuucaauuuccuga

SEQ ID NO: 3863664 - RNA, 18 nt, Shigella flexneri 2a str. 2457T
augcuuccgccagcggcg

SEQ ID NO: 3863665 - RNA, 16 nt, Shigella flexneri 2a str. 2457T
augcuugacucuguag

SEQ ID NO: 3863666 - RNA, 16 nt, Shigella flexneri 2a str. 2457T
augcuugaugucugcc

SEQ ID NO: 3863667 - RNA, 19 nt, Shigella flexneri 2a str. 2457T
augcuugcgauauucuuca

SEQ ID NO: 3863668 - RNA, 14 nt, Shigella flexneri 2a str. 2457T
augcuuuaaaugcu

SEQ ID NO: 3863669 - RNA, 17 nt, Shigella flexneri 2a str. 2457T
augcuuugcaucccaga

SEQ ID NO: 3863670 - RNA, 14 nt, Shigella flexneri 2a str. 2457T
augcuuuuuccugc

SEQ ID NO: 3863671 - RNA, 21 nt, Shigella flexneri 2a str. 2457T
auggaaaaucaucaggggcag

SEQ ID NO: 3863672 - RNA, 13 nt, Shigella flexneri 2a str. 2457T
auggaaacagcac

SEQ ID NO: 3863673 - RNA, 18 nt, Shigella flexneri 2a str. 2457T
auggaaacagcaccaucc

SEQ ID NO: 3863674 - RNA, 18 nt, Shigella flexneri 2a str. 2457T
auggaaaucacccagcga

SEQ ID NO: 3863675 - RNA, 13 nt, Shigella flexneri 2a str. 2457T
auggaagaaaaau

SEQ ID NO: 3863676 - RNA, 14 nt, Shigella flexneri 2a str. 2457T
auggaagaaaaaua

SEQ ID NO: 3863677 - RNA, 18 nt, Shigella flexneri 2a str. 2457T
auggaagacauagcacau

SEQ ID NO: 3863678 - RNA, 19 nt, Shigella flexneri 2a str. 2457T
auggaauggucaauggugg

SEQ ID NO: 3863679 - RNA, 18 nt, Shigella flexneri 2a str. 2457T
auggacaccagcucagug

SEQ ID NO: 3863680 - RNA, 19 nt, Shigella flexneri 2a str. 2457T
auggacgaugagacccgcc

SEQ ID NO: 3863681 - RNA, 13 nt, Shigella flexneri 2a str. 2457T
auggacgcagacc

SEQ ID NO: 3863682 - RNA, 22 nt, Shigella flexneri 2a str. 2457T
auggaggcuucgguaaugacuc

SEQ ID NO: 3863683 - RNA, 13 nt, Shigella flexneri 2a str. 2457T
auggagugagaau

SEQ ID NO: 3863684 - RNA, 11 nt, Shigella flexneri 2a str. 2457T
auggaucaacu

SEQ ID NO: 3863685 - RNA, 19 nt, Shigella flexneri 2a str. 2457T
auggaucagaguugaaaaa

SEQ ID NO: 3863686 - RNA, 21 nt, Shigella flexneri 2a str. 2457T
auggaucagaguugaaaaaca

SEQ ID NO: 3863687 - RNA, 18 nt, Shigella flexneri 2a str. 2457T
auggaucccucuuucugg

SEQ ID NO: 3863688 - RNA, 16 nt, Shigella flexneri 2a str. 2457T
auggauuagcgaccga

SEQ ID NO: 3863689 - RNA, 23 nt, Shigella flexneri 2a str. 2457T
auggauuaucgacugcgcccuga

SEQ ID NO: 3863690 - RNA, 13 nt, Shigella flexneri 2a str. 2457T
auggauugcugaa

SEQ ID NO: 3863691 - RNA, 16 nt, Shigella flexneri 2a str. 2457T
auggauugcugaaaua

SEQ ID NO: 3863692 - RNA, 17 nt, Shigella flexneri 2a str. 2457T
auggcaaaaacuuccau

SEQ ID NO: 3863693 - RNA, 15 nt, Shigella flexneri 2a str. 2457T
auggcaaacaaacug

SEQ ID NO: 3863694 - RNA, 21 nt, Shigella flexneri 2a str. 2457T
auggcaauaaagacauccgcc

SEQ ID NO: 3863695 - RNA, 12 nt, Shigella flexneri 2a str. 2457T
auggcacaaaug

SEQ ID NO: 3863696 - RNA, 12 nt, Shigella flexneri 2a str. 2457T
auggcaccguuc

SEQ ID NO: 3863697 - RNA, 13 nt, Shigella flexneri 2a str. 2457T
auggcagaagcau

SEQ ID NO: 3863698 - RNA, 18 nt, Shigella flexneri 2a str. 2457T
auggcagauaaaauacuu

SEQ ID NO: 3863699 - RNA, 21 nt, Shigella flexneri 2a str. 2457T
auggcaggaguggcagcaugc

SEQ ID NO: 3863700 - RNA, 18 nt, Shigella flexneri 2a str. 2457T
auggcaggcucagacuga

SEQ ID NO: 3863701 - RNA, 16 nt, Shigella flexneri 2a str. 2457T
auggcauccgccacuu

SEQ ID NO: 3863702 - RNA, 23 nt, Shigella flexneri 2a str. 2457T
auggcauccuguuuucuggaugc

SEQ ID NO: 3863703 - RNA, 17 nt, Shigella flexneri 2a str. 2457T
auggcauucucacucca

SEQ ID NO: 3863704 - RNA, 21 nt, Shigella flexneri 2a str. 2457T
auggcauuggccguugccauu

SEQ ID NO: 3863705 - RNA, 12 nt, Shigella flexneri 2a str. 2457T
auggccagccag

SEQ ID NO: 3863706 - RNA, 15 nt, Shigella flexneri 2a str. 2457T
auggccagccagcag

SEQ ID NO: 3863707 - RNA, 23 nt, Shigella flexneri 2a str. 2457T
auggcccccguuuuuugaaacag

SEQ ID NO: 3863708 - RNA, 19 nt, Shigella flexneri 2a str. 2457T
auggcccgccgcauuggua

SEQ ID NO: 3863709 - RNA, 16 nt, Shigella flexneri 2a str. 2457T
auggccgcgcagggca

SEQ ID NO: 3863710 - RNA, 17 nt, Shigella flexneri 2a str. 2457T
auggccgcuccaagguc

SEQ ID NO: 3863711 - RNA, 20 nt, Shigella flexneri 2a str. 2457T
auggccugaugugacgcugu

SEQ ID NO: 3863712 - RNA, 14 nt, Shigella flexneri 2a str. 2457T
auggcgaauggcac

SEQ ID NO: 3863713 - RNA, 14 nt, Shigella flexneri 2a str. 2457T
auggcgacaaggcg

SEQ ID NO: 3863714 - RNA, 13 nt, Shigella flexneri 2a str. 2457T
auggcgacauaaa

SEQ ID NO: 3863715 - RNA, 20 nt, Shigella flexneri 2a str. 2457T
auggcgauuucacaagacug

SEQ ID NO: 3863716 - RNA, 22 nt, Shigella flexneri 2a str. 2457T
auggcgcaauccggugauguuu

SEQ ID NO: 3863717 - RNA, 17 nt, Shigella flexneri 2a str. 2457T
auggcgcacauugugcg

SEQ ID NO: 3863718 - RNA, 13 nt, Shigella flexneri 2a str. 2457T
auggcgcauccag

SEQ ID NO: 3863719 - RNA, 17 nt, Shigella flexneri 2a str. 2457T
auggcgccaguuauuaa

SEQ ID NO: 3863720 - RNA, 15 nt, Shigella flexneri 2a str. 2457T
auggcgcccaucggc

SEQ ID NO: 3863721 - RNA, 17 nt, Shigella flexneri 2a str. 2457T
auggcgcccaucggcgc

SEQ ID NO: 3863722 - RNA, 20 nt, Shigella flexneri 2a str. 2457T
auggcgcgccaccucuuuca

SEQ ID NO: 3863723 - RNA, 18 nt, Shigella flexneri 2a str. 2457T
auggcgcgcggcaggaag

SEQ ID NO: 3863724 - RNA, 14 nt, Shigella flexneri 2a str. 2457T
auggcggaucacgc

SEQ ID NO: 3863725 - RNA, 19 nt, Shigella flexneri 2a str. 2457T
auggcggaucacgcuguuu

SEQ ID NO: 3863726 - RNA, 24 nt, Shigella flexneri 2a str. 2457T
auggcggcggcuuuuacgagcauc

SEQ ID NO: 3863727 - RNA, 22 nt, Shigella flexneri 2a str. 2457T
auggcggggagggaauccagca

SEQ ID NO: 3863728 - RNA, 19 nt, Shigella flexneri 2a str. 2457T
auggcggugagggggggau

SEQ ID NO: 3863729 - RNA, 20 nt, Shigella flexneri 2a str. 2457T
auggcuauaacauuuuucuc

SEQ ID NO: 3863730 - RNA, 14 nt, Shigella flexneri 2a str. 2457T
auggcucaccagca

SEQ ID NO: 3863731 - RNA, 16 nt, Shigella flexneri 2a str. 2457T
auggcucagauugaac

SEQ ID NO: 3863732 - RNA, 22 nt, Shigella flexneri 2a str. 2457T
auggcuccgggugugacaacaa

SEQ ID NO: 3863733 - RNA, 19 nt, Shigella flexneri 2a str. 2457T
auggcucgccauccaguga

SEQ ID NO: 3863734 - RNA, 22 nt, Shigella flexneri 2a str. 2457T
auggcugaaagcgccgggaaug

SEQ ID NO: 3863735 - RNA, 19 nt, Shigella flexneri 2a str. 2457T
auguuaucaagauauuuca

SEQ ID NO: 3863736 - RNA, 12 nt, Shigella flexneri 2a str. 2457T
auguuauucaug

SEQ ID NO: 3863737 - RNA, 14 nt, Shigella flexneri 2a str. 2457T
auguuauucaugcc

SEQ ID NO: 3863738 - RNA, 20 nt, Shigella flexneri 2a str. 2457T
auguucagaaagcgccagca

SEQ ID NO: 3863739 - RNA, 21 nt, Shigella flexneri 2a str. 2457T
auguucagaaagcgccagcaa

SEQ ID NO: 3863740 - RNA, 13 nt, Shigella flexneri 2a str. 2457T
auguucagauaau

SEQ ID NO: 3863741 - RNA, 19 nt, Shigella flexneri 2a str. 2457T
auguucagauaaugcccga

SEQ ID NO: 3863742 - RNA, 22 nt, Shigella flexneri 2a str. 2457T
auguucagccgucauccaggaa

SEQ ID NO: 3863743 - RNA, 17 nt, Shigella flexneri 2a str. 2457T
auguucaggauauuuau

SEQ ID NO: 3863744 - RNA, 20 nt, Shigella flexneri 2a str. 2457T
auguucaucaagcugugccu

SEQ ID NO: 3863745 - RNA, 20 nt, Shigella flexneri 2a str. 2457T
auguuccagggccuccugca

SEQ ID NO: 3863746 - RNA, 17 nt, Shigella flexneri 2a str. 2457T
auguuccaucaccagau

SEQ ID NO: 3863747 - RNA, 19 nt, Shigella flexneri 2a str. 2457T
auguuccggcgacacaucu

SEQ ID NO: 3863748 - RNA, 22 nt, Shigella flexneri 2a str. 2457T
auguuccggguuugccacauca

SEQ ID NO: 3863749 - RNA, 13 nt, Shigella flexneri 2a str. 2457T
auguuccuccucg

SEQ ID NO: 3863750 - RNA, 17 nt, Shigella flexneri 2a str. 2457T
auguucgccagauuuuu

SEQ ID NO: 3863751 - RNA, 20 nt, Shigella flexneri 2a str. 2457T
auguucguccauuucagcgc

SEQ ID NO: 3863752 - RNA, 14 nt, Shigella flexneri 2a str. 2457T
auguucuaucuuuc

SEQ ID NO: 3863753 - RNA, 21 nt, Shigella flexneri 2a str. 2457T
auguucuggucacucucgacc

SEQ ID NO: 3863754 - RNA, 20 nt, Shigella flexneri 2a str. 2457T
auguugaaauucgccagaca

SEQ ID NO: 3863755 - RNA, 19 nt, Shigella flexneri 2a str. 2457T
auguugcgcggucggaaaa

SEQ ID NO: 3863756 - RNA, 13 nt, Shigella flexneri 2a str. 2457T
auguugcuggaag

SEQ ID NO: 3863757 - RNA, 17 nt, Shigella flexneri 2a str. 2457T
auguuggagauaacaac

SEQ ID NO: 3863758 - RNA, 20 nt, Shigella flexneri 2a str. 2457T
auguugucucagauucagau

SEQ ID NO: 3863759 - RNA, 14 nt, Shigella flexneri 2a str. 2457T
auguuguuccuuuu

SEQ ID NO: 3863760 - RNA, 16 nt, Shigella flexneri 2a str. 2457T
auguuguugucuauuu

SEQ ID NO: 3863761 - RNA, 17 nt, Shigella flexneri 2a str. 2457T
auguuguuucucuuucu

SEQ ID NO: 3863762 - RNA, 18 nt, Shigella flexneri 2a str. 2457T
auguuuaguauuguuaaa

SEQ ID NO: 3863763 - RNA, 22 nt, Shigella flexneri 2a str. 2457T
auguuuaguauuguuaaauauu

SEQ ID NO: 3863764 - RNA, 14 nt, Shigella flexneri 2a str. 2457T
auguuuaucuacag

SEQ ID NO: 3863765 - RNA, 16 nt, Shigella flexneri 2a str. 2457T
auguuuaugccugguu

SEQ ID NO: 3863766 - RNA, 19 nt, Shigella flexneri 2a str. 2457T
auguuucaacggaccaaua

SEQ ID NO: 3863767 - RNA, 17 nt, Shigella flexneri 2a str. 2457T
auguuucuucaacaccc

SEQ ID NO: 3863768 - RNA, 17 nt, Shigella flexneri 2a str. 2457T
auguuugaaccagauau

SEQ ID NO: 3863769 - RNA, 12 nt, Shigella flexneri 2a str. 2457T
auguuugcaaua

SEQ ID NO: 3863770 - RNA, 23 nt, Shigella flexneri 2a str. 2457T
auguuugucacugacuauuuccg

SEQ ID NO: 3863771 - RNA, 23 nt, Shigella flexneri 2a str. 2457T
auguuuuaacacacaauuaccuu

SEQ ID NO: 3863772 - RNA, 17 nt, Shigella flexneri 2a str. 2457T
auuaaacacgggguuaa

SEQ ID NO: 3863773 - RNA, 17 nt, Shigella flexneri 2a str. 2457T
auuaaaccuaaaaagaa

SEQ ID NO: 3863774 - RNA, 19 nt, Shigella flexneri 2a str. 2457T
auuaaaccuaaaaagaaaa

SEQ ID NO: 3863775 - RNA, 19 nt, Shigella flexneri 2a str. 2457T
auuaaacgcaguaagcgcc

SEQ ID NO: 3863776 - RNA, 19 nt, Shigella flexneri 2a str. 2457T
auuaaacgccauccggcag

SEQ ID NO: 3863777 - RNA, 14 nt, Shigella flexneri 2a str. 2457T
auuaaagaaaauaa

SEQ ID NO: 3863778 - RNA, 20 nt, Shigella flexneri 2a str. 2457T
auuaaagcaucugccagcca

SEQ ID NO: 3863779 - RNA, 23 nt, Shigella flexneri 2a str. 2457T
auuaaagcaucugccagccauaa

SEQ ID NO: 3863780 - RNA, 21 nt, Shigella flexneri 2a str. 2457T
auuaaaggaaggucauccaaa

SEQ ID NO: 3863781 - RNA, 18 nt, Shigella flexneri 2a str. 2457T
auuaaauccugaaaccau

SEQ ID NO: 3863782 - RNA, 22 nt, Shigella flexneri 2a str. 2457T
auuaaauucgaacggugaauuc

SEQ ID NO: 3863783 - RNA, 12 nt, Shigella flexneri 2a str. 2457T
auuaaauugucu

SEQ ID NO: 3863784 - RNA, 16 nt, Shigella flexneri 2a str. 2457T
auuaacaacguuuuuc

SEQ ID NO: 3863785 - RNA, 17 nt, Shigella flexneri 2a str. 2457T
auuaacaacguuuuucu

SEQ ID NO: 3863786 - RNA, 23 nt, Shigella flexneri 2a str. 2457T
auuaacaccuagugcagauaguu

SEQ ID NO: 3863787 - RNA, 17 nt, Shigella flexneri 2a str. 2457T
auuaacaggugucacau

SEQ ID NO: 3863788 - RNA, 21 nt, Shigella flexneri 2a str. 2457T
auuaaccagccacugcgccau

SEQ ID NO: 3863789 - RNA, 22 nt, Shigella flexneri 2a str. 2457T
auuaaccgggcguuauuuccag

SEQ ID NO: 3863790 - RNA, 20 nt, Shigella flexneri 2a str. 2457T
auuaacgacacucucuucaa

SEQ ID NO: 3863791 - RNA, 14 nt, Shigella flexneri 2a str. 2457T
auuaacgcugggga

SEQ ID NO: 3863792 - RNA, 17 nt, Shigella flexneri 2a str. 2457T
auuaacgugaucaaauc

SEQ ID NO: 3863793 - RNA, 20 nt, Shigella flexneri 2a str. 2457T
auuaacugcgcgauuaucau

SEQ ID NO: 3863794 - RNA, 22 nt, Shigella flexneri 2a str. 2457T
auuaacugcgcgauuaucauuu

SEQ ID NO: 3863795 - RNA, 13 nt, Shigella flexneri 2a str. 2457T
auuaacuguucug

SEQ ID NO: 3863796 - RNA, 21 nt, Shigella flexneri 2a str. 2457T
auuaagccaugaaugauguaa

SEQ ID NO: 3863797 - RNA, 14 nt, Shigella flexneri 2a str. 2457T
auuaagcgucggua

SEQ ID NO: 3863798 - RNA, 15 nt, Shigella flexneri 2a str. 2457T
auuaaggcaagaaaa

SEQ ID NO: 3863799 - RNA, 16 nt, Shigella flexneri 2a str. 2457T
auuaaggcaagaaaau

SEQ ID NO: 3863800 - RNA, 24 nt, Shigella flexneri 2a str. 2457T
auuaaguaaugcggcaagggcgaa

SEQ ID NO: 3863801 - RNA, 13 nt, Shigella flexneri 2a str. 2457T
auuaauaacacau

SEQ ID NO: 3863802 - RNA, 20 nt, Shigella flexneri 2a str. 2457T
auuaauacaacaacacccau

SEQ ID NO: 3863803 - RNA, 18 nt, Shigella flexneri 2a str. 2457T
auuaauaugcucaacaau

SEQ ID NO: 3863804 - RNA, 19 nt, Shigella flexneri 2a str. 2457T
auuaauccagggaucaaca

SEQ ID NO: 3863805 - RNA, 22 nt, Shigella flexneri 2a str. 2457T
auuaaucccugcuucggucaga

SEQ ID NO: 3863806 - RNA, 20 nt, Shigella flexneri 2a str. 2457T
auuaaucgauaaaccagcaa

SEQ ID NO: 3863807 - RNA, 11 nt, Shigella flexneri 2a str. 2457T
auuaaugacau

SEQ ID NO: 3863808 - RNA, 21 nt, Shigella flexneri 2a str. 2457T
auuaaugacauucaggccgcc

SEQ ID NO: 3863809 - RNA, 21 nt, Shigella flexneri 2a str. 2457T
auuaaugcgcccagcgucagc

SEQ ID NO: 3863810 - RNA, 22 nt, Shigella flexneri 2a str. 2457T
auuaaugcgcuuuuacggcuuu

SEQ ID NO: 3863811 - RNA, 21 nt, Shigella flexneri 2a str. 2457T
auuaauuaacaacguuuuucu

SEQ ID NO: 3863812 - RNA, 20 nt, Shigella flexneri 2a str. 2457T
auuaauugccguuaaaacua

SEQ ID NO: 3863813 - RNA, 22 nt, Shigella flexneri 2a str. 2457T
auuaauugccguuaaaacuaaa

SEQ ID NO: 3863814 - RNA, 22 nt, Shigella flexneri 2a str. 2457T
auuacaacguauuauauauaau

SEQ ID NO: 3863815 - RNA, 20 nt, Shigella flexneri 2a str. 2457T
auuacaagaaucaugccaaa

SEQ ID NO: 3863816 - RNA, 13 nt, Shigella flexneri 2a str. 2457T
auuacacagccac

SEQ ID NO: 3863817 - RNA, 14 nt, Shigella flexneri 2a str. 2457T
auuacacagccaca

SEQ ID NO: 3863818 - RNA, 21 nt, Shigella flexneri 2a str. 2457T
auuacacccugaugugaugcc

SEQ ID NO: 3863819 - RNA, 19 nt, Shigella flexneri 2a str. 2457T
auuacacgcggcuguugcc

SEQ ID NO: 3863820 - RNA, 18 nt, Shigella flexneri 2a str. 2457T
auuacagagguuuuauga

SEQ ID NO: 3863821 - RNA, 12 nt, Shigella flexneri 2a str. 2457T
auuacagcucau

SEQ ID NO: 3863822 - RNA, 15 nt, Shigella flexneri 2a str. 2457T
auuacaugcuggugu

SEQ ID NO: 3863823 - RNA, 19 nt, Shigella flexneri 2a str. 2457T
auuaccaauaucaaauaaa

SEQ ID NO: 3863824 - RNA, 19 nt, Shigella flexneri 2a str. 2457T
auuaccaccggauaaaggc

SEQ ID NO: 3863825 - RNA, 16 nt, Shigella flexneri 2a str. 2457T
auuacccauauccaga

SEQ ID NO: 3863826 - RNA, 22 nt, Shigella flexneri 2a str. 2457T
auuacccgccucgcaaauucca

SEQ ID NO: 3863827 - RNA, 23 nt, Shigella flexneri 2a str. 2457T
auuacccugcacguuggcgcaua

SEQ ID NO: 3863828 - RNA, 21 nt, Shigella flexneri 2a str. 2457T
auuaccgcaccaccagcagcu

SEQ ID NO: 3863829 - RNA, 19 nt, Shigella flexneri 2a str. 2457T
auuaccgccaccaggaacg

SEQ ID NO: 3863830 - RNA, 18 nt, Shigella flexneri 2a str. 2457T
auuaccgccacuaucgcc

SEQ ID NO: 3863831 - RNA, 13 nt, Shigella flexneri 2a str. 2457T
auucaaucucuuc

SEQ ID NO: 3863832 - RNA, 15 nt, Shigella flexneri 2a str. 2457T
auucaaucucuucac

SEQ ID NO: 3863833 - RNA, 16 nt, Shigella flexneri 2a str. 2457T
auucaaucucuucaca

SEQ ID NO: 3863834 - RNA, 15 nt, Shigella flexneri 2a str. 2457T
auucaauuauaguau

SEQ ID NO: 3863835 - RNA, 19 nt, Shigella flexneri 2a str. 2457T
auucaauuauaguaucguu

SEQ ID NO: 3863836 - RNA, 12 nt, Shigella flexneri 2a str. 2457T
auucacauuuaa

SEQ ID NO: 3863837 - RNA, 14 nt, Shigella flexneri 2a str. 2457T
auucacauuuaaac

SEQ ID NO: 3863838 - RNA, 14 nt, Shigella flexneri 2a str. 2457T
auucaccagcaaau

SEQ ID NO: 3863839 - RNA, 19 nt, Shigella flexneri 2a str. 2457T
auucaccgauacaaucauu

SEQ ID NO: 3863840 - RNA, 11 nt, Shigella flexneri 2a str. 2457T
auucaccucug

SEQ ID NO: 3863841 - RNA, 19 nt, Shigella flexneri 2a str. 2457T
auucacgaauauuucccgg

SEQ ID NO: 3863842 - RNA, 17 nt, Shigella flexneri 2a str. 2457T
auucacgaaucuauuca

SEQ ID NO: 3863843 - RNA, 21 nt, Shigella flexneri 2a str. 2457T
auucacgccgcauccggcauc

SEQ ID NO: 3863844 - RNA, 18 nt, Shigella flexneri 2a str. 2457T
auucacgcuaucuuucaa

SEQ ID NO: 3863845 - RNA, 16 nt, Shigella flexneri 2a str. 2457T
auucacguugauggua

SEQ ID NO: 3863846 - RNA, 21 nt, Shigella flexneri 2a str. 2457T
auucacucuauaccgcugaag

SEQ ID NO: 3863847 - RNA, 14 nt, Shigella flexneri 2a str. 2457T
auucacuggcaccg

SEQ ID NO: 3863848 - RNA, 17 nt, Shigella flexneri 2a str. 2457T
auucacuugaaguacga

SEQ ID NO: 3863849 - RNA, 17 nt, Shigella flexneri 2a str. 2457T
auucacuuucugaagga

SEQ ID NO: 3863850 - RNA, 17 nt, Shigella flexneri 2a str. 2457T
auucagaaaaauacaau

SEQ ID NO: 3863851 - RNA, 21 nt, Shigella flexneri 2a str. 2457T
auucagacacgccgccagacc

SEQ ID NO: 3863852 - RNA, 22 nt, Shigella flexneri 2a str. 2457T
auucagacaggcgaaacccgcu

SEQ ID NO: 3863853 - RNA, 23 nt, Shigella flexneri 2a str. 2457T
auucagagggcaaauucuucacg

SEQ ID NO: 3863854 - RNA, 23 nt, Shigella flexneri 2a str. 2457T
auucagauaauccccaaugaccu

SEQ ID NO: 3863855 - RNA, 17 nt, Shigella flexneri 2a str. 2457T
auucagaucgguuuuuu

SEQ ID NO: 3863856 - RNA, 13 nt, Shigella flexneri 2a str. 2457T
auucagauuaugu

SEQ ID NO: 3863857 - RNA, 20 nt, Shigella flexneri 2a str. 2457T
auucagcaauguuucucugg

SEQ ID NO: 3863858 - RNA, 18 nt, Shigella flexneri 2a str. 2457T
auucagcagcagacagcc

SEQ ID NO: 3863859 - RNA, 21 nt, Shigella flexneri 2a str. 2457T
auucagcagcagcaagauauu

SEQ ID NO: 3863860 - RNA, 14 nt, Shigella flexneri 2a str. 2457T
auucagcccggcaa

SEQ ID NO: 3863861 - RNA, 22 nt, Shigella flexneri 2a str. 2457T
auucagcgaguuuuucagucca

SEQ ID NO: 3863862 - RNA, 17 nt, Shigella flexneri 2a str. 2457T
auucagcguaucaauua

SEQ ID NO: 3863863 - RNA, 20 nt, Shigella flexneri 2a str. 2457T
auucagcgucgcgguugcug

SEQ ID NO: 3863864 - RNA, 20 nt, Shigella flexneri 2a str. 2457T
auucagcgucgucagcaguu

SEQ ID NO: 3863865 - RNA, 23 nt, Shigella flexneri 2a str. 2457T
auucagcgucgucagcaguucac

SEQ ID NO: 3863866 - RNA, 15 nt, Shigella flexneri 2a str. 2457T
auucagcgucucacu

SEQ ID NO: 3863867 - RNA, 15 nt, Shigella flexneri 2a str. 2457T
auucagcucaagaau

SEQ ID NO: 3863868 - RNA, 20 nt, Shigella flexneri 2a str. 2457T
auucaggccaaagccgccga

SEQ ID NO: 3863869 - RNA, 20 nt, Shigella flexneri 2a str. 2457T
auucaggcguugaaaaauca

SEQ ID NO: 3863870 - RNA, 16 nt, Shigella flexneri 2a str. 2457T
auucagguaauuaaca

SEQ ID NO: 3863871 - RNA, 18 nt, Shigella flexneri 2a str. 2457T
auucagugacagguugcu

SEQ ID NO: 3863872 - RNA, 22 nt, Shigella flexneri 2a str. 2457T
auucagugcaaaugccagauaa

SEQ ID NO: 3863873 - RNA, 23 nt, Shigella flexneri 2a str. 2457T
auucaguucaacggugugagcac

SEQ ID NO: 3863874 - RNA, 16 nt, Shigella flexneri 2a str. 2457T
auucauaaugcccagc

SEQ ID NO: 3863875 - RNA, 20 nt, Shigella flexneri 2a str. 2457T
auucauacagcggccagcca

SEQ ID NO: 3863876 - RNA, 21 nt, Shigella flexneri 2a str. 2457T
auucauacagcggccagccau

SEQ ID NO: 3863877 - RNA, 19 nt, Shigella flexneri 2a str. 2457T
auucauaucaaacgccuga

SEQ ID NO: 3863878 - RNA, 12 nt, Shigella flexneri 2a str. 2457T
auucaucaauuc

SEQ ID NO: 3863879 - RNA, 16 nt, Shigella flexneri 2a str. 2457T
auucaucgccuucuug

SEQ ID NO: 3863880 - RNA, 15 nt, Shigella flexneri 2a str. 2457T
auucauggugaauau

SEQ ID NO: 3863881 - RNA, 14 nt, Shigella flexneri 2a str. 2457T
auucauuaaaacug

SEQ ID NO: 3863882 - RNA, 22 nt, Shigella flexneri 2a str. 2457T
auucauuacuuaacgucaaacg

SEQ ID NO: 3863883 - RNA, 16 nt, Shigella flexneri 2a str. 2457T
auucauuaguuuggcc

SEQ ID NO: 3863884 - RNA, 17 nt, Shigella flexneri 2a str. 2457T
auucauuguucucccau

SEQ ID NO: 3863885 - RNA, 19 nt, Shigella flexneri 2a str. 2457T
auucauuuugcuggaaaag

SEQ ID NO: 3863886 - RNA, 21 nt, Shigella flexneri 2a str. 2457T
auucauuuugcuggaaaagua

SEQ ID NO: 3863887 - RNA, 22 nt, Shigella flexneri 2a str. 2457T
auucauuuugcuggaaaaguaa

SEQ ID NO: 3863888 - RNA, 18 nt, Shigella flexneri 2a str. 2457T
auuccaccgaaacuuuua

SEQ ID NO: 3863889 - RNA, 19 nt, Shigella flexneri 2a str. 2457T
auuccacgauaaaauuccu

SEQ ID NO: 3863890 - RNA, 14 nt, Shigella flexneri 2a str. 2457T
auuccacucauuaa

SEQ ID NO: 3863891 - RNA, 16 nt, Shigella flexneri 2a str. 2457T
auuccagcaagccacu

SEQ ID NO: 3863892 - RNA, 15 nt, Shigella flexneri 2a str. 2457T
auuccagcgccgcca

SEQ ID NO: 3863893 - RNA, 15 nt, Shigella flexneri 2a str. 2457T
auuccagugccgcau

SEQ ID NO: 3863894 - RNA, 21 nt, Shigella flexneri 2a str. 2457T
auuccaguucgaucucuucgc

SEQ ID NO: 3863895 - RNA, 20 nt, Shigella flexneri 2a str. 2457T
auuccaucaccuuccacaua

SEQ ID NO: 3863896 - RNA, 22 nt, Shigella flexneri 2a str. 2457T
auuccauccugcucaaguaaua

SEQ ID NO: 3863897 - RNA, 15 nt, Shigella flexneri 2a str. 2457T
auuccauuucccuga

SEQ ID NO: 3863898 - RNA, 21 nt, Shigella flexneri 2a str. 2457T
auucccagcaccuguugugcg

SEQ ID NO: 3863899 - RNA, 22 nt, Shigella flexneri 2a str. 2457T
auucccagucgcgcaauugcca

SEQ ID NO: 3863900 - RNA, 13 nt, Shigella flexneri 2a str. 2457T
auucccauuuauu

SEQ ID NO: 3863901 - RNA, 17 nt, Shigella flexneri 2a str. 2457T
auucccccuuugaccag

SEQ ID NO: 3863902 - RNA, 15 nt, Shigella flexneri 2a str. 2457T
auucccgcagcucca

SEQ ID NO: 3863903 - RNA, 16 nt, Shigella flexneri 2a str. 2457T
auucccgccagcggcc

SEQ ID NO: 3863904 - RNA, 16 nt, Shigella flexneri 2a str. 2457T
auucccggaaauugcc

SEQ ID NO: 3863905 - RNA, 22 nt, Shigella flexneri 2a str. 2457T
auucccugcagucaccugcccu

SEQ ID NO: 3863906 - RNA, 12 nt, Shigella flexneri 2a str. 2457T
auuccgaaucca

SEQ ID NO: 3863907 - RNA, 20 nt, Shigella flexneri 2a str. 2457T
auuccgaauuucauccugua

SEQ ID NO: 3863908 - RNA, 17 nt, Shigella flexneri 2a str. 2457T
auuccgcacgaacuacc

SEQ ID NO: 3863909 - RNA, 19 nt, Shigella flexneri 2a str. 2457T
auuccgggaauucgaagcu

SEQ ID NO: 3863910 - RNA, 22 nt, Shigella flexneri 2a str. 2457T
auuccggugaccaguuauuugg

SEQ ID NO: 3863911 - RNA, 14 nt, Shigella flexneri 2a str. 2457T
auuccguuucucca

SEQ ID NO: 3863912 - RNA, 20 nt, Shigella flexneri 2a str. 2457T
auuccuaaaguuguuuucuu

SEQ ID NO: 3863913 - RNA, 21 nt, Shigella flexneri 2a str. 2457T
auuccuaaaguuguuuucuug

SEQ ID NO: 3863914 - RNA, 20 nt, Shigella flexneri 2a str. 2457T
auuccuaugcaacaacugaa

SEQ ID NO: 3863915 - RNA, 17 nt, Shigella flexneri 2a str. 2457T
auuccuccgguagccau

SEQ ID NO: 3863916 - RNA, 10 nt, Shigella flexneri 2a str. 2457T
auuccucuca

SEQ ID NO: 3863917 - RNA, 17 nt, Shigella flexneri 2a str. 2457T
auuccugacccagcacc

SEQ ID NO: 3863918 - RNA, 18 nt, Shigella flexneri 2a str. 2457T
auuccugacccagcacca

SEQ ID NO: 3863919 - RNA, 23 nt, Shigella flexneri 2a str. 2457T
auuccugacguaacgaccaccac

SEQ ID NO: 3863920 - RNA, 17 nt, Shigella flexneri 2a str. 2457T
auuccugcugacggcac

SEQ ID NO: 3863921 - RNA, 20 nt, Shigella flexneri 2a str. 2457T
auuccuggggucaucagcau

SEQ ID NO: 3863922 - RNA, 16 nt, Shigella flexneri 2a str. 2457T
auuccuuaugguucac

SEQ ID NO: 3863923 - RNA, 21 nt, Shigella flexneri 2a str. 2457T
auucgaaauagagaaaguaaa

SEQ ID NO: 3863924 - RNA, 15 nt, Shigella flexneri 2a str. 2457T
auucgagaagcccau

SEQ ID NO: 3863925 - RNA, 12 nt, Shigella flexneri 2a str. 2457T
auucgccagcac

SEQ ID NO: 3863926 - RNA, 18 nt, Shigella flexneri 2a str. 2457T
auucgccgguuccagcuu

SEQ ID NO: 3863927 - RNA, 16 nt, Shigella flexneri 2a str. 2457T
auucgccucgacgccu

SEQ ID NO: 3863928 - RNA, 21 nt, Shigella flexneri 2a str. 2457T
auugcaggguuuuguuuaaau

SEQ ID NO: 3863929 - RNA, 22 nt, Shigella flexneri 2a str. 2457T
auugcaggguuuuguuuaaaua

SEQ ID NO: 3863930 - RNA, 21 nt, Shigella flexneri 2a str. 2457T
auugcauauuucaacgacgcu

SEQ ID NO: 3863931 - RNA, 18 nt, Shigella flexneri 2a str. 2457T
auugccacuucguaacca

SEQ ID NO: 3863932 - RNA, 17 nt, Shigella flexneri 2a str. 2457T
auugccccacaccgcga

SEQ ID NO: 3863933 - RNA, 21 nt, Shigella flexneri 2a str. 2457T
auugcccgaagccaauuugcg

SEQ ID NO: 3863934 - RNA, 22 nt, Shigella flexneri 2a str. 2457T
auugcccggucaggauggccgg

SEQ ID NO: 3863935 - RNA, 22 nt, Shigella flexneri 2a str. 2457T
auugcccuguuugucgaucauc

SEQ ID NO: 3863936 - RNA, 16 nt, Shigella flexneri 2a str. 2457T
auugccgaagaccaga

SEQ ID NO: 3863937 - RNA, 15 nt, Shigella flexneri 2a str. 2457T
auugccgcagcgauu

SEQ ID NO: 3863938 - RNA, 16 nt, Shigella flexneri 2a str. 2457T
auugccgccagcucac

SEQ ID NO: 3863939 - RNA, 20 nt, Shigella flexneri 2a str. 2457T
auugccgcgucguccucuuc

SEQ ID NO: 3863940 - RNA, 23 nt, Shigella flexneri 2a str. 2457T
auugccgcgucguccucuucacc

SEQ ID NO: 3863941 - RNA, 12 nt, Shigella flexneri 2a str. 2457T
auugccggaaug

SEQ ID NO: 3863942 - RNA, 16 nt, Shigella flexneri 2a str. 2457T
auugccgggcgcauca

SEQ ID NO: 3863943 - RNA, 22 nt, Shigella flexneri 2a str. 2457T
auugccguggauuuaaugccaa

SEQ ID NO: 3863944 - RNA, 17 nt, Shigella flexneri 2a str. 2457T
auugccguugauaaaga

SEQ ID NO: 3863945 - RNA, 15 nt, Shigella flexneri 2a str. 2457T
auugccugauggccu

SEQ ID NO: 3863946 - RNA, 14 nt, Shigella flexneri 2a str. 2457T
auugcgaauuccuu

SEQ ID NO: 3863947 - RNA, 17 nt, Shigella flexneri 2a str. 2457T
auugcgaauuccuucac

SEQ ID NO: 3863948 - RNA, 16 nt, Shigella flexneri 2a str. 2457T
auugcgcaccagcuug

SEQ ID NO: 3863949 - RNA, 18 nt, Shigella flexneri 2a str. 2457T
auugcgcagagaugccca

SEQ ID NO: 3863950 - RNA, 14 nt, Shigella flexneri 2a str. 2457T
auugcgccugcagg

SEQ ID NO: 3863951 - RNA, 21 nt, Shigella flexneri 2a str. 2457T
auugcggaacaucgccugccg

SEQ ID NO: 3863952 - RNA, 16 nt, Shigella flexneri 2a str. 2457T
auugcggaacggcagc

SEQ ID NO: 3863953 - RNA, 22 nt, Shigella flexneri 2a str. 2457T
auugcggcggcgcaaagcgacg

SEQ ID NO: 3863954 - RNA, 16 nt, Shigella flexneri 2a str. 2457T
auugcguaaucuuuuc

SEQ ID NO: 3863955 - RNA, 21 nt, Shigella flexneri 2a str. 2457T
auugcguccaggcccaggcau

SEQ ID NO: 3863956 - RNA, 18 nt, Shigella flexneri 2a str. 2457T
auugcgugucccacuggu

SEQ ID NO: 3863957 - RNA, 13 nt, Shigella flexneri 2a str. 2457T
auugcuccaucca

SEQ ID NO: 3863958 - RNA, 16 nt, Shigella flexneri 2a str. 2457T
auugcucgacaagaua

SEQ ID NO: 3863959 - RNA, 12 nt, Shigella flexneri 2a str. 2457T
auugcugaaaua

SEQ ID NO: 3863960 - RNA, 24 nt, Shigella flexneri 2a str. 2457T
auugcugaaguuauaagcguuacg

SEQ ID NO: 3863961 - RNA, 17 nt, Shigella flexneri 2a str. 2457T
auugcugaugcaccuuc

SEQ ID NO: 3863962 - RNA, 18 nt, Shigella flexneri 2a str. 2457T
auugcugcacauccggua

SEQ ID NO: 3863963 - RNA, 11 nt, Shigella flexneri 2a str. 2457T
auugcugccag

SEQ ID NO: 3863964 - RNA, 22 nt, Shigella flexneri 2a str. 2457T
auugcugguacuuucacaggga

SEQ ID NO: 3863965 - RNA, 17 nt, Shigella flexneri 2a str. 2457T
auugcuguaaauugccg

SEQ ID NO: 3863966 - RNA, 15 nt, Shigella flexneri 2a str. 2457T
auugcuucaguugcc

SEQ ID NO: 3863967 - RNA, 13 nt, Shigella flexneri 2a str. 2457T
auuggaauacaua

SEQ ID NO: 3863968 - RNA, 14 nt, Shigella flexneri 2a str. 2457T
auuggaauacauau

SEQ ID NO: 3863969 - RNA, 16 nt, Shigella flexneri 2a str. 2457T
auuggaauacauauau

SEQ ID NO: 3863970 - RNA, 18 nt, Shigella flexneri 2a str. 2457T
auuggacgguaaaaagaa

SEQ ID NO: 3863971 - RNA, 22 nt, Shigella flexneri 2a str. 2457T
auuggagacugaugacaaacgc

SEQ ID NO: 3863972 - RNA, 20 nt, Shigella flexneri 2a str. 2457T
auuggagaguugcaccagca

SEQ ID NO: 3863973 - RNA, 14 nt, Shigella flexneri 2a str. 2457T
auuggaguaucacc

SEQ ID NO: 3863974 - RNA, 16 nt, Shigella flexneri 2a str. 2457T
auuggaguaucaccau

SEQ ID NO: 3863975 - RNA, 24 nt, Shigella flexneri 2a str. 2457T
auuggcauccgugguggcagccag

SEQ ID NO: 3863976 - RNA, 14 nt, Shigella flexneri 2a str. 2457T
auuggcaucgccag

SEQ ID NO: 3863977 - RNA, 23 nt, Shigella flexneri 2a str. 2457T
auuggcggcguccuggaacuggu

SEQ ID NO: 3863978 - RNA, 15 nt, Shigella flexneri 2a str. 2457T
auuggcuucauugau

SEQ ID NO: 3863979 - RNA, 19 nt, Shigella flexneri 2a str. 2457T
auugggaugccgaaaaaag

SEQ ID NO: 3863980 - RNA, 16 nt, Shigella flexneri 2a str. 2457T
auugggcgaaagaaaa

SEQ ID NO: 3863981 - RNA, 15 nt, Shigella flexneri 2a str. 2457T
auugggcgaucuccc

SEQ ID NO: 3863982 - RNA, 15 nt, Shigella flexneri 2a str. 2457T
auugggguuacgacc

SEQ ID NO: 3863983 - RNA, 14 nt, Shigella flexneri 2a str. 2457T
auuggguucaucug

SEQ ID NO: 3863984 - RNA, 17 nt, Shigella flexneri 2a str. 2457T
auugguaaacucaaagu

SEQ ID NO: 3863985 - RNA, 14 nt, Shigella flexneri 2a str. 2457T
auugguaaugacuc

SEQ ID NO: 3863986 - RNA, 15 nt, Shigella flexneri 2a str. 2457T
auugguagacgcacc

SEQ ID NO: 3863987 - RNA, 18 nt, Shigella flexneri 2a str. 2457T
auugguaguguguuugau

SEQ ID NO: 3863988 - RNA, 21 nt, Shigella flexneri 2a str. 2457T
auugguaguguguuugaucac

SEQ ID NO: 3863989 - RNA, 15 nt, Shigella flexneri 2a str. 2457T
auugguccaucuuuu

SEQ ID NO: 3863990 - RNA, 14 nt, Shigella flexneri 2a str. 2457T
auuggucuggaacu

SEQ ID NO: 3863991 - RNA, 17 nt, Shigella flexneri 2a str. 2457T
auuggucuggaacuggc

SEQ ID NO: 3863992 - RNA, 22 nt, Shigella flexneri 2a str. 2457T
auuggucuggaacuggcugcca

SEQ ID NO: 3863993 - RNA, 14 nt, Shigella flexneri 2a str. 2457T
auuguagaaaaucu

SEQ ID NO: 3863994 - RNA, 16 nt, Shigella flexneri 2a str. 2457T
auuguagaaaaucuca

SEQ ID NO: 3863995 - RNA, 15 nt, Shigella flexneri 2a str. 2457T
auugucagcuggugg

SEQ ID NO: 3863996 - RNA, 17 nt, Shigella flexneri 2a str. 2457T
auugucgcagaagccac

SEQ ID NO: 3863997 - RNA, 14 nt, Shigella flexneri 2a str. 2457T
auugucgccacaaa

SEQ ID NO: 3863998 - RNA, 17 nt, Shigella flexneri 2a str. 2457T
auugucgccacaaacgc

SEQ ID NO: 3863999 - RNA, 20 nt, Shigella flexneri 2a str. 2457T
auugucuaaagguccauucu

SEQ ID NO: 3864000 - RNA, 21 nt, Shigella flexneri 2a str. 2457T
auugucuaugaacacgaucuc

SEQ ID NO: 3864001 - RNA, 16 nt, Shigella flexneri 2a str. 2457T
auugucuccgcugaga

SEQ ID NO: 3864002 - RNA, 15 nt, Shigella flexneri 2a str. 2457T
auugugauaaaaauc

SEQ ID NO: 3864003 - RNA, 21 nt, Shigella flexneri 2a str. 2457T
auugugcgcgauccggcggug

SEQ ID NO: 3864004 - RNA, 22 nt, Shigella flexneri 2a str. 2457T
auugugcucacuacggcucagu

SEQ ID NO: 3864005 - RNA, 21 nt, Shigella flexneri 2a str. 2457T
auugugguccgcuuguaggcc

SEQ ID NO: 3864006 - RNA, 15 nt, Shigella flexneri 2a str. 2457T
auuguggugaucacc

SEQ ID NO: 3864007 - RNA, 14 nt, Shigella flexneri 2a str. 2457T
auuguguaaauuca

SEQ ID NO: 3864008 - RNA, 21 nt, Shigella flexneri 2a str. 2457T
auuguguaaauucaauaaauu

SEQ ID NO: 3864009 - RNA, 18 nt, Shigella flexneri 2a str. 2457T
auugugugauacuucuuc

SEQ ID NO: 3864010 - RNA, 21 nt, Shigella flexneri 2a str. 2457T
auuguuaacgccgcgccgugc

SEQ ID NO: 3864011 - RNA, 18 nt, Shigella flexneri 2a str. 2457T
auuguuauaccaguccac

SEQ ID NO: 3864012 - RNA, 21 nt, Shigella flexneri 2a str. 2457T
auuguuaucguuugcauuauc

SEQ ID NO: 3864013 - RNA, 22 nt, Shigella flexneri 2a str. 2457T
auuguucgcaccggugcugguc

SEQ ID NO: 3864014 - RNA, 20 nt, Shigella flexneri 2a str. 2457T
auuguucgggccgguuuuaa

SEQ ID NO: 3864015 - RNA, 21 nt, Shigella flexneri 2a str. 2457T
auuguucuguaugccggauaa

SEQ ID NO: 3864016 - RNA, 17 nt, Shigella flexneri 2a str. 2457T
auuguugauaaggaaau

SEQ ID NO: 3864017 - RNA, 22 nt, Shigella flexneri 2a str. 2457T
auuguugauaaggaaauucagc

SEQ ID NO: 3864018 - RNA, 17 nt, Shigella flexneri 2a str. 2457T
auuguuggcaaaaaaau

SEQ ID NO: 3864019 - RNA, 20 nt, Shigella flexneri 2a str. 2457T
auuguuggcaaaaaaauuca

SEQ ID NO: 3864020 - RNA, 18 nt, Shigella flexneri 2a str. 2457T
auuguuugucaugacgac

SEQ ID NO: 3864021 - RNA, 17 nt, Shigella flexneri 2a str. 2457T
auuguuuugaugaauca

SEQ ID NO: 3864022 - RNA, 12 nt, Shigella flexneri 2a str. 2457T
auuuaaaaagaa

SEQ ID NO: 3864023 - RNA, 20 nt, Shigella flexneri 2a str. 2457T
auuuaaaaccacuacccaua

SEQ ID NO: 3864024 - RNA, 20 nt, Shigella flexneri 2a str. 2457T
auuuaaacaauuucagaaua

SEQ ID NO: 3864025 - RNA, 13 nt, Shigella flexneri 2a str. 2457T
auuucgcagccau

SEQ ID NO: 3864026 - RNA, 18 nt, Shigella flexneri 2a str. 2457T
auuucgccacccagcgcc

SEQ ID NO: 3864027 - RNA, 12 nt, Shigella flexneri 2a str. 2457T
auuucgccgcac

SEQ ID NO: 3864028 - RNA, 14 nt, Shigella flexneri 2a str. 2457T
auuucgcuaccacc

SEQ ID NO: 3864029 - RNA, 21 nt, Shigella flexneri 2a str. 2457T
auuucggcagcgcgcucgcca

SEQ ID NO: 3864030 - RNA, 19 nt, Shigella flexneri 2a str. 2457T
auuucguagacugcagcgg

SEQ ID NO: 3864031 - RNA, 14 nt, Shigella flexneri 2a str. 2457T
auuucguccagcga

SEQ ID NO: 3864032 - RNA, 20 nt, Shigella flexneri 2a str. 2457T
auuucguccagcgaaccuuc

SEQ ID NO: 3864033 - RNA, 20 nt, Shigella flexneri 2a str. 2457T
auuucguccauguuggagau

SEQ ID NO: 3864034 - RNA, 17 nt, Shigella flexneri 2a str. 2457T
auuucuacacccagccc

SEQ ID NO: 3864035 - RNA, 17 nt, Shigella flexneri 2a str. 2457T
auuucucggcaaauuca

SEQ ID NO: 3864036 - RNA, 15 nt, Shigella flexneri 2a str. 2457T
auuucucgugccacc

SEQ ID NO: 3864037 - RNA, 21 nt, Shigella flexneri 2a str. 2457T
auuucucuuucguuccggcuu

SEQ ID NO: 3864038 - RNA, 22 nt, Shigella flexneri 2a str. 2457T
auuucugaaggaauauucaggc

SEQ ID NO: 3864039 - RNA, 18 nt, Shigella flexneri 2a str. 2457T
auuucugacugagcuggu

SEQ ID NO: 3864040 - RNA, 15 nt, Shigella flexneri 2a str. 2457T
auuucugccagcggg

SEQ ID NO: 3864041 - RNA, 17 nt, Shigella flexneri 2a str. 2457T
auuucugccuugaguuu

SEQ ID NO: 3864042 - RNA, 18 nt, Shigella flexneri 2a str. 2457T
auuucugcgggggcggca

SEQ ID NO: 3864043 - RNA, 23 nt, Shigella flexneri 2a str. 2457T
auuucugcugccacuuucucacu

SEQ ID NO: 3864044 - RNA, 15 nt, Shigella flexneri 2a str. 2457T
auuucuguauaauca

SEQ ID NO: 3864045 - RNA, 20 nt, Shigella flexneri 2a str. 2457T
auuucugugcagccaaaaau

SEQ ID NO: 3864046 - RNA, 17 nt, Shigella flexneri 2a str. 2457T
auuucuucauacuaccu

SEQ ID NO: 3864047 - RNA, 17 nt, Shigella flexneri 2a str. 2457T
auuucuuuacugacagg

SEQ ID NO: 3864048 - RNA, 15 nt, Shigella flexneri 2a str. 2457T
auuucuuugcgcucu

SEQ ID NO: 3864049 - RNA, 19 nt, Shigella flexneri 2a str. 2457T
auuucuuuugguugccguc

SEQ ID NO: 3864050 - RNA, 21 nt, Shigella flexneri 2a str. 2457T
auuugaaaugugguuucacuu

SEQ ID NO: 3864051 - RNA, 19 nt, Shigella flexneri 2a str. 2457T
auuugacccaucugccagc

SEQ ID NO: 3864052 - RNA, 14 nt, Shigella flexneri 2a str. 2457T
auuugacuguucua

SEQ ID NO: 3864053 - RNA, 13 nt, Shigella flexneri 2a str. 2457T
auuugagaucgga

SEQ ID NO: 3864054 - RNA, 17 nt, Shigella flexneri 2a str. 2457T
auuugaggaagcugccu

SEQ ID NO: 3864055 - RNA, 15 nt, Shigella flexneri 2a str. 2457T
auuugaguucacugc

SEQ ID NO: 3864056 - RNA, 16 nt, Shigella flexneri 2a str. 2457T
auuugaguucacugcc

SEQ ID NO: 3864057 - RNA, 17 nt, Shigella flexneri 2a str. 2457T
auuugaguucacugccg

SEQ ID NO: 3864058 - RNA, 13 nt, Shigella flexneri 2a str. 2457T
auuugauauuuau

SEQ ID NO: 3864059 - RNA, 14 nt, Shigella flexneri 2a str. 2457T
auuugaucucuuca

SEQ ID NO: 3864060 - RNA, 16 nt, Shigella flexneri 2a str. 2457T
auuugauugcagauuc

SEQ ID NO: 3864061 - RNA, 19 nt, Shigella flexneri 2a str. 2457T
auuugccgcagcaguugcc

SEQ ID NO: 3864062 - RNA, 15 nt, Shigella flexneri 2a str. 2457T
auuugccuaauaaau

SEQ ID NO: 3864063 - RNA, 20 nt, Shigella flexneri 2a str. 2457T
auuugccuaauaaaucuaaa

SEQ ID NO: 3864064 - RNA, 23 nt, Shigella flexneri 2a str. 2457T
auuugcgcgaugccgccguagaa

SEQ ID NO: 3864065 - RNA, 21 nt, Shigella flexneri 2a str. 2457T
auuugcgcucaauaaucaauc

SEQ ID NO: 3864066 - RNA, 17 nt, Shigella flexneri 2a str. 2457T
auuugcggucguaugcu

SEQ ID NO: 3864067 - RNA, 22 nt, Shigella flexneri 2a str. 2457T
auuugcggucguaugcuggaag

SEQ ID NO: 3864068 - RNA, 13 nt, Shigella flexneri 2a str. 2457T
auuugcuccagaa

SEQ ID NO: 3864069 - RNA, 16 nt, Shigella flexneri 2a str. 2457T
auuugcuccagcgaac

SEQ ID NO: 3864070 - RNA, 13 nt, Shigella flexneri 2a str. 2457T
auuugcugacaau

SEQ ID NO: 3864071 - RNA, 21 nt, Shigella flexneri 2a str. 2457T
auuugcuuguuucauuacucg

SEQ ID NO: 3864072 - RNA, 12 nt, Shigella flexneri 2a str. 2457T
auuuggaaagug

SEQ ID NO: 3864073 - RNA, 20 nt, Shigella flexneri 2a str. 2457T
auuuggcugccgagcaaauc

SEQ ID NO: 3864074 - RNA, 23 nt, Shigella flexneri 2a str. 2457T
auuuggguguaucuucagcugca

SEQ ID NO: 3864075 - RNA, 16 nt, Shigella flexneri 2a str. 2457T
auuuguagcuguugcu

SEQ ID NO: 3864076 - RNA, 22 nt, Shigella flexneri 2a str. 2457T
auuuguagcuguugcugaagaa

SEQ ID NO: 3864077 - RNA, 17 nt, Shigella flexneri 2a str. 2457T
auuuguaggccugauaa

SEQ ID NO: 3864078 - RNA, 18 nt, Shigella flexneri 2a str. 2457T
auuuguaguuugauaauu

SEQ ID NO: 3864079 - RNA, 15 nt, Shigella flexneri 2a str. 2457T
auuuguccacgccgc

SEQ ID NO: 3864080 - RNA, 13 nt, Shigella flexneri 2a str. 2457T
auuugucgaagau

SEQ ID NO: 3864081 - RNA, 17 nt, Shigella flexneri 2a str. 2457T
auuuguggugaagccac

SEQ ID NO: 3864082 - RNA, 12 nt, Shigella flexneri 2a str. 2457T
auuugugucaga

SEQ ID NO: 3864083 - RNA, 18 nt, Shigella flexneri 2a str. 2457T
auuuguuggcgaaaaucu

SEQ ID NO: 3864084 - RNA, 23 nt, Shigella flexneri 2a str. 2457T
auuuuaaacgucaacccuuuauc

SEQ ID NO: 3864085 - RNA, 21 nt, Shigella flexneri 2a str. 2457T
auuuuaaauuuccucuuguca

SEQ ID NO: 3864086 - RNA, 13 nt, Shigella flexneri 2a str. 2457T
auuuuagaaaaac

SEQ ID NO: 3864087 - RNA, 20 nt, Shigella flexneri 2a str. 2457T
auuuuaggaugcugcaauaa

SEQ ID NO: 3864088 - RNA, 22 nt, Shigella flexneri 2a str. 2457T
auuuuauugcguaaucuuuuca

SEQ ID NO: 3864089 - RNA, 16 nt, Shigella flexneri 2a str. 2457T
auuuuauuucuguauu

SEQ ID NO: 3864090 - RNA, 20 nt, Shigella flexneri 2a str. 2457T
auuuuauuucuguauuacag

SEQ ID NO: 3864091 - RNA, 22 nt, Shigella flexneri 2a str. 2457T
auuuucaaaauaucgacauuca

SEQ ID NO: 3864092 - RNA, 23 nt, Shigella flexneri 2a str. 2457T
auuuucaaaauaucgacauucaa

SEQ ID NO: 3864093 - RNA, 18 nt, Shigella flexneri 2a str. 2457T
auuuucaccagcaucgcc

SEQ ID NO: 3864094 - RNA, 18 nt, Shigella flexneri 2a str. 2457T
auuuucagcgugcccacg

SEQ ID NO: 3864095 - RNA, 22 nt, Shigella flexneri 2a str. 2457T
auuuucagcgugcccacguuca

SEQ ID NO: 3864096 - RNA, 20 nt, Shigella flexneri 2a str. 2457T
auuuucaggauggucaacgu

SEQ ID NO: 3864097 - RNA, 22 nt, Shigella flexneri 2a str. 2457T
auuuucccuucugagaucaaug

SEQ ID NO: 3864098 - RNA, 22 nt, Shigella flexneri 2a str. 2457T
auuuuccgugaagaauuugccc

SEQ ID NO: 3864099 - RNA, 18 nt, Shigella flexneri 2a str. 2457T
auuuuccuugaaaaagag

SEQ ID NO: 3864100 - RNA, 18 nt, Shigella flexneri 2a str. 2457T
auuuucgccaucucaaaa

SEQ ID NO: 3864101 - RNA, 17 nt, Shigella flexneri 2a str. 2457T
auuuucuauuuugcauu

SEQ ID NO: 3864102 - RNA, 21 nt, Shigella flexneri 2a str. 2457T
auuuucucgugccgccagcac

SEQ ID NO: 3864103 - RNA, 16 nt, Shigella flexneri 2a str. 2457T
auuuucugaaaaucau

SEQ ID NO: 3864104 - RNA, 19 nt, Shigella flexneri 2a str. 2457T
auuuucuucagcaguucag

SEQ ID NO: 3864105 - RNA, 15 nt, Shigella flexneri 2a str. 2457T
auuuucuuugacaaa

SEQ ID NO: 3864106 - RNA, 19 nt, Shigella flexneri 2a str. 2457T
auuuugaagucuuuuuuca

SEQ ID NO: 3864107 - RNA, 21 nt, Shigella flexneri 2a str. 2457T
auuuugacucggcucauuauu

SEQ ID NO: 3864108 - RNA, 16 nt, Shigella flexneri 2a str. 2457T
auuuugauggaagaaa

SEQ ID NO: 3864109 - RNA, 14 nt, Shigella flexneri 2a str. 2457T
auuuugcaaggcuu

SEQ ID NO: 3864110 - RNA, 18 nt, Shigella flexneri 2a str. 2457T
auuuugcaguaacaauau

SEQ ID NO: 3864111 - RNA, 13 nt, Shigella flexneri 2a str. 2457T
auuuugcauuuua

SEQ ID NO: 3864112 - RNA, 15 nt, Shigella flexneri 2a str. 2457T
auuuugcauuuuaaa

SEQ ID NO: 3864113 - RNA, 17 nt, Shigella flexneri 2a str. 2457T
auuuugcauuuuaaaug

SEQ ID NO: 3864114 - RNA, 15 nt, Shigella flexneri 2a str. 2457T
auuuugccagcauga

SEQ ID NO: 3864115 - RNA, 17 nt, Shigella flexneri 2a str. 2457T
auuuugccagcaugacu

SEQ ID NO: 3864116 - RNA, 13 nt, Shigella flexneri 2a str. 2457T
auuuugccaguua

SEQ ID NO: 3864117 - RNA, 23 nt, Shigella flexneri 2a str. 2457T
auuuugcgagcagcauuccggca

SEQ ID NO: 3864118 - RNA, 13 nt, Shigella flexneri 2a str. 2457T
auuuugcgcuucu

SEQ ID NO: 3864119 - RNA, 22 nt, Shigella flexneri 2a str. 2457T
auuuugcggcuauucuugaagu

SEQ ID NO: 3864120 - RNA, 18 nt, Shigella flexneri 2a str. 2457T
auuuugcguguuucagaa

SEQ ID NO: 3864121 - RNA, 18 nt, Shigella flexneri 2a str. 2457T
auuuugcugugcuuuaca

SEQ ID NO: 3864122 - RNA, 21 nt, Shigella flexneri 2a str. 2457T
caaaaucuucuaacgacauuu

SEQ ID NO: 3864123 - RNA, 15 nt, Shigella flexneri 2a str. 2457T
caaaaugcaucggca

SEQ ID NO: 3864124 - RNA, 21 nt, Shigella flexneri 2a str. 2457T
caaaaugcugcaauugcggca

SEQ ID NO: 3864125 - RNA, 22 nt, Shigella flexneri 2a str. 2457T
caaaaugguggagauaaacucc

SEQ ID NO: 3864126 - RNA, 15 nt, Shigella flexneri 2a str. 2457T
caaaauguugucauu

SEQ ID NO: 3864127 - RNA, 13 nt, Shigella flexneri 2a str. 2457T
caaaauguuuaug

SEQ ID NO: 3864128 - RNA, 17 nt, Shigella flexneri 2a str. 2457T
caaaauguuuaugccug

SEQ ID NO: 3864129 - RNA, 19 nt, Shigella flexneri 2a str. 2457T
caaaauguuuaugccuggu

SEQ ID NO: 3864130 - RNA, 13 nt, Shigella flexneri 2a str. 2457T
caaaauuagagau

SEQ ID NO: 3864131 - RNA, 22 nt, Shigella flexneri 2a str. 2457T
caaaauuuaacaccaucauauu

SEQ ID NO: 3864132 - RNA, 13 nt, Shigella flexneri 2a str. 2457T
caaacaagaucca

SEQ ID NO: 3864133 - RNA, 23 nt, Shigella flexneri 2a str. 2457T
caaacaauuuucauugaaaaagu

SEQ ID NO: 3864134 - RNA, 17 nt, Shigella flexneri 2a str. 2457T
caaacacaaaacugccu

SEQ ID NO: 3864135 - RNA, 20 nt, Shigella flexneri 2a str. 2457T
caaacacaaaacugccugau

SEQ ID NO: 3864136 - RNA, 16 nt, Shigella flexneri 2a str. 2457T
caaacacaauauucau

SEQ ID NO: 3864137 - RNA, 19 nt, Shigella flexneri 2a str. 2457T
caaacacaggcaaaacacu

SEQ ID NO: 3864138 - RNA, 18 nt, Shigella flexneri 2a str. 2457T
caaacaccgaaccagaga

SEQ ID NO: 3864139 - RNA, 22 nt, Shigella flexneri 2a str. 2457T
caaacacugaaccgaaauggcu

SEQ ID NO: 3864140 - RNA, 19 nt, Shigella flexneri 2a str. 2457T
caaacacuugcggcaccca

SEQ ID NO: 3864141 - RNA, 16 nt, Shigella flexneri 2a str. 2457T
caaacagaauauugug

SEQ ID NO: 3864142 - RNA, 12 nt, Shigella flexneri 2a str. 2457T
caaacagaccau

SEQ ID NO: 3864143 - RNA, 13 nt, Shigella flexneri 2a str. 2457T
caaacagcagaac

SEQ ID NO: 3864144 - RNA, 22 nt, Shigella flexneri 2a str. 2457T
caaacagcgccagauagccgac

SEQ ID NO: 3864145 - RNA, 21 nt, Shigella flexneri 2a str. 2457T
caaacagcgcgccagccacca

SEQ ID NO: 3864146 - RNA, 18 nt, Shigella flexneri 2a str. 2457T
caaacaggaacaccagca

SEQ ID NO: 3864147 - RNA, 17 nt, Shigella flexneri 2a str. 2457T
caaacaggcugcugcug

SEQ ID NO: 3864148 - RNA, 22 nt, Shigella flexneri 2a str. 2457T
caaacaguacaucuuccacuuu

SEQ ID NO: 3864149 - RNA, 19 nt, Shigella flexneri 2a str. 2457T
caaacagucgcccgaccau

SEQ ID NO: 3864150 - RNA, 23 nt, Shigella flexneri 2a str. 2457T
caaacaguguuuugacauuggca

SEQ ID NO: 3864151 - RNA, 23 nt, Shigella flexneri 2a str. 2457T
caaacaugacgcgcaucacgaca

SEQ ID NO: 3864152 - RNA, 19 nt, Shigella flexneri 2a str. 2457T
caaacauuagcgcaugacc

SEQ ID NO: 3864153 - RNA, 16 nt, Shigella flexneri 2a str. 2457T
caaacauugcugccag

SEQ ID NO: 3864154 - RNA, 16 nt, Shigella flexneri 2a str. 2457T
caaaccaacgcugucc

SEQ ID NO: 3864155 - RNA, 20 nt, Shigella flexneri 2a str. 2457T
caaaccaauuaugaauaacc

SEQ ID NO: 3864156 - RNA, 17 nt, Shigella flexneri 2a str. 2457T
caaaccacccagcagcg

SEQ ID NO: 3864157 - RNA, 14 nt, Shigella flexneri 2a str. 2457T
caaaccacgacgaa

SEQ ID NO: 3864158 - RNA, 18 nt, Shigella flexneri 2a str. 2457T
caaaccagaugaauagcg

SEQ ID NO: 3864159 - RNA, 21 nt, Shigella flexneri 2a str. 2457T
caaacccuuccauacagcuca

SEQ ID NO: 3864160 - RNA, 16 nt, Shigella flexneri 2a str. 2457T
caaacccuucuucaau

SEQ ID NO: 3864161 - RNA, 15 nt, Shigella flexneri 2a str. 2457T
caaaccgacugccug

SEQ ID NO: 3864162 - RNA, 11 nt, Shigella flexneri 2a str. 2457T
caaaccggacg

SEQ ID NO: 3864163 - RNA, 14 nt, Shigella flexneri 2a str. 2457T
caaaccucaccgcu

SEQ ID NO: 3864164 - RNA, 15 nt, Shigella flexneri 2a str. 2457T
caaaccucaccgcua

SEQ ID NO: 3864165 - RNA, 15 nt, Shigella flexneri 2a str. 2457T
caaaccucaggaaua

SEQ ID NO: 3864166 - RNA, 19 nt, Shigella flexneri 2a str. 2457T
caaaccugcaaugauguca

SEQ ID NO: 3864167 - RNA, 23 nt, Shigella flexneri 2a str. 2457T
caaaccuggcauguggcggcgcg

SEQ ID NO: 3864168 - RNA, 13 nt, Shigella flexneri 2a str. 2457T
caaacgacgcaga

SEQ ID NO: 3864169 - RNA, 21 nt, Shigella flexneri 2a str. 2457T
caaacgauuuuuuuaauaaua

SEQ ID NO: 3864170 - RNA, 15 nt, Shigella flexneri 2a str. 2457T
caaacgcaaaacugc

SEQ ID NO: 3864171 - RNA, 20 nt, Shigella flexneri 2a str. 2457T
caaacgcaaaacugccugau

SEQ ID NO: 3864172 - RNA, 20 nt, Shigella flexneri 2a str. 2457T
caaacgcaaaauugccugau

SEQ ID NO: 3864173 - RNA, 16 nt, Shigella flexneri 2a str. 2457T
caaacgcaaacaccag

SEQ ID NO: 3864174 - RNA, 17 nt, Shigella flexneri 2a str. 2457T
caaacgccacagcaauu

SEQ ID NO: 3864175 - RNA, 18 nt, Shigella flexneri 2a str. 2457T
caaacgccuagaugcuca

SEQ ID NO: 3864176 - RNA, 14 nt, Shigella flexneri 2a str. 2457T
caaacgcucccugc

SEQ ID NO: 3864177 - RNA, 19 nt, Shigella flexneri 2a str. 2457T
caaacgcugacauauuuuu

SEQ ID NO: 3864178 - RNA, 12 nt, Shigella flexneri 2a str. 2457T
caaacgcugacg

SEQ ID NO: 3864179 - RNA, 16 nt, Shigella flexneri 2a str. 2457T
caaacgcuuuacucaa

SEQ ID NO: 3864180 - RNA, 23 nt, Shigella flexneri 2a str. 2457T
caaacgcuuuacucaacuccccg

SEQ ID NO: 3864181 - RNA, 22 nt, Shigella flexneri 2a str. 2457T
caaacggaucgcguaaggcuuc

SEQ ID NO: 3864182 - RNA, 13 nt, Shigella flexneri 2a str. 2457T
caaacggcuggaa

SEQ ID NO: 3864183 - RNA, 20 nt, Shigella flexneri 2a str. 2457T
caaacgugacauucugacug

SEQ ID NO: 3864184 - RNA, 21 nt, Shigella flexneri 2a str. 2457T
caaacgugacauucugacugg

SEQ ID NO: 3864185 - RNA, 22 nt, Shigella flexneri 2a str. 2457T
caaacgugacauucugacuggu

SEQ ID NO: 3864186 - RNA, 16 nt, Shigella flexneri 2a str. 2457T
caaacucaauuaccaa

SEQ ID NO: 3864187 - RNA, 15 nt, Shigella flexneri 2a str. 2457T
caaacuccgcgacca

SEQ ID NO: 3864188 - RNA, 22 nt, Shigella flexneri 2a str. 2457T
caaacuccgcgaccacacucaa

SEQ ID NO: 3864189 - RNA, 19 nt, Shigella flexneri 2a str. 2457T
caaacuccgugaagcucac

SEQ ID NO: 3864190 - RNA, 18 nt, Shigella flexneri 2a str. 2457T
caaacucgcgcaggcuga

SEQ ID NO: 3864191 - RNA, 23 nt, Shigella flexneri 2a str. 2457T
caaacucgcgcaggcugacauua

SEQ ID NO: 3864192 - RNA, 13 nt, Shigella flexneri 2a str. 2457T
caaacucuuuucc

SEQ ID NO: 3864193 - RNA, 19 nt, Shigella flexneri 2a str. 2457T
caaacugccgcgccgcauc

SEQ ID NO: 3864194 - RNA, 12 nt, Shigella flexneri 2a str. 2457T
caaacugcugau

SEQ ID NO: 3864195 - RNA, 15 nt, Shigella flexneri 2a str. 2457T
caaacuuaccgccgc

SEQ ID NO: 3864196 - RNA, 17 nt, Shigella flexneri 2a str. 2457T
caaacuuaccgccgcuc

SEQ ID NO: 3864197 - RNA, 20 nt, Shigella flexneri 2a str. 2457T
caaacuugauagaacaaaag

SEQ ID NO: 3864198 - RNA, 22 nt, Shigella flexneri 2a str. 2457T
caaacuugauagaacaaaagac

SEQ ID NO: 3864199 - RNA, 13 nt, Shigella flexneri 2a str. 2457T
caaacuuuuaaau

SEQ ID NO: 3864200 - RNA, 18 nt, Shigella flexneri 2a str. 2457T
caaagaaauccacaaauu

SEQ ID NO: 3864201 - RNA, 12 nt, Shigella flexneri 2a str. 2457T
caaagacaaauu

SEQ ID NO: 3864202 - RNA, 23 nt, Shigella flexneri 2a str. 2457T
caaagacaaauuuugaacagaac

SEQ ID NO: 3864203 - RNA, 21 nt, Shigella flexneri 2a str. 2457T
caaagacgacuuuaugcgucu

SEQ ID NO: 3864204 - RNA, 20 nt, Shigella flexneri 2a str. 2457T
caaagacgcgguaaaagccc

SEQ ID NO: 3864205 - RNA, 19 nt, Shigella flexneri 2a str. 2457T
caaagagcuuucauuucaa

SEQ ID NO: 3864206 - RNA, 22 nt, Shigella flexneri 2a str. 2457T
caaagauuguuggcaaaaaaau

SEQ ID NO: 3864207 - RNA, 16 nt, Shigella flexneri 2a str. 2457T
caaagauuuuaccaau

SEQ ID NO: 3864208 - RNA, 15 nt, Shigella flexneri 2a str. 2457T
caaagcaccacuccu

SEQ ID NO: 3864209 - RNA, 16 nt, Shigella flexneri 2a str. 2457T
caaagcagaguugcug

SEQ ID NO: 3864210 - RNA, 14 nt, Shigella flexneri 2a str. 2457T
caaagcaggcgauu

SEQ ID NO: 3864211 - RNA, 18 nt, Shigella flexneri 2a str. 2457T
caaagcauuuuuucacau

SEQ ID NO: 3864212 - RNA, 13 nt, Shigella flexneri 2a str. 2457T
caaagccaacagc

SEQ ID NO: 3864213 - RNA, 15 nt, Shigella flexneri 2a str. 2457T
caaagccaacagcag

SEQ ID NO: 3864214 - RNA, 17 nt, Shigella flexneri 2a str. 2457T
caaagccgcgugcgcug

SEQ ID NO: 3864215 - RNA, 18 nt, Shigella flexneri 2a str. 2457T
caaagccgucgagggccu

SEQ ID NO: 3864216 - RNA, 23 nt, Shigella flexneri 2a str. 2457T
caaagcgcacuuuacuggucugu

SEQ ID NO: 3864217 - RNA, 22 nt, Shigella flexneri 2a str. 2457T
caaagcgcacuuugucaaaaau

SEQ ID NO: 3864218 - RNA, 16 nt, Shigella flexneri 2a str. 2457T
caaagcggucuucugu

SEQ ID NO: 3864219 - RNA, 15 nt, Shigella flexneri 2a str. 2457T
caacaaucucuucca

SEQ ID NO: 3864220 - RNA, 22 nt, Shigella flexneri 2a str. 2457T
caacaaucucuuccagaauauc

SEQ ID NO: 3864221 - RNA, 12 nt, Shigella flexneri 2a str. 2457T
caacaauggcau

SEQ ID NO: 3864222 - RNA, 22 nt, Shigella flexneri 2a str. 2457T
caacaauugaagaauaucuucu

SEQ ID NO: 3864223 - RNA, 23 nt, Shigella flexneri 2a str. 2457T
caacaauugcgggccaaagacca

SEQ ID NO: 3864224 - RNA, 14 nt, Shigella flexneri 2a str. 2457T
caacaauugucgcc

SEQ ID NO: 3864225 - RNA, 21 nt, Shigella flexneri 2a str. 2457T
caacacagauugauaaaaaua

SEQ ID NO: 3864226 - RNA, 22 nt, Shigella flexneri 2a str. 2457T
caacacagauugauaaaaauag

SEQ ID NO: 3864227 - RNA, 13 nt, Shigella flexneri 2a str. 2457T
caacacauaaccg

SEQ ID NO: 3864228 - RNA, 20 nt, Shigella flexneri 2a str. 2457T
caacacaucgauaagguuau

SEQ ID NO: 3864229 - RNA, 23 nt, Shigella flexneri 2a str. 2457T
caacaccgggugcagacaugacg

SEQ ID NO: 3864230 - RNA, 16 nt, Shigella flexneri 2a str. 2457T
caacaccucagccagc

SEQ ID NO: 3864231 - RNA, 17 nt, Shigella flexneri 2a str. 2457T
caacaccuguuccagug

SEQ ID NO: 3864232 - RNA, 23 nt, Shigella flexneri 2a str. 2457T
caacacgccagcguuaucccauc

SEQ ID NO: 3864233 - RNA, 20 nt, Shigella flexneri 2a str. 2457T
caacacgccgaucgaagaga

SEQ ID NO: 3864234 - RNA, 20 nt, Shigella flexneri 2a str. 2457T
caacacucaguccgccuuca

SEQ ID NO: 3864235 - RNA, 15 nt, Shigella flexneri 2a str. 2457T
caacacucucugaag

SEQ ID NO: 3864236 - RNA, 14 nt, Shigella flexneri 2a str. 2457T
caacagaaacgcca

SEQ ID NO: 3864237 - RNA, 22 nt, Shigella flexneri 2a str. 2457T
caacagaaauaaucgcaauuac

SEQ ID NO: 3864238 - RNA, 20 nt, Shigella flexneri 2a str. 2457T
caacagaauuacuggcagau

SEQ ID NO: 3864239 - RNA, 21 nt, Shigella flexneri 2a str. 2457T
caacagacgacgagucacgga

SEQ ID NO: 3864240 - RNA, 14 nt, Shigella flexneri 2a str. 2457T
caacagcggcauua

SEQ ID NO: 3864241 - RNA, 21 nt, Shigella flexneri 2a str. 2457T
caacaggcccaacuguugauc

SEQ ID NO: 3864242 - RNA, 23 nt, Shigella flexneri 2a str. 2457T
caacaggcccaacuguugaucca

SEQ ID NO: 3864243 - RNA, 15 nt, Shigella flexneri 2a str. 2457T
caacaggcgguaacc

SEQ ID NO: 3864244 - RNA, 19 nt, Shigella flexneri 2a str. 2457T
caacaguaauaaugcccau

SEQ ID NO: 3864245 - RNA, 13 nt, Shigella flexneri 2a str. 2457T
caacaguucaugg

SEQ ID NO: 3864246 - RNA, 18 nt, Shigella flexneri 2a str. 2457T
caacauacuuugcuggcu

SEQ ID NO: 3864247 - RNA, 21 nt, Shigella flexneri 2a str. 2457T
caacaucaaauuacagcaccu

SEQ ID NO: 3864248 - RNA, 23 nt, Shigella flexneri 2a str. 2457T
caacaucagcguggcgagaauag

SEQ ID NO: 3864249 - RNA, 22 nt, Shigella flexneri 2a str. 2457T
caacauccgaggacagcaucgu

SEQ ID NO: 3864250 - RNA, 20 nt, Shigella flexneri 2a str. 2457T
caacauccgggcgaacuggc

SEQ ID NO: 3864251 - RNA, 20 nt, Shigella flexneri 2a str. 2457T
caacauccuguaaacgaaaa

SEQ ID NO: 3864252 - RNA, 22 nt, Shigella flexneri 2a str. 2457T
caacauccuguaaacgaaaacu

SEQ ID NO: 3864253 - RNA, 18 nt, Shigella flexneri 2a str. 2457T
caacaucgaaaacgccac

SEQ ID NO: 3864254 - RNA, 18 nt, Shigella flexneri 2a str. 2457T
caacaugaaacagaaaau

SEQ ID NO: 3864255 - RNA, 15 nt, Shigella flexneri 2a str. 2457T
caacaugagaacagu

SEQ ID NO: 3864256 - RNA, 16 nt, Shigella flexneri 2a str. 2457T
caacaugagaacaguu

SEQ ID NO: 3864257 - RNA, 11 nt, Shigella flexneri 2a str. 2457T
caacauucaga

SEQ ID NO: 3864258 - RNA, 13 nt, Shigella flexneri 2a str. 2457T
caacauuuccccc

SEQ ID NO: 3864259 - RNA, 21 nt, Shigella flexneri 2a str. 2457T
caacauuucccccuuccugcu

SEQ ID NO: 3864260 - RNA, 20 nt, Shigella flexneri 2a str. 2457T
caaccaaagcguaaaguggc

SEQ ID NO: 3864261 - RNA, 16 nt, Shigella flexneri 2a str. 2457T
caaccaacgccagcag

SEQ ID NO: 3864262 - RNA, 15 nt, Shigella flexneri 2a str. 2457T
caaccaacggccuug

SEQ ID NO: 3864263 - RNA, 21 nt, Shigella flexneri 2a str. 2457T
caaccaaggaaggucacgaug

SEQ ID NO: 3864264 - RNA, 12 nt, Shigella flexneri 2a str. 2457T
caaccaaucgcg

SEQ ID NO: 3864265 - RNA, 20 nt, Shigella flexneri 2a str. 2457T
caaccacaaaacacucuuca

SEQ ID NO: 3864266 - RNA, 19 nt, Shigella flexneri 2a str. 2457T
caaccacaaucucgcgccc

SEQ ID NO: 3864267 - RNA, 14 nt, Shigella flexneri 2a str. 2457T
caaccacaauguca

SEQ ID NO: 3864268 - RNA, 17 nt, Shigella flexneri 2a str. 2457T
caaccacacccacauca

SEQ ID NO: 3864269 - RNA, 17 nt, Shigella flexneri 2a str. 2457T
caaccaccggcaccacu

SEQ ID NO: 3864270 - RNA, 19 nt, Shigella flexneri 2a str. 2457T
caaccaccucaguacccgc

SEQ ID NO: 3864271 - RNA, 15 nt, Shigella flexneri 2a str. 2457T
caaccacuacgugau

SEQ ID NO: 3864272 - RNA, 20 nt, Shigella flexneri 2a str. 2457T
caaccacuacgugaucgucu

SEQ ID NO: 3864273 - RNA, 15 nt, Shigella flexneri 2a str. 2457T
caaccacucaccgcu

SEQ ID NO: 3864274 - RNA, 21 nt, Shigella flexneri 2a str. 2457T
caaccacuucaguaucuuuua

SEQ ID NO: 3864275 - RNA, 18 nt, Shigella flexneri 2a str. 2457T
caaccacuuuaucgagaa

SEQ ID NO: 3864276 - RNA, 16 nt, Shigella flexneri 2a str. 2457T
caaccagaaagaugca

SEQ ID NO: 3864277 - RNA, 18 nt, Shigella flexneri 2a str. 2457T
caaccagaaagaugcauc

SEQ ID NO: 3864278 - RNA, 15 nt, Shigella flexneri 2a str. 2457T
caaccagaagagaac

SEQ ID NO: 3864279 - RNA, 15 nt, Shigella flexneri 2a str. 2457T
caaccagauaaccau

SEQ ID NO: 3864280 - RNA, 18 nt, Shigella flexneri 2a str. 2457T
caaccagauaaccaucgc

SEQ ID NO: 3864281 - RNA, 21 nt, Shigella flexneri 2a str. 2457T
caaccagaucgcucaucugcu

SEQ ID NO: 3864282 - RNA, 19 nt, Shigella flexneri 2a str. 2457T
caaccagcacuucgccauc

SEQ ID NO: 3864283 - RNA, 16 nt, Shigella flexneri 2a str. 2457T
caaccagcccaugaau

SEQ ID NO: 3864284 - RNA, 21 nt, Shigella flexneri 2a str. 2457T
caaccagcuucaacgauucaa

SEQ ID NO: 3864285 - RNA, 22 nt, Shigella flexneri 2a str. 2457T
caaccaguuacgugcugcgcag

SEQ ID NO: 3864286 - RNA, 13 nt, Shigella flexneri 2a str. 2457T
caaccauccccaa

SEQ ID NO: 3864287 - RNA, 16 nt, Shigella flexneri 2a str. 2457T
caaccauccccaaaaa

SEQ ID NO: 3864288 - RNA, 17 nt, Shigella flexneri 2a str. 2457T
caaccauccuaaaaaag

SEQ ID NO: 3864289 - RNA, 23 nt, Shigella flexneri 2a str. 2457T
caaccaucgguacgcuuucaccc

SEQ ID NO: 3864290 - RNA, 21 nt, Shigella flexneri 2a str. 2457T
caaccaugguuucgaacgcca

SEQ ID NO: 3864291 - RNA, 19 nt, Shigella flexneri 2a str. 2457T
caacccagcggaugaccca

SEQ ID NO: 3864292 - RNA, 12 nt, Shigella flexneri 2a str. 2457T
caaccccagcca

SEQ ID NO: 3864293 - RNA, 22 nt, Shigella flexneri 2a str. 2457T
caaccccgcacggugcaccgca

SEQ ID NO: 3864294 - RNA, 20 nt, Shigella flexneri 2a str. 2457T
caacccgugagucuccuuua

SEQ ID NO: 3864295 - RNA, 20 nt, Shigella flexneri 2a str. 2457T
caacccuaaagcacccagca

SEQ ID NO: 3864296 - RNA, 15 nt, Shigella flexneri 2a str. 2457T
caacccugcccuuca

SEQ ID NO: 3864297 - RNA, 20 nt, Shigella flexneri 2a str. 2457T
caaccgagcgccccagaccu

SEQ ID NO: 3864298 - RNA, 15 nt, Shigella flexneri 2a str. 2457T
caaccgcaaaugauu

SEQ ID NO: 3864299 - RNA, 21 nt, Shigella flexneri 2a str. 2457T
caaccgcgacugggaggacag

SEQ ID NO: 3864300 - RNA, 20 nt, Shigella flexneri 2a str. 2457T
caaccgcuauaccgccgauc

SEQ ID NO: 3864301 - RNA, 21 nt, Shigella flexneri 2a str. 2457T
caaccgguggcaguagcgccu

SEQ ID NO: 3864302 - RNA, 23 nt, Shigella flexneri 2a str. 2457T
caaccgguggcaguagcgccucu

SEQ ID NO: 3864303 - RNA, 22 nt, Shigella flexneri 2a str. 2457T
caaccgucaacguucagcaucu

SEQ ID NO: 3864304 - RNA, 15 nt, Shigella flexneri 2a str. 2457T
caaccguccuccgua

SEQ ID NO: 3864305 - RNA, 17 nt, Shigella flexneri 2a str. 2457T
caaccguccuccguauc

SEQ ID NO: 3864306 - RNA, 23 nt, Shigella flexneri 2a str. 2457T
caaccguccuccguauccuguca

SEQ ID NO: 3864307 - RNA, 17 nt, Shigella flexneri 2a str. 2457T
caaccuacaaacguugc

SEQ ID NO: 3864308 - RNA, 15 nt, Shigella flexneri 2a str. 2457T
caaccuagccuuccu

SEQ ID NO: 3864309 - RNA, 17 nt, Shigella flexneri 2a str. 2457T
caaccugaucgugccag

SEQ ID NO: 3864310 - RNA, 12 nt, Shigella flexneri 2a str. 2457T
caacgaagaaaa

SEQ ID NO: 3864311 - RNA, 21 nt, Shigella flexneri 2a str. 2457T
caacgacaccguuaaauaacu

SEQ ID NO: 3864312 - RNA, 19 nt, Shigella flexneri 2a str. 2457T
caacgacccagccagacgc

SEQ ID NO: 3864313 - RNA, 23 nt, Shigella flexneri 2a str. 2457T
caacgacccagccagacgccagc

SEQ ID NO: 3864314 - RNA, 19 nt, Shigella flexneri 2a str. 2457T
caacgacgcugaugucagc

SEQ ID NO: 3864315 - RNA, 23 nt, Shigella flexneri 2a str. 2457T
caagaggguuauuuguucagcaa

SEQ ID NO: 3864316 - RNA, 23 nt, Shigella flexneri 2a str. 2457T
caagaguaacccacguuagcgcu

SEQ ID NO: 3864317 - RNA, 16 nt, Shigella flexneri 2a str. 2457T
caagauaacagacaug

SEQ ID NO: 3864318 - RNA, 21 nt, Shigella flexneri 2a str. 2457T
caagauacugccgauuacgua

SEQ ID NO: 3864319 - RNA, 13 nt, Shigella flexneri 2a str. 2457T
caagauagaacca

SEQ ID NO: 3864320 - RNA, 20 nt, Shigella flexneri 2a str. 2457T
caagauagcgcguugcgcca

SEQ ID NO: 3864321 - RNA, 18 nt, Shigella flexneri 2a str. 2457T
caagaucagcauccauau

SEQ ID NO: 3864322 - RNA, 19 nt, Shigella flexneri 2a str. 2457T
caagaucagcauccauauc

SEQ ID NO: 3864323 - RNA, 15 nt, Shigella flexneri 2a str. 2457T
caagauccugauacu

SEQ ID NO: 3864324 - RNA, 18 nt, Shigella flexneri 2a str. 2457T
caagaucgcgcaucagcu

SEQ ID NO: 3864325 - RNA, 13 nt, Shigella flexneri 2a str. 2457T
caagaugccugau

SEQ ID NO: 3864326 - RNA, 15 nt, Shigella flexneri 2a str. 2457T
caagauuagcgacga

SEQ ID NO: 3864327 - RNA, 17 nt, Shigella flexneri 2a str. 2457T
caagauugauccccgcu

SEQ ID NO: 3864328 - RNA, 17 nt, Shigella flexneri 2a str. 2457T
caagauugccugaugcg

SEQ ID NO: 3864329 - RNA, 12 nt, Shigella flexneri 2a str. 2457T
caagcaaaugaa

SEQ ID NO: 3864330 - RNA, 13 nt, Shigella flexneri 2a str. 2457T
caagcaaaugaau

SEQ ID NO: 3864331 - RNA, 12 nt, Shigella flexneri 2a str. 2457T
caagcagagaga

SEQ ID NO: 3864332 - RNA, 13 nt, Shigella flexneri 2a str. 2457T
caagcagagagac

SEQ ID NO: 3864333 - RNA, 22 nt, Shigella flexneri 2a str. 2457T
caagcagagagacaaucgccac

SEQ ID NO: 3864334 - RNA, 20 nt, Shigella flexneri 2a str. 2457T
caagcagccagguuaacgca

SEQ ID NO: 3864335 - RNA, 19 nt, Shigella flexneri 2a str. 2457T
caagcagcgcgcagaacau

SEQ ID NO: 3864336 - RNA, 20 nt, Shigella flexneri 2a str. 2457T
caagcaguugguuaaucuuu

SEQ ID NO: 3864337 - RNA, 23 nt, Shigella flexneri 2a str. 2457T
caagcaguugguuaaucuuuucu

SEQ ID NO: 3864338 - RNA, 18 nt, Shigella flexneri 2a str. 2457T
caagccaggcuuuaaauu

SEQ ID NO: 3864339 - RNA, 22 nt, Shigella flexneri 2a str. 2457T
caagccaugcuuugcaucccag

SEQ ID NO: 3864340 - RNA, 20 nt, Shigella flexneri 2a str. 2457T
caagcccugguaacugccag

SEQ ID NO: 3864341 - RNA, 22 nt, Shigella flexneri 2a str. 2457T
caagccgaauaacggcucaaac

SEQ ID NO: 3864342 - RNA, 23 nt, Shigella flexneri 2a str. 2457T
caagccgaauaacggcucaaacu

SEQ ID NO: 3864343 - RNA, 20 nt, Shigella flexneri 2a str. 2457T
caagcgauaacucgcuuugc

SEQ ID NO: 3864344 - RNA, 15 nt, Shigella flexneri 2a str. 2457T
caagcgauaauuuau

SEQ ID NO: 3864345 - RNA, 15 nt, Shigella flexneri 2a str. 2457T
caagcgccgccaguc

SEQ ID NO: 3864346 - RNA, 14 nt, Shigella flexneri 2a str. 2457T
caagcgcgcuguca

SEQ ID NO: 3864347 - RNA, 19 nt, Shigella flexneri 2a str. 2457T
caagcgcugagacgcgcuu

SEQ ID NO: 3864348 - RNA, 22 nt, Shigella flexneri 2a str. 2457T
caagcgcugagacgcgcuugcu

SEQ ID NO: 3864349 - RNA, 16 nt, Shigella flexneri 2a str. 2457T
caagcggaaacguaac

SEQ ID NO: 3864350 - RNA, 21 nt, Shigella flexneri 2a str. 2457T
caagcggaauauuuuuaccgu

SEQ ID NO: 3864351 - RNA, 15 nt, Shigella flexneri 2a str. 2457T
caagcggcucaugca

SEQ ID NO: 3864352 - RNA, 18 nt, Shigella flexneri 2a str. 2457T
caagcggggaaggaugag

SEQ ID NO: 3864353 - RNA, 15 nt, Shigella flexneri 2a str. 2457T
caagcggugcgaugc

SEQ ID NO: 3864354 - RNA, 19 nt, Shigella flexneri 2a str. 2457T
caagcguaacguguuuagc

SEQ ID NO: 3864355 - RNA, 21 nt, Shigella flexneri 2a str. 2457T
caagcgucgcaucaggcauuu

SEQ ID NO: 3864356 - RNA, 20 nt, Shigella flexneri 2a str. 2457T
caagcguuucaucuucaguc

SEQ ID NO: 3864357 - RNA, 19 nt, Shigella flexneri 2a str. 2457T
caagcuaacgaacgcagug

SEQ ID NO: 3864358 - RNA, 18 nt, Shigella flexneri 2a str. 2457T
caagcuccggcuuuuuac

SEQ ID NO: 3864359 - RNA, 15 nt, Shigella flexneri 2a str. 2457T
caagcucgcagagau

SEQ ID NO: 3864360 - RNA, 22 nt, Shigella flexneri 2a str. 2457T
caagcucguugguuccacggca

SEQ ID NO: 3864361 - RNA, 20 nt, Shigella flexneri 2a str. 2457T
caagcugcgugagccgaaau

SEQ ID NO: 3864362 - RNA, 14 nt, Shigella flexneri 2a str. 2457T
caagcuguucuucc

SEQ ID NO: 3864363 - RNA, 20 nt, Shigella flexneri 2a str. 2457T
caagcuuacguuacccagca

SEQ ID NO: 3864364 - RNA, 19 nt, Shigella flexneri 2a str. 2457T
caagcuucgggauggcgau

SEQ ID NO: 3864365 - RNA, 18 nt, Shigella flexneri 2a str. 2457T
caaggcaggcaucaauga

SEQ ID NO: 3864366 - RNA, 16 nt, Shigella flexneri 2a str. 2457T
caaggccaauccagcc

SEQ ID NO: 3864367 - RNA, 21 nt, Shigella flexneri 2a str. 2457T
caagggaaauaagaaaagcga

SEQ ID NO: 3864368 - RNA, 19 nt, Shigella flexneri 2a str. 2457T
caagggcggcgagaaacuu

SEQ ID NO: 3864369 - RNA, 20 nt, Shigella flexneri 2a str. 2457T
caagggugucggcacacaca

SEQ ID NO: 3864370 - RNA, 14 nt, Shigella flexneri 2a str. 2457T
caagguauccagac

SEQ ID NO: 3864371 - RNA, 20 nt, Shigella flexneri 2a str. 2457T
caagguaucgguugcuggau

SEQ ID NO: 3864372 - RNA, 23 nt, Shigella flexneri 2a str. 2457T
caaggugcgcgaugcuuucccac

SEQ ID NO: 3864373 - RNA, 21 nt, Shigella flexneri 2a str. 2457T
caagguggugaggccagagca

SEQ ID NO: 3864374 - RNA, 18 nt, Shigella flexneri 2a str. 2457T
caaguaaaaggagauaaa

SEQ ID NO: 3864375 - RNA, 13 nt, Shigella flexneri 2a str. 2457T
caaguaauaaagc

SEQ ID NO: 3864376 - RNA, 18 nt, Shigella flexneri 2a str. 2457T
caaguaauaauaucucca

SEQ ID NO: 3864377 - RNA, 23 nt, Shigella flexneri 2a str. 2457T
caaguaauagaacuauaauugcu

SEQ ID NO: 3864378 - RNA, 19 nt, Shigella flexneri 2a str. 2457T
caaguaauucauucacgcu

SEQ ID NO: 3864379 - RNA, 15 nt, Shigella flexneri 2a str. 2457T
caaguauucacucug

SEQ ID NO: 3864380 - RNA, 22 nt, Shigella flexneri 2a str. 2457T
caagucucaagagugaacacgu

SEQ ID NO: 3864381 - RNA, 20 nt, Shigella flexneri 2a str. 2457T
caagugaauaaauuuuauuc

SEQ ID NO: 3864382 - RNA, 14 nt, Shigella flexneri 2a str. 2457T
caaguuacuccugg

SEQ ID NO: 3864383 - RNA, 15 nt, Shigella flexneri 2a str. 2457T
caaguuacuccuggu

SEQ ID NO: 3864384 - RNA, 16 nt, Shigella flexneri 2a str. 2457T
caaguuacuccuggua

SEQ ID NO: 3864385 - RNA, 17 nt, Shigella flexneri 2a str. 2457T
caaguucgaacgccgcc

SEQ ID NO: 3864386 - RNA, 19 nt, Shigella flexneri 2a str. 2457T
caaguucuucgaagcacuc

SEQ ID NO: 3864387 - RNA, 18 nt, Shigella flexneri 2a str. 2457T
caaguuguauugcucaac

SEQ ID NO: 3864388 - RNA, 14 nt, Shigella flexneri 2a str. 2457T
caauaaacgccagg

SEQ ID NO: 3864389 - RNA, 12 nt, Shigella flexneri 2a str. 2457T
caauaaacuggc

SEQ ID NO: 3864390 - RNA, 18 nt, Shigella flexneri 2a str. 2457T
caauaaacuucaauauau

SEQ ID NO: 3864391 - RNA, 12 nt, Shigella flexneri 2a str. 2457T
caauaaauuccc

SEQ ID NO: 3864392 - RNA, 15 nt, Shigella flexneri 2a str. 2457T
caauaaauuccccgc

SEQ ID NO: 3864393 - RNA, 18 nt, Shigella flexneri 2a str. 2457T
caauaaauuccccgcagg

SEQ ID NO: 3864394 - RNA, 16 nt, Shigella flexneri 2a str. 2457T
caauaaauugcgauuc

SEQ ID NO: 3864395 - RNA, 17 nt, Shigella flexneri 2a str. 2457T
caauaacacgcuaccac

SEQ ID NO: 3864396 - RNA, 13 nt, Shigella flexneri 2a str. 2457T
caauaaccaucag

SEQ ID NO: 3864397 - RNA, 14 nt, Shigella flexneri 2a str. 2457T
caauaaccaucagc

SEQ ID NO: 3864398 - RNA, 21 nt, Shigella flexneri 2a str. 2457T
caauaacccgcuguaaaugcu

SEQ ID NO: 3864399 - RNA, 17 nt, Shigella flexneri 2a str. 2457T
caauaaccggcacuuca

SEQ ID NO: 3864400 - RNA, 12 nt, Shigella flexneri 2a str. 2457T
caauaacgcuuu

SEQ ID NO: 3864401 - RNA, 12 nt, Shigella flexneri 2a str. 2457T
caauaacuccau

SEQ ID NO: 3864402 - RNA, 18 nt, Shigella flexneri 2a str. 2457T
caauaagauaacccugca

SEQ ID NO: 3864403 - RNA, 23 nt, Shigella flexneri 2a str. 2457T
caauaaguuacacaucauuagua

SEQ ID NO: 3864404 - RNA, 14 nt, Shigella flexneri 2a str. 2457T
caauaauacccagc

SEQ ID NO: 3864405 - RNA, 15 nt, Shigella flexneri 2a str. 2457T
caauaauacccagca

SEQ ID NO: 3864406 - RNA, 14 nt, Shigella flexneri 2a str. 2457T
caauaauaucuuuu

SEQ ID NO: 3864407 - RNA, 19 nt, Shigella flexneri 2a str. 2457T
caauaauauuacuucgcgu

SEQ ID NO: 3864408 - RNA, 22 nt, Shigella flexneri 2a str. 2457T
caauaaucaaucuuuacacaca

SEQ ID NO: 3864409 - RNA, 21 nt, Shigella flexneri 2a str. 2457T
caauaaucaucucuccuuucg

SEQ ID NO: 3864410 - RNA, 17 nt, Shigella flexneri 2a str. 2457T
caauaaucgccuuaccc

SEQ ID NO: 3864411 - RNA, 14 nt, Shigella flexneri 2a str. 2457T
caauaaucugauuu

SEQ ID NO: 3864412 - RNA, 20 nt, Shigella flexneri 2a str. 2457T
caaucccuuaguaacgccag

SEQ ID NO: 3864413 - RNA, 19 nt, Shigella flexneri 2a str. 2457T
caaucccuuucucuucaaa

SEQ ID NO: 3864414 - RNA, 20 nt, Shigella flexneri 2a str. 2457T
caauccgauaaucccuuccc

SEQ ID NO: 3864415 - RNA, 13 nt, Shigella flexneri 2a str. 2457T
caaucgaccaggc

SEQ ID NO: 3864416 - RNA, 14 nt, Shigella flexneri 2a str. 2457T
caaucgaccaggcc

SEQ ID NO: 3864417 - RNA, 14 nt, Shigella flexneri 2a str. 2457T
caaucgccagauca

SEQ ID NO: 3864418 - RNA, 19 nt, Shigella flexneri 2a str. 2457T
caaucgcugcggcaauaau

SEQ ID NO: 3864419 - RNA, 19 nt, Shigella flexneri 2a str. 2457T
caaucggcaauucaguacg

SEQ ID NO: 3864420 - RNA, 16 nt, Shigella flexneri 2a str. 2457T
caaucgggaaaaucug

SEQ ID NO: 3864421 - RNA, 16 nt, Shigella flexneri 2a str. 2457T
caaucgguaacgcuug

SEQ ID NO: 3864422 - RNA, 22 nt, Shigella flexneri 2a str. 2457T
caaucggugcacgaugccugau

SEQ ID NO: 3864423 - RNA, 20 nt, Shigella flexneri 2a str. 2457T
caaucgguucgccugcacca

SEQ ID NO: 3864424 - RNA, 16 nt, Shigella flexneri 2a str. 2457T
caaucguagcccagcu

SEQ ID NO: 3864425 - RNA, 17 nt, Shigella flexneri 2a str. 2457T
caaucguuucaugccau

SEQ ID NO: 3864426 - RNA, 13 nt, Shigella flexneri 2a str. 2457T
caaucucacuccg

SEQ ID NO: 3864427 - RNA, 22 nt, Shigella flexneri 2a str. 2457T
caaucucuacgacuugaaaaag

SEQ ID NO: 3864428 - RNA, 23 nt, Shigella flexneri 2a str. 2457T
caaucucugguuuguuuucagau

SEQ ID NO: 3864429 - RNA, 15 nt, Shigella flexneri 2a str. 2457T
caaucucuuuuucca

SEQ ID NO: 3864430 - RNA, 16 nt, Shigella flexneri 2a str. 2457T
caaucucuuuuuccac

SEQ ID NO: 3864431 - RNA, 22 nt, Shigella flexneri 2a str. 2457T
caaucugauauuuagccagcaa

SEQ ID NO: 3864432 - RNA, 14 nt, Shigella flexneri 2a str. 2457T
caaucugauugaca

SEQ ID NO: 3864433 - RNA, 14 nt, Shigella flexneri 2a str. 2457T
caaucugcaaaaua

SEQ ID NO: 3864434 - RNA, 18 nt, Shigella flexneri 2a str. 2457T
caaucugcaaaucgaucu

SEQ ID NO: 3864435 - RNA, 16 nt, Shigella flexneri 2a str. 2457T
caaucugcuccauuag

SEQ ID NO: 3864436 - RNA, 13 nt, Shigella flexneri 2a str. 2457T
caaucugcugccu

SEQ ID NO: 3864437 - RNA, 14 nt, Shigella flexneri 2a str. 2457T
caaucugcugccug

SEQ ID NO: 3864438 - RNA, 17 nt, Shigella flexneri 2a str. 2457T
caaucugcuggcaaacg

SEQ ID NO: 3864439 - RNA, 15 nt, Shigella flexneri 2a str. 2457T
caaucugcuugcgau

SEQ ID NO: 3864440 - RNA, 12 nt, Shigella flexneri 2a str. 2457T
caaucugugccg

SEQ ID NO: 3864441 - RNA, 23 nt, Shigella flexneri 2a str. 2457T
caaucuuguucucagcacauuga

SEQ ID NO: 3864442 - RNA, 18 nt, Shigella flexneri 2a str. 2457T
caaucuuuacacacaagc

SEQ ID NO: 3864443 - RNA, 20 nt, Shigella flexneri 2a str. 2457T
caaugaaacgcaaauacuga

SEQ ID NO: 3864444 - RNA, 19 nt, Shigella flexneri 2a str. 2457T
caaugaaagccccaccagc

SEQ ID NO: 3864445 - RNA, 21 nt, Shigella flexneri 2a str. 2457T
caaugaaagccccaccagcaa

SEQ ID NO: 3864446 - RNA, 15 nt, Shigella flexneri 2a str. 2457T
caaugaagcccgcug

SEQ ID NO: 3864447 - RNA, 20 nt, Shigella flexneri 2a str. 2457T
caaugacacguuuauuauag

SEQ ID NO: 3864448 - RNA, 17 nt, Shigella flexneri 2a str. 2457T
caaugaccacuccggca

SEQ ID NO: 3864449 - RNA, 20 nt, Shigella flexneri 2a str. 2457T
caaugacuagcgccauaaua

SEQ ID NO: 3864450 - RNA, 21 nt, Shigella flexneri 2a str. 2457T
caaugagagggcgauaaaucu

SEQ ID NO: 3864451 - RNA, 18 nt, Shigella flexneri 2a str. 2457T
caaugaguggugaaaaaa

SEQ ID NO: 3864452 - RNA, 20 nt, Shigella flexneri 2a str. 2457T
caaugaguggugaaaaaaag

SEQ ID NO: 3864453 - RNA, 22 nt, Shigella flexneri 2a str. 2457T
caaugaguggugaaaaaaaggc

SEQ ID NO: 3864454 - RNA, 21 nt, Shigella flexneri 2a str. 2457T
caaugaguucgcgcgcugcca

SEQ ID NO: 3864455 - RNA, 15 nt, Shigella flexneri 2a str. 2457T
caaugauuucugcca

SEQ ID NO: 3864456 - RNA, 22 nt, Shigella flexneri 2a str. 2457T
caaugcaggcaucggugaugcu

SEQ ID NO: 3864457 - RNA, 13 nt, Shigella flexneri 2a str. 2457T
caaugcaguucca

SEQ ID NO: 3864458 - RNA, 17 nt, Shigella flexneri 2a str. 2457T
caaugcaucgcgaccaa

SEQ ID NO: 3864459 - RNA, 19 nt, Shigella flexneri 2a str. 2457T
caaugcaucgcgaccaauc

SEQ ID NO: 3864460 - RNA, 13 nt, Shigella flexneri 2a str. 2457T
caaugccacaaac

SEQ ID NO: 3864461 - RNA, 15 nt, Shigella flexneri 2a str. 2457T
caaugccacaaacgc

SEQ ID NO: 3864462 - RNA, 14 nt, Shigella flexneri 2a str. 2457T
caaugccacgccac

SEQ ID NO: 3864463 - RNA, 15 nt, Shigella flexneri 2a str. 2457T
caaugccacgccaca

SEQ ID NO: 3864464 - RNA, 15 nt, Shigella flexneri 2a str. 2457T
caaugccauccagcu

SEQ ID NO: 3864465 - RNA, 20 nt, Shigella flexneri 2a str. 2457T
caaugcccagaaaccaguuu

SEQ ID NO: 3864466 - RNA, 16 nt, Shigella flexneri 2a str. 2457T
caaugcccgguguucc

SEQ ID NO: 3864467 - RNA, 18 nt, Shigella flexneri 2a str. 2457T
caaugccgcggcgcggcg

SEQ ID NO: 3864468 - RNA, 19 nt, Shigella flexneri 2a str. 2457T
caaugccgucaccagcauc

SEQ ID NO: 3864469 - RNA, 17 nt, Shigella flexneri 2a str. 2457T
caaugccuucuggaaau

SEQ ID NO: 3864470 - RNA, 21 nt, Shigella flexneri 2a str. 2457T
caaugccuuuguccucaauga

SEQ ID NO: 3864471 - RNA, 19 nt, Shigella flexneri 2a str. 2457T
caaugcgacaaacaggaag

SEQ ID NO: 3864472 - RNA, 19 nt, Shigella flexneri 2a str. 2457T
caaugcgcaucaaagccag

SEQ ID NO: 3864473 - RNA, 22 nt, Shigella flexneri 2a str. 2457T
caaugcgcugaguguaacgcuu

SEQ ID NO: 3864474 - RNA, 22 nt, Shigella flexneri 2a str. 2457T
caaugcgcuguuuagcgcggca

SEQ ID NO: 3864475 - RNA, 19 nt, Shigella flexneri 2a str. 2457T
caaugcuuuuugcauuucc

SEQ ID NO: 3864476 - RNA, 12 nt, Shigella flexneri 2a str. 2457T
caauggcacugu

SEQ ID NO: 3864477 - RNA, 14 nt, Shigella flexneri 2a str. 2457T
caauggcauccgcc

SEQ ID NO: 3864478 - RNA, 15 nt, Shigella flexneri 2a str. 2457T
caauggcauuuaucu

SEQ ID NO: 3864479 - RNA, 17 nt, Shigella flexneri 2a str. 2457T
caauggccugcgcgacc

SEQ ID NO: 3864480 - RNA, 18 nt, Shigella flexneri 2a str. 2457T
caauggcgacuucugcuu

SEQ ID NO: 3864481 - RNA, 16 nt, Shigella flexneri 2a str. 2457T
caauggcggugauccc

SEQ ID NO: 3864482 - RNA, 23 nt, Shigella flexneri 2a str. 2457T
caauggcuccgggugugacaaca

SEQ ID NO: 3864483 - RNA, 22 nt, Shigella flexneri 2a str. 2457T
caauggcugcaaagcauuuuuu

SEQ ID NO: 3864484 - RNA, 17 nt, Shigella flexneri 2a str. 2457T
caauggguaacggcaga

SEQ ID NO: 3864485 - RNA, 16 nt, Shigella flexneri 2a str. 2457T
caauggucagccacag

SEQ ID NO: 3864486 - RNA, 23 nt, Shigella flexneri 2a str. 2457T
caauggucagcgccaggcuuucc

SEQ ID NO: 3864487 - RNA, 19 nt, Shigella flexneri 2a str. 2457T
caaugguggcaaucugaau

SEQ ID NO: 3864488 - RNA, 21 nt, Shigella flexneri 2a str. 2457T
caauguaauacgcucaucugg

SEQ ID NO: 3864489 - RNA, 15 nt, Shigella flexneri 2a str. 2457T
caauguagccgcacg

SEQ ID NO: 3864490 - RNA, 16 nt, Shigella flexneri 2a str. 2457T
caauguaggccugaua

SEQ ID NO: 3864491 - RNA, 21 nt, Shigella flexneri 2a str. 2457T
caaugucaucagcauucucau

SEQ ID NO: 3864492 - RNA, 15 nt, Shigella flexneri 2a str. 2457T
caaugucgaaagccc

SEQ ID NO: 3864493 - RNA, 23 nt, Shigella flexneri 2a str. 2457T
caaugucugucauauuaucuauc

SEQ ID NO: 3864494 - RNA, 20 nt, Shigella flexneri 2a str. 2457T
caaugugaaaacccugcgca

SEQ ID NO: 3864495 - RNA, 14 nt, Shigella flexneri 2a str. 2457T
caauguuaccgauc

SEQ ID NO: 3864496 - RNA, 23 nt, Shigella flexneri 2a str. 2457T
caauguuaccgaucgccagcagg

SEQ ID NO: 3864497 - RNA, 14 nt, Shigella flexneri 2a str. 2457T
caauguucguccau

SEQ ID NO: 3864498 - RNA, 18 nt, Shigella flexneri 2a str. 2457T
caauguucguccauuuca

SEQ ID NO: 3864499 - RNA, 20 nt, Shigella flexneri 2a str. 2457T
caauguucguccauuucagc

SEQ ID NO: 3864500 - RNA, 16 nt, Shigella flexneri 2a str. 2457T
caauguugcgggggcu

SEQ ID NO: 3864501 - RNA, 20 nt, Shigella flexneri 2a str. 2457T
caauguugcguuugucauca

SEQ ID NO: 3864502 - RNA, 16 nt, Shigella flexneri 2a str. 2457T
caauuaacgaaaucuc

SEQ ID NO: 3864503 - RNA, 17 nt, Shigella flexneri 2a str. 2457T
caauuaacgguaauaau

SEQ ID NO: 3864504 - RNA, 22 nt, Shigella flexneri 2a str. 2457T
caauuaacgguaauaauucucc

SEQ ID NO: 3864505 - RNA, 18 nt, Shigella flexneri 2a str. 2457T
caauuaccaacucaucgc

SEQ ID NO: 3864506 - RNA, 17 nt, Shigella flexneri 2a str. 2457T
caauuaccacaaguaaa

SEQ ID NO: 3864507 - RNA, 22 nt, Shigella flexneri 2a str. 2457T
caauuacccaguagacagcaaa

SEQ ID NO: 3864508 - RNA, 12 nt, Shigella flexneri 2a str. 2457T
caauuaccuucc

SEQ ID NO: 3864509 - RNA, 12 nt, Shigella flexneri 2a str. 2457T
cacaccaccaug

SEQ ID NO: 3864510 - RNA, 14 nt, Shigella flexneri 2a str. 2457T
cacaccaguaaagc

SEQ ID NO: 3864511 - RNA, 14 nt, Shigella flexneri 2a str. 2457T
cacaccagucagcg

SEQ ID NO: 3864512 - RNA, 13 nt, Shigella flexneri 2a str. 2457T
cacaccaucaaca

SEQ ID NO: 3864513 - RNA, 22 nt, Shigella flexneri 2a str. 2457T
cacaccauugauaauccaucac

SEQ ID NO: 3864514 - RNA, 23 nt, Shigella flexneri 2a str. 2457T
cacacccauguuuaauucacgca

SEQ ID NO: 3864515 - RNA, 15 nt, Shigella flexneri 2a str. 2457T
cacaccccgcgcagc

SEQ ID NO: 3864516 - RNA, 21 nt, Shigella flexneri 2a str. 2457T
cacaccgcgaucuuccacgcc

SEQ ID NO: 3864517 - RNA, 15 nt, Shigella flexneri 2a str. 2457T
cacaccgcggaacgc

SEQ ID NO: 3864518 - RNA, 15 nt, Shigella flexneri 2a str. 2457T
cacacgacauccgug

SEQ ID NO: 3864519 - RNA, 18 nt, Shigella flexneri 2a str. 2457T
cacacgccaggccacgcu

SEQ ID NO: 3864520 - RNA, 14 nt, Shigella flexneri 2a str. 2457T
cacacgcgcugagg

SEQ ID NO: 3864521 - RNA, 22 nt, Shigella flexneri 2a str. 2457T
cacacggucuaucaucagcaug

SEQ ID NO: 3864522 - RNA, 22 nt, Shigella flexneri 2a str. 2457T
cacacguaaucguauucaacgg

SEQ ID NO: 3864523 - RNA, 13 nt, Shigella flexneri 2a str. 2457T
cacacucaugauc

SEQ ID NO: 3864524 - RNA, 13 nt, Shigella flexneri 2a str. 2457T
cacacugaauaaa

SEQ ID NO: 3864525 - RNA, 20 nt, Shigella flexneri 2a str. 2457T
cacacugguucccaacaaca

SEQ ID NO: 3864526 - RNA, 22 nt, Shigella flexneri 2a str. 2457T
cacacugguucccaacaacagc

SEQ ID NO: 3864527 - RNA, 18 nt, Shigella flexneri 2a str. 2457T
cacacuguaagccaccga

SEQ ID NO: 3864528 - RNA, 23 nt, Shigella flexneri 2a str. 2457T
cacacuguucauuaaagccgccc

SEQ ID NO: 3864529 - RNA, 20 nt, Shigella flexneri 2a str. 2457T
cacacuucaauauuaaugcu

SEQ ID NO: 3864530 - RNA, 16 nt, Shigella flexneri 2a str. 2457T
cacacuucuucagcca

SEQ ID NO: 3864531 - RNA, 16 nt, Shigella flexneri 2a str. 2457T
cacacuuuccaguucc

SEQ ID NO: 3864532 - RNA, 21 nt, Shigella flexneri 2a str. 2457T
cacacuuuccaguuccggcau

SEQ ID NO: 3864533 - RNA, 14 nt, Shigella flexneri 2a str. 2457T
cacagaaacgccau

SEQ ID NO: 3864534 - RNA, 13 nt, Shigella flexneri 2a str. 2457T
cacagaacaaaau

SEQ ID NO: 3864535 - RNA, 17 nt, Shigella flexneri 2a str. 2457T
cacagaaccggagucag

SEQ ID NO: 3864536 - RNA, 15 nt, Shigella flexneri 2a str. 2457T
cacagaaggccagga

SEQ ID NO: 3864537 - RNA, 11 nt, Shigella flexneri 2a str. 2457T
cacagaaguga

SEQ ID NO: 3864538 - RNA, 12 nt, Shigella flexneri 2a str. 2457T
cacagacaaaca

SEQ ID NO: 3864539 - RNA, 14 nt, Shigella flexneri 2a str. 2457T
cacagacaaacagc

SEQ ID NO: 3864540 - RNA, 15 nt, Shigella flexneri 2a str. 2457T
cacagacauccugcg

SEQ ID NO: 3864541 - RNA, 14 nt, Shigella flexneri 2a str. 2457T
cacagacuuaauau

SEQ ID NO: 3864542 - RNA, 17 nt, Shigella flexneri 2a str. 2457T
cacagagcugauuuccg

SEQ ID NO: 3864543 - RNA, 16 nt, Shigella flexneri 2a str. 2457T
cacagaggcagcaucu

SEQ ID NO: 3864544 - RNA, 20 nt, Shigella flexneri 2a str. 2457T
cacagaggcagcaucucgcg

SEQ ID NO: 3864545 - RNA, 18 nt, Shigella flexneri 2a str. 2457T
cacagaggucuuuucucg

SEQ ID NO: 3864546 - RNA, 14 nt, Shigella flexneri 2a str. 2457T
cacagaguauuucc

SEQ ID NO: 3864547 - RNA, 17 nt, Shigella flexneri 2a str. 2457T
cacagauugauaaaaau

SEQ ID NO: 3864548 - RNA, 18 nt, Shigella flexneri 2a str. 2457T
cacagauugauaaaaaua

SEQ ID NO: 3864549 - RNA, 20 nt, Shigella flexneri 2a str. 2457T
cacagauuuccaagcgcggc

SEQ ID NO: 3864550 - RNA, 17 nt, Shigella flexneri 2a str. 2457T
cacagcacgcuuuucag

SEQ ID NO: 3864551 - RNA, 15 nt, Shigella flexneri 2a str. 2457T
cacagcagccuucgc

SEQ ID NO: 3864552 - RNA, 15 nt, Shigella flexneri 2a str. 2457T
cacagcaguugugug

SEQ ID NO: 3864553 - RNA, 15 nt, Shigella flexneri 2a str. 2457T
cacagcccgccgcca

SEQ ID NO: 3864554 - RNA, 15 nt, Shigella flexneri 2a str. 2457T
cacagccgagcgcca

SEQ ID NO: 3864555 - RNA, 18 nt, Shigella flexneri 2a str. 2457T
cacagccgagcgccacca

SEQ ID NO: 3864556 - RNA, 11 nt, Shigella flexneri 2a str. 2457T
cacagccgcag

SEQ ID NO: 3864557 - RNA, 15 nt, Shigella flexneri 2a str. 2457T
cacagccgcaggccu

SEQ ID NO: 3864558 - RNA, 14 nt, Shigella flexneri 2a str. 2457T
cacagcgacguaaa

SEQ ID NO: 3864559 - RNA, 21 nt, Shigella flexneri 2a str. 2457T
cacaggccaucacauccugau

SEQ ID NO: 3864560 - RNA, 15 nt, Shigella flexneri 2a str. 2457T
cacaggccauuuccc

SEQ ID NO: 3864561 - RNA, 12 nt, Shigella flexneri 2a str. 2457T
cacaggccgcca

SEQ ID NO: 3864562 - RNA, 19 nt, Shigella flexneri 2a str. 2457T
cacaggccggagccagccg

SEQ ID NO: 3864563 - RNA, 23 nt, Shigella flexneri 2a str. 2457T
cacaggccugauaagacgcgcag

SEQ ID NO: 3864564 - RNA, 20 nt, Shigella flexneri 2a str. 2457T
cacagggcucuuaagcaccg

SEQ ID NO: 3864565 - RNA, 13 nt, Shigella flexneri 2a str. 2457T
cacagggugauca

SEQ ID NO: 3864566 - RNA, 20 nt, Shigella flexneri 2a str. 2457T
cacaggguguauucaugccc

SEQ ID NO: 3864567 - RNA, 20 nt, Shigella flexneri 2a str. 2457T
cacaggucagcaggagcagc

SEQ ID NO: 3864568 - RNA, 19 nt, Shigella flexneri 2a str. 2457T
cacagguuuguagaacgua

SEQ ID NO: 3864569 - RNA, 21 nt, Shigella flexneri 2a str. 2457T
cacaguaaugauuuaaaacca

SEQ ID NO: 3864570 - RNA, 18 nt, Shigella flexneri 2a str. 2457T
cacagucacuacgcgacc

SEQ ID NO: 3864571 - RNA, 16 nt, Shigella flexneri 2a str. 2457T
cacagugaaucucuua

SEQ ID NO: 3864572 - RNA, 22 nt, Shigella flexneri 2a str. 2457T
cacagugacccgcagccagcac

SEQ ID NO: 3864573 - RNA, 18 nt, Shigella flexneri 2a str. 2457T
cacagugaugaaaacgaa

SEQ ID NO: 3864574 - RNA, 16 nt, Shigella flexneri 2a str. 2457T
cacagugcugauuuug

SEQ ID NO: 3864575 - RNA, 22 nt, Shigella flexneri 2a str. 2457T
cacauacgacgcuucaguucag

SEQ ID NO: 3864576 - RNA, 18 nt, Shigella flexneri 2a str. 2457T
cacauacugcaucagcgc

SEQ ID NO: 3864577 - RNA, 16 nt, Shigella flexneri 2a str. 2457T
cacauacuuauuauga

SEQ ID NO: 3864578 - RNA, 15 nt, Shigella flexneri 2a str. 2457T
cacauaugaucggaa

SEQ ID NO: 3864579 - RNA, 23 nt, Shigella flexneri 2a str. 2457T
cacauauucgccgcccugcagca

SEQ ID NO: 3864580 - RNA, 15 nt, Shigella flexneri 2a str. 2457T
cacauauugcagcuu

SEQ ID NO: 3864581 - RNA, 18 nt, Shigella flexneri 2a str. 2457T
cacaucaacucugcaaug

SEQ ID NO: 3864582 - RNA, 13 nt, Shigella flexneri 2a str. 2457T
cacaucaauuugc

SEQ ID NO: 3864583 - RNA, 14 nt, Shigella flexneri 2a str. 2457T
cacaucaauuugcc

SEQ ID NO: 3864584 - RNA, 13 nt, Shigella flexneri 2a str. 2457T
cacaucaccauaa

SEQ ID NO: 3864585 - RNA, 15 nt, Shigella flexneri 2a str. 2457T
cacaucaccauagcc

SEQ ID NO: 3864586 - RNA, 19 nt, Shigella flexneri 2a str. 2457T
cacaucacuccauccagca

SEQ ID NO: 3864587 - RNA, 14 nt, Shigella flexneri 2a str. 2457T
cacaucagacucag

SEQ ID NO: 3864588 - RNA, 17 nt, Shigella flexneri 2a str. 2457T
cacaucagacucagucg

SEQ ID NO: 3864589 - RNA, 20 nt, Shigella flexneri 2a str. 2457T
cacaucagccagaugcaccg

SEQ ID NO: 3864590 - RNA, 16 nt, Shigella flexneri 2a str. 2457T
cacaucaucaaagcca

SEQ ID NO: 3864591 - RNA, 15 nt, Shigella flexneri 2a str. 2457T
cacaucaucaucgcg

SEQ ID NO: 3864592 - RNA, 22 nt, Shigella flexneri 2a str. 2457T
cacauccacgccuuuuuucacu

SEQ ID NO: 3864593 - RNA, 13 nt, Shigella flexneri 2a str. 2457T
cacauccaguggc

SEQ ID NO: 3864594 - RNA, 14 nt, Shigella flexneri 2a str. 2457T
cacaucccagcaga

SEQ ID NO: 3864595 - RNA, 11 nt, Shigella flexneri 2a str. 2457T
cacauccggcc

SEQ ID NO: 3864596 - RNA, 23 nt, Shigella flexneri 2a str. 2457T
cacaucgccgaccgcaaccggcc

SEQ ID NO: 3864597 - RNA, 20 nt, Shigella flexneri 2a str. 2457T
cacaucgcugugcugcugac

SEQ ID NO: 3864598 - RNA, 22 nt, Shigella flexneri 2a str. 2457T
cacaugaauucgacuuucucug

SEQ ID NO: 3864599 - RNA, 15 nt, Shigella flexneri 2a str. 2457T
cacaugaguugcugg

SEQ ID NO: 3864600 - RNA, 16 nt, Shigella flexneri 2a str. 2457T
cacaugaguugcugga

SEQ ID NO: 3864601 - RNA, 23 nt, Shigella flexneri 2a str. 2457T
cacaugcaacgucaucaccggcu

SEQ ID NO: 3864602 - RNA, 13 nt, Shigella flexneri 2a str. 2457T
cacaugcagcgcc

SEQ ID NO: 3864603 - RNA, 22 nt, Shigella flexneri 2a str. 2457T
cacaugguuuacggcggucugg

SEQ ID NO: 3864604 - RNA, 13 nt, Shigella flexneri 2a str. 2457T
cacauuagauaaa

SEQ ID NO: 3864605 - RNA, 14 nt, Shigella flexneri 2a str. 2457T
cacauuaucaaacg

SEQ ID NO: 3864606 - RNA, 16 nt, Shigella flexneri 2a str. 2457T
cacauuccucugucag

SEQ ID NO: 3864607 - RNA, 13 nt, Shigella flexneri 2a str. 2457T
ggccgaggcacag

SEQ ID NO: 3864608 - RNA, 18 nt, Shigella flexneri 2a str. 2457T
ggccgcaaaccagcgcau

SEQ ID NO: 3864609 - RNA, 21 nt, Shigella flexneri 2a str. 2457T
ggccgcaggcuguuaccccug

SEQ ID NO: 3864610 - RNA, 16 nt, Shigella flexneri 2a str. 2457T
ggccgccacacagcac

SEQ ID NO: 3864611 - RNA, 19 nt, Shigella flexneri 2a str. 2457T
ggccgcgccgacugcgcca

SEQ ID NO: 3864612 - RNA, 16 nt, Shigella flexneri 2a str. 2457T
ggccgcuuccagcauu

SEQ ID NO: 3864613 - RNA, 11 nt, Shigella flexneri 2a str. 2457T
ggccgcuuucu

SEQ ID NO: 3864614 - RNA, 13 nt, Shigella flexneri 2a str. 2457T
ggccggagccagc

SEQ ID NO: 3864615 - RNA, 16 nt, Shigella flexneri 2a str. 2457T
ggccggagccagccgu

SEQ ID NO: 3864616 - RNA, 16 nt, Shigella flexneri 2a str. 2457T
ggccggauaaggcgcu

SEQ ID NO: 3864617 - RNA, 15 nt, Shigella flexneri 2a str. 2457T
ggccggaugacagac

SEQ ID NO: 3864618 - RNA, 18 nt, Shigella flexneri 2a str. 2457T
ggccggaugucgcugcua

SEQ ID NO: 3864619 - RNA, 22 nt, Shigella flexneri 2a str. 2457T
ggccggcauauaccucagcaga

SEQ ID NO: 3864620 - RNA, 18 nt, Shigella flexneri 2a str. 2457T
ggccggguuuucucccuc

SEQ ID NO: 3864621 - RNA, 19 nt, Shigella flexneri 2a str. 2457T
ggccguauggcgagcagga

SEQ ID NO: 3864622 - RNA, 16 nt, Shigella flexneri 2a str. 2457T
ggccuaacaccaucag

SEQ ID NO: 3864623 - RNA, 21 nt, Shigella flexneri 2a str. 2457T
ggccuacaaaaucuauugcaa

SEQ ID NO: 3864624 - RNA, 20 nt, Shigella flexneri 2a str. 2457T
ggccuacaaguccguugaaa

SEQ ID NO: 3864625 - RNA, 14 nt, Shigella flexneri 2a str. 2457T
ggccuacacaugcg

SEQ ID NO: 3864626 - RNA, 19 nt, Shigella flexneri 2a str. 2457T
ggccuacauagucccugca

SEQ ID NO: 3864627 - RNA, 19 nt, Shigella flexneri 2a str. 2457T
ggccuaccaugaccugcaa

SEQ ID NO: 3864628 - RNA, 19 nt, Shigella flexneri 2a str. 2457T
ggccuacgcguccccugca

SEQ ID NO: 3864629 - RNA, 15 nt, Shigella flexneri 2a str. 2457T
ggcguaaugccuggg

SEQ ID NO: 3864630 - RNA, 12 nt, Shigella flexneri 2a str. 2457T
ggcgucaaacgg

SEQ ID NO: 3864631 - RNA, 22 nt, Shigella flexneri 2a str. 2457T
ggcgucaaacggcuaaagccgu

SEQ ID NO: 3864632 - RNA, 20 nt, Shigella flexneri 2a str. 2457T
ggcgucacgccgaccagacc

SEQ ID NO: 3864633 - RNA, 24 nt, Shigella flexneri 2a str. 2457T
ggcgucagcguuccacgugcggcc

SEQ ID NO: 3864634 - RNA, 18 nt, Shigella flexneri 2a str. 2457T
ggcguccuggaacuggug

SEQ ID NO: 3864635 - RNA, 13 nt, Shigella flexneri 2a str. 2457T
ggcgucuccaccu

SEQ ID NO: 3864636 - RNA, 18 nt, Shigella flexneri 2a str. 2457T
ggcgugaacgccuuaucu

SEQ ID NO: 3864637 - RNA, 18 nt, Shigella flexneri 2a str. 2457T
ggcgugagaucgcgcggg

SEQ ID NO: 3864638 - RNA, 20 nt, Shigella flexneri 2a str. 2457T
ggcgugauucauacagcggc

SEQ ID NO: 3864639 - RNA, 15 nt, Shigella flexneri 2a str. 2457T
ggcgugauuccagac

SEQ ID NO: 3864640 - RNA, 15 nt, Shigella flexneri 2a str. 2457T
ggcgugguccagcug

SEQ ID NO: 3864641 - RNA, 15 nt, Shigella flexneri 2a str. 2457T
ggcguggucgguuaa

SEQ ID NO: 3864642 - RNA, 15 nt, Shigella flexneri 2a str. 2457T
ggcguuaaaacaggu

SEQ ID NO: 3864643 - RNA, 14 nt, Shigella flexneri 2a str. 2457T
ggcguuacagcugg

SEQ ID NO: 3864644 - RNA, 16 nt, Shigella flexneri 2a str. 2457T
ggcguuauggcaaucu

SEQ ID NO: 3864645 - RNA, 15 nt, Shigella flexneri 2a str. 2457T
ggcguucacgccgca

SEQ ID NO: 3864646 - RNA, 15 nt, Shigella flexneri 2a str. 2457T
ggcguucugccuggc

SEQ ID NO: 3864647 - RNA, 22 nt, Shigella flexneri 2a str. 2457T
ggcguucugccuggcgcagcaa

SEQ ID NO: 3864648 - RNA, 17 nt, Shigella flexneri 2a str. 2457T
ggcguugcccaucgcca

SEQ ID NO: 3864649 - RNA, 19 nt, Shigella flexneri 2a str. 2457T
ggcguuuacgccgcaucag

SEQ ID NO: 3864650 - RNA, 17 nt, Shigella flexneri 2a str. 2457T
ggcguuucacuucugag

SEQ ID NO: 3864651 - RNA, 14 nt, Shigella flexneri 2a str. 2457T
ggcguuuccagcuc

SEQ ID NO: 3864652 - RNA, 14 nt, Shigella flexneri 2a str. 2457T
ggcguuuucuggca

SEQ ID NO: 3864653 - RNA, 23 nt, Shigella flexneri 2a str. 2457T
ggcguuuugauuuucaccagcau

SEQ ID NO: 3864654 - RNA, 15 nt, Shigella flexneri 2a str. 2457T
ggcuaaaaacgccgc

SEQ ID NO: 3864655 - RNA, 18 nt, Shigella flexneri 2a str. 2457T
ggcuaaacguguaguauu

SEQ ID NO: 3864656 - RNA, 21 nt, Shigella flexneri 2a str. 2457T
ggcuaaccuuaugguguucag

SEQ ID NO: 3864657 - RNA, 18 nt, Shigella flexneri 2a str. 2457T
ggcuaaucgucaucgaca

SEQ ID NO: 3864658 - RNA, 21 nt, Shigella flexneri 2a str. 2457T
ggcuaaucuugaaaccagaca

SEQ ID NO: 3864659 - RNA, 15 nt, Shigella flexneri 2a str. 2457T
ggcuaaugccaguca

SEQ ID NO: 3864660 - RNA, 16 nt, Shigella flexneri 2a str. 2457T
ggcuaaugccagucag

SEQ ID NO: 3864661 - RNA, 15 nt, Shigella flexneri 2a str. 2457T
ggcuagccucccugc

SEQ ID NO: 3864662 - RNA, 14 nt, Shigella flexneri 2a str. 2457T
ggcuauauucaaac

SEQ ID NO: 3864663 - RNA, 12 nt, Shigella flexneri 2a str. 2457T
ggcuaucccaaa

SEQ ID NO: 3864664 - RNA, 15 nt, Shigella flexneri 2a str. 2457T
ggcucaccugcacac

SEQ ID NO: 3864665 - RNA, 15 nt, Shigella flexneri 2a str. 2457T
ggcucauaccuucca

SEQ ID NO: 3864666 - RNA, 23 nt, Shigella flexneri 2a str. 2457T
ggcucaucaccccgcgcucacac

SEQ ID NO: 3864667 - RNA, 21 nt, Shigella flexneri 2a str. 2457T
ggcucauugccauucgccagu

SEQ ID NO: 3864668 - RNA, 15 nt, Shigella flexneri 2a str. 2457T
ggcuccacuucguuc

SEQ ID NO: 3864669 - RNA, 14 nt, Shigella flexneri 2a str. 2457T
ggcuccagcaaugu

SEQ ID NO: 3864670 - RNA, 14 nt, Shigella flexneri 2a str. 2457T
ggcucccgcagcca

SEQ ID NO: 3864671 - RNA, 22 nt, Shigella flexneri 2a str. 2457T
ggcucccggcgguaaaucgccg

SEQ ID NO: 3864672 - RNA, 18 nt, Shigella flexneri 2a str. 2457T
ggcuccgcugacgccugc

SEQ ID NO: 3864673 - RNA, 19 nt, Shigella flexneri 2a str. 2457T
ggcuccgguuaacgccgcg

SEQ ID NO: 3864674 - RNA, 21 nt, Shigella flexneri 2a str. 2457T
ggcuccgguuaacgccgcgcc

SEQ ID NO: 3864675 - RNA, 22 nt, Shigella flexneri 2a str. 2457T
ggcucgccuuucggcugcagca

SEQ ID NO: 3864676 - RNA, 23 nt, Shigella flexneri 2a str. 2457T
ggcucgguaaaaucaacgccgca

SEQ ID NO: 3864677 - RNA, 19 nt, Shigella flexneri 2a str. 2457T
ggcucugauugccuuccac

SEQ ID NO: 3864678 - RNA, 19 nt, Shigella flexneri 2a str. 2457T
ggcucugguguucuuuuac

SEQ ID NO: 3864679 - RNA, 14 nt, Shigella flexneri 2a str. 2457T
ggcucuuuaaacag

SEQ ID NO: 3864680 - RNA, 13 nt, Shigella flexneri 2a str. 2457T
ggcugaagaagua

SEQ ID NO: 3864681 - RNA, 14 nt, Shigella flexneri 2a str. 2457T
ggcugacaaaucag

SEQ ID NO: 3864682 - RNA, 19 nt, Shigella flexneri 2a str. 2457T
ggcugacguuaagaaaacg

SEQ ID NO: 3864683 - RNA, 10 nt, Shigella flexneri 2a str. 2457T
ggcugacugu

SEQ ID NO: 3864684 - RNA, 21 nt, Shigella flexneri 2a str. 2457T
ggcugacugucgcagccagcg

SEQ ID NO: 3864685 - RNA, 23 nt, Shigella flexneri 2a str. 2457T
ggcugagauuuaugacaaacgca

SEQ ID NO: 3864686 - RNA, 21 nt, Shigella flexneri 2a str. 2457T
ggcugagcaaacaguucugca

SEQ ID NO: 3864687 - RNA, 22 nt, Shigella flexneri 2a str. 2457T
ggcugagcaaacaguucugcag

SEQ ID NO: 3864688 - RNA, 18 nt, Shigella flexneri 2a str. 2457T
ggcugauaaacaagcgua

SEQ ID NO: 3864689 - RNA, 22 nt, Shigella flexneri 2a str. 2457T
ggcugauuccgguuggccugcc

SEQ ID NO: 3864690 - RNA, 17 nt, Shigella flexneri 2a str. 2457T
ggcugcagaauacggau

SEQ ID NO: 3864691 - RNA, 14 nt, Shigella flexneri 2a str. 2457T
ggcugcauaaugcg

SEQ ID NO: 3864692 - RNA, 24 nt, Shigella flexneri 2a str. 2457T
ggcugccagaucaucguuuccgau

SEQ ID NO: 3864693 - RNA, 13 nt, Shigella flexneri 2a str. 2457T
ggcugccaugguu

SEQ ID NO: 3864694 - RNA, 13 nt, Shigella flexneri 2a str. 2457T
ggcugcccaugcc

SEQ ID NO: 3864695 - RNA, 10 nt, Shigella flexneri 2a str. 2457T
ggcugccgcc

SEQ ID NO: 3864696 - RNA, 15 nt, Shigella flexneri 2a str. 2457T
ggcugccugagcugu

SEQ ID NO: 3864697 - RNA, 15 nt, Shigella flexneri 2a str. 2457T
ggcugcgggaaaucg

SEQ ID NO: 3864698 - RNA, 20 nt, Shigella flexneri 2a str. 2457T
ggcugcugcuguagccgaug

SEQ ID NO: 3864699 - RNA, 18 nt, Shigella flexneri 2a str. 2457T
ggcuggaagcuggauuaa

SEQ ID NO: 3864700 - RNA, 16 nt, Shigella flexneri 2a str. 2457T
ggcuggcacaaaaaau

SEQ ID NO: 3864701 - RNA, 16 nt, Shigella flexneri 2a str. 2457T
ggcuggcacgcucuuc

SEQ ID NO: 3864702 - RNA, 21 nt, Shigella flexneri 2a str. 2457T
ggcuggcauuuuuuauggugg

SEQ ID NO: 3864703 - RNA, 19 nt, Shigella flexneri 2a str. 2457T
ggcuggccccgucagcaaa

SEQ ID NO: 3864704 - RNA, 20 nt, Shigella flexneri 2a str. 2457T
ggcuggcucguugcgccggg

SEQ ID NO: 3864705 - RNA, 13 nt, Shigella flexneri 2a str. 2457T
ggcuggcuguucu

SEQ ID NO: 3864706 - RNA, 20 nt, Shigella flexneri 2a str. 2457T
gcgcuucgcuuauccgaccu

SEQ ID NO: 3864707 - RNA, 13 nt, Shigella flexneri 2a str. 2457T
gcgcuucugccac

SEQ ID NO: 3864708 - RNA, 16 nt, Shigella flexneri 2a str. 2457T
gcgcuuuuaccgcguc

SEQ ID NO: 3864709 - RNA, 14 nt, Shigella flexneri 2a str. 2457T
gcgcuuuuggcgcg

SEQ ID NO: 3864710 - RNA, 17 nt, Shigella flexneri 2a str. 2457T
gcgcuuuuuuccugccg

SEQ ID NO: 3864711 - RNA, 19 nt, Shigella flexneri 2a str. 2457T
gcggaaacgacuauuaaac

SEQ ID NO: 3864712 - RNA, 23 nt, Shigella flexneri 2a str. 2457T
gcggaaauaucggcgucguugua

SEQ ID NO: 3864713 - RNA, 20 nt, Shigella flexneri 2a str. 2457T
gcggaaaucacgauugcugc

SEQ ID NO: 3864714 - RNA, 19 nt, Shigella flexneri 2a str. 2457T
gcggaaaucacgcaucacu

SEQ ID NO: 3864715 - RNA, 14 nt, Shigella flexneri 2a str. 2457T
gcggaaaucuccag

SEQ ID NO: 3864716 - RNA, 15 nt, Shigella flexneri 2a str. 2457T
gcggaaauuaccgca

SEQ ID NO: 3864717 - RNA, 18 nt, Shigella flexneri 2a str. 2457T
gcggaacaucgccugccg

SEQ ID NO: 3864718 - RNA, 12 nt, Shigella flexneri 2a str. 2457T
gcggaacccagc

SEQ ID NO: 3864719 - RNA, 15 nt, Shigella flexneri 2a str. 2457T
gcggaacccagcgcg

SEQ ID NO: 3864720 - RNA, 19 nt, Shigella flexneri 2a str. 2457T
gcggaagacccggcggcgc

SEQ ID NO: 3864721 - RNA, 18 nt, Shigella flexneri 2a str. 2457T
gcggaauauuuuuaccgu

SEQ ID NO: 3864722 - RNA, 14 nt, Shigella flexneri 2a str. 2457T
gcggaaucaccggc

SEQ ID NO: 3864723 - RNA, 16 nt, Shigella flexneri 2a str. 2457T
gcggaauuugaugaga

SEQ ID NO: 3864724 - RNA, 20 nt, Shigella flexneri 2a str. 2457T
gcggacaauaauaucuuuuu

SEQ ID NO: 3864725 - RNA, 23 nt, Shigella flexneri 2a str. 2457T
gcggacagccauccgucauccau

SEQ ID NO: 3864726 - RNA, 16 nt, Shigella flexneri 2a str. 2457T
gcggaccaacaaaaau

SEQ ID NO: 3864727 - RNA, 16 nt, Shigella flexneri 2a str. 2457T
gcggacgagagaguga

SEQ ID NO: 3864728 - RNA, 14 nt, Shigella flexneri 2a str. 2457T
gcggacgguucccu

SEQ ID NO: 3864729 - RNA, 18 nt, Shigella flexneri 2a str. 2457T
gcggacugaacgcggccc

SEQ ID NO: 3864730 - RNA, 14 nt, Shigella flexneri 2a str. 2457T
gcggacugaauacg

SEQ ID NO: 3864731 - RNA, 20 nt, Shigella flexneri 2a str. 2457T
gcggacugaauacgcuggcg

SEQ ID NO: 3864732 - RNA, 22 nt, Shigella flexneri 2a str. 2457T
gcggagacucaaaccccgcagc

SEQ ID NO: 3864733 - RNA, 14 nt, Shigella flexneri 2a str. 2457T
gcggagcgccuguc

SEQ ID NO: 3864734 - RNA, 21 nt, Shigella flexneri 2a str. 2457T
gcggaguaaucgccagcaaaa

SEQ ID NO: 3864735 - RNA, 22 nt, Shigella flexneri 2a str. 2457T
gcggaguuuucggggcgaucgc

SEQ ID NO: 3864736 - RNA, 14 nt, Shigella flexneri 2a str. 2457T
gcggauauaaaauu

SEQ ID NO: 3864737 - RNA, 23 nt, Shigella flexneri 2a str. 2457T
gcggaucguuaaacucugccgca

SEQ ID NO: 3864738 - RNA, 20 nt, Shigella flexneri 2a str. 2457T
gcggaucucuucguuuucaa

SEQ ID NO: 3864739 - RNA, 13 nt, Shigella flexneri 2a str. 2457T
gcggaucugcucc

SEQ ID NO: 3864740 - RNA, 13 nt, Shigella flexneri 2a str. 2457T
gcggaugacccag

SEQ ID NO: 3864741 - RNA, 15 nt, Shigella flexneri 2a str. 2457T
gcggaugacccagcg

SEQ ID NO: 3864742 - RNA, 21 nt, Shigella flexneri 2a str. 2457T
gcggaugaggcguuaacagcg

SEQ ID NO: 3864743 - RNA, 19 nt, Shigella flexneri 2a str. 2457T
gcggauggaguggggcgga

SEQ ID NO: 3864744 - RNA, 12 nt, Shigella flexneri 2a str. 2457T
gcggauggcgaa

SEQ ID NO: 3864745 - RNA, 23 nt, Shigella flexneri 2a str. 2457T
gcggauugcuucugcuucagccg

SEQ ID NO: 3864746 - RNA, 11 nt, Shigella flexneri 2a str. 2457T
gcggauuucac

SEQ ID NO: 3864747 - RNA, 18 nt, Shigella flexneri 2a str. 2457T
gcggauuuuauucagcag

SEQ ID NO: 3864748 - RNA, 18 nt, Shigella flexneri 2a str. 2457T
gcggcaaaaucgccggug

SEQ ID NO: 3864749 - RNA, 16 nt, Shigella flexneri 2a str. 2457T
gcggcaaacaguuucu

SEQ ID NO: 3864750 - RNA, 20 nt, Shigella flexneri 2a str. 2457T
gcggcaagaucgcgaugggu

SEQ ID NO: 3864751 - RNA, 19 nt, Shigella flexneri 2a str. 2457T
gcggcaauccccgccagca

SEQ ID NO: 3864752 - RNA, 17 nt, Shigella flexneri 2a str. 2457T
gcggcaaucgccagaau

SEQ ID NO: 3864753 - RNA, 22 nt, Shigella flexneri 2a str. 2457T
gcggcaaugaaagcgagcgagc

SEQ ID NO: 3864754 - RNA, 12 nt, Shigella flexneri 2a str. 2457T
gcggcaauggcu

SEQ ID NO: 3864755 - RNA, 23 nt, Shigella flexneri 2a str. 2457T
gcggcaauuagcggccagcgggc

SEQ ID NO: 3864756 - RNA, 18 nt, Shigella flexneri 2a str. 2457T
gcggcaauuagcggcugg

SEQ ID NO: 3864757 - RNA, 19 nt, Shigella flexneri 2a str. 2457T
gcggcaauuagcggcuggc

SEQ ID NO: 3864758 - RNA, 21 nt, Shigella flexneri 2a str. 2457T
gcggcaauuagcggcuggcug

SEQ ID NO: 3864759 - RNA, 19 nt, Shigella flexneri 2a str. 2457T
gcggcaauucuuucucgcu

SEQ ID NO: 3864760 - RNA, 22 nt, Shigella flexneri 2a str. 2457T
gcggcaauucuuucucgcucag

SEQ ID NO: 3864761 - RNA, 16 nt, Shigella flexneri 2a str. 2457T
gcggcacagaaacgcc

SEQ ID NO: 3864762 - RNA, 21 nt, Shigella flexneri 2a str. 2457T
gcggcacagcggaguaaucgc

SEQ ID NO: 3864763 - RNA, 22 nt, Shigella flexneri 2a str. 2457T
gcggcacugguacucaaccgcc

SEQ ID NO: 3864764 - RNA, 18 nt, Shigella flexneri 2a str. 2457T
gcggcacuguuucgccag

SEQ ID NO: 3864765 - RNA, 14 nt, Shigella flexneri 2a str. 2457T
gcggcagaaugguu

SEQ ID NO: 3864766 - RNA, 17 nt, Shigella flexneri 2a str. 2457T
gcggcagcaauggcacu

SEQ ID NO: 3864767 - RNA, 17 nt, Shigella flexneri 2a str. 2457T
gcggcagcucgcguucg

SEQ ID NO: 3864768 - RNA, 21 nt, Shigella flexneri 2a str. 2457T
gcggcagcuuguacugcucgc

SEQ ID NO: 3864769 - RNA, 18 nt, Shigella flexneri 2a str. 2457T
gcggcaggcagcgccacg

SEQ ID NO: 3864770 - RNA, 20 nt, Shigella flexneri 2a str. 2457T
gcggcaggcagcgccacgua

SEQ ID NO: 3864771 - RNA, 17 nt, Shigella flexneri 2a str. 2457T
gcggcaggcguaacacu

SEQ ID NO: 3864772 - RNA, 14 nt, Shigella flexneri 2a str. 2457T
gcggcagguugaug

SEQ ID NO: 3864773 - RNA, 15 nt, Shigella flexneri 2a str. 2457T
gcggcaguaaauauu

SEQ ID NO: 3864774 - RNA, 17 nt, Shigella flexneri 2a str. 2457T
gcggcaguauagcggca

SEQ ID NO: 3864775 - RNA, 12 nt, Shigella flexneri 2a str. 2457T
gcggcaguucgu

SEQ ID NO: 3864776 - RNA, 14 nt, Shigella flexneri 2a str. 2457T
gcggcaucuucucc

SEQ ID NO: 3864777 - RNA, 16 nt, Shigella flexneri 2a str. 2457T
gcggcaucuucuccac

SEQ ID NO: 3864778 - RNA, 16 nt, Shigella flexneri 2a str. 2457T
gcggcauuacgcccga

SEQ ID NO: 3864779 - RNA, 24 nt, Shigella flexneri 2a str. 2457T
gcggcauugcaaugacgccgagga

SEQ ID NO: 3864780 - RNA, 15 nt, Shigella flexneri 2a str. 2457T
gcggccaaagggagc

SEQ ID NO: 3864781 - RNA, 14 nt, Shigella flexneri 2a str. 2457T
gcggccguuccauu

SEQ ID NO: 3864782 - RNA, 22 nt, Shigella flexneri 2a str. 2457T
gcggccuuuaccuucgccgccc

SEQ ID NO: 3864783 - RNA, 18 nt, Shigella flexneri 2a str. 2457T
gcggcgaaaacgccacau

SEQ ID NO: 3864784 - RNA, 23 nt, Shigella flexneri 2a str. 2457T
gcggcgaaaacgccacauccggc

SEQ ID NO: 3864785 - RNA, 17 nt, Shigella flexneri 2a str. 2457T
gcggcgaaccagccguu

SEQ ID NO: 3864786 - RNA, 18 nt, Shigella flexneri 2a str. 2457T
gcggcgaaccagccguug

SEQ ID NO: 3864787 - RNA, 22 nt, Shigella flexneri 2a str. 2457T
gcggcgaacugccgaucaccac

SEQ ID NO: 3864788 - RNA, 14 nt, Shigella flexneri 2a str. 2457T
gcggcgaaggugcc

SEQ ID NO: 3864789 - RNA, 17 nt, Shigella flexneri 2a str. 2457T
gcggcgaauguuccauc

SEQ ID NO: 3864790 - RNA, 14 nt, Shigella flexneri 2a str. 2457T
gcggcgacaauaau

SEQ ID NO: 3864791 - RNA, 18 nt, Shigella flexneri 2a str. 2457T
gcggcgacuuccagcgau

SEQ ID NO: 3864792 - RNA, 17 nt, Shigella flexneri 2a str. 2457T
gcggcgauauccagcgc

SEQ ID NO: 3864793 - RNA, 18 nt, Shigella flexneri 2a str. 2457T
gcggcgaucuuuuaauaa

SEQ ID NO: 3864794 - RNA, 16 nt, Shigella flexneri 2a str. 2457T
gcggcgaugaccgcca

SEQ ID NO: 3864795 - RNA, 18 nt, Shigella flexneri 2a str. 2457T
gcggcgcaacccccacac

SEQ ID NO: 3864796 - RNA, 16 nt, Shigella flexneri 2a str. 2457T
gcggcgcaagcggcga

SEQ ID NO: 3864797 - RNA, 14 nt, Shigella flexneri 2a str. 2457T
gcggcgcaggcgcu

SEQ ID NO: 3864798 - RNA, 15 nt, Shigella flexneri 2a str. 2457T
gcggcgcgcgcugcu

SEQ ID NO: 3864799 - RNA, 18 nt, Shigella flexneri 2a str. 2457T
gcggcggacgugcaccgu

SEQ ID NO: 3864800 - RNA, 20 nt, Shigella flexneri 2a str. 2457T
gcggcggauauguucucggu

SEQ ID NO: 3864801 - RNA, 15 nt, Shigella flexneri 2a str. 2457T
gcggcggcaaaauca

SEQ ID NO: 3864802 - RNA, 21 nt, Shigella flexneri 2a str. 2457T
gcggcggcagauugagcguca

SEQ ID NO: 3864803 - RNA, 13 nt, Shigella flexneri 2a str. 2457T
gcggcggcgggcg

SEQ ID NO: 3864804 - RNA, 17 nt, Shigella flexneri 2a str. 2457T
gcguccgguaauuuuua

SEQ ID NO: 3864805 - RNA, 18 nt, Shigella flexneri 2a str. 2457T
gcguccugccugggacgg

SEQ ID NO: 3864806 - RNA, 18 nt, Shigella flexneri 2a str. 2457T
gcgucgacauagccaucc

SEQ ID NO: 3864807 - RNA, 20 nt, Shigella flexneri 2a str. 2457T
gcgucgacauagccaucccu

SEQ ID NO: 3864808 - RNA, 16 nt, Shigella flexneri 2a str. 2457T
gcgucgauugcucaac

SEQ ID NO: 3864809 - RNA, 19 nt, Shigella flexneri 2a str. 2457T
gcgucgcaucaggcaucug

SEQ ID NO: 3864810 - RNA, 14 nt, Shigella flexneri 2a str. 2457T
gcgucgcauccgac

SEQ ID NO: 3864811 - RNA, 17 nt, Shigella flexneri 2a str. 2457T
gcgucgcauccggcacu

SEQ ID NO: 3864812 - RNA, 13 nt, Shigella flexneri 2a str. 2457T
gcgucgccagcgc

SEQ ID NO: 3864813 - RNA, 14 nt, Shigella flexneri 2a str. 2457T
gcgucggaaccaca

SEQ ID NO: 3864814 - RNA, 20 nt, Shigella flexneri 2a str. 2457T
gcgucguccccacagcguca

SEQ ID NO: 3864815 - RNA, 17 nt, Shigella flexneri 2a str. 2457T
gcgucguucgcgccaac

SEQ ID NO: 3864816 - RNA, 21 nt, Shigella flexneri 2a str. 2457T
gcgucguucgcgccaacagcg

SEQ ID NO: 3864817 - RNA, 19 nt, Shigella flexneri 2a str. 2457T
gcgucucacuaucgcugag

SEQ ID NO: 3864818 - RNA, 16 nt, Shigella flexneri 2a str. 2457T
gcgucucauaccggau

SEQ ID NO: 3864819 - RNA, 23 nt, Shigella flexneri 2a str. 2457T
gcgucucaucuuuaucggugaga

SEQ ID NO: 3864820 - RNA, 16 nt, Shigella flexneri 2a str. 2457T
gcgucuggcccaugcc

SEQ ID NO: 3864821 - RNA, 18 nt, Shigella flexneri 2a str. 2457T
gcgucuggcccaugccag

SEQ ID NO: 3864822 - RNA, 11 nt, Shigella flexneri 2a str. 2457T
gcgucugggcg

SEQ ID NO: 3864823 - RNA, 15 nt, Shigella flexneri 2a str. 2457T
gcgucuuaucaggcc

SEQ ID NO: 3864824 - RNA, 14 nt, Shigella flexneri 2a str. 2457T
gcgucuuauccggc

SEQ ID NO: 3864825 - RNA, 16 nt, Shigella flexneri 2a str. 2457T
gcgucuuauccggccu

SEQ ID NO: 3864826 - RNA, 12 nt, Shigella flexneri 2a str. 2457T
gcgucuuaucug

SEQ ID NO: 3864827 - RNA, 18 nt, Shigella flexneri 2a str. 2457T
gcgucuuccgugccugac

SEQ ID NO: 3864828 - RNA, 15 nt, Shigella flexneri 2a str. 2457T
gcgucuugccaucau

SEQ ID NO: 3864829 - RNA, 22 nt, Shigella flexneri 2a str. 2457T
gcgugaacgccuaauccagccu

SEQ ID NO: 3864830 - RNA, 23 nt, Shigella flexneri 2a str. 2457T
gcgugaacgccuuauccggccug

SEQ ID NO: 3864831 - RNA, 19 nt, Shigella flexneri 2a str. 2457T
gcgugaacgugcaaaauca

SEQ ID NO: 3864832 - RNA, 19 nt, Shigella flexneri 2a str. 2457T
gcgugaacugggccugcau

SEQ ID NO: 3864833 - RNA, 20 nt, Shigella flexneri 2a str. 2457T
gcgugaagugugcaaacgau

SEQ ID NO: 3864834 - RNA, 14 nt, Shigella flexneri 2a str. 2457T
gcgugaaucaacac

SEQ ID NO: 3864835 - RNA, 14 nt, Shigella flexneri 2a str. 2457T
gcgugacaccagca

SEQ ID NO: 3864836 - RNA, 21 nt, Shigella flexneri 2a str. 2457T
gcgugacgcuggcagaaaguu

SEQ ID NO: 3864837 - RNA, 15 nt, Shigella flexneri 2a str. 2457T
gcgugacuaaaaccc

SEQ ID NO: 3864838 - RNA, 21 nt, Shigella flexneri 2a str. 2457T
gcgugagaucgcgcgggagca

SEQ ID NO: 3864839 - RNA, 15 nt, Shigella flexneri 2a str. 2457T
gcgugauggccagau

SEQ ID NO: 3864840 - RNA, 22 nt, Shigella flexneri 2a str. 2457T
gcgugauucauacagcggccag

SEQ ID NO: 3864841 - RNA, 12 nt, Shigella flexneri 2a str. 2457T
gcgugauuccag

SEQ ID NO: 3864842 - RNA, 16 nt, Shigella flexneri 2a str. 2457T
gcgugauuccagacgg

SEQ ID NO: 3864843 - RNA, 16 nt, Shigella flexneri 2a str. 2457T
gcgugauuguggcaau

SEQ ID NO: 3864844 - RNA, 14 nt, Shigella flexneri 2a str. 2457T
gcguggacggucaa

SEQ ID NO: 3864845 - RNA, 13 nt, Shigella flexneri 2a str. 2457T
gcguggagauguc

SEQ ID NO: 3864846 - RNA, 21 nt, Shigella flexneri 2a str. 2457T
gcguggcgauaaucagcgcca

SEQ ID NO: 3864847 - RNA, 13 nt, Shigella flexneri 2a str. 2457T
gcgugucccacug

SEQ ID NO: 3864848 - RNA, 13 nt, Shigella flexneri 2a str. 2457T
gcguguuccagag

SEQ ID NO: 3864849 - RNA, 23 nt, Shigella flexneri 2a str. 2457T
gcguguuccagagaacgaccauc

SEQ ID NO: 3864850 - RNA, 13 nt, Shigella flexneri 2a str. 2457T
gcguguucgguaa

SEQ ID NO: 3864851 - RNA, 21 nt, Shigella flexneri 2a str. 2457T
gcguuaacugcuuaucaucac

SEQ ID NO: 3864852 - RNA, 14 nt, Shigella flexneri 2a str. 2457T
gcguuaacuuguug

SEQ ID NO: 3864853 - RNA, 20 nt, Shigella flexneri 2a str. 2457T
gcguuaagccaucccagaca

SEQ ID NO: 3864854 - RNA, 15 nt, Shigella flexneri 2a str. 2457T
gcguuacauuuccag

SEQ ID NO: 3864855 - RNA, 14 nt, Shigella flexneri 2a str. 2457T
gcguuaccagcaaa

SEQ ID NO: 3864856 - RNA, 20 nt, Shigella flexneri 2a str. 2457T
gcguuacccauucaagauca

SEQ ID NO: 3864857 - RNA, 20 nt, Shigella flexneri 2a str. 2457T
gcguuaccggcacuggcagc

SEQ ID NO: 3864858 - RNA, 18 nt, Shigella flexneri 2a str. 2457T
gcguuagcaucgcaucag

SEQ ID NO: 3864859 - RNA, 17 nt, Shigella flexneri 2a str. 2457T
gcguuauccgcuuuuuc

SEQ ID NO: 3864860 - RNA, 15 nt, Shigella flexneri 2a str. 2457T
gcguucacgccacau

SEQ ID NO: 3864861 - RNA, 15 nt, Shigella flexneri 2a str. 2457T
gcguucacgccgcau

SEQ ID NO: 3864862 - RNA, 22 nt, Shigella flexneri 2a str. 2457T
gcguucacgccgcauccggcau

SEQ ID NO: 3864863 - RNA, 23 nt, Shigella flexneri 2a str. 2457T
gcguucacuguaguuauccgcaa

SEQ ID NO: 3864864 - RNA, 19 nt, Shigella flexneri 2a str. 2457T
gcguucagcaguucugcca

SEQ ID NO: 3864865 - RNA, 21 nt, Shigella flexneri 2a str. 2457T
gcguucaucaguuccaguuca

SEQ ID NO: 3864866 - RNA, 19 nt, Shigella flexneri 2a str. 2457T
gcguucauccaacaauagu

SEQ ID NO: 3864867 - RNA, 19 nt, Shigella flexneri 2a str. 2457T
gcguuccagcaucuccugc

SEQ ID NO: 3864868 - RNA, 23 nt, Shigella flexneri 2a str. 2457T
gcguuccaucagauucagcagcg

SEQ ID NO: 3864869 - RNA, 19 nt, Shigella flexneri 2a str. 2457T
gcguuccauuggcggcguc

SEQ ID NO: 3864870 - RNA, 13 nt, Shigella flexneri 2a str. 2457T
gcguuccccagaa

SEQ ID NO: 3864871 - RNA, 22 nt, Shigella flexneri 2a str. 2457T
gcguuccccuguugugccagac

SEQ ID NO: 3864872 - RNA, 23 nt, Shigella flexneri 2a str. 2457T
gcguucccguccgcacgcuggag

SEQ ID NO: 3864873 - RNA, 18 nt, Shigella flexneri 2a str. 2457T
gcguuccugcucuuccgg

SEQ ID NO: 3864874 - RNA, 18 nt, Shigella flexneri 2a str. 2457T
gcguucgauggcgcgcca

SEQ ID NO: 3864875 - RNA, 16 nt, Shigella flexneri 2a str. 2457T
gcguucgccaaaccca

SEQ ID NO: 3864876 - RNA, 22 nt, Shigella flexneri 2a str. 2457T
gcguucgcgccgcauccggcau

SEQ ID NO: 3864877 - RNA, 13 nt, Shigella flexneri 2a str. 2457T
gcguucgucgaua

SEQ ID NO: 3864878 - RNA, 13 nt, Shigella flexneri 2a str. 2457T
gcguucugccugg

SEQ ID NO: 3864879 - RNA, 15 nt, Shigella flexneri 2a str. 2457T
gcguucugucgauaa

SEQ ID NO: 3864880 - RNA, 22 nt, Shigella flexneri 2a str. 2457T
gcguucugucgauaaacucaug

SEQ ID NO: 3864881 - RNA, 20 nt, Shigella flexneri 2a str. 2457T
gcguugaugauuugucgaua

SEQ ID NO: 3864882 - RNA, 22 nt, Shigella flexneri 2a str. 2457T
gcguugcacgcagacacugcug

SEQ ID NO: 3864883 - RNA, 13 nt, Shigella flexneri 2a str. 2457T
gcguugcagcagg

SEQ ID NO: 3864884 - RNA, 14 nt, Shigella flexneri 2a str. 2457T
gcguugcgccuguu

SEQ ID NO: 3864885 - RNA, 16 nt, Shigella flexneri 2a str. 2457T
gcguugcuaugcugaa

SEQ ID NO: 3864886 - RNA, 14 nt, Shigella flexneri 2a str. 2457T
gcguuggcagguca

SEQ ID NO: 3864887 - RNA, 16 nt, Shigella flexneri 2a str. 2457T
gcguugucgccaucca

SEQ ID NO: 3864888 - RNA, 15 nt, Shigella flexneri 2a str. 2457T
gcguuuacgccgcau

SEQ ID NO: 3864889 - RNA, 18 nt, Shigella flexneri 2a str. 2457T
gcguuuaucgacagacgc

SEQ ID NO: 3864890 - RNA, 17 nt, Shigella flexneri 2a str. 2457T
gcguuuccagcaccagu

SEQ ID NO: 3864891 - RNA, 20 nt, Shigella flexneri 2a str. 2457T
gcguuucugcgcuucugcca

SEQ ID NO: 3864892 - RNA, 19 nt, Shigella flexneri 2a str. 2457T
gcguuugaaaaagccaaaa

SEQ ID NO: 3864893 - RNA, 14 nt, Shigella flexneri 2a str. 2457T
gcguuugcuccugc

SEQ ID NO: 3864894 - RNA, 16 nt, Shigella flexneri 2a str. 2457T
gcguuugcuccugcuu

SEQ ID NO: 3864895 - RNA, 22 nt, Shigella flexneri 2a str. 2457T
gcguuuugauuuucaccagcau

SEQ ID NO: 3864896 - RNA, 23 nt, Shigella flexneri 2a str. 2457T
gcguuuugauuuucaccagcauc

SEQ ID NO: 3864897 - RNA, 19 nt, Shigella flexneri 2a str. 2457T
gcguuuugccaguucguug

SEQ ID NO: 3864898 - RNA, 13 nt, Shigella flexneri 2a str. 2457T
gcguuuuucagaa

SEQ ID NO: 3864899 - RNA, 13 nt, Shigella flexneri 2a str. 2457T
gcguuuuucuuca

SEQ ID NO: 3864900 - RNA, 20 nt, Shigella flexneri 2a str. 2457T
gcguuuuuugauaguuuacu

SEQ ID NO: 3864901 - RNA, 14 nt, Shigella flexneri 2a str. 2457T
gcuaaaaacaucau

SEQ ID NO: 3864902 - RNA, 20 nt, Shigella flexneri 2a str. 2457T
gcuaaaaauagcgacuuggg

SEQ ID NO: 3864903 - RNA, 19 nt, Shigella flexneri 2a str. 2457T
gcuaaaguacguaaaacaa

SEQ ID NO: 3864904 - RNA, 17 nt, Shigella flexneri 2a str. 2457T
gcuaaauaaccagcaua

SEQ ID NO: 3864905 - RNA, 14 nt, Shigella flexneri 2a str. 2457T
gcuaaaugccgcgu

SEQ ID NO: 3864906 - RNA, 13 nt, Shigella flexneri 2a str. 2457T
gcuaacagcagca

SEQ ID NO: 3864907 - RNA, 16 nt, Shigella flexneri 2a str. 2457T
gcuaaccacgccgcuu

SEQ ID NO: 3864908 - RNA, 21 nt, Shigella flexneri 2a str. 2457T
gcuaaccgcuuuuccagcaua

SEQ ID NO: 3864909 - RNA, 17 nt, Shigella flexneri 2a str. 2457T
gcuaacuaggcgaacau

SEQ ID NO: 3864910 - RNA, 21 nt, Shigella flexneri 2a str. 2457T
gcuaacugguggcaggaaaac

SEQ ID NO: 3864911 - RNA, 19 nt, Shigella flexneri 2a str. 2457T
gcuaagcaggcuggcuacg

SEQ ID NO: 3864912 - RNA, 17 nt, Shigella flexneri 2a str. 2457T
gcuaagcgccaccguca

SEQ ID NO: 3864913 - RNA, 13 nt, Shigella flexneri 2a str. 2457T
gcuaaguugaauc

SEQ ID NO: 3864914 - RNA, 17 nt, Shigella flexneri 2a str. 2457T
gcuaauaaugagcagaa

SEQ ID NO: 3864915 - RNA, 23 nt, Shigella flexneri 2a str. 2457T
gcuaauaaugagcagaaaaaccc

SEQ ID NO: 3864916 - RNA, 23 nt, Shigella flexneri 2a str. 2457T
gcuaauaccgucgaugccaauaa

SEQ ID NO: 3864917 - RNA, 21 nt, Shigella flexneri 2a str. 2457T
gcuaaucaaaucaaugccuuu

SEQ ID NO: 3864918 - RNA, 14 nt, Shigella flexneri 2a str. 2457T
gcuaaugcaaauca

SEQ ID NO: 3864919 - RNA, 13 nt, Shigella flexneri 2a str. 2457T
gcuaauucaacgc

SEQ ID NO: 3864920 - RNA, 22 nt, Shigella flexneri 2a str. 2457T
gcuaauuccagucguguuccgg

SEQ ID NO: 3864921 - RNA, 17 nt, Shigella flexneri 2a str. 2457T
gcuacaacaucguaucu

SEQ ID NO: 3864922 - RNA, 15 nt, Shigella flexneri 2a str. 2457T
gcuacagccugguga

SEQ ID NO: 3864923 - RNA, 15 nt, Shigella flexneri 2a str. 2457T
gcuacauacuuaaau

SEQ ID NO: 3864924 - RNA, 23 nt, Shigella flexneri 2a str. 2457T
gcuaccaaaaaaucaaugcccau

SEQ ID NO: 3864925 - RNA, 14 nt, Shigella flexneri 2a str. 2457T
gcuaccaccaaacg

SEQ ID NO: 3864926 - RNA, 17 nt, Shigella flexneri 2a str. 2457T
gcuaccaugcuaauaau

SEQ ID NO: 3864927 - RNA, 16 nt, Shigella flexneri 2a str. 2457T
gcuacccacuuccccu

SEQ ID NO: 3864928 - RNA, 15 nt, Shigella flexneri 2a str. 2457T
gcuaccgccagacca

SEQ ID NO: 3864929 - RNA, 15 nt, Shigella flexneri 2a str. 2457T
gcuaccgcccugagc

SEQ ID NO: 3864930 - RNA, 22 nt, Shigella flexneri 2a str. 2457T
gcuaccggacaguuugaucagu

SEQ ID NO: 3864931 - RNA, 23 nt, Shigella flexneri 2a str. 2457T
gcuacgaucgauaaccaucuucu

SEQ ID NO: 3864932 - RNA, 13 nt, Shigella flexneri 2a str. 2457T
gcuacgccagcaa

SEQ ID NO: 3864933 - RNA, 17 nt, Shigella flexneri 2a str. 2457T
gcuacgcuuaucaggcc

SEQ ID NO: 3864934 - RNA, 22 nt, Shigella flexneri 2a str. 2457T
gcuacgcuuaucaggccuacgc

SEQ ID NO: 3864935 - RNA, 20 nt, Shigella flexneri 2a str. 2457T
gcuacguucugcguaauguu

SEQ ID NO: 3864936 - RNA, 13 nt, Shigella flexneri 2a str. 2457T
gcuacugauaaua

SEQ ID NO: 3864937 - RNA, 19 nt, Shigella flexneri 2a str. 2457T
gcuacuggcaauccagcuc

SEQ ID NO: 3864938 - RNA, 16 nt, Shigella flexneri 2a str. 2457T
gcuacugucuaaaaua

SEQ ID NO: 3864939 - RNA, 15 nt, Shigella flexneri 2a str. 2457T
gcuacuucaaacaaa

SEQ ID NO: 3864940 - RNA, 16 nt, Shigella flexneri 2a str. 2457T
gcuacuucaaacaaaa

SEQ ID NO: 3864941 - RNA, 20 nt, Shigella flexneri 2a str. 2457T
gcuacuuuuuucacccacac

SEQ ID NO: 3864942 - RNA, 18 nt, Shigella flexneri 2a str. 2457T
gcuagcggcuuuuuacgc

SEQ ID NO: 3864943 - RNA, 14 nt, Shigella flexneri 2a str. 2457T
gcuaguaaguuaca

SEQ ID NO: 3864944 - RNA, 15 nt, Shigella flexneri 2a str. 2457T
gcuaguaaguuacau

SEQ ID NO: 3864945 - RNA, 21 nt, Shigella flexneri 2a str. 2457T
gcuaguuaucuccuugcuggu

SEQ ID NO: 3864946 - RNA, 22 nt, Shigella flexneri 2a str. 2457T
gcuaguuaucuccuugcuggug

SEQ ID NO: 3864947 - RNA, 21 nt, Shigella flexneri 2a str. 2457T
gcuauaacauuuuucucggca

SEQ ID NO: 3864948 - RNA, 17 nt, Shigella flexneri 2a str. 2457T
gcuauaaccugguggug

SEQ ID NO: 3864949 - RNA, 21 nt, Shigella flexneri 2a str. 2457T
gcuauagacaccuugcaacuc

SEQ ID NO: 3864950 - RNA, 16 nt, Shigella flexneri 2a str. 2457T
gcuauauuuugccgga

SEQ ID NO: 3864951 - RNA, 17 nt, Shigella flexneri 2a str. 2457T
gcuaucagcgccaccac

SEQ ID NO: 3864952 - RNA, 13 nt, Shigella flexneri 2a str. 2457T
gcuauccugguua

SEQ ID NO: 3864953 - RNA, 13 nt, Shigella flexneri 2a str. 2457T
gcuaucgcugaua

SEQ ID NO: 3864954 - RNA, 21 nt, Shigella flexneri 2a str. 2457T
gcuaucguccacgucaucaaa

SEQ ID NO: 3864955 - RNA, 23 nt, Shigella flexneri 2a str. 2457T
gcuaucuucgauaaacucaauca

SEQ ID NO: 3864956 - RNA, 18 nt, Shigella flexneri 2a str. 2457T
gcuaugaaagaaaaucaa

SEQ ID NO: 3864957 - RNA, 13 nt, Shigella flexneri 2a str. 2457T
gcuauucagcagu

SEQ ID NO: 3864958 - RNA, 14 nt, Shigella flexneri 2a str. 2457T
gcuauucagcaguu

SEQ ID NO: 3864959 - RNA, 19 nt, Shigella flexneri 2a str. 2457T
gcuauuccgaugguagcag

SEQ ID NO: 3864960 - RNA, 18 nt, Shigella flexneri 2a str. 2457T
gcuauucuuauaaagaaa

SEQ ID NO: 3864961 - RNA, 13 nt, Shigella flexneri 2a str. 2457T
gcuauuuaacagu

SEQ ID NO: 3864962 - RNA, 21 nt, Shigella flexneri 2a str. 2457T
gcuauuuaccacuacugcguc

SEQ ID NO: 3864963 - RNA, 16 nt, Shigella flexneri 2a str. 2457T
gcuauuugcccaccug

SEQ ID NO: 3864964 - RNA, 17 nt, Shigella flexneri 2a str. 2457T
gcuauuugcccaccugc

SEQ ID NO: 3864965 - RNA, 13 nt, Shigella flexneri 2a str. 2457T
gcuauuuuuugca

SEQ ID NO: 3864966 - RNA, 21 nt, Shigella flexneri 2a str. 2457T
gcuauuuuuugcaggccagau

SEQ ID NO: 3864967 - RNA, 18 nt, Shigella flexneri 2a str. 2457T
gcuauuuuuugcagugcu

SEQ ID NO: 3864968 - RNA, 14 nt, Shigella flexneri 2a str. 2457T
gcucaaaccagcga

SEQ ID NO: 3864969 - RNA, 11 nt, Shigella flexneri 2a str. 2457T
gcucaaacgaa

SEQ ID NO: 3864970 - RNA, 19 nt, Shigella flexneri 2a str. 2457T
gcucaaacggcguuuucuc

SEQ ID NO: 3864971 - RNA, 22 nt, Shigella flexneri 2a str. 2457T
gcucaaacuucgucacagcggc

SEQ ID NO: 3864972 - RNA, 22 nt, Shigella flexneri 2a str. 2457T
gcucaaagccgucgagggccug

SEQ ID NO: 3864973 - RNA, 22 nt, Shigella flexneri 2a str. 2457T
gcucaaaguaaucaagcccugg

SEQ ID NO: 3864974 - RNA, 18 nt, Shigella flexneri 2a str. 2457T
gcucaaauccaucagacc

SEQ ID NO: 3864975 - RNA, 13 nt, Shigella flexneri 2a str. 2457T
gcucaacaauaaa

SEQ ID NO: 3864976 - RNA, 23 nt, Shigella flexneri 2a str. 2457T
gcucaacugccaguucccccugc

SEQ ID NO: 3864977 - RNA, 18 nt, Shigella flexneri 2a str. 2457T
gcucaagcguuucaucuu

SEQ ID NO: 3864978 - RNA, 17 nt, Shigella flexneri 2a str. 2457T
gcucaauauccugaccu

SEQ ID NO: 3864979 - RNA, 16 nt, Shigella flexneri 2a str. 2457T
gcucaaucgcauggcu

SEQ ID NO: 3864980 - RNA, 23 nt, Shigella flexneri 2a str. 2457T
gcucaaucguaugaucauccgcc

SEQ ID NO: 3864981 - RNA, 22 nt, Shigella flexneri 2a str. 2457T
gcucaaugagcaccuuuuuucu

SEQ ID NO: 3864982 - RNA, 23 nt, Shigella flexneri 2a str. 2457T
gcucaauugacaguuuauuuucu

SEQ ID NO: 3864983 - RNA, 23 nt, Shigella flexneri 2a str. 2457T
gcucaccaaaaccgagaagcagc

SEQ ID NO: 3864984 - RNA, 14 nt, Shigella flexneri 2a str. 2457T
gcucaccgccagca

SEQ ID NO: 3864985 - RNA, 17 nt, Shigella flexneri 2a str. 2457T
gcucaccgccagcaucg

SEQ ID NO: 3864986 - RNA, 14 nt, Shigella flexneri 2a str. 2457T
gcucaccugacugu

SEQ ID NO: 3864987 - RNA, 15 nt, Shigella flexneri 2a str. 2457T
gcucaccugauacgc

SEQ ID NO: 3864988 - RNA, 14 nt, Shigella flexneri 2a str. 2457T
gcucacgcccauca

SEQ ID NO: 3864989 - RNA, 14 nt, Shigella flexneri 2a str. 2457T
gcucacgcgcugcc

SEQ ID NO: 3864990 - RNA, 16 nt, Shigella flexneri 2a str. 2457T
gcucacugcaaaacag

SEQ ID NO: 3864991 - RNA, 18 nt, Shigella flexneri 2a str. 2457T
gcucacugcaaaacaggu

SEQ ID NO: 3864992 - RNA, 19 nt, Shigella flexneri 2a str. 2457T
gcucacugcaaaacagguc

SEQ ID NO: 3864993 - RNA, 21 nt, Shigella flexneri 2a str. 2457T
gcucacuucgauccagugauu

SEQ ID NO: 3864994 - RNA, 23 nt, Shigella flexneri 2a str. 2457T
gcucacuucgcuuacgccugcca

SEQ ID NO: 3864995 - RNA, 21 nt, Shigella flexneri 2a str. 2457T
gcucagaagacgcuccagugu

SEQ ID NO: 3864996 - RNA, 23 nt, Shigella flexneri 2a str. 2457T
gcucagaaucacgccaacaaaca

SEQ ID NO: 3864997 - RNA, 16 nt, Shigella flexneri 2a str. 2457T
gcucagcgcauccugc

SEQ ID NO: 3864998 - RNA, 15 nt, Shigella flexneri 2a str. 2457T
gcucagcgccacauc

SEQ ID NO: 3864999 - RNA, 21 nt, Shigella flexneri 2a str. 2457T
gcucagcuccucuuucauuuc

SEQ ID NO: 3865000 - RNA, 13 nt, Shigella flexneri 2a str. 2457T
gcucaggguuuuc

SEQ ID NO: 3865001 - RNA, 17 nt, Shigella flexneri 2a str. 2457T
gcucaguugcaucgucu

SEQ ID NO: 3865002 - RNA, 18 nt, Shigella flexneri 2a str. 2457T
gcucaguugcaucgucug

SEQ ID NO: 3865003 - RNA, 15 nt, Shigella flexneri 2a str. 2457T
gcucaguugguuaga

SEQ ID NO: 3865004 - RNA, 13 nt, Shigella flexneri 2a str. 2457T
gcucauagccacu

SEQ ID NO: 3865005 - RNA, 21 nt, Shigella flexneri 2a str. 2457T
gcucaucagcggcgaagccua

SEQ ID NO: 3865006 - RNA, 13 nt, Shigella flexneri 2a str. 2457T
gcucauccagcgu

SEQ ID NO: 3865007 - RNA, 21 nt, Shigella flexneri 2a str. 2457T
gcucaucggcauacagcgaca

SEQ ID NO: 3865008 - RNA, 20 nt, Shigella flexneri 2a str. 2457T
gcucaucuaaugcaggggcg

SEQ ID NO: 3865009 - RNA, 17 nt, Shigella flexneri 2a str. 2457T
gcucaucugcugcguuu

SEQ ID NO: 3865010 - RNA, 15 nt, Shigella flexneri 2a str. 2457T
gcucauuaaaaauau

SEQ ID NO: 3865011 - RNA, 21 nt, Shigella flexneri 2a str. 2457T
gcucauucuuccuccagcggu

SEQ ID NO: 3865012 - RNA, 20 nt, Shigella flexneri 2a str. 2457T
gcucauugguccaucuuuuu

SEQ ID NO: 3865013 - RNA, 22 nt, Shigella flexneri 2a str. 2457T
gcucauuucaucggcuaguaau

SEQ ID NO: 3865014 - RNA, 15 nt, Shigella flexneri 2a str. 2457T
gcucauuuuccggga

SEQ ID NO: 3865015 - RNA, 23 nt, Shigella flexneri 2a str. 2457T
gcuccacaagaaugccugccagc

SEQ ID NO: 3865016 - RNA, 16 nt, Shigella flexneri 2a str. 2457T
gcuccacaagcuccgg

SEQ ID NO: 3865017 - RNA, 18 nt, Shigella flexneri 2a str. 2457T
gcuccacaagcuccggcu

SEQ ID NO: 3865018 - RNA, 13 nt, Shigella flexneri 2a str. 2457T
gcuccagaaacca

SEQ ID NO: 3865019 - RNA, 20 nt, Shigella flexneri 2a str. 2457T
gcuccagauuaccagcgaca

SEQ ID NO: 3865020 - RNA, 21 nt, Shigella flexneri 2a str. 2457T
gcuccagcgggcgaaucaacu

SEQ ID NO: 3865021 - RNA, 20 nt, Shigella flexneri 2a str. 2457T
gcuccagcguaccugccgcg

SEQ ID NO: 3865022 - RNA, 20 nt, Shigella flexneri 2a str. 2457T
gcuccaguaccugcaaaccg

SEQ ID NO: 3865023 - RNA, 18 nt, Shigella flexneri 2a str. 2457T
gcuccagugcauccagca

SEQ ID NO: 3865024 - RNA, 15 nt, Shigella flexneri 2a str. 2457T
gcuccaguguggcca

SEQ ID NO: 3865025 - RNA, 16 nt, Shigella flexneri 2a str. 2457T
gcuccauaauugccag

SEQ ID NO: 3865026 - RNA, 18 nt, Shigella flexneri 2a str. 2457T
gcuccauaauugccagcu

SEQ ID NO: 3865027 - RNA, 14 nt, Shigella flexneri 2a str. 2457T
gcuccauccaccag

SEQ ID NO: 3865028 - RNA, 22 nt, Shigella flexneri 2a str. 2457T
gcuccaugagaagcugaaauca

SEQ ID NO: 3865029 - RNA, 14 nt, Shigella flexneri 2a str. 2457T
gcucccagcagaga

SEQ ID NO: 3865030 - RNA, 13 nt, Shigella flexneri 2a str. 2457T
gcucccgcagcca

SEQ ID NO: 3865031 - RNA, 15 nt, Shigella flexneri 2a str. 2457T
gcucccgcagccacu

SEQ ID NO: 3865032 - RNA, 17 nt, Shigella flexneri 2a str. 2457T
gcucccgcagccacucc

SEQ ID NO: 3865033 - RNA, 22 nt, Shigella flexneri 2a str. 2457T
gcucccugccaguccugcucaa

SEQ ID NO: 3865034 - RNA, 17 nt, Shigella flexneri 2a str. 2457T
gcucccugcggcgauga

SEQ ID NO: 3865035 - RNA, 15 nt, Shigella flexneri 2a str. 2457T
gcuccgcaagcgaau

SEQ ID NO: 3865036 - RNA, 22 nt, Shigella flexneri 2a str. 2457T
gcuccggcgcgauaucgacgac

SEQ ID NO: 3865037 - RNA, 19 nt, Shigella flexneri 2a str. 2457T
gcuccgggcugguuuucag

SEQ ID NO: 3865038 - RNA, 17 nt, Shigella flexneri 2a str. 2457T
gcuccgguuaacgccgc

SEQ ID NO: 3865039 - RNA, 14 nt, Shigella flexneri 2a str. 2457T
gcuccguaaacccc

SEQ ID NO: 3865040 - RNA, 14 nt, Shigella flexneri 2a str. 2457T
gcuccguuccccuc

SEQ ID NO: 3865041 - RNA, 14 nt, Shigella flexneri 2a str. 2457T
gcuccugcauugac

SEQ ID NO: 3865042 - RNA, 16 nt, Shigella flexneri 2a str. 2457T
gcuccugcauugacuc

SEQ ID NO: 3865043 - RNA, 22 nt, Shigella flexneri 2a str. 2457T
gcuccugcauugacucgccuuc

SEQ ID NO: 3865044 - RNA, 20 nt, Shigella flexneri 2a str. 2457T
gcuccuggcgaaucaggacc

SEQ ID NO: 3865045 - RNA, 21 nt, Shigella flexneri 2a str. 2457T
gcuccuggcgguuaauaauga

SEQ ID NO: 3865046 - RNA, 13 nt, Shigella flexneri 2a str. 2457T
gcuccuguugaug

SEQ ID NO: 3865047 - RNA, 18 nt, Shigella flexneri 2a str. 2457T
gcucgaacagcugguuga

SEQ ID NO: 3865048 - RNA, 17 nt, Shigella flexneri 2a str. 2457T
gcucgaacgccucugca

SEQ ID NO: 3865049 - RNA, 16 nt, Shigella flexneri 2a str. 2457T
gcucgagagagaaaau

SEQ ID NO: 3865050 - RNA, 12 nt, Shigella flexneri 2a str. 2457T
gcucgcacuuuc

SEQ ID NO: 3865051 - RNA, 23 nt, Shigella flexneri 2a str. 2457T
gcucgccgcagagaucagauaau

SEQ ID NO: 3865052 - RNA, 14 nt, Shigella flexneri 2a str. 2457T
gcucgccgccgcug

SEQ ID NO: 3865053 - RNA, 22 nt, Shigella flexneri 2a str. 2457T
gcucgcgcuugcggaagcaacc

SEQ ID NO: 3865054 - RNA, 15 nt, Shigella flexneri 2a str. 2457T
gcucgcuggcaggcc

SEQ ID NO: 3865055 - RNA, 16 nt, Shigella flexneri 2a str. 2457T
gcucgcuggcaggccg

SEQ ID NO: 3865056 - RNA, 16 nt, Shigella flexneri 2a str. 2457T
gcucgcuucaucugcc

SEQ ID NO: 3865057 - RNA, 17 nt, Shigella flexneri 2a str. 2457T
gcucggcuccgggcgca

SEQ ID NO: 3865058 - RNA, 15 nt, Shigella flexneri 2a str. 2457T
gcucggucacugaca

SEQ ID NO: 3865059 - RNA, 11 nt, Shigella flexneri 2a str. 2457T
gcucggucaga

SEQ ID NO: 3865060 - RNA, 19 nt, Shigella flexneri 2a str. 2457T
gcucgucacaucaccaaca

SEQ ID NO: 3865061 - RNA, 16 nt, Shigella flexneri 2a str. 2457T
gcucgucauccgccag

SEQ ID NO: 3865062 - RNA, 15 nt, Shigella flexneri 2a str. 2457T
gcucguuaaucagaa

SEQ ID NO: 3865063 - RNA, 17 nt, Shigella flexneri 2a str. 2457T
gcucguucagcggcccg

SEQ ID NO: 3865064 - RNA, 23 nt, Shigella flexneri 2a str. 2457T
gcucguugccugcgaagcucuuu

SEQ ID NO: 3865065 - RNA, 22 nt, Shigella flexneri 2a str. 2457T
gcucuaacccuuccagauucag

SEQ ID NO: 3865066 - RNA, 17 nt, Shigella flexneri 2a str. 2457T
gcucuacaauauccuca

SEQ ID NO: 3865067 - RNA, 15 nt, Shigella flexneri 2a str. 2457T
gcucuaucucccuga

SEQ ID NO: 3865068 - RNA, 15 nt, Shigella flexneri 2a str. 2457T
gcucucaaauaucug

SEQ ID NO: 3865069 - RNA, 16 nt, Shigella flexneri 2a str. 2457T
gcucucaaauaucugc

SEQ ID NO: 3865070 - RNA, 15 nt, Shigella flexneri 2a str. 2457T
gcucucacuuauuug

SEQ ID NO: 3865071 - RNA, 14 nt, Shigella flexneri 2a str. 2457T
gcucucagccagcu

SEQ ID NO: 3865072 - RNA, 17 nt, Shigella flexneri 2a str. 2457T
gcucucagccagcuggc

SEQ ID NO: 3865073 - RNA, 14 nt, Shigella flexneri 2a str. 2457T
gcucucauuuuuca

SEQ ID NO: 3865074 - RNA, 22 nt, Shigella flexneri 2a str. 2457T
gcucucccaaauaugaaaucuc

SEQ ID NO: 3865075 - RNA, 15 nt, Shigella flexneri 2a str. 2457T
gcucucucgcuggcg

SEQ ID NO: 3865076 - RNA, 11 nt, Shigella flexneri 2a str. 2457T
gcucucugcua

SEQ ID NO: 3865077 - RNA, 19 nt, Shigella flexneri 2a str. 2457T
gcucugacaccaucaccca

SEQ ID NO: 3865078 - RNA, 15 nt, Shigella flexneri 2a str. 2457T
gcucugacuggcgcu

SEQ ID NO: 3865079 - RNA, 13 nt, Shigella flexneri 2a str. 2457T
gcucugcgccgcc

SEQ ID NO: 3865080 - RNA, 14 nt, Shigella flexneri 2a str. 2457T
gcucugcgguaucg

SEQ ID NO: 3865081 - RNA, 22 nt, Shigella flexneri 2a str. 2457T
gcucugcuuucucagcaaauag

SEQ ID NO: 3865082 - RNA, 21 nt, Shigella flexneri 2a str. 2457T
gcucuggauaaucacaauggu

SEQ ID NO: 3865083 - RNA, 16 nt, Shigella flexneri 2a str. 2457T
gcucuggcaagcgacu

SEQ ID NO: 3865084 - RNA, 20 nt, Shigella flexneri 2a str. 2457T
gcucuggcaggcuucaauuu

SEQ ID NO: 3865085 - RNA, 17 nt, Shigella flexneri 2a str. 2457T
gcucugguguucuuuua

SEQ ID NO: 3865086 - RNA, 15 nt, Shigella flexneri 2a str. 2457T
gcucugguucaccau

SEQ ID NO: 3865087 - RNA, 20 nt, Shigella flexneri 2a str. 2457T
gcucugguucaccauucugc

SEQ ID NO: 3865088 - RNA, 17 nt, Shigella flexneri 2a str. 2457T
gcucugguugugguggg

SEQ ID NO: 3865089 - RNA, 16 nt, Shigella flexneri 2a str. 2457T
gcucuguucugcgcuu

SEQ ID NO: 3865090 - RNA, 19 nt, Shigella flexneri 2a str. 2457T
gcucuucaauggucagcca

SEQ ID NO: 3865091 - RNA, 20 nt, Shigella flexneri 2a str. 2457T
gcucuucaauggucagccac

SEQ ID NO: 3865092 - RNA, 13 nt, Shigella flexneri 2a str. 2457T
gcucuuccuucag

SEQ ID NO: 3865093 - RNA, 15 nt, Shigella flexneri 2a str. 2457T
gcucuuccuucagcu

SEQ ID NO: 3865094 - RNA, 17 nt, Shigella flexneri 2a str. 2457T
gcucuucuggcaccagu

SEQ ID NO: 3865095 - RNA, 23 nt, Shigella flexneri 2a str. 2457T
gcucuucuucgcgauaaaucaga

SEQ ID NO: 3865096 - RNA, 21 nt, Shigella flexneri 2a str. 2457T
gcucuuguucuuccggcacac

SEQ ID NO: 3865097 - RNA, 12 nt, Shigella flexneri 2a str. 2457T
gcucuuuauaau

SEQ ID NO: 3865098 - RNA, 15 nt, Shigella flexneri 2a str. 2457T
gcucuuucagcaccg

SEQ ID NO: 3865099 - RNA, 14 nt, Shigella flexneri 2a str. 2457T
gcucuuuuccagcc

SEQ ID NO: 3865100 - RNA, 15 nt, Shigella flexneri 2a str. 2457T
gcucuuuucugaagu

SEQ ID NO: 3865101 - RNA, 21 nt, Shigella flexneri 2a str. 2457T
gcugaaaccgugcaucuguug

SEQ ID NO: 3865102 - RNA, 23 nt, Shigella flexneri 2a str. 2457T
gcugaaagaagcggugaaaaaau

SEQ ID NO: 3865103 - RNA, 13 nt, Shigella flexneri 2a str. 2457T
gcugaaaguucau

SEQ ID NO: 3865104 - RNA, 17 nt, Shigella flexneri 2a str. 2457T
gcugaaaguucaugauu

SEQ ID NO: 3865105 - RNA, 20 nt, Shigella flexneri 2a str. 2457T
gcugaaauaacguaggccug

SEQ ID NO: 3865106 - RNA, 15 nt, Shigella flexneri 2a str. 2457T
gcugaacgcaccuuc

SEQ ID NO: 3865107 - RNA, 17 nt, Shigella flexneri 2a str. 2457T
gcugaacgggccaucca

SEQ ID NO: 3865108 - RNA, 17 nt, Shigella flexneri 2a str. 2457T
gcugaacgugcucugcg

SEQ ID NO: 3865109 - RNA, 21 nt, Shigella flexneri 2a str. 2457T
gcugaagaaaauggccagcca

SEQ ID NO: 3865110 - RNA, 22 nt, Shigella flexneri 2a str. 2457T
gcugaagggaucuucuuccgcg

SEQ ID NO: 3865111 - RNA, 14 nt, Shigella flexneri 2a str. 2457T
gcugaauaccgauu

SEQ ID NO: 3865112 - RNA, 16 nt, Shigella flexneri 2a str. 2457T
gcugaauaucuuucuc

SEQ ID NO: 3865113 - RNA, 15 nt, Shigella flexneri 2a str. 2457T
gcugaaucaacaggc

SEQ ID NO: 3865114 - RNA, 19 nt, Shigella flexneri 2a str. 2457T
gcugaauggcgauuucaca

SEQ ID NO: 3865115 - RNA, 18 nt, Shigella flexneri 2a str. 2457T
gcugacaaaucagaggcu

SEQ ID NO: 3865116 - RNA, 15 nt, Shigella flexneri 2a str. 2457T
gcugacaacgcugaa

SEQ ID NO: 3865117 - RNA, 17 nt, Shigella flexneri 2a str. 2457T
gcugacauaaacaccag

SEQ ID NO: 3865118 - RNA, 20 nt, Shigella flexneri 2a str. 2457T
gcugacauaaacaccagcaa

SEQ ID NO: 3865119 - RNA, 13 nt, Shigella flexneri 2a str. 2457T
gcugaccaccagc

SEQ ID NO: 3865120 - RNA, 16 nt, Shigella flexneri 2a str. 2457T
gcugaccagacuggag

SEQ ID NO: 3865121 - RNA, 22 nt, Shigella flexneri 2a str. 2457T
gcugaccagacuggagcacugc

SEQ ID NO: 3865122 - RNA, 12 nt, Shigella flexneri 2a str. 2457T
gcugaccgcuug

SEQ ID NO: 3865123 - RNA, 20 nt, Shigella flexneri 2a str. 2457T
gcugaccgucaaagcgccag

SEQ ID NO: 3865124 - RNA, 15 nt, Shigella flexneri 2a str. 2457T
gcugacgcacuguug

SEQ ID NO: 3865125 - RNA, 17 nt, Shigella flexneri 2a str. 2457T
gcugacgcaucuucucc

SEQ ID NO: 3865126 - RNA, 22 nt, Shigella flexneri 2a str. 2457T
gcugacggugauaaucauccca

SEQ ID NO: 3865127 - RNA, 16 nt, Shigella flexneri 2a str. 2457T
gcugacguagcaguuc

SEQ ID NO: 3865128 - RNA, 18 nt, Shigella flexneri 2a str. 2457T
gcugacguuaagaaaacg

SEQ ID NO: 3865129 - RNA, 17 nt, Shigella flexneri 2a str. 2457T
gcugacuguaggccgga

SEQ ID NO: 3865130 - RNA, 19 nt, Shigella flexneri 2a str. 2457T
gcugacuuugauccagcca

SEQ ID NO: 3865131 - RNA, 18 nt, Shigella flexneri 2a str. 2457T
gcugagaaaugccagaau

SEQ ID NO: 3865132 - RNA, 11 nt, Shigella flexneri 2a str. 2457T
gcugagauacu

SEQ ID NO: 3865133 - RNA, 21 nt, Shigella flexneri 2a str. 2457T
gcugagauacucaagcagcca

SEQ ID NO: 3865134 - RNA, 21 nt, Shigella flexneri 2a str. 2457T
gcugagcaaacaguucugcag

SEQ ID NO: 3865135 - RNA, 21 nt, Shigella flexneri 2a str. 2457T
gcugaguguaacgcuugcuga

SEQ ID NO: 3865136 - RNA, 13 nt, Shigella flexneri 2a str. 2457T
gcugauaaacaag

SEQ ID NO: 3865137 - RNA, 15 nt, Shigella flexneri 2a str. 2457T
gcugauaaaucccgc

SEQ ID NO: 3865138 - RNA, 22 nt, Shigella flexneri 2a str. 2457T
gcugauaaaucccgccgcuuca

SEQ ID NO: 3865139 - RNA, 17 nt, Shigella flexneri 2a str. 2457T
gcugauaacaauaucaa

SEQ ID NO: 3865140 - RNA, 19 nt, Shigella flexneri 2a str. 2457T
gcugauacuccaugaguaa

SEQ ID NO: 3865141 - RNA, 20 nt, Shigella flexneri 2a str. 2457T
gcugauauucgacaccaucu

SEQ ID NO: 3865142 - RNA, 12 nt, Shigella flexneri 2a str. 2457T
gcugaugacgcg

SEQ ID NO: 3865143 - RNA, 12 nt, Shigella flexneri 2a str. 2457T
gcugaugagcaa

SEQ ID NO: 3865144 - RNA, 20 nt, Shigella flexneri 2a str. 2457T
gcugaugagcaaaucgcggc

SEQ ID NO: 3865145 - RNA, 22 nt, Shigella flexneri 2a str. 2457T
gcugaugauuaacagcaaacag

SEQ ID NO: 3865146 - RNA, 23 nt, Shigella flexneri 2a str. 2457T
gcugaugauuaacagcaaacagu

SEQ ID NO: 3865147 - RNA, 16 nt, Shigella flexneri 2a str. 2457T
gcugaugcagcgauga

SEQ ID NO: 3865148 - RNA, 18 nt, Shigella flexneri 2a str. 2457T
gcugaugccaggcucgga

SEQ ID NO: 3865149 - RNA, 18 nt, Shigella flexneri 2a str. 2457T
gcugaugccgcguuggug

SEQ ID NO: 3865150 - RNA, 22 nt, Shigella flexneri 2a str. 2457T
gcugauggucagugccugcgcc

SEQ ID NO: 3865151 - RNA, 17 nt, Shigella flexneri 2a str. 2457T
gcugauguucgccagau

SEQ ID NO: 3865152 - RNA, 21 nt, Shigella flexneri 2a str. 2457T
gcugauguuguuucucuuucu

SEQ ID NO: 3865153 - RNA, 18 nt, Shigella flexneri 2a str. 2457T
gcugauuccauuauucaa

SEQ ID NO: 3865154 - RNA, 14 nt, Shigella flexneri 2a str. 2457T
gcugauuccugcaa

SEQ ID NO: 3865155 - RNA, 16 nt, Shigella flexneri 2a str. 2457T
gcugauuucaccaucu

SEQ ID NO: 3865156 - RNA, 21 nt, Shigella flexneri 2a str. 2457T
gcugauuuuucugcucguugc

SEQ ID NO: 3865157 - RNA, 12 nt, Shigella flexneri 2a str. 2457T
gcugcaaagucu

SEQ ID NO: 3865158 - RNA, 22 nt, Shigella flexneri 2a str. 2457T
gcugcaagaugaauaauguuua

SEQ ID NO: 3865159 - RNA, 13 nt, Shigella flexneri 2a str. 2457T
gcugcaauaaaau

SEQ ID NO: 3865160 - RNA, 22 nt, Shigella flexneri 2a str. 2457T
gcugcaauugcggcaggucauc

SEQ ID NO: 3865161 - RNA, 19 nt, Shigella flexneri 2a str. 2457T
gcugcacaauugccagccc

SEQ ID NO: 3865162 - RNA, 20 nt, Shigella flexneri 2a str. 2457T
gcugcacaauugccagcccu

SEQ ID NO: 3865163 - RNA, 15 nt, Shigella flexneri 2a str. 2457T
gcugcacauccggua

SEQ ID NO: 3865164 - RNA, 19 nt, Shigella flexneri 2a str. 2457T
gcugcaccucgagaucauc

SEQ ID NO: 3865165 - RNA, 17 nt, Shigella flexneri 2a str. 2457T
gcugcacgaugacugaa

SEQ ID NO: 3865166 - RNA, 22 nt, Shigella flexneri 2a str. 2457T
gcugcacgucauacugcucaga

SEQ ID NO: 3865167 - RNA, 15 nt, Shigella flexneri 2a str. 2457T
gcugcagcucuuuca

SEQ ID NO: 3865168 - RNA, 13 nt, Shigella flexneri 2a str. 2457T
gcugcauccgcgc

SEQ ID NO: 3865169 - RNA, 19 nt, Shigella flexneri 2a str. 2457T
gcugcauggcaauuuucgu

SEQ ID NO: 3865170 - RNA, 12 nt, Shigella flexneri 2a str. 2457T
gcugcauugccc

SEQ ID NO: 3865171 - RNA, 21 nt, Shigella flexneri 2a str. 2457T
gcugcauugcccaauacagcg

SEQ ID NO: 3865172 - RNA, 23 nt, Shigella flexneri 2a str. 2457T
gcugccacauugcguccaggccc

SEQ ID NO: 3865173 - RNA, 22 nt, Shigella flexneri 2a str. 2457T
gcugccagaaaucggccuucca

SEQ ID NO: 3865174 - RNA, 20 nt, Shigella flexneri 2a str. 2457T
gcugccagaucaucguuucc

SEQ ID NO: 3865175 - RNA, 13 nt, Shigella flexneri 2a str. 2457T
gcugccagcacuu

SEQ ID NO: 3865176 - RNA, 22 nt, Shigella flexneri 2a str. 2457T
gcugccagcgauuuaucggcaa

SEQ ID NO: 3865177 - RNA, 16 nt, Shigella flexneri 2a str. 2457T
gcugccgacaaaugca

SEQ ID NO: 3865178 - RNA, 13 nt, Shigella flexneri 2a str. 2457T
gcugccgacgcca

SEQ ID NO: 3865179 - RNA, 15 nt, Shigella flexneri 2a str. 2457T
gcugccgacgccagu

SEQ ID NO: 3865180 - RNA, 21 nt, Shigella flexneri 2a str. 2457T
gcugccgccaguucuuccagu

SEQ ID NO: 3865181 - RNA, 23 nt, Shigella flexneri 2a str. 2457T
gcugccgcuucuucuucagcgcu

SEQ ID NO: 3865182 - RNA, 18 nt, Shigella flexneri 2a str. 2457T
gcugccggaccaucuucc

SEQ ID NO: 3865183 - RNA, 19 nt, Shigella flexneri 2a str. 2457T
gcugccggaugacagacuc

SEQ ID NO: 3865184 - RNA, 17 nt, Shigella flexneri 2a str. 2457T
gcugccggggagauauu

SEQ ID NO: 3865185 - RNA, 14 nt, Shigella flexneri 2a str. 2457T
gcugccgucaauuu

SEQ ID NO: 3865186 - RNA, 14 nt, Shigella flexneri 2a str. 2457T
gcugccguuuucaa

SEQ ID NO: 3865187 - RNA, 14 nt, Shigella flexneri 2a str. 2457T
gcugccuacacaau

SEQ ID NO: 3865188 - RNA, 20 nt, Shigella flexneri 2a str. 2457T
gcugccucucuucgcugcug

SEQ ID NO: 3865189 - RNA, 13 nt, Shigella flexneri 2a str. 2457T
gcugccugagcug

SEQ ID NO: 3865190 - RNA, 15 nt, Shigella flexneri 2a str. 2457T
gcugccugagcuguc

SEQ ID NO: 3865191 - RNA, 23 nt, Shigella flexneri 2a str. 2457T
gcugccuggcccauagacagggu

SEQ ID NO: 3865192 - RNA, 15 nt, Shigella flexneri 2a str. 2457T
gcugccuuucgcucc

SEQ ID NO: 3865193 - RNA, 16 nt, Shigella flexneri 2a str. 2457T
gcugcgaaucgcuuca

SEQ ID NO: 3865194 - RNA, 22 nt, Shigella flexneri 2a str. 2457T
gcugcgauaguggaacaaagaa

SEQ ID NO: 3865195 - RNA, 19 nt, Shigella flexneri 2a str. 2457T
gcugcgaucgcaaauccau

SEQ ID NO: 3865196 - RNA, 18 nt, Shigella flexneri 2a str. 2457T
gcugcgccccacaccacc

SEQ ID NO: 3865197 - RNA, 13 nt, Shigella flexneri 2a str. 2457T
gcugcgcggcagc

SEQ ID NO: 3865198 - RNA, 15 nt, Shigella flexneri 2a str. 2457T
gcugcggcgcgcauc

SEQ ID NO: 3865199 - RNA, 20 nt, Shigella flexneri 2a str. 2457T
gcugcggcgcgcaucuucgu

SEQ ID NO: 3865200 - RNA, 18 nt, Shigella flexneri 2a str. 2457T
gcugcggcggacaaaguu

SEQ ID NO: 3865201 - RNA, 19 nt, Shigella flexneri 2a str. 2457T
gcugcgggaguugcuccac

SEQ ID NO: 3865202 - RNA, 21 nt, Shigella flexneri 2a str. 2457T
gcugcguaugguugccgggcu

SEQ ID NO: 3865203 - RNA, 18 nt, Shigella flexneri 2a str. 2457T
gcugcgugaggcggucug

SEQ ID NO: 3865204 - RNA, 15 nt, Shigella flexneri 2a str. 2457T
gcugcguggcgcuuu

SEQ ID NO: 3865205 - RNA, 20 nt, Shigella flexneri 2a str. 2457T
gcugcguuugcccuaaagcg

SEQ ID NO: 3865206 - RNA, 23 nt, Shigella flexneri 2a str. 2457T
gcugcguuugcccuaaagcgcga

SEQ ID NO: 3865207 - RNA, 12 nt, Shigella flexneri 2a str. 2457T
gcugcuaauauu

SEQ ID NO: 3865208 - RNA, 13 nt, Shigella flexneri 2a str. 2457T
gcugcucgguucg

SEQ ID NO: 3865209 - RNA, 23 nt, Shigella flexneri 2a str. 2457T
gcugcugacuuugauccagccau

SEQ ID NO: 3865210 - RNA, 16 nt, Shigella flexneri 2a str. 2457T
gcugcugauccagcuu

SEQ ID NO: 3865211 - RNA, 19 nt, Shigella flexneri 2a str. 2457T
gcugcugauccagcuucca

SEQ ID NO: 3865212 - RNA, 22 nt, Shigella flexneri 2a str. 2457T
gcugcugcacauacugcaucag

SEQ ID NO: 3865213 - RNA, 12 nt, Shigella flexneri 2a str. 2457T
gcugcugccgcu

SEQ ID NO: 3865214 - RNA, 13 nt, Shigella flexneri 2a str. 2457T
gcugcuggaucug

SEQ ID NO: 3865215 - RNA, 18 nt, Shigella flexneri 2a str. 2457T
gcugcuguagcaguucca

SEQ ID NO: 3865216 - RNA, 15 nt, Shigella flexneri 2a str. 2457T
gcugcuucauugcuc

SEQ ID NO: 3865217 - RNA, 17 nt, Shigella flexneri 2a str. 2457T
gcugcuucggucagcac

SEQ ID NO: 3865218 - RNA, 17 nt, Shigella flexneri 2a str. 2457T
gcugcuuguuccacuuc

SEQ ID NO: 3865219 - RNA, 18 nt, Shigella flexneri 2a str. 2457T
gcugcuuguuccacuuca

SEQ ID NO: 3865220 - RNA, 22 nt, Shigella flexneri 2a str. 2457T
gcuggaaagcucuucaugcagc

SEQ ID NO: 3865221 - RNA, 17 nt, Shigella flexneri 2a str. 2457T
gcuggaaauguccgcga

SEQ ID NO: 3865222 - RNA, 13 nt, Shigella flexneri 2a str. 2457T
gcuggaagcuggc

SEQ ID NO: 3865223 - RNA, 23 nt, Shigella flexneri 2a str. 2457T
gcuggaaugcaacugaguucuca

SEQ ID NO: 3865224 - RNA, 20 nt, Shigella flexneri 2a str. 2457T
gcuggacguugcguugcagc

SEQ ID NO: 3865225 - RNA, 13 nt, Shigella flexneri 2a str. 2457T
gcuggagcgggga

SEQ ID NO: 3865226 - RNA, 17 nt, Shigella flexneri 2a str. 2457T
gcuggauaaggcguuua

SEQ ID NO: 3865227 - RNA, 19 nt, Shigella flexneri 2a str. 2457T
gcuggaucagacgcagcca

SEQ ID NO: 3865228 - RNA, 13 nt, Shigella flexneri 2a str. 2457T
gcuggaucccaga

SEQ ID NO: 3865229 - RNA, 17 nt, Shigella flexneri 2a str. 2457T
gcuggaucugcggguua

SEQ ID NO: 3865230 - RNA, 23 nt, Shigella flexneri 2a str. 2457T
gcuggaucugcggguuagucugc

SEQ ID NO: 3865231 - RNA, 13 nt, Shigella flexneri 2a str. 2457T
gcuggaugcccaa

SEQ ID NO: 3865232 - RNA, 18 nt, Shigella flexneri 2a str. 2457T
gcuggaugcccaacaggc

SEQ ID NO: 3865233 - RNA, 17 nt, Shigella flexneri 2a str. 2457T
gcuggaugucuggcaga

SEQ ID NO: 3865234 - RNA, 19 nt, Shigella flexneri 2a str. 2457T
gcuggauuaacgcugggga

SEQ ID NO: 3865235 - RNA, 21 nt, Shigella flexneri 2a str. 2457T
gcuggauuuuagggacaaaga

SEQ ID NO: 3865236 - RNA, 21 nt, Shigella flexneri 2a str. 2457T
gcuggcaaaaaugauagccag

SEQ ID NO: 3865237 - RNA, 13 nt, Shigella flexneri 2a str. 2457T
gcuggcaacaugg

SEQ ID NO: 3865238 - RNA, 14 nt, Shigella flexneri 2a str. 2457T
gcuggcaagauggc

SEQ ID NO: 3865239 - RNA, 22 nt, Shigella flexneri 2a str. 2457T
gcuggcaagauggcgaacauaa

SEQ ID NO: 3865240 - RNA, 22 nt, Shigella flexneri 2a str. 2457T
gcuggcaccgcagaucagacca

SEQ ID NO: 3865241 - RNA, 16 nt, Shigella flexneri 2a str. 2457T
gcuggcacgcucuuca

SEQ ID NO: 3865242 - RNA, 13 nt, Shigella flexneri 2a str. 2457T
gcuggcacuggga

SEQ ID NO: 3865243 - RNA, 15 nt, Shigella flexneri 2a str. 2457T
gcuggcagaccugcu

SEQ ID NO: 3865244 - RNA, 20 nt, Shigella flexneri 2a str. 2457T
gcuggcagaugcgucuucug

SEQ ID NO: 3865245 - RNA, 13 nt, Shigella flexneri 2a str. 2457T
gcuggcagcugcu

SEQ ID NO: 3865246 - RNA, 16 nt, Shigella flexneri 2a str. 2457T
gcuggcagcugcuacg

SEQ ID NO: 3865247 - RNA, 14 nt, Shigella flexneri 2a str. 2457T
gcuggcaggccgcg

SEQ ID NO: 3865248 - RNA, 13 nt, Shigella flexneri 2a str. 2457T
gcuggcagugggc

SEQ ID NO: 3865249 - RNA, 12 nt, Shigella flexneri 2a str. 2457T
gcuggcaucagc

SEQ ID NO: 3865250 - RNA, 20 nt, Shigella flexneri 2a str. 2457T
gcuggcauuacaagaaucau

SEQ ID NO: 3865251 - RNA, 19 nt, Shigella flexneri 2a str. 2457T
gcuggcccaguugauucgc

SEQ ID NO: 3865252 - RNA, 20 nt, Shigella flexneri 2a str. 2457T
gcuggccccgucagcaaaau

SEQ ID NO: 3865253 - RNA, 13 nt, Shigella flexneri 2a str. 2457T
gcuggccuccagu

SEQ ID NO: 3865254 - RNA, 17 nt, Shigella flexneri 2a str. 2457T
gcuggcgaacgugcagg

SEQ ID NO: 3865255 - RNA, 13 nt, Shigella flexneri 2a str. 2457T
gcuggcgacgccu

SEQ ID NO: 3865256 - RNA, 22 nt, Shigella flexneri 2a str. 2457T
gcuggcgacgccucuauuaaaa

SEQ ID NO: 3865257 - RNA, 22 nt, Shigella flexneri 2a str. 2457T
gcuggcgcguuuaaucacacca

SEQ ID NO: 3865258 - RNA, 13 nt, Shigella flexneri 2a str. 2457T
gcuggcggcggcg

SEQ ID NO: 3865259 - RNA, 19 nt, Shigella flexneri 2a str. 2457T
gcuggcggcggcgggcgca

SEQ ID NO: 3865260 - RNA, 19 nt, Shigella flexneri 2a str. 2457T
gcuggcgguucuauggucu

SEQ ID NO: 3865261 - RNA, 16 nt, Shigella flexneri 2a str. 2457T
gcuggcguacccauca

SEQ ID NO: 3865262 - RNA, 18 nt, Shigella flexneri 2a str. 2457T
gcuggcgucacgccgacc

SEQ ID NO: 3865263 - RNA, 15 nt, Shigella flexneri 2a str. 2457T
gcuggcuggcacgcu

SEQ ID NO: 3865264 - RNA, 20 nt, Shigella flexneri 2a str. 2457T
gcuggcuuugcccuggcgcg

SEQ ID NO: 3865265 - RNA, 14 nt, Shigella flexneri 2a str. 2457T
gcugggcgauuucg

SEQ ID NO: 3865266 - RNA, 14 nt, Shigella flexneri 2a str. 2457T
gcugggcgcaccug

SEQ ID NO: 3865267 - RNA, 17 nt, Shigella flexneri 2a str. 2457T
gcuggggaaaaucaucu

SEQ ID NO: 3865268 - RNA, 16 nt, Shigella flexneri 2a str. 2457T
gcuggguaaagacauc

SEQ ID NO: 3865269 - RNA, 19 nt, Shigella flexneri 2a str. 2457T
gcuggguaaagacaucgcc

SEQ ID NO: 3865270 - RNA, 11 nt, Shigella flexneri 2a str. 2457T
gcuggguaaau

SEQ ID NO: 3865271 - RNA, 15 nt, Shigella flexneri 2a str. 2457T
gcugguaaucaccac

SEQ ID NO: 3865272 - RNA, 20 nt, Shigella flexneri 2a str. 2457T
gcugguaauccgagaaucgu

SEQ ID NO: 3865273 - RNA, 13 nt, Shigella flexneri 2a str. 2457T
gcugguagaagcu

SEQ ID NO: 3865274 - RNA, 20 nt, Shigella flexneri 2a str. 2457T
gcuggucacugaccacuucg

SEQ ID NO: 3865275 - RNA, 14 nt, Shigella flexneri 2a str. 2457T
gcuggugacgcauu

SEQ ID NO: 3865276 - RNA, 17 nt, Shigella flexneri 2a str. 2457T
gcuggugauuucgucca

SEQ ID NO: 3865277 - RNA, 19 nt, Shigella flexneri 2a str. 2457T
gcuggugccaagcuccagc

SEQ ID NO: 3865278 - RNA, 18 nt, Shigella flexneri 2a str. 2457T
gcugguguaacugcgcca

SEQ ID NO: 3865279 - RNA, 16 nt, Shigella flexneri 2a str. 2457T
gcugguuaccaccugc

SEQ ID NO: 3865280 - RNA, 15 nt, Shigella flexneri 2a str. 2457T
gcugguuuucagcga

SEQ ID NO: 3865281 - RNA, 21 nt, Shigella flexneri 2a str. 2457T
gcuguaaaaggcgccauuuuc

SEQ ID NO: 3865282 - RNA, 23 nt, Shigella flexneri 2a str. 2457T
gcuguaaaaggcgccauuuucau

SEQ ID NO: 3865283 - RNA, 21 nt, Shigella flexneri 2a str. 2457T
gcuguaaaugccgacuuuguu

SEQ ID NO: 3865284 - RNA, 21 nt, Shigella flexneri 2a str. 2457T
gcuguaaauugccgucgauau

SEQ ID NO: 3865285 - RNA, 15 nt, Shigella flexneri 2a str. 2457T
gcuguaacggugucg

SEQ ID NO: 3865286 - RNA, 16 nt, Shigella flexneri 2a str. 2457T
gcuguaauaccagccu

SEQ ID NO: 3865287 - RNA, 14 nt, Shigella flexneri 2a str. 2457T
gcuguaauuucaca

SEQ ID NO: 3865288 - RNA, 20 nt, Shigella flexneri 2a str. 2457T
gcuguaauuucacaccauca

SEQ ID NO: 3865289 - RNA, 19 nt, Shigella flexneri 2a str. 2457T
gcuguagcaguuccagcau

SEQ ID NO: 3865290 - RNA, 20 nt, Shigella flexneri 2a str. 2457T
gcuguagcaguuccagcauc

SEQ ID NO: 3865291 - RNA, 13 nt, Shigella flexneri 2a str. 2457T
gcuguagccagcu

SEQ ID NO: 3865292 - RNA, 16 nt, Shigella flexneri 2a str. 2457T
gcuguagccgaugccg

SEQ ID NO: 3865293 - RNA, 17 nt, Shigella flexneri 2a str. 2457T
gcuguaguccuaacaga

SEQ ID NO: 3865294 - RNA, 20 nt, Shigella flexneri 2a str. 2457T
gcuguaguccuaacagagca

SEQ ID NO: 3865295 - RNA, 16 nt, Shigella flexneri 2a str. 2457T
gcugucaacugacuau

SEQ ID NO: 3865296 - RNA, 19 nt, Shigella flexneri 2a str. 2457T
gcugucaacugcgccacuc

SEQ ID NO: 3865297 - RNA, 19 nt, Shigella flexneri 2a str. 2457T
gcugucaccagugagugug

SEQ ID NO: 3865298 - RNA, 16 nt, Shigella flexneri 2a str. 2457T
gcugucauccagcagc

SEQ ID NO: 3865299 - RNA, 18 nt, Shigella flexneri 2a str. 2457T
gcuguccgcuucaccacc

SEQ ID NO: 3865300 - RNA, 19 nt, Shigella flexneri 2a str. 2457T
gcuguccgcuucaccaccg

SEQ ID NO: 3865301 - RNA, 19 nt, Shigella flexneri 2a str. 2457T
gcuguccggcaccaucgga

SEQ ID NO: 3865302 - RNA, 21 nt, Shigella flexneri 2a str. 2457T
gcuguccggugauuuaucuuc

SEQ ID NO: 3865303 - RNA, 22 nt, Shigella flexneri 2a str. 2457T
gcugucgacuaaccugagagug

SEQ ID NO: 3865304 - RNA, 20 nt, Shigella flexneri 2a str. 2457T
gcugucggcugccagccaua

SEQ ID NO: 3865305 - RNA, 16 nt, Shigella flexneri 2a str. 2457T
gcugucggugccauca

SEQ ID NO: 3865306 - RNA, 15 nt, Shigella flexneri 2a str. 2457T
gcugucgguuuccac

SEQ ID NO: 3865307 - RNA, 23 nt, Shigella flexneri 2a str. 2457T
gcugucguccggcagcagaaagc

SEQ ID NO: 3865308 - RNA, 24 nt, Shigella flexneri 2a str. 2457T
gcugugaagauggcuaacuaggcg

SEQ ID NO: 3865309 - RNA, 23 nt, Shigella flexneri 2a str. 2457T
gcugugacagauuuugccagcau

SEQ ID NO: 3865310 - RNA, 23 nt, Shigella flexneri 2a str. 2457T
gcugugauguccguuuaccacag

SEQ ID NO: 3865311 - RNA, 14 nt, Shigella flexneri 2a str. 2457T
gcugugccaggacu

SEQ ID NO: 3865312 - RNA, 20 nt, Shigella flexneri 2a str. 2457T
gcugugccagugccacacgc

SEQ ID NO: 3865313 - RNA, 18 nt, Shigella flexneri 2a str. 2457T
gcugugccggaaggggcg

SEQ ID NO: 3865314 - RNA, 20 nt, Shigella flexneri 2a str. 2457T
gcugugccguaaaucccagu

SEQ ID NO: 3865315 - RNA, 12 nt, Shigella flexneri 2a str. 2457T
gcugugcucugg

SEQ ID NO: 3865316 - RNA, 22 nt, Shigella flexneri 2a str. 2457T
gcugugguuugcccgcaaagau

SEQ ID NO: 3865317 - RNA, 17 nt, Shigella flexneri 2a str. 2457T
gcuguuccggcuuuguu

SEQ ID NO: 3865318 - RNA, 17 nt, Shigella flexneri 2a str. 2457T
gcuguucgagcaucaca

SEQ ID NO: 3865319 - RNA, 20 nt, Shigella flexneri 2a str. 2457T
gcuguucgguuuugcccaca

SEQ ID NO: 3865320 - RNA, 14 nt, Shigella flexneri 2a str. 2457T
gcuguuguucaaca

SEQ ID NO: 3865321 - RNA, 19 nt, Shigella flexneri 2a str. 2457T
gcuguuuuccagcaccacu

SEQ ID NO: 3865322 - RNA, 16 nt, Shigella flexneri 2a str. 2457T
gcuuaacgagcgcaag

SEQ ID NO: 3865323 - RNA, 14 nt, Shigella flexneri 2a str. 2457T
gcuuaacugcgcuu

SEQ ID NO: 3865324 - RNA, 16 nt, Shigella flexneri 2a str. 2457T
gcuuaagccaucauca

SEQ ID NO: 3865325 - RNA, 18 nt, Shigella flexneri 2a str. 2457T
gcuuaaggcagaaacaaa

SEQ ID NO: 3865326 - RNA, 22 nt, Shigella flexneri 2a str. 2457T
gcuuaauaucccuuccucccuu

SEQ ID NO: 3865327 - RNA, 21 nt, Shigella flexneri 2a str. 2457T
gcuuaaucaauugcaggaagg

SEQ ID NO: 3865328 - RNA, 13 nt, Shigella flexneri 2a str. 2457T
gcuuaaucaccag

SEQ ID NO: 3865329 - RNA, 14 nt, Shigella flexneri 2a str. 2457T
gcuuaaucaccagc

SEQ ID NO: 3865330 - RNA, 15 nt, Shigella flexneri 2a str. 2457T
gcuuaaucgcggcgg

SEQ ID NO: 3865331 - RNA, 13 nt, Shigella flexneri 2a str. 2457T
gcuuaauguugag

SEQ ID NO: 3865332 - RNA, 20 nt, Shigella flexneri 2a str. 2457T
gcuuaauguugagcggcagu

SEQ ID NO: 3865333 - RNA, 16 nt, Shigella flexneri 2a str. 2457T
gcuuaauuacugccuu

SEQ ID NO: 3865334 - RNA, 16 nt, Shigella flexneri 2a str. 2457T
gcuuacaaaaccugcu

SEQ ID NO: 3865335 - RNA, 20 nt, Shigella flexneri 2a str. 2457T
gcuuacaaaaccugcuuaac

SEQ ID NO: 3865336 - RNA, 15 nt, Shigella flexneri 2a str. 2457T
gcuuacacacccggc

SEQ ID NO: 3865337 - RNA, 16 nt, Shigella flexneri 2a str. 2457T
gcuuacccuaaauccg

SEQ ID NO: 3865338 - RNA, 20 nt, Shigella flexneri 2a str. 2457T
gcuuaccguccucuucccag

SEQ ID NO: 3865339 - RNA, 22 nt, Shigella flexneri 2a str. 2457T
gcuuaccguccucuucccagac

SEQ ID NO: 3865340 - RNA, 21 nt, Shigella flexneri 2a str. 2457T
gcuuacucaugaugucauaaa

SEQ ID NO: 3865341 - RNA, 18 nt, Shigella flexneri 2a str. 2457T
gcuuacucuucguucuuc

SEQ ID NO: 3865342 - RNA, 13 nt, Shigella flexneri 2a str. 2457T
gcuuagaaauuca

SEQ ID NO: 3865343 - RNA, 23 nt, Shigella flexneri 2a str. 2457T
gcuuauaauccccggccuuugau

SEQ ID NO: 3865344 - RNA, 19 nt, Shigella flexneri 2a str. 2457T
gcuuaucaggccugcaaac

SEQ ID NO: 3865345 - RNA, 17 nt, Shigella flexneri 2a str. 2457T
gcuuaucgccagcgcca

SEQ ID NO: 3865346 - RNA, 19 nt, Shigella flexneri 2a str. 2457T
gcuuaucgcccugcuccag

SEQ ID NO: 3865347 - RNA, 14 nt, Shigella flexneri 2a str. 2457T
gcuuaucuuccugu

SEQ ID NO: 3865348 - RNA, 23 nt, Shigella flexneri 2a str. 2457T
gcuuauuagggaucaucuuaacu

SEQ ID NO: 3865349 - RNA, 22 nt, Shigella flexneri 2a str. 2457T
gcuuauuucugugacuuccgac

SEQ ID NO: 3865350 - RNA, 22 nt, Shigella flexneri 2a str. 2457T
gcuucaaaucauuacaguuucg

SEQ ID NO: 3865351 - RNA, 15 nt, Shigella flexneri 2a str. 2457T
gcuucaacacaggcc

SEQ ID NO: 3865352 - RNA, 16 nt, Shigella flexneri 2a str. 2457T
gcuucaacauacccuu

SEQ ID NO: 3865353 - RNA, 14 nt, Shigella flexneri 2a str. 2457T
gcuucaaccaacgc

SEQ ID NO: 3865354 - RNA, 16 nt, Shigella flexneri 2a str. 2457T
gcuucaaggugcgcga

SEQ ID NO: 3865355 - RNA, 13 nt, Shigella flexneri 2a str. 2457T
gcuucaaucugau

SEQ ID NO: 3865356 - RNA, 23 nt, Shigella flexneri 2a str. 2457T
gcuucaaucugauauuuagccag

SEQ ID NO: 3865357 - RNA, 15 nt, Shigella flexneri 2a str. 2457T
gcuucaauuuccuga

SEQ ID NO: 3865358 - RNA, 13 nt, Shigella flexneri 2a str. 2457T
gcuucacaugcca

SEQ ID NO: 3865359 - RNA, 13 nt, Shigella flexneri 2a str. 2457T
gcuucaccagcag

SEQ ID NO: 3865360 - RNA, 15 nt, Shigella flexneri 2a str. 2457T
gcuucaccagcagcg

SEQ ID NO: 3865361 - RNA, 19 nt, Shigella flexneri 2a str. 2457T
gcuucacccuugaugcaga

SEQ ID NO: 3865362 - RNA, 19 nt, Shigella flexneri 2a str. 2457T
gcuucaccgacaucuuucu

SEQ ID NO: 3865363 - RNA, 16 nt, Shigella flexneri 2a str. 2457T
gcuucacgcgccagcu

SEQ ID NO: 3865364 - RNA, 17 nt, Shigella flexneri 2a str. 2457T
gcuucacgcgccagcuu

SEQ ID NO: 3865365 - RNA, 14 nt, Shigella flexneri 2a str. 2457T
gcuucagcgcgucg

SEQ ID NO: 3865366 - RNA, 17 nt, Shigella flexneri 2a str. 2457T
gcuucaggaauaagaca

SEQ ID NO: 3865367 - RNA, 16 nt, Shigella flexneri 2a str. 2457T
gcuucaggugcccaac

SEQ ID NO: 3865368 - RNA, 21 nt, Shigella flexneri 2a str. 2457T
gcuucagugacuucugccagc

SEQ ID NO: 3865369 - RNA, 15 nt, Shigella flexneri 2a str. 2457T
gcuucauccagcagu

SEQ ID NO: 3865370 - RNA, 19 nt, Shigella flexneri 2a str. 2457T
gcuucauccagcagugacu

SEQ ID NO: 3865371 - RNA, 15 nt, Shigella flexneri 2a str. 2457T
gcuucaucgcccaca

SEQ ID NO: 3865372 - RNA, 18 nt, Shigella flexneri 2a str. 2457T
gcuucaugcaucgguuuu

SEQ ID NO: 3865373 - RNA, 14 nt, Shigella flexneri 2a str. 2457T
gcuucaugcuuaau

SEQ ID NO: 3865374 - RNA, 11 nt, Shigella flexneri 2a str. 2457T
gcuucauugac

SEQ ID NO: 3865375 - RNA, 18 nt, Shigella flexneri 2a str. 2457T
gcuucauugcucucuucu

SEQ ID NO: 3865376 - RNA, 20 nt, Shigella flexneri 2a str. 2457T
gcuucauugcucucuucucc

SEQ ID NO: 3865377 - RNA, 13 nt, Shigella flexneri 2a str. 2457T
gcuucauuuacau

SEQ ID NO: 3865378 - RNA, 15 nt, Shigella flexneri 2a str. 2457T
gcuuccaccgccgga

SEQ ID NO: 3865379 - RNA, 16 nt, Shigella flexneri 2a str. 2457T
gcuuccagcagaccuu

SEQ ID NO: 3865380 - RNA, 12 nt, Shigella flexneri 2a str. 2457T
gcuuccagcucc

SEQ ID NO: 3865381 - RNA, 13 nt, Shigella flexneri 2a str. 2457T
gcuucccaaagau

SEQ ID NO: 3865382 - RNA, 15 nt, Shigella flexneri 2a str. 2457T
gcuucccaaagaucu

SEQ ID NO: 3865383 - RNA, 15 nt, Shigella flexneri 2a str. 2457T
gcuuccgccagcggc

SEQ ID NO: 3865384 - RNA, 19 nt, Shigella flexneri 2a str. 2457T
gcuuccgguuguucaacca

SEQ ID NO: 3865385 - RNA, 14 nt, Shigella flexneri 2a str. 2457T
gcuuccuaacauaa

SEQ ID NO: 3865386 - RNA, 22 nt, Shigella flexneri 2a str. 2457T
gcuuccuaacauaaugcaacga

SEQ ID NO: 3865387 - RNA, 18 nt, Shigella flexneri 2a str. 2457T
gcuuccugaguaauaacu

SEQ ID NO: 3865388 - RNA, 12 nt, Shigella flexneri 2a str. 2457T
gcuuccugcagc

SEQ ID NO: 3865389 - RNA, 18 nt, Shigella flexneri 2a str. 2457T
gcuucgagcuggaagcca

SEQ ID NO: 3865390 - RNA, 16 nt, Shigella flexneri 2a str. 2457T
gcuucgccugagcggc

SEQ ID NO: 3865391 - RNA, 21 nt, Shigella flexneri 2a str. 2457T
gcuucgccuuuuaccagcgcc

SEQ ID NO: 3865392 - RNA, 19 nt, Shigella flexneri 2a str. 2457T
gcuucgcgaaucgccacaa

SEQ ID NO: 3865393 - RNA, 19 nt, Shigella flexneri 2a str. 2457T
gcuucgcggacaucgucca

SEQ ID NO: 3865394 - RNA, 23 nt, Shigella flexneri 2a str. 2457T
gcuucgcggacaucguccagcuu

SEQ ID NO: 3865395 - RNA, 18 nt, Shigella flexneri 2a str. 2457T
gcuucgcuuaccaugcca

SEQ ID NO: 3865396 - RNA, 18 nt, Shigella flexneri 2a str. 2457T
gcuucgguaagcaaagcg

SEQ ID NO: 3865397 - RNA, 14 nt, Shigella flexneri 2a str. 2457T
gcuucggucagcac

SEQ ID NO: 3865398 - RNA, 22 nt, Shigella flexneri 2a str. 2457T
gcuucgguuuucgcgccagcca

SEQ ID NO: 3865399 - RNA, 23 nt, Shigella flexneri 2a str. 2457T
gcuucgguuuuguugccgcccgu

SEQ ID NO: 3865400 - RNA, 14 nt, Shigella flexneri 2a str. 2457T
gcuucguagacgcu

SEQ ID NO: 3865401 - RNA, 17 nt, Shigella flexneri 2a str. 2457T
gcuucguccaguuucac

SEQ ID NO: 3865402 - RNA, 12 nt, Shigella flexneri 2a str. 2457T
gcuucguccaug

SEQ ID NO: 3865403 - RNA, 14 nt, Shigella flexneri 2a str. 2457T
gcuucuaccaugau

SEQ ID NO: 3865404 - RNA, 18 nt, Shigella flexneri 2a str. 2457T
gcuucuauaccaaugauu

SEQ ID NO: 3865405 - RNA, 18 nt, Shigella flexneri 2a str. 2457T
gcuucucgugaaacucac

SEQ ID NO: 3865406 - RNA, 21 nt, Shigella flexneri 2a str. 2457T
gcuucugccuuauccagcaga

SEQ ID NO: 3865407 - RNA, 23 nt, Shigella flexneri 2a str. 2457T
gcuucuggcgacauuuucucuac

SEQ ID NO: 3865408 - RNA, 16 nt, Shigella flexneri 2a str. 2457T
gcuucuggcuggcgcu

SEQ ID NO: 3865409 - RNA, 15 nt, Shigella flexneri 2a str. 2457T
gcuucuguuauucca

SEQ ID NO: 3865410 - RNA, 15 nt, Shigella flexneri 2a str. 2457T
gcuucuuccggcgau

SEQ ID NO: 3865411 - RNA, 22 nt, Shigella flexneri 2a str. 2457T
gcuucuucugccgcuuccagca

SEQ ID NO: 3865412 - RNA, 23 nt, Shigella flexneri 2a str. 2457T
gcuucuuuuuaccuucauuugcc

SEQ ID NO: 3865413 - RNA, 13 nt, Shigella flexneri 2a str. 2457T
gcuugaaaaggua

SEQ ID NO: 3865414 - RNA, 18 nt, Shigella flexneri 2a str. 2457T
gcuugacgcgucuuauca

SEQ ID NO: 3865415 - RNA, 22 nt, Shigella flexneri 2a str. 2457T
gcuugacgcgucuuaucaggcc

SEQ ID NO: 3865416 - RNA, 14 nt, Shigella flexneri 2a str. 2457T
gcuugacgugucuu

SEQ ID NO: 3865417 - RNA, 18 nt, Shigella flexneri 2a str. 2457T
gcuugacgugucuuauca

SEQ ID NO: 3865418 - RNA, 22 nt, Shigella flexneri 2a str. 2457T
gcuugacgugucuuaucaggcc

SEQ ID NO: 3865419 - RNA, 18 nt, Shigella flexneri 2a str. 2457T
gcuugauccuacacauac

SEQ ID NO: 3865420 - RNA, 22 nt, Shigella flexneri 2a str. 2457T
gcuugcaccggcgacaucccag

SEQ ID NO: 3865421 - RNA, 13 nt, Shigella flexneri 2a str. 2457T
gcuugcagcgucu

SEQ ID NO: 3865422 - RNA, 15 nt, Shigella flexneri 2a str. 2457T
gcuugccagagcagc

SEQ ID NO: 3865423 - RNA, 20 nt, Shigella flexneri 2a str. 2457T
gcuugccagagcagcaacaa

SEQ ID NO: 3865424 - RNA, 18 nt, Shigella flexneri 2a str. 2457T
gcuugccguugagggcgc

SEQ ID NO: 3865425 - RNA, 14 nt, Shigella flexneri 2a str. 2457T
gcuugcgagacggc

SEQ ID NO: 3865426 - RNA, 18 nt, Shigella flexneri 2a str. 2457T
gcuugcgauauucuucag

SEQ ID NO: 3865427 - RNA, 20 nt, Shigella flexneri 2a str. 2457T
gcuugcgcgcaaucagcacc

SEQ ID NO: 3865428 - RNA, 12 nt, Shigella flexneri 2a str. 2457T
gcuugcgguuug

SEQ ID NO: 3865429 - RNA, 20 nt, Shigella flexneri 2a str. 2457T
gcuugcgucauccagcacuu

SEQ ID NO: 3865430 - RNA, 14 nt, Shigella flexneri 2a str. 2457T
gcuugcucaaguug

SEQ ID NO: 3865431 - RNA, 12 nt, Shigella flexneri 2a str. 2457T
gcuuggcagagc

SEQ ID NO: 3865432 - RNA, 16 nt, Shigella flexneri 2a str. 2457T
gcuugugcaccagcug

SEQ ID NO: 3865433 - RNA, 14 nt, Shigella flexneri 2a str. 2457T
gcuuguggaauuaa

SEQ ID NO: 3865434 - RNA, 11 nt, Shigella flexneri 2a str. 2457T
gcuuuaaaaaa

SEQ ID NO: 3865435 - RNA, 14 nt, Shigella flexneri 2a str. 2457T
gcuuuaaagcaggc

SEQ ID NO: 3865436 - RNA, 21 nt, Shigella flexneri 2a str. 2457T
gcuuuaaauuacugagcaauu

SEQ ID NO: 3865437 - RNA, 21 nt, Shigella flexneri 2a str. 2457T
gcuuuaacgaaagcgccucaa

SEQ ID NO: 3865438 - RNA, 21 nt, Shigella flexneri 2a str. 2457T
gcuuuaccaccgucaaaaaaa

SEQ ID NO: 3865439 - RNA, 16 nt, Shigella flexneri 2a str. 2457T
gcuuuacccagccaug

SEQ ID NO: 3865440 - RNA, 20 nt, Shigella flexneri 2a str. 2457T
gcuuuaccuuggugagauug

SEQ ID NO: 3865441 - RNA, 15 nt, Shigella flexneri 2a str. 2457T
gcuuuauacaaauga

SEQ ID NO: 3865442 - RNA, 18 nt, Shigella flexneri 2a str. 2457T
gcuuuauagggugcaauu

SEQ ID NO: 3865443 - RNA, 21 nt, Shigella flexneri 2a str. 2457T
gcuuuauccugcccacuccag

SEQ ID NO: 3865444 - RNA, 23 nt, Shigella flexneri 2a str. 2457T
gcuuuauccugcccacuccagcu

SEQ ID NO: 3865445 - RNA, 20 nt, Shigella flexneri 2a str. 2457T
gcuuuaucgacuaacuucug

SEQ ID NO: 3865446 - RNA, 12 nt, Shigella flexneri 2a str. 2457T
gcuuuauucgcu

SEQ ID NO: 3865447 - RNA, 13 nt, Shigella flexneri 2a str. 2457T
gcuuucaccgucg

SEQ ID NO: 3865448 - RNA, 14 nt, Shigella flexneri 2a str. 2457T
gcuuucaccugcgc

SEQ ID NO: 3865449 - RNA, 21 nt, Shigella flexneri 2a str. 2457T
gcuuucaccugcgcgugaccg

SEQ ID NO: 3865450 - RNA, 21 nt, Shigella flexneri 2a str. 2457T
gcuuucacgcucgguccuucg

SEQ ID NO: 3865451 - RNA, 16 nt, Shigella flexneri 2a str. 2457T
gcuuucacgucaggau

SEQ ID NO: 3865452 - RNA, 18 nt, Shigella flexneri 2a str. 2457T
gcuuucagagaagcaccg

SEQ ID NO: 3865453 - RNA, 17 nt, Shigella flexneri 2a str. 2457T
gcuuucagcacuuaucu

SEQ ID NO: 3865454 - RNA, 20 nt, Shigella flexneri 2a str. 2457T
gcuuucagcacuuaucucuu

SEQ ID NO: 3865455 - RNA, 20 nt, Shigella flexneri 2a str. 2457T
gcuuucaguucuagaacuaa

SEQ ID NO: 3865456 - RNA, 17 nt, Shigella flexneri 2a str. 2457T
gcuuucauauuccagcc

SEQ ID NO: 3865457 - RNA, 16 nt, Shigella flexneri 2a str. 2457T
gcuuucauucgguuuu

SEQ ID NO: 3865458 - RNA, 22 nt, Shigella flexneri 2a str. 2457T
gcuuuccaggcaucagcaacac

SEQ ID NO: 3865459 - RNA, 14 nt, Shigella flexneri 2a str. 2457T
gcuuuccgcuggcg

SEQ ID NO: 3865460 - RNA, 21 nt, Shigella flexneri 2a str. 2457T
gcuuuccggcggucagcgcca

SEQ ID NO: 3865461 - RNA, 17 nt, Shigella flexneri 2a str. 2457T
gcuuuccgggagcaauu

SEQ ID NO: 3865462 - RNA, 14 nt, Shigella flexneri 2a str. 2457T
gcuuuccugauaau

SEQ ID NO: 3865463 - RNA, 21 nt, Shigella flexneri 2a str. 2457T
gcuuucgagcacgacuuucuc

SEQ ID NO: 3865464 - RNA, 21 nt, Shigella flexneri 2a str. 2457T
gcuuucgcaauaaucaucucu

SEQ ID NO: 3865465 - RNA, 15 nt, Shigella flexneri 2a str. 2457T
gcuuucgugaagcug

SEQ ID NO: 3865466 - RNA, 18 nt, Shigella flexneri 2a str. 2457T
gcuuucgugaagcuggca

SEQ ID NO: 3865467 - RNA, 21 nt, Shigella flexneri 2a str. 2457T
gcuuucugaacugaacaaaaa

SEQ ID NO: 3865468 - RNA, 13 nt, Shigella flexneri 2a str. 2457T
gcuuucugggaug

SEQ ID NO: 3865469 - RNA, 21 nt, Shigella flexneri 2a str. 2457T
gcuuucugggaugaucaccug

SEQ ID NO: 3865470 - RNA, 23 nt, Shigella flexneri 2a str. 2457T
gcuuucugggaugaucaccugca

SEQ ID NO: 3865471 - RNA, 14 nt, Shigella flexneri 2a str. 2457T
gcuuugaauaucuc

SEQ ID NO: 3865472 - RNA, 19 nt, Shigella flexneri 2a str. 2457T
gcuuugaauaucuccucug

SEQ ID NO: 3865473 - RNA, 23 nt, Shigella flexneri 2a str. 2457T
gcuuugacgaccuucuuccagcu

SEQ ID NO: 3865474 - RNA, 14 nt, Shigella flexneri 2a str. 2457T
gcuuugcaggcugg

SEQ ID NO: 3865475 - RNA, 15 nt, Shigella flexneri 2a str. 2457T
gcuuugcaucccaga

SEQ ID NO: 3865476 - RNA, 17 nt, Shigella flexneri 2a str. 2457T
gcuuugccacugccggu

SEQ ID NO: 3865477 - RNA, 21 nt, Shigella flexneri 2a str. 2457T
gcuuugccacugccggugucg

SEQ ID NO: 3865478 - RNA, 17 nt, Shigella flexneri 2a str. 2457T
gcuuugcuaccuuccuc

SEQ ID NO: 3865479 - RNA, 16 nt, Shigella flexneri 2a str. 2457T
gcuuugcugauucucc

SEQ ID NO: 3865480 - RNA, 21 nt, Shigella flexneri 2a str. 2457T
gcuuuggauuugcaaauuuug

SEQ ID NO: 3865481 - RNA, 18 nt, Shigella flexneri 2a str. 2457T
gcuuuggcaaacuacaaa

SEQ ID NO: 3865482 - RNA, 12 nt, Shigella flexneri 2a str. 2457T
gcuuuggcaaau

SEQ ID NO: 3865483 - RNA, 19 nt, Shigella flexneri 2a str. 2457T
gcuuuggcgugagaucgcg

SEQ ID NO: 3865484 - RNA, 15 nt, Shigella flexneri 2a str. 2457T
gcuuuggugccagau

SEQ ID NO: 3865485 - RNA, 18 nt, Shigella flexneri 2a str. 2457T
gcuuugguggucaccaug

SEQ ID NO: 3865486 - RNA, 16 nt, Shigella flexneri 2a str. 2457T
gcuuugugcuggaaag

SEQ ID NO: 3865487 - RNA, 17 nt, Shigella flexneri 2a str. 2457T
gcuuuguguaaguuuaa

SEQ ID NO: 3865488 - RNA, 18 nt, Shigella flexneri 2a str. 2457T
gcuuuguucaugccggau

SEQ ID NO: 3865489 - RNA, 22 nt, Shigella flexneri 2a str. 2457T
gcuuuuacauuauccagcgacu

SEQ ID NO: 3865490 - RNA, 12 nt, Shigella flexneri 2a str. 2457T
gcuuuuacgcau

SEQ ID NO: 3865491 - RNA, 17 nt, Shigella flexneri 2a str. 2457T
gcuuuuacugcauucac

SEQ ID NO: 3865492 - RNA, 23 nt, Shigella flexneri 2a str. 2457T
gcuuuuagcgacaaauccuucac

SEQ ID NO: 3865493 - RNA, 17 nt, Shigella flexneri 2a str. 2457T
gcuuuucagugccaggu

SEQ ID NO: 3865494 - RNA, 14 nt, Shigella flexneri 2a str. 2457T
gcuuuucccuccac

SEQ ID NO: 3865495 - RNA, 15 nt, Shigella flexneri 2a str. 2457T
gcuuuucccuccacu

SEQ ID NO: 3865496 - RNA, 15 nt, Shigella flexneri 2a str. 2457T
gcuuuucucaccuau

SEQ ID NO: 3865497 - RNA, 23 nt, Shigella flexneri 2a str. 2457T
gcuuuuuaguaucuauucaucaa

SEQ ID NO: 3865498 - RNA, 14 nt, Shigella flexneri 2a str. 2457T
gcuuuuuauagcaa

SEQ ID NO: 3865499 - RNA, 18 nt, Shigella flexneri 2a str. 2457T
gcuuuuucugcgcacaca

SEQ ID NO: 3865500 - RNA, 15 nt, Shigella flexneri 2a str. 2457T
gcuuuuucugcuucu

SEQ ID NO: 3865501 - RNA, 18 nt, Shigella flexneri 2a str. 2457T
gcuuuuuuacaucaucag

SEQ ID NO: 3865502 - RNA, 18 nt, Shigella flexneri 2a str. 2457T
gcuuuuuuaccucuuuuu

SEQ ID NO: 3865503 - RNA, 18 nt, Shigella flexneri 2a str. 2457T
gcuuuuuugauuacagcu

SEQ ID NO: 3865504 - RNA, 19 nt, Shigella flexneri 2a str. 2457T
gcuuuuuuggcgaucuccg

SEQ ID NO: 3865505 - RNA, 15 nt, Shigella flexneri 2a str. 2457T
ggaaaaacagaggcc

SEQ ID NO: 3865506 - RNA, 16 nt, Shigella flexneri 2a str. 2457T
ggaaaaacggaggccc

SEQ ID NO: 3865507 - RNA, 21 nt, Shigella flexneri 2a str. 2457T
ggaaaacagcgcaccagaaac

SEQ ID NO: 3865508 - RNA, 21 nt, Shigella flexneri 2a str. 2457T
ggaaaauagcauaauauaaca

SEQ ID NO: 3865509 - RNA, 16 nt, Shigella flexneri 2a str. 2457T
ggaaaauaucgcccau

SEQ ID NO: 3865510 - RNA, 18 nt, Shigella flexneri 2a str. 2457T
ggaaaaucaucaggggca

SEQ ID NO: 3865511 - RNA, 21 nt, Shigella flexneri 2a str. 2457T
ggaaaaucaucaggggcagca

SEQ ID NO: 3865512 - RNA, 22 nt, Shigella flexneri 2a str. 2457T
ggaaacagcaccauccgcccac

SEQ ID NO: 3865513 - RNA, 13 nt, Shigella flexneri 2a str. 2457T
ggaaacagugcug

SEQ ID NO: 3865514 - RNA, 14 nt, Shigella flexneri 2a str. 2457T
ggaaaccaacucca

SEQ ID NO: 3865515 - RNA, 17 nt, Shigella flexneri 2a str. 2457T
ggaaaccaacuccagcg

SEQ ID NO: 3865516 - RNA, 19 nt, Shigella flexneri 2a str. 2457T
ggaaagaagucucugaaau

SEQ ID NO: 3865517 - RNA, 12 nt, Shigella flexneri 2a str. 2457T
ggaaagagcaac

SEQ ID NO: 3865518 - RNA, 16 nt, Shigella flexneri 2a str. 2457T
ggaaagauaccgccgc

SEQ ID NO: 3865519 - RNA, 15 nt, Shigella flexneri 2a str. 2457T
ggaaagcaccugcgc

SEQ ID NO: 3865520 - RNA, 15 nt, Shigella flexneri 2a str. 2457T
ggaaaucauccagca

SEQ ID NO: 3865521 - RNA, 17 nt, Shigella flexneri 2a str. 2457T
ggaaaucauccagcacg

SEQ ID NO: 3865522 - RNA, 14 nt, Shigella flexneri 2a str. 2457T
ggaaauccaacaga

SEQ ID NO: 3865523 - RNA, 17 nt, Shigella flexneri 2a str. 2457T
ggaaauccaggucagca

SEQ ID NO: 3865524 - RNA, 13 nt, Shigella flexneri 2a str. 2457T
ggaaauuaccgca

SEQ ID NO: 3865525 - RNA, 22 nt, Shigella flexneri 2a str. 2457T
ggaaauuaccgcaaagcccacg

SEQ ID NO: 3865526 - RNA, 14 nt, Shigella flexneri 2a str. 2457T
ggaaauucagcagu

SEQ ID NO: 3865527 - RNA, 21 nt, Shigella flexneri 2a str. 2457T
ggaaauucagcaguuuuugca

SEQ ID NO: 3865528 - RNA, 21 nt, Shigella flexneri 2a str. 2457T
ggaaauugcagagcugcguuu

SEQ ID NO: 3865529 - RNA, 20 nt, Shigella flexneri 2a str. 2457T
ggaacaaacugccgcgccgc

SEQ ID NO: 3865530 - RNA, 16 nt, Shigella flexneri 2a str. 2457T
ggaacaggcagggcca

SEQ ID NO: 3865531 - RNA, 19 nt, Shigella flexneri 2a str. 2457T
ggaacauaucaaaaagcug

SEQ ID NO: 3865532 - RNA, 14 nt, Shigella flexneri 2a str. 2457T
ggaaccacagcgcc

SEQ ID NO: 3865533 - RNA, 13 nt, Shigella flexneri 2a str. 2457T
ggaaccaggcgcg

SEQ ID NO: 3865534 - RNA, 19 nt, Shigella flexneri 2a str. 2457T
ggaacccggcuuucugcaa

SEQ ID NO: 3865535 - RNA, 15 nt, Shigella flexneri 2a str. 2457T
ggaaccggauuuuca

SEQ ID NO: 3865536 - RNA, 20 nt, Shigella flexneri 2a str. 2457T
ggaaccuccauguccagcuu

SEQ ID NO: 3865537 - RNA, 16 nt, Shigella flexneri 2a str. 2457T
ggaacgauuuuagcaa

SEQ ID NO: 3865538 - RNA, 22 nt, Shigella flexneri 2a str. 2457T
ggaacgcgcgauagucaugaug

SEQ ID NO: 3865539 - RNA, 17 nt, Shigella flexneri 2a str. 2457T
ggaacuggcugccagcg

SEQ ID NO: 3865540 - RNA, 18 nt, Shigella flexneri 2a str. 2457T
ggaacugugcugccgggg

SEQ ID NO: 3865541 - RNA, 14 nt, Shigella flexneri 2a str. 2457T
ggaacuguuucacc

SEQ ID NO: 3865542 - RNA, 15 nt, Shigella flexneri 2a str. 2457T
ggaacuugccgggcg

SEQ ID NO: 3865543 - RNA, 14 nt, Shigella flexneri 2a str. 2457T
ggaagaauggaaaa

SEQ ID NO: 3865544 - RNA, 21 nt, Shigella flexneri 2a str. 2457T
ggaagaauuugcuaccccuga

SEQ ID NO: 3865545 - RNA, 17 nt, Shigella flexneri 2a str. 2457T
ggaagagacuauuucuu

SEQ ID NO: 3865546 - RNA, 13 nt, Shigella flexneri 2a str. 2457T
ggaagagauggug

SEQ ID NO: 3865547 - RNA, 21 nt, Shigella flexneri 2a str. 2457T
ggaagagcgacaaucccugca

SEQ ID NO: 3865548 - RNA, 19 nt, Shigella flexneri 2a str. 2457T
ggaagauccagguuacgca

SEQ ID NO: 3865549 - RNA, 20 nt, Shigella flexneri 2a str. 2457T
ggaagauguacgccagugcu

SEQ ID NO: 3865550 - RNA, 14 nt, Shigella flexneri 2a str. 2457T
ggaagauuuaccga

SEQ ID NO: 3865551 - RNA, 15 nt, Shigella flexneri 2a str. 2457T
ggaagccaccacgcc

SEQ ID NO: 3865552 - RNA, 19 nt, Shigella flexneri 2a str. 2457T
ggaagccuuccgcaaacag

SEQ ID NO: 3865553 - RNA, 14 nt, Shigella flexneri 2a str. 2457T
ggaagcuccaccag

SEQ ID NO: 3865554 - RNA, 21 nt, Shigella flexneri 2a str. 2457T
ggaagcuggauuaacgcuggg

SEQ ID NO: 3865555 - RNA, 17 nt, Shigella flexneri 2a str. 2457T
ggaaggaagacgcagca

SEQ ID NO: 3865556 - RNA, 20 nt, Shigella flexneri 2a str. 2457T
ggaaggaagacgcagcaugc

SEQ ID NO: 3865557 - RNA, 17 nt, Shigella flexneri 2a str. 2457T
ggaaggacucgaggagc

SEQ ID NO: 3865558 - RNA, 22 nt, Shigella flexneri 2a str. 2457T
ggaaggacucgaggagcuggag

SEQ ID NO: 3865559 - RNA, 13 nt, Shigella flexneri 2a str. 2457T
ggaaggcauaacg

SEQ ID NO: 3865560 - RNA, 21 nt, Shigella flexneri 2a str. 2457T
ggaaggccagcaggucaaagc

SEQ ID NO: 3865561 - RNA, 16 nt, Shigella flexneri 2a str. 2457T
ggaaggcccuuucccu

SEQ ID NO: 3865562 - RNA, 18 nt, Shigella flexneri 2a str. 2457T
ggaaguaccaauggcaau

SEQ ID NO: 3865563 - RNA, 13 nt, Shigella flexneri 2a str. 2457T
ggaaguuacucaa

SEQ ID NO: 3865564 - RNA, 18 nt, Shigella flexneri 2a str. 2457T
ggaauaagacuggcaaau

SEQ ID NO: 3865565 - RNA, 19 nt, Shigella flexneri 2a str. 2457T
ggaauacauauauuacaac

SEQ ID NO: 3865566 - RNA, 14 nt, Shigella flexneri 2a str. 2457T
ggaauaccacuuuc

SEQ ID NO: 3865567 - RNA, 19 nt, Shigella flexneri 2a str. 2457T
ggaauagcggcaagcccag

SEQ ID NO: 3865568 - RNA, 20 nt, Shigella flexneri 2a str. 2457T
ggaauagcuuuacccaaauc

SEQ ID NO: 3865569 - RNA, 18 nt, Shigella flexneri 2a str. 2457T
ggaauauaccuuccgguu

SEQ ID NO: 3865570 - RNA, 17 nt, Shigella flexneri 2a str. 2457T
ggaauauuucaccgguu

SEQ ID NO: 3865571 - RNA, 16 nt, Shigella flexneri 2a str. 2457T
ggaauccgggucugua

SEQ ID NO: 3865572 - RNA, 21 nt, Shigella flexneri 2a str. 2457T
ggaaugagcuguacggagcgg

SEQ ID NO: 3865573 - RNA, 19 nt, Shigella flexneri 2a str. 2457T
ggaauuaacgauacuucug

SEQ ID NO: 3865574 - RNA, 12 nt, Shigella flexneri 2a str. 2457T
ggaauucucaaa

SEQ ID NO: 3865575 - RNA, 18 nt, Shigella flexneri 2a str. 2457T
ggaauuuuacagcccugg

SEQ ID NO: 3865576 - RNA, 19 nt, Shigella flexneri 2a str. 2457T
ggaauuuuacagcccuggc

SEQ ID NO: 3865577 - RNA, 23 nt, Shigella flexneri 2a str. 2457T
ggacaaaagccccaggcgauauu

SEQ ID NO: 3865578 - RNA, 19 nt, Shigella flexneri 2a str. 2457T
ggacaaaguuccugccgau

SEQ ID NO: 3865579 - RNA, 13 nt, Shigella flexneri 2a str. 2457T
ggacacacuucau

SEQ ID NO: 3865580 - RNA, 16 nt, Shigella flexneri 2a str. 2457T
ggacacauuucuuuug

SEQ ID NO: 3865581 - RNA, 21 nt, Shigella flexneri 2a str. 2457T
ggacacugccggaagagagca

SEQ ID NO: 3865582 - RNA, 16 nt, Shigella flexneri 2a str. 2457T
ggacagauucaugcug

SEQ ID NO: 3865583 - RNA, 13 nt, Shigella flexneri 2a str. 2457T
ggacaggcggccc

SEQ ID NO: 3865584 - RNA, 17 nt, Shigella flexneri 2a str. 2457T
ggacagugggauuaaaa

SEQ ID NO: 3865585 - RNA, 16 nt, Shigella flexneri 2a str. 2457T
ggacaucguccagcuu

SEQ ID NO: 3865586 - RNA, 15 nt, Shigella flexneri 2a str. 2457T
ggacaugauucauaa

SEQ ID NO: 3865587 - RNA, 17 nt, Shigella flexneri 2a str. 2457T
ggaccccgucaauuacc

SEQ ID NO: 3865588 - RNA, 17 nt, Shigella flexneri 2a str. 2457T
ggacccgcgaucgccug

SEQ ID NO: 3865589 - RNA, 18 nt, Shigella flexneri 2a str. 2457T
ggacccgcgaucgccugc

SEQ ID NO: 3865590 - RNA, 18 nt, Shigella flexneri 2a str. 2457T
ggaccuuucugaugcaua

SEQ ID NO: 3865591 - RNA, 16 nt, Shigella flexneri 2a str. 2457T
ggacgaucgcagauga

SEQ ID NO: 3865592 - RNA, 12 nt, Shigella flexneri 2a str. 2457T
ggacgggcaauu

SEQ ID NO: 3865593 - RNA, 22 nt, Shigella flexneri 2a str. 2457T
ggacgugcaccgucacuucuuc

SEQ ID NO: 3865594 - RNA, 16 nt, Shigella flexneri 2a str. 2457T
ggacucgaggagcugg

SEQ ID NO: 3865595 - RNA, 17 nt, Shigella flexneri 2a str. 2457T
ggacuucaugcgcagca

SEQ ID NO: 3865596 - RNA, 13 nt, Shigella flexneri 2a str. 2457T
ggacuuuuuauuu

SEQ ID NO: 3865597 - RNA, 24 nt, Shigella flexneri 2a str. 2457T
ggagaaacccggccacagcgccag

SEQ ID NO: 3865598 - RNA, 14 nt, Shigella flexneri 2a str. 2457T
ggagaagcaucagc

SEQ ID NO: 3865599 - RNA, 14 nt, Shigella flexneri 2a str. 2457T
ggagacagcuuaga

SEQ ID NO: 3865600 - RNA, 20 nt, Shigella flexneri 2a str. 2457T
ggagacgguuucugcucgca

SEQ ID NO: 3865601 - RNA, 20 nt, Shigella flexneri 2a str. 2457T
ggagaguaaacggugauacu

SEQ ID NO: 3865602 - RNA, 20 nt, Shigella flexneri 2a str. 2457T
ggagaguaugcgcgucagag

SEQ ID NO: 3865603 - RNA, 13 nt, Shigella flexneri 2a str. 2457T
ggagaguugaaag

SEQ ID NO: 3865604 - RNA, 14 nt, Shigella flexneri 2a str. 2457T
ggagaguugaaagc

SEQ ID NO: 3865605 - RNA, 21 nt, Shigella flexneri 2a str. 2457T
ggagaguugcaccagcaacaa

SEQ ID NO: 3865606 - RNA, 14 nt, Shigella flexneri 2a str. 2457T
ggagcaacugcgcu

SEQ ID NO: 3865607 - RNA, 14 nt, Shigella flexneri 2a str. 2457T
ggagcagccagcca

SEQ ID NO: 3865608 - RNA, 21 nt, Shigella flexneri 2a str. 2457T
ggagcagccccugcgccagcg

SEQ ID NO: 3865609 - RNA, 17 nt, Shigella flexneri 2a str. 2457T
ggagcaggagucauguc

SEQ ID NO: 3865610 - RNA, 14 nt, Shigella flexneri 2a str. 2457T
ggagcaggccgggu

SEQ ID NO: 3865611 - RNA, 14 nt, Shigella flexneri 2a str. 2457T
ggagccaguuggcg

SEQ ID NO: 3865612 - RNA, 13 nt, Shigella flexneri 2a str. 2457T
ggagccgaaagau

SEQ ID NO: 3865613 - RNA, 21 nt, Shigella flexneri 2a str. 2457T
ggagcgauuaugaaacaagaa

SEQ ID NO: 3865614 - RNA, 20 nt, Shigella flexneri 2a str. 2457T
ggagcgcuuuuuuccugccg

SEQ ID NO: 3865615 - RNA, 16 nt, Shigella flexneri 2a str. 2457T
ggcaaauaccggacac

SEQ ID NO: 3865616 - RNA, 20 nt, Shigella flexneri 2a str. 2457T
ggcaaaugcaucagugacaa

SEQ ID NO: 3865617 - RNA, 20 nt, Shigella flexneri 2a str. 2457T
ggcaaauuacuggcggcaaa

SEQ ID NO: 3865618 - RNA, 18 nt, Shigella flexneri 2a str. 2457T
ggcaaauucuucacggaa

SEQ ID NO: 3865619 - RNA, 15 nt, Shigella flexneri 2a str. 2457T
ggcaacaucaaauua

SEQ ID NO: 3865620 - RNA, 19 nt, Shigella flexneri 2a str. 2457T
ggcaacaugaaacagaaaa

SEQ ID NO: 3865621 - RNA, 15 nt, Shigella flexneri 2a str. 2457T
ggcaaccacaaccgc

SEQ ID NO: 3865622 - RNA, 14 nt, Shigella flexneri 2a str. 2457T
ggcaaccagcccau

SEQ ID NO: 3865623 - RNA, 14 nt, Shigella flexneri 2a str. 2457T
ggcaaccgcugagc

SEQ ID NO: 3865624 - RNA, 18 nt, Shigella flexneri 2a str. 2457T
ggcaacgacccgaagggc

SEQ ID NO: 3865625 - RNA, 15 nt, Shigella flexneri 2a str. 2457T
ggcaacgacugcgag

SEQ ID NO: 3865626 - RNA, 12 nt, Shigella flexneri 2a str. 2457T
ggcaacguucca

SEQ ID NO: 3865627 - RNA, 13 nt, Shigella flexneri 2a str. 2457T
ggcaacguuccag

SEQ ID NO: 3865628 - RNA, 14 nt, Shigella flexneri 2a str. 2457T
ggcaagaucgcgau

SEQ ID NO: 3865629 - RNA, 23 nt, Shigella flexneri 2a str. 2457T
ggcaagaucgcgaugggucgccg

SEQ ID NO: 3865630 - RNA, 15 nt, Shigella flexneri 2a str. 2457T
ggcaagcaggacgcc

SEQ ID NO: 3865631 - RNA, 22 nt, Shigella flexneri 2a str. 2457T
ggcaagcaggucggcucagccg

SEQ ID NO: 3865632 - RNA, 14 nt, Shigella flexneri 2a str. 2457T
ggcaagccagcaua

SEQ ID NO: 3865633 - RNA, 16 nt, Shigella flexneri 2a str. 2457T
ggcaaguaauaauauc

SEQ ID NO: 3865634 - RNA, 15 nt, Shigella flexneri 2a str. 2457T
ggcaaguagcgccau

SEQ ID NO: 3865635 - RNA, 22 nt, Shigella flexneri 2a str. 2457T
ggcaauacgauccugagcagcc

SEQ ID NO: 3865636 - RNA, 22 nt, Shigella flexneri 2a str. 2457T
ggcaauauagauaucaugcucu

SEQ ID NO: 3865637 - RNA, 17 nt, Shigella flexneri 2a str. 2457T
ggcaauauucauuaaaa

SEQ ID NO: 3865638 - RNA, 23 nt, Shigella flexneri 2a str. 2457T
ggcaaucaucaccggucggccuu

SEQ ID NO: 3865639 - RNA, 17 nt, Shigella flexneri 2a str. 2457T
ggcaaucauucccagac

SEQ ID NO: 3865640 - RNA, 16 nt, Shigella flexneri 2a str. 2457T
ggcaauccacugcuug

SEQ ID NO: 3865641 - RNA, 12 nt, Shigella flexneri 2a str. 2457T
ggcaauccguaa

SEQ ID NO: 3865642 - RNA, 12 nt, Shigella flexneri 2a str. 2457T
ggcaaucgccag

SEQ ID NO: 3865643 - RNA, 23 nt, Shigella flexneri 2a str. 2457T
ggcaaucucacuccggccagagc

SEQ ID NO: 3865644 - RNA, 14 nt, Shigella flexneri 2a str. 2457T
ggcaaucugcuggc

SEQ ID NO: 3865645 - RNA, 13 nt, Shigella flexneri 2a str. 2457T
ggcaaugcccggu

SEQ ID NO: 3865646 - RNA, 15 nt, Shigella flexneri 2a str. 2457T
ggcaaugcccggugu

SEQ ID NO: 3865647 - RNA, 20 nt, Shigella flexneri 2a str. 2457T
ggcaaugcgggugcaaucaa

SEQ ID NO: 3865648 - RNA, 22 nt, Shigella flexneri 2a str. 2457T
ggcaaugcguagcugagcaaca

SEQ ID NO: 3865649 - RNA, 15 nt, Shigella flexneri 2a str. 2457T
ggcaaugcugucggu

SEQ ID NO: 3865650 - RNA, 13 nt, Shigella flexneri 2a str. 2457T
ggcaauggugaac

SEQ ID NO: 3865651 - RNA, 12 nt, Shigella flexneri 2a str. 2457T
ggcaauucaccg

SEQ ID NO: 3865652 - RNA, 22 nt, Shigella flexneri 2a str. 2457T
ggcaauucaguacguucacgca

SEQ ID NO: 3865653 - RNA, 12 nt, Shigella flexneri 2a str. 2457T
ggcacaaagcug

SEQ ID NO: 3865654 - RNA, 15 nt, Shigella flexneri 2a str. 2457T
ggcacagcaggccaa

SEQ ID NO: 3865655 - RNA, 19 nt, Shigella flexneri 2a str. 2457T
ggcacagucgcgacgcuga

SEQ ID NO: 3865656 - RNA, 21 nt, Shigella flexneri 2a str. 2457T
ggcacauuucacucacgccgu

SEQ ID NO: 3865657 - RNA, 22 nt, Shigella flexneri 2a str. 2457T
ggcaccaaucaccgccagcaag

SEQ ID NO: 3865658 - RNA, 15 nt, Shigella flexneri 2a str. 2457T
ggcaccagccccugg

SEQ ID NO: 3865659 - RNA, 19 nt, Shigella flexneri 2a str. 2457T
ggcaccauuaaggcugaug

SEQ ID NO: 3865660 - RNA, 11 nt, Shigella flexneri 2a str. 2457T
ggcaccauuua

SEQ ID NO: 3865661 - RNA, 20 nt, Shigella flexneri 2a str. 2457T
ggcaccgccaaagauaaaau

SEQ ID NO: 3865662 - RNA, 19 nt, Shigella flexneri 2a str. 2457T
ggcaccuguaccagcccgc

SEQ ID NO: 3865663 - RNA, 15 nt, Shigella flexneri 2a str. 2457T
ggcaccuucgccucc

SEQ ID NO: 3865664 - RNA, 23 nt, Shigella flexneri 2a str. 2457T
ggcacgauaaauggcucuucacc

SEQ ID NO: 3865665 - RNA, 13 nt, Shigella flexneri 2a str. 2457T
ggcacgcccgcgc

SEQ ID NO: 3865666 - RNA, 16 nt, Shigella flexneri 2a str. 2457T
ggcacgucuucgauau

SEQ ID NO: 3865667 - RNA, 17 nt, Shigella flexneri 2a str. 2457T
ggcacguugcugcggcg

SEQ ID NO: 3865668 - RNA, 18 nt, Shigella flexneri 2a str. 2457T
ggcacucaacaaccagaa

SEQ ID NO: 3865669 - RNA, 20 nt, Shigella flexneri 2a str. 2457T
ggcacuuacucauuaaugca

SEQ ID NO: 3865670 - RNA, 14 nt, Shigella flexneri 2a str. 2457T
ggcacuuuuauccu

SEQ ID NO: 3865671 - RNA, 19 nt, Shigella flexneri 2a str. 2457T
ggcagaaacggaccuggga

SEQ ID NO: 3865672 - RNA, 17 nt, Shigella flexneri 2a str. 2457T
ggcagaauaacggcaga

SEQ ID NO: 3865673 - RNA, 17 nt, Shigella flexneri 2a str. 2457T
ggcagagaaaccacauc

SEQ ID NO: 3865674 - RNA, 15 nt, Shigella flexneri 2a str. 2457T
ggcagaguugccacc

SEQ ID NO: 3865675 - RNA, 21 nt, Shigella flexneri 2a str. 2457T
ggcagauacaaccaaucgcgg

SEQ ID NO: 3865676 - RNA, 22 nt, Shigella flexneri 2a str. 2457T
ggcagcaaggcuauucagcagu

SEQ ID NO: 3865677 - RNA, 23 nt, Shigella flexneri 2a str. 2457T
ggcagcaaggcuauucagcaguu

SEQ ID NO: 3865678 - RNA, 16 nt, Shigella flexneri 2a str. 2457T
ggcagcaaucacugcc

SEQ ID NO: 3865679 - RNA, 17 nt, Shigella flexneri 2a str. 2457T
ggcagcaaucacugcca

SEQ ID NO: 3865680 - RNA, 20 nt, Shigella flexneri 2a str. 2457T
ggcagcaauugucgcagaag

SEQ ID NO: 3865681 - RNA, 12 nt, Shigella flexneri 2a str. 2457T
ggcagcaggugc

SEQ ID NO: 3865682 - RNA, 20 nt, Shigella flexneri 2a str. 2457T
ggcagccaccgccagcgggu

SEQ ID NO: 3865683 - RNA, 16 nt, Shigella flexneri 2a str. 2457T
ggcagccagauggcug

SEQ ID NO: 3865684 - RNA, 23 nt, Shigella flexneri 2a str. 2457T
ggcagccagccaugcggcaucuu

SEQ ID NO: 3865685 - RNA, 14 nt, Shigella flexneri 2a str. 2457T
ggcagccaggcgcg

SEQ ID NO: 3865686 - RNA, 21 nt, Shigella flexneri 2a str. 2457T
ggcagccaguucgagaaaaau

SEQ ID NO: 3865687 - RNA, 21 nt, Shigella flexneri 2a str. 2457T
ggcagcgcgcauucagcagca

SEQ ID NO: 3865688 - RNA, 13 nt, Shigella flexneri 2a str. 2457T
ggcagcguuaugu

SEQ ID NO: 3865689 - RNA, 17 nt, Shigella flexneri 2a str. 2457T
ggcaggaaaaaagcgcu

SEQ ID NO: 3865690 - RNA, 14 nt, Shigella flexneri 2a str. 2457T
ggcaggaacugcuc

SEQ ID NO: 3865691 - RNA, 15 nt, Shigella flexneri 2a str. 2457T
ggcaggaguggcagc

SEQ ID NO: 3865692 - RNA, 16 nt, Shigella flexneri 2a str. 2457T
ggcaggaguggcagca

SEQ ID NO: 3865693 - RNA, 22 nt, Shigella flexneri 2a str. 2457T
ggcaggaugcccaugccaauua

SEQ ID NO: 3865694 - RNA, 14 nt, Shigella flexneri 2a str. 2457T
ggcaggccaaaaaa

SEQ ID NO: 3865695 - RNA, 15 nt, Shigella flexneri 2a str. 2457T
ggcaggccuaacaca

SEQ ID NO: 3865696 - RNA, 16 nt, Shigella flexneri 2a str. 2457T
ggcaggccuggguaaa

SEQ ID NO: 3865697 - RNA, 20 nt, Shigella flexneri 2a str. 2457T
ggcaggcuucaacacaggcc

SEQ ID NO: 3865698 - RNA, 22 nt, Shigella flexneri 2a str. 2457T
ggcaggguggugacaccaugcc

SEQ ID NO: 3865699 - RNA, 13 nt, Shigella flexneri 2a str. 2457T
ggcaggucaucgu

SEQ ID NO: 3865700 - RNA, 20 nt, Shigella flexneri 2a str. 2457T
ggcaggucaugugucgccgc

SEQ ID NO: 3865701 - RNA, 22 nt, Shigella flexneri 2a str. 2457T
ggcaggucuuucaccugauuac

SEQ ID NO: 3865702 - RNA, 19 nt, Shigella flexneri 2a str. 2457T
ggcaguaaccaaaagcugg

SEQ ID NO: 3865703 - RNA, 15 nt, Shigella flexneri 2a str. 2457T
ggcaguaauaccaga

SEQ ID NO: 3865704 - RNA, 18 nt, Shigella flexneri 2a str. 2457T
ggcaguucgggccgauca

SEQ ID NO: 3865705 - RNA, 16 nt, Shigella flexneri 2a str. 2457T
ggcaguucgugcagug

SEQ ID NO: 3865706 - RNA, 16 nt, Shigella flexneri 2a str. 2457T
ggcauaagccgucccu

SEQ ID NO: 3865707 - RNA, 16 nt, Shigella flexneri 2a str. 2457T
ggcauacuuugauuaa

SEQ ID NO: 3865708 - RNA, 20 nt, Shigella flexneri 2a str. 2457T
ggcauauuccgccaccugcg

SEQ ID NO: 3865709 - RNA, 13 nt, Shigella flexneri 2a str. 2457T
ggcauauucgcgc

SEQ ID NO: 3865710 - RNA, 16 nt, Shigella flexneri 2a str. 2457T
ggcaucacaucgcugg

SEQ ID NO: 3865711 - RNA, 18 nt, Shigella flexneri 2a str. 2457T
ggcaucaccaucgggccu

SEQ ID NO: 3865712 - RNA, 20 nt, Shigella flexneri 2a str. 2457T
ggcaucagcaacacgcugcu

SEQ ID NO: 3865713 - RNA, 20 nt, Shigella flexneri 2a str. 2457T
aaaacagcgcccaacacuuc

SEQ ID NO: 3865714 - RNA, 16 nt, Shigella flexneri 2a str. 2457T
aaaacaggcagcugcc

SEQ ID NO: 3865715 - RNA, 20 nt, Shigella flexneri 2a str. 2457T
aaaacaggucgccagucccu

SEQ ID NO: 3865716 - RNA, 14 nt, Shigella flexneri 2a str. 2457T
aaaacaguaccaga

SEQ ID NO: 3865717 - RNA, 20 nt, Shigella flexneri 2a str. 2457T
aaaacaguaccagaccaaca

SEQ ID NO: 3865718 - RNA, 16 nt, Shigella flexneri 2a str. 2457T
aaaacagugauuacua

SEQ ID NO: 3865719 - RNA, 15 nt, Shigella flexneri 2a str. 2457T
aaaacauaaucaaua

SEQ ID NO: 3865720 - RNA, 20 nt, Shigella flexneri 2a str. 2457T
aaaacauacccaguuucaug

SEQ ID NO: 3865721 - RNA, 13 nt, Shigella flexneri 2a str. 2457T
aaaacaucaugau

SEQ ID NO: 3865722 - RNA, 22 nt, Shigella flexneri 2a str. 2457T
aaaacaucaugauucacaguua

SEQ ID NO: 3865723 - RNA, 19 nt, Shigella flexneri 2a str. 2457T
aaaacccaacguuacucua

SEQ ID NO: 3865724 - RNA, 13 nt, Shigella flexneri 2a str. 2457T
aaaacccgcuucg

SEQ ID NO: 3865725 - RNA, 14 nt, Shigella flexneri 2a str. 2457T
aaaaccgaggggcu

SEQ ID NO: 3865726 - RNA, 22 nt, Shigella flexneri 2a str. 2457T
aaaaccgcaccguauugcgccg

SEQ ID NO: 3865727 - RNA, 18 nt, Shigella flexneri 2a str. 2457T
aaaaccgccucaggcaac

SEQ ID NO: 3865728 - RNA, 20 nt, Shigella flexneri 2a str. 2457T
aaaaccgcgaugaccaaaaa

SEQ ID NO: 3865729 - RNA, 15 nt, Shigella flexneri 2a str. 2457T
aaaaccgggugcaga

SEQ ID NO: 3865730 - RNA, 23 nt, Shigella flexneri 2a str. 2457T
aaaaccguauucgcggugcuuca

SEQ ID NO: 3865731 - RNA, 19 nt, Shigella flexneri 2a str. 2457T
aaaaccucuuccagcagau

SEQ ID NO: 3865732 - RNA, 17 nt, Shigella flexneri 2a str. 2457T
aaaacgccgccagcuca

SEQ ID NO: 3865733 - RNA, 20 nt, Shigella flexneri 2a str. 2457T
aaaacgccggagugaaaauu

SEQ ID NO: 3865734 - RNA, 22 nt, Shigella flexneri 2a str. 2457T
aaaacgccggagugaaaauucu

SEQ ID NO: 3865735 - RNA, 21 nt, Shigella flexneri 2a str. 2457T
aaaacgccuuauccggccuac

SEQ ID NO: 3865736 - RNA, 23 nt, Shigella flexneri 2a str. 2457T
aaaacgcgcccucagcccacauc

SEQ ID NO: 3865737 - RNA, 18 nt, Shigella flexneri 2a str. 2457T
aaaacgcuuacgcuucau

SEQ ID NO: 3865738 - RNA, 22 nt, Shigella flexneri 2a str. 2457T
aaaacggauugcuuguucgaug

SEQ ID NO: 3865739 - RNA, 16 nt, Shigella flexneri 2a str. 2457T
aaaacgguaaggacaa

SEQ ID NO: 3865740 - RNA, 19 nt, Shigella flexneri 2a str. 2457T
aaaacgguaguugaacucg

SEQ ID NO: 3865741 - RNA, 16 nt, Shigella flexneri 2a str. 2457T
aaaacggucacggcug

SEQ ID NO: 3865742 - RNA, 19 nt, Shigella flexneri 2a str. 2457T
aaaacguccggcaauauag

SEQ ID NO: 3865743 - RNA, 13 nt, Shigella flexneri 2a str. 2457T
aaaacgugcagcu

SEQ ID NO: 3865744 - RNA, 16 nt, Shigella flexneri 2a str. 2457T
aaaacgugcagcugcc

SEQ ID NO: 3865745 - RNA, 17 nt, Shigella flexneri 2a str. 2457T
aaaacguggccuccaaa

SEQ ID NO: 3865746 - RNA, 18 nt, Shigella flexneri 2a str. 2457T
aaaacguggccuccaaaa

SEQ ID NO: 3865747 - RNA, 19 nt, Shigella flexneri 2a str. 2457T
aaaacguggccuccaaaaa

SEQ ID NO: 3865748 - RNA, 20 nt, Shigella flexneri 2a str. 2457T
aaaacguggccuccaaaaaa

SEQ ID NO: 3865749 - RNA, 15 nt, Shigella flexneri 2a str. 2457T
aaaacuaaaaacagc

SEQ ID NO: 3865750 - RNA, 23 nt, Shigella flexneri 2a str. 2457T
aaaacucucaucuuugaaaucac

SEQ ID NO: 3865751 - RNA, 23 nt, Shigella flexneri 2a str. 2457T
aaaacucuccucguuaccccuuc

SEQ ID NO: 3865752 - RNA, 21 nt, Shigella flexneri 2a str. 2457T
aaaacucuuagcaaacaggau

SEQ ID NO: 3865753 - RNA, 16 nt, Shigella flexneri 2a str. 2457T
aaaacuggaaaaauaa

SEQ ID NO: 3865754 - RNA, 20 nt, Shigella flexneri 2a str. 2457T
aaaacuggauuacaaauaaa

SEQ ID NO: 3865755 - RNA, 22 nt, Shigella flexneri 2a str. 2457T
aaaacuggauuacaaauaaaua

SEQ ID NO: 3865756 - RNA, 17 nt, Shigella flexneri 2a str. 2457T
aaaacuuccggcagaaa

SEQ ID NO: 3865757 - RNA, 22 nt, Shigella flexneri 2a str. 2457T
aaaacuuccggcagaaauaaaa

SEQ ID NO: 3865758 - RNA, 16 nt, Shigella flexneri 2a str. 2457T
aaaacuugauacugaa

SEQ ID NO: 3865759 - RNA, 19 nt, Shigella flexneri 2a str. 2457T
aaaacuuuauucaguggca

SEQ ID NO: 3865760 - RNA, 11 nt, Shigella flexneri 2a str. 2457T
aaaacuuucca

SEQ ID NO: 3865761 - RNA, 11 nt, Shigella flexneri 2a str. 2457T
aaaagaaaauc

SEQ ID NO: 3865762 - RNA, 21 nt, Shigella flexneri 2a str. 2457T
aaaagaaaguuugcagaaauu

SEQ ID NO: 3865763 - RNA, 18 nt, Shigella flexneri 2a str. 2457T
aaaagaauggacacuauu

SEQ ID NO: 3865764 - RNA, 19 nt, Shigella flexneri 2a str. 2457T
aaaagacaccaucgcgcug

SEQ ID NO: 3865765 - RNA, 15 nt, Shigella flexneri 2a str. 2457T
aaaagaguaaaguua

SEQ ID NO: 3865766 - RNA, 18 nt, Shigella flexneri 2a str. 2457T
aaaagauggauugcugaa

SEQ ID NO: 3865767 - RNA, 15 nt, Shigella flexneri 2a str. 2457T
aaaagauuaaaaaaa

SEQ ID NO: 3865768 - RNA, 16 nt, Shigella flexneri 2a str. 2457T
aaaagauuaaaaaaac

SEQ ID NO: 3865769 - RNA, 18 nt, Shigella flexneri 2a str. 2457T
aaaagauugaauuauuca

SEQ ID NO: 3865770 - RNA, 20 nt, Shigella flexneri 2a str. 2457T
aaaagauugaauuauucacu

SEQ ID NO: 3865771 - RNA, 15 nt, Shigella flexneri 2a str. 2457T
aaaagcacagaaucu

SEQ ID NO: 3865772 - RNA, 17 nt, Shigella flexneri 2a str. 2457T
aaaagcauuuaauacug

SEQ ID NO: 3865773 - RNA, 14 nt, Shigella flexneri 2a str. 2457T
aaaagccuaagaag

SEQ ID NO: 3865774 - RNA, 17 nt, Shigella flexneri 2a str. 2457T
aaaagccuaagaaguca

SEQ ID NO: 3865775 - RNA, 15 nt, Shigella flexneri 2a str. 2457T
aaaagccugccaucu

SEQ ID NO: 3865776 - RNA, 12 nt, Shigella flexneri 2a str. 2457T
aaaaggcagcgg

SEQ ID NO: 3865777 - RNA, 16 nt, Shigella flexneri 2a str. 2457T
aaaaggcguucacgcc

SEQ ID NO: 3865778 - RNA, 18 nt, Shigella flexneri 2a str. 2457T
aaaagggagcuaucuccc

SEQ ID NO: 3865779 - RNA, 15 nt, Shigella flexneri 2a str. 2457T
aaaagggcuggaagc

SEQ ID NO: 3865780 - RNA, 18 nt, Shigella flexneri 2a str. 2457T
aaaagguaggccugauaa

SEQ ID NO: 3865781 - RNA, 14 nt, Shigella flexneri 2a str. 2457T
aaaaggucacuccc

SEQ ID NO: 3865782 - RNA, 17 nt, Shigella flexneri 2a str. 2457T
aaaaggugcucaaugag

SEQ ID NO: 3865783 - RNA, 17 nt, Shigella flexneri 2a str. 2457T
aaaagguugccugucuu

SEQ ID NO: 3865784 - RNA, 15 nt, Shigella flexneri 2a str. 2457T
aaaaguccaggcugc

SEQ ID NO: 3865785 - RNA, 24 nt, Shigella flexneri 2a str. 2457T
aaaaguuuuaucggagaacaggaa

SEQ ID NO: 3865786 - RNA, 17 nt, Shigella flexneri 2a str. 2457T
aaaauaaaucaaaguca

SEQ ID NO: 3865787 - RNA, 18 nt, Shigella flexneri 2a str. 2457T
aaaauaaccaaauaaaau

SEQ ID NO: 3865788 - RNA, 21 nt, Shigella flexneri 2a str. 2457T
aaaauaacuuaaugucauaca

SEQ ID NO: 3865789 - RNA, 18 nt, Shigella flexneri 2a str. 2457T
aaaauaaucuauugauuu

SEQ ID NO: 3865790 - RNA, 18 nt, Shigella flexneri 2a str. 2457T
aaaauaauuuuaaauauc

SEQ ID NO: 3865791 - RNA, 12 nt, Shigella flexneri 2a str. 2457T
aaaauacacuuu

SEQ ID NO: 3865792 - RNA, 17 nt, Shigella flexneri 2a str. 2457T
aaaauacauacgcaaaa

SEQ ID NO: 3865793 - RNA, 12 nt, Shigella flexneri 2a str. 2457T
aaaauaccaaua

SEQ ID NO: 3865794 - RNA, 15 nt, Shigella flexneri 2a str. 2457T
aaaauaccaccaaug

SEQ ID NO: 3865795 - RNA, 15 nt, Shigella flexneri 2a str. 2457T
aaaauaccagcaauu

SEQ ID NO: 3865796 - RNA, 16 nt, Shigella flexneri 2a str. 2457T
aaaauaccgagcagcc

SEQ ID NO: 3865797 - RNA, 19 nt, Shigella flexneri 2a str. 2457T
aaaauagccaaucauuccc

SEQ ID NO: 3865798 - RNA, 21 nt, Shigella flexneri 2a str. 2457T
aaaauagcuguuuauuuauac

SEQ ID NO: 3865799 - RNA, 23 nt, Shigella flexneri 2a str. 2457T
aaaauaggaauccgggucuguaa

SEQ ID NO: 3865800 - RNA, 13 nt, Shigella flexneri 2a str. 2457T
aaaauaucacucg

SEQ ID NO: 3865801 - RNA, 20 nt, Shigella flexneri 2a str. 2457T
aaaauauccguagugaaaaa

SEQ ID NO: 3865802 - RNA, 20 nt, Shigella flexneri 2a str. 2457T
aaaauaucguaggccugcuc

SEQ ID NO: 3865803 - RNA, 22 nt, Shigella flexneri 2a str. 2457T
aaaauaucguaggccugcucaa

SEQ ID NO: 3865804 - RNA, 15 nt, Shigella flexneri 2a str. 2457T
aaaaucaacgacaaa

SEQ ID NO: 3865805 - RNA, 13 nt, Shigella flexneri 2a str. 2457T
aaaaucaccauca

SEQ ID NO: 3865806 - RNA, 19 nt, Shigella flexneri 2a str. 2457T
aaaaucauccgcucccugg

SEQ ID NO: 3865807 - RNA, 10 nt, Shigella flexneri 2a str. 2457T
aaaaucaucu

SEQ ID NO: 3865808 - RNA, 19 nt, Shigella flexneri 2a str. 2457T
aaaauccagauuuauaaaa

SEQ ID NO: 3865809 - RNA, 22 nt, Shigella flexneri 2a str. 2457T
aaaauccauuuucuauuuugca

SEQ ID NO: 3865810 - RNA, 21 nt, Shigella flexneri 2a str. 2457T
aaaccagacacuucaagaaua

SEQ ID NO: 3865811 - RNA, 17 nt, Shigella flexneri 2a str. 2457T
aaaccagacagcacauu

SEQ ID NO: 3865812 - RNA, 15 nt, Shigella flexneri 2a str. 2457T
aaaccagagaauauu

SEQ ID NO: 3865813 - RNA, 19 nt, Shigella flexneri 2a str. 2457T
aaaccagcccugguuuauc

SEQ ID NO: 3865814 - RNA, 17 nt, Shigella flexneri 2a str. 2457T
aaacccaccagcugaug

SEQ ID NO: 3865815 - RNA, 14 nt, Shigella flexneri 2a str. 2457T
aaacccgcaggcgc

SEQ ID NO: 3865816 - RNA, 20 nt, Shigella flexneri 2a str. 2457T
aaacccggggcgguucaaau

SEQ ID NO: 3865817 - RNA, 21 nt, Shigella flexneri 2a str. 2457T
aaacccgugugguaaaguuug

SEQ ID NO: 3865818 - RNA, 20 nt, Shigella flexneri 2a str. 2457T
aaaccgacaauauugaugcu

SEQ ID NO: 3865819 - RNA, 20 nt, Shigella flexneri 2a str. 2457T
aaaccgacuuacuuauuucu

SEQ ID NO: 3865820 - RNA, 18 nt, Shigella flexneri 2a str. 2457T
aaaccgauuaauugccgc

SEQ ID NO: 3865821 - RNA, 23 nt, Shigella flexneri 2a str. 2457T
aaaccgccuucugcgccgccucu

SEQ ID NO: 3865822 - RNA, 22 nt, Shigella flexneri 2a str. 2457T
aaaccgcgaugaccaaaaacau

SEQ ID NO: 3865823 - RNA, 16 nt, Shigella flexneri 2a str. 2457T
aaaccgcuauuuacgg

SEQ ID NO: 3865824 - RNA, 20 nt, Shigella flexneri 2a str. 2457T
aaaccgcucgugggcaucgc

SEQ ID NO: 3865825 - RNA, 17 nt, Shigella flexneri 2a str. 2457T
aaaccggauacccugcc

SEQ ID NO: 3865826 - RNA, 18 nt, Shigella flexneri 2a str. 2457T
aaaccgggagaacauugg

SEQ ID NO: 3865827 - RNA, 18 nt, Shigella flexneri 2a str. 2457T
aaaccgggcaauuuaaac

SEQ ID NO: 3865828 - RNA, 23 nt, Shigella flexneri 2a str. 2457T
aaaccguaaguaagauaaaagca

SEQ ID NO: 3865829 - RNA, 17 nt, Shigella flexneri 2a str. 2457T
aaaccgucagcaccagg

SEQ ID NO: 3865830 - RNA, 23 nt, Shigella flexneri 2a str. 2457T
aaaccgucguuacugucgcgcag

SEQ ID NO: 3865831 - RNA, 19 nt, Shigella flexneri 2a str. 2457T
aaaccguguuuaugaaagu

SEQ ID NO: 3865832 - RNA, 15 nt, Shigella flexneri 2a str. 2457T
aaaccucacgcaucc

SEQ ID NO: 3865833 - RNA, 19 nt, Shigella flexneri 2a str. 2457T
aaaccucacgcauccucua

SEQ ID NO: 3865834 - RNA, 16 nt, Shigella flexneri 2a str. 2457T
aaaccuccgcaaugcg

SEQ ID NO: 3865835 - RNA, 23 nt, Shigella flexneri 2a str. 2457T
aaaccucguccuguugaaaaacc

SEQ ID NO: 3865836 - RNA, 14 nt, Shigella flexneri 2a str. 2457T
aaaccucuuccagc

SEQ ID NO: 3865837 - RNA, 18 nt, Shigella flexneri 2a str. 2457T
aaaccucuuccagcagau

SEQ ID NO: 3865838 - RNA, 17 nt, Shigella flexneri 2a str. 2457T
aaaccugacaacaaaac

SEQ ID NO: 3865839 - RNA, 16 nt, Shigella flexneri 2a str. 2457T
aaaccugauuacgcac

SEQ ID NO: 3865840 - RNA, 19 nt, Shigella flexneri 2a str. 2457T
aaaccugcgggaugguugg

SEQ ID NO: 3865841 - RNA, 16 nt, Shigella flexneri 2a str. 2457T
aaaccuguugaaauua

SEQ ID NO: 3865842 - RNA, 18 nt, Shigella flexneri 2a str. 2457T
aaaccuguugaaauuauu

SEQ ID NO: 3865843 - RNA, 14 nt, Shigella flexneri 2a str. 2457T
aaacgaaagcaggg

SEQ ID NO: 3865844 - RNA, 18 nt, Shigella flexneri 2a str. 2457T
aaacgaaccauaaaauca

SEQ ID NO: 3865845 - RNA, 16 nt, Shigella flexneri 2a str. 2457T
aaacgaaucugcaaau

SEQ ID NO: 3865846 - RNA, 22 nt, Shigella flexneri 2a str. 2457T
aaacgaauggcaaaacggcucu

SEQ ID NO: 3865847 - RNA, 17 nt, Shigella flexneri 2a str. 2457T
aaacgaccacucuuucg

SEQ ID NO: 3865848 - RNA, 16 nt, Shigella flexneri 2a str. 2457T
aaacgaccaugacacu

SEQ ID NO: 3865849 - RNA, 20 nt, Shigella flexneri 2a str. 2457T
aaacgcaaaacugccugaug

SEQ ID NO: 3865850 - RNA, 15 nt, Shigella flexneri 2a str. 2457T
aaacgcaacauugcc

SEQ ID NO: 3865851 - RNA, 20 nt, Shigella flexneri 2a str. 2457T
aaacgcaacauugccugaug

SEQ ID NO: 3865852 - RNA, 15 nt, Shigella flexneri 2a str. 2457T
aaacgcaccucagca

SEQ ID NO: 3865853 - RNA, 16 nt, Shigella flexneri 2a str. 2457T
aaacgcacgucugaug

SEQ ID NO: 3865854 - RNA, 16 nt, Shigella flexneri 2a str. 2457T
aaacgcagucuuccca

SEQ ID NO: 3865855 - RNA, 17 nt, Shigella flexneri 2a str. 2457T
aaacgcagucuucccag

SEQ ID NO: 3865856 - RNA, 18 nt, Shigella flexneri 2a str. 2457T
aaacgccaccuguuucuu

SEQ ID NO: 3865857 - RNA, 13 nt, Shigella flexneri 2a str. 2457T
aaacgccagcagc

SEQ ID NO: 3865858 - RNA, 21 nt, Shigella flexneri 2a str. 2457T
aaacgcccgaauugaagccaa

SEQ ID NO: 3865859 - RNA, 18 nt, Shigella flexneri 2a str. 2457T
aaacgcccuuaccuuuac

SEQ ID NO: 3865860 - RNA, 22 nt, Shigella flexneri 2a str. 2457T
aaacgccuuauccagccuacaa

SEQ ID NO: 3865861 - RNA, 16 nt, Shigella flexneri 2a str. 2457T
aaacgccuuauccggc

SEQ ID NO: 3865862 - RNA, 20 nt, Shigella flexneri 2a str. 2457T
aaacgccuugcgcgcagugc

SEQ ID NO: 3865863 - RNA, 14 nt, Shigella flexneri 2a str. 2457T
aaacgcgaccgccg

SEQ ID NO: 3865864 - RNA, 14 nt, Shigella flexneri 2a str. 2457T
aaacgcgccaggua

SEQ ID NO: 3865865 - RNA, 14 nt, Shigella flexneri 2a str. 2457T
aaacgcgcgcugga

SEQ ID NO: 3865866 - RNA, 23 nt, Shigella flexneri 2a str. 2457T
aaacgcguuacucuggcgcugga

SEQ ID NO: 3865867 - RNA, 12 nt, Shigella flexneri 2a str. 2457T
aaacgcugacgg

SEQ ID NO: 3865868 - RNA, 12 nt, Shigella flexneri 2a str. 2457T
aaacgcuggcag

SEQ ID NO: 3865869 - RNA, 22 nt, Shigella flexneri 2a str. 2457T
aaacgcuggcagcauuucucua

SEQ ID NO: 3865870 - RNA, 12 nt, Shigella flexneri 2a str. 2457T
aaacgcuuuuuu

SEQ ID NO: 3865871 - RNA, 15 nt, Shigella flexneri 2a str. 2457T
aaacggcacgaugag

SEQ ID NO: 3865872 - RNA, 20 nt, Shigella flexneri 2a str. 2457T
aaacggcacgaugagcaaau

SEQ ID NO: 3865873 - RNA, 20 nt, Shigella flexneri 2a str. 2457T
aaacggcauaugccaugcga

SEQ ID NO: 3865874 - RNA, 18 nt, Shigella flexneri 2a str. 2457T
aaacggcguugagcaauc

SEQ ID NO: 3865875 - RNA, 14 nt, Shigella flexneri 2a str. 2457T
aaacgggcgcugag

SEQ ID NO: 3865876 - RNA, 16 nt, Shigella flexneri 2a str. 2457T
aaacgguccggcaucc

SEQ ID NO: 3865877 - RNA, 16 nt, Shigella flexneri 2a str. 2457T
aaacggugauacugau

SEQ ID NO: 3865878 - RNA, 17 nt, Shigella flexneri 2a str. 2457T
aaacgguuuauccccaa

SEQ ID NO: 3865879 - RNA, 19 nt, Shigella flexneri 2a str. 2457T
aaacgguuuauccccaagg

SEQ ID NO: 3865880 - RNA, 20 nt, Shigella flexneri 2a str. 2457T
aaacgguuucagcagcggca

SEQ ID NO: 3865881 - RNA, 20 nt, Shigella flexneri 2a str. 2457T
aaacguaaaacugccugaug

SEQ ID NO: 3865882 - RNA, 22 nt, Shigella flexneri 2a str. 2457T
aaacgucgcaacuccaccagca

SEQ ID NO: 3865883 - RNA, 22 nt, Shigella flexneri 2a str. 2457T
aaacgucucacuaacgguguaa

SEQ ID NO: 3865884 - RNA, 18 nt, Shigella flexneri 2a str. 2457T
aaacgugaacggcuucgc

SEQ ID NO: 3865885 - RNA, 16 nt, Shigella flexneri 2a str. 2457T
aaacgugacagcauac

SEQ ID NO: 3865886 - RNA, 22 nt, Shigella flexneri 2a str. 2457T
aaacgugacagcauaccuucac

SEQ ID NO: 3865887 - RNA, 16 nt, Shigella flexneri 2a str. 2457T
aaacguuaugcaccga

SEQ ID NO: 3865888 - RNA, 20 nt, Shigella flexneri 2a str. 2457T
aaacguucaucgggcauugc

SEQ ID NO: 3865889 - RNA, 20 nt, Shigella flexneri 2a str. 2457T
aaacguugucaguucuuuua

SEQ ID NO: 3865890 - RNA, 15 nt, Shigella flexneri 2a str. 2457T
aaacguuuaaaaacu

SEQ ID NO: 3865891 - RNA, 14 nt, Shigella flexneri 2a str. 2457T
aaacguuucaaaca

SEQ ID NO: 3865892 - RNA, 15 nt, Shigella flexneri 2a str. 2457T
aaacuacaggcaacg

SEQ ID NO: 3865893 - RNA, 13 nt, Shigella flexneri 2a str. 2457T
aaacucacgcagg

SEQ ID NO: 3865894 - RNA, 18 nt, Shigella flexneri 2a str. 2457T
aaacucauaaauucaaag

SEQ ID NO: 3865895 - RNA, 14 nt, Shigella flexneri 2a str. 2457T
aaacucaugggucu

SEQ ID NO: 3865896 - RNA, 14 nt, Shigella flexneri 2a str. 2457T
aaacuccagcccuu

SEQ ID NO: 3865897 - RNA, 22 nt, Shigella flexneri 2a str. 2457T
aaacuccagcccuuuugacgcg

SEQ ID NO: 3865898 - RNA, 21 nt, Shigella flexneri 2a str. 2457T
aaacuccgccgcaucuuccca

SEQ ID NO: 3865899 - RNA, 22 nt, Shigella flexneri 2a str. 2457T
aaacuccgccgcaucuucccag

SEQ ID NO: 3865900 - RNA, 20 nt, Shigella flexneri 2a str. 2457T
aaacucgcgcaggcugacau

SEQ ID NO: 3865901 - RNA, 20 nt, Shigella flexneri 2a str. 2457T
aaacucucaucuuugaaauc

SEQ ID NO: 3865902 - RNA, 12 nt, Shigella flexneri 2a str. 2457T
aaacucugcggc

SEQ ID NO: 3865903 - RNA, 16 nt, Shigella flexneri 2a str. 2457T
aaacugagccaaacgc

SEQ ID NO: 3865904 - RNA, 13 nt, Shigella flexneri 2a str. 2457T
aaacugccugaug

SEQ ID NO: 3865905 - RNA, 21 nt, Shigella flexneri 2a str. 2457T
aaacugcgauuuaacgccugg

SEQ ID NO: 3865906 - RNA, 22 nt, Shigella flexneri 2a str. 2457T
aaacugcgucgacauagccauc

SEQ ID NO: 3865907 - RNA, 18 nt, Shigella flexneri 2a str. 2457T
aaagcgagaguuacagcu

SEQ ID NO: 3865908 - RNA, 13 nt, Shigella flexneri 2a str. 2457T
aaagcgagcagua

SEQ ID NO: 3865909 - RNA, 19 nt, Shigella flexneri 2a str. 2457T
aaagcgcaaaauaccagca

SEQ ID NO: 3865910 - RNA, 23 nt, Shigella flexneri 2a str. 2457T
aaagcgcaaaauaccagcaauuu

SEQ ID NO: 3865911 - RNA, 23 nt, Shigella flexneri 2a str. 2457T
aaagcgcaggccaacagucuuaa

SEQ ID NO: 3865912 - RNA, 14 nt, Shigella flexneri 2a str. 2457T
aaagcgcgcaguuu

SEQ ID NO: 3865913 - RNA, 23 nt, Shigella flexneri 2a str. 2457T
aaagcgcggcagugacugcccca

SEQ ID NO: 3865914 - RNA, 20 nt, Shigella flexneri 2a str. 2457T
aaagcgcgguuucaauuucc

SEQ ID NO: 3865915 - RNA, 18 nt, Shigella flexneri 2a str. 2457T
aaagcggcucauugccau

SEQ ID NO: 3865916 - RNA, 18 nt, Shigella flexneri 2a str. 2457T
aaagcguacccgccugau

SEQ ID NO: 3865917 - RNA, 16 nt, Shigella flexneri 2a str. 2457T
aaagcguauccaucac

SEQ ID NO: 3865918 - RNA, 16 nt, Shigella flexneri 2a str. 2457T
aaagcguuuaugcgca

SEQ ID NO: 3865919 - RNA, 22 nt, Shigella flexneri 2a str. 2457T
aaagcucuuuugacgcccccaa

SEQ ID NO: 3865920 - RNA, 19 nt, Shigella flexneri 2a str. 2457T
aaagcugcaaggugaaagc

SEQ ID NO: 3865921 - RNA, 23 nt, Shigella flexneri 2a str. 2457T
aaagcugccgucaauuuuaagca

SEQ ID NO: 3865922 - RNA, 19 nt, Shigella flexneri 2a str. 2457T
aaagcugcugaccaccagc

SEQ ID NO: 3865923 - RNA, 16 nt, Shigella flexneri 2a str. 2457T
aaagcuguaucccagc

SEQ ID NO: 3865924 - RNA, 16 nt, Shigella flexneri 2a str. 2457T
aaagcugucaccaauc

SEQ ID NO: 3865925 - RNA, 17 nt, Shigella flexneri 2a str. 2457T
aaagcugucaccaauca

SEQ ID NO: 3865926 - RNA, 21 nt, Shigella flexneri 2a str. 2457T
aaaggaaaaucacaggcgcga

SEQ ID NO: 3865927 - RNA, 22 nt, Shigella flexneri 2a str. 2457T
aaaggauguuuaucgccuggua

SEQ ID NO: 3865928 - RNA, 16 nt, Shigella flexneri 2a str. 2457T
aaaggcaaaaugccag

SEQ ID NO: 3865929 - RNA, 16 nt, Shigella flexneri 2a str. 2457T
aaaggcaacaugaaac

SEQ ID NO: 3865930 - RNA, 18 nt, Shigella flexneri 2a str. 2457T
aaaggcaacaugaaacag

SEQ ID NO: 3865931 - RNA, 22 nt, Shigella flexneri 2a str. 2457T
aaaggcaccaauauugacugau

SEQ ID NO: 3865932 - RNA, 15 nt, Shigella flexneri 2a str. 2457T
aaaggcaccuggaaa

SEQ ID NO: 3865933 - RNA, 18 nt, Shigella flexneri 2a str. 2457T
aaaggccagcaaucccca

SEQ ID NO: 3865934 - RNA, 16 nt, Shigella flexneri 2a str. 2457T
aaaggccagccaggca

SEQ ID NO: 3865935 - RNA, 12 nt, Shigella flexneri 2a str. 2457T
aaaggcgaaacc

SEQ ID NO: 3865936 - RNA, 14 nt, Shigella flexneri 2a str. 2457T
aaaggcgaugcugu

SEQ ID NO: 3865937 - RNA, 19 nt, Shigella flexneri 2a str. 2457T
aaaggcgcgguuucugcuu

SEQ ID NO: 3865938 - RNA, 20 nt, Shigella flexneri 2a str. 2457T
aaaggcggcagaacagaaca

SEQ ID NO: 3865939 - RNA, 19 nt, Shigella flexneri 2a str. 2457T
aaaggcgugaacuucgcca

SEQ ID NO: 3865940 - RNA, 16 nt, Shigella flexneri 2a str. 2457T
aaaggcugacaaauca

SEQ ID NO: 3865941 - RNA, 22 nt, Shigella flexneri 2a str. 2457T
aaaggcugacaaaucagaggcu

SEQ ID NO: 3865942 - RNA, 11 nt, Shigella flexneri 2a str. 2457T
aaagggaugcc

SEQ ID NO: 3865943 - RNA, 15 nt, Shigella flexneri 2a str. 2457T
aaagggaugccccca

SEQ ID NO: 3865944 - RNA, 12 nt, Shigella flexneri 2a str. 2457T
aaagggcaaagu

SEQ ID NO: 3865945 - RNA, 20 nt, Shigella flexneri 2a str. 2457T
aaagggcuaacgugcagguu

SEQ ID NO: 3865946 - RNA, 15 nt, Shigella flexneri 2a str. 2457T
aaaggggugaaaaaa

SEQ ID NO: 3865947 - RNA, 15 nt, Shigella flexneri 2a str. 2457T
aaagguaauggucag

SEQ ID NO: 3865948 - RNA, 22 nt, Shigella flexneri 2a str. 2457T
aaaggucccugaugcaucaguc

SEQ ID NO: 3865949 - RNA, 17 nt, Shigella flexneri 2a str. 2457T
aaagguccuguaaugag

SEQ ID NO: 3865950 - RNA, 12 nt, Shigella flexneri 2a str. 2457T
aaaguaaaaaag

SEQ ID NO: 3865951 - RNA, 14 nt, Shigella flexneri 2a str. 2457T
aaaguaaacaauaa

SEQ ID NO: 3865952 - RNA, 15 nt, Shigella flexneri 2a str. 2457T
aaaguaaaccaccag

SEQ ID NO: 3865953 - RNA, 20 nt, Shigella flexneri 2a str. 2457T
aaaguaaaccagagagaagc

SEQ ID NO: 3865954 - RNA, 10 nt, Shigella flexneri 2a str. 2457T
aaaguaaauu

SEQ ID NO: 3865955 - RNA, 13 nt, Shigella flexneri 2a str. 2457T
aaaguaacaccau

SEQ ID NO: 3865956 - RNA, 19 nt, Shigella flexneri 2a str. 2457T
aaaguaacugacaguagcc

SEQ ID NO: 3865957 - RNA, 18 nt, Shigella flexneri 2a str. 2457T
aaaguaagaauugauaaa

SEQ ID NO: 3865958 - RNA, 18 nt, Shigella flexneri 2a str. 2457T
aaaguacuucacaaucag

SEQ ID NO: 3865959 - RNA, 17 nt, Shigella flexneri 2a str. 2457T
aaaguagaaauuauuuc

SEQ ID NO: 3865960 - RNA, 17 nt, Shigella flexneri 2a str. 2457T
aaaguagggcugauaaa

SEQ ID NO: 3865961 - RNA, 22 nt, Shigella flexneri 2a str. 2457T
aaagucacgccaauaaucgauu

SEQ ID NO: 3865962 - RNA, 19 nt, Shigella flexneri 2a str. 2457T
aaagucagauaaaaaguuu

SEQ ID NO: 3865963 - RNA, 14 nt, Shigella flexneri 2a str. 2457T
aaagucauaucagc

SEQ ID NO: 3865964 - RNA, 12 nt, Shigella flexneri 2a str. 2457T
aaagucaucaau

SEQ ID NO: 3865965 - RNA, 13 nt, Shigella flexneri 2a str. 2457T
aaagucccuuccc

SEQ ID NO: 3865966 - RNA, 17 nt, Shigella flexneri 2a str. 2457T
aaagucgaugcgcuggc

SEQ ID NO: 3865967 - RNA, 19 nt, Shigella flexneri 2a str. 2457T
aaagucguaggccugauaa

SEQ ID NO: 3865968 - RNA, 13 nt, Shigella flexneri 2a str. 2457T
aaagugaaaaaca

SEQ ID NO: 3865969 - RNA, 21 nt, Shigella flexneri 2a str. 2457T
aaagugacacaaucaaauccu

SEQ ID NO: 3865970 - RNA, 16 nt, Shigella flexneri 2a str. 2457T
aaagugagcuuuguuc

SEQ ID NO: 3865971 - RNA, 15 nt, Shigella flexneri 2a str. 2457T
aaagugaguuuugca

SEQ ID NO: 3865972 - RNA, 23 nt, Shigella flexneri 2a str. 2457T
aaagugccgccagcuucgcuucc

SEQ ID NO: 3865973 - RNA, 17 nt, Shigella flexneri 2a str. 2457T
aaaguggaaaaauaaca

SEQ ID NO: 3865974 - RNA, 20 nt, Shigella flexneri 2a str. 2457T
aaaguggaaaaauaacaaau

SEQ ID NO: 3865975 - RNA, 20 nt, Shigella flexneri 2a str. 2457T
aaaguggcggggaucacucc

SEQ ID NO: 3865976 - RNA, 19 nt, Shigella flexneri 2a str. 2457T
aaaguguggggauaacuau

SEQ ID NO: 3865977 - RNA, 21 nt, Shigella flexneri 2a str. 2457T
aaaguguuccaucgcguuggu

SEQ ID NO: 3865978 - RNA, 14 nt, Shigella flexneri 2a str. 2457T
aaaguguugcagga

SEQ ID NO: 3865979 - RNA, 17 nt, Shigella flexneri 2a str. 2457T
aaaguuaccuucgaaga

SEQ ID NO: 3865980 - RNA, 15 nt, Shigella flexneri 2a str. 2457T
aaaguuauaaauaaa

SEQ ID NO: 3865981 - RNA, 17 nt, Shigella flexneri 2a str. 2457T
aaaguugcucucaaaga

SEQ ID NO: 3865982 - RNA, 18 nt, Shigella flexneri 2a str. 2457T
aaaguugcucucaaagac

SEQ ID NO: 3865983 - RNA, 15 nt, Shigella flexneri 2a str. 2457T
aaaguuuaauugcca

SEQ ID NO: 3865984 - RNA, 18 nt, Shigella flexneri 2a str. 2457T
aaaguuuucuucagugcc

SEQ ID NO: 3865985 - RNA, 14 nt, Shigella flexneri 2a str. 2457T
aaauaaaaaacauu

SEQ ID NO: 3865986 - RNA, 17 nt, Shigella flexneri 2a str. 2457T
aaauaaaaagagauugu

SEQ ID NO: 3865987 - RNA, 11 nt, Shigella flexneri 2a str. 2457T
aaauaaaaauu

SEQ ID NO: 3865988 - RNA, 19 nt, Shigella flexneri 2a str. 2457T
aaauaaauaccguucauua

SEQ ID NO: 3865989 - RNA, 21 nt, Shigella flexneri 2a str. 2457T
aaauaacagcggcaaccagcc

SEQ ID NO: 3865990 - RNA, 17 nt, Shigella flexneri 2a str. 2457T
aaauaacaucgccagaa

SEQ ID NO: 3865991 - RNA, 17 nt, Shigella flexneri 2a str. 2457T
aaauaaccaaauaaaau

SEQ ID NO: 3865992 - RNA, 16 nt, Shigella flexneri 2a str. 2457T
aaauaacguaaaaacc

SEQ ID NO: 3865993 - RNA, 18 nt, Shigella flexneri 2a str. 2457T
aaauaaggccaugcugcu

SEQ ID NO: 3865994 - RNA, 12 nt, Shigella flexneri 2a str. 2457T
aaauaauauccc

SEQ ID NO: 3865995 - RNA, 21 nt, Shigella flexneri 2a str. 2457T
aaauaaucccgcgcaacaaau

SEQ ID NO: 3865996 - RNA, 23 nt, Shigella flexneri 2a str. 2457T
aaauaaucccgcgcaacaaauaa

SEQ ID NO: 3865997 - RNA, 14 nt, Shigella flexneri 2a str. 2457T
aaauaauccgcugu

SEQ ID NO: 3865998 - RNA, 21 nt, Shigella flexneri 2a str. 2457T
aaauaaucgcaauuacccagu

SEQ ID NO: 3865999 - RNA, 21 nt, Shigella flexneri 2a str. 2457T
aaauaauuuucguaguauaga

SEQ ID NO: 3866000 - RNA, 14 nt, Shigella flexneri 2a str. 2457T
aaauacaaggccaa

SEQ ID NO: 3866001 - RNA, 14 nt, Shigella flexneri 2a str. 2457T
aaauacaauucuca

SEQ ID NO: 3866002 - RNA, 18 nt, Shigella flexneri 2a str. 2457T
aaauacagcaauggaaaa

SEQ ID NO: 3866003 - RNA, 11 nt, Shigella flexneri 2a str. 2457T
aaauacaugac

SEQ ID NO: 3866004 - RNA, 14 nt, Shigella flexneri 2a str. 2457T
aaauaccaccagcg

SEQ ID NO: 3866005 - RNA, 13 nt, Shigella flexneri 2a str. 2457T
aaaucuccauuuc

SEQ ID NO: 3866006 - RNA, 14 nt, Shigella flexneri 2a str. 2457T
aaaucuccauuuca

SEQ ID NO: 3866007 - RNA, 21 nt, Shigella flexneri 2a str. 2457T
aaaucuccugccaauacaaaa

SEQ ID NO: 3866008 - RNA, 16 nt, Shigella flexneri 2a str. 2457T
aaaucugaaaucauca

SEQ ID NO: 3866009 - RNA, 18 nt, Shigella flexneri 2a str. 2457T
aaaucugauuaauauuga

SEQ ID NO: 3866010 - RNA, 16 nt, Shigella flexneri 2a str. 2457T
aaaucugcccguuaac

SEQ ID NO: 3866011 - RNA, 19 nt, Shigella flexneri 2a str. 2457T
aaaucugcccguuaaccau

SEQ ID NO: 3866012 - RNA, 20 nt, Shigella flexneri 2a str. 2457T
aaaucugcccguuaaccaua

SEQ ID NO: 3866013 - RNA, 18 nt, Shigella flexneri 2a str. 2457T
aaaucugcgccuacggca

SEQ ID NO: 3866014 - RNA, 14 nt, Shigella flexneri 2a str. 2457T
aaaucuuucauuuc

SEQ ID NO: 3866015 - RNA, 12 nt, Shigella flexneri 2a str. 2457T
aaaugaaaaaau

SEQ ID NO: 3866016 - RNA, 16 nt, Shigella flexneri 2a str. 2457T
aaaugaaaaucaccau

SEQ ID NO: 3866017 - RNA, 22 nt, Shigella flexneri 2a str. 2457T
aaaugaaaaucaccauuuccgg

SEQ ID NO: 3866018 - RNA, 14 nt, Shigella flexneri 2a str. 2457T
aaaugaacugggca

SEQ ID NO: 3866019 - RNA, 15 nt, Shigella flexneri 2a str. 2457T
aaaugaccgggcuug

SEQ ID NO: 3866020 - RNA, 19 nt, Shigella flexneri 2a str. 2457T
aaaugacgaugacugguag

SEQ ID NO: 3866021 - RNA, 13 nt, Shigella flexneri 2a str. 2457T
aaaugaggaauua

SEQ ID NO: 3866022 - RNA, 20 nt, Shigella flexneri 2a str. 2457T
aaaugaucgccgaagugaag

SEQ ID NO: 3866023 - RNA, 23 nt, Shigella flexneri 2a str. 2457T
aaaugaucgccgaagugaagagu

SEQ ID NO: 3866024 - RNA, 18 nt, Shigella flexneri 2a str. 2457T
aaaugauguagaccugau

SEQ ID NO: 3866025 - RNA, 12 nt, Shigella flexneri 2a str. 2457T
aaaugauuuccu

SEQ ID NO: 3866026 - RNA, 13 nt, Shigella flexneri 2a str. 2457T
aaaugauuuccug

SEQ ID NO: 3866027 - RNA, 14 nt, Shigella flexneri 2a str. 2457T
aaaugcaguuuuua

SEQ ID NO: 3866028 - RNA, 14 nt, Shigella flexneri 2a str. 2457T
aaaugcaucaguga

SEQ ID NO: 3866029 - RNA, 19 nt, Shigella flexneri 2a str. 2457T
aaaugcaucagugacaaau

SEQ ID NO: 3866030 - RNA, 20 nt, Shigella flexneri 2a str. 2457T
aaaugcaucggcauaaucau

SEQ ID NO: 3866031 - RNA, 20 nt, Shigella flexneri 2a str. 2457T
aaaugccaaauauuucuuua

SEQ ID NO: 3866032 - RNA, 11 nt, Shigella flexneri 2a str. 2457T
aaaugccagau

SEQ ID NO: 3866033 - RNA, 18 nt, Shigella flexneri 2a str. 2457T
aaaugcccgauaagcaaa

SEQ ID NO: 3866034 - RNA, 13 nt, Shigella flexneri 2a str. 2457T
aaaugccgcacau

SEQ ID NO: 3866035 - RNA, 12 nt, Shigella flexneri 2a str. 2457T
aaaugccugaug

SEQ ID NO: 3866036 - RNA, 19 nt, Shigella flexneri 2a str. 2457T
aaaugccuuucucagaagu

SEQ ID NO: 3866037 - RNA, 11 nt, Shigella flexneri 2a str. 2457T
aaaugcgcaug

SEQ ID NO: 3866038 - RNA, 15 nt, Shigella flexneri 2a str. 2457T
aaaugcgcucagggu

SEQ ID NO: 3866039 - RNA, 18 nt, Shigella flexneri 2a str. 2457T
aaaugcgcuuuauucaga

SEQ ID NO: 3866040 - RNA, 22 nt, Shigella flexneri 2a str. 2457T
aaaugcguggcgcguaccgccg

SEQ ID NO: 3866041 - RNA, 23 nt, Shigella flexneri 2a str. 2457T
aaaugcucuccguaggccagaua

SEQ ID NO: 3866042 - RNA, 19 nt, Shigella flexneri 2a str. 2457T
aaaugcugcaauugcggca

SEQ ID NO: 3866043 - RNA, 19 nt, Shigella flexneri 2a str. 2457T
aaaugcugcuuuauauucu

SEQ ID NO: 3866044 - RNA, 11 nt, Shigella flexneri 2a str. 2457T
aaaugcuggau

SEQ ID NO: 3866045 - RNA, 15 nt, Shigella flexneri 2a str. 2457T
aaaugcugguuuugu

SEQ ID NO: 3866046 - RNA, 18 nt, Shigella flexneri 2a str. 2457T
aaauggcacaauggagcu

SEQ ID NO: 3866047 - RNA, 23 nt, Shigella flexneri 2a str. 2457T
aaauggcgcuucguguuuaagaa

SEQ ID NO: 3866048 - RNA, 12 nt, Shigella flexneri 2a str. 2457T
aaauggcgcuuu

SEQ ID NO: 3866049 - RNA, 15 nt, Shigella flexneri 2a str. 2457T
aaaugggagcuggga

SEQ ID NO: 3866050 - RNA, 19 nt, Shigella flexneri 2a str. 2457T
aaaugggugacaucgcccu

SEQ ID NO: 3866051 - RNA, 19 nt, Shigella flexneri 2a str. 2457T
aaaugggugucgccuucca

SEQ ID NO: 3866052 - RNA, 18 nt, Shigella flexneri 2a str. 2457T
aaaugguaaagaaggcau

SEQ ID NO: 3866053 - RNA, 12 nt, Shigella flexneri 2a str. 2457T
aaaugucacugc

SEQ ID NO: 3866054 - RNA, 18 nt, Shigella flexneri 2a str. 2457T
aaaugugaagaggaacaa

SEQ ID NO: 3866055 - RNA, 20 nt, Shigella flexneri 2a str. 2457T
aaaugugcaaucacaguuaa

SEQ ID NO: 3866056 - RNA, 19 nt, Shigella flexneri 2a str. 2457T
aaaugugccggaugcauca

SEQ ID NO: 3866057 - RNA, 21 nt, Shigella flexneri 2a str. 2457T
aaaugugccggaugcaucaca

SEQ ID NO: 3866058 - RNA, 19 nt, Shigella flexneri 2a str. 2457T
aaauguuaucgggcauagg

SEQ ID NO: 3866059 - RNA, 20 nt, Shigella flexneri 2a str. 2457T
aaauuaaaucgguauuucca

SEQ ID NO: 3866060 - RNA, 23 nt, Shigella flexneri 2a str. 2457T
aaauuaacgacgcauacucuuug

SEQ ID NO: 3866061 - RNA, 16 nt, Shigella flexneri 2a str. 2457T
aaauuaacgucaccau

SEQ ID NO: 3866062 - RNA, 14 nt, Shigella flexneri 2a str. 2457T
aaauuacaaaaagu

SEQ ID NO: 3866063 - RNA, 22 nt, Shigella flexneri 2a str. 2457T
aaauuaccgcaccaccagcagc

SEQ ID NO: 3866064 - RNA, 23 nt, Shigella flexneri 2a str. 2457T
aaauuaccgcaccaccagcagcu

SEQ ID NO: 3866065 - RNA, 15 nt, Shigella flexneri 2a str. 2457T
aaauuacgcaaccag

SEQ ID NO: 3866066 - RNA, 23 nt, Shigella flexneri 2a str. 2457T
aaauuacucccgugccagagcau

SEQ ID NO: 3866067 - RNA, 21 nt, Shigella flexneri 2a str. 2457T
aaauuacugccuugaugaaaa

SEQ ID NO: 3866068 - RNA, 23 nt, Shigella flexneri 2a str. 2457T
aaauuacugccuugaugaaaaaa

SEQ ID NO: 3866069 - RNA, 20 nt, Shigella flexneri 2a str. 2457T
aaauuaggucaaagaaucaa

SEQ ID NO: 3866070 - RNA, 15 nt, Shigella flexneri 2a str. 2457T
aaauuauaucuuauu

SEQ ID NO: 3866071 - RNA, 14 nt, Shigella flexneri 2a str. 2457T
aaauuauccagcuu

SEQ ID NO: 3866072 - RNA, 13 nt, Shigella flexneri 2a str. 2457T
aaauuauuuuaaa

SEQ ID NO: 3866073 - RNA, 14 nt, Shigella flexneri 2a str. 2457T
aaauuauuuuaaau

SEQ ID NO: 3866074 - RNA, 19 nt, Shigella flexneri 2a str. 2457T
aaauucaagacaucaauaa

SEQ ID NO: 3866075 - RNA, 20 nt, Shigella flexneri 2a str. 2457T
aaauucaagacaucaauaaa

SEQ ID NO: 3866076 - RNA, 19 nt, Shigella flexneri 2a str. 2457T
aaauucagaugaugauacu

SEQ ID NO: 3866077 - RNA, 18 nt, Shigella flexneri 2a str. 2457T
aaauucagcaguuuuugc

SEQ ID NO: 3866078 - RNA, 19 nt, Shigella flexneri 2a str. 2457T
aaauucagcaguuuuugca

SEQ ID NO: 3866079 - RNA, 15 nt, Shigella flexneri 2a str. 2457T
aaauucagcauuacc

SEQ ID NO: 3866080 - RNA, 21 nt, Shigella flexneri 2a str. 2457T
aaauucagcauuacccgucug

SEQ ID NO: 3866081 - RNA, 15 nt, Shigella flexneri 2a str. 2457T
aaauucauuugaaua

SEQ ID NO: 3866082 - RNA, 15 nt, Shigella flexneri 2a str. 2457T
aaauuccgaacaaaa

SEQ ID NO: 3866083 - RNA, 15 nt, Shigella flexneri 2a str. 2457T
aaauuccuaaaguug

SEQ ID NO: 3866084 - RNA, 21 nt, Shigella flexneri 2a str. 2457T
aaauuccuaaccgaauucaaa

SEQ ID NO: 3866085 - RNA, 18 nt, Shigella flexneri 2a str. 2457T
aaauucgaaauagagaaa

SEQ ID NO: 3866086 - RNA, 23 nt, Shigella flexneri 2a str. 2457T
aaauucuacagaaaugaaaaaau

SEQ ID NO: 3866087 - RNA, 22 nt, Shigella flexneri 2a str. 2457T
aaauucucagugguugucgcag

SEQ ID NO: 3866088 - RNA, 18 nt, Shigella flexneri 2a str. 2457T
aaauucuccuuucuuucu

SEQ ID NO: 3866089 - RNA, 23 nt, Shigella flexneri 2a str. 2457T
aaauucuccuuucuuucuggaaa

SEQ ID NO: 3866090 - RNA, 19 nt, Shigella flexneri 2a str. 2457T
aaauucuggguaaugacuc

SEQ ID NO: 3866091 - RNA, 14 nt, Shigella flexneri 2a str. 2457T
aaauucuuaaugau

SEQ ID NO: 3866092 - RNA, 19 nt, Shigella flexneri 2a str. 2457T
aaauucuuacguaauuuau

SEQ ID NO: 3866093 - RNA, 20 nt, Shigella flexneri 2a str. 2457T
aaauucuucugaaugugccu

SEQ ID NO: 3866094 - RNA, 13 nt, Shigella flexneri 2a str. 2457T
aaauugaagaguu

SEQ ID NO: 3866095 - RNA, 16 nt, Shigella flexneri 2a str. 2457T
aaauugacuacaccau

SEQ ID NO: 3866096 - RNA, 14 nt, Shigella flexneri 2a str. 2457T
aaauugaugugaaa

SEQ ID NO: 3866097 - RNA, 18 nt, Shigella flexneri 2a str. 2457T
aaauugcaccauccauuu

SEQ ID NO: 3866098 - RNA, 23 nt, Shigella flexneri 2a str. 2457T
aaauugccccagacacaguucuu

SEQ ID NO: 3866099 - RNA, 17 nt, Shigella flexneri 2a str. 2457T
aaauugcguaaagccug

SEQ ID NO: 3866100 - RNA, 23 nt, Shigella flexneri 2a str. 2457T
aaauugcguaaagccugcuggca

SEQ ID NO: 3866101 - RNA, 16 nt, Shigella flexneri 2a str. 2457T
aaauugcugguuuugu

SEQ ID NO: 3866102 - RNA, 19 nt, Shigella flexneri 2a str. 2457T
aacagaagugcguuucugg

SEQ ID NO: 3866103 - RNA, 17 nt, Shigella flexneri 2a str. 2457T
aacagaauuacuggcag

SEQ ID NO: 3866104 - RNA, 22 nt, Shigella flexneri 2a str. 2457T
aacagaauuacuggcagauuau

SEQ ID NO: 3866105 - RNA, 15 nt, Shigella flexneri 2a str. 2457T
aacagacaaaaagaa

SEQ ID NO: 3866106 - RNA, 19 nt, Shigella flexneri 2a str. 2457T
aacagaccacauuccaggc

SEQ ID NO: 3866107 - RNA, 13 nt, Shigella flexneri 2a str. 2457T
aacagaccagcac

SEQ ID NO: 3866108 - RNA, 15 nt, Shigella flexneri 2a str. 2457T
aacagaccaguaaag

SEQ ID NO: 3866109 - RNA, 21 nt, Shigella flexneri 2a str. 2457T
aacagauaggcaucagcaauu

SEQ ID NO: 3866110 - RNA, 16 nt, Shigella flexneri 2a str. 2457T
aacagcaaccuccguc

SEQ ID NO: 3866111 - RNA, 19 nt, Shigella flexneri 2a str. 2457T
aacagcaauacguuucaua

SEQ ID NO: 3866112 - RNA, 15 nt, Shigella flexneri 2a str. 2457T
aacagcaaucccaaa

SEQ ID NO: 3866113 - RNA, 16 nt, Shigella flexneri 2a str. 2457T
aacagcacaucagcca

SEQ ID NO: 3866114 - RNA, 11 nt, Shigella flexneri 2a str. 2457T
aacagcaccau

SEQ ID NO: 3866115 - RNA, 13 nt, Shigella flexneri 2a str. 2457T
aacagcaccaucc

SEQ ID NO: 3866116 - RNA, 16 nt, Shigella flexneri 2a str. 2457T
aacagcaccauccgcc

SEQ ID NO: 3866117 - RNA, 16 nt, Shigella flexneri 2a str. 2457T
aacagcaggcagaucc

SEQ ID NO: 3866118 - RNA, 14 nt, Shigella flexneri 2a str. 2457T
aacagcagggccug

SEQ ID NO: 3866119 - RNA, 15 nt, Shigella flexneri 2a str. 2457T
aacagcagggccuga

SEQ ID NO: 3866120 - RNA, 15 nt, Shigella flexneri 2a str. 2457T
aacagccacugguga

SEQ ID NO: 3866121 - RNA, 21 nt, Shigella flexneri 2a str. 2457T
aacagccagcgcugacgugau

SEQ ID NO: 3866122 - RNA, 16 nt, Shigella flexneri 2a str. 2457T
aacagcccaaucaucg

SEQ ID NO: 3866123 - RNA, 20 nt, Shigella flexneri 2a str. 2457T
aacagcccaaucaucgcggc

SEQ ID NO: 3866124 - RNA, 16 nt, Shigella flexneri 2a str. 2457T
aacagccccugagcgu

SEQ ID NO: 3866125 - RNA, 14 nt, Shigella flexneri 2a str. 2457T
aacagcgacaccag

SEQ ID NO: 3866126 - RNA, 13 nt, Shigella flexneri 2a str. 2457T
aacagcgcaccag

SEQ ID NO: 3866127 - RNA, 11 nt, Shigella flexneri 2a str. 2457T
aacagcgcauu

SEQ ID NO: 3866128 - RNA, 14 nt, Shigella flexneri 2a str. 2457T
aacagcggcauuac

SEQ ID NO: 3866129 - RNA, 20 nt, Shigella flexneri 2a str. 2457T
aacagcgguuuacccugcuc

SEQ ID NO: 3866130 - RNA, 16 nt, Shigella flexneri 2a str. 2457T
aacagcucgacaccaa

SEQ ID NO: 3866131 - RNA, 15 nt, Shigella flexneri 2a str. 2457T
aacagcuuuuuccug

SEQ ID NO: 3866132 - RNA, 18 nt, Shigella flexneri 2a str. 2457T
aacaggaacaccagcauc

SEQ ID NO: 3866133 - RNA, 16 nt, Shigella flexneri 2a str. 2457T
aacaggaguagcucug

SEQ ID NO: 3866134 - RNA, 12 nt, Shigella flexneri 2a str. 2457T
aacaggaucugg

SEQ ID NO: 3866135 - RNA, 13 nt, Shigella flexneri 2a str. 2457T
aacaggcaacaac

SEQ ID NO: 3866136 - RNA, 14 nt, Shigella flexneri 2a str. 2457T
aacaggcagcugcc

SEQ ID NO: 3866137 - RNA, 16 nt, Shigella flexneri 2a str. 2457T
aacaggcccaacuguu

SEQ ID NO: 3866138 - RNA, 21 nt, Shigella flexneri 2a str. 2457T
aacagggaggggugcaugaaa

SEQ ID NO: 3866139 - RNA, 19 nt, Shigella flexneri 2a str. 2457T
aacagggcaauuaaaaauu

SEQ ID NO: 3866140 - RNA, 21 nt, Shigella flexneri 2a str. 2457T
aacagggcgucaccggucaga

SEQ ID NO: 3866141 - RNA, 22 nt, Shigella flexneri 2a str. 2457T
aacagguaaagaccauaaauau

SEQ ID NO: 3866142 - RNA, 23 nt, Shigella flexneri 2a str. 2457T
aacagguuuugacgugucugaua

SEQ ID NO: 3866143 - RNA, 11 nt, Shigella flexneri 2a str. 2457T
aacaguaaccc

SEQ ID NO: 3866144 - RNA, 20 nt, Shigella flexneri 2a str. 2457T
aacaguaagcacucugacgg

SEQ ID NO: 3866145 - RNA, 19 nt, Shigella flexneri 2a str. 2457T
aacaguaauaaugcccauc

SEQ ID NO: 3866146 - RNA, 18 nt, Shigella flexneri 2a str. 2457T
aacaguacacagacgaag

SEQ ID NO: 3866147 - RNA, 11 nt, Shigella flexneri 2a str. 2457T
aacaguacauu

SEQ ID NO: 3866148 - RNA, 21 nt, Shigella flexneri 2a str. 2457T
aacaguagacaauuuuucaua

SEQ ID NO: 3866149 - RNA, 19 nt, Shigella flexneri 2a str. 2457T
aacaguagccucgccgagc

SEQ ID NO: 3866150 - RNA, 23 nt, Shigella flexneri 2a str. 2457T
aacagucgcccgaccaucgccag

SEQ ID NO: 3866151 - RNA, 22 nt, Shigella flexneri 2a str. 2457T
aacagucgcucggcgacacguu

SEQ ID NO: 3866152 - RNA, 16 nt, Shigella flexneri 2a str. 2457T
aacagugaaacacaug

SEQ ID NO: 3866153 - RNA, 18 nt, Shigella flexneri 2a str. 2457T
aacagugauuucuucauu

SEQ ID NO: 3866154 - RNA, 14 nt, Shigella flexneri 2a str. 2457T
aacagugcaccgga

SEQ ID NO: 3866155 - RNA, 12 nt, Shigella flexneri 2a str. 2457T
aacaguuaccuu

SEQ ID NO: 3866156 - RNA, 22 nt, Shigella flexneri 2a str. 2457T
aacaguucaacgccgcuaucag

SEQ ID NO: 3866157 - RNA, 23 nt, Shigella flexneri 2a str. 2457T
aacaguuccgcaaagcccaucac

SEQ ID NO: 3866158 - RNA, 17 nt, Shigella flexneri 2a str. 2457T
aacaguucuggaagaga

SEQ ID NO: 3866159 - RNA, 12 nt, Shigella flexneri 2a str. 2457T
aacaguuucugc

SEQ ID NO: 3866160 - RNA, 12 nt, Shigella flexneri 2a str. 2457T
aacaguuuucaa

SEQ ID NO: 3866161 - RNA, 15 nt, Shigella flexneri 2a str. 2457T
aacauaauauaaauu

SEQ ID NO: 3866162 - RNA, 17 nt, Shigella flexneri 2a str. 2457T
aacauaaucaauaaaaa

SEQ ID NO: 3866163 - RNA, 17 nt, Shigella flexneri 2a str. 2457T
aacauacccaguuucau

SEQ ID NO: 3866164 - RNA, 20 nt, Shigella flexneri 2a str. 2457T
aacauaccuaaaagcacgcc

SEQ ID NO: 3866165 - RNA, 15 nt, Shigella flexneri 2a str. 2457T
aacauaucagcgcaa

SEQ ID NO: 3866166 - RNA, 19 nt, Shigella flexneri 2a str. 2457T
aacaucaaaaagcugucgu

SEQ ID NO: 3866167 - RNA, 14 nt, Shigella flexneri 2a str. 2457T
aacaucaaauuaca

SEQ ID NO: 3866168 - RNA, 12 nt, Shigella flexneri 2a str. 2457T
aacaucacaugc

SEQ ID NO: 3866169 - RNA, 12 nt, Shigella flexneri 2a str. 2457T
aacaucagauaa

SEQ ID NO: 3866170 - RNA, 20 nt, Shigella flexneri 2a str. 2457T
aacaucauaauaauugcggc

SEQ ID NO: 3866171 - RNA, 13 nt, Shigella flexneri 2a str. 2457T
aacaucaucuccc

SEQ ID NO: 3866172 - RNA, 13 nt, Shigella flexneri 2a str. 2457T
aacauccagauca

SEQ ID NO: 3866173 - RNA, 15 nt, Shigella flexneri 2a str. 2457T
aacauccagaucacg

SEQ ID NO: 3866174 - RNA, 16 nt, Shigella flexneri 2a str. 2457T
aacauccaucgccagc

SEQ ID NO: 3866175 - RNA, 18 nt, Shigella flexneri 2a str. 2457T
aacaucccuguaaaacgc

SEQ ID NO: 3866176 - RNA, 21 nt, Shigella flexneri 2a str. 2457T
aacaucgccugccgcaggacg

SEQ ID NO: 3866177 - RNA, 20 nt, Shigella flexneri 2a str. 2457T
aacaucggcuuauucauauc

SEQ ID NO: 3866178 - RNA, 13 nt, Shigella flexneri 2a str. 2457T
aacaugaaaauaa

SEQ ID NO: 3866179 - RNA, 16 nt, Shigella flexneri 2a str. 2457T
aacaugagcgaauaaa

SEQ ID NO: 3866180 - RNA, 19 nt, Shigella flexneri 2a str. 2457T
aacaugagcgaauaaaaaa

SEQ ID NO: 3866181 - RNA, 13 nt, Shigella flexneri 2a str. 2457T
aacaugccacugg

SEQ ID NO: 3866182 - RNA, 17 nt, Shigella flexneri 2a str. 2457T
aacaugcggugauuuug

SEQ ID NO: 3866183 - RNA, 19 nt, Shigella flexneri 2a str. 2457T
aacaugcggugauuuugcc

SEQ ID NO: 3866184 - RNA, 23 nt, Shigella flexneri 2a str. 2457T
aacauggugggcggguggaguau

SEQ ID NO: 3866185 - RNA, 14 nt, Shigella flexneri 2a str. 2457T
aacauuacuuuccg

SEQ ID NO: 3866186 - RNA, 19 nt, Shigella flexneri 2a str. 2457T
aacauucccaucaguagca

SEQ ID NO: 3866187 - RNA, 19 nt, Shigella flexneri 2a str. 2457T
aacauucgccgcugugauu

SEQ ID NO: 3866188 - RNA, 21 nt, Shigella flexneri 2a str. 2457T
aacauucgccgcugugauuuc

SEQ ID NO: 3866189 - RNA, 21 nt, Shigella flexneri 2a str. 2457T
aacauugcccggucaggaugg

SEQ ID NO: 3866190 - RNA, 19 nt, Shigella flexneri 2a str. 2457T
aacauugcugcugaagcaa

SEQ ID NO: 3866191 - RNA, 16 nt, Shigella flexneri 2a str. 2457T
aaccaaaaauuuccac

SEQ ID NO: 3866192 - RNA, 14 nt, Shigella flexneri 2a str. 2457T
aaccaaacagucac

SEQ ID NO: 3866193 - RNA, 14 nt, Shigella flexneri 2a str. 2457T
aaccaaauaaaaua

SEQ ID NO: 3866194 - RNA, 19 nt, Shigella flexneri 2a str. 2457T
aaccaacaauugcccccca

SEQ ID NO: 3866195 - RNA, 21 nt, Shigella flexneri 2a str. 2457T
aaccaacaccuguuccagugg

SEQ ID NO: 3866196 - RNA, 20 nt, Shigella flexneri 2a str. 2457T
aaccaacggcgagccagcgc

SEQ ID NO: 3866197 - RNA, 13 nt, Shigella flexneri 2a str. 2457T
aaccaaugccacc

SEQ ID NO: 3866198 - RNA, 22 nt, Shigella flexneri 2a str. 2457T
aaccaauuaugaauaaccucuu

SEQ ID NO: 3866199 - RNA, 17 nt, Shigella flexneri 2a str. 2457T
aaccacaaaacacucuu

SEQ ID NO: 3866200 - RNA, 20 nt, Shigella flexneri 2a str. 2457T
aaccggauaucgaacaaaaa

SEQ ID NO: 3866201 - RNA, 15 nt, Shigella flexneri 2a str. 2457T
aaccggaucgccaau

SEQ ID NO: 3866202 - RNA, 18 nt, Shigella flexneri 2a str. 2457T
aaccggauuuucaccauc

SEQ ID NO: 3866203 - RNA, 13 nt, Shigella flexneri 2a str. 2457T
aaccggcaagcaa

SEQ ID NO: 3866204 - RNA, 15 nt, Shigella flexneri 2a str. 2457T
aaccgggaagaucca

SEQ ID NO: 3866205 - RNA, 17 nt, Shigella flexneri 2a str. 2457T
aaccgggucgauaaaca

SEQ ID NO: 3866206 - RNA, 16 nt, Shigella flexneri 2a str. 2457T
aaccgggugcagagcc

SEQ ID NO: 3866207 - RNA, 14 nt, Shigella flexneri 2a str. 2457T
aaccgguaaagaag

SEQ ID NO: 3866208 - RNA, 15 nt, Shigella flexneri 2a str. 2457T
aaccgguaaagaaga

SEQ ID NO: 3866209 - RNA, 14 nt, Shigella flexneri 2a str. 2457T
aaccgguaccggac

SEQ ID NO: 3866210 - RNA, 14 nt, Shigella flexneri 2a str. 2457T
aaccguacagcaug

SEQ ID NO: 3866211 - RNA, 14 nt, Shigella flexneri 2a str. 2457T
aaccguacgcauca

SEQ ID NO: 3866212 - RNA, 16 nt, Shigella flexneri 2a str. 2457T
aaccguacgcaucacc

SEQ ID NO: 3866213 - RNA, 23 nt, Shigella flexneri 2a str. 2457T
aaccguaguccauacccagcauc

SEQ ID NO: 3866214 - RNA, 22 nt, Shigella flexneri 2a str. 2457T
aaccguaguggccacagauaau

SEQ ID NO: 3866215 - RNA, 15 nt, Shigella flexneri 2a str. 2457T
aaccgucgagauaca

SEQ ID NO: 3866216 - RNA, 19 nt, Shigella flexneri 2a str. 2457T
aaccgugcgggcaucaucu

SEQ ID NO: 3866217 - RNA, 21 nt, Shigella flexneri 2a str. 2457T
aaccguugaggauggcgucga

SEQ ID NO: 3866218 - RNA, 15 nt, Shigella flexneri 2a str. 2457T
aaccuaaaaagaaaa

SEQ ID NO: 3866219 - RNA, 19 nt, Shigella flexneri 2a str. 2457T
aaccuacgugcgcaauaac

SEQ ID NO: 3866220 - RNA, 14 nt, Shigella flexneri 2a str. 2457T
aaccuacuuuuuaa

SEQ ID NO: 3866221 - RNA, 21 nt, Shigella flexneri 2a str. 2457T
aaccucacagaggucuuuucu

SEQ ID NO: 3866222 - RNA, 21 nt, Shigella flexneri 2a str. 2457T
aaccucagaguuaaccugaaa

SEQ ID NO: 3866223 - RNA, 18 nt, Shigella flexneri 2a str. 2457T
aaccuccucggcaaaaca

SEQ ID NO: 3866224 - RNA, 21 nt, Shigella flexneri 2a str. 2457T
aaccucgcccauuuuucauga

SEQ ID NO: 3866225 - RNA, 14 nt, Shigella flexneri 2a str. 2457T
aaccucgcccgcag

SEQ ID NO: 3866226 - RNA, 16 nt, Shigella flexneri 2a str. 2457T
aaccucuuccagcaga

SEQ ID NO: 3866227 - RNA, 17 nt, Shigella flexneri 2a str. 2457T
aaccugacucgguucaa

SEQ ID NO: 3866228 - RNA, 17 nt, Shigella flexneri 2a str. 2457T
aaccugauuacgcaccg

SEQ ID NO: 3866229 - RNA, 16 nt, Shigella flexneri 2a str. 2457T
aaccugcacgaaacca

SEQ ID NO: 3866230 - RNA, 18 nt, Shigella flexneri 2a str. 2457T
aaccugcuccucaguuuc

SEQ ID NO: 3866231 - RNA, 23 nt, Shigella flexneri 2a str. 2457T
aaccugugcgccaggauaagcgc

SEQ ID NO: 3866232 - RNA, 22 nt, Shigella flexneri 2a str. 2457T
aaccuucuucauuaugaauagc

SEQ ID NO: 3866233 - RNA, 15 nt, Shigella flexneri 2a str. 2457T
aaccuugccauucca

SEQ ID NO: 3866234 - RNA, 18 nt, Shigella flexneri 2a str. 2457T
aaccuuggucgaagcuuc

SEQ ID NO: 3866235 - RNA, 10 nt, Shigella flexneri 2a str. 2457T
aaccuuuaau

SEQ ID NO: 3866236 - RNA, 16 nt, Shigella flexneri 2a str. 2457T
aaccuuuaaucaggcu

SEQ ID NO: 3866237 - RNA, 17 nt, Shigella flexneri 2a str. 2457T
aacgaaaagcgcacaac

SEQ ID NO: 3866238 - RNA, 21 nt, Shigella flexneri 2a str. 2457T
aacgaaagucccgauaaccgc

SEQ ID NO: 3866239 - RNA, 21 nt, Shigella flexneri 2a str. 2457T
aacgaaccauaaaaucacagg

SEQ ID NO: 3866240 - RNA, 12 nt, Shigella flexneri 2a str. 2457T
aacgaagaaaac

SEQ ID NO: 3866241 - RNA, 17 nt, Shigella flexneri 2a str. 2457T
aacgaaguaauaaucaa

SEQ ID NO: 3866242 - RNA, 15 nt, Shigella flexneri 2a str. 2457T
aacgaauaguuucag

SEQ ID NO: 3866243 - RNA, 13 nt, Shigella flexneri 2a str. 2457T
aacgaaucugcaa

SEQ ID NO: 3866244 - RNA, 21 nt, Shigella flexneri 2a str. 2457T
aacgacaccguuaaauaacug

SEQ ID NO: 3866245 - RNA, 17 nt, Shigella flexneri 2a str. 2457T
aacgacauuuucugccc

SEQ ID NO: 3866246 - RNA, 14 nt, Shigella flexneri 2a str. 2457T
aacgaccagaaaug

SEQ ID NO: 3866247 - RNA, 13 nt, Shigella flexneri 2a str. 2457T
aacgaccaucagc

SEQ ID NO: 3866248 - RNA, 21 nt, Shigella flexneri 2a str. 2457T
aacgaccaucagcugccaggg

SEQ ID NO: 3866249 - RNA, 21 nt, Shigella flexneri 2a str. 2457T
aacgacgacugccgcucaccu

SEQ ID NO: 3866250 - RNA, 15 nt, Shigella flexneri 2a str. 2457T
aacgacgcagaacug

SEQ ID NO: 3866251 - RNA, 19 nt, Shigella flexneri 2a str. 2457T
aacgagaaaaugacgauga

SEQ ID NO: 3866252 - RNA, 14 nt, Shigella flexneri 2a str. 2457T
aacgauaauucagc

SEQ ID NO: 3866253 - RNA, 22 nt, Shigella flexneri 2a str. 2457T
aacgaucgccugguaccagcac

SEQ ID NO: 3866254 - RNA, 12 nt, Shigella flexneri 2a str. 2457T
aacgaugacauc

SEQ ID NO: 3866255 - RNA, 15 nt, Shigella flexneri 2a str. 2457T
aacgaugaucgcuau

SEQ ID NO: 3866256 - RNA, 16 nt, Shigella flexneri 2a str. 2457T
aacgaugcaugacagc

SEQ ID NO: 3866257 - RNA, 20 nt, Shigella flexneri 2a str. 2457T
aacgaugucgcccacuuuca

SEQ ID NO: 3866258 - RNA, 21 nt, Shigella flexneri 2a str. 2457T
aacgauucaaaagaugagaaa

SEQ ID NO: 3866259 - RNA, 21 nt, Shigella flexneri 2a str. 2457T
aacgauuuuagcaaacugauc

SEQ ID NO: 3866260 - RNA, 20 nt, Shigella flexneri 2a str. 2457T
aacgauuuuuuuaauaauau

SEQ ID NO: 3866261 - RNA, 12 nt, Shigella flexneri 2a str. 2457T
aacgcaaaauuc

SEQ ID NO: 3866262 - RNA, 20 nt, Shigella flexneri 2a str. 2457T
aacgcaaacaccagcgaaug

SEQ ID NO: 3866263 - RNA, 17 nt, Shigella flexneri 2a str. 2457T
aacgcaaacuguuucag

SEQ ID NO: 3866264 - RNA, 20 nt, Shigella flexneri 2a str. 2457T
aacgcaaagagagaagccag

SEQ ID NO: 3866265 - RNA, 21 nt, Shigella flexneri 2a str. 2457T
aacgcaaagagagaagccaga

SEQ ID NO: 3866266 - RNA, 23 nt, Shigella flexneri 2a str. 2457T
aacgcaaagagagaagccagaua

SEQ ID NO: 3866267 - RNA, 15 nt, Shigella flexneri 2a str. 2457T
aacgcaacaucgcaa

SEQ ID NO: 3866268 - RNA, 21 nt, Shigella flexneri 2a str. 2457T
aacgcaaucaaauaccaccag

SEQ ID NO: 3866269 - RNA, 16 nt, Shigella flexneri 2a str. 2457T
aacgcacacauccaca

SEQ ID NO: 3866270 - RNA, 13 nt, Shigella flexneri 2a str. 2457T
aacgcaccaggcg

SEQ ID NO: 3866271 - RNA, 21 nt, Shigella flexneri 2a str. 2457T
aacgcaccaggcgaaaacgcu

SEQ ID NO: 3866272 - RNA, 18 nt, Shigella flexneri 2a str. 2457T
aacgcaccgaccaucggc

SEQ ID NO: 3866273 - RNA, 13 nt, Shigella flexneri 2a str. 2457T
aacgcaccugaaa

SEQ ID NO: 3866274 - RNA, 20 nt, Shigella flexneri 2a str. 2457T
aacgcagcaucaugccgcuc

SEQ ID NO: 3866275 - RNA, 21 nt, Shigella flexneri 2a str. 2457T
aacgcaguaagcgccagggca

SEQ ID NO: 3866276 - RNA, 15 nt, Shigella flexneri 2a str. 2457T
aacgcagucuuccca

SEQ ID NO: 3866277 - RNA, 18 nt, Shigella flexneri 2a str. 2457T
aacgcauaccccaucagc

SEQ ID NO: 3866278 - RNA, 21 nt, Shigella flexneri 2a str. 2457T
aacgcaucaggcaacccagaa

SEQ ID NO: 3866279 - RNA, 23 nt, Shigella flexneri 2a str. 2457T
aacgcauuuaucuucaaggcaga

SEQ ID NO: 3866280 - RNA, 14 nt, Shigella flexneri 2a str. 2457T
aacgccacauccgg

SEQ ID NO: 3866281 - RNA, 23 nt, Shigella flexneri 2a str. 2457T
aacgccaccauuuuacguccgcg

SEQ ID NO: 3866282 - RNA, 14 nt, Shigella flexneri 2a str. 2457T
aacgccacgcucac

SEQ ID NO: 3866283 - RNA, 14 nt, Shigella flexneri 2a str. 2457T
aacgccagaucacc

SEQ ID NO: 3866284 - RNA, 15 nt, Shigella flexneri 2a str. 2457T
aacgccagcagcagc

SEQ ID NO: 3866285 - RNA, 14 nt, Shigella flexneri 2a str. 2457T
aacgccauccggca

SEQ ID NO: 3866286 - RNA, 14 nt, Shigella flexneri 2a str. 2457T
aacgccaucgccag

SEQ ID NO: 3866287 - RNA, 15 nt, Shigella flexneri 2a str. 2457T
aacgcccguccauca

SEQ ID NO: 3866288 - RNA, 13 nt, Shigella flexneri 2a str. 2457T
aacgcccuuaccu

SEQ ID NO: 3866289 - RNA, 16 nt, Shigella flexneri 2a str. 2457T
aacgccgccagaccac

SEQ ID NO: 3866290 - RNA, 22 nt, Shigella flexneri 2a str. 2457T
aacgccgcuauacgccucacag

SEQ ID NO: 3866291 - RNA, 15 nt, Shigella flexneri 2a str. 2457T
aacgccggagagaaa

SEQ ID NO: 3866292 - RNA, 16 nt, Shigella flexneri 2a str. 2457T
aacgccggagugaaaa

SEQ ID NO: 3866293 - RNA, 24 nt, Shigella flexneri 2a str. 2457T
aacgccggugaccaucagcaugac

SEQ ID NO: 3866294 - RNA, 21 nt, Shigella flexneri 2a str. 2457T
aacgccugauagcccgcacaa

SEQ ID NO: 3866295 - RNA, 19 nt, Shigella flexneri 2a str. 2457T
aacgccugcuuaucgcccu

SEQ ID NO: 3866296 - RNA, 23 nt, Shigella flexneri 2a str. 2457T
aacgccugcuuaucgcccugcuc

SEQ ID NO: 3866297 - RNA, 13 nt, Shigella flexneri 2a str. 2457T
aacguuccagcaa

SEQ ID NO: 3866298 - RNA, 17 nt, Shigella flexneri 2a str. 2457T
aacguugaauuucaggu

SEQ ID NO: 3866299 - RNA, 18 nt, Shigella flexneri 2a str. 2457T
aacguugaauuucagguu

SEQ ID NO: 3866300 - RNA, 21 nt, Shigella flexneri 2a str. 2457T
aacguugccugauuuuauuuc

SEQ ID NO: 3866301 - RNA, 22 nt, Shigella flexneri 2a str. 2457T
aacguugcugcgccgagcaaua

SEQ ID NO: 3866302 - RNA, 22 nt, Shigella flexneri 2a str. 2457T
aacguugggaucaguaaacgcu

SEQ ID NO: 3866303 - RNA, 15 nt, Shigella flexneri 2a str. 2457T
aacguuuaaaaacuu

SEQ ID NO: 3866304 - RNA, 22 nt, Shigella flexneri 2a str. 2457T
aacguuucuuucaucaggucaa

SEQ ID NO: 3866305 - RNA, 13 nt, Shigella flexneri 2a str. 2457T
aacuaaaaacagc

SEQ ID NO: 3866306 - RNA, 22 nt, Shigella flexneri 2a str. 2457T
aacuaaaaacagcaucaauaau

SEQ ID NO: 3866307 - RNA, 16 nt, Shigella flexneri 2a str. 2457T
aacuaacugacuuccg

SEQ ID NO: 3866308 - RNA, 12 nt, Shigella flexneri 2a str. 2457T
aacuacaaauua

SEQ ID NO: 3866309 - RNA, 21 nt, Shigella flexneri 2a str. 2457T
aacuaucaggcaaaaaaaugc

SEQ ID NO: 3866310 - RNA, 15 nt, Shigella flexneri 2a str. 2457T
aacuaucccagccua

SEQ ID NO: 3866311 - RNA, 21 nt, Shigella flexneri 2a str. 2457T
aacuaucccagccuauaacga

SEQ ID NO: 3866312 - RNA, 18 nt, Shigella flexneri 2a str. 2457T
aacuaucgacgcaaacgc

SEQ ID NO: 3866313 - RNA, 19 nt, Shigella flexneri 2a str. 2457T
aacuauggucggucaggag

SEQ ID NO: 3866314 - RNA, 16 nt, Shigella flexneri 2a str. 2457T
aacucaaaaauaauca

SEQ ID NO: 3866315 - RNA, 19 nt, Shigella flexneri 2a str. 2457T
aacucaaaaauaaucaucu

SEQ ID NO: 3866316 - RNA, 20 nt, Shigella flexneri 2a str. 2457T
aacucaaaaauaaucaucuc

SEQ ID NO: 3866317 - RNA, 16 nt, Shigella flexneri 2a str. 2457T
aacucaauaccugaug

SEQ ID NO: 3866318 - RNA, 13 nt, Shigella flexneri 2a str. 2457T
aacucaccaucaa

SEQ ID NO: 3866319 - RNA, 22 nt, Shigella flexneri 2a str. 2457T
aacucaccgaugaucgccauca

SEQ ID NO: 3866320 - RNA, 14 nt, Shigella flexneri 2a str. 2457T
aacucaccuuuaaa

SEQ ID NO: 3866321 - RNA, 16 nt, Shigella flexneri 2a str. 2457T
aacucaccuuuuuugu

SEQ ID NO: 3866322 - RNA, 19 nt, Shigella flexneri 2a str. 2457T
aacucacgauuguuaauca

SEQ ID NO: 3866323 - RNA, 12 nt, Shigella flexneri 2a str. 2457T
aacucacgcagg

SEQ ID NO: 3866324 - RNA, 18 nt, Shigella flexneri 2a str. 2457T
aacucagcauuauuuuua

SEQ ID NO: 3866325 - RNA, 20 nt, Shigella flexneri 2a str. 2457T
aacucagcauuauuuuuaaa

SEQ ID NO: 3866326 - RNA, 14 nt, Shigella flexneri 2a str. 2457T
aacucaguaacguu

SEQ ID NO: 3866327 - RNA, 15 nt, Shigella flexneri 2a str. 2457T
aacucauaaauucaa

SEQ ID NO: 3866328 - RNA, 18 nt, Shigella flexneri 2a str. 2457T
aacucauacaccagcggc

SEQ ID NO: 3866329 - RNA, 20 nt, Shigella flexneri 2a str. 2457T
aacucauacaccagcggcac

SEQ ID NO: 3866330 - RNA, 18 nt, Shigella flexneri 2a str. 2457T
aacucaucaccaucaggc

SEQ ID NO: 3866331 - RNA, 19 nt, Shigella flexneri 2a str. 2457T
aacucaucaccaucaggca

SEQ ID NO: 3866332 - RNA, 11 nt, Shigella flexneri 2a str. 2457T
aacucaucacu

SEQ ID NO: 3866333 - RNA, 14 nt, Shigella flexneri 2a str. 2457T
aacucaucgccgcu

SEQ ID NO: 3866334 - RNA, 20 nt, Shigella flexneri 2a str. 2457T
aacucauugccaguccuaaa

SEQ ID NO: 3866335 - RNA, 20 nt, Shigella flexneri 2a str. 2457T
aacucauuuuuuaauaugcu

SEQ ID NO: 3866336 - RNA, 13 nt, Shigella flexneri 2a str. 2457T
aacuccagaauac

SEQ ID NO: 3866337 - RNA, 20 nt, Shigella flexneri 2a str. 2457T
aacuccagaauaccgccaau

SEQ ID NO: 3866338 - RNA, 15 nt, Shigella flexneri 2a str. 2457T
aacuccaucuuuaac

SEQ ID NO: 3866339 - RNA, 16 nt, Shigella flexneri 2a str. 2457T
aacuccccgagaaaua

SEQ ID NO: 3866340 - RNA, 22 nt, Shigella flexneri 2a str. 2457T
aacuccgccagcaacugauaaa

SEQ ID NO: 3866341 - RNA, 21 nt, Shigella flexneri 2a str. 2457T
aacuccugaaagcgaaccaua

SEQ ID NO: 3866342 - RNA, 11 nt, Shigella flexneri 2a str. 2457T
aacuccuggag

SEQ ID NO: 3866343 - RNA, 17 nt, Shigella flexneri 2a str. 2457T
aacucgcugccagcacu

SEQ ID NO: 3866344 - RNA, 16 nt, Shigella flexneri 2a str. 2457T
aacucgcuuaagccau

SEQ ID NO: 3866345 - RNA, 21 nt, Shigella flexneri 2a str. 2457T
aacucgcuuaagccaucauca

SEQ ID NO: 3866346 - RNA, 22 nt, Shigella flexneri 2a str. 2457T
aacucucaucuuugaaaucacg

SEQ ID NO: 3866347 - RNA, 15 nt, Shigella flexneri 2a str. 2457T
aacucugcggcauca

SEQ ID NO: 3866348 - RNA, 14 nt, Shigella flexneri 2a str. 2457T
aacucuuccuuaac

SEQ ID NO: 3866349 - RNA, 19 nt, Shigella flexneri 2a str. 2457T
aacucuuuuuccugcugca

SEQ ID NO: 3866350 - RNA, 14 nt, Shigella flexneri 2a str. 2457T
aacugaacaaaaaa

SEQ ID NO: 3866351 - RNA, 15 nt, Shigella flexneri 2a str. 2457T
aacugaacaaaaaag

SEQ ID NO: 3866352 - RNA, 23 nt, Shigella flexneri 2a str. 2457T
aacugaagauugaacagcagaac

SEQ ID NO: 3866353 - RNA, 16 nt, Shigella flexneri 2a str. 2457T
aacugacagagaacau

SEQ ID NO: 3866354 - RNA, 17 nt, Shigella flexneri 2a str. 2457T
aacugacugaaugccac

SEQ ID NO: 3866355 - RNA, 18 nt, Shigella flexneri 2a str. 2457T
aacugacugacuucaaca

SEQ ID NO: 3866356 - RNA, 14 nt, Shigella flexneri 2a str. 2457T
aacugacuggcucu

SEQ ID NO: 3866357 - RNA, 18 nt, Shigella flexneri 2a str. 2457T
aacugacuuccacuuccu

SEQ ID NO: 3866358 - RNA, 22 nt, Shigella flexneri 2a str. 2457T
aacugacuuucguuugaaaacu

SEQ ID NO: 3866359 - RNA, 18 nt, Shigella flexneri 2a str. 2457T
aacugagcgccgucgcga

SEQ ID NO: 3866360 - RNA, 20 nt, Shigella flexneri 2a str. 2457T
aacugaguggaguccagcgc

SEQ ID NO: 3866361 - RNA, 22 nt, Shigella flexneri 2a str. 2457T
aacugauaaaccuucaucguuu

SEQ ID NO: 3866362 - RNA, 19 nt, Shigella flexneri 2a str. 2457T
aacugccaguaaagcagcg

SEQ ID NO: 3866363 - RNA, 17 nt, Shigella flexneri 2a str. 2457T
aacugccaguucccccu

SEQ ID NO: 3866364 - RNA, 18 nt, Shigella flexneri 2a str. 2457T
aacugccaguucccccug

SEQ ID NO: 3866365 - RNA, 22 nt, Shigella flexneri 2a str. 2457T
aacugccaugaccgcuccgcca

SEQ ID NO: 3866366 - RNA, 14 nt, Shigella flexneri 2a str. 2457T
aacugcccgaucaa

SEQ ID NO: 3866367 - RNA, 16 nt, Shigella flexneri 2a str. 2457T
aacugccgcgccugaa

SEQ ID NO: 3866368 - RNA, 20 nt, Shigella flexneri 2a str. 2457T
aacugccgcgccugaaucug

SEQ ID NO: 3866369 - RNA, 15 nt, Shigella flexneri 2a str. 2457T
aacugccggaaggcg

SEQ ID NO: 3866370 - RNA, 20 nt, Shigella flexneri 2a str. 2457T
aacugccucgggauccaugc

SEQ ID NO: 3866371 - RNA, 12 nt, Shigella flexneri 2a str. 2457T
aacugccugaug

SEQ ID NO: 3866372 - RNA, 13 nt, Shigella flexneri 2a str. 2457T
aacugcgccucaa

SEQ ID NO: 3866373 - RNA, 21 nt, Shigella flexneri 2a str. 2457T
aacugcggucuaaaucuuccg

SEQ ID NO: 3866374 - RNA, 20 nt, Shigella flexneri 2a str. 2457T
aacugcgucgacauagccau

SEQ ID NO: 3866375 - RNA, 16 nt, Shigella flexneri 2a str. 2457T
aacugcucaaaggcga

SEQ ID NO: 3866376 - RNA, 18 nt, Shigella flexneri 2a str. 2457T
aacugcucguucagcggc

SEQ ID NO: 3866377 - RNA, 14 nt, Shigella flexneri 2a str. 2457T
aacugcugacgcag

SEQ ID NO: 3866378 - RNA, 23 nt, Shigella flexneri 2a str. 2457T
aacugcuggcuuaaaaaacggau

SEQ ID NO: 3866379 - RNA, 16 nt, Shigella flexneri 2a str. 2457T
aacugcuuaucaucac

SEQ ID NO: 3866380 - RNA, 14 nt, Shigella flexneri 2a str. 2457T
aacuggaaaaauaa

SEQ ID NO: 3866381 - RNA, 22 nt, Shigella flexneri 2a str. 2457T
aacuggaagauuuaccgaaaua

SEQ ID NO: 3866382 - RNA, 17 nt, Shigella flexneri 2a str. 2457T
aacuggaagcugccucg

SEQ ID NO: 3866383 - RNA, 14 nt, Shigella flexneri 2a str. 2457T
aacuggcaaaaacc

SEQ ID NO: 3866384 - RNA, 11 nt, Shigella flexneri 2a str. 2457T
aacuggcaaca

SEQ ID NO: 3866385 - RNA, 13 nt, Shigella flexneri 2a str. 2457T
aacuggcaggaaa

SEQ ID NO: 3866386 - RNA, 20 nt, Shigella flexneri 2a str. 2457T
aacuggcggucaugacgaua

SEQ ID NO: 3866387 - RNA, 13 nt, Shigella flexneri 2a str. 2457T
aacuggucugcau

SEQ ID NO: 3866388 - RNA, 18 nt, Shigella flexneri 2a str. 2457T
aacuggucugcaugacgg

SEQ ID NO: 3866389 - RNA, 20 nt, Shigella flexneri 2a str. 2457T
aacugguggauuauauggaa

SEQ ID NO: 3866390 - RNA, 15 nt, Shigella flexneri 2a str. 2457T
aacuguaaaucgcca

SEQ ID NO: 3866391 - RNA, 16 nt, Shigella flexneri 2a str. 2457T
aacuguaaaucgccau

SEQ ID NO: 3866392 - RNA, 21 nt, Shigella flexneri 2a str. 2457T
aacuguaacgcagaagguuau

SEQ ID NO: 3866393 - RNA, 23 nt, Shigella flexneri 2a str. 2457T
aacuguacaggcuccuguagcug

SEQ ID NO: 3866394 - RNA, 23 nt, Shigella flexneri 2a str. 2457T
aagaccugggcgaugcuggcaga

SEQ ID NO: 3866395 - RNA, 13 nt, Shigella flexneri 2a str. 2457T
aagacgcagcaug

SEQ ID NO: 3866396 - RNA, 17 nt, Shigella flexneri 2a str. 2457T
aagacgccauucacugg

SEQ ID NO: 3866397 - RNA, 14 nt, Shigella flexneri 2a str. 2457T
aagacgccguccau

SEQ ID NO: 3866398 - RNA, 21 nt, Shigella flexneri 2a str. 2457T
aagacgcgacaagcgucgcau

SEQ ID NO: 3866399 - RNA, 21 nt, Shigella flexneri 2a str. 2457T
aagacgcgaccggcgucgcau

SEQ ID NO: 3866400 - RNA, 14 nt, Shigella flexneri 2a str. 2457T
aagacgcgccagcg

SEQ ID NO: 3866401 - RNA, 16 nt, Shigella flexneri 2a str. 2457T
aagacgcguaaagcgu

SEQ ID NO: 3866402 - RNA, 21 nt, Shigella flexneri 2a str. 2457T
aagacgcgucaagcgucgcau

SEQ ID NO: 3866403 - RNA, 20 nt, Shigella flexneri 2a str. 2457T
aagacgcgucagcgucgcau

SEQ ID NO: 3866404 - RNA, 20 nt, Shigella flexneri 2a str. 2457T
aagacgcguuagcaucgcau

SEQ ID NO: 3866405 - RNA, 23 nt, Shigella flexneri 2a str. 2457T
aagacguugauucacuuucugaa

SEQ ID NO: 3866406 - RNA, 17 nt, Shigella flexneri 2a str. 2457T
aagacguuuugugagaa

SEQ ID NO: 3866407 - RNA, 22 nt, Shigella flexneri 2a str. 2457T
aagacucuuacucuuucaauuu

SEQ ID NO: 3866408 - RNA, 16 nt, Shigella flexneri 2a str. 2457T
aagacuguagcaggau

SEQ ID NO: 3866409 - RNA, 16 nt, Shigella flexneri 2a str. 2457T
aagagaaccagcugcc

SEQ ID NO: 3866410 - RNA, 20 nt, Shigella flexneri 2a str. 2457T
aagagacagaaucaggccau

SEQ ID NO: 3866411 - RNA, 20 nt, Shigella flexneri 2a str. 2457T
aagagacgcuggaagcccug

SEQ ID NO: 3866412 - RNA, 13 nt, Shigella flexneri 2a str. 2457T
aagagagaagcca

SEQ ID NO: 3866413 - RNA, 19 nt, Shigella flexneri 2a str. 2457T
aagagauggaaugagcauc

SEQ ID NO: 3866414 - RNA, 14 nt, Shigella flexneri 2a str. 2457T
aagagauggaucaa

SEQ ID NO: 3866415 - RNA, 17 nt, Shigella flexneri 2a str. 2457T
aagagauuguauuuaaa

SEQ ID NO: 3866416 - RNA, 19 nt, Shigella flexneri 2a str. 2457T
aagagcaaauaaaacauca

SEQ ID NO: 3866417 - RNA, 15 nt, Shigella flexneri 2a str. 2457T
aagagcgacaauccc

SEQ ID NO: 3866418 - RNA, 19 nt, Shigella flexneri 2a str. 2457T
aagagcgauccguucagau

SEQ ID NO: 3866419 - RNA, 21 nt, Shigella flexneri 2a str. 2457T
aagagcuggcaucagcaaaca

SEQ ID NO: 3866420 - RNA, 13 nt, Shigella flexneri 2a str. 2457T
aagaggaacaaau

SEQ ID NO: 3866421 - RNA, 13 nt, Shigella flexneri 2a str. 2457T
aagaggcgcagau

SEQ ID NO: 3866422 - RNA, 21 nt, Shigella flexneri 2a str. 2457T
aagaguaaauugcaaaccuca

SEQ ID NO: 3866423 - RNA, 21 nt, Shigella flexneri 2a str. 2457T
aagagugacuucgccgugaaa

SEQ ID NO: 3866424 - RNA, 22 nt, Shigella flexneri 2a str. 2457T
aagagugugaauauucagaaua

SEQ ID NO: 3866425 - RNA, 21 nt, Shigella flexneri 2a str. 2457T
aagaguucaaagccgaagcug

SEQ ID NO: 3866426 - RNA, 17 nt, Shigella flexneri 2a str. 2457T
aagaguuuuaaacgcag

SEQ ID NO: 3866427 - RNA, 15 nt, Shigella flexneri 2a str. 2457T
aagauaauccaggac

SEQ ID NO: 3866428 - RNA, 16 nt, Shigella flexneri 2a str. 2457T
aagauagcgucauuuc

SEQ ID NO: 3866429 - RNA, 21 nt, Shigella flexneri 2a str. 2457T
aagauauuggggguaauuccc

SEQ ID NO: 3866430 - RNA, 19 nt, Shigella flexneri 2a str. 2457T
aagauauuucaccagcgca

SEQ ID NO: 3866431 - RNA, 18 nt, Shigella flexneri 2a str. 2457T
aagauauuuuuaugcaug

SEQ ID NO: 3866432 - RNA, 16 nt, Shigella flexneri 2a str. 2457T
aagaucaucaaacuuu

SEQ ID NO: 3866433 - RNA, 17 nt, Shigella flexneri 2a str. 2457T
aagauccguaaugccug

SEQ ID NO: 3866434 - RNA, 21 nt, Shigella flexneri 2a str. 2457T
aagaucgcccugagggacguu

SEQ ID NO: 3866435 - RNA, 21 nt, Shigella flexneri 2a str. 2457T
aagaucgcccuuuuuuacuuu

SEQ ID NO: 3866436 - RNA, 12 nt, Shigella flexneri 2a str. 2457T
aagaucuuugcg

SEQ ID NO: 3866437 - RNA, 19 nt, Shigella flexneri 2a str. 2457T
aagaucuuugcgcuuauac

SEQ ID NO: 3866438 - RNA, 17 nt, Shigella flexneri 2a str. 2457T
aagaugaaacuuauuca

SEQ ID NO: 3866439 - RNA, 19 nt, Shigella flexneri 2a str. 2457T
aagaugaaauaguugcauu

SEQ ID NO: 3866440 - RNA, 17 nt, Shigella flexneri 2a str. 2457T
aagaugaauaauguuua

SEQ ID NO: 3866441 - RNA, 16 nt, Shigella flexneri 2a str. 2457T
aagaugaugucacagc

SEQ ID NO: 3866442 - RNA, 19 nt, Shigella flexneri 2a str. 2457T
aagaugcaucauuaaugug

SEQ ID NO: 3866443 - RNA, 15 nt, Shigella flexneri 2a str. 2457T
aagaugcauuuauau

SEQ ID NO: 3866444 - RNA, 22 nt, Shigella flexneri 2a str. 2457T
aagaugcggaauuugaugagaa

SEQ ID NO: 3866445 - RNA, 12 nt, Shigella flexneri 2a str. 2457T
aagaugcuacaa

SEQ ID NO: 3866446 - RNA, 16 nt, Shigella flexneri 2a str. 2457T
aagaugcuacaacauc

SEQ ID NO: 3866447 - RNA, 19 nt, Shigella flexneri 2a str. 2457T
aagauguucuaucuuucag

SEQ ID NO: 3866448 - RNA, 21 nt, Shigella flexneri 2a str. 2457T
aagauguucuaucuuucagac

SEQ ID NO: 3866449 - RNA, 14 nt, Shigella flexneri 2a str. 2457T
aagauguugccaca

SEQ ID NO: 3866450 - RNA, 22 nt, Shigella flexneri 2a str. 2457T
aagauuaagagaaccagcugcc

SEQ ID NO: 3866451 - RNA, 13 nt, Shigella flexneri 2a str. 2457T
aagauuacugaca

SEQ ID NO: 3866452 - RNA, 20 nt, Shigella flexneri 2a str. 2457T
aagauucaguucaacggugu

SEQ ID NO: 3866453 - RNA, 16 nt, Shigella flexneri 2a str. 2457T
aagauucguauuuaaa

SEQ ID NO: 3866454 - RNA, 14 nt, Shigella flexneri 2a str. 2457T
aagauugccugaug

SEQ ID NO: 3866455 - RNA, 18 nt, Shigella flexneri 2a str. 2457T
aagauuguuggcaaaaaa

SEQ ID NO: 3866456 - RNA, 22 nt, Shigella flexneri 2a str. 2457T
aagauuuugcugugcuuuacac

SEQ ID NO: 3866457 - RNA, 13 nt, Shigella flexneri 2a str. 2457T
aagcaaaaaaaca

SEQ ID NO: 3866458 - RNA, 14 nt, Shigella flexneri 2a str. 2457T
aagcaaaaaaacau

SEQ ID NO: 3866459 - RNA, 17 nt, Shigella flexneri 2a str. 2457T
aagcaaaaacgcauacg

SEQ ID NO: 3866460 - RNA, 14 nt, Shigella flexneri 2a str. 2457T
aagcaaaaauaaau

SEQ ID NO: 3866461 - RNA, 15 nt, Shigella flexneri 2a str. 2457T
aagcaacaaaguuug

SEQ ID NO: 3866462 - RNA, 18 nt, Shigella flexneri 2a str. 2457T
aagcaacgcgcaccguga

SEQ ID NO: 3866463 - RNA, 14 nt, Shigella flexneri 2a str. 2457T
aagcaagaacagcc

SEQ ID NO: 3866464 - RNA, 19 nt, Shigella flexneri 2a str. 2457T
aagcaagcgucgccagcgc

SEQ ID NO: 3866465 - RNA, 22 nt, Shigella flexneri 2a str. 2457T
aagcacaugcugacauuuugga

SEQ ID NO: 3866466 - RNA, 13 nt, Shigella flexneri 2a str. 2457T
aagcaccacuccu

SEQ ID NO: 3866467 - RNA, 15 nt, Shigella flexneri 2a str. 2457T
aagcaccacuccuca

SEQ ID NO: 3866468 - RNA, 19 nt, Shigella flexneri 2a str. 2457T
aagcacucguaagaggcgu

SEQ ID NO: 3866469 - RNA, 13 nt, Shigella flexneri 2a str. 2457T
aagcagacaaccc

SEQ ID NO: 3866470 - RNA, 18 nt, Shigella flexneri 2a str. 2457T
aagcagaucggcauucac

SEQ ID NO: 3866471 - RNA, 16 nt, Shigella flexneri 2a str. 2457T
aagcagauucuucgau

SEQ ID NO: 3866472 - RNA, 23 nt, Shigella flexneri 2a str. 2457T
aagcagcaaauagccgagcgcgu

SEQ ID NO: 3866473 - RNA, 15 nt, Shigella flexneri 2a str. 2457T
aagcagcgaugcuuu

SEQ ID NO: 3866474 - RNA, 15 nt, Shigella flexneri 2a str. 2457T
aagcaggcuucacgc

SEQ ID NO: 3866475 - RNA, 17 nt, Shigella flexneri 2a str. 2457T
aagcaggucggcucagc

SEQ ID NO: 3866476 - RNA, 23 nt, Shigella flexneri 2a str. 2457T
aagcaggucggcucagccgauga

SEQ ID NO: 3866477 - RNA, 15 nt, Shigella flexneri 2a str. 2457T
aagcaggugccuuac

SEQ ID NO: 3866478 - RNA, 21 nt, Shigella flexneri 2a str. 2457T
aagcaguccagcgccugacgc

SEQ ID NO: 3866479 - RNA, 15 nt, Shigella flexneri 2a str. 2457T
aagcaguuucaccag

SEQ ID NO: 3866480 - RNA, 19 nt, Shigella flexneri 2a str. 2457T
aagcaguuucaccagcagu

SEQ ID NO: 3866481 - RNA, 16 nt, Shigella flexneri 2a str. 2457T
aagcauaauaagcuuu

SEQ ID NO: 3866482 - RNA, 14 nt, Shigella flexneri 2a str. 2457T
aagcaucaauugcu

SEQ ID NO: 3866483 - RNA, 13 nt, Shigella flexneri 2a str. 2457T
aagcaugauauuc

SEQ ID NO: 3866484 - RNA, 12 nt, Shigella flexneri 2a str. 2457T
aagcaugaugcg

SEQ ID NO: 3866485 - RNA, 16 nt, Shigella flexneri 2a str. 2457T
aagcauuagcaaagcu

SEQ ID NO: 3866486 - RNA, 16 nt, Shigella flexneri 2a str. 2457T
aagcauugcgccugca

SEQ ID NO: 3866487 - RNA, 14 nt, Shigella flexneri 2a str. 2457T
aagcauuuuuucac

SEQ ID NO: 3866488 - RNA, 20 nt, Shigella flexneri 2a str. 2457T
aagcauuuuuucacauguuc

SEQ ID NO: 3866489 - RNA, 15 nt, Shigella flexneri 2a str. 2457T
aagccaacagcagcc

SEQ ID NO: 3866490 - RNA, 18 nt, Shigella flexneri 2a str. 2457T
aagccaacagcagccaca

SEQ ID NO: 3866491 - RNA, 18 nt, Shigella flexneri 2a str. 2457T
aaggccagcaauccccag

SEQ ID NO: 3866492 - RNA, 22 nt, Shigella flexneri 2a str. 2457T
aaggccagcaggucaaagcagg

SEQ ID NO: 3866493 - RNA, 15 nt, Shigella flexneri 2a str. 2457T
aaggccagccaggca

SEQ ID NO: 3866494 - RNA, 15 nt, Shigella flexneri 2a str. 2457T
aaggcccuuccccuu

SEQ ID NO: 3866495 - RNA, 16 nt, Shigella flexneri 2a str. 2457T
aaggccgacagcaggc

SEQ ID NO: 3866496 - RNA, 22 nt, Shigella flexneri 2a str. 2457T
aaggccgcgaaccggaccagca

SEQ ID NO: 3866497 - RNA, 21 nt, Shigella flexneri 2a str. 2457T
aaggccggagaagaugcguca

SEQ ID NO: 3866498 - RNA, 21 nt, Shigella flexneri 2a str. 2457T
aaggccuuaguagaagaggaa

SEQ ID NO: 3866499 - RNA, 20 nt, Shigella flexneri 2a str. 2457T
aaggcgaaaccuccgcaaug

SEQ ID NO: 3866500 - RNA, 14 nt, Shigella flexneri 2a str. 2457T
aaggcgaaacgccu

SEQ ID NO: 3866501 - RNA, 16 nt, Shigella flexneri 2a str. 2457T
aaggcgaaaggcuggc

SEQ ID NO: 3866502 - RNA, 23 nt, Shigella flexneri 2a str. 2457T
aaggcgcauugcuggcugcggga

SEQ ID NO: 3866503 - RNA, 16 nt, Shigella flexneri 2a str. 2457T
aaggcgcgguuucugc

SEQ ID NO: 3866504 - RNA, 22 nt, Shigella flexneri 2a str. 2457T
aaggcgcucauuuucucuuuca

SEQ ID NO: 3866505 - RNA, 18 nt, Shigella flexneri 2a str. 2457T
aaggcggcagaacagaac

SEQ ID NO: 3866506 - RNA, 16 nt, Shigella flexneri 2a str. 2457T
aaggcgggaauaauuu

SEQ ID NO: 3866507 - RNA, 18 nt, Shigella flexneri 2a str. 2457T
aaggcguacacgccgcau

SEQ ID NO: 3866508 - RNA, 18 nt, Shigella flexneri 2a str. 2457T
aaggcguuauacugcggc

SEQ ID NO: 3866509 - RNA, 17 nt, Shigella flexneri 2a str. 2457T
aaggcguucacgccaca

SEQ ID NO: 3866510 - RNA, 20 nt, Shigella flexneri 2a str. 2457T
aaggcguucacgccacaucc

SEQ ID NO: 3866511 - RNA, 18 nt, Shigella flexneri 2a str. 2457T
aaggcguucacgccgcau

SEQ ID NO: 3866512 - RNA, 19 nt, Shigella flexneri 2a str. 2457T
aaggcguucacgccgcauc

SEQ ID NO: 3866513 - RNA, 20 nt, Shigella flexneri 2a str. 2457T
aaggcguucgcgccgcaucc

SEQ ID NO: 3866514 - RNA, 23 nt, Shigella flexneri 2a str. 2457T
aaggcguuggugauaaaacgcag

SEQ ID NO: 3866515 - RNA, 18 nt, Shigella flexneri 2a str. 2457T
aaggcguuuacgccgcau

SEQ ID NO: 3866516 - RNA, 17 nt, Shigella flexneri 2a str. 2457T
aaggcguuuucgccaca

SEQ ID NO: 3866517 - RNA, 19 nt, Shigella flexneri 2a str. 2457T
aaggcuguuguagaccgga

SEQ ID NO: 3866518 - RNA, 18 nt, Shigella flexneri 2a str. 2457T
aaggcuucguaaguggcg

SEQ ID NO: 3866519 - RNA, 17 nt, Shigella flexneri 2a str. 2457T
aaggcuuucgugaagcu

SEQ ID NO: 3866520 - RNA, 15 nt, Shigella flexneri 2a str. 2457T
aagggacaaaccaca

SEQ ID NO: 3866521 - RNA, 23 nt, Shigella flexneri 2a str. 2457T
aagggagagggauucucuuuguu

SEQ ID NO: 3866522 - RNA, 13 nt, Shigella flexneri 2a str. 2457T
aagggcaaaguca

SEQ ID NO: 3866523 - RNA, 23 nt, Shigella flexneri 2a str. 2457T
aagggccgcaguggauaauacac

SEQ ID NO: 3866524 - RNA, 17 nt, Shigella flexneri 2a str. 2457T
aaggggacguaaagaag

SEQ ID NO: 3866525 - RNA, 14 nt, Shigella flexneri 2a str. 2457T
aagggguuguaauc

SEQ ID NO: 3866526 - RNA, 18 nt, Shigella flexneri 2a str. 2457T
aagggguuuuccaguuca

SEQ ID NO: 3866527 - RNA, 22 nt, Shigella flexneri 2a str. 2457T
aagggugucuguuaaucgcauu

SEQ ID NO: 3866528 - RNA, 20 nt, Shigella flexneri 2a str. 2457T
aagguagaauaaggcuuucg

SEQ ID NO: 3866529 - RNA, 21 nt, Shigella flexneri 2a str. 2457T
aagguaucgcgaaaaaaagau

SEQ ID NO: 3866530 - RNA, 16 nt, Shigella flexneri 2a str. 2457T
aaggucaccaguucac

SEQ ID NO: 3866531 - RNA, 13 nt, Shigella flexneri 2a str. 2457T
aaggucagacgaa

SEQ ID NO: 3866532 - RNA, 18 nt, Shigella flexneri 2a str. 2457T
aaggucauccaaaucgcc

SEQ ID NO: 3866533 - RNA, 17 nt, Shigella flexneri 2a str. 2457T
aaggucggcuuugaaua

SEQ ID NO: 3866534 - RNA, 18 nt, Shigella flexneri 2a str. 2457T
aaggucggcuuugaauau

SEQ ID NO: 3866535 - RNA, 17 nt, Shigella flexneri 2a str. 2457T
aaggugccggaauauau

SEQ ID NO: 3866536 - RNA, 19 nt, Shigella flexneri 2a str. 2457T
aaggugccggaauauauuc

SEQ ID NO: 3866537 - RNA, 21 nt, Shigella flexneri 2a str. 2457T
aagguggcgucaaaaagcuca

SEQ ID NO: 3866538 - RNA, 22 nt, Shigella flexneri 2a str. 2457T
aagguggucagacggaacaucu

SEQ ID NO: 3866539 - RNA, 14 nt, Shigella flexneri 2a str. 2457T
aagguguuugacug

SEQ ID NO: 3866540 - RNA, 16 nt, Shigella flexneri 2a str. 2457T
aagguuaaaccgccag

SEQ ID NO: 3866541 - RNA, 18 nt, Shigella flexneri 2a str. 2457T
aagguuaauaaauauuaa

SEQ ID NO: 3866542 - RNA, 16 nt, Shigella flexneri 2a str. 2457T
aagguuacccgcacgg

SEQ ID NO: 3866543 - RNA, 17 nt, Shigella flexneri 2a str. 2457T
aagguucuuugcugccg

SEQ ID NO: 3866544 - RNA, 19 nt, Shigella flexneri 2a str. 2457T
aagguugccauaucuuccc

SEQ ID NO: 3866545 - RNA, 14 nt, Shigella flexneri 2a str. 2457T
aagguuguugaaag

SEQ ID NO: 3866546 - RNA, 18 nt, Shigella flexneri 2a str. 2457T
aagguuugaaaaaaccug

SEQ ID NO: 3866547 - RNA, 19 nt, Shigella flexneri 2a str. 2457T
aaguaaaaaagaaggaaaa

SEQ ID NO: 3866548 - RNA, 16 nt, Shigella flexneri 2a str. 2457T
aaguaaaccaccaguc

SEQ ID NO: 3866549 - RNA, 19 nt, Shigella flexneri 2a str. 2457T
aaguaagaauugauaaaaa

SEQ ID NO: 3866550 - RNA, 19 nt, Shigella flexneri 2a str. 2457T
aaguaaggcgggaauaauu

SEQ ID NO: 3866551 - RNA, 15 nt, Shigella flexneri 2a str. 2457T
aaguaauaaugauca

SEQ ID NO: 3866552 - RNA, 23 nt, Shigella flexneri 2a str. 2457T
aaguaauagaacuauaauugcuu

SEQ ID NO: 3866553 - RNA, 13 nt, Shigella flexneri 2a str. 2457T
aaguaaucuauau

SEQ ID NO: 3866554 - RNA, 23 nt, Shigella flexneri 2a str. 2457T
aaguaaugcggcaagggcgaauc

SEQ ID NO: 3866555 - RNA, 20 nt, Shigella flexneri 2a str. 2457T
aaguacacauaaacagguaa

SEQ ID NO: 3866556 - RNA, 13 nt, Shigella flexneri 2a str. 2457T
aaguacauuaaaa

SEQ ID NO: 3866557 - RNA, 19 nt, Shigella flexneri 2a str. 2457T
aaguaccaucguccagcag

SEQ ID NO: 3866558 - RNA, 20 nt, Shigella flexneri 2a str. 2457T
aaguaccaucguccagcagc

SEQ ID NO: 3866559 - RNA, 21 nt, Shigella flexneri 2a str. 2457T
aaguaccaucguccagcagca

SEQ ID NO: 3866560 - RNA, 14 nt, Shigella flexneri 2a str. 2457T
aaguacuccugcuc

SEQ ID NO: 3866561 - RNA, 19 nt, Shigella flexneri 2a str. 2457T
aaguacucuuugaacagcc

SEQ ID NO: 3866562 - RNA, 21 nt, Shigella flexneri 2a str. 2457T
aaguacucuuugaacagccag

SEQ ID NO: 3866563 - RNA, 19 nt, Shigella flexneri 2a str. 2457T
aaguacuucacaaucagcg

SEQ ID NO: 3866564 - RNA, 13 nt, Shigella flexneri 2a str. 2457T
aaguagaaauuau

SEQ ID NO: 3866565 - RNA, 21 nt, Shigella flexneri 2a str. 2457T
aaguagagugguuuuucaaca

SEQ ID NO: 3866566 - RNA, 17 nt, Shigella flexneri 2a str. 2457T
aaguagccuucaucaga

SEQ ID NO: 3866567 - RNA, 16 nt, Shigella flexneri 2a str. 2457T
aaguagugauuuuaau

SEQ ID NO: 3866568 - RNA, 19 nt, Shigella flexneri 2a str. 2457T
aaguagugauuuuaauaaa

SEQ ID NO: 3866569 - RNA, 17 nt, Shigella flexneri 2a str. 2457T
aaguaguuccagcauga

SEQ ID NO: 3866570 - RNA, 18 nt, Shigella flexneri 2a str. 2457T
aaguaguuccagcaugau

SEQ ID NO: 3866571 - RNA, 16 nt, Shigella flexneri 2a str. 2457T
aaguauauaaaaaaca

SEQ ID NO: 3866572 - RNA, 17 nt, Shigella flexneri 2a str. 2457T
aaguauauaaaaaacaa

SEQ ID NO: 3866573 - RNA, 18 nt, Shigella flexneri 2a str. 2457T
aaguauauaaaaaacaau

SEQ ID NO: 3866574 - RNA, 19 nt, Shigella flexneri 2a str. 2457T
aaguauccacacagacaau

SEQ ID NO: 3866575 - RNA, 13 nt, Shigella flexneri 2a str. 2457T
aagucaaacuggu

SEQ ID NO: 3866576 - RNA, 19 nt, Shigella flexneri 2a str. 2457T
aagucacgccaauaaucga

SEQ ID NO: 3866577 - RNA, 17 nt, Shigella flexneri 2a str. 2457T
aagucaggguauuaacc

SEQ ID NO: 3866578 - RNA, 14 nt, Shigella flexneri 2a str. 2457T
aagucauuccuuca

SEQ ID NO: 3866579 - RNA, 12 nt, Shigella flexneri 2a str. 2457T
aaguccaaaagg

SEQ ID NO: 3866580 - RNA, 15 nt, Shigella flexneri 2a str. 2457T
aaguccaccgcgaug

SEQ ID NO: 3866581 - RNA, 16 nt, Shigella flexneri 2a str. 2457T
aagucggcaucgccac

SEQ ID NO: 3866582 - RNA, 15 nt, Shigella flexneri 2a str. 2457T
aagucguaggccuga

SEQ ID NO: 3866583 - RNA, 17 nt, Shigella flexneri 2a str. 2457T
aagucguaggccugaua

SEQ ID NO: 3866584 - RNA, 20 nt, Shigella flexneri 2a str. 2457T
aagucguaggccugauaaga

SEQ ID NO: 3866585 - RNA, 15 nt, Shigella flexneri 2a str. 2457T
aagucguucagaucu

SEQ ID NO: 3866586 - RNA, 22 nt, Shigella flexneri 2a str. 2457T
aagucguucagaucuuucacga

SEQ ID NO: 3866587 - RNA, 18 nt, Shigella flexneri 2a str. 2457T
aagucucaagagugaaca

SEQ ID NO: 3866588 - RNA, 15 nt, Shigella flexneri 2a str. 2457T
aauauccaacagguu

SEQ ID NO: 3866589 - RNA, 21 nt, Shigella flexneri 2a str. 2457T
aauauccguagugaaaaagcu

SEQ ID NO: 3866590 - RNA, 22 nt, Shigella flexneri 2a str. 2457T
aauauccuguggacgcagcuca

SEQ ID NO: 3866591 - RNA, 22 nt, Shigella flexneri 2a str. 2457T
aauaucguugauuguugcgcga

SEQ ID NO: 3866592 - RNA, 18 nt, Shigella flexneri 2a str. 2457T
aauaucuauccaguaucu

SEQ ID NO: 3866593 - RNA, 13 nt, Shigella flexneri 2a str. 2457T
aauaucuccagcu

SEQ ID NO: 3866594 - RNA, 13 nt, Shigella flexneri 2a str. 2457T
aauaucuccucug

SEQ ID NO: 3866595 - RNA, 21 nt, Shigella flexneri 2a str. 2457T
aauaucugccggaagacacau

SEQ ID NO: 3866596 - RNA, 11 nt, Shigella flexneri 2a str. 2457T
aauaucuuccu

SEQ ID NO: 3866597 - RNA, 16 nt, Shigella flexneri 2a str. 2457T
aauaucuuccuggcgc

SEQ ID NO: 3866598 - RNA, 19 nt, Shigella flexneri 2a str. 2457T
aauaugaacaugaaaaaac

SEQ ID NO: 3866599 - RNA, 21 nt, Shigella flexneri 2a str. 2457T
aauaugaauuaacgucaggug

SEQ ID NO: 3866600 - RNA, 15 nt, Shigella flexneri 2a str. 2457T
aauaugauaaaccuc

SEQ ID NO: 3866601 - RNA, 22 nt, Shigella flexneri 2a str. 2457T
aauaugcccauguucgcggcuu

SEQ ID NO: 3866602 - RNA, 19 nt, Shigella flexneri 2a str. 2457T
aauaugcugguuccugacu

SEQ ID NO: 3866603 - RNA, 23 nt, Shigella flexneri 2a str. 2457T
aauauggaacggaugcagcauca

SEQ ID NO: 3866604 - RNA, 20 nt, Shigella flexneri 2a str. 2457T
aauauggugaaaguaaaaaa

SEQ ID NO: 3866605 - RNA, 22 nt, Shigella flexneri 2a str. 2457T
aauauguaagaucgaaggcugu

SEQ ID NO: 3866606 - RNA, 16 nt, Shigella flexneri 2a str. 2457T
aauaugucguuauaua

SEQ ID NO: 3866607 - RNA, 17 nt, Shigella flexneri 2a str. 2457T
aauauuaacuuaauaaa

SEQ ID NO: 3866608 - RNA, 19 nt, Shigella flexneri 2a str. 2457T
aauauuaacuuaauaaaca

SEQ ID NO: 3866609 - RNA, 15 nt, Shigella flexneri 2a str. 2457T
aauauuagaucgagu

SEQ ID NO: 3866610 - RNA, 18 nt, Shigella flexneri 2a str. 2457T
aauauuauggcugucaug

SEQ ID NO: 3866611 - RNA, 18 nt, Shigella flexneri 2a str. 2457T
aauauuccuuaugguuca

SEQ ID NO: 3866612 - RNA, 20 nt, Shigella flexneri 2a str. 2457T
aauauucugaagcaaacuug

SEQ ID NO: 3866613 - RNA, 21 nt, Shigella flexneri 2a str. 2457T
aauauugaauugcucaguaca

SEQ ID NO: 3866614 - RNA, 15 nt, Shigella flexneri 2a str. 2457T
aauauugauuauugg

SEQ ID NO: 3866615 - RNA, 22 nt, Shigella flexneri 2a str. 2457T
aauauugccggaugugaugcau

SEQ ID NO: 3866616 - RNA, 10 nt, Shigella flexneri 2a str. 2457T
aauauuuaau

SEQ ID NO: 3866617 - RNA, 21 nt, Shigella flexneri 2a str. 2457T
aauauuucucggcaaauucau

SEQ ID NO: 3866618 - RNA, 17 nt, Shigella flexneri 2a str. 2457T
aauauuuucugaaaauc

SEQ ID NO: 3866619 - RNA, 19 nt, Shigella flexneri 2a str. 2457T
aauauuuucugaaaaucau

SEQ ID NO: 3866620 - RNA, 17 nt, Shigella flexneri 2a str. 2457T
aauauuuuucgucaguu

SEQ ID NO: 3866621 - RNA, 12 nt, Shigella flexneri 2a str. 2457T
aaucaaaaaacu

SEQ ID NO: 3866622 - RNA, 20 nt, Shigella flexneri 2a str. 2457T
aaucaaaaaacuggaaaaau

SEQ ID NO: 3866623 - RNA, 21 nt, Shigella flexneri 2a str. 2457T
aaucaaaaaacuggaaaaaua

SEQ ID NO: 3866624 - RNA, 20 nt, Shigella flexneri 2a str. 2457T
aaucaaaaaaggcugacaaa

SEQ ID NO: 3866625 - RNA, 23 nt, Shigella flexneri 2a str. 2457T
aaucaaaaaaggcugacaaauca

SEQ ID NO: 3866626 - RNA, 12 nt, Shigella flexneri 2a str. 2457T
aaucaaaaaugg

SEQ ID NO: 3866627 - RNA, 17 nt, Shigella flexneri 2a str. 2457T
aaucaaaccaagcagca

SEQ ID NO: 3866628 - RNA, 22 nt, Shigella flexneri 2a str. 2457T
aaucaaagaugaugucacagcc

SEQ ID NO: 3866629 - RNA, 22 nt, Shigella flexneri 2a str. 2457T
aaucaaauaccaccagcgaaag

SEQ ID NO: 3866630 - RNA, 12 nt, Shigella flexneri 2a str. 2457T
aaucaaaugacu

SEQ ID NO: 3866631 - RNA, 15 nt, Shigella flexneri 2a str. 2457T
aaucaacaaacgcug

SEQ ID NO: 3866632 - RNA, 23 nt, Shigella flexneri 2a str. 2457T
aaucaacaauugcgggccaaaga

SEQ ID NO: 3866633 - RNA, 19 nt, Shigella flexneri 2a str. 2457T
aaucaacaccaaacccgga

SEQ ID NO: 3866634 - RNA, 16 nt, Shigella flexneri 2a str. 2457T
aaucaacauauucccc

SEQ ID NO: 3866635 - RNA, 16 nt, Shigella flexneri 2a str. 2457T
aaucaacaugaaaaua

SEQ ID NO: 3866636 - RNA, 22 nt, Shigella flexneri 2a str. 2457T
aaucaacaugaaaauaaccaua

SEQ ID NO: 3866637 - RNA, 21 nt, Shigella flexneri 2a str. 2457T
aaucaaccagcacuucgccau

SEQ ID NO: 3866638 - RNA, 15 nt, Shigella flexneri 2a str. 2457T
aaucaacgccgcaug

SEQ ID NO: 3866639 - RNA, 17 nt, Shigella flexneri 2a str. 2457T
aaucaacgcgauauaau

SEQ ID NO: 3866640 - RNA, 22 nt, Shigella flexneri 2a str. 2457T
aaucaagcgccgaguaaaaaaa

SEQ ID NO: 3866641 - RNA, 14 nt, Shigella flexneri 2a str. 2457T
aaucaauaaaaaua

SEQ ID NO: 3866642 - RNA, 19 nt, Shigella flexneri 2a str. 2457T
aaucaauaauuaaucuggu

SEQ ID NO: 3866643 - RNA, 12 nt, Shigella flexneri 2a str. 2457T
aaucaaucccau

SEQ ID NO: 3866644 - RNA, 13 nt, Shigella flexneri 2a str. 2457T
aaucaaucccauc

SEQ ID NO: 3866645 - RNA, 13 nt, Shigella flexneri 2a str. 2457T
aaucaaucgcccc

SEQ ID NO: 3866646 - RNA, 18 nt, Shigella flexneri 2a str. 2457T
aaucaaucuuuacacaca

SEQ ID NO: 3866647 - RNA, 17 nt, Shigella flexneri 2a str. 2457T
aaucaaugcccaucacu

SEQ ID NO: 3866648 - RNA, 21 nt, Shigella flexneri 2a str. 2457T
aaucaauggucccgacaaccu

SEQ ID NO: 3866649 - RNA, 21 nt, Shigella flexneri 2a str. 2457T
aaucacaauagaaauauugau

SEQ ID NO: 3866650 - RNA, 18 nt, Shigella flexneri 2a str. 2457T
aaucacaauggucaacau

SEQ ID NO: 3866651 - RNA, 16 nt, Shigella flexneri 2a str. 2457T
aaucacacaaccaugc

SEQ ID NO: 3866652 - RNA, 17 nt, Shigella flexneri 2a str. 2457T
aaucacacaaccaugca

SEQ ID NO: 3866653 - RNA, 14 nt, Shigella flexneri 2a str. 2457T
aaucacaucaccau

SEQ ID NO: 3866654 - RNA, 17 nt, Shigella flexneri 2a str. 2457T
aaucacaucaccauaaa

SEQ ID NO: 3866655 - RNA, 20 nt, Shigella flexneri 2a str. 2457T
aaucacaucaucaucgccag

SEQ ID NO: 3866656 - RNA, 19 nt, Shigella flexneri 2a str. 2457T
aaucaccacccauuuuaau

SEQ ID NO: 3866657 - RNA, 19 nt, Shigella flexneri 2a str. 2457T
aaucaccagaugucccauc

SEQ ID NO: 3866658 - RNA, 20 nt, Shigella flexneri 2a str. 2457T
aaucaccauauucagcagca

SEQ ID NO: 3866659 - RNA, 22 nt, Shigella flexneri 2a str. 2457T
aaucaccauauucagcagcaga

SEQ ID NO: 3866660 - RNA, 21 nt, Shigella flexneri 2a str. 2457T
aaucaccaucagcagcaacaa

SEQ ID NO: 3866661 - RNA, 23 nt, Shigella flexneri 2a str. 2457T
aaucaccaugccgugaugcgcaa

SEQ ID NO: 3866662 - RNA, 20 nt, Shigella flexneri 2a str. 2457T
aaucacccccaccccggccc

SEQ ID NO: 3866663 - RNA, 14 nt, Shigella flexneri 2a str. 2457T
aaucaccgccacca

SEQ ID NO: 3866664 - RNA, 16 nt, Shigella flexneri 2a str. 2457T
aaucaccguuucuggu

SEQ ID NO: 3866665 - RNA, 22 nt, Shigella flexneri 2a str. 2457T
aaucaccucaucaccacagaca

SEQ ID NO: 3866666 - RNA, 16 nt, Shigella flexneri 2a str. 2457T
aaucaccucuuuuucc

SEQ ID NO: 3866667 - RNA, 19 nt, Shigella flexneri 2a str. 2457T
aaucacgacaaacacaaua

SEQ ID NO: 3866668 - RNA, 19 nt, Shigella flexneri 2a str. 2457T
aaucacgauugcugccgau

SEQ ID NO: 3866669 - RNA, 23 nt, Shigella flexneri 2a str. 2457T
aaucacgcuucacccuugaugca

SEQ ID NO: 3866670 - RNA, 22 nt, Shigella flexneri 2a str. 2457T
aaucacuauuaaagaaaguaau

SEQ ID NO: 3866671 - RNA, 15 nt, Shigella flexneri 2a str. 2457T
aaucacucaaaauau

SEQ ID NO: 3866672 - RNA, 23 nt, Shigella flexneri 2a str. 2457T
aaucacucuuccccgcuucagcc

SEQ ID NO: 3866673 - RNA, 13 nt, Shigella flexneri 2a str. 2457T
aaucacuucuucu

SEQ ID NO: 3866674 - RNA, 19 nt, Shigella flexneri 2a str. 2457T
aaucacuugcgcauaauaa

SEQ ID NO: 3866675 - RNA, 13 nt, Shigella flexneri 2a str. 2457T
aaucagaaaggcg

SEQ ID NO: 3866676 - RNA, 15 nt, Shigella flexneri 2a str. 2457T
aaucagaauuuuucg

SEQ ID NO: 3866677 - RNA, 12 nt, Shigella flexneri 2a str. 2457T
aaucagauaaaa

SEQ ID NO: 3866678 - RNA, 14 nt, Shigella flexneri 2a str. 2457T
aaucagauaaaaua

SEQ ID NO: 3866679 - RNA, 22 nt, Shigella flexneri 2a str. 2457T
aaucagaucguugaccugaaua

SEQ ID NO: 3866680 - RNA, 17 nt, Shigella flexneri 2a str. 2457T
aaucagauugccacagg

SEQ ID NO: 3866681 - RNA, 11 nt, Shigella flexneri 2a str. 2457T
aaucagcacac

SEQ ID NO: 3866682 - RNA, 13 nt, Shigella flexneri 2a str. 2457T
aaucagcagaacc

SEQ ID NO: 3866683 - RNA, 20 nt, Shigella flexneri 2a str. 2457T
aaucagcagauaucccgcca

SEQ ID NO: 3866684 - RNA, 20 nt, Shigella flexneri 2a str. 2457T
aaucagccagaacagcggug

SEQ ID NO: 3866685 - RNA, 21 nt, Shigella flexneri 2a str. 2457T
aaucgucgguguccacuuccg

SEQ ID NO: 3866686 - RNA, 13 nt, Shigella flexneri 2a str. 2457T
aaucgugaaaaau

SEQ ID NO: 3866687 - RNA, 23 nt, Shigella flexneri 2a str. 2457T
aaucguucugugccgucugcccc

SEQ ID NO: 3866688 - RNA, 18 nt, Shigella flexneri 2a str. 2457T
aaucuaaccuacuuuuua

SEQ ID NO: 3866689 - RNA, 22 nt, Shigella flexneri 2a str. 2457T
aaucuacaaaagauuauugcuu

SEQ ID NO: 3866690 - RNA, 22 nt, Shigella flexneri 2a str. 2457T
aaucuacgguggaacauuuacc

SEQ ID NO: 3866691 - RNA, 14 nt, Shigella flexneri 2a str. 2457T
aaucuauucauuua

SEQ ID NO: 3866692 - RNA, 15 nt, Shigella flexneri 2a str. 2457T
aaucuauugcaacau

SEQ ID NO: 3866693 - RNA, 17 nt, Shigella flexneri 2a str. 2457T
aaucucaauguauuccc

SEQ ID NO: 3866694 - RNA, 15 nt, Shigella flexneri 2a str. 2457T
aaucucaauuuucac

SEQ ID NO: 3866695 - RNA, 20 nt, Shigella flexneri 2a str. 2457T
aaucucacuccggccagagc

SEQ ID NO: 3866696 - RNA, 16 nt, Shigella flexneri 2a str. 2457T
aaucucagcccgauga

SEQ ID NO: 3866697 - RNA, 20 nt, Shigella flexneri 2a str. 2457T
aaucucagcccgaugauaaa

SEQ ID NO: 3866698 - RNA, 23 nt, Shigella flexneri 2a str. 2457T
aaucucccguuccugguuuucca

SEQ ID NO: 3866699 - RNA, 19 nt, Shigella flexneri 2a str. 2457T
aaucuccugccaauacaaa

SEQ ID NO: 3866700 - RNA, 13 nt, Shigella flexneri 2a str. 2457T
aaucuccugcgca

SEQ ID NO: 3866701 - RNA, 19 nt, Shigella flexneri 2a str. 2457T
aaucucgccguggauggga

SEQ ID NO: 3866702 - RNA, 15 nt, Shigella flexneri 2a str. 2457T
aaucucgcguuucga

SEQ ID NO: 3866703 - RNA, 21 nt, Shigella flexneri 2a str. 2457T
aaucucgucucccgucaggag

SEQ ID NO: 3866704 - RNA, 16 nt, Shigella flexneri 2a str. 2457T
aaucucuucacagaca

SEQ ID NO: 3866705 - RNA, 21 nt, Shigella flexneri 2a str. 2457T
aaucucuuuuuccaccgcaaa

SEQ ID NO: 3866706 - RNA, 13 nt, Shigella flexneri 2a str. 2457T
aaucugaaaucau

SEQ ID NO: 3866707 - RNA, 16 nt, Shigella flexneri 2a str. 2457T
aaucugaauggcugca

SEQ ID NO: 3866708 - RNA, 14 nt, Shigella flexneri 2a str. 2457T
aaucugauaaucca

SEQ ID NO: 3866709 - RNA, 13 nt, Shigella flexneri 2a str. 2457T
aaucugcaaaaua

SEQ ID NO: 3866710 - RNA, 17 nt, Shigella flexneri 2a str. 2457T
aaucugcaaaauaccaa

SEQ ID NO: 3866711 - RNA, 23 nt, Shigella flexneri 2a str. 2457T
aaucugcaucaccaucuugagaa

SEQ ID NO: 3866712 - RNA, 18 nt, Shigella flexneri 2a str. 2457T
aaucugccagaaggauug

SEQ ID NO: 3866713 - RNA, 20 nt, Shigella flexneri 2a str. 2457T
aaucugccagcguaaauccu

SEQ ID NO: 3866714 - RNA, 19 nt, Shigella flexneri 2a str. 2457T
aaucugcccguuaaccaua

SEQ ID NO: 3866715 - RNA, 13 nt, Shigella flexneri 2a str. 2457T
aaucugcugccug

SEQ ID NO: 3866716 - RNA, 20 nt, Shigella flexneri 2a str. 2457T
aaucuggcagccuaauuccu

SEQ ID NO: 3866717 - RNA, 14 nt, Shigella flexneri 2a str. 2457T
aaucuggccugaga

SEQ ID NO: 3866718 - RNA, 19 nt, Shigella flexneri 2a str. 2457T
aaucugucguaacugcgcc

SEQ ID NO: 3866719 - RNA, 12 nt, Shigella flexneri 2a str. 2457T
aaucugucuuuu

SEQ ID NO: 3866720 - RNA, 17 nt, Shigella flexneri 2a str. 2457T
aaucuguuucaucucuu

SEQ ID NO: 3866721 - RNA, 15 nt, Shigella flexneri 2a str. 2457T
aaucuuauaugauga

SEQ ID NO: 3866722 - RNA, 21 nt, Shigella flexneri 2a str. 2457T
aaucuuauaugaugaaacuga

SEQ ID NO: 3866723 - RNA, 15 nt, Shigella flexneri 2a str. 2457T
aaucuugcaaauuca

SEQ ID NO: 3866724 - RNA, 20 nt, Shigella flexneri 2a str. 2457T
aaucuuguucucagcacauu

SEQ ID NO: 3866725 - RNA, 14 nt, Shigella flexneri 2a str. 2457T
aaucuuuaaaaaaa

SEQ ID NO: 3866726 - RNA, 21 nt, Shigella flexneri 2a str. 2457T
aaucuuuagcauaaaaacucg

SEQ ID NO: 3866727 - RNA, 19 nt, Shigella flexneri 2a str. 2457T
aaucuuugcagcuuugcug

SEQ ID NO: 3866728 - RNA, 14 nt, Shigella flexneri 2a str. 2457T
aaugaaaaaauaga

SEQ ID NO: 3866729 - RNA, 11 nt, Shigella flexneri 2a str. 2457T
aaugaaaaacc

SEQ ID NO: 3866730 - RNA, 14 nt, Shigella flexneri 2a str. 2457T
aaugaaaaucacca

SEQ ID NO: 3866731 - RNA, 13 nt, Shigella flexneri 2a str. 2457T
aaugaaagaggcc

SEQ ID NO: 3866732 - RNA, 23 nt, Shigella flexneri 2a str. 2457T
aaugaaagccccaccagcaaaua

SEQ ID NO: 3866733 - RNA, 18 nt, Shigella flexneri 2a str. 2457T
aaugaacucaacgccuuc

SEQ ID NO: 3866734 - RNA, 11 nt, Shigella flexneri 2a str. 2457T
aaugaagaugc

SEQ ID NO: 3866735 - RNA, 21 nt, Shigella flexneri 2a str. 2457T
aaugaaucaucguucauauau

SEQ ID NO: 3866736 - RNA, 15 nt, Shigella flexneri 2a str. 2457T
aaugacaaaauugcu

SEQ ID NO: 3866737 - RNA, 14 nt, Shigella flexneri 2a str. 2457T
aaugacaacauuuu

SEQ ID NO: 3866738 - RNA, 18 nt, Shigella flexneri 2a str. 2457T
aaugacguuaauaaaauu

SEQ ID NO: 3866739 - RNA, 13 nt, Shigella flexneri 2a str. 2457T
aaugacuccaacu

SEQ ID NO: 3866740 - RNA, 20 nt, Shigella flexneri 2a str. 2457T
aaugacuccaacuuacugau

SEQ ID NO: 3866741 - RNA, 18 nt, Shigella flexneri 2a str. 2457T
aaugacuucgcuuucgcc

SEQ ID NO: 3866742 - RNA, 22 nt, Shigella flexneri 2a str. 2457T
aaugagagggcgauaaaucucc

SEQ ID NO: 3866743 - RNA, 20 nt, Shigella flexneri 2a str. 2457T
aaugagauauuuaaaugauu

SEQ ID NO: 3866744 - RNA, 18 nt, Shigella flexneri 2a str. 2457T
aaugaggcagcaaggaaa

SEQ ID NO: 3866745 - RNA, 23 nt, Shigella flexneri 2a str. 2457T
aaugaggcagcaaggaaaaccag

SEQ ID NO: 3866746 - RNA, 15 nt, Shigella flexneri 2a str. 2457T
aaugagugaugauga

SEQ ID NO: 3866747 - RNA, 18 nt, Shigella flexneri 2a str. 2457T
aaugaguggugaaaaaaa

SEQ ID NO: 3866748 - RNA, 11 nt, Shigella flexneri 2a str. 2457T
aaugauaagcc

SEQ ID NO: 3866749 - RNA, 19 nt, Shigella flexneri 2a str. 2457T
aaugaucagcgguuuugcc

SEQ ID NO: 3866750 - RNA, 20 nt, Shigella flexneri 2a str. 2457T
aaugaucagcgguuuugcca

SEQ ID NO: 3866751 - RNA, 15 nt, Shigella flexneri 2a str. 2457T
aaugaucaguggaag

SEQ ID NO: 3866752 - RNA, 19 nt, Shigella flexneri 2a str. 2457T
aaugaugcccgguugcuuu

SEQ ID NO: 3866753 - RNA, 16 nt, Shigella flexneri 2a str. 2457T
aaugaugccgccagaa

SEQ ID NO: 3866754 - RNA, 21 nt, Shigella flexneri 2a str. 2457T
aaugaugccgccagaaaugga

SEQ ID NO: 3866755 - RNA, 17 nt, Shigella flexneri 2a str. 2457T
aaugauguaaaaauacu

SEQ ID NO: 3866756 - RNA, 17 nt, Shigella flexneri 2a str. 2457T
aaugaugucggcauaaa

SEQ ID NO: 3866757 - RNA, 21 nt, Shigella flexneri 2a str. 2457T
aaugaugucggcauaaagcug

SEQ ID NO: 3866758 - RNA, 22 nt, Shigella flexneri 2a str. 2457T
aaugauugggauuaaagcgcuc

SEQ ID NO: 3866759 - RNA, 23 nt, Shigella flexneri 2a str. 2457T
aaugauuuugauggaagaaacca

SEQ ID NO: 3866760 - RNA, 15 nt, Shigella flexneri 2a str. 2457T
aaugcaaaaugccgu

SEQ ID NO: 3866761 - RNA, 17 nt, Shigella flexneri 2a str. 2457T
aaugcacauauucugga

SEQ ID NO: 3866762 - RNA, 17 nt, Shigella flexneri 2a str. 2457T
aaugcacuuccagcggc

SEQ ID NO: 3866763 - RNA, 16 nt, Shigella flexneri 2a str. 2457T
aaugcagcauugccug

SEQ ID NO: 3866764 - RNA, 15 nt, Shigella flexneri 2a str. 2457T
aaugcagcggguuaa

SEQ ID NO: 3866765 - RNA, 18 nt, Shigella flexneri 2a str. 2457T
aaugcagcguuuccagcc

SEQ ID NO: 3866766 - RNA, 19 nt, Shigella flexneri 2a str. 2457T
aaugcaggcgcgccuggug

SEQ ID NO: 3866767 - RNA, 19 nt, Shigella flexneri 2a str. 2457T
aaugcaggggcguccagau

SEQ ID NO: 3866768 - RNA, 15 nt, Shigella flexneri 2a str. 2457T
aaugcaguuccauau

SEQ ID NO: 3866769 - RNA, 21 nt, Shigella flexneri 2a str. 2457T
aaugcaguuuuuaauuuucgu

SEQ ID NO: 3866770 - RNA, 22 nt, Shigella flexneri 2a str. 2457T
aaugcauccgcuuacucaucca

SEQ ID NO: 3866771 - RNA, 13 nt, Shigella flexneri 2a str. 2457T
aaugcaucggcau

SEQ ID NO: 3866772 - RNA, 21 nt, Shigella flexneri 2a str. 2457T
aaugccaaguaauagaacuau

SEQ ID NO: 3866773 - RNA, 14 nt, Shigella flexneri 2a str. 2457T
aaugccagauaaga

SEQ ID NO: 3866774 - RNA, 21 nt, Shigella flexneri 2a str. 2457T
aaugcccaucacuaucgccau

SEQ ID NO: 3866775 - RNA, 17 nt, Shigella flexneri 2a str. 2457T
aaugcccauggcaagaa

SEQ ID NO: 3866776 - RNA, 22 nt, Shigella flexneri 2a str. 2457T
aaugcccgaugaccuugucaug

SEQ ID NO: 3866777 - RNA, 23 nt, Shigella flexneri 2a str. 2457T
aaugccgauauaaauuccacgcg

SEQ ID NO: 3866778 - RNA, 21 nt, Shigella flexneri 2a str. 2457T
aaugccgcguggccuggaauu

SEQ ID NO: 3866779 - RNA, 18 nt, Shigella flexneri 2a str. 2457T
aaugccgucgaggaacau

SEQ ID NO: 3866780 - RNA, 14 nt, Shigella flexneri 2a str. 2457T
aaugccuaccgcau

SEQ ID NO: 3866781 - RNA, 16 nt, Shigella flexneri 2a str. 2457T
aaugccucagagcuaa

SEQ ID NO: 3866782 - RNA, 17 nt, Shigella flexneri 2a str. 2457T
aauuacggauuacaugg

SEQ ID NO: 3866783 - RNA, 13 nt, Shigella flexneri 2a str. 2457T
aauuacucauacu

SEQ ID NO: 3866784 - RNA, 21 nt, Shigella flexneri 2a str. 2457T
aauuacucccgugccagagca

SEQ ID NO: 3866785 - RNA, 22 nt, Shigella flexneri 2a str. 2457T
aauuacucccgugccagagcau

SEQ ID NO: 3866786 - RNA, 19 nt, Shigella flexneri 2a str. 2457T
aauuacugccuugaugaaa

SEQ ID NO: 3866787 - RNA, 17 nt, Shigella flexneri 2a str. 2457T
aauuacuggcagauuau

SEQ ID NO: 3866788 - RNA, 17 nt, Shigella flexneri 2a str. 2457T
aauuagcaauauuuuua

SEQ ID NO: 3866789 - RNA, 16 nt, Shigella flexneri 2a str. 2457T
aauuagcacgauuuug

SEQ ID NO: 3866790 - RNA, 18 nt, Shigella flexneri 2a str. 2457T
aauuagcacgauuuugua

SEQ ID NO: 3866791 - RNA, 14 nt, Shigella flexneri 2a str. 2457T
aauuaguaaugaua

SEQ ID NO: 3866792 - RNA, 19 nt, Shigella flexneri 2a str. 2457T
aauuauagggaugcagaau

SEQ ID NO: 3866793 - RNA, 20 nt, Shigella flexneri 2a str. 2457T
aauuauaguaucguuaaauu

SEQ ID NO: 3866794 - RNA, 20 nt, Shigella flexneri 2a str. 2457T
aauuaucacaacuucgcgaa

SEQ ID NO: 3866795 - RNA, 20 nt, Shigella flexneri 2a str. 2457T
aauuaucaccgcaccuguaa

SEQ ID NO: 3866796 - RNA, 19 nt, Shigella flexneri 2a str. 2457T
aauuaucucuguuuugcau

SEQ ID NO: 3866797 - RNA, 20 nt, Shigella flexneri 2a str. 2457T
aauuaucuuuacugauaauu

SEQ ID NO: 3866798 - RNA, 18 nt, Shigella flexneri 2a str. 2457T
aauuaugccgaucaucau

SEQ ID NO: 3866799 - RNA, 13 nt, Shigella flexneri 2a str. 2457T
aauuauuauaaua

SEQ ID NO: 3866800 - RNA, 15 nt, Shigella flexneri 2a str. 2457T
aauuauuucuuuuac

SEQ ID NO: 3866801 - RNA, 23 nt, Shigella flexneri 2a str. 2457T
aauucaaacaguucuggaagaga

SEQ ID NO: 3866802 - RNA, 12 nt, Shigella flexneri 2a str. 2457T
aauucaaauccu

SEQ ID NO: 3866803 - RNA, 14 nt, Shigella flexneri 2a str. 2457T
aauucaauauauug

SEQ ID NO: 3866804 - RNA, 18 nt, Shigella flexneri 2a str. 2457T
aauucacgaauauuuccc

SEQ ID NO: 3866805 - RNA, 19 nt, Shigella flexneri 2a str. 2457T
aauucacgcaggcgagaau

SEQ ID NO: 3866806 - RNA, 14 nt, Shigella flexneri 2a str. 2457T
aauucacgccuucu

SEQ ID NO: 3866807 - RNA, 15 nt, Shigella flexneri 2a str. 2457T
aauucacucuauacc

SEQ ID NO: 3866808 - RNA, 16 nt, Shigella flexneri 2a str. 2457T
aauucagaaaaauaca

SEQ ID NO: 3866809 - RNA, 21 nt, Shigella flexneri 2a str. 2457T
aauucagaaaaauacaauucu

SEQ ID NO: 3866810 - RNA, 21 nt, Shigella flexneri 2a str. 2457T
aauucagaugaugauacugac

SEQ ID NO: 3866811 - RNA, 18 nt, Shigella flexneri 2a str. 2457T
aauucauacaucgcgcuu

SEQ ID NO: 3866812 - RNA, 22 nt, Shigella flexneri 2a str. 2457T
aauucaucuucacuucaucccu

SEQ ID NO: 3866813 - RNA, 20 nt, Shigella flexneri 2a str. 2457T
aauucauuacgaaguuuaau

SEQ ID NO: 3866814 - RNA, 14 nt, Shigella flexneri 2a str. 2457T
aauucauuccugga

SEQ ID NO: 3866815 - RNA, 20 nt, Shigella flexneri 2a str. 2457T
aauucauuugaauaguuaau

SEQ ID NO: 3866816 - RNA, 23 nt, Shigella flexneri 2a str. 2457T
aauuccaccccuuuacugacugu

SEQ ID NO: 3866817 - RNA, 15 nt, Shigella flexneri 2a str. 2457T
aauuccagaaaagag

SEQ ID NO: 3866818 - RNA, 23 nt, Shigella flexneri 2a str. 2457T
aauuccauuucccugacaaauca

SEQ ID NO: 3866819 - RNA, 12 nt, Shigella flexneri 2a str. 2457T
aauucccagaau

SEQ ID NO: 3866820 - RNA, 18 nt, Shigella flexneri 2a str. 2457T
aauucccaguuacugcca

SEQ ID NO: 3866821 - RNA, 16 nt, Shigella flexneri 2a str. 2457T
aauuccccgcaggaug

SEQ ID NO: 3866822 - RNA, 20 nt, Shigella flexneri 2a str. 2457T
aauucccgcagcuccagccc

SEQ ID NO: 3866823 - RNA, 18 nt, Shigella flexneri 2a str. 2457T
aauucccgcuucuucugc

SEQ ID NO: 3866824 - RNA, 13 nt, Shigella flexneri 2a str. 2457T
aauuccgaacaaa

SEQ ID NO: 3866825 - RNA, 14 nt, Shigella flexneri 2a str. 2457T
aauuccgaacaaaa

SEQ ID NO: 3866826 - RNA, 21 nt, Shigella flexneri 2a str. 2457T
aauuccggcuugguguggaua

SEQ ID NO: 3866827 - RNA, 17 nt, Shigella flexneri 2a str. 2457T
aauuccggugcgccaga

SEQ ID NO: 3866828 - RNA, 19 nt, Shigella flexneri 2a str. 2457T
aauuccuaaccgaauucaa

SEQ ID NO: 3866829 - RNA, 16 nt, Shigella flexneri 2a str. 2457T
aauuccuaugcaacaa

SEQ ID NO: 3866830 - RNA, 21 nt, Shigella flexneri 2a str. 2457T
aauuccuccggcaccgggcuu

SEQ ID NO: 3866831 - RNA, 13 nt, Shigella flexneri 2a str. 2457T
aauuccugccgcg

SEQ ID NO: 3866832 - RNA, 21 nt, Shigella flexneri 2a str. 2457T
aauuccuuucccuauuuuuuc

SEQ ID NO: 3866833 - RNA, 21 nt, Shigella flexneri 2a str. 2457T
aauucgaaauagagaaaguaa

SEQ ID NO: 3866834 - RNA, 16 nt, Shigella flexneri 2a str. 2457T
aauucgacuuucucug

SEQ ID NO: 3866835 - RNA, 13 nt, Shigella flexneri 2a str. 2457T
aauucgcccuucg

SEQ ID NO: 3866836 - RNA, 19 nt, Shigella flexneri 2a str. 2457T
aauucgcugaauaccgauu

SEQ ID NO: 3866837 - RNA, 20 nt, Shigella flexneri 2a str. 2457T
aauucguaaguacauuaaaa

SEQ ID NO: 3866838 - RNA, 14 nt, Shigella flexneri 2a str. 2457T
aauucuaaauguuc

SEQ ID NO: 3866839 - RNA, 16 nt, Shigella flexneri 2a str. 2457T
aauucuaaauguucaa

SEQ ID NO: 3866840 - RNA, 15 nt, Shigella flexneri 2a str. 2457T
aauucuaauguuaaa

SEQ ID NO: 3866841 - RNA, 17 nt, Shigella flexneri 2a str. 2457T
aauucuacagaaaugaa

SEQ ID NO: 3866842 - RNA, 21 nt, Shigella flexneri 2a str. 2457T
aauucuacagaaaugaaaaaa

SEQ ID NO: 3866843 - RNA, 22 nt, Shigella flexneri 2a str. 2457T
aauucuacagaaaugaaaaaau

SEQ ID NO: 3866844 - RNA, 20 nt, Shigella flexneri 2a str. 2457T
aauucucaaacgaaucugca

SEQ ID NO: 3866845 - RNA, 17 nt, Shigella flexneri 2a str. 2457T
aauucuccgcucucaau

SEQ ID NO: 3866846 - RNA, 20 nt, Shigella flexneri 2a str. 2457T
aauucugagagcaugaaaug

SEQ ID NO: 3866847 - RNA, 22 nt, Shigella flexneri 2a str. 2457T
aauucugagagcaugaaaugaa

SEQ ID NO: 3866848 - RNA, 20 nt, Shigella flexneri 2a str. 2457T
aauucuggacgguggagcaa

SEQ ID NO: 3866849 - RNA, 16 nt, Shigella flexneri 2a str. 2457T
aauugaagguuuaaua

SEQ ID NO: 3866850 - RNA, 19 nt, Shigella flexneri 2a str. 2457T
aauugaucucacaaucauc

SEQ ID NO: 3866851 - RNA, 15 nt, Shigella flexneri 2a str. 2457T
aauugaugugaaaac

SEQ ID NO: 3866852 - RNA, 20 nt, Shigella flexneri 2a str. 2457T
aauugcacauauuuuucacc

SEQ ID NO: 3866853 - RNA, 22 nt, Shigella flexneri 2a str. 2457T
aauugcacguccgguggcaucc

SEQ ID NO: 3866854 - RNA, 23 nt, Shigella flexneri 2a str. 2457T
aauugcagacccguuaagcguuc

SEQ ID NO: 3866855 - RNA, 12 nt, Shigella flexneri 2a str. 2457T
aauugcagauac

SEQ ID NO: 3866856 - RNA, 23 nt, Shigella flexneri 2a str. 2457T
aauugcaggguuuuguuuaaaua

SEQ ID NO: 3866857 - RNA, 12 nt, Shigella flexneri 2a str. 2457T
aauugccagaca

SEQ ID NO: 3866858 - RNA, 13 nt, Shigella flexneri 2a str. 2457T
aauugccagcccu

SEQ ID NO: 3866859 - RNA, 14 nt, Shigella flexneri 2a str. 2457T
aauugccagcuugc

SEQ ID NO: 3866860 - RNA, 21 nt, Shigella flexneri 2a str. 2457T
aauugccguuaaaacuaaaaa

SEQ ID NO: 3866861 - RNA, 14 nt, Shigella flexneri 2a str. 2457T
aauugcgguuuuua

SEQ ID NO: 3866862 - RNA, 16 nt, Shigella flexneri 2a str. 2457T
aauugcguaaagccug

SEQ ID NO: 3866863 - RNA, 19 nt, Shigella flexneri 2a str. 2457T
aauugcguaaagccugcug

SEQ ID NO: 3866864 - RNA, 22 nt, Shigella flexneri 2a str. 2457T
aauugcguaaagccugcuggca

SEQ ID NO: 3866865 - RNA, 12 nt, Shigella flexneri 2a str. 2457T
aauugcgucagu

SEQ ID NO: 3866866 - RNA, 19 nt, Shigella flexneri 2a str. 2457T
aauugcguuaaaaucagcg

SEQ ID NO: 3866867 - RNA, 18 nt, Shigella flexneri 2a str. 2457T
aauugcucauagagcgca

SEQ ID NO: 3866868 - RNA, 23 nt, Shigella flexneri 2a str. 2457T
aauugcuggcgcguuaucgacaa

SEQ ID NO: 3866869 - RNA, 17 nt, Shigella flexneri 2a str. 2457T
aauugcugguuuuguag

SEQ ID NO: 3866870 - RNA, 18 nt, Shigella flexneri 2a str. 2457T
aauugcuuuuaccauacu

SEQ ID NO: 3866871 - RNA, 17 nt, Shigella flexneri 2a str. 2457T
aauuggaguaucaccau

SEQ ID NO: 3866872 - RNA, 17 nt, Shigella flexneri 2a str. 2457T
aauugucgccggagaga

SEQ ID NO: 3866873 - RNA, 17 nt, Shigella flexneri 2a str. 2457T
aauugucuccaccaaug

SEQ ID NO: 3866874 - RNA, 22 nt, Shigella flexneri 2a str. 2457T
aauugugaacgagaaaaugacg

SEQ ID NO: 3866875 - RNA, 14 nt, Shigella flexneri 2a str. 2457T
aauuguucugcgcu

SEQ ID NO: 3866876 - RNA, 22 nt, Shigella flexneri 2a str. 2457T
aauuguuugacuuauaagucuc

SEQ ID NO: 3866877 - RNA, 19 nt, Shigella flexneri 2a str. 2457T
aauuguuuuauaaagaacu

SEQ ID NO: 3866878 - RNA, 17 nt, Shigella flexneri 2a str. 2457T
aauuguuuuugauuuug

SEQ ID NO: 3866879 - RNA, 15 nt, Shigella flexneri 2a str. 2457T
acaaauagccaauuc

SEQ ID NO: 3866880 - RNA, 21 nt, Shigella flexneri 2a str. 2457T
acaaauccuucacuuuugcca

SEQ ID NO: 3866881 - RNA, 17 nt, Shigella flexneri 2a str. 2457T
acaaauggcaaugacua

SEQ ID NO: 3866882 - RNA, 21 nt, Shigella flexneri 2a str. 2457T
acaaauucacgccuucuucca

SEQ ID NO: 3866883 - RNA, 10 nt, Shigella flexneri 2a str. 2457T
acaaauuccg

SEQ ID NO: 3866884 - RNA, 16 nt, Shigella flexneri 2a str. 2457T
acaaauuugugcucug

SEQ ID NO: 3866885 - RNA, 14 nt, Shigella flexneri 2a str. 2457T
acaacaacacccau

SEQ ID NO: 3866886 - RNA, 13 nt, Shigella flexneri 2a str. 2457T
acaacaccgugca

SEQ ID NO: 3866887 - RNA, 18 nt, Shigella flexneri 2a str. 2457T
acaacacgccgauaauca

SEQ ID NO: 3866888 - RNA, 13 nt, Shigella flexneri 2a str. 2457T
acaacacucucug

SEQ ID NO: 3866889 - RNA, 17 nt, Shigella flexneri 2a str. 2457T
acaacacucucugaagu

SEQ ID NO: 3866890 - RNA, 23 nt, Shigella flexneri 2a str. 2457T
acaacagaaauaaucgcaauuac

SEQ ID NO: 3866891 - RNA, 13 nt, Shigella flexneri 2a str. 2457T
acaacaucaucug

SEQ ID NO: 3866892 - RNA, 14 nt, Shigella flexneri 2a str. 2457T
acaacaucaucugc

SEQ ID NO: 3866893 - RNA, 15 nt, Shigella flexneri 2a str. 2457T
acaacaucaucugcc

SEQ ID NO: 3866894 - RNA, 23 nt, Shigella flexneri 2a str. 2457T
acaacaugcuauugcgccagccu

SEQ ID NO: 3866895 - RNA, 19 nt, Shigella flexneri 2a str. 2457T
acaacauuccugcugacgg

SEQ ID NO: 3866896 - RNA, 18 nt, Shigella flexneri 2a str. 2457T
acaaccaaucgcggcgau

SEQ ID NO: 3866897 - RNA, 18 nt, Shigella flexneri 2a str. 2457T
acaacccaagcgcgcugu

SEQ ID NO: 3866898 - RNA, 21 nt, Shigella flexneri 2a str. 2457T
acaacccgugagucuccuuua

SEQ ID NO: 3866899 - RNA, 15 nt, Shigella flexneri 2a str. 2457T
acaaccgaggcucaa

SEQ ID NO: 3866900 - RNA, 12 nt, Shigella flexneri 2a str. 2457T
acaaccggauau

SEQ ID NO: 3866901 - RNA, 22 nt, Shigella flexneri 2a str. 2457T
acaaccuugccauuccacaaaa

SEQ ID NO: 3866902 - RNA, 18 nt, Shigella flexneri 2a str. 2457T
acaacgaccggccauucc

SEQ ID NO: 3866903 - RNA, 13 nt, Shigella flexneri 2a str. 2457T
acaacgagcgcaa

SEQ ID NO: 3866904 - RNA, 13 nt, Shigella flexneri 2a str. 2457T
acaacgcaauaaa

SEQ ID NO: 3866905 - RNA, 20 nt, Shigella flexneri 2a str. 2457T
acaacgcaauauccgccacu

SEQ ID NO: 3866906 - RNA, 19 nt, Shigella flexneri 2a str. 2457T
acaacgccauauaaauuuc

SEQ ID NO: 3866907 - RNA, 11 nt, Shigella flexneri 2a str. 2457T
acaacgccgcc

SEQ ID NO: 3866908 - RNA, 13 nt, Shigella flexneri 2a str. 2457T
acaacggaacgaa

SEQ ID NO: 3866909 - RNA, 19 nt, Shigella flexneri 2a str. 2457T
acaacggaacgaaaaaaau

SEQ ID NO: 3866910 - RNA, 14 nt, Shigella flexneri 2a str. 2457T
acaacgguccgguu

SEQ ID NO: 3866911 - RNA, 18 nt, Shigella flexneri 2a str. 2457T
acaacguaucuugcguca

SEQ ID NO: 3866912 - RNA, 17 nt, Shigella flexneri 2a str. 2457T
acaacgucgccaguccu

SEQ ID NO: 3866913 - RNA, 15 nt, Shigella flexneri 2a str. 2457T
acaacgugugcuuug

SEQ ID NO: 3866914 - RNA, 18 nt, Shigella flexneri 2a str. 2457T
acaacuaagccaguucau

SEQ ID NO: 3866915 - RNA, 23 nt, Shigella flexneri 2a str. 2457T
acaacucgcuuaagccaucauca

SEQ ID NO: 3866916 - RNA, 23 nt, Shigella flexneri 2a str. 2457T
acaacugcgaccguacaaccaaa

SEQ ID NO: 3866917 - RNA, 18 nt, Shigella flexneri 2a str. 2457T
acaacuuaauaggggcac

SEQ ID NO: 3866918 - RNA, 21 nt, Shigella flexneri 2a str. 2457T
acaacuucaacguugaauuuc

SEQ ID NO: 3866919 - RNA, 13 nt, Shigella flexneri 2a str. 2457T
acaacuucccugu

SEQ ID NO: 3866920 - RNA, 14 nt, Shigella flexneri 2a str. 2457T
acaagaaauauaca

SEQ ID NO: 3866921 - RNA, 18 nt, Shigella flexneri 2a str. 2457T
acaagaaauauacaggcg

SEQ ID NO: 3866922 - RNA, 17 nt, Shigella flexneri 2a str. 2457T
acaagaaucaugccaaa

SEQ ID NO: 3866923 - RNA, 23 nt, Shigella flexneri 2a str. 2457T
acaagaaugccugccagcuugcg

SEQ ID NO: 3866924 - RNA, 14 nt, Shigella flexneri 2a str. 2457T
acaagacuguaaau

SEQ ID NO: 3866925 - RNA, 16 nt, Shigella flexneri 2a str. 2457T
acaagauaacagacau

SEQ ID NO: 3866926 - RNA, 17 nt, Shigella flexneri 2a str. 2457T
acaagauacggaacugc

SEQ ID NO: 3866927 - RNA, 15 nt, Shigella flexneri 2a str. 2457T
acaagauacugccga

SEQ ID NO: 3866928 - RNA, 14 nt, Shigella flexneri 2a str. 2457T
acaagaucgcccug

SEQ ID NO: 3866929 - RNA, 17 nt, Shigella flexneri 2a str. 2457T
acaagaucgcccugagg

SEQ ID NO: 3866930 - RNA, 22 nt, Shigella flexneri 2a str. 2457T
acaagcauuaaggcaagaaaau

SEQ ID NO: 3866931 - RNA, 17 nt, Shigella flexneri 2a str. 2457T
acaagcguaugauugcc

SEQ ID NO: 3866932 - RNA, 15 nt, Shigella flexneri 2a str. 2457T
acaagcuaccagccc

SEQ ID NO: 3866933 - RNA, 14 nt, Shigella flexneri 2a str. 2457T
acaagcuccggcuu

SEQ ID NO: 3866934 - RNA, 19 nt, Shigella flexneri 2a str. 2457T
acaaggaauguggcaauga

SEQ ID NO: 3866935 - RNA, 21 nt, Shigella flexneri 2a str. 2457T
acaaggaauguggcaaugagu

SEQ ID NO: 3866936 - RNA, 14 nt, Shigella flexneri 2a str. 2457T
acaaggcaucguga

SEQ ID NO: 3866937 - RNA, 22 nt, Shigella flexneri 2a str. 2457T
acaagggaaauaagaaaagcga

SEQ ID NO: 3866938 - RNA, 14 nt, Shigella flexneri 2a str. 2457T
acaagguacgaaaa

SEQ ID NO: 3866939 - RNA, 22 nt, Shigella flexneri 2a str. 2457T
acaagguacgaaaaaaauuacu

SEQ ID NO: 3866940 - RNA, 21 nt, Shigella flexneri 2a str. 2457T
acaaguaaaaggagauaaacc

SEQ ID NO: 3866941 - RNA, 20 nt, Shigella flexneri 2a str. 2457T
acaaguccguugaaaaugcu

SEQ ID NO: 3866942 - RNA, 17 nt, Shigella flexneri 2a str. 2457T
acaauaauacccagcac

SEQ ID NO: 3866943 - RNA, 13 nt, Shigella flexneri 2a str. 2457T
acaauaauaucuu

SEQ ID NO: 3866944 - RNA, 14 nt, Shigella flexneri 2a str. 2457T
acaauaauaucuuu

SEQ ID NO: 3866945 - RNA, 17 nt, Shigella flexneri 2a str. 2457T
acaauaauaucuuuuuu

SEQ ID NO: 3866946 - RNA, 15 nt, Shigella flexneri 2a str. 2457T
acaauacaaaugccu

SEQ ID NO: 3866947 - RNA, 18 nt, Shigella flexneri 2a str. 2457T
acaauacauagaaacuca

SEQ ID NO: 3866948 - RNA, 15 nt, Shigella flexneri 2a str. 2457T
acaauacaucuuuuc

SEQ ID NO: 3866949 - RNA, 18 nt, Shigella flexneri 2a str. 2457T
acaauagcaaucuguaac

SEQ ID NO: 3866950 - RNA, 20 nt, Shigella flexneri 2a str. 2457T
acaauauugaugcucacugc

SEQ ID NO: 3866951 - RNA, 20 nt, Shigella flexneri 2a str. 2457T
acaaucaccaggucaccaga

SEQ ID NO: 3866952 - RNA, 12 nt, Shigella flexneri 2a str. 2457T
acaaucagccag

SEQ ID NO: 3866953 - RNA, 17 nt, Shigella flexneri 2a str. 2457T
acaaucccuuaguaacg

SEQ ID NO: 3866954 - RNA, 20 nt, Shigella flexneri 2a str. 2457T
acaaucccuuaguaacgcca

SEQ ID NO: 3866955 - RNA, 21 nt, Shigella flexneri 2a str. 2457T
acaaucccuuaguaacgccag

SEQ ID NO: 3866956 - RNA, 14 nt, Shigella flexneri 2a str. 2457T
acaaucgcuuaauc

SEQ ID NO: 3866957 - RNA, 17 nt, Shigella flexneri 2a str. 2457T
acaaucgucagcucgcu

SEQ ID NO: 3866958 - RNA, 24 nt, Shigella flexneri 2a str. 2457T
acaaucgucagcucgcugccauca

SEQ ID NO: 3866959 - RNA, 17 nt, Shigella flexneri 2a str. 2457T
acaaucucaaccgcuuc

SEQ ID NO: 3866960 - RNA, 13 nt, Shigella flexneri 2a str. 2457T
acaaucugauaau

SEQ ID NO: 3866961 - RNA, 22 nt, Shigella flexneri 2a str. 2457T
acaaugagauauuuaaaugauu

SEQ ID NO: 3866962 - RNA, 18 nt, Shigella flexneri 2a str. 2457T
acaaugccgauaaauaca

SEQ ID NO: 3866963 - RNA, 20 nt, Shigella flexneri 2a str. 2457T
acaauggagcacauugccug

SEQ ID NO: 3866964 - RNA, 18 nt, Shigella flexneri 2a str. 2457T
acaauggagcuaaacagc

SEQ ID NO: 3866965 - RNA, 21 nt, Shigella flexneri 2a str. 2457T
acaauggagcuaaacagcgcu

SEQ ID NO: 3866966 - RNA, 11 nt, Shigella flexneri 2a str. 2457T
acaauucaggg

SEQ ID NO: 3866967 - RNA, 15 nt, Shigella flexneri 2a str. 2457T
acaauucgccagggc

SEQ ID NO: 3866968 - RNA, 15 nt, Shigella flexneri 2a str. 2457T
acaauugaccaguaa

SEQ ID NO: 3866969 - RNA, 14 nt, Shigella flexneri 2a str. 2457T
acaauugccggaug

SEQ ID NO: 3866970 - RNA, 18 nt, Shigella flexneri 2a str. 2457T
acaauugcgggccaaaga

SEQ ID NO: 3866971 - RNA, 14 nt, Shigella flexneri 2a str. 2457T
acaauuguugaccg

SEQ ID NO: 3866972 - RNA, 21 nt, Shigella flexneri 2a str. 2457T
acaauuucagaauagacaaaa

SEQ ID NO: 3866973 - RNA, 22 nt, Shigella flexneri 2a str. 2457T
acaauuucagaauagacaaaaa

SEQ ID NO: 3866974 - RNA, 12 nt, Shigella flexneri 2a str. 2457T
acaauuugccca

SEQ ID NO: 3866975 - RNA, 23 nt, Shigella flexneri 2a str. 2457T
acaauuugcccauguaguacccg

SEQ ID NO: 3866976 - RNA, 17 nt, Shigella flexneri 2a str. 2457T
acacaaccgaggcucaa

SEQ ID NO: 3866977 - RNA, 16 nt, Shigella flexneri 2a str. 2457T
acacaauaccuucugc

SEQ ID NO: 3866978 - RNA, 15 nt, Shigella flexneri 2a str. 2457T
acacaaugccugaug

SEQ ID NO: 3866979 - RNA, 14 nt, Shigella flexneri 2a str. 2457T
acacaauuuuguag

SEQ ID NO: 3866980 - RNA, 12 nt, Shigella flexneri 2a str. 2457T
acacacaucacg

SEQ ID NO: 3866981 - RNA, 16 nt, Shigella flexneri 2a str. 2457T
acacacgcccagcuca

SEQ ID NO: 3866982 - RNA, 15 nt, Shigella flexneri 2a str. 2457T
acacacuaucccaac

SEQ ID NO: 3866983 - RNA, 13 nt, Shigella flexneri 2a str. 2457T
acacacuuuccag

SEQ ID NO: 3866984 - RNA, 15 nt, Shigella flexneri 2a str. 2457T
acacacuuuccaggc

SEQ ID NO: 3866985 - RNA, 16 nt, Shigella flexneri 2a str. 2457T
acacagacgguuuuuc

SEQ ID NO: 3866986 - RNA, 14 nt, Shigella flexneri 2a str. 2457T
acacagcacuauga

SEQ ID NO: 3866987 - RNA, 13 nt, Shigella flexneri 2a str. 2457T
acacagccacagg

SEQ ID NO: 3866988 - RNA, 19 nt, Shigella flexneri 2a str. 2457T
acacagcgacguaaaaaac

SEQ ID NO: 3866989 - RNA, 17 nt, Shigella flexneri 2a str. 2457T
acacaggcagcaaucac

SEQ ID NO: 3866990 - RNA, 21 nt, Shigella flexneri 2a str. 2457T
acacagugaaucucuuaucau

SEQ ID NO: 3866991 - RNA, 19 nt, Shigella flexneri 2a str. 2457T
acacaguucuucaaaaaua

SEQ ID NO: 3866992 - RNA, 20 nt, Shigella flexneri 2a str. 2457T
acacauaaacagguaaagac

SEQ ID NO: 3866993 - RNA, 15 nt, Shigella flexneri 2a str. 2457T
acacauacuuauuau

SEQ ID NO: 3866994 - RNA, 16 nt, Shigella flexneri 2a str. 2457T
acacaucaccuccagc

SEQ ID NO: 3866995 - RNA, 17 nt, Shigella flexneri 2a str. 2457T
acacauuacgccaguaa

SEQ ID NO: 3866996 - RNA, 19 nt, Shigella flexneri 2a str. 2457T
acacauuaucucaacacac

SEQ ID NO: 3866997 - RNA, 20 nt, Shigella flexneri 2a str. 2457T
acacauucaaacgauuuuuu

SEQ ID NO: 3866998 - RNA, 14 nt, Shigella flexneri 2a str. 2457T
acaccaacaucacg

SEQ ID NO: 3866999 - RNA, 15 nt, Shigella flexneri 2a str. 2457T
acaccaaggaacugu

SEQ ID NO: 3867000 - RNA, 21 nt, Shigella flexneri 2a str. 2457T
acaccaccaauggcuggccug

SEQ ID NO: 3867001 - RNA, 15 nt, Shigella flexneri 2a str. 2457T
acaccacugccagau

SEQ ID NO: 3867002 - RNA, 14 nt, Shigella flexneri 2a str. 2457T
acaccacugcgcau

SEQ ID NO: 3867003 - RNA, 14 nt, Shigella flexneri 2a str. 2457T
acaccagagccugc

SEQ ID NO: 3867004 - RNA, 18 nt, Shigella flexneri 2a str. 2457T
acaccagagccugccaau

SEQ ID NO: 3867005 - RNA, 12 nt, Shigella flexneri 2a str. 2457T
acaccagaugag

SEQ ID NO: 3867006 - RNA, 15 nt, Shigella flexneri 2a str. 2457T
acaccagaugauuag

SEQ ID NO: 3867007 - RNA, 16 nt, Shigella flexneri 2a str. 2457T
acaccagcaauaaugc

SEQ ID NO: 3867008 - RNA, 15 nt, Shigella flexneri 2a str. 2457T
acaccagcacaucau

SEQ ID NO: 3867009 - RNA, 22 nt, Shigella flexneri 2a str. 2457T
acaccagcaguaaaccacccac

SEQ ID NO: 3867010 - RNA, 16 nt, Shigella flexneri 2a str. 2457T
acaccagccagaauua

SEQ ID NO: 3867011 - RNA, 23 nt, Shigella flexneri 2a str. 2457T
acaccagcuuucgcuuaacgccc

SEQ ID NO: 3867012 - RNA, 14 nt, Shigella flexneri 2a str. 2457T
acaccaucaacaaa

SEQ ID NO: 3867013 - RNA, 14 nt, Shigella flexneri 2a str. 2457T
acaccaucaguggc

SEQ ID NO: 3867014 - RNA, 15 nt, Shigella flexneri 2a str. 2457T
acaccaucuuccuca

SEQ ID NO: 3867015 - RNA, 22 nt, Shigella flexneri 2a str. 2457T
acaccauugauaauccaucacu

SEQ ID NO: 3867016 - RNA, 12 nt, Shigella flexneri 2a str. 2457T
acacccagcccc

SEQ ID NO: 3867017 - RNA, 14 nt, Shigella flexneri 2a str. 2457T
acaccgauuuugua

SEQ ID NO: 3867018 - RNA, 21 nt, Shigella flexneri 2a str. 2457T
acaccgauuuuguaaaagaag

SEQ ID NO: 3867019 - RNA, 22 nt, Shigella flexneri 2a str. 2457T
acaccgauuuuguaaaagaagg

SEQ ID NO: 3867020 - RNA, 15 nt, Shigella flexneri 2a str. 2457T
acaccgcacgcagaa

SEQ ID NO: 3867021 - RNA, 21 nt, Shigella flexneri 2a str. 2457T
acaccgcagccgccacaauaa

SEQ ID NO: 3867022 - RNA, 16 nt, Shigella flexneri 2a str. 2457T
acaccgcccaacagac

SEQ ID NO: 3867023 - RNA, 21 nt, Shigella flexneri 2a str. 2457T
acaccgcgaucuuccacgccu

SEQ ID NO: 3867024 - RNA, 13 nt, Shigella flexneri 2a str. 2457T
acaccggaccaga

SEQ ID NO: 3867025 - RNA, 16 nt, Shigella flexneri 2a str. 2457T
acaccggcaauaauua

SEQ ID NO: 3867026 - RNA, 16 nt, Shigella flexneri 2a str. 2457T
acaccuguuccagugg

SEQ ID NO: 3867027 - RNA, 15 nt, Shigella flexneri 2a str. 2457T
acaccuuaaggcugu

SEQ ID NO: 3867028 - RNA, 14 nt, Shigella flexneri 2a str. 2457T
acaccuucauccag

SEQ ID NO: 3867029 - RNA, 13 nt, Shigella flexneri 2a str. 2457T
acacgaucucacg

SEQ ID NO: 3867030 - RNA, 16 nt, Shigella flexneri 2a str. 2457T
acacguaggccggaua

SEQ ID NO: 3867031 - RNA, 19 nt, Shigella flexneri 2a str. 2457T
acacguuaaugcaaucaaa

SEQ ID NO: 3867032 - RNA, 18 nt, Shigella flexneri 2a str. 2457T
acacuaacagaacaauaa

SEQ ID NO: 3867033 - RNA, 16 nt, Shigella flexneri 2a str. 2457T
acacuaccggaaccca

SEQ ID NO: 3867034 - RNA, 18 nt, Shigella flexneri 2a str. 2457T
acacuauucgccagcacg

SEQ ID NO: 3867035 - RNA, 14 nt, Shigella flexneri 2a str. 2457T
acacucaaugacuu

SEQ ID NO: 3867036 - RNA, 17 nt, Shigella flexneri 2a str. 2457T
acacuccagucccaguu

SEQ ID NO: 3867037 - RNA, 17 nt, Shigella flexneri 2a str. 2457T
acacuccuaucaccagc

SEQ ID NO: 3867038 - RNA, 19 nt, Shigella flexneri 2a str. 2457T
acacucgugcgucgcaucc

SEQ ID NO: 3867039 - RNA, 20 nt, Shigella flexneri 2a str. 2457T
acacucuuccagucgccugc

SEQ ID NO: 3867040 - RNA, 17 nt, Shigella flexneri 2a str. 2457T
acacugaaccgaaaugg

SEQ ID NO: 3867041 - RNA, 20 nt, Shigella flexneri 2a str. 2457T
acacugaauaaaaaugugca

SEQ ID NO: 3867042 - RNA, 20 nt, Shigella flexneri 2a str. 2457T
acacugacgcgucuuaucug

SEQ ID NO: 3867043 - RNA, 18 nt, Shigella flexneri 2a str. 2457T
acacugaugacaggcuac

SEQ ID NO: 3867044 - RNA, 17 nt, Shigella flexneri 2a str. 2457T
acacugcguacagcgcg

SEQ ID NO: 3867045 - RNA, 21 nt, Shigella flexneri 2a str. 2457T
acacugguucccaacaacagc

SEQ ID NO: 3867046 - RNA, 23 nt, Shigella flexneri 2a str. 2457T
acacugguucccaacaacagcgc

SEQ ID NO: 3867047 - RNA, 21 nt, Shigella flexneri 2a str. 2457T
acacuguaagccaccgaacaa

SEQ ID NO: 3867048 - RNA, 20 nt, Shigella flexneri 2a str. 2457T
acacuucacacacuuuuauu

SEQ ID NO: 3867049 - RNA, 15 nt, Shigella flexneri 2a str. 2457T
acacuucuucugucg

SEQ ID NO: 3867050 - RNA, 22 nt, Shigella flexneri 2a str. 2457T
acacuuuaaugccacauuagau

SEQ ID NO: 3867051 - RNA, 16 nt, Shigella flexneri 2a str. 2457T
acacuuuaucuaucag

SEQ ID NO: 3867052 - RNA, 21 nt, Shigella flexneri 2a str. 2457T
acacuuuccaguuccggcauu

SEQ ID NO: 3867053 - RNA, 19 nt, Shigella flexneri 2a str. 2457T
acacuuugccgucagccac

SEQ ID NO: 3867054 - RNA, 18 nt, Shigella flexneri 2a str. 2457T
acacuuuuauuaacucag

SEQ ID NO: 3867055 - RNA, 15 nt, Shigella flexneri 2a str. 2457T
acagaaaugaaaaaa

SEQ ID NO: 3867056 - RNA, 12 nt, Shigella flexneri 2a str. 2457T
acagaaauggua

SEQ ID NO: 3867057 - RNA, 20 nt, Shigella flexneri 2a str. 2457T
acagaaaugguaaagaaggc

SEQ ID NO: 3867058 - RNA, 13 nt, Shigella flexneri 2a str. 2457T
acagaacaauaau

SEQ ID NO: 3867059 - RNA, 17 nt, Shigella flexneri 2a str. 2457T
acagaacagugccaugc

SEQ ID NO: 3867060 - RNA, 23 nt, Shigella flexneri 2a str. 2457T
acagaacagugccaugccaauca

SEQ ID NO: 3867061 - RNA, 23 nt, Shigella flexneri 2a str. 2457T
acagaacgcgccuuaaaaaccag

SEQ ID NO: 3867062 - RNA, 17 nt, Shigella flexneri 2a str. 2457T
acagaacggcgaugcuu

SEQ ID NO: 3867063 - RNA, 14 nt, Shigella flexneri 2a str. 2457T
acagaaggccagga

SEQ ID NO: 3867064 - RNA, 18 nt, Shigella flexneri 2a str. 2457T
acagaauauaagucaggg

SEQ ID NO: 3867065 - RNA, 15 nt, Shigella flexneri 2a str. 2457T
acagaaucgggcuga

SEQ ID NO: 3867066 - RNA, 17 nt, Shigella flexneri 2a str. 2457T
acagaaucugaaggaug

SEQ ID NO: 3867067 - RNA, 14 nt, Shigella flexneri 2a str. 2457T
acagaauguugcuu

SEQ ID NO: 3867068 - RNA, 21 nt, Shigella flexneri 2a str. 2457T
acagaauucccccauugaaac

SEQ ID NO: 3867069 - RNA, 12 nt, Shigella flexneri 2a str. 2457T
acagacaaacag

SEQ ID NO: 3867070 - RNA, 20 nt, Shigella flexneri 2a str. 2457T
acagacagccucaagcaccc

SEQ ID NO: 3867071 - RNA, 17 nt, Shigella flexneri 2a str. 2457T
acagaccauaaccgccc

SEQ ID NO: 3867072 - RNA, 19 nt, Shigella flexneri 2a str. 2457T
acagaccuuucgaacccaa

SEQ ID NO: 3867073 - RNA, 21 nt, Shigella flexneri 2a str. 2457T
acagaccuuucgaacccaacc

SEQ ID NO: 3867074 - RNA, 15 nt, Shigella flexneri 2a str. 2457T
acagacucaaaccaa

SEQ ID NO: 3867075 - RNA, 16 nt, Shigella flexneri 2a str. 2457T
acagguuuaaacagag

SEQ ID NO: 3867076 - RNA, 15 nt, Shigella flexneri 2a str. 2457T
acaguaaagcgcaaa

SEQ ID NO: 3867077 - RNA, 23 nt, Shigella flexneri 2a str. 2457T
acaguaaagcgcaaaauaccagc

SEQ ID NO: 3867078 - RNA, 12 nt, Shigella flexneri 2a str. 2457T
acaguaaaguuu

SEQ ID NO: 3867079 - RNA, 15 nt, Shigella flexneri 2a str. 2457T
acaguaacccggcac

SEQ ID NO: 3867080 - RNA, 16 nt, Shigella flexneri 2a str. 2457T
acaguaacccggcacc

SEQ ID NO: 3867081 - RNA, 17 nt, Shigella flexneri 2a str. 2457T
acaguaaugauuuaaaa

SEQ ID NO: 3867082 - RNA, 16 nt, Shigella flexneri 2a str. 2457T
acaguacaauaugaau

SEQ ID NO: 3867083 - RNA, 21 nt, Shigella flexneri 2a str. 2457T
acaguagacaauuuuucauaa

SEQ ID NO: 3867084 - RNA, 21 nt, Shigella flexneri 2a str. 2457T
acaguauagcaucauaagacu

SEQ ID NO: 3867085 - RNA, 23 nt, Shigella flexneri 2a str. 2457T
acaguauuaucugggcugccuga

SEQ ID NO: 3867086 - RNA, 22 nt, Shigella flexneri 2a str. 2457T
acagucgcccgaccaucgccag

SEQ ID NO: 3867087 - RNA, 14 nt, Shigella flexneri 2a str. 2457T
acagugaaucucuu

SEQ ID NO: 3867088 - RNA, 21 nt, Shigella flexneri 2a str. 2457T
acagugacuuccguaccggcc

SEQ ID NO: 3867089 - RNA, 14 nt, Shigella flexneri 2a str. 2457T
acagugauuacuaa

SEQ ID NO: 3867090 - RNA, 21 nt, Shigella flexneri 2a str. 2457T
acagugauuacuaaaugugca

SEQ ID NO: 3867091 - RNA, 15 nt, Shigella flexneri 2a str. 2457T
acagugcaccggaca

SEQ ID NO: 3867092 - RNA, 17 nt, Shigella flexneri 2a str. 2457T
acagugggauuaaaaag

SEQ ID NO: 3867093 - RNA, 12 nt, Shigella flexneri 2a str. 2457T
acaguuaucaaa

SEQ ID NO: 3867094 - RNA, 17 nt, Shigella flexneri 2a str. 2457T
acaguuccgcaaagccc

SEQ ID NO: 3867095 - RNA, 13 nt, Shigella flexneri 2a str. 2457T
acaguuguaaagu

SEQ ID NO: 3867096 - RNA, 23 nt, Shigella flexneri 2a str. 2457T
acaguugucagcccuuuuucacg

SEQ ID NO: 3867097 - RNA, 19 nt, Shigella flexneri 2a str. 2457T
acaguuucggaccagccgc

SEQ ID NO: 3867098 - RNA, 20 nt, Shigella flexneri 2a str. 2457T
acaguuuucaagacgccguc

SEQ ID NO: 3867099 - RNA, 21 nt, Shigella flexneri 2a str. 2457T
acauaaaacgcuuacgcuuca

SEQ ID NO: 3867100 - RNA, 21 nt, Shigella flexneri 2a str. 2457T
acauaaacagguaaagaccau

SEQ ID NO: 3867101 - RNA, 15 nt, Shigella flexneri 2a str. 2457T
acauaaagucuuucu

SEQ ID NO: 3867102 - RNA, 16 nt, Shigella flexneri 2a str. 2457T
acauaaagucuuucuu

SEQ ID NO: 3867103 - RNA, 13 nt, Shigella flexneri 2a str. 2457T
acauaaccacuca

SEQ ID NO: 3867104 - RNA, 18 nt, Shigella flexneri 2a str. 2457T
acauaaccacucaccgcc

SEQ ID NO: 3867105 - RNA, 20 nt, Shigella flexneri 2a str. 2457T
acauaacgccaauucauucc

SEQ ID NO: 3867106 - RNA, 14 nt, Shigella flexneri 2a str. 2457T
acauaacugccucg

SEQ ID NO: 3867107 - RNA, 17 nt, Shigella flexneri 2a str. 2457T
acauaaucaauaaaaau

SEQ ID NO: 3867108 - RNA, 21 nt, Shigella flexneri 2a str. 2457T
acauaauccagacacuccaga

SEQ ID NO: 3867109 - RNA, 13 nt, Shigella flexneri 2a str. 2457T
acauaaucgaaaa

SEQ ID NO: 3867110 - RNA, 16 nt, Shigella flexneri 2a str. 2457T
acauacaaauagccaa

SEQ ID NO: 3867111 - RNA, 17 nt, Shigella flexneri 2a str. 2457T
acauacaaauagccaau

SEQ ID NO: 3867112 - RNA, 14 nt, Shigella flexneri 2a str. 2457T
acauacacaagcca

SEQ ID NO: 3867113 - RNA, 17 nt, Shigella flexneri 2a str. 2457T
acauacagaucgugcau

SEQ ID NO: 3867114 - RNA, 23 nt, Shigella flexneri 2a str. 2457T
acauaccuaaaagcacgccagac

SEQ ID NO: 3867115 - RNA, 18 nt, Shigella flexneri 2a str. 2457T
acauacugagaaccuuua

SEQ ID NO: 3867116 - RNA, 21 nt, Shigella flexneri 2a str. 2457T
acauacuuaaauaaugcuucu

SEQ ID NO: 3867117 - RNA, 20 nt, Shigella flexneri 2a str. 2457T
acauauaaccggcaacagaa

SEQ ID NO: 3867118 - RNA, 14 nt, Shigella flexneri 2a str. 2457T
acauauaucgaaaa

SEQ ID NO: 3867119 - RNA, 22 nt, Shigella flexneri 2a str. 2457T
acauauauuacaacguauuaua

SEQ ID NO: 3867120 - RNA, 14 nt, Shigella flexneri 2a str. 2457T
acauaucagcgcaa

SEQ ID NO: 3867121 - RNA, 23 nt, Shigella flexneri 2a str. 2457T
acauaucaggcuccggaaauuug

SEQ ID NO: 3867122 - RNA, 17 nt, Shigella flexneri 2a str. 2457T
acauauccuucacacau

SEQ ID NO: 3867123 - RNA, 14 nt, Shigella flexneri 2a str. 2457T
acauauuccccugg

SEQ ID NO: 3867124 - RNA, 15 nt, Shigella flexneri 2a str. 2457T
acauauucuggagca

SEQ ID NO: 3867125 - RNA, 14 nt, Shigella flexneri 2a str. 2457T
acauauugcagcuu

SEQ ID NO: 3867126 - RNA, 19 nt, Shigella flexneri 2a str. 2457T
acaucaaauuacagcaccu

SEQ ID NO: 3867127 - RNA, 16 nt, Shigella flexneri 2a str. 2457T
acaucaacucugcaau

SEQ ID NO: 3867128 - RNA, 22 nt, Shigella flexneri 2a str. 2457T
acaucacaccugcucagcccgu

SEQ ID NO: 3867129 - RNA, 13 nt, Shigella flexneri 2a str. 2457T
acaucacaugcug

SEQ ID NO: 3867130 - RNA, 13 nt, Shigella flexneri 2a str. 2457T
acaucacucauaa

SEQ ID NO: 3867131 - RNA, 20 nt, Shigella flexneri 2a str. 2457T
acaucacuccauccagcaac

SEQ ID NO: 3867132 - RNA, 15 nt, Shigella flexneri 2a str. 2457T
acaucacugcaaaua

SEQ ID NO: 3867133 - RNA, 13 nt, Shigella flexneri 2a str. 2457T
acaucagcgacaa

SEQ ID NO: 3867134 - RNA, 16 nt, Shigella flexneri 2a str. 2457T
acaucaucaaagccaa

SEQ ID NO: 3867135 - RNA, 11 nt, Shigella flexneri 2a str. 2457T
acaucaucaga

SEQ ID NO: 3867136 - RNA, 19 nt, Shigella flexneri 2a str. 2457T
acaucaucagaaaugccag

SEQ ID NO: 3867137 - RNA, 20 nt, Shigella flexneri 2a str. 2457T
acaucaucagaaaugccagu

SEQ ID NO: 3867138 - RNA, 16 nt, Shigella flexneri 2a str. 2457T
acaucauccagugccg

SEQ ID NO: 3867139 - RNA, 13 nt, Shigella flexneri 2a str. 2457T
acaucaucugcca

SEQ ID NO: 3867140 - RNA, 16 nt, Shigella flexneri 2a str. 2457T
acaucaugccagugau

SEQ ID NO: 3867141 - RNA, 20 nt, Shigella flexneri 2a str. 2457T
acaucaugcgucaccaacag

SEQ ID NO: 3867142 - RNA, 18 nt, Shigella flexneri 2a str. 2457T
acaucauuaguaccuucc

SEQ ID NO: 3867143 - RNA, 23 nt, Shigella flexneri 2a str. 2457T
acaucauuuuuucccauuaccau

SEQ ID NO: 3867144 - RNA, 23 nt, Shigella flexneri 2a str. 2457T
acauccaugcacugcaacgccuu

SEQ ID NO: 3867145 - RNA, 13 nt, Shigella flexneri 2a str. 2457T
acaucccagcaga

SEQ ID NO: 3867146 - RNA, 19 nt, Shigella flexneri 2a str. 2457T
acaucccgcgaacgagaau

SEQ ID NO: 3867147 - RNA, 17 nt, Shigella flexneri 2a str. 2457T
acauccggcaaaaacaa

SEQ ID NO: 3867148 - RNA, 19 nt, Shigella flexneri 2a str. 2457T
acauccgggcgaacuggcg

SEQ ID NO: 3867149 - RNA, 18 nt, Shigella flexneri 2a str. 2457T
acauccguggguugccag

SEQ ID NO: 3867150 - RNA, 14 nt, Shigella flexneri 2a str. 2457T
acauccucuucaag

SEQ ID NO: 3867151 - RNA, 17 nt, Shigella flexneri 2a str. 2457T
acauccucuucaagaau

SEQ ID NO: 3867152 - RNA, 15 nt, Shigella flexneri 2a str. 2457T
acauccugcguuaau

SEQ ID NO: 3867153 - RNA, 22 nt, Shigella flexneri 2a str. 2457T
acauccugcguuaaucgccgua

SEQ ID NO: 3867154 - RNA, 17 nt, Shigella flexneri 2a str. 2457T
acaucgauaagguuaug

SEQ ID NO: 3867155 - RNA, 14 nt, Shigella flexneri 2a str. 2457T
acaucgcagcaaac

SEQ ID NO: 3867156 - RNA, 15 nt, Shigella flexneri 2a str. 2457T
acaucgccagaaauc

SEQ ID NO: 3867157 - RNA, 13 nt, Shigella flexneri 2a str. 2457T
acaucgcgccaac

SEQ ID NO: 3867158 - RNA, 21 nt, Shigella flexneri 2a str. 2457T
acaucgcguugacguucaugc

SEQ ID NO: 3867159 - RNA, 19 nt, Shigella flexneri 2a str. 2457T
acaucgcugauuucaccau

SEQ ID NO: 3867160 - RNA, 23 nt, Shigella flexneri 2a str. 2457T
acaucgcugauuucaccaucuuc

SEQ ID NO: 3867161 - RNA, 14 nt, Shigella flexneri 2a str. 2457T
acaucgcuuuccag

SEQ ID NO: 3867162 - RNA, 21 nt, Shigella flexneri 2a str. 2457T
acaucguugacauuugcuuuu

SEQ ID NO: 3867163 - RNA, 22 nt, Shigella flexneri 2a str. 2457T
acaucucgaucgagaagaccau

SEQ ID NO: 3867164 - RNA, 12 nt, Shigella flexneri 2a str. 2457T
acaucucuuccc

SEQ ID NO: 3867165 - RNA, 19 nt, Shigella flexneri 2a str. 2457T
acaucugucugauaaaaaa

SEQ ID NO: 3867166 - RNA, 16 nt, Shigella flexneri 2a str. 2457T
acaucuucaauccacg

SEQ ID NO: 3867167 - RNA, 19 nt, Shigella flexneri 2a str. 2457T
acaucuucuccagcgaauc

SEQ ID NO: 3867168 - RNA, 16 nt, Shigella flexneri 2a str. 2457T
acaucuuuauaugcaa

SEQ ID NO: 3867169 - RNA, 19 nt, Shigella flexneri 2a str. 2457T
acaugaaccgugucgccau

SEQ ID NO: 3867170 - RNA, 14 nt, Shigella flexneri 2a str. 2457T
acaugaagcacugc

SEQ ID NO: 3867171 - RNA, 15 nt, Shigella flexneri 2a str. 2457T
acaugacgcgcauca

SEQ ID NO: 3867172 - RNA, 18 nt, Shigella flexneri 2a str. 2457T
accagauggcuuuccacc

SEQ ID NO: 3867173 - RNA, 16 nt, Shigella flexneri 2a str. 2457T
accagauuaauuauug

SEQ ID NO: 3867174 - RNA, 22 nt, Shigella flexneri 2a str. 2457T
accagauuauaagccaguaaga

SEQ ID NO: 3867175 - RNA, 12 nt, Shigella flexneri 2a str. 2457T
accagcaaauau

SEQ ID NO: 3867176 - RNA, 22 nt, Shigella flexneri 2a str. 2457T
accagcaaccaacgccagcagc

SEQ ID NO: 3867177 - RNA, 13 nt, Shigella flexneri 2a str. 2457T
accagcaacgcuu

SEQ ID NO: 3867178 - RNA, 13 nt, Shigella flexneri 2a str. 2457T
accagcaauaaca

SEQ ID NO: 3867179 - RNA, 16 nt, Shigella flexneri 2a str. 2457T
accagcacaaaguggc

SEQ ID NO: 3867180 - RNA, 22 nt, Shigella flexneri 2a str. 2457T
accagcaccagcuccggcaccu

SEQ ID NO: 3867181 - RNA, 13 nt, Shigella flexneri 2a str. 2457T
accagcacuucgc

SEQ ID NO: 3867182 - RNA, 15 nt, Shigella flexneri 2a str. 2457T
accagcacuucgcca

SEQ ID NO: 3867183 - RNA, 17 nt, Shigella flexneri 2a str. 2457T
accagcagcauuucaaa

SEQ ID NO: 3867184 - RNA, 13 nt, Shigella flexneri 2a str. 2457T
accagcaucaaca

SEQ ID NO: 3867185 - RNA, 15 nt, Shigella flexneri 2a str. 2457T
accagcaucaacaac

SEQ ID NO: 3867186 - RNA, 17 nt, Shigella flexneri 2a str. 2457T
accagcaucaacaacaa

SEQ ID NO: 3867187 - RNA, 23 nt, Shigella flexneri 2a str. 2457T
accagcaucaacaacaauuucac

SEQ ID NO: 3867188 - RNA, 17 nt, Shigella flexneri 2a str. 2457T
accagcaucccggcagc

SEQ ID NO: 3867189 - RNA, 11 nt, Shigella flexneri 2a str. 2457T
accagcaucgc

SEQ ID NO: 3867190 - RNA, 19 nt, Shigella flexneri 2a str. 2457T
accagcauuagcaaugcgc

SEQ ID NO: 3867191 - RNA, 17 nt, Shigella flexneri 2a str. 2457T
accagccagaauuaccc

SEQ ID NO: 3867192 - RNA, 17 nt, Shigella flexneri 2a str. 2457T
accagccaggccgccag

SEQ ID NO: 3867193 - RNA, 17 nt, Shigella flexneri 2a str. 2457T
accagccccagaauuca

SEQ ID NO: 3867194 - RNA, 15 nt, Shigella flexneri 2a str. 2457T
accagcccgacgaua

SEQ ID NO: 3867195 - RNA, 20 nt, Shigella flexneri 2a str. 2457T
accagccguugucagucauc

SEQ ID NO: 3867196 - RNA, 23 nt, Shigella flexneri 2a str. 2457T
accagccguugucagucaucacu

SEQ ID NO: 3867197 - RNA, 20 nt, Shigella flexneri 2a str. 2457T
accagccuggcggaaagcca

SEQ ID NO: 3867198 - RNA, 20 nt, Shigella flexneri 2a str. 2457T
accagcgaaaucaccgccac

SEQ ID NO: 3867199 - RNA, 22 nt, Shigella flexneri 2a str. 2457T
accagcgaaaucaccgccacca

SEQ ID NO: 3867200 - RNA, 22 nt, Shigella flexneri 2a str. 2457T
accagcgaauggguaaaaccgc

SEQ ID NO: 3867201 - RNA, 13 nt, Shigella flexneri 2a str. 2457T
accagcgacauca

SEQ ID NO: 3867202 - RNA, 18 nt, Shigella flexneri 2a str. 2457T
accagcgaggucaaaauc

SEQ ID NO: 3867203 - RNA, 17 nt, Shigella flexneri 2a str. 2457T
accagcgcaauauguuu

SEQ ID NO: 3867204 - RNA, 16 nt, Shigella flexneri 2a str. 2457T
accagcgcgugaccga

SEQ ID NO: 3867205 - RNA, 23 nt, Shigella flexneri 2a str. 2457T
accagcggacaaugccuaccgca

SEQ ID NO: 3867206 - RNA, 12 nt, Shigella flexneri 2a str. 2457T
accagcggcuga

SEQ ID NO: 3867207 - RNA, 18 nt, Shigella flexneri 2a str. 2457T
accagcggguugcugaga

SEQ ID NO: 3867208 - RNA, 16 nt, Shigella flexneri 2a str. 2457T
accagcgucagaaaca

SEQ ID NO: 3867209 - RNA, 19 nt, Shigella flexneri 2a str. 2457T
accagcgucgcaucaggca

SEQ ID NO: 3867210 - RNA, 17 nt, Shigella flexneri 2a str. 2457T
accagcguuuccagcac

SEQ ID NO: 3867211 - RNA, 18 nt, Shigella flexneri 2a str. 2457T
accagcguuuccagcacc

SEQ ID NO: 3867212 - RNA, 14 nt, Shigella flexneri 2a str. 2457T
accagcuccagcag

SEQ ID NO: 3867213 - RNA, 15 nt, Shigella flexneri 2a str. 2457T
accagcuccagcaga

SEQ ID NO: 3867214 - RNA, 23 nt, Shigella flexneri 2a str. 2457T
accagcucccggagggguuuuug

SEQ ID NO: 3867215 - RNA, 11 nt, Shigella flexneri 2a str. 2457T
accagcugccg

SEQ ID NO: 3867216 - RNA, 21 nt, Shigella flexneri 2a str. 2457T
accagcuuaugccuguccucu

SEQ ID NO: 3867217 - RNA, 23 nt, Shigella flexneri 2a str. 2457T
accagcuuucgcuuaacgcccau

SEQ ID NO: 3867218 - RNA, 23 nt, Shigella flexneri 2a str. 2457T
accaggaaacccaacgcaaagag

SEQ ID NO: 3867219 - RNA, 19 nt, Shigella flexneri 2a str. 2457T
accaggaacgcgccaagau

SEQ ID NO: 3867220 - RNA, 23 nt, Shigella flexneri 2a str. 2457T
accaggaagauguacgccagugc

SEQ ID NO: 3867221 - RNA, 20 nt, Shigella flexneri 2a str. 2457T
accaggaagcgacccgguuc

SEQ ID NO: 3867222 - RNA, 12 nt, Shigella flexneri 2a str. 2457T
accaggcaaacc

SEQ ID NO: 3867223 - RNA, 15 nt, Shigella flexneri 2a str. 2457T
accaggccaucagca

SEQ ID NO: 3867224 - RNA, 18 nt, Shigella flexneri 2a str. 2457T
accaggcgaccguuuuca

SEQ ID NO: 3867225 - RNA, 19 nt, Shigella flexneri 2a str. 2457T
accaggcgaccguuuucac

SEQ ID NO: 3867226 - RNA, 14 nt, Shigella flexneri 2a str. 2457T
accaggcguggaua

SEQ ID NO: 3867227 - RNA, 18 nt, Shigella flexneri 2a str. 2457T
accaggcguucugccugg

SEQ ID NO: 3867228 - RNA, 22 nt, Shigella flexneri 2a str. 2457T
accagggaaauaaucgggaaua

SEQ ID NO: 3867229 - RNA, 15 nt, Shigella flexneri 2a str. 2457T
accagguucaacagc

SEQ ID NO: 3867230 - RNA, 22 nt, Shigella flexneri 2a str. 2457T
accagguugccuugucaucguc

SEQ ID NO: 3867231 - RNA, 14 nt, Shigella flexneri 2a str. 2457T
accaguaaaccaau

SEQ ID NO: 3867232 - RNA, 23 nt, Shigella flexneri 2a str. 2457T
accaguaaaccaauuucugugca

SEQ ID NO: 3867233 - RNA, 15 nt, Shigella flexneri 2a str. 2457T
accaguaaagugcgc

SEQ ID NO: 3867234 - RNA, 15 nt, Shigella flexneri 2a str. 2457T
accaguaaggcaucu

SEQ ID NO: 3867235 - RNA, 13 nt, Shigella flexneri 2a str. 2457T
accaguaccgccg

SEQ ID NO: 3867236 - RNA, 22 nt, Shigella flexneri 2a str. 2457T
accaguaccgccgccauaaaca

SEQ ID NO: 3867237 - RNA, 22 nt, Shigella flexneri 2a str. 2457T
accagucagcgaacaccagcag

SEQ ID NO: 3867238 - RNA, 14 nt, Shigella flexneri 2a str. 2457T
accaguccacccac

SEQ ID NO: 3867239 - RNA, 20 nt, Shigella flexneri 2a str. 2457T
accagugaauuucacuucgc

SEQ ID NO: 3867240 - RNA, 22 nt, Shigella flexneri 2a str. 2457T
accagugaauuucacuucgcca

SEQ ID NO: 3867241 - RNA, 20 nt, Shigella flexneri 2a str. 2457T
accagugcaggcaccagccc

SEQ ID NO: 3867242 - RNA, 14 nt, Shigella flexneri 2a str. 2457T
accaguuacgugcu

SEQ ID NO: 3867243 - RNA, 23 nt, Shigella flexneri 2a str. 2457T
accaguuacguuuaugccacugu

SEQ ID NO: 3867244 - RNA, 15 nt, Shigella flexneri 2a str. 2457T
accaguucacaccag

SEQ ID NO: 3867245 - RNA, 19 nt, Shigella flexneri 2a str. 2457T
accaguucacaccagccac

SEQ ID NO: 3867246 - RNA, 14 nt, Shigella flexneri 2a str. 2457T
accauaaauuucac

SEQ ID NO: 3867247 - RNA, 15 nt, Shigella flexneri 2a str. 2457T
accauaaauuucacg

SEQ ID NO: 3867248 - RNA, 22 nt, Shigella flexneri 2a str. 2457T
accauaaauuucacgucacgcu

SEQ ID NO: 3867249 - RNA, 18 nt, Shigella flexneri 2a str. 2457T
accauaaucucaucagcg

SEQ ID NO: 3867250 - RNA, 19 nt, Shigella flexneri 2a str. 2457T
accauaaucucaucagcgu

SEQ ID NO: 3867251 - RNA, 16 nt, Shigella flexneri 2a str. 2457T
accauacagcagcaac

SEQ ID NO: 3867252 - RNA, 19 nt, Shigella flexneri 2a str. 2457T
accauacagcagcaacgau

SEQ ID NO: 3867253 - RNA, 15 nt, Shigella flexneri 2a str. 2457T
accauagcaucccaa

SEQ ID NO: 3867254 - RNA, 20 nt, Shigella flexneri 2a str. 2457T
accauauaugauaauuauua

SEQ ID NO: 3867255 - RNA, 21 nt, Shigella flexneri 2a str. 2457T
accauauaugauaauuauuau

SEQ ID NO: 3867256 - RNA, 16 nt, Shigella flexneri 2a str. 2457T
accauauucagcagca

SEQ ID NO: 3867257 - RNA, 19 nt, Shigella flexneri 2a str. 2457T
accauauuuaugcagugca

SEQ ID NO: 3867258 - RNA, 12 nt, Shigella flexneri 2a str. 2457T
accaucaaagaa

SEQ ID NO: 3867259 - RNA, 18 nt, Shigella flexneri 2a str. 2457T
accaucaaagaagcucuu

SEQ ID NO: 3867260 - RNA, 21 nt, Shigella flexneri 2a str. 2457T
accaucaaguagcagguaauc

SEQ ID NO: 3867261 - RNA, 23 nt, Shigella flexneri 2a str. 2457T
accaucaauggcugcaaagcauu

SEQ ID NO: 3867262 - RNA, 13 nt, Shigella flexneri 2a str. 2457T
accaucaccucuu

SEQ ID NO: 3867263 - RNA, 15 nt, Shigella flexneri 2a str. 2457T
accaucaccucuuca

SEQ ID NO: 3867264 - RNA, 12 nt, Shigella flexneri 2a str. 2457T
accaucacuuuc

SEQ ID NO: 3867265 - RNA, 14 nt, Shigella flexneri 2a str. 2457T
accaucacuuucaa

SEQ ID NO: 3867266 - RNA, 16 nt, Shigella flexneri 2a str. 2457T
accaucagcagcggca

SEQ ID NO: 3867267 - RNA, 20 nt, Shigella flexneri 2a str. 2457T
accaucagcugccagggcac

SEQ ID NO: 3867268 - RNA, 19 nt, Shigella flexneri 2a str. 2457T
accaucaggaugacaaacu

SEQ ID NO: 3867269 - RNA, 13 nt, Shigella flexneri 2a str. 2457T
acccgccagacca

SEQ ID NO: 3867270 - RNA, 13 nt, Shigella flexneri 2a str. 2457T
acccgccugauag

SEQ ID NO: 3867271 - RNA, 14 nt, Shigella flexneri 2a str. 2457T
acccgcgacgcgcu

SEQ ID NO: 3867272 - RNA, 15 nt, Shigella flexneri 2a str. 2457T
acccgcgaucgccug

SEQ ID NO: 3867273 - RNA, 17 nt, Shigella flexneri 2a str. 2457T
acccgcucaaacaccgu

SEQ ID NO: 3867274 - RNA, 20 nt, Shigella flexneri 2a str. 2457T
acccgcucauucguaaacga

SEQ ID NO: 3867275 - RNA, 20 nt, Shigella flexneri 2a str. 2457T
acccgcucgccauaucuucu

SEQ ID NO: 3867276 - RNA, 18 nt, Shigella flexneri 2a str. 2457T
acccggaggaaagcaccu

SEQ ID NO: 3867277 - RNA, 13 nt, Shigella flexneri 2a str. 2457T
acccggccacagc

SEQ ID NO: 3867278 - RNA, 14 nt, Shigella flexneri 2a str. 2457T
acccggccacagcg

SEQ ID NO: 3867279 - RNA, 21 nt, Shigella flexneri 2a str. 2457T
acccggccuguuuauccauca

SEQ ID NO: 3867280 - RNA, 18 nt, Shigella flexneri 2a str. 2457T
acccggcugauuuaucag

SEQ ID NO: 3867281 - RNA, 19 nt, Shigella flexneri 2a str. 2457T
acccggucccuucagccac

SEQ ID NO: 3867282 - RNA, 18 nt, Shigella flexneri 2a str. 2457T
acccgucguugcaaucag

SEQ ID NO: 3867283 - RNA, 23 nt, Shigella flexneri 2a str. 2457T
acccguuaagcguucauccaaca

SEQ ID NO: 3867284 - RNA, 13 nt, Shigella flexneri 2a str. 2457T
acccuaaagcacc

SEQ ID NO: 3867285 - RNA, 14 nt, Shigella flexneri 2a str. 2457T
acccuaacaucauc

SEQ ID NO: 3867286 - RNA, 13 nt, Shigella flexneri 2a str. 2457T
acccuaccagcug

SEQ ID NO: 3867287 - RNA, 14 nt, Shigella flexneri 2a str. 2457T
acccuaccagcugc

SEQ ID NO: 3867288 - RNA, 13 nt, Shigella flexneri 2a str. 2457T
acccucacgcauu

SEQ ID NO: 3867289 - RNA, 17 nt, Shigella flexneri 2a str. 2457T
acccucauucaccaguu

SEQ ID NO: 3867290 - RNA, 19 nt, Shigella flexneri 2a str. 2457T
acccucuccccagaagggc

SEQ ID NO: 3867291 - RNA, 13 nt, Shigella flexneri 2a str. 2457T
acccucucccgaa

SEQ ID NO: 3867292 - RNA, 13 nt, Shigella flexneri 2a str. 2457T
acccugacccaga

SEQ ID NO: 3867293 - RNA, 16 nt, Shigella flexneri 2a str. 2457T
acccugacccagaccg

SEQ ID NO: 3867294 - RNA, 11 nt, Shigella flexneri 2a str. 2457T
acccugaguga

SEQ ID NO: 3867295 - RNA, 18 nt, Shigella flexneri 2a str. 2457T
acccugagugaauuguuu

SEQ ID NO: 3867296 - RNA, 15 nt, Shigella flexneri 2a str. 2457T
acccugaguuuucag

SEQ ID NO: 3867297 - RNA, 21 nt, Shigella flexneri 2a str. 2457T
acccugaguuuucaguaccgc

SEQ ID NO: 3867298 - RNA, 15 nt, Shigella flexneri 2a str. 2457T
acccugguucgcaac

SEQ ID NO: 3867299 - RNA, 15 nt, Shigella flexneri 2a str. 2457T
acccuguccgccaug

SEQ ID NO: 3867300 - RNA, 14 nt, Shigella flexneri 2a str. 2457T
acccugugcgccac

SEQ ID NO: 3867301 - RNA, 21 nt, Shigella flexneri 2a str. 2457T
acccuguguggugagauugcu

SEQ ID NO: 3867302 - RNA, 13 nt, Shigella flexneri 2a str. 2457T
acccuuacucacu

SEQ ID NO: 3867303 - RNA, 22 nt, Shigella flexneri 2a str. 2457T
acccuucaaucccgccaaugca

SEQ ID NO: 3867304 - RNA, 17 nt, Shigella flexneri 2a str. 2457T
acccuucauauuccuga

SEQ ID NO: 3867305 - RNA, 23 nt, Shigella flexneri 2a str. 2457T
acccuucauauuccugacccagc

SEQ ID NO: 3867306 - RNA, 12 nt, Shigella flexneri 2a str. 2457T
acccuucuucca

SEQ ID NO: 3867307 - RNA, 16 nt, Shigella flexneri 2a str. 2457T
acccuugcguuucuga

SEQ ID NO: 3867308 - RNA, 13 nt, Shigella flexneri 2a str. 2457T
accgaaaucgcca

SEQ ID NO: 3867309 - RNA, 15 nt, Shigella flexneri 2a str. 2457T
accgaacaaaacagc

SEQ ID NO: 3867310 - RNA, 16 nt, Shigella flexneri 2a str. 2457T
accgaaccuguuuuca

SEQ ID NO: 3867311 - RNA, 23 nt, Shigella flexneri 2a str. 2457T
accgaaguggacgaacaguucaa

SEQ ID NO: 3867312 - RNA, 22 nt, Shigella flexneri 2a str. 2457T
accgaaguguuuaaauuucuug

SEQ ID NO: 3867313 - RNA, 12 nt, Shigella flexneri 2a str. 2457T
accgaaguugua

SEQ ID NO: 3867314 - RNA, 24 nt, Shigella flexneri 2a str. 2457T
accgaauucaaauccuucagacua

SEQ ID NO: 3867315 - RNA, 15 nt, Shigella flexneri 2a str. 2457T
accgacaauccggua

SEQ ID NO: 3867316 - RNA, 21 nt, Shigella flexneri 2a str. 2457T
accgacuccgacgcagugggu

SEQ ID NO: 3867317 - RNA, 19 nt, Shigella flexneri 2a str. 2457T
accgacugcggccugaguu

SEQ ID NO: 3867318 - RNA, 21 nt, Shigella flexneri 2a str. 2457T
accgacuggcuccgggaaaac

SEQ ID NO: 3867319 - RNA, 12 nt, Shigella flexneri 2a str. 2457T
accgagaaaauc

SEQ ID NO: 3867320 - RNA, 15 nt, Shigella flexneri 2a str. 2457T
accgagaaaaucauc

SEQ ID NO: 3867321 - RNA, 23 nt, Shigella flexneri 2a str. 2457T
accgaggccaaaaccacagugac

SEQ ID NO: 3867322 - RNA, 17 nt, Shigella flexneri 2a str. 2457T
accgauaaaagcccugg

SEQ ID NO: 3867323 - RNA, 21 nt, Shigella flexneri 2a str. 2457T
accgauccccggauucaugcu

SEQ ID NO: 3867324 - RNA, 22 nt, Shigella flexneri 2a str. 2457T
accgauccccggauucaugcua

SEQ ID NO: 3867325 - RNA, 12 nt, Shigella flexneri 2a str. 2457T
accgauccggca

SEQ ID NO: 3867326 - RNA, 19 nt, Shigella flexneri 2a str. 2457T
accgauccggcaccaaugu

SEQ ID NO: 3867327 - RNA, 16 nt, Shigella flexneri 2a str. 2457T
accgaucgccagcagg

SEQ ID NO: 3867328 - RNA, 17 nt, Shigella flexneri 2a str. 2457T
accgaucgccagcaggg

SEQ ID NO: 3867329 - RNA, 19 nt, Shigella flexneri 2a str. 2457T
accgaugcaaucuguuuau

SEQ ID NO: 3867330 - RNA, 21 nt, Shigella flexneri 2a str. 2457T
accgauggcaaacaaacugcg

SEQ ID NO: 3867331 - RNA, 12 nt, Shigella flexneri 2a str. 2457T
accgauucccag

SEQ ID NO: 3867332 - RNA, 15 nt, Shigella flexneri 2a str. 2457T
accgauuucacccac

SEQ ID NO: 3867333 - RNA, 20 nt, Shigella flexneri 2a str. 2457T
accgauuuucagccaucauc

SEQ ID NO: 3867334 - RNA, 15 nt, Shigella flexneri 2a str. 2457T
accgauuuuguaaaa

SEQ ID NO: 3867335 - RNA, 21 nt, Shigella flexneri 2a str. 2457T
accgcaaacugccguugcugc

SEQ ID NO: 3867336 - RNA, 23 nt, Shigella flexneri 2a str. 2457T
accgcaaagguugcugcgcccca

SEQ ID NO: 3867337 - RNA, 20 nt, Shigella flexneri 2a str. 2457T
accgcaaaugauuagugcca

SEQ ID NO: 3867338 - RNA, 15 nt, Shigella flexneri 2a str. 2457T
accgcaacucauuua

SEQ ID NO: 3867339 - RNA, 17 nt, Shigella flexneri 2a str. 2457T
accgcaagccaaauaca

SEQ ID NO: 3867340 - RNA, 23 nt, Shigella flexneri 2a str. 2457T
accgcaauaaccaucagcucugg

SEQ ID NO: 3867341 - RNA, 13 nt, Shigella flexneri 2a str. 2457T
accgcaccaccag

SEQ ID NO: 3867342 - RNA, 14 nt, Shigella flexneri 2a str. 2457T
accgcaccaccagc

SEQ ID NO: 3867343 - RNA, 13 nt, Shigella flexneri 2a str. 2457T
accgcaccgcccg

SEQ ID NO: 3867344 - RNA, 19 nt, Shigella flexneri 2a str. 2457T
accgcacgcagaaucucug

SEQ ID NO: 3867345 - RNA, 15 nt, Shigella flexneri 2a str. 2457T
accgcacgcaggcca

SEQ ID NO: 3867346 - RNA, 19 nt, Shigella flexneri 2a str. 2457T
accgcagcaucgucaucag

SEQ ID NO: 3867347 - RNA, 13 nt, Shigella flexneri 2a str. 2457T
accgcagcccaga

SEQ ID NO: 3867348 - RNA, 13 nt, Shigella flexneri 2a str. 2457T
accgcaggcuuuu

SEQ ID NO: 3867349 - RNA, 19 nt, Shigella flexneri 2a str. 2457T
accgcauuggacagauuca

SEQ ID NO: 3867350 - RNA, 16 nt, Shigella flexneri 2a str. 2457T
accgccaaagauaaaa

SEQ ID NO: 3867351 - RNA, 16 nt, Shigella flexneri 2a str. 2457T
accgccacagcagccu

SEQ ID NO: 3867352 - RNA, 13 nt, Shigella flexneri 2a str. 2457T
accgccaccaccg

SEQ ID NO: 3867353 - RNA, 18 nt, Shigella flexneri 2a str. 2457T
accgccaccaccgaugau

SEQ ID NO: 3867354 - RNA, 18 nt, Shigella flexneri 2a str. 2457T
accgccaccagcgucaga

SEQ ID NO: 3867355 - RNA, 17 nt, Shigella flexneri 2a str. 2457T
accgccacuaccaucag

SEQ ID NO: 3867356 - RNA, 13 nt, Shigella flexneri 2a str. 2457T
accgccagcaagg

SEQ ID NO: 3867357 - RNA, 16 nt, Shigella flexneri 2a str. 2457T
accgccauauuuaaag

SEQ ID NO: 3867358 - RNA, 15 nt, Shigella flexneri 2a str. 2457T
accgccaucauggau

SEQ ID NO: 3867359 - RNA, 16 nt, Shigella flexneri 2a str. 2457T
accgccaucauggaug

SEQ ID NO: 3867360 - RNA, 14 nt, Shigella flexneri 2a str. 2457T
accgcccaccacca

SEQ ID NO: 3867361 - RNA, 18 nt, Shigella flexneri 2a str. 2457T
accgcccagaccugcguu

SEQ ID NO: 3867362 - RNA, 20 nt, Shigella flexneri 2a str. 2457T
accgcccagugccagcacca

SEQ ID NO: 3867363 - RNA, 14 nt, Shigella flexneri 2a str. 2457T
accgccccugcacu

SEQ ID NO: 3867364 - RNA, 14 nt, Shigella flexneri 2a str. 2457T
accgccccugcgcu

SEQ ID NO: 3867365 - RNA, 22 nt, Shigella flexneri 2a str. 2457T
accgcccgcgcgguaucaccac

SEQ ID NO: 3867366 - RNA, 20 nt, Shigella flexneri 2a str. 2457T
accgcccuccgguccgccgu

SEQ ID NO: 3867367 - RNA, 12 nt, Shigella flexneri 2a str. 2457T
accuaauuuuuu

SEQ ID NO: 3867368 - RNA, 21 nt, Shigella flexneri 2a str. 2457T
accuaccaucuccugcaacga

SEQ ID NO: 3867369 - RNA, 19 nt, Shigella flexneri 2a str. 2457T
accuaccugcaguucauca

SEQ ID NO: 3867370 - RNA, 21 nt, Shigella flexneri 2a str. 2457T
accuacgcuuucgaugugaac

SEQ ID NO: 3867371 - RNA, 20 nt, Shigella flexneri 2a str. 2457T
accuacuuuuuaauucagga

SEQ ID NO: 3867372 - RNA, 22 nt, Shigella flexneri 2a str. 2457T
accuacuuuuuaauucaggaaa

SEQ ID NO: 3867373 - RNA, 21 nt, Shigella flexneri 2a str. 2457T
accuagcaaacuaucugugua

SEQ ID NO: 3867374 - RNA, 22 nt, Shigella flexneri 2a str. 2457T
accuaugccgaucaauuucaca

SEQ ID NO: 3867375 - RNA, 11 nt, Shigella flexneri 2a str. 2457T
accucaccgcu

SEQ ID NO: 3867376 - RNA, 22 nt, Shigella flexneri 2a str. 2457T
accucaccgggcuuggcaccau

SEQ ID NO: 3867377 - RNA, 22 nt, Shigella flexneri 2a str. 2457T
accucacuuucuggcagcugcg

SEQ ID NO: 3867378 - RNA, 12 nt, Shigella flexneri 2a str. 2457T
accucagcaagu

SEQ ID NO: 3867379 - RNA, 12 nt, Shigella flexneri 2a str. 2457T
accucagcgaac

SEQ ID NO: 3867380 - RNA, 15 nt, Shigella flexneri 2a str. 2457T
accucaggcaccuuc

SEQ ID NO: 3867381 - RNA, 17 nt, Shigella flexneri 2a str. 2457T
accucaucagacaccag

SEQ ID NO: 3867382 - RNA, 20 nt, Shigella flexneri 2a str. 2457T
accucauuaagaugcauuua

SEQ ID NO: 3867383 - RNA, 20 nt, Shigella flexneri 2a str. 2457T
accuccagccugaugaugag

SEQ ID NO: 3867384 - RNA, 19 nt, Shigella flexneri 2a str. 2457T
accuccagcgaaggaucac

SEQ ID NO: 3867385 - RNA, 22 nt, Shigella flexneri 2a str. 2457T
accuccagcgaaggaucacccc

SEQ ID NO: 3867386 - RNA, 23 nt, Shigella flexneri 2a str. 2457T
accucccgucgcccacaccagau

SEQ ID NO: 3867387 - RNA, 15 nt, Shigella flexneri 2a str. 2457T
accuccguuuuucug

SEQ ID NO: 3867388 - RNA, 23 nt, Shigella flexneri 2a str. 2457T
accuccuggaucacaauccgcuc

SEQ ID NO: 3867389 - RNA, 14 nt, Shigella flexneri 2a str. 2457T
accuccuucacagu

SEQ ID NO: 3867390 - RNA, 15 nt, Shigella flexneri 2a str. 2457T
accucgagaucauca

SEQ ID NO: 3867391 - RNA, 19 nt, Shigella flexneri 2a str. 2457T
accucgcccauuuuucaug

SEQ ID NO: 3867392 - RNA, 19 nt, Shigella flexneri 2a str. 2457T
accucgccccgugaugaac

SEQ ID NO: 3867393 - RNA, 20 nt, Shigella flexneri 2a str. 2457T
accucgcguaaagaguugau

SEQ ID NO: 3867394 - RNA, 13 nt, Shigella flexneri 2a str. 2457T
accucguccuguu

SEQ ID NO: 3867395 - RNA, 17 nt, Shigella flexneri 2a str. 2457T
accucugcugcugcguu

SEQ ID NO: 3867396 - RNA, 21 nt, Shigella flexneri 2a str. 2457T
accucuggcgaauagaaagca

SEQ ID NO: 3867397 - RNA, 20 nt, Shigella flexneri 2a str. 2457T
accucuuaaugcaggcagca

SEQ ID NO: 3867398 - RNA, 22 nt, Shigella flexneri 2a str. 2457T
accucuuucgcacgaaccguaa

SEQ ID NO: 3867399 - RNA, 11 nt, Shigella flexneri 2a str. 2457T
accugaacucg

SEQ ID NO: 3867400 - RNA, 13 nt, Shigella flexneri 2a str. 2457T
accugaauauuag

SEQ ID NO: 3867401 - RNA, 15 nt, Shigella flexneri 2a str. 2457T
accugaaucgucaga

SEQ ID NO: 3867402 - RNA, 14 nt, Shigella flexneri 2a str. 2457T
accugacauuaagu

SEQ ID NO: 3867403 - RNA, 13 nt, Shigella flexneri 2a str. 2457T
accugaccgcgag

SEQ ID NO: 3867404 - RNA, 13 nt, Shigella flexneri 2a str. 2457T
accugacugugac

SEQ ID NO: 3867405 - RNA, 19 nt, Shigella flexneri 2a str. 2457T
accugacuguuccagcacg

SEQ ID NO: 3867406 - RNA, 23 nt, Shigella flexneri 2a str. 2457T
accugagcuugauccuacacaua

SEQ ID NO: 3867407 - RNA, 15 nt, Shigella flexneri 2a str. 2457T
accugagucaucaac

SEQ ID NO: 3867408 - RNA, 15 nt, Shigella flexneri 2a str. 2457T
accugauccagcucu

SEQ ID NO: 3867409 - RNA, 16 nt, Shigella flexneri 2a str. 2457T
accugauccagcucuu

SEQ ID NO: 3867410 - RNA, 20 nt, Shigella flexneri 2a str. 2457T
accugauccagcucuucuuc

SEQ ID NO: 3867411 - RNA, 23 nt, Shigella flexneri 2a str. 2457T
accugauuaccgugaaucaccac

SEQ ID NO: 3867412 - RNA, 16 nt, Shigella flexneri 2a str. 2457T
accugauuacgcaccg

SEQ ID NO: 3867413 - RNA, 18 nt, Shigella flexneri 2a str. 2457T
accugcaaauucaauaaa

SEQ ID NO: 3867414 - RNA, 22 nt, Shigella flexneri 2a str. 2457T
accugcaaauucaauaaauugc

SEQ ID NO: 3867415 - RNA, 22 nt, Shigella flexneri 2a str. 2457T
accugcacaaauagccagcaga

SEQ ID NO: 3867416 - RNA, 22 nt, Shigella flexneri 2a str. 2457T
accugcacguuagcccuuugua

SEQ ID NO: 3867417 - RNA, 20 nt, Shigella flexneri 2a str. 2457T
accugcaguucaucaacgcc

SEQ ID NO: 3867418 - RNA, 21 nt, Shigella flexneri 2a str. 2457T
accugccagcgccgacagcag

SEQ ID NO: 3867419 - RNA, 13 nt, Shigella flexneri 2a str. 2457T
accugccagggag

SEQ ID NO: 3867420 - RNA, 23 nt, Shigella flexneri 2a str. 2457T
accugccaggugagauccgggaa

SEQ ID NO: 3867421 - RNA, 19 nt, Shigella flexneri 2a str. 2457T
accugcccgguauccauca

SEQ ID NO: 3867422 - RNA, 14 nt, Shigella flexneri 2a str. 2457T
accugcccuccggu

SEQ ID NO: 3867423 - RNA, 15 nt, Shigella flexneri 2a str. 2457T
accugcccuccggua

SEQ ID NO: 3867424 - RNA, 14 nt, Shigella flexneri 2a str. 2457T
accugccuggcagu

SEQ ID NO: 3867425 - RNA, 14 nt, Shigella flexneri 2a str. 2457T
accugccuuacaua

SEQ ID NO: 3867426 - RNA, 20 nt, Shigella flexneri 2a str. 2457T
accugcgccugcaccauugc

SEQ ID NO: 3867427 - RNA, 17 nt, Shigella flexneri 2a str. 2457T
accugcgggaugguugg

SEQ ID NO: 3867428 - RNA, 13 nt, Shigella flexneri 2a str. 2457T
accugcguucagc

SEQ ID NO: 3867429 - RNA, 17 nt, Shigella flexneri 2a str. 2457T
accugcucgucauccgc

SEQ ID NO: 3867430 - RNA, 18 nt, Shigella flexneri 2a str. 2457T
accugcuggaaaggccgc

SEQ ID NO: 3867431 - RNA, 20 nt, Shigella flexneri 2a str. 2457T
accugcuggaaaggccgcga

SEQ ID NO: 3867432 - RNA, 22 nt, Shigella flexneri 2a str. 2457T
accugcuggacgcgccaacaaa

SEQ ID NO: 3867433 - RNA, 18 nt, Shigella flexneri 2a str. 2457T
accugcuuaacgagcgca

SEQ ID NO: 3867434 - RNA, 22 nt, Shigella flexneri 2a str. 2457T
accugcuuaauaucccuuccuc

SEQ ID NO: 3867435 - RNA, 16 nt, Shigella flexneri 2a str. 2457T
accugcuuuguucagc

SEQ ID NO: 3867436 - RNA, 19 nt, Shigella flexneri 2a str. 2457T
accugcuuuguucagcccu

SEQ ID NO: 3867437 - RNA, 18 nt, Shigella flexneri 2a str. 2457T
accuggaaccaggcgcga

SEQ ID NO: 3867438 - RNA, 23 nt, Shigella flexneri 2a str. 2457T
accuggaaggacucgaggagcug

SEQ ID NO: 3867439 - RNA, 16 nt, Shigella flexneri 2a str. 2457T
accuggauauugcgga

SEQ ID NO: 3867440 - RNA, 16 nt, Shigella flexneri 2a str. 2457T
accuggcgcagcugcg

SEQ ID NO: 3867441 - RNA, 17 nt, Shigella flexneri 2a str. 2457T
accuggcgcaguggaua

SEQ ID NO: 3867442 - RNA, 16 nt, Shigella flexneri 2a str. 2457T
accuggcgcuguucgg

SEQ ID NO: 3867443 - RNA, 14 nt, Shigella flexneri 2a str. 2457T
accuggcuugccgg

SEQ ID NO: 3867444 - RNA, 21 nt, Shigella flexneri 2a str. 2457T
accugggaaauccaacagacc

SEQ ID NO: 3867445 - RNA, 22 nt, Shigella flexneri 2a str. 2457T
accugggcaauggugaacugcc

SEQ ID NO: 3867446 - RNA, 18 nt, Shigella flexneri 2a str. 2457T
accugggcgaugcuggca

SEQ ID NO: 3867447 - RNA, 19 nt, Shigella flexneri 2a str. 2457T
accugggugagcgucaucg

SEQ ID NO: 3867448 - RNA, 16 nt, Shigella flexneri 2a str. 2457T
accugguccuucaucu

SEQ ID NO: 3867449 - RNA, 17 nt, Shigella flexneri 2a str. 2457T
accuggugcagcggcuc

SEQ ID NO: 3867450 - RNA, 14 nt, Shigella flexneri 2a str. 2457T
accuguaccagccc

SEQ ID NO: 3867451 - RNA, 15 nt, Shigella flexneri 2a str. 2457T
accuguaccagcccg

SEQ ID NO: 3867452 - RNA, 21 nt, Shigella flexneri 2a str. 2457T
accuguccuguaggccugaua

SEQ ID NO: 3867453 - RNA, 14 nt, Shigella flexneri 2a str. 2457T
accugucgcgucga

SEQ ID NO: 3867454 - RNA, 21 nt, Shigella flexneri 2a str. 2457T
accugugaauuucuaagcugc

SEQ ID NO: 3867455 - RNA, 16 nt, Shigella flexneri 2a str. 2457T
accugugacagcagcg

SEQ ID NO: 3867456 - RNA, 18 nt, Shigella flexneri 2a str. 2457T
accuguuccaguggcuga

SEQ ID NO: 3867457 - RNA, 13 nt, Shigella flexneri 2a str. 2457T
accuguucuccug

SEQ ID NO: 3867458 - RNA, 14 nt, Shigella flexneri 2a str. 2457T
accuguugaaauua

SEQ ID NO: 3867459 - RNA, 17 nt, Shigella flexneri 2a str. 2457T
accuguugaaauuauug

SEQ ID NO: 3867460 - RNA, 14 nt, Shigella flexneri 2a str. 2457T
accuuacccgcgac

SEQ ID NO: 3867461 - RNA, 17 nt, Shigella flexneri 2a str. 2457T
accuuacggcacuccuc

SEQ ID NO: 3867462 - RNA, 20 nt, Shigella flexneri 2a str. 2457T
accuuacggcacuccucuuc

SEQ ID NO: 3867463 - RNA, 15 nt, Shigella flexneri 2a str. 2457T
accuuacggucagua

SEQ ID NO: 3867464 - RNA, 17 nt, Shigella flexneri 2a str. 2457T
accuuaugagucagaau

SEQ ID NO: 3867465 - RNA, 19 nt, Shigella flexneri 2a str. 2457T
accuucacagaaggccagg

SEQ ID NO: 3867466 - RNA, 23 nt, Shigella flexneri 2a str. 2457T
accuucagcgaagcccacgccgc

SEQ ID NO: 3867467 - RNA, 14 nt, Shigella flexneri 2a str. 2457T
accuucaggcacaa

SEQ ID NO: 3867468 - RNA, 15 nt, Shigella flexneri 2a str. 2457T
accuucauccagcau

SEQ ID NO: 3867469 - RNA, 21 nt, Shigella flexneri 2a str. 2457T
accuuccucaccguuuaagaa

SEQ ID NO: 3867470 - RNA, 14 nt, Shigella flexneri 2a str. 2457T
accuuccuuauuuc

SEQ ID NO: 3867471 - RNA, 21 nt, Shigella flexneri 2a str. 2457T
accuucgaaugccgcagcacc

SEQ ID NO: 3867472 - RNA, 20 nt, Shigella flexneri 2a str. 2457T
accuucgccgcccagccagc

SEQ ID NO: 3867473 - RNA, 13 nt, Shigella flexneri 2a str. 2457T
accuucgcggcac

SEQ ID NO: 3867474 - RNA, 17 nt, Shigella flexneri 2a str. 2457T
accuucggauugcccug

SEQ ID NO: 3867475 - RNA, 21 nt, Shigella flexneri 2a str. 2457T
accuucgggugccuuuuuuau

SEQ ID NO: 3867476 - RNA, 19 nt, Shigella flexneri 2a str. 2457T
accuucugcgcccgcccgc

SEQ ID NO: 3867477 - RNA, 16 nt, Shigella flexneri 2a str. 2457T
accuucuucagcaaua

SEQ ID NO: 3867478 - RNA, 12 nt, Shigella flexneri 2a str. 2457T
accuucuuccca

SEQ ID NO: 3867479 - RNA, 11 nt, Shigella flexneri 2a str. 2457T
accuucuuccu

SEQ ID NO: 3867480 - RNA, 13 nt, Shigella flexneri 2a str. 2457T
accuucuuccugc

SEQ ID NO: 3867481 - RNA, 18 nt, Shigella flexneri 2a str. 2457T
accuucuuccugcgccag

SEQ ID NO: 3867482 - RNA, 14 nt, Shigella flexneri 2a str. 2457T
accuucuucuuuca

SEQ ID NO: 3867483 - RNA, 16 nt, Shigella flexneri 2a str. 2457T
accuugcggaaacugu

SEQ ID NO: 3867484 - RNA, 13 nt, Shigella flexneri 2a str. 2457T
accuuuaaacaga

SEQ ID NO: 3867485 - RNA, 23 nt, Shigella flexneri 2a str. 2457T
accuuucagauguuccgccauuu

SEQ ID NO: 3867486 - RNA, 23 nt, Shigella flexneri 2a str. 2457T
accuuucguggugagggcaaaca

SEQ ID NO: 3867487 - RNA, 21 nt, Shigella flexneri 2a str. 2457T
accuuugaacaaccagaaaga

SEQ ID NO: 3867488 - RNA, 15 nt, Shigella flexneri 2a str. 2457T
accuuugaacugcug

SEQ ID NO: 3867489 - RNA, 14 nt, Shigella flexneri 2a str. 2457T
accuuugccuucca

SEQ ID NO: 3867490 - RNA, 22 nt, Shigella flexneri 2a str. 2457T
accuuugccuuccagcgaugcc

SEQ ID NO: 3867491 - RNA, 18 nt, Shigella flexneri 2a str. 2457T
accuuugcgguuaaaaau

SEQ ID NO: 3867492 - RNA, 18 nt, Shigella flexneri 2a str. 2457T
accuuuguaugccuggca

SEQ ID NO: 3867493 - RNA, 14 nt, Shigella flexneri 2a str. 2457T
acgaaaaaucaaua

SEQ ID NO: 3867494 - RNA, 12 nt, Shigella flexneri 2a str. 2457T
acgaaaacgggc

SEQ ID NO: 3867495 - RNA, 13 nt, Shigella flexneri 2a str. 2457T
acgaaaacugcgc

SEQ ID NO: 3867496 - RNA, 16 nt, Shigella flexneri 2a str. 2457T
acgaaaccgacugcca

SEQ ID NO: 3867497 - RNA, 23 nt, Shigella flexneri 2a str. 2457T
acgaaaccgggcaauuuaaaccc

SEQ ID NO: 3867498 - RNA, 19 nt, Shigella flexneri 2a str. 2457T
acgaaaguuaauccacagc

SEQ ID NO: 3867499 - RNA, 12 nt, Shigella flexneri 2a str. 2457T
acgaaauggugu

SEQ ID NO: 3867500 - RNA, 17 nt, Shigella flexneri 2a str. 2457T
acgaacagcgauugcuu

SEQ ID NO: 3867501 - RNA, 18 nt, Shigella flexneri 2a str. 2457T
acgaaccauaaaaucaca

SEQ ID NO: 3867502 - RNA, 12 nt, Shigella flexneri 2a str. 2457T
acgaaccauuuc

SEQ ID NO: 3867503 - RNA, 18 nt, Shigella flexneri 2a str. 2457T
acgaaccgucccucgccc

SEQ ID NO: 3867504 - RNA, 13 nt, Shigella flexneri 2a str. 2457T
acgaagcggcugc

SEQ ID NO: 3867505 - RNA, 13 nt, Shigella flexneri 2a str. 2457T
acgaaguacucaa

SEQ ID NO: 3867506 - RNA, 20 nt, Shigella flexneri 2a str. 2457T
acgaauaaaacagaaaccga

SEQ ID NO: 3867507 - RNA, 17 nt, Shigella flexneri 2a str. 2457T
acgaauaccuucuuccu

SEQ ID NO: 3867508 - RNA, 19 nt, Shigella flexneri 2a str. 2457T
acgaauaguuucagccucu

SEQ ID NO: 3867509 - RNA, 15 nt, Shigella flexneri 2a str. 2457T
acgaaucuauucauu

SEQ ID NO: 3867510 - RNA, 21 nt, Shigella flexneri 2a str. 2457T
acgaaucuauucauuuauguu

SEQ ID NO: 3867511 - RNA, 21 nt, Shigella flexneri 2a str. 2457T
acgaaugacauaaugcaaaau

SEQ ID NO: 3867512 - RNA, 17 nt, Shigella flexneri 2a str. 2457T
acgaaugacugauugcc

SEQ ID NO: 3867513 - RNA, 13 nt, Shigella flexneri 2a str. 2457T
acgaauuaucacu

SEQ ID NO: 3867514 - RNA, 16 nt, Shigella flexneri 2a str. 2457T
acgaauuccaagcaga

SEQ ID NO: 3867515 - RNA, 14 nt, Shigella flexneri 2a str. 2457T
acgaauugcaggac

SEQ ID NO: 3867516 - RNA, 21 nt, Shigella flexneri 2a str. 2457T
acgacaaaaauaccaccaaug

SEQ ID NO: 3867517 - RNA, 20 nt, Shigella flexneri 2a str. 2457T
acgacaacgcggcacagcaa

SEQ ID NO: 3867518 - RNA, 21 nt, Shigella flexneri 2a str. 2457T
acgacaaggcaggcaucaaug

SEQ ID NO: 3867519 - RNA, 20 nt, Shigella flexneri 2a str. 2457T
acgacaaucaaccagcacuu

SEQ ID NO: 3867520 - RNA, 22 nt, Shigella flexneri 2a str. 2457T
acgacaaucucaauuuucacuu

SEQ ID NO: 3867521 - RNA, 12 nt, Shigella flexneri 2a str. 2457T
acgacaccaucu

SEQ ID NO: 3867522 - RNA, 23 nt, Shigella flexneri 2a str. 2457T
acgacaccuuucacgccgaagug

SEQ ID NO: 3867523 - RNA, 17 nt, Shigella flexneri 2a str. 2457T
acgacauuuucugccca

SEQ ID NO: 3867524 - RNA, 14 nt, Shigella flexneri 2a str. 2457T
acgaccacccaccg

SEQ ID NO: 3867525 - RNA, 23 nt, Shigella flexneri 2a str. 2457T
acgaccacucuuucgacggcauc

SEQ ID NO: 3867526 - RNA, 13 nt, Shigella flexneri 2a str. 2457T
acgaccaucagcu

SEQ ID NO: 3867527 - RNA, 18 nt, Shigella flexneri 2a str. 2457T
acgaccaucagcugccag

SEQ ID NO: 3867528 - RNA, 21 nt, Shigella flexneri 2a str. 2457T
acgaccgcuuuugucggcacu

SEQ ID NO: 3867529 - RNA, 19 nt, Shigella flexneri 2a str. 2457T
acgaccguuccauucaaac

SEQ ID NO: 3867530 - RNA, 22 nt, Shigella flexneri 2a str. 2457T
acgaccuguaccuucagcggca

SEQ ID NO: 3867531 - RNA, 18 nt, Shigella flexneri 2a str. 2457T
acgacgcugaugucagca

SEQ ID NO: 3867532 - RNA, 15 nt, Shigella flexneri 2a str. 2457T
acgacgguuuccacc

SEQ ID NO: 3867533 - RNA, 16 nt, Shigella flexneri 2a str. 2457T
acgacgguuuccaccg

SEQ ID NO: 3867534 - RNA, 14 nt, Shigella flexneri 2a str. 2457T
acgacguaccagcg

SEQ ID NO: 3867535 - RNA, 13 nt, Shigella flexneri 2a str. 2457T
acgacgugccgca

SEQ ID NO: 3867536 - RNA, 20 nt, Shigella flexneri 2a str. 2457T
acgacucaaaucacgcaguu

SEQ ID NO: 3867537 - RNA, 15 nt, Shigella flexneri 2a str. 2457T
acgacugcgccugca

SEQ ID NO: 3867538 - RNA, 15 nt, Shigella flexneri 2a str. 2457T
acgacuugaaaaagu

SEQ ID NO: 3867539 - RNA, 14 nt, Shigella flexneri 2a str. 2457T
acgacuuuuuccau

SEQ ID NO: 3867540 - RNA, 13 nt, Shigella flexneri 2a str. 2457T
acgagaaaagcca

SEQ ID NO: 3867541 - RNA, 23 nt, Shigella flexneri 2a str. 2457T
acgagacgguuaaaaacagccag

SEQ ID NO: 3867542 - RNA, 22 nt, Shigella flexneri 2a str. 2457T
acgagagccggaagaauuucau

SEQ ID NO: 3867543 - RNA, 18 nt, Shigella flexneri 2a str. 2457T
acgagcccuucggggcua

SEQ ID NO: 3867544 - RNA, 16 nt, Shigella flexneri 2a str. 2457T
acgagcgcaaugaaaa

SEQ ID NO: 3867545 - RNA, 16 nt, Shigella flexneri 2a str. 2457T
acgaggcgcuggcgca

SEQ ID NO: 3867546 - RNA, 18 nt, Shigella flexneri 2a str. 2457T
acgaggggagaccucacu

SEQ ID NO: 3867547 - RNA, 18 nt, Shigella flexneri 2a str. 2457T
acgagucaacgcuucagc

SEQ ID NO: 3867548 - RNA, 18 nt, Shigella flexneri 2a str. 2457T
acgagucacaaacaucau

SEQ ID NO: 3867549 - RNA, 23 nt, Shigella flexneri 2a str. 2457T
acgagugcaucugguaagugcca

SEQ ID NO: 3867550 - RNA, 18 nt, Shigella flexneri 2a str. 2457T
acgaguggugucgucaaa

SEQ ID NO: 3867551 - RNA, 13 nt, Shigella flexneri 2a str. 2457T
acgauaauucagc

SEQ ID NO: 3867552 - RNA, 15 nt, Shigella flexneri 2a str. 2457T
acgauacagaagcac

SEQ ID NO: 3867553 - RNA, 14 nt, Shigella flexneri 2a str. 2457T
acgauauuuuuccg

SEQ ID NO: 3867554 - RNA, 22 nt, Shigella flexneri 2a str. 2457T
acgauauuuuuccggcaguucu

SEQ ID NO: 3867555 - RNA, 22 nt, Shigella flexneri 2a str. 2457T
acgaucaagauugauccccgcu

SEQ ID NO: 3867556 - RNA, 21 nt, Shigella flexneri 2a str. 2457T
acgaucaucgacaguaccagc

SEQ ID NO: 3867557 - RNA, 23 nt, Shigella flexneri 2a str. 2457T
acgaucaucgacaguaccagcag

SEQ ID NO: 3867558 - RNA, 14 nt, Shigella flexneri 2a str. 2457T
acgauccaccaccg

SEQ ID NO: 3867559 - RNA, 19 nt, Shigella flexneri 2a str. 2457T
acgauccuucaaacguuuu

SEQ ID NO: 3867560 - RNA, 19 nt, Shigella flexneri 2a str. 2457T
acgaucgauaaccaucuuc

SEQ ID NO: 3867561 - RNA, 13 nt, Shigella flexneri 2a str. 2457T
acgccccacaaac

SEQ ID NO: 3867562 - RNA, 21 nt, Shigella flexneri 2a str. 2457T
acgccccacaaacccgccaga

SEQ ID NO: 3867563 - RNA, 17 nt, Shigella flexneri 2a str. 2457T
acgccccacagacccag

SEQ ID NO: 3867564 - RNA, 19 nt, Shigella flexneri 2a str. 2457T
acgccccacagacccaggu

SEQ ID NO: 3867565 - RNA, 14 nt, Shigella flexneri 2a str. 2457T
acgccccagauugc

SEQ ID NO: 3867566 - RNA, 15 nt, Shigella flexneri 2a str. 2457T
acgccccagauugcc

SEQ ID NO: 3867567 - RNA, 17 nt, Shigella flexneri 2a str. 2457T
acgccccgguuucucuu

SEQ ID NO: 3867568 - RNA, 19 nt, Shigella flexneri 2a str. 2457T
acgcccgcauaugcgggcg

SEQ ID NO: 3867569 - RNA, 14 nt, Shigella flexneri 2a str. 2457T
acgcccgccgacca

SEQ ID NO: 3867570 - RNA, 20 nt, Shigella flexneri 2a str. 2457T
acgcccgucaacggugccau

SEQ ID NO: 3867571 - RNA, 22 nt, Shigella flexneri 2a str. 2457T
acgcccguuguuuuauuuaugu

SEQ ID NO: 3867572 - RNA, 18 nt, Shigella flexneri 2a str. 2457T
acgcccuacaaggaacgg

SEQ ID NO: 3867573 - RNA, 19 nt, Shigella flexneri 2a str. 2457T
acgcccugcgcuggugaaa

SEQ ID NO: 3867574 - RNA, 13 nt, Shigella flexneri 2a str. 2457T
acgccgaagugcg

SEQ ID NO: 3867575 - RNA, 15 nt, Shigella flexneri 2a str. 2457T
acgccgaagugcgcg

SEQ ID NO: 3867576 - RNA, 19 nt, Shigella flexneri 2a str. 2457T
acgccgaauaacgcgcagc

SEQ ID NO: 3867577 - RNA, 13 nt, Shigella flexneri 2a str. 2457T
acgccgaaucagu

SEQ ID NO: 3867578 - RNA, 15 nt, Shigella flexneri 2a str. 2457T
acgccgaccagaccg

SEQ ID NO: 3867579 - RNA, 17 nt, Shigella flexneri 2a str. 2457T
acgccgacgcccugcgc

SEQ ID NO: 3867580 - RNA, 18 nt, Shigella flexneri 2a str. 2457T
acgccgacgcccugcgcu

SEQ ID NO: 3867581 - RNA, 20 nt, Shigella flexneri 2a str. 2457T
acgccgacgggucagcgggg

SEQ ID NO: 3867582 - RNA, 19 nt, Shigella flexneri 2a str. 2457T
acgccgagaauaaaacagg

SEQ ID NO: 3867583 - RNA, 23 nt, Shigella flexneri 2a str. 2457T
acgccgagaauaaaacaggcagc

SEQ ID NO: 3867584 - RNA, 22 nt, Shigella flexneri 2a str. 2457T
acgccgagacguuuugccaguu

SEQ ID NO: 3867585 - RNA, 16 nt, Shigella flexneri 2a str. 2457T
acgccgaggaguuuau

SEQ ID NO: 3867586 - RNA, 22 nt, Shigella flexneri 2a str. 2457T
acgccgcaauggcuucauccac

SEQ ID NO: 3867587 - RNA, 16 nt, Shigella flexneri 2a str. 2457T
acgccgcauccggcau

SEQ ID NO: 3867588 - RNA, 19 nt, Shigella flexneri 2a str. 2457T
acgccgcauccggcaugaa

SEQ ID NO: 3867589 - RNA, 17 nt, Shigella flexneri 2a str. 2457T
acgccgcauccggcauu

SEQ ID NO: 3867590 - RNA, 21 nt, Shigella flexneri 2a str. 2457T
acgccgcaucuggcauaaaca

SEQ ID NO: 3867591 - RNA, 16 nt, Shigella flexneri 2a str. 2457T
acgccgccagaccaau

SEQ ID NO: 3867592 - RNA, 21 nt, Shigella flexneri 2a str. 2457T
acgccgccagaccaauagaaa

SEQ ID NO: 3867593 - RNA, 20 nt, Shigella flexneri 2a str. 2457T
acgccgcccagagaacuggc

SEQ ID NO: 3867594 - RNA, 14 nt, Shigella flexneri 2a str. 2457T
acgccgccgagcac

SEQ ID NO: 3867595 - RNA, 21 nt, Shigella flexneri 2a str. 2457T
acgccgccgcuucgcccaaau

SEQ ID NO: 3867596 - RNA, 15 nt, Shigella flexneri 2a str. 2457T
acgccgcgcgccacc

SEQ ID NO: 3867597 - RNA, 15 nt, Shigella flexneri 2a str. 2457T
acgccgcguuugcgc

SEQ ID NO: 3867598 - RNA, 20 nt, Shigella flexneri 2a str. 2457T
acgccgcugucuaccagcac

SEQ ID NO: 3867599 - RNA, 21 nt, Shigella flexneri 2a str. 2457T
acgccgcugucuaccagcacc

SEQ ID NO: 3867600 - RNA, 22 nt, Shigella flexneri 2a str. 2457T
acgccgcugucuaccagcaccu

SEQ ID NO: 3867601 - RNA, 23 nt, Shigella flexneri 2a str. 2457T
acgccgcugucuaccagcaccug

SEQ ID NO: 3867602 - RNA, 22 nt, Shigella flexneri 2a str. 2457T
acgccgcuuuuuuuacgucugc

SEQ ID NO: 3867603 - RNA, 18 nt, Shigella flexneri 2a str. 2457T
acgccgggaaauuuuucc

SEQ ID NO: 3867604 - RNA, 24 nt, Shigella flexneri 2a str. 2457T
acgccgggaaauuuuuccguuuuc

SEQ ID NO: 3867605 - RNA, 22 nt, Shigella flexneri 2a str. 2457T
acgccggugaccaucagcauga

SEQ ID NO: 3867606 - RNA, 15 nt, Shigella flexneri 2a str. 2457T
acgccguaaguaagg

SEQ ID NO: 3867607 - RNA, 21 nt, Shigella flexneri 2a str. 2457T
acgccguuuuuacccagcagc

SEQ ID NO: 3867608 - RNA, 23 nt, Shigella flexneri 2a str. 2457T
acgccguuuuuacccagcagcag

SEQ ID NO: 3867609 - RNA, 12 nt, Shigella flexneri 2a str. 2457T
acgccuaauaaa

SEQ ID NO: 3867610 - RNA, 15 nt, Shigella flexneri 2a str. 2457T
acgccuaauccagcc

SEQ ID NO: 3867611 - RNA, 22 nt, Shigella flexneri 2a str. 2457T
acgccuaaugccagcgauaucg

SEQ ID NO: 3867612 - RNA, 15 nt, Shigella flexneri 2a str. 2457T
acgccucguaaugcu

SEQ ID NO: 3867613 - RNA, 14 nt, Shigella flexneri 2a str. 2457T
acgccucuauuaaa

SEQ ID NO: 3867614 - RNA, 17 nt, Shigella flexneri 2a str. 2457T
acgccugauagcccgca

SEQ ID NO: 3867615 - RNA, 14 nt, Shigella flexneri 2a str. 2457T
acgccugccgcauc

SEQ ID NO: 3867616 - RNA, 21 nt, Shigella flexneri 2a str. 2457T
acgccugcgggcauuucgcuu

SEQ ID NO: 3867617 - RNA, 17 nt, Shigella flexneri 2a str. 2457T
acgccugcucuuauuac

SEQ ID NO: 3867618 - RNA, 15 nt, Shigella flexneri 2a str. 2457T
acgccuggaaagugu

SEQ ID NO: 3867619 - RNA, 19 nt, Shigella flexneri 2a str. 2457T
acgccuguuaaucagcuaa

SEQ ID NO: 3867620 - RNA, 22 nt, Shigella flexneri 2a str. 2457T
acgccuuaguuauaaacuuuuc

SEQ ID NO: 3867621 - RNA, 15 nt, Shigella flexneri 2a str. 2457T
acgccuuauccggcc

SEQ ID NO: 3867622 - RNA, 19 nt, Shigella flexneri 2a str. 2457T
acgccuuauccggccuaca

SEQ ID NO: 3867623 - RNA, 20 nt, Shigella flexneri 2a str. 2457T
acgccuuauccggccuacca

SEQ ID NO: 3867624 - RNA, 20 nt, Shigella flexneri 2a str. 2457T
acgccuuauccggccuacga

SEQ ID NO: 3867625 - RNA, 14 nt, Shigella flexneri 2a str. 2457T
acgccuucccuuuc

SEQ ID NO: 3867626 - RNA, 19 nt, Shigella flexneri 2a str. 2457T
acgccuugcggaaauucca

SEQ ID NO: 3867627 - RNA, 17 nt, Shigella flexneri 2a str. 2457T
acgccuuuaccgcgcau

SEQ ID NO: 3867628 - RNA, 22 nt, Shigella flexneri 2a str. 2457T
acgccuuugucgggcaggcuuc

SEQ ID NO: 3867629 - RNA, 21 nt, Shigella flexneri 2a str. 2457T
acgcgacaagcgucgcaucag

SEQ ID NO: 3867630 - RNA, 17 nt, Shigella flexneri 2a str. 2457T
acgcgaccaaaggcgag

SEQ ID NO: 3867631 - RNA, 13 nt, Shigella flexneri 2a str. 2457T
acgcgaccaucaa

SEQ ID NO: 3867632 - RNA, 20 nt, Shigella flexneri 2a str. 2457T
acgcgaccaucgcggaucag

SEQ ID NO: 3867633 - RNA, 13 nt, Shigella flexneri 2a str. 2457T
acgcgaccggcgu

SEQ ID NO: 3867634 - RNA, 21 nt, Shigella flexneri 2a str. 2457T
acgcgaccgugggcaauuucu

SEQ ID NO: 3867635 - RNA, 23 nt, Shigella flexneri 2a str. 2457T
acgcgauaaaagacgccgacauc

SEQ ID NO: 3867636 - RNA, 17 nt, Shigella flexneri 2a str. 2457T
acgcgauuucucaucaa

SEQ ID NO: 3867637 - RNA, 19 nt, Shigella flexneri 2a str. 2457T
acgcgauuucucaucaaau

SEQ ID NO: 3867638 - RNA, 14 nt, Shigella flexneri 2a str. 2457T
acgcgcauggccgu

SEQ ID NO: 3867639 - RNA, 15 nt, Shigella flexneri 2a str. 2457T
acgcgccaccgacca

SEQ ID NO: 3867640 - RNA, 21 nt, Shigella flexneri 2a str. 2457T
acgcgccagagagaacugcgc

SEQ ID NO: 3867641 - RNA, 16 nt, Shigella flexneri 2a str. 2457T
acgcgccagcaccgca

SEQ ID NO: 3867642 - RNA, 20 nt, Shigella flexneri 2a str. 2457T
acgcgccagcgucgcaucag

SEQ ID NO: 3867643 - RNA, 22 nt, Shigella flexneri 2a str. 2457T
acgcgccaggaucagaaugcgc

SEQ ID NO: 3867644 - RNA, 22 nt, Shigella flexneri 2a str. 2457T
acgcgcccguagucggugccau

SEQ ID NO: 3867645 - RNA, 16 nt, Shigella flexneri 2a str. 2457T
acgcgcuaaucagcuu

SEQ ID NO: 3867646 - RNA, 15 nt, Shigella flexneri 2a str. 2457T
acgcgcuccaggagu

SEQ ID NO: 3867647 - RNA, 16 nt, Shigella flexneri 2a str. 2457T
acgcggcaacggcuuc

SEQ ID NO: 3867648 - RNA, 23 nt, Shigella flexneri 2a str. 2457T
acgcggcaauaauagccccaacc

SEQ ID NO: 3867649 - RNA, 19 nt, Shigella flexneri 2a str. 2457T
acgcggcagcgucgcauca

SEQ ID NO: 3867650 - RNA, 18 nt, Shigella flexneri 2a str. 2457T
acgcggcuguugccggau

SEQ ID NO: 3867651 - RNA, 18 nt, Shigella flexneri 2a str. 2457T
acgcgggcaaucggcugc

SEQ ID NO: 3867652 - RNA, 15 nt, Shigella flexneri 2a str. 2457T
acgcgggcagcagaa

SEQ ID NO: 3867653 - RNA, 20 nt, Shigella flexneri 2a str. 2457T
acgcgggccauccaccagug

SEQ ID NO: 3867654 - RNA, 20 nt, Shigella flexneri 2a str. 2457T
acgcggguaaguacgccauc

SEQ ID NO: 3867655 - RNA, 20 nt, Shigella flexneri 2a str. 2457T
acgcgguauggucacgguga

SEQ ID NO: 3867656 - RNA, 21 nt, Shigella flexneri 2a str. 2457T
acgcguaaagcgucgcaucag

SEQ ID NO: 3867657 - RNA, 20 nt, Shigella flexneri 2a str. 2457T
acggcggaaagggccgcagu

SEQ ID NO: 3867658 - RNA, 15 nt, Shigella flexneri 2a str. 2457T
acggcggagucauuc

SEQ ID NO: 3867659 - RNA, 17 nt, Shigella flexneri 2a str. 2457T
acggcgggugacuuccc

SEQ ID NO: 3867660 - RNA, 14 nt, Shigella flexneri 2a str. 2457T
acggcguaccgccg

SEQ ID NO: 3867661 - RNA, 14 nt, Shigella flexneri 2a str. 2457T
acggcgucaacacc

SEQ ID NO: 3867662 - RNA, 22 nt, Shigella flexneri 2a str. 2457T
acggcgucgauugcucaacgcc

SEQ ID NO: 3867663 - RNA, 14 nt, Shigella flexneri 2a str. 2457T
acggcgugccgucg

SEQ ID NO: 3867664 - RNA, 20 nt, Shigella flexneri 2a str. 2457T
acggcguuaacuguacaggc

SEQ ID NO: 3867665 - RNA, 22 nt, Shigella flexneri 2a str. 2457T
acggcuaaaaaaagccgccauc

SEQ ID NO: 3867666 - RNA, 17 nt, Shigella flexneri 2a str. 2457T
acggcuaucuacgcgua

SEQ ID NO: 3867667 - RNA, 14 nt, Shigella flexneri 2a str. 2457T
acggcucgcccguu

SEQ ID NO: 3867668 - RNA, 18 nt, Shigella flexneri 2a str. 2457T
acggcugauaugccagac

SEQ ID NO: 3867669 - RNA, 16 nt, Shigella flexneri 2a str. 2457T
acggcugcuaauauuu

SEQ ID NO: 3867670 - RNA, 12 nt, Shigella flexneri 2a str. 2457T
acggcuggaaca

SEQ ID NO: 3867671 - RNA, 15 nt, Shigella flexneri 2a str. 2457T
acggcugggaaauca

SEQ ID NO: 3867672 - RNA, 17 nt, Shigella flexneri 2a str. 2457T
acggcugggaaaucacc

SEQ ID NO: 3867673 - RNA, 19 nt, Shigella flexneri 2a str. 2457T
acggcugggaaaucaccac

SEQ ID NO: 3867674 - RNA, 18 nt, Shigella flexneri 2a str. 2457T
acggcugucauccagcag

SEQ ID NO: 3867675 - RNA, 21 nt, Shigella flexneri 2a str. 2457T
acggcuguuggaaucacucau

SEQ ID NO: 3867676 - RNA, 15 nt, Shigella flexneri 2a str. 2457T
acggcuuguggugaa

SEQ ID NO: 3867677 - RNA, 15 nt, Shigella flexneri 2a str. 2457T
acggcuuugcgcaug

SEQ ID NO: 3867678 - RNA, 20 nt, Shigella flexneri 2a str. 2457T
acgggaagggguucuccuua

SEQ ID NO: 3867679 - RNA, 16 nt, Shigella flexneri 2a str. 2457T
acgggcaccaguaacg

SEQ ID NO: 3867680 - RNA, 22 nt, Shigella flexneri 2a str. 2457T
acgggccauccaucaacgccag

SEQ ID NO: 3867681 - RNA, 15 nt, Shigella flexneri 2a str. 2457T
acgggcgacaaacgc

SEQ ID NO: 3867682 - RNA, 18 nt, Shigella flexneri 2a str. 2457T
acgggcgaggaaauugcg

SEQ ID NO: 3867683 - RNA, 20 nt, Shigella flexneri 2a str. 2457T
acgggcgauggaaccacaug

SEQ ID NO: 3867684 - RNA, 22 nt, Shigella flexneri 2a str. 2457T
acgggcgcgagguaacaucccu

SEQ ID NO: 3867685 - RNA, 17 nt, Shigella flexneri 2a str. 2457T
acgggcugauuucaccc

SEQ ID NO: 3867686 - RNA, 18 nt, Shigella flexneri 2a str. 2457T
acggggacuccacaccgg

SEQ ID NO: 3867687 - RNA, 18 nt, Shigella flexneri 2a str. 2457T
acggggugcgguaaaacc

SEQ ID NO: 3867688 - RNA, 19 nt, Shigella flexneri 2a str. 2457T
acgggguugugauuacagg

SEQ ID NO: 3867689 - RNA, 23 nt, Shigella flexneri 2a str. 2457T
acgggguugugauuacaggaugc

SEQ ID NO: 3867690 - RNA, 19 nt, Shigella flexneri 2a str. 2457T
acggguaaaacgugccauu

SEQ ID NO: 3867691 - RNA, 20 nt, Shigella flexneri 2a str. 2457T
acggguaaaacgugccauua

SEQ ID NO: 3867692 - RNA, 19 nt, Shigella flexneri 2a str. 2457T
acgggugagggcguagaga

SEQ ID NO: 3867693 - RNA, 15 nt, Shigella flexneri 2a str. 2457T
acggguuuuccccuu

SEQ ID NO: 3867694 - RNA, 23 nt, Shigella flexneri 2a str. 2457T
acgguaaggacauuauucagcga

SEQ ID NO: 3867695 - RNA, 18 nt, Shigella flexneri 2a str. 2457T
acgguaaguucacgcagg

SEQ ID NO: 3867696 - RNA, 16 nt, Shigella flexneri 2a str. 2457T
acgguaauaaaugccg

SEQ ID NO: 3867697 - RNA, 12 nt, Shigella flexneri 2a str. 2457T
acgguaauacaa

SEQ ID NO: 3867698 - RNA, 17 nt, Shigella flexneri 2a str. 2457T
acgguaccaguacgccc

SEQ ID NO: 3867699 - RNA, 21 nt, Shigella flexneri 2a str. 2457T
acgguacucaucacgucgccu

SEQ ID NO: 3867700 - RNA, 16 nt, Shigella flexneri 2a str. 2457T
acgguaguugaacucg

SEQ ID NO: 3867701 - RNA, 13 nt, Shigella flexneri 2a str. 2457T
acgguccggcauc

SEQ ID NO: 3867702 - RNA, 21 nt, Shigella flexneri 2a str. 2457T
acggucgaggcaaccagcacg

SEQ ID NO: 3867703 - RNA, 17 nt, Shigella flexneri 2a str. 2457T
acggugaaaaucaaucu

SEQ ID NO: 3867704 - RNA, 22 nt, Shigella flexneri 2a str. 2457T
acggugaagaagcggaaaucac

SEQ ID NO: 3867705 - RNA, 17 nt, Shigella flexneri 2a str. 2457T
acggugauaaucauccc

SEQ ID NO: 3867706 - RNA, 16 nt, Shigella flexneri 2a str. 2457T
acggugcaccgcaucg

SEQ ID NO: 3867707 - RNA, 17 nt, Shigella flexneri 2a str. 2457T
acgguuaaaaacagcca

SEQ ID NO: 3867708 - RNA, 14 nt, Shigella flexneri 2a str. 2457T
acgguucagcgucg

SEQ ID NO: 3867709 - RNA, 22 nt, Shigella flexneri 2a str. 2457T
acgguucauuggguucaucuga

SEQ ID NO: 3867710 - RNA, 15 nt, Shigella flexneri 2a str. 2457T
acgguucgugcuaac

SEQ ID NO: 3867711 - RNA, 16 nt, Shigella flexneri 2a str. 2457T
acgguugaugccguuc

SEQ ID NO: 3867712 - RNA, 17 nt, Shigella flexneri 2a str. 2457T
acgguugcggcuuacca

SEQ ID NO: 3867713 - RNA, 17 nt, Shigella flexneri 2a str. 2457T
acgguuuuuugaacaga

SEQ ID NO: 3867714 - RNA, 15 nt, Shigella flexneri 2a str. 2457T
acguaaacgcagcau

SEQ ID NO: 3867715 - RNA, 15 nt, Shigella flexneri 2a str. 2457T
acguaacaaaacuca

SEQ ID NO: 3867716 - RNA, 14 nt, Shigella flexneri 2a str. 2457T
acguaacagagcau

SEQ ID NO: 3867717 - RNA, 16 nt, Shigella flexneri 2a str. 2457T
acguaaugucggugaa

SEQ ID NO: 3867718 - RNA, 22 nt, Shigella flexneri 2a str. 2457T
acguaauuuauaaucuuuaaaa

SEQ ID NO: 3867719 - RNA, 14 nt, Shigella flexneri 2a str. 2457T
acguaccaacugau

SEQ ID NO: 3867720 - RNA, 20 nt, Shigella flexneri 2a str. 2457T
acguaccacgcacagcccgc

SEQ ID NO: 3867721 - RNA, 22 nt, Shigella flexneri 2a str. 2457T
acguagcaauucggauguuagu

SEQ ID NO: 3867722 - RNA, 12 nt, Shigella flexneri 2a str. 2457T
acguagcaccga

SEQ ID NO: 3867723 - RNA, 22 nt, Shigella flexneri 2a str. 2457T
acguagcuauauuuugccggac

SEQ ID NO: 3867724 - RNA, 14 nt, Shigella flexneri 2a str. 2457T
acguaggccugaua

SEQ ID NO: 3867725 - RNA, 16 nt, Shigella flexneri 2a str. 2457T
acguaggcgaucccgg

SEQ ID NO: 3867726 - RNA, 18 nt, Shigella flexneri 2a str. 2457T
acguagugaaaucgccaa

SEQ ID NO: 3867727 - RNA, 21 nt, Shigella flexneri 2a str. 2457T
acguaguugcccuuuucacca

SEQ ID NO: 3867728 - RNA, 22 nt, Shigella flexneri 2a str. 2457T
acguaguugcccuuuucaccau

SEQ ID NO: 3867729 - RNA, 14 nt, Shigella flexneri 2a str. 2457T
acguauuauauaua

SEQ ID NO: 3867730 - RNA, 19 nt, Shigella flexneri 2a str. 2457T
acgucaaauaauuccugcg

SEQ ID NO: 3867731 - RNA, 14 nt, Shigella flexneri 2a str. 2457T
acgucaacuuuguu

SEQ ID NO: 3867732 - RNA, 15 nt, Shigella flexneri 2a str. 2457T
acgucaauggugaga

SEQ ID NO: 3867733 - RNA, 16 nt, Shigella flexneri 2a str. 2457T
acgucagcacaaacau

SEQ ID NO: 3867734 - RNA, 16 nt, Shigella flexneri 2a str. 2457T
acgucaugaugaugcc

SEQ ID NO: 3867735 - RNA, 22 nt, Shigella flexneri 2a str. 2457T
acguccagccaggaaucagaua

SEQ ID NO: 3867736 - RNA, 15 nt, Shigella flexneri 2a str. 2457T
acgucccaugaugcg

SEQ ID NO: 3867737 - RNA, 14 nt, Shigella flexneri 2a str. 2457T
acguccccugggga

SEQ ID NO: 3867738 - RNA, 22 nt, Shigella flexneri 2a str. 2457T
acgucgauauaauugaccagau

SEQ ID NO: 3867739 - RNA, 22 nt, Shigella flexneri 2a str. 2457T
acgucgauuucuggguggcguu

SEQ ID NO: 3867740 - RNA, 18 nt, Shigella flexneri 2a str. 2457T
acgucgauuuuuaaugaa

SEQ ID NO: 3867741 - RNA, 23 nt, Shigella flexneri 2a str. 2457T
acgucgcgcgauguuuggcggau

SEQ ID NO: 3867742 - RNA, 22 nt, Shigella flexneri 2a str. 2457T
acgucgcuuuauagguggcaaa

SEQ ID NO: 3867743 - RNA, 15 nt, Shigella flexneri 2a str. 2457T
acgucgucaggcaac

SEQ ID NO: 3867744 - RNA, 14 nt, Shigella flexneri 2a str. 2457T
acgucgucgucuuc

SEQ ID NO: 3867745 - RNA, 19 nt, Shigella flexneri 2a str. 2457T
acgucguuccccauuaccu

SEQ ID NO: 3867746 - RNA, 13 nt, Shigella flexneri 2a str. 2457T
acgucuccaucaa

SEQ ID NO: 3867747 - RNA, 17 nt, Shigella flexneri 2a str. 2457T
acgucuccgcccaaacu

SEQ ID NO: 3867748 - RNA, 17 nt, Shigella flexneri 2a str. 2457T
acgucuccggugcuuua

SEQ ID NO: 3867749 - RNA, 15 nt, Shigella flexneri 2a str. 2457T
acgucuuaauguaau

SEQ ID NO: 3867750 - RNA, 20 nt, Shigella flexneri 2a str. 2457T
acgucuugcugauaagugau

SEQ ID NO: 3867751 - RNA, 17 nt, Shigella flexneri 2a str. 2457T
acgugacaaaaauugcg

SEQ ID NO: 3867752 - RNA, 13 nt, Shigella flexneri 2a str. 2457T
acgugacagcaua

SEQ ID NO: 3867753 - RNA, 17 nt, Shigella flexneri 2a str. 2457T
acgugacagcauaccuu

SEQ ID NO: 3867754 - RNA, 13 nt, Shigella flexneri 2a str. 2457T
acuauuucuuugu

SEQ ID NO: 3867755 - RNA, 17 nt, Shigella flexneri 2a str. 2457T
acuauuucuuuguagau

SEQ ID NO: 3867756 - RNA, 14 nt, Shigella flexneri 2a str. 2457T
acucaaacagggca

SEQ ID NO: 3867757 - RNA, 21 nt, Shigella flexneri 2a str. 2457T
acucaaacagggcaauuaaaa

SEQ ID NO: 3867758 - RNA, 16 nt, Shigella flexneri 2a str. 2457T
acucaaccccagccau

SEQ ID NO: 3867759 - RNA, 22 nt, Shigella flexneri 2a str. 2457T
acucaacgguucgccaucaaga

SEQ ID NO: 3867760 - RNA, 21 nt, Shigella flexneri 2a str. 2457T
acucaauaccugaugagaugc

SEQ ID NO: 3867761 - RNA, 13 nt, Shigella flexneri 2a str. 2457T
acucaaugacuuc

SEQ ID NO: 3867762 - RNA, 15 nt, Shigella flexneri 2a str. 2457T
acucaauggcauccg

SEQ ID NO: 3867763 - RNA, 19 nt, Shigella flexneri 2a str. 2457T
acucaauggcauccgccac

SEQ ID NO: 3867764 - RNA, 12 nt, Shigella flexneri 2a str. 2457T
acucaccagaca

SEQ ID NO: 3867765 - RNA, 22 nt, Shigella flexneri 2a str. 2457T
acucaccagacaucccagugca

SEQ ID NO: 3867766 - RNA, 20 nt, Shigella flexneri 2a str. 2457T
acucaccgagcagcacaaug

SEQ ID NO: 3867767 - RNA, 23 nt, Shigella flexneri 2a str. 2457T
acucaccgaugaucgccaucagu

SEQ ID NO: 3867768 - RNA, 22 nt, Shigella flexneri 2a str. 2457T
acucaccugcuuuacccagcca

SEQ ID NO: 3867769 - RNA, 16 nt, Shigella flexneri 2a str. 2457T
acucaccuuuuuuguu

SEQ ID NO: 3867770 - RNA, 16 nt, Shigella flexneri 2a str. 2457T
acucacgaaucgccuc

SEQ ID NO: 3867771 - RNA, 19 nt, Shigella flexneri 2a str. 2457T
acucacgccguuaacuuca

SEQ ID NO: 3867772 - RNA, 16 nt, Shigella flexneri 2a str. 2457T
acucagcgccugcugc

SEQ ID NO: 3867773 - RNA, 17 nt, Shigella flexneri 2a str. 2457T
acucagcgccugcugca

SEQ ID NO: 3867774 - RNA, 22 nt, Shigella flexneri 2a str. 2457T
acucaguguuggauggcggcuu

SEQ ID NO: 3867775 - RNA, 18 nt, Shigella flexneri 2a str. 2457T
acucauaugcagcaucca

SEQ ID NO: 3867776 - RNA, 23 nt, Shigella flexneri 2a str. 2457T
acucaucaacguuuuuuugcuuu

SEQ ID NO: 3867777 - RNA, 15 nt, Shigella flexneri 2a str. 2457T
acucaucaccaucag

SEQ ID NO: 3867778 - RNA, 17 nt, Shigella flexneri 2a str. 2457T
acucaucuuauugauca

SEQ ID NO: 3867779 - RNA, 12 nt, Shigella flexneri 2a str. 2457T
acucauugccag

SEQ ID NO: 3867780 - RNA, 13 nt, Shigella flexneri 2a str. 2457T
acucauugccagu

SEQ ID NO: 3867781 - RNA, 15 nt, Shigella flexneri 2a str. 2457T
acucauugccagucc

SEQ ID NO: 3867782 - RNA, 13 nt, Shigella flexneri 2a str. 2457T
acucauuucugua

SEQ ID NO: 3867783 - RNA, 16 nt, Shigella flexneri 2a str. 2457T
acucauuucuguauaa

SEQ ID NO: 3867784 - RNA, 21 nt, Shigella flexneri 2a str. 2457T
acucauuucuguauaaucacc

SEQ ID NO: 3867785 - RNA, 15 nt, Shigella flexneri 2a str. 2457T
acuccaacuuacuga

SEQ ID NO: 3867786 - RNA, 12 nt, Shigella flexneri 2a str. 2457T
acuccagcagac

SEQ ID NO: 3867787 - RNA, 15 nt, Shigella flexneri 2a str. 2457T
acuccagcagaccag

SEQ ID NO: 3867788 - RNA, 21 nt, Shigella flexneri 2a str. 2457T
acuccagcagaccagcaaaaa

SEQ ID NO: 3867789 - RNA, 14 nt, Shigella flexneri 2a str. 2457T
acuccagccagagc

SEQ ID NO: 3867790 - RNA, 11 nt, Shigella flexneri 2a str. 2457T
acuccagcccu

SEQ ID NO: 3867791 - RNA, 14 nt, Shigella flexneri 2a str. 2457T
acuccagcgccagc

SEQ ID NO: 3867792 - RNA, 15 nt, Shigella flexneri 2a str. 2457T
acuccagcgcuucgc

SEQ ID NO: 3867793 - RNA, 20 nt, Shigella flexneri 2a str. 2457T
acuccagcuaucguuaucca

SEQ ID NO: 3867794 - RNA, 14 nt, Shigella flexneri 2a str. 2457T
acuccaguuucaca

SEQ ID NO: 3867795 - RNA, 14 nt, Shigella flexneri 2a str. 2457T
acuccauccagcaa

SEQ ID NO: 3867796 - RNA, 15 nt, Shigella flexneri 2a str. 2457T
acuccauccagcaac

SEQ ID NO: 3867797 - RNA, 16 nt, Shigella flexneri 2a str. 2457T
acuccauccagcaaca

SEQ ID NO: 3867798 - RNA, 13 nt, Shigella flexneri 2a str. 2457T
acuccaugaguaa

SEQ ID NO: 3867799 - RNA, 17 nt, Shigella flexneri 2a str. 2457T
acucccagaacaacccg

SEQ ID NO: 3867800 - RNA, 14 nt, Shigella flexneri 2a str. 2457T
acucccccuuucug

SEQ ID NO: 3867801 - RNA, 17 nt, Shigella flexneri 2a str. 2457T
acuccccgcaacaguga

SEQ ID NO: 3867802 - RNA, 14 nt, Shigella flexneri 2a str. 2457T
acuccccgcacaac

SEQ ID NO: 3867803 - RNA, 17 nt, Shigella flexneri 2a str. 2457T
acuccccgcacaacggc

SEQ ID NO: 3867804 - RNA, 20 nt, Shigella flexneri 2a str. 2457T
acuccccgcauuuacucuca

SEQ ID NO: 3867805 - RNA, 14 nt, Shigella flexneri 2a str. 2457T
acucccgcgccgca

SEQ ID NO: 3867806 - RNA, 16 nt, Shigella flexneri 2a str. 2457T
acuccgagaaucauaa

SEQ ID NO: 3867807 - RNA, 21 nt, Shigella flexneri 2a str. 2457T
acuccgagaaucauaaauaca

SEQ ID NO: 3867808 - RNA, 19 nt, Shigella flexneri 2a str. 2457T
acuccgccgcaucuuccca

SEQ ID NO: 3867809 - RNA, 23 nt, Shigella flexneri 2a str. 2457T
acuccggaaaaacagaggcccgc

SEQ ID NO: 3867810 - RNA, 20 nt, Shigella flexneri 2a str. 2457T
acuccggcuugaaccagcca

SEQ ID NO: 3867811 - RNA, 21 nt, Shigella flexneri 2a str. 2457T
acuccggcuugaaccagccaa

SEQ ID NO: 3867812 - RNA, 21 nt, Shigella flexneri 2a str. 2457T
acuccgguuauuauuuacuug

SEQ ID NO: 3867813 - RNA, 21 nt, Shigella flexneri 2a str. 2457T
acuccguugaaauugcugguu

SEQ ID NO: 3867814 - RNA, 15 nt, Shigella flexneri 2a str. 2457T
acuccugaaagcgaa

SEQ ID NO: 3867815 - RNA, 13 nt, Shigella flexneri 2a str. 2457T
acuccugccacca

SEQ ID NO: 3867816 - RNA, 14 nt, Shigella flexneri 2a str. 2457T
acuccugccaccac

SEQ ID NO: 3867817 - RNA, 20 nt, Shigella flexneri 2a str. 2457T
acuccugccaccacugcaau

SEQ ID NO: 3867818 - RNA, 12 nt, Shigella flexneri 2a str. 2457T
acuccuggagcg

SEQ ID NO: 3867819 - RNA, 19 nt, Shigella flexneri 2a str. 2457T
acuccuguaucgucacugg

SEQ ID NO: 3867820 - RNA, 18 nt, Shigella flexneri 2a str. 2457T
acuccuuccugaaauaga

SEQ ID NO: 3867821 - RNA, 23 nt, Shigella flexneri 2a str. 2457T
acucgauaccagauuaauuauug

SEQ ID NO: 3867822 - RNA, 22 nt, Shigella flexneri 2a str. 2457T
acucgaugcugccgucuucguu

SEQ ID NO: 3867823 - RNA, 16 nt, Shigella flexneri 2a str. 2457T
acucgauuaauucaua

SEQ ID NO: 3867824 - RNA, 19 nt, Shigella flexneri 2a str. 2457T
acucgcccccgaagagggg

SEQ ID NO: 3867825 - RNA, 24 nt, Shigella flexneri 2a str. 2457T
acucgccccgagaaaaauagcauu

SEQ ID NO: 3867826 - RNA, 15 nt, Shigella flexneri 2a str. 2457T
acucgcugccagcac

SEQ ID NO: 3867827 - RNA, 20 nt, Shigella flexneri 2a str. 2457T
acucgcuuugcccagaggau

SEQ ID NO: 3867828 - RNA, 11 nt, Shigella flexneri 2a str. 2457T
acucggcacau

SEQ ID NO: 3867829 - RNA, 17 nt, Shigella flexneri 2a str. 2457T
acucggcggcuuaaccg

SEQ ID NO: 3867830 - RNA, 20 nt, Shigella flexneri 2a str. 2457T
acucggugaccgaucgcccg

SEQ ID NO: 3867831 - RNA, 15 nt, Shigella flexneri 2a str. 2457T
acucguaagaggcgu

SEQ ID NO: 3867832 - RNA, 22 nt, Shigella flexneri 2a str. 2457T
acucgucacgucgucaggcaac

SEQ ID NO: 3867833 - RNA, 18 nt, Shigella flexneri 2a str. 2457T
acucgugcgucgcauccg

SEQ ID NO: 3867834 - RNA, 19 nt, Shigella flexneri 2a str. 2457T
acucuaccguuaaaauacg

SEQ ID NO: 3867835 - RNA, 23 nt, Shigella flexneri 2a str. 2457T
acucuacugaaggcgcauugcug

SEQ ID NO: 3867836 - RNA, 15 nt, Shigella flexneri 2a str. 2457T
acucuccuguuuaau

SEQ ID NO: 3867837 - RNA, 13 nt, Shigella flexneri 2a str. 2457T
acucucugaagua

SEQ ID NO: 3867838 - RNA, 19 nt, Shigella flexneri 2a str. 2457T
acucucuucaacacggcgc

SEQ ID NO: 3867839 - RNA, 15 nt, Shigella flexneri 2a str. 2457T
acucucuuuugcuug

SEQ ID NO: 3867840 - RNA, 15 nt, Shigella flexneri 2a str. 2457T
acucugaaaacgcug

SEQ ID NO: 3867841 - RNA, 21 nt, Shigella flexneri 2a str. 2457T
acucugaaacucgaccagcag

SEQ ID NO: 3867842 - RNA, 21 nt, Shigella flexneri 2a str. 2457T
acucugccguaccaucgccag

SEQ ID NO: 3867843 - RNA, 18 nt, Shigella flexneri 2a str. 2457T
acucugcugccacauucc

SEQ ID NO: 3867844 - RNA, 19 nt, Shigella flexneri 2a str. 2457T
acucugggcugaagaguaa

SEQ ID NO: 3867845 - RNA, 18 nt, Shigella flexneri 2a str. 2457T
acucuuauuuaaauccua

SEQ ID NO: 3867846 - RNA, 17 nt, Shigella flexneri 2a str. 2457T
acucuucguucuucuuc

SEQ ID NO: 3867847 - RNA, 23 nt, Shigella flexneri 2a str. 2457T
acucuucugaaaaggucacuccc

SEQ ID NO: 3867848 - RNA, 15 nt, Shigella flexneri 2a str. 2457T
acucuuuauugagau

SEQ ID NO: 3867849 - RNA, 17 nt, Shigella flexneri 2a str. 2457T
acucuuucaauuuguag

SEQ ID NO: 3867850 - RNA, 19 nt, Shigella flexneri 2a str. 2457T
acucuuucagcaccagccc

SEQ ID NO: 3867851 - RNA, 15 nt, Shigella flexneri 2a str. 2457T
acuggagccgcauca

SEQ ID NO: 3867852 - RNA, 17 nt, Shigella flexneri 2a str. 2457T
acuggcaaaaaccaauc

SEQ ID NO: 3867853 - RNA, 16 nt, Shigella flexneri 2a str. 2457T
acuggcaaaaucaaaa

SEQ ID NO: 3867854 - RNA, 17 nt, Shigella flexneri 2a str. 2457T
acuggcaacaauggcau

SEQ ID NO: 3867855 - RNA, 17 nt, Shigella flexneri 2a str. 2457T
acuggcaaccagaagag

SEQ ID NO: 3867856 - RNA, 23 nt, Shigella flexneri 2a str. 2457T
acuggcaauagcggacacuacca

SEQ ID NO: 3867857 - RNA, 18 nt, Shigella flexneri 2a str. 2457T
acuggcaauccagcucuu

SEQ ID NO: 3867858 - RNA, 15 nt, Shigella flexneri 2a str. 2457T
acuggcaaucgccag

SEQ ID NO: 3867859 - RNA, 20 nt, Shigella flexneri 2a str. 2457T
acuggcaugcuguccagcag

SEQ ID NO: 3867860 - RNA, 17 nt, Shigella flexneri 2a str. 2457T
acuggccgaaaaaggau

SEQ ID NO: 3867861 - RNA, 14 nt, Shigella flexneri 2a str. 2457T
acuggcgagcgcca

SEQ ID NO: 3867862 - RNA, 17 nt, Shigella flexneri 2a str. 2457T
acuggcgcgaauugccg

SEQ ID NO: 3867863 - RNA, 16 nt, Shigella flexneri 2a str. 2457T
acuggcgcgagccugu

SEQ ID NO: 3867864 - RNA, 17 nt, Shigella flexneri 2a str. 2457T
acuggcggucaugacga

SEQ ID NO: 3867865 - RNA, 16 nt, Shigella flexneri 2a str. 2457T
acuggcgguuuucuuc

SEQ ID NO: 3867866 - RNA, 16 nt, Shigella flexneri 2a str. 2457T
acuggcuacugucuaa

SEQ ID NO: 3867867 - RNA, 19 nt, Shigella flexneri 2a str. 2457T
acugggaagaauggaaaaa

SEQ ID NO: 3867868 - RNA, 20 nt, Shigella flexneri 2a str. 2457T
acugggaagaauggaaaaaa

SEQ ID NO: 3867869 - RNA, 15 nt, Shigella flexneri 2a str. 2457T
acugggaugaaagug

SEQ ID NO: 3867870 - RNA, 16 nt, Shigella flexneri 2a str. 2457T
acugggccgccuguuu

SEQ ID NO: 3867871 - RNA, 16 nt, Shigella flexneri 2a str. 2457T
acuggggcuggcggca

SEQ ID NO: 3867872 - RNA, 22 nt, Shigella flexneri 2a str. 2457T
acuggguuggguucacuuuccc

SEQ ID NO: 3867873 - RNA, 13 nt, Shigella flexneri 2a str. 2457T
acugguagugcag

SEQ ID NO: 3867874 - RNA, 21 nt, Shigella flexneri 2a str. 2457T
acuggucaucaaauuacgaua

SEQ ID NO: 3867875 - RNA, 15 nt, Shigella flexneri 2a str. 2457T
acugguccagccccu

SEQ ID NO: 3867876 - RNA, 23 nt, Shigella flexneri 2a str. 2457T
acuggugacuuuugcccggcaug

SEQ ID NO: 3867877 - RNA, 13 nt, Shigella flexneri 2a str. 2457T
acuggugccauga

SEQ ID NO: 3867878 - RNA, 17 nt, Shigella flexneri 2a str. 2457T
acugguggcaggaaaac

SEQ ID NO: 3867879 - RNA, 15 nt, Shigella flexneri 2a str. 2457T
acuguaaaucgccau

SEQ ID NO: 3867880 - RNA, 13 nt, Shigella flexneri 2a str. 2457T
acuguaccagcaa

SEQ ID NO: 3867881 - RNA, 16 nt, Shigella flexneri 2a str. 2457T
acuguagacaaaaugu

SEQ ID NO: 3867882 - RNA, 21 nt, Shigella flexneri 2a str. 2457T
acuguauacgggcuuuuuaau

SEQ ID NO: 3867883 - RNA, 14 nt, Shigella flexneri 2a str. 2457T
acugucccauccac

SEQ ID NO: 3867884 - RNA, 14 nt, Shigella flexneri 2a str. 2457T
acugucgcgcagca

SEQ ID NO: 3867885 - RNA, 16 nt, Shigella flexneri 2a str. 2457T
acugucuaauggugaa

SEQ ID NO: 3867886 - RNA, 22 nt, Shigella flexneri 2a str. 2457T
acugucugcucggaaauauuca

SEQ ID NO: 3867887 - RNA, 21 nt, Shigella flexneri 2a str. 2457T
acugugcacccgcuucaguga

SEQ ID NO: 3867888 - RNA, 22 nt, Shigella flexneri 2a str. 2457T
acugugcacccgcuucagugac

SEQ ID NO: 3867889 - RNA, 20 nt, Shigella flexneri 2a str. 2457T
acugugcagguggaauaucc

SEQ ID NO: 3867890 - RNA, 13 nt, Shigella flexneri 2a str. 2457T
acuguggcaucgg

SEQ ID NO: 3867891 - RNA, 16 nt, Shigella flexneri 2a str. 2457T
acuguggcgcgaccaa

SEQ ID NO: 3867892 - RNA, 18 nt, Shigella flexneri 2a str. 2457T
acugugggauugcuucag

SEQ ID NO: 3867893 - RNA, 16 nt, Shigella flexneri 2a str. 2457T
acuguuacugucggca

SEQ ID NO: 3867894 - RNA, 20 nt, Shigella flexneri 2a str. 2457T
acuguuucaccauuugugca

SEQ ID NO: 3867895 - RNA, 13 nt, Shigella flexneri 2a str. 2457T
acuguuucacugu

SEQ ID NO: 3867896 - RNA, 21 nt, Shigella flexneri 2a str. 2457T
acuguuugacaacucaucacu

SEQ ID NO: 3867897 - RNA, 16 nt, Shigella flexneri 2a str. 2457T
acuguuuucuaacuca

SEQ ID NO: 3867898 - RNA, 18 nt, Shigella flexneri 2a str. 2457T
acuguuuucuaacucauu

SEQ ID NO: 3867899 - RNA, 21 nt, Shigella flexneri 2a str. 2457T
acuuaaauccguuaugucucc

SEQ ID NO: 3867900 - RNA, 15 nt, Shigella flexneri 2a str. 2457T
acuuaacaggaucug

SEQ ID NO: 3867901 - RNA, 22 nt, Shigella flexneri 2a str. 2457T
acuuaaccccagaccaaucccg

SEQ ID NO: 3867902 - RNA, 12 nt, Shigella flexneri 2a str. 2457T
acuuaagucucc

SEQ ID NO: 3867903 - RNA, 21 nt, Shigella flexneri 2a str. 2457T
acuuaauccugaguuaagcaa

SEQ ID NO: 3867904 - RNA, 16 nt, Shigella flexneri 2a str. 2457T
acuuaauuauuaacaa

SEQ ID NO: 3867905 - RNA, 12 nt, Shigella flexneri 2a str. 2457T
acuuacacauca

SEQ ID NO: 3867906 - RNA, 21 nt, Shigella flexneri 2a str. 2457T
acuuacaucugucugauaaaa

SEQ ID NO: 3867907 - RNA, 14 nt, Shigella flexneri 2a str. 2457T
acuuaccuucacga

SEQ ID NO: 3867908 - RNA, 17 nt, Shigella flexneri 2a str. 2457T
acuuacucauuaaugca

SEQ ID NO: 3867909 - RNA, 18 nt, Shigella flexneri 2a str. 2457T
acuuacugauaguguuuu

SEQ ID NO: 3867910 - RNA, 20 nt, Shigella flexneri 2a str. 2457T
acuuacugauaguguuuuau

SEQ ID NO: 3867911 - RNA, 14 nt, Shigella flexneri 2a str. 2457T
acuuacuucagcaa

SEQ ID NO: 3867912 - RNA, 13 nt, Shigella flexneri 2a str. 2457T
acuuacuuuccuu

SEQ ID NO: 3867913 - RNA, 18 nt, Shigella flexneri 2a str. 2457T
acuuauaagucucagaaa

SEQ ID NO: 3867914 - RNA, 19 nt, Shigella flexneri 2a str. 2457T
acuuauuaaaauugcauga

SEQ ID NO: 3867915 - RNA, 20 nt, Shigella flexneri 2a str. 2457T
acuuauucaaucucuucaca

SEQ ID NO: 3867916 - RNA, 14 nt, Shigella flexneri 2a str. 2457T
acuucaaucgccac

SEQ ID NO: 3867917 - RNA, 17 nt, Shigella flexneri 2a str. 2457T
acuucaaucgccaccac

SEQ ID NO: 3867918 - RNA, 22 nt, Shigella flexneri 2a str. 2457T
acuucacaaucagcgcgauaaa

SEQ ID NO: 3867919 - RNA, 12 nt, Shigella flexneri 2a str. 2457T
acuucacacacu

SEQ ID NO: 3867920 - RNA, 16 nt, Shigella flexneri 2a str. 2457T
acuucacaucaccaua

SEQ ID NO: 3867921 - RNA, 17 nt, Shigella flexneri 2a str. 2457T
acuucacccaucgccag

SEQ ID NO: 3867922 - RNA, 20 nt, Shigella flexneri 2a str. 2457T
acuucacggcugcuaauauu

SEQ ID NO: 3867923 - RNA, 23 nt, Shigella flexneri 2a str. 2457T
acuucacggcugcuaauauuuuc

SEQ ID NO: 3867924 - RNA, 13 nt, Shigella flexneri 2a str. 2457T
acuucacuucuuc

SEQ ID NO: 3867925 - RNA, 16 nt, Shigella flexneri 2a str. 2457T
acuucagacggucagc

SEQ ID NO: 3867926 - RNA, 21 nt, Shigella flexneri 2a str. 2457T
acuucagcaagcgauaauuua

SEQ ID NO: 3867927 - RNA, 16 nt, Shigella flexneri 2a str. 2457T
acuucauaugcgccag

SEQ ID NO: 3867928 - RNA, 22 nt, Shigella flexneri 2a str. 2457T
acuucaucacuaccuucuuccc

SEQ ID NO: 3867929 - RNA, 23 nt, Shigella flexneri 2a str. 2457T
acuucaucgcccacguuuacugc

SEQ ID NO: 3867930 - RNA, 19 nt, Shigella flexneri 2a str. 2457T
acuucaucggaaugcaccg

SEQ ID NO: 3867931 - RNA, 23 nt, Shigella flexneri 2a str. 2457T
acuucaucggcggugaccagcag

SEQ ID NO: 3867932 - RNA, 14 nt, Shigella flexneri 2a str. 2457T
acuuccaccacuuc

SEQ ID NO: 3867933 - RNA, 18 nt, Shigella flexneri 2a str. 2457T
acuuccaccacuuccugc

SEQ ID NO: 3867934 - RNA, 20 nt, Shigella flexneri 2a str. 2457T
acuuccagcagaccagcaau

SEQ ID NO: 3867935 - RNA, 23 nt, Shigella flexneri 2a str. 2457T
acuuccagcguagugaaggcaaa

SEQ ID NO: 3867936 - RNA, 21 nt, Shigella flexneri 2a str. 2457T
acuucccagccuucgcgcaac

SEQ ID NO: 3867937 - RNA, 13 nt, Shigella flexneri 2a str. 2457T
acuuccccucugc

SEQ ID NO: 3867938 - RNA, 15 nt, Shigella flexneri 2a str. 2457T
acuucccgcauccag

SEQ ID NO: 3867939 - RNA, 21 nt, Shigella flexneri 2a str. 2457T
acuucccucccguuucccugu

SEQ ID NO: 3867940 - RNA, 22 nt, Shigella flexneri 2a str. 2457T
acuuccgacagaauauaaguca

SEQ ID NO: 3867941 - RNA, 18 nt, Shigella flexneri 2a str. 2457T
acuuccgcgucaaucugc

SEQ ID NO: 3867942 - RNA, 20 nt, Shigella flexneri 2a str. 2457T
acuuccgcgucaaucugccc

SEQ ID NO: 3867943 - RNA, 20 nt, Shigella flexneri 2a str. 2457T
acuuccggacguucagccau

SEQ ID NO: 3867944 - RNA, 21 nt, Shigella flexneri 2a str. 2457T
acuuccgggauuucccggcac

SEQ ID NO: 3867945 - RNA, 18 nt, Shigella flexneri 2a str. 2457T
acuuccguaccagccuug

SEQ ID NO: 3867946 - RNA, 20 nt, Shigella flexneri 2a str. 2457T
acuuccugagugaauauuua

SEQ ID NO: 3867947 - RNA, 21 nt, Shigella flexneri 2a str. 2457T
acuuccugcggagcaaccugc

SEQ ID NO: 3867948 - RNA, 18 nt, Shigella flexneri 2a str. 2457T
agaaagccggaugaucau

SEQ ID NO: 3867949 - RNA, 16 nt, Shigella flexneri 2a str. 2457T
agaaagcgccagcaag

SEQ ID NO: 3867950 - RNA, 17 nt, Shigella flexneri 2a str. 2457T
agaaagcgccagcaaga

SEQ ID NO: 3867951 - RNA, 14 nt, Shigella flexneri 2a str. 2457T
agaaagggaagaac

SEQ ID NO: 3867952 - RNA, 15 nt, Shigella flexneri 2a str. 2457T
agaaagggaagaaca

SEQ ID NO: 3867953 - RNA, 22 nt, Shigella flexneri 2a str. 2457T
agaaaguaacaauagcgaacag

SEQ ID NO: 3867954 - RNA, 16 nt, Shigella flexneri 2a str. 2457T
agaaaguaaucuauau

SEQ ID NO: 3867955 - RNA, 21 nt, Shigella flexneri 2a str. 2457T
agaaaguauauaaaaaacaau

SEQ ID NO: 3867956 - RNA, 23 nt, Shigella flexneri 2a str. 2457T
agaaaguauauaaaaaacaauau

SEQ ID NO: 3867957 - RNA, 20 nt, Shigella flexneri 2a str. 2457T
agaaaguugccagauaaaua

SEQ ID NO: 3867958 - RNA, 22 nt, Shigella flexneri 2a str. 2457T
agaaaguugccagauaaauauu

SEQ ID NO: 3867959 - RNA, 13 nt, Shigella flexneri 2a str. 2457T
agaaaguuguuuu

SEQ ID NO: 3867960 - RNA, 14 nt, Shigella flexneri 2a str. 2457T
agaaaguuuuucaa

SEQ ID NO: 3867961 - RNA, 15 nt, Shigella flexneri 2a str. 2457T
agaaaguuuuucaac

SEQ ID NO: 3867962 - RNA, 14 nt, Shigella flexneri 2a str. 2457T
agaaauaccacccg

SEQ ID NO: 3867963 - RNA, 23 nt, Shigella flexneri 2a str. 2457T
agaaauaccacccgucgggcaga

SEQ ID NO: 3867964 - RNA, 18 nt, Shigella flexneri 2a str. 2457T
agaaauacuggcuaagaa

SEQ ID NO: 3867965 - RNA, 18 nt, Shigella flexneri 2a str. 2457T
agaaaucaguaaauugca

SEQ ID NO: 3867966 - RNA, 15 nt, Shigella flexneri 2a str. 2457T
agaaauccacaaauu

SEQ ID NO: 3867967 - RNA, 16 nt, Shigella flexneri 2a str. 2457T
agaaaugaaaaaauag

SEQ ID NO: 3867968 - RNA, 17 nt, Shigella flexneri 2a str. 2457T
agaaauggcccaaaagg

SEQ ID NO: 3867969 - RNA, 15 nt, Shigella flexneri 2a str. 2457T
agaaaugguaaagaa

SEQ ID NO: 3867970 - RNA, 13 nt, Shigella flexneri 2a str. 2457T
agaaauuauuucu

SEQ ID NO: 3867971 - RNA, 15 nt, Shigella flexneri 2a str. 2457T
agaaauuauuucuuu

SEQ ID NO: 3867972 - RNA, 20 nt, Shigella flexneri 2a str. 2457T
agaaauugucuccaccaaug

SEQ ID NO: 3867973 - RNA, 21 nt, Shigella flexneri 2a str. 2457T
agaaauugucuccaccaauga

SEQ ID NO: 3867974 - RNA, 19 nt, Shigella flexneri 2a str. 2457T
agaaauuuggcuccucuga

SEQ ID NO: 3867975 - RNA, 16 nt, Shigella flexneri 2a str. 2457T
agaacaauaauaacuc

SEQ ID NO: 3867976 - RNA, 12 nt, Shigella flexneri 2a str. 2457T
agaacaccaccu

SEQ ID NO: 3867977 - RNA, 19 nt, Shigella flexneri 2a str. 2457T
agaacacgcucccagcaga

SEQ ID NO: 3867978 - RNA, 21 nt, Shigella flexneri 2a str. 2457T
agaacacgcucccagcagaga

SEQ ID NO: 3867979 - RNA, 15 nt, Shigella flexneri 2a str. 2457T
agaacacgguaauga

SEQ ID NO: 3867980 - RNA, 18 nt, Shigella flexneri 2a str. 2457T
agaacacgguaaugacuc

SEQ ID NO: 3867981 - RNA, 13 nt, Shigella flexneri 2a str. 2457T
agaacagaacauc

SEQ ID NO: 3867982 - RNA, 17 nt, Shigella flexneri 2a str. 2457T
agaacagcggugcaaga

SEQ ID NO: 3867983 - RNA, 15 nt, Shigella flexneri 2a str. 2457T
agaacauaaacagcg

SEQ ID NO: 3867984 - RNA, 13 nt, Shigella flexneri 2a str. 2457T
agaaccacaauga

SEQ ID NO: 3867985 - RNA, 21 nt, Shigella flexneri 2a str. 2457T
agaaccacaaugaagaaagua

SEQ ID NO: 3867986 - RNA, 21 nt, Shigella flexneri 2a str. 2457T
agaaccagggaaaaaagcccc

SEQ ID NO: 3867987 - RNA, 21 nt, Shigella flexneri 2a str. 2457T
agaaccaugcaauuaccgcca

SEQ ID NO: 3867988 - RNA, 16 nt, Shigella flexneri 2a str. 2457T
agaaccguaaacagau

SEQ ID NO: 3867989 - RNA, 13 nt, Shigella flexneri 2a str. 2457T
agaaccucaacag

SEQ ID NO: 3867990 - RNA, 18 nt, Shigella flexneri 2a str. 2457T
agaacgaccaucagcugc

SEQ ID NO: 3867991 - RNA, 19 nt, Shigella flexneri 2a str. 2457T
agaacgaccaucagcugcc

SEQ ID NO: 3867992 - RNA, 20 nt, Shigella flexneri 2a str. 2457T
agaacgcgccuuaaaaacca

SEQ ID NO: 3867993 - RNA, 16 nt, Shigella flexneri 2a str. 2457T
agaacggauucaguga

SEQ ID NO: 3867994 - RNA, 22 nt, Shigella flexneri 2a str. 2457T
agaacggcgcaccagaauaccu

SEQ ID NO: 3867995 - RNA, 21 nt, Shigella flexneri 2a str. 2457T
agaacgguucuugaaaaucaa

SEQ ID NO: 3867996 - RNA, 16 nt, Shigella flexneri 2a str. 2457T
agaacguaaacgcagc

SEQ ID NO: 3867997 - RNA, 14 nt, Shigella flexneri 2a str. 2457T
agaacgugccggga

SEQ ID NO: 3867998 - RNA, 19 nt, Shigella flexneri 2a str. 2457T
agaacuaaaagauggcggc

SEQ ID NO: 3867999 - RNA, 16 nt, Shigella flexneri 2a str. 2457T
agaacuccagcccgga

SEQ ID NO: 3868000 - RNA, 18 nt, Shigella flexneri 2a str. 2457T
agaacuccugaaagcgaa

SEQ ID NO: 3868001 - RNA, 21 nt, Shigella flexneri 2a str. 2457T
agaacugagcgccgucgcgaa

SEQ ID NO: 3868002 - RNA, 20 nt, Shigella flexneri 2a str. 2457T
agaacugauaacgcauuuca

SEQ ID NO: 3868003 - RNA, 15 nt, Shigella flexneri 2a str. 2457T
agaacugcgccagac

SEQ ID NO: 3868004 - RNA, 13 nt, Shigella flexneri 2a str. 2457T
agaacugcuggaa

SEQ ID NO: 3868005 - RNA, 14 nt, Shigella flexneri 2a str. 2457T
agaacuucugcaac

SEQ ID NO: 3868006 - RNA, 22 nt, Shigella flexneri 2a str. 2457T
agaacuugacucgccugaaagu

SEQ ID NO: 3868007 - RNA, 14 nt, Shigella flexneri 2a str. 2457T
agaagaaagccgga

SEQ ID NO: 3868008 - RNA, 15 nt, Shigella flexneri 2a str. 2457T
agaagagagauaauu

SEQ ID NO: 3868009 - RNA, 20 nt, Shigella flexneri 2a str. 2457T
agaagauuuuuugccagcac

SEQ ID NO: 3868010 - RNA, 12 nt, Shigella flexneri 2a str. 2457T
agaagcaaucau

SEQ ID NO: 3868011 - RNA, 13 nt, Shigella flexneri 2a str. 2457T
agaagcagcaaca

SEQ ID NO: 3868012 - RNA, 13 nt, Shigella flexneri 2a str. 2457T
agaagcauuuuac

SEQ ID NO: 3868013 - RNA, 23 nt, Shigella flexneri 2a str. 2457T
agaagccaccgcgccacgaccua

SEQ ID NO: 3868014 - RNA, 19 nt, Shigella flexneri 2a str. 2457T
agaagccauuaaacaccag

SEQ ID NO: 3868015 - RNA, 22 nt, Shigella flexneri 2a str. 2457T
agaagccauuaaacaccaguac

SEQ ID NO: 3868016 - RNA, 15 nt, Shigella flexneri 2a str. 2457T
agaagcccauacccg

SEQ ID NO: 3868017 - RNA, 15 nt, Shigella flexneri 2a str. 2457T
agaagcggaaaucac

SEQ ID NO: 3868018 - RNA, 16 nt, Shigella flexneri 2a str. 2457T
agaagcggaaaucacg

SEQ ID NO: 3868019 - RNA, 12 nt, Shigella flexneri 2a str. 2457T
agaagcuggcga

SEQ ID NO: 3868020 - RNA, 12 nt, Shigella flexneri 2a str. 2457T
agaagcuuaccg

SEQ ID NO: 3868021 - RNA, 14 nt, Shigella flexneri 2a str. 2457T
agaagcuuuccauc

SEQ ID NO: 3868022 - RNA, 14 nt, Shigella flexneri 2a str. 2457T
agaaggaaaauaca

SEQ ID NO: 3868023 - RNA, 23 nt, Shigella flexneri 2a str. 2457T
agaaggcauaacuccccgagaaa

SEQ ID NO: 3868024 - RNA, 15 nt, Shigella flexneri 2a str. 2457T
agaaggcgcugacgu

SEQ ID NO: 3868025 - RNA, 13 nt, Shigella flexneri 2a str. 2457T
agaagguugccau

SEQ ID NO: 3868026 - RNA, 16 nt, Shigella flexneri 2a str. 2457T
agaauaaaacaggcag

SEQ ID NO: 3868027 - RNA, 14 nt, Shigella flexneri 2a str. 2457T
agaauagacaaaaa

SEQ ID NO: 3868028 - RNA, 19 nt, Shigella flexneri 2a str. 2457T
agaauaguuugauuaacgc

SEQ ID NO: 3868029 - RNA, 23 nt, Shigella flexneri 2a str. 2457T
agaauauacggaaugauauuggu

SEQ ID NO: 3868030 - RNA, 19 nt, Shigella flexneri 2a str. 2457T
agaauaugcgccagcguua

SEQ ID NO: 3868031 - RNA, 14 nt, Shigella flexneri 2a str. 2457T
agaauaugcuuugc

SEQ ID NO: 3868032 - RNA, 19 nt, Shigella flexneri 2a str. 2457T
agaaucaaucccaucaggc

SEQ ID NO: 3868033 - RNA, 19 nt, Shigella flexneri 2a str. 2457T
agaaucaaucucagcgaug

SEQ ID NO: 3868034 - RNA, 13 nt, Shigella flexneri 2a str. 2457T
agaaucaccucuu

SEQ ID NO: 3868035 - RNA, 14 nt, Shigella flexneri 2a str. 2457T
agaaucacgccaac

SEQ ID NO: 3868036 - RNA, 19 nt, Shigella flexneri 2a str. 2457T
agaaucaggccauuacuac

SEQ ID NO: 3868037 - RNA, 16 nt, Shigella flexneri 2a str. 2457T
agaaucauaaauacaa

SEQ ID NO: 3868038 - RNA, 16 nt, Shigella flexneri 2a str. 2457T
agaaucaugccaaaaa

SEQ ID NO: 3868039 - RNA, 13 nt, Shigella flexneri 2a str. 2457T
agaaucgguccac

SEQ ID NO: 3868040 - RNA, 17 nt, Shigella flexneri 2a str. 2457T
agaaucguaaagaucug

SEQ ID NO: 3868041 - RNA, 14 nt, Shigella flexneri 2a str. 2457T
agaaucucugacag

SEQ ID NO: 3868042 - RNA, 13 nt, Shigella flexneri 2a str. 2457T
agaaugacgccau

SEQ ID NO: 3868043 - RNA, 22 nt, Shigella flexneri 2a str. 2457T
agaaugaugccgccagaaaugg

SEQ ID NO: 3868044 - RNA, 23 nt, Shigella flexneri 2a str. 2457T
agaaugcgcaacgccguaaguaa

SEQ ID NO: 3868045 - RNA, 21 nt, Shigella flexneri 2a str. 2457T
agaaugcgggcgaaaacaucg

SEQ ID NO: 3868046 - RNA, 19 nt, Shigella flexneri 2a str. 2457T
agagguuauaaauaaaaau

SEQ ID NO: 3868047 - RNA, 20 nt, Shigella flexneri 2a str. 2457T
agaguaaagcccgccaucgc

SEQ ID NO: 3868048 - RNA, 15 nt, Shigella flexneri 2a str. 2457T
agaguacugccggga

SEQ ID NO: 3868049 - RNA, 14 nt, Shigella flexneri 2a str. 2457T
agaguaguaauugc

SEQ ID NO: 3868050 - RNA, 17 nt, Shigella flexneri 2a str. 2457T
agaguauccaugcgcau

SEQ ID NO: 3868051 - RNA, 20 nt, Shigella flexneri 2a str. 2457T
agaguaugcgcgucagagau

SEQ ID NO: 3868052 - RNA, 20 nt, Shigella flexneri 2a str. 2457T
agagucaugcguuugagugg

SEQ ID NO: 3868053 - RNA, 18 nt, Shigella flexneri 2a str. 2457T
agagugacgacgcugacg

SEQ ID NO: 3868054 - RNA, 20 nt, Shigella flexneri 2a str. 2457T
agagugacuucgccgugaaa

SEQ ID NO: 3868055 - RNA, 15 nt, Shigella flexneri 2a str. 2457T
agagugauucuuugu

SEQ ID NO: 3868056 - RNA, 20 nt, Shigella flexneri 2a str. 2457T
agagugccgaagaacauaaa

SEQ ID NO: 3868057 - RNA, 13 nt, Shigella flexneri 2a str. 2457T
agaguuauuucau

SEQ ID NO: 3868058 - RNA, 16 nt, Shigella flexneri 2a str. 2457T
agaguucaaagccgaa

SEQ ID NO: 3868059 - RNA, 16 nt, Shigella flexneri 2a str. 2457T
agaguuccaacgcagc

SEQ ID NO: 3868060 - RNA, 23 nt, Shigella flexneri 2a str. 2457T
agaguucugcgcaucggcgucgu

SEQ ID NO: 3868061 - RNA, 14 nt, Shigella flexneri 2a str. 2457T
agaguugagcaguc

SEQ ID NO: 3868062 - RNA, 16 nt, Shigella flexneri 2a str. 2457T
agaguugcaccagcaa

SEQ ID NO: 3868063 - RNA, 18 nt, Shigella flexneri 2a str. 2457T
agaguuucaacaucaucu

SEQ ID NO: 3868064 - RNA, 13 nt, Shigella flexneri 2a str. 2457T
agauaaaaaguuu
